United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 102

SEQ ID NO: 4317760 - DNA, 13 bp, Homo sapiens
ctgcctaaggact

SEQ ID NO: 4317761 - DNA, 20 bp, Homo sapiens
ctgcctaaggacttctttaa

SEQ ID NO: 4317762 - DNA, 21 bp, Homo sapiens
ctgcctaaggacttctttaat

SEQ ID NO: 4317763 - DNA, 12 bp, Homo sapiens
ctgctttcagat

SEQ ID NO: 4317764 - DNA, 16 bp, Homo sapiens
ctgctttcagatactg

SEQ ID NO: 4317765 - DNA, 21 bp, Homo sapiens
ctgctttcagatactggattg

SEQ ID NO: 4317766 - DNA, 14 bp, Homo sapiens
ctggggttatctga

SEQ ID NO: 4317767 - DNA, 15 bp, Homo sapiens
ctggtgactgattct

SEQ ID NO: 4317768 - DNA, 17 bp, Homo sapiens
ctggtgactgattcttc

SEQ ID NO: 4317769 - DNA, 21 bp, Homo sapiens
ctggtgccctgctttcagata

SEQ ID NO: 4317770 - DNA, 15 bp, Homo sapiens
ctggtgtatgtgtga

SEQ ID NO: 4317771 - DNA, 15 bp, Homo sapiens
ctgtatagattagag

SEQ ID NO: 4317772 - DNA, 18 bp, Homo sapiens
ctgtgaacttgaaatttg

SEQ ID NO: 4317773 - DNA, 17 bp, Homo sapiens
ctgtggtgactttggat

SEQ ID NO: 4317774 - DNA, 14 bp, Homo sapiens
cttaaagttgaatt

SEQ ID NO: 4317775 - DNA, 18 bp, Homo sapiens
cttaaagttgaatttatt

SEQ ID NO: 4317776 - DNA, 16 bp, Homo sapiens
cttctttaattttgga

SEQ ID NO: 4317777 - DNA, 17 bp, Homo sapiens
cttctttaattttggaa

SEQ ID NO: 4317778 - DNA, 14 bp, Homo sapiens
cttgcctttttcat

SEQ ID NO: 4317779 - DNA, 22 bp, Homo sapiens
cttgcctttttcattattttat

SEQ ID NO: 4317780 - DNA, 14 bp, Homo sapiens
cttgtctcagattt

SEQ ID NO: 4317781 - DNA, 17 bp, Homo sapiens
cttgtctcagattttat

SEQ ID NO: 4317782 - DNA, 14 bp, Homo sapiens
ctttaattttggaa

SEQ ID NO: 4317783 - DNA, 22 bp, Homo sapiens
ctttcagatactggattgtact

SEQ ID NO: 4317784 - DNA, 11 bp, Homo sapiens
ctttgtataga

SEQ ID NO: 4317785 - DNA, 15 bp, Homo sapiens
cttttctgatccagt

SEQ ID NO: 4317786 - DNA, 19 bp, Homo sapiens
gaaaagtttaatattaaag

SEQ ID NO: 4317787 - DNA, 22 bp, Homo sapiens
gaaaagtttaatattaaagcca

SEQ ID NO: 4317788 - DNA, 20 bp, Homo sapiens
gaaacttgtgtaaatacaat

SEQ ID NO: 4317789 - DNA, 12 bp, Homo sapiens
gaaatctttaaa

SEQ ID NO: 4317790 - DNA, 13 bp, Homo sapiens
gaaatttgaattt

SEQ ID NO: 4317791 - DNA, 24 bp, Homo sapiens
gaaatttgaattttgtgttagaga

SEQ ID NO: 4317792 - DNA, 15 bp, Homo sapiens
gaacttgaaatttga

SEQ ID NO: 4317793 - DNA, 22 bp, Homo sapiens
gaagtcagatctgcctaaggac

SEQ ID NO: 4317794 - DNA, 21 bp, Homo sapiens
gaatggctttgtatagaacct

SEQ ID NO: 4317795 - DNA, 14 bp, Homo sapiens
gaattctgtataga

SEQ ID NO: 4317796 - DNA, 21 bp, Homo sapiens
gaattctgtatagattagaat

SEQ ID NO: 4317797 - DNA, 14 bp, Homo sapiens
gaatttattggctt

SEQ ID NO: 4317798 - DNA, 13 bp, Homo sapiens
gactgattcttca

SEQ ID NO: 4317799 - DNA, 12 bp, Homo sapiens
gactggtgactg

SEQ ID NO: 4317800 - DNA, 13 bp, Homo sapiens
gactgtggtgact

SEQ ID NO: 4317801 - DNA, 23 bp, Homo sapiens
gagcctgcacggtgaatggcttt

SEQ ID NO: 4317802 - DNA, 18 bp, Homo sapiens
gaggaagcctgattaaag

SEQ ID NO: 4317803 - DNA, 21 bp, Homo sapiens
gataataaggaaaagtttaat

SEQ ID NO: 4317804 - DNA, 22 bp, Homo sapiens
gataataaggaaaagtttaata

SEQ ID NO: 4317805 - DNA, 16 bp, Homo sapiens
gatactggattgtact

SEQ ID NO: 4317806 - DNA, 15 bp, Homo sapiens
gatctgcctaaggac

SEQ ID NO: 4317807 - DNA, 16 bp, Homo sapiens
gatctgcctaaggact

SEQ ID NO: 4317808 - DNA, 21 bp, Homo sapiens
gatctgcctaaggacttcttt

SEQ ID NO: 4317809 - DNA, 23 bp, Homo sapiens
gatctgcctaaggacttctttaa

SEQ ID NO: 4317810 - DNA, 14 bp, Homo sapiens
gattagaattctgt

SEQ ID NO: 4317811 - DNA, 15 bp, Homo sapiens
gattagaattctgta

SEQ ID NO: 4317812 - DNA, 23 bp, Homo sapiens
gattagaattctgtatagattag

SEQ ID NO: 4317813 - DNA, 22 bp, Homo sapiens
gattattcactgatttgacata

SEQ ID NO: 4317814 - DNA, 13 bp, Homo sapiens
gattttattatgt

SEQ ID NO: 4317815 - DNA, 18 bp, Homo sapiens
gattttattatgtaaatc

SEQ ID NO: 4317816 - DNA, 20 bp, Homo sapiens
gattttattatgtaaatccc

SEQ ID NO: 4317817 - DNA, 13 bp, Homo sapiens
gcataacataaat

SEQ ID NO: 4317818 - DNA, 23 bp, Homo sapiens
gcataacataaatctgtgaactt

SEQ ID NO: 4317819 - DNA, 14 bp, Homo sapiens
gcatatatttttat

SEQ ID NO: 4317820 - DNA, 20 bp, Homo sapiens
gcatatatttttatatttac

SEQ ID NO: 4317821 - DNA, 24 bp, Homo sapiens
gccatcaataaaaaattatgacat

SEQ ID NO: 4317822 - DNA, 11 bp, Homo sapiens
gccatgtttat

SEQ ID NO: 4317823 - DNA, 18 bp, Homo sapiens
gccatgtttattacagta

SEQ ID NO: 4317824 - DNA, 11 bp, Homo sapiens
gcctaaatcca

SEQ ID NO: 4317825 - DNA, 13 bp, Homo sapiens
gcctaaatccatt

SEQ ID NO: 4317826 - DNA, 18 bp, Homo sapiens
gcctaaggacttctttaa

SEQ ID NO: 4317827 - DNA, 20 bp, Homo sapiens
gcctttttcattattttatt

SEQ ID NO: 4317828 - DNA, 22 bp, Homo sapiens
gcctttttcattattttattat

SEQ ID NO: 4317829 - DNA, 22 bp, Homo sapiens
gcgttcatggaacgcgttgaaa

SEQ ID NO: 4317830 - DNA, 12 bp, Homo sapiens
gcgttgaaattg

SEQ ID NO: 4317831 - DNA, 24 bp, Homo sapiens
gcgttgaaattgtaattatatctg

SEQ ID NO: 4317832 - DNA, 13 bp, Homo sapiens
gctaaacttttct

SEQ ID NO: 4317833 - DNA, 15 bp, Homo sapiens
gctaaacttttctga

SEQ ID NO: 4317834 - DNA, 17 bp, Homo sapiens
gctaaacttttctgata

SEQ ID NO: 4317835 - DNA, 13 bp, Homo sapiens
gctagactggtga

SEQ ID NO: 4317836 - DNA, 15 bp, Homo sapiens
gctagactggtgact

SEQ ID NO: 4317837 - DNA, 15 bp, Homo sapiens
gctatttctatattt

SEQ ID NO: 4317838 - DNA, 21 bp, Homo sapiens
gctggtgtatgtgtgaagtga

SEQ ID NO: 4317839 - DNA, 14 bp, Homo sapiens
gctttcagatactg

SEQ ID NO: 4317840 - DNA, 13 bp, Homo sapiens
gctttgtatagaa

SEQ ID NO: 4317841 - DNA, 14 bp, Homo sapiens
ggaaaagtttaata

SEQ ID NO: 4317842 - DNA, 13 bp, Homo sapiens
ggaaatctttaaa

SEQ ID NO: 4317843 - DNA, 15 bp, Homo sapiens
ggaagcctgattaaa

SEQ ID NO: 4317844 - DNA, 16 bp, Homo sapiens
ggaccaaaaaccagta

SEQ ID NO: 4317845 - DNA, 15 bp, Homo sapiens
ggactgtggtgactt

SEQ ID NO: 4317846 - DNA, 21 bp, Homo sapiens
ggactgtggtgactttggata

SEQ ID NO: 4317847 - DNA, 12 bp, Homo sapiens
ggataaatgcca

SEQ ID NO: 4317848 - DNA, 20 bp, Homo sapiens
ggattcttaaagttgaattt

SEQ ID NO: 4317849 - DNA, 12 bp, Homo sapiens
ggcttttctgat

SEQ ID NO: 4317850 - DNA, 17 bp, Homo sapiens
ggtccgtgctaaggact

SEQ ID NO: 4317851 - DNA, 17 bp, Homo sapiens
ggtgaatggctttgtat

SEQ ID NO: 4317852 - DNA, 20 bp, Homo sapiens
ggtgaatggctttgtataga

SEQ ID NO: 4317853 - DNA, 14 bp, Homo sapiens
ggtgactttggata

SEQ ID NO: 4317854 - DNA, 18 bp, Homo sapiens
ggtgactttggataataa

SEQ ID NO: 4317855 - DNA, 20 bp, Homo sapiens
ggtgactttggataataagg

SEQ ID NO: 4317856 - DNA, 16 bp, Homo sapiens
ggtgtatgtgtgaagt

SEQ ID NO: 4317857 - DNA, 19 bp, Homo sapiens
ggtgttgtactcaatttta

SEQ ID NO: 4317858 - DNA, 15 bp, Homo sapiens
gtaaatcccattatt

SEQ ID NO: 4317859 - DNA, 17 bp, Homo sapiens
gtaaatcccattattca

SEQ ID NO: 4317860 - DNA, 19 bp, Homo sapiens
gtaaatcccattattcaaa

SEQ ID NO: 4317861 - DNA, 21 bp, Homo sapiens
gtacaaagtattaagcatata

SEQ ID NO: 4317862 - DNA, 14 bp, Homo sapiens
gtatagattagaat

SEQ ID NO: 4317863 - DNA, 17 bp, Homo sapiens
gtatgtgtgaagtgagt

SEQ ID NO: 4317864 - DNA, 21 bp, Homo sapiens
gtatgtgtgaagtgagtgagt

SEQ ID NO: 4317865 - DNA, 16 bp, Homo sapiens
gtattaagcatatatt

SEQ ID NO: 4317866 - DNA, 17 bp, Homo sapiens
gtattaagcatatattt

SEQ ID NO: 4317867 - DNA, 21 bp, Homo sapiens
gtattaagcatatatttttat

SEQ ID NO: 4317868 - DNA, 23 bp, Homo sapiens
gtattgtacaaagtattaagcat

SEQ ID NO: 4317869 - DNA, 20 bp, Homo sapiens
gtcagatctgcctaaggact

SEQ ID NO: 4317870 - DNA, 16 bp, Homo sapiens
gtccgtgctaaggact

SEQ ID NO: 4317871 - DNA, 14 bp, Homo sapiens
gtctcagattttat

SEQ ID NO: 4317872 - DNA, 17 bp, Homo sapiens
gtctcagattttattat

SEQ ID NO: 4317873 - DNA, 21 bp, Homo sapiens
gtctcagattttattatgtaa

SEQ ID NO: 4317874 - DNA, 15 bp, Homo sapiens
gtcttgtctcagatt

SEQ ID NO: 4317875 - DNA, 20 bp, Homo sapiens
gtcttgtctcagattttatt

SEQ ID NO: 4317876 - DNA, 15 bp, Homo sapiens
gtgaacttgaaattt

SEQ ID NO: 4317877 - DNA, 19 bp, Homo sapiens
gtgaatggctttgtataga

SEQ ID NO: 4317878 - DNA, 15 bp, Homo sapiens
gtggtgactttggat

SEQ ID NO: 4317879 - DNA, 23 bp, Homo sapiens
gtgttgaaacggatgatttctat

SEQ ID NO: 4317880 - DNA, 18 bp, Homo sapiens
gttaaaccatgggataaa

SEQ ID NO: 4317881 - DNA, 13 bp, Homo sapiens
gttacagaagccc

SEQ ID NO: 4317882 - DNA, 23 bp, Homo sapiens
gttcatggaacgcgttgaaattg

SEQ ID NO: 4317883 - DNA, 15 bp, Homo sapiens
gttgaaattgtaatt

SEQ ID NO: 4317884 - DNA, 14 bp, Homo sapiens
gttgcctaaatcca

SEQ ID NO: 4317885 - DNA, 13 bp, Homo sapiens
gtttaatattaaa

SEQ ID NO: 4317886 - DNA, 18 bp, Homo sapiens
gtttaatattaaagccat

SEQ ID NO: 4317887 - DNA, 19 bp, Homo sapiens
gtttaatattaaagccatg

SEQ ID NO: 4317888 - DNA, 10 bp, Homo sapiens
gtttctgtac

SEQ ID NO: 4317889 - DNA, 20 bp, Homo sapiens
gtttctgtactttttggcat

SEQ ID NO: 4317890 - DNA, 13 bp, Homo sapiens
taaacttttctga

SEQ ID NO: 4317891 - DNA, 13 bp, Homo sapiens
taaagccatgttt

SEQ ID NO: 4317892 - DNA, 21 bp, Homo sapiens
taaagttgaatttattggctt

SEQ ID NO: 4317893 - DNA, 17 bp, Homo sapiens
taaataaataaatagct

SEQ ID NO: 4317894 - DNA, 22 bp, Homo sapiens
taaatacaattttgtttctgta

SEQ ID NO: 4317895 - DNA, 18 bp, Homo sapiens
taaatagctagactggtg

SEQ ID NO: 4317896 - DNA, 23 bp, Homo sapiens
taaatagctagactggtgactga

SEQ ID NO: 4317897 - DNA, 14 bp, Homo sapiens
taaatccatttgga

SEQ ID NO: 4317898 - DNA, 16 bp, Homo sapiens
taaatccatttggaaa

SEQ ID NO: 4317899 - DNA, 15 bp, Homo sapiens
taaatctgtgaactt

SEQ ID NO: 4317900 - DNA, 16 bp, Homo sapiens
taacatgttaaaccat

SEQ ID NO: 4317901 - DNA, 13 bp, Homo sapiens
taagcatatattt

SEQ ID NO: 4317902 - DNA, 19 bp, Homo sapiens
taagcatatatttttatat

SEQ ID NO: 4317903 - DNA, 16 bp, Homo sapiens
taaggaaaagtttaat

SEQ ID NO: 4317904 - DNA, 21 bp, Homo sapiens
taaggaaaagtttaatattaa

SEQ ID NO: 4317905 - DNA, 16 bp, Homo sapiens
taaggacttctttaat

SEQ ID NO: 4317906 - DNA, 15 bp, Homo sapiens
taaggacttgttaga

SEQ ID NO: 4317907 - DNA, 16 bp, Homo sapiens
taaggacttgttagat

SEQ ID NO: 4317908 - DNA, 20 bp, Homo sapiens
taataattatatgctatttc

SEQ ID NO: 4317909 - DNA, 22 bp, Homo sapiens
taataattatatgctatttcta

SEQ ID NO: 4317910 - DNA, 23 bp, Homo sapiens
taataattatatgctatttctat

SEQ ID NO: 4317911 - DNA, 12 bp, Homo sapiens
taatattaaagc

SEQ ID NO: 4317912 - DNA, 17 bp, Homo sapiens
taatattaaagccatgt

SEQ ID NO: 4317913 - DNA, 15 bp, Homo sapiens
taattaacatgttaa

SEQ ID NO: 4317914 - DNA, 18 bp, Homo sapiens
taattaacatgttaaacc

SEQ ID NO: 4317915 - DNA, 19 bp, Homo sapiens
taattatatctgaggaatt

SEQ ID NO: 4317916 - DNA, 18 bp, Homo sapiens
taattatatgctatttct

SEQ ID NO: 4317917 - DNA, 21 bp, Homo sapiens
taattatatgctatttctata

SEQ ID NO: 4317918 - DNA, 21 bp, Homo sapiens
tacaattttgtttctgtactt

SEQ ID NO: 4317919 - DNA, 16 bp, Homo sapiens
tacagtataattaaca

SEQ ID NO: 4317920 - DNA, 17 bp, Homo sapiens
tacagtataattaacat

SEQ ID NO: 4317921 - DNA, 19 bp, Homo sapiens
tacagtataattaacatgt

SEQ ID NO: 4317922 - DNA, 21 bp, Homo sapiens
tagactggtgactgattcttc

SEQ ID NO: 4317923 - DNA, 15 bp, Homo sapiens
tagagagtgttgaaa

SEQ ID NO: 4317924 - DNA, 23 bp, Homo sapiens
tagagatttttttgttgtttgtt

SEQ ID NO: 4317925 - DNA, 13 bp, Homo sapiens
tataattaacatg

SEQ ID NO: 4317926 - DNA, 16 bp, Homo sapiens
tataattaacatgtta

SEQ ID NO: 4317927 - DNA, 20 bp, Homo sapiens
tatagaacctctttgtctac

SEQ ID NO: 4317928 - DNA, 18 bp, Homo sapiens
tatagattagaattctgt

SEQ ID NO: 4317929 - DNA, 20 bp, Homo sapiens
tatatctgaggaattctgta

SEQ ID NO: 4317930 - DNA, 22 bp, Homo sapiens
tatatctgaggaattctgtata

SEQ ID NO: 4317931 - DNA, 17 bp, Homo sapiens
tatctgaagtcagatct

SEQ ID NO: 4317932 - DNA, 18 bp, Homo sapiens
tatctgaagtcagatctg

SEQ ID NO: 4317933 - DNA, 17 bp, Homo sapiens
tatctgaggaattctgt

SEQ ID NO: 4317934 - DNA, 11 bp, Homo sapiens
tatgatccagc

SEQ ID NO: 4317935 - DNA, 16 bp, Homo sapiens
tatgctatttctatat

SEQ ID NO: 4317936 - DNA, 15 bp, Homo sapiens
tatgctgagtttgtg

SEQ ID NO: 4317937 - DNA, 12 bp, Homo sapiens
tatgtaaatccc

SEQ ID NO: 4317938 - DNA, 15 bp, Homo sapiens
tatgtaaatcccatt

SEQ ID NO: 4317939 - DNA, 19 bp, Homo sapiens
tatgtaaatcccattattc

SEQ ID NO: 4317940 - DNA, 20 bp, Homo sapiens
tatgtaaatcccattattca

SEQ ID NO: 4317941 - DNA, 23 bp, Homo sapiens
tatgtaaatcccattattcaaag

SEQ ID NO: 4317942 - DNA, 12 bp, Homo sapiens
tatgtgtgaagt

SEQ ID NO: 4317943 - DNA, 17 bp, Homo sapiens
tattaaagccatgttta

SEQ ID NO: 4317944 - DNA, 20 bp, Homo sapiens
tattaaagccatgtttatta

SEQ ID NO: 4317945 - DNA, 16 bp, Homo sapiens
tattaagcatatattt

SEQ ID NO: 4317946 - DNA, 21 bp, Homo sapiens
tattacagtataattaacatg

SEQ ID NO: 4317947 - DNA, 12 bp, Homo sapiens
tattatgtaaat

SEQ ID NO: 4317948 - DNA, 22 bp, Homo sapiens
tattatgtaaatcccattattc

SEQ ID NO: 4317949 - DNA, 12 bp, Homo sapiens
tattcaaagttg

SEQ ID NO: 4317950 - DNA, 13 bp, Homo sapiens
tattcaaagttgc

SEQ ID NO: 4317951 - DNA, 18 bp, Homo sapiens
tattcaaagttgcctaaa

SEQ ID NO: 4317952 - DNA, 13 bp, Homo sapiens
tattcactgattt

SEQ ID NO: 4317953 - DNA, 14 bp, Homo sapiens
tattggcttttctg

SEQ ID NO: 4317954 - DNA, 15 bp, Homo sapiens
tattggcttttctga

SEQ ID NO: 4317955 - DNA, 18 bp, Homo sapiens
tattggcttttctgatcc

SEQ ID NO: 4317956 - DNA, 23 bp, Homo sapiens
tattgtgcgctaaacttttctga

SEQ ID NO: 4317957 - DNA, 16 bp, Homo sapiens
tatttctatattttca

SEQ ID NO: 4317958 - DNA, 17 bp, Homo sapiens
tatttctatattttcat

SEQ ID NO: 4317959 - DNA, 18 bp, Homo sapiens
tatttctatattttcatt

SEQ ID NO: 4317960 - DNA, 13 bp, Homo sapiens
tattttattatga

SEQ ID NO: 4317961 - DNA, 15 bp, Homo sapiens
tattttcattctcct

SEQ ID NO: 4317962 - DNA, 15 bp, Homo sapiens
tcaaagttgcctaaa

SEQ ID NO: 4317963 - DNA, 19 bp, Homo sapiens
tcaataaaaaattatgaca

SEQ ID NO: 4317964 - DNA, 13 bp, Homo sapiens
tcaattttaacaa

SEQ ID NO: 4317965 - DNA, 13 bp, Homo sapiens
tcagattttatta

SEQ ID NO: 4317966 - DNA, 23 bp, Homo sapiens
tcagattttattatgtaaatccc

SEQ ID NO: 4317967 - DNA, 16 bp, Homo sapiens
tcattattttattatg

SEQ ID NO: 4317968 - DNA, 18 bp, Homo sapiens
tcattattttattatgaa

SEQ ID NO: 4317969 - DNA, 22 bp, Homo sapiens
tcattattttattatgaaactt

SEQ ID NO: 4317970 - DNA, 14 bp, Homo sapiens
tccagcagattatt

SEQ ID NO: 4317971 - DNA, 19 bp, Homo sapiens
tcccattattcaaagttgc

SEQ ID NO: 4317972 - DNA, 17 bp, Homo sapiens
tccgtgctaaggacttg

SEQ ID NO: 4317973 - DNA, 20 bp, Homo sapiens
tcctatcacctgtcttgcct

SEQ ID NO: 4317974 - DNA, 16 bp, Homo sapiens
tctatattttcattct

SEQ ID NO: 4317975 - DNA, 14 bp, Homo sapiens
tctcagattttatt

SEQ ID NO: 4317976 - DNA, 17 bp, Homo sapiens
tctcagattttattatg

SEQ ID NO: 4317977 - DNA, 23 bp, Homo sapiens
tctcagattttattatgtaaatc

SEQ ID NO: 4317978 - DNA, 19 bp, Homo sapiens
tctccatttaataattata

SEQ ID NO: 4317979 - DNA, 15 bp, Homo sapiens
tctgaagtcagatct

SEQ ID NO: 4317980 - DNA, 14 bp, Homo sapiens
tctgaggaattctg

SEQ ID NO: 4317981 - DNA, 17 bp, Homo sapiens
tctgaggaattctgtat

SEQ ID NO: 4317982 - DNA, 19 bp, Homo sapiens
tctgaggaattctgtatag

SEQ ID NO: 4317983 - DNA, 21 bp, Homo sapiens
tctgatccagttttgtttgga

SEQ ID NO: 4317984 - DNA, 15 bp, Homo sapiens
tctgcctaaggactt

SEQ ID NO: 4317985 - DNA, 23 bp, Homo sapiens
tctgcctaaggacttctttaatt

SEQ ID NO: 4317986 - DNA, 22 bp, Homo sapiens
tcttaaagttgaatttattggc

SEQ ID NO: 4317987 - DNA, 21 bp, Homo sapiens
tcttcagcaaaaatattttat

SEQ ID NO: 4317988 - DNA, 23 bp, Homo sapiens
tcttcagcaaaaatattttatga

SEQ ID NO: 4317989 - DNA, 17 bp, Homo sapiens
tcttgtctcagatttta

SEQ ID NO: 4317990 - DNA, 19 bp, Homo sapiens
tcttgtctcagattttatt

SEQ ID NO: 4317991 - DNA, 16 bp, Homo sapiens
tctttaattttggaat

SEQ ID NO: 4317992 - DNA, 13 bp, Homo sapiens
tgaaattgtaatt

SEQ ID NO: 4317993 - DNA, 14 bp, Homo sapiens
tgaaattgtaatta

SEQ ID NO: 4317994 - DNA, 16 bp, Homo sapiens
tgaaattgtaattata

SEQ ID NO: 4317995 - DNA, 17 bp, Homo sapiens
tgaaatttgaattttgt

SEQ ID NO: 4317996 - DNA, 18 bp, Homo sapiens
tgaacttgaaatttgaat

SEQ ID NO: 4317997 - DNA, 23 bp, Homo sapiens
tgaagtcagatctgcctaaggac

SEQ ID NO: 4317998 - DNA, 15 bp, Homo sapiens
tgaatggctttgtat

SEQ ID NO: 4317999 - DNA, 18 bp, Homo sapiens
tgaatggctttgtataga

SEQ ID NO: 4318000 - DNA, 19 bp, Homo sapiens
tgaatggctttgtatagaa

SEQ ID NO: 4318001 - DNA, 22 bp, Homo sapiens
tgaatggctttgtatagaacct

SEQ ID NO: 4318002 - DNA, 17 bp, Homo sapiens
tgactgattcttcagca

SEQ ID NO: 4318003 - DNA, 14 bp, Homo sapiens
tgactttggataat

SEQ ID NO: 4318004 - DNA, 18 bp, Homo sapiens
tgaggaattctgtataga

SEQ ID NO: 4318005 - DNA, 21 bp, Homo sapiens
tgatccagcagattattcact

SEQ ID NO: 4318006 - DNA, 16 bp, Homo sapiens
tgatttctatgctgag

SEQ ID NO: 4318007 - DNA, 19 bp, Homo sapiens
tgcacggtgaatggctttg

SEQ ID NO: 4318008 - DNA, 16 bp, Homo sapiens
tgccctgctttcagat

SEQ ID NO: 4318009 - DNA, 12 bp, Homo sapiens
tgcctaaggact

SEQ ID NO: 4318010 - DNA, 15 bp, Homo sapiens
tgcctaaggacttct

SEQ ID NO: 4318011 - DNA, 20 bp, Homo sapiens
tgcctaaggacttctttaat

SEQ ID NO: 4318012 - DNA, 23 bp, Homo sapiens
tgcctcacccacccttttttaaa

SEQ ID NO: 4318013 - DNA, 16 bp, Homo sapiens
tgcctttttcattatt

SEQ ID NO: 4318014 - DNA, 21 bp, Homo sapiens
tgcctttttcattattttatt

SEQ ID NO: 4318015 - DNA, 19 bp, Homo sapiens
tgcgctaaacttttctgat

SEQ ID NO: 4318016 - DNA, 12 bp, Homo sapiens
tgctaaggactt

SEQ ID NO: 4318017 - DNA, 13 bp, Homo sapiens
tgctaaggacttg

SEQ ID NO: 4318018 - DNA, 18 bp, Homo sapiens
tgctaaggacttgttaga

SEQ ID NO: 4318019 - DNA, 22 bp, Homo sapiens
tgctatttctatattttcattc

SEQ ID NO: 4318020 - DNA, 20 bp, Homo sapiens
tgctttcagatactggattg

SEQ ID NO: 4318021 - DNA, 14 bp, Homo sapiens
tggaaatctttaaa

SEQ ID NO: 4318022 - DNA, 15 bp, Homo sapiens
tggaacgcgttgaaa

SEQ ID NO: 4318023 - DNA, 17 bp, Homo sapiens
tggaattttcctccttt

SEQ ID NO: 4318024 - DNA, 17 bp, Homo sapiens
tggaccaaaaaccagta

SEQ ID NO: 4318025 - DNA, 19 bp, Homo sapiens
tggactgtggtgactttgg

SEQ ID NO: 4318026 - DNA, 22 bp, Homo sapiens
tggactgtggtgactttggata

SEQ ID NO: 4318027 - DNA, 23 bp, Homo sapiens
tggagcctgcacggtgaatggct

SEQ ID NO: 4318028 - DNA, 20 bp, Homo sapiens
tggataataaggaaaagttt

SEQ ID NO: 4318029 - DNA, 17 bp, Homo sapiens
tggcataacataaatct

SEQ ID NO: 4318030 - DNA, 15 bp, Homo sapiens
tggctgtacccagga

SEQ ID NO: 4318031 - DNA, 14 bp, Homo sapiens
tggctttgtataga

SEQ ID NO: 4318032 - DNA, 22 bp, Homo sapiens
tggctttgtatagaacctcttt

SEQ ID NO: 4318033 - DNA, 12 bp, Homo sapiens
tgggataaatgc

SEQ ID NO: 4318034 - DNA, 13 bp, Homo sapiens
tggggattcttaa

SEQ ID NO: 4318035 - DNA, 17 bp, Homo sapiens
tggtccgtgctaaggac

SEQ ID NO: 4318036 - DNA, 18 bp, Homo sapiens
tggtccgtgctaaggact

SEQ ID NO: 4318037 - DNA, 15 bp, Homo sapiens
tggtgactgattctt

SEQ ID NO: 4318038 - DNA, 19 bp, Homo sapiens
tggtgactgattcttcagc

SEQ ID NO: 4318039 - DNA, 16 bp, Homo sapiens
tggtgactttggataa

SEQ ID NO: 4318040 - DNA, 18 bp, Homo sapiens
tggtgactttggataata

SEQ ID NO: 4318041 - DNA, 19 bp, Homo sapiens
tggtgactttggataataa

SEQ ID NO: 4318042 - DNA, 16 bp, Homo sapiens
tggtgccctgctttca

SEQ ID NO: 4318043 - DNA, 19 bp, Homo sapiens
tggtgccctgctttcagat

SEQ ID NO: 4318044 - DNA, 20 bp, Homo sapiens
tggtgccctgctttcagata

SEQ ID NO: 4318045 - DNA, 15 bp, Homo sapiens
tgtaaatacaatttt

SEQ ID NO: 4318046 - DNA, 21 bp, Homo sapiens
tgtaaatacaattttgtttct

SEQ ID NO: 4318047 - DNA, 13 bp, Homo sapiens
tgtaaatcccatt

SEQ ID NO: 4318048 - DNA, 13 bp, Homo sapiens
tgtaattatatct

SEQ ID NO: 4318049 - DNA, 14 bp, Homo sapiens
tgtaattatatctg

SEQ ID NO: 4318050 - DNA, 20 bp, Homo sapiens
tgtacaaagtattaagcata

SEQ ID NO: 4318051 - DNA, 13 bp, Homo sapiens
tgtactcaatttt

SEQ ID NO: 4318052 - DNA, 17 bp, Homo sapiens
tgtctacaccattatgt

SEQ ID NO: 4318053 - DNA, 22 bp, Homo sapiens
tgtctcagattttattatgtaa

SEQ ID NO: 4318054 - DNA, 16 bp, Homo sapiens
tgtcttgcctttttca

SEQ ID NO: 4318055 - DNA, 21 bp, Homo sapiens
tgtcttgcctttttcattatt

SEQ ID NO: 4318056 - DNA, 14 bp, Homo sapiens
tgtgcgctaaactt

SEQ ID NO: 4318057 - DNA, 19 bp, Homo sapiens
tgtgctggggttatctgaa

SEQ ID NO: 4318058 - DNA, 16 bp, Homo sapiens
tgttaaaccatgggat

SEQ ID NO: 4318059 - DNA, 18 bp, Homo sapiens
tgttaaaccatgggataa

SEQ ID NO: 4318060 - DNA, 21 bp, Homo sapiens
tgttaaaccatgggataaatg

SEQ ID NO: 4318061 - DNA, 22 bp, Homo sapiens
tgttgaaacggatgatttctat

SEQ ID NO: 4318062 - DNA, 23 bp, Homo sapiens
tgttgaaacggatgatttctatg

SEQ ID NO: 4318063 - DNA, 13 bp, Homo sapiens
tgtttagtcttgt

SEQ ID NO: 4318064 - DNA, 20 bp, Homo sapiens
tgtttagtcttgtctcagat

SEQ ID NO: 4318065 - DNA, 23 bp, Homo sapiens
tgtttctgtactttttggcataa

SEQ ID NO: 4318066 - DNA, 12 bp, Homo sapiens
tgtttgtttagt

SEQ ID NO: 4318067 - DNA, 22 bp, Homo sapiens
ttaaaccatgggataaatgcca

SEQ ID NO: 4318068 - DNA, 14 bp, Homo sapiens
ttaaagccatgttt

SEQ ID NO: 4318069 - DNA, 20 bp, Homo sapiens
ttaaagccatgtttattaca

SEQ ID NO: 4318070 - DNA, 13 bp, Homo sapiens
ttaaagttgaatt

SEQ ID NO: 4318071 - DNA, 16 bp, Homo sapiens
ttaaagttgaatttat

SEQ ID NO: 4318072 - DNA, 22 bp, Homo sapiens
ttaaagttgaatttattggctt

SEQ ID NO: 4318073 - DNA, 18 bp, Homo sapiens
ttaacatgttaaaccatg

SEQ ID NO: 4318074 - DNA, 19 bp, Homo sapiens
ttaagcatatatttttata

SEQ ID NO: 4318075 - DNA, 23 bp, Homo sapiens
ttaagcatatatttttatattta

SEQ ID NO: 4318076 - DNA, 20 bp, Homo sapiens
ttaatattaaagccatgttt

SEQ ID NO: 4318077 - DNA, 22 bp, Homo sapiens
ttaatattaaagccatgtttat

SEQ ID NO: 4318078 - DNA, 13 bp, Homo sapiens
ttaattttggaat

SEQ ID NO: 4318079 - DNA, 12 bp, Homo sapiens
ttacagaagccc

SEQ ID NO: 4318080 - DNA, 18 bp, Homo sapiens
ttacagtataattaacat

SEQ ID NO: 4318081 - DNA, 14 bp, Homo sapiens
ttagagagtgttga

SEQ ID NO: 4318082 - DNA, 18 bp, Homo sapiens
ttagagagtgttgaaacg

SEQ ID NO: 4318083 - DNA, 20 bp, Homo sapiens
ttatatctgaggaattctgt

SEQ ID NO: 4318084 - DNA, 18 bp, Homo sapiens
ttatatgctatttctata

SEQ ID NO: 4318085 - DNA, 17 bp, Homo sapiens
ttatctgaagtcagatc

SEQ ID NO: 4318086 - DNA, 21 bp, Homo sapiens
ttatgtaaatcccattattca

SEQ ID NO: 4318087 - DNA, 22 bp, Homo sapiens
ttattatgaaacttgtgtaaat

SEQ ID NO: 4318088 - DNA, 23 bp, Homo sapiens
ttattatgaaacttgtgtaaata

SEQ ID NO: 4318089 - DNA, 16 bp, Homo sapiens
ttattatgtaaatccc

SEQ ID NO: 4318090 - DNA, 22 bp, Homo sapiens
ttattatgtaaatcccattatt

SEQ ID NO: 4318091 - DNA, 12 bp, Homo sapiens
ttattggctttt

SEQ ID NO: 4318092 - DNA, 16 bp, Homo sapiens
ttattggcttttctga

SEQ ID NO: 4318093 - DNA, 14 bp, Homo sapiens
ttattttattatga

SEQ ID NO: 4318094 - DNA, 15 bp, Homo sapiens
ttattttattatgaa

SEQ ID NO: 4318095 - DNA, 11 bp, Homo sapiens
ttcaaagttgc

SEQ ID NO: 4318096 - DNA, 21 bp, Homo sapiens
ttcactctccatttaataatt

SEQ ID NO: 4318097 - DNA, 20 bp, Homo sapiens
ttcagatactggattgtact

SEQ ID NO: 4318098 - DNA, 19 bp, Homo sapiens
ttcagcaaaaatattttat

SEQ ID NO: 4318099 - DNA, 20 bp, Homo sapiens
ttcatggaacgcgttgaaat

SEQ ID NO: 4318100 - DNA, 21 bp, Homo sapiens
ttcatggaacgcgttgaaatt

SEQ ID NO: 4318101 - DNA, 11 bp, Homo sapiens
ttctatatttt

SEQ ID NO: 4318102 - DNA, 17 bp, Homo sapiens
ttctatgctgagtttgt

SEQ ID NO: 4318103 - DNA, 18 bp, Homo sapiens
ttctgtactttttggcat

SEQ ID NO: 4318104 - DNA, 19 bp, Homo sapiens
ttctgtactttttggcata

SEQ ID NO: 4318105 - DNA, 14 bp, Homo sapiens
ttctgtatagatta

SEQ ID NO: 4318106 - DNA, 13 bp, Homo sapiens
ttcttaaagttga

SEQ ID NO: 4318107 - DNA, 17 bp, Homo sapiens
ttctttaattttggaat

SEQ ID NO: 4318108 - DNA, 21 bp, Homo sapiens
ttgaaacggatgatttctatg

SEQ ID NO: 4318109 - DNA, 14 bp, Homo sapiens
ttgaaattgtaatt

SEQ ID NO: 4318110 - DNA, 15 bp, Homo sapiens
ttgaaattgtaatta

SEQ ID NO: 4318111 - DNA, 17 bp, Homo sapiens
ttgaaattgtaattata

SEQ ID NO: 4318112 - DNA, 22 bp, Homo sapiens
ttgaatttattggcttttctga

SEQ ID NO: 4318113 - DNA, 13 bp, Homo sapiens
ttgcctttttcat

SEQ ID NO: 4318114 - DNA, 16 bp, Homo sapiens
ttgcctttttcattat

SEQ ID NO: 4318115 - DNA, 18 bp, Homo sapiens
ttggcataacataaatct

SEQ ID NO: 4318116 - DNA, 23 bp, Homo sapiens
ttggcataacataaatctgtgaa

SEQ ID NO: 4318117 - DNA, 15 bp, Homo sapiens
ttggcttttctgatc

SEQ ID NO: 4318118 - DNA, 16 bp, Homo sapiens
ttgggtgtattgtgcg

SEQ ID NO: 4318119 - DNA, 15 bp, Homo sapiens
ttgtaattatatctg

SEQ ID NO: 4318120 - DNA, 17 bp, Homo sapiens
ttgtacaaagtattaag

SEQ ID NO: 4318121 - DNA, 22 bp, Homo sapiens
ttgtctcagattttattatgta

SEQ ID NO: 4318122 - DNA, 13 bp, Homo sapiens
ttgtttgtttagt

SEQ ID NO: 4318123 - DNA, 17 bp, Homo sapiens
tttaaaaaaaaaattgg

SEQ ID NO: 4318124 - DNA, 16 bp, Homo sapiens
tttaacaacagctggt

SEQ ID NO: 4318125 - DNA, 21 bp, Homo sapiens
tttaataattatatgctattt

SEQ ID NO: 4318126 - DNA, 17 bp, Homo sapiens
tttaatattaaagccat

SEQ ID NO: 4318127 - DNA, 14 bp, Homo sapiens
tttaattttggaat

SEQ ID NO: 4318128 - DNA, 15 bp, Homo sapiens
tttactaaaatggac

SEQ ID NO: 4318129 - DNA, 13 bp, Homo sapiens
tttatatttacta

SEQ ID NO: 4318130 - DNA, 16 bp, Homo sapiens
tttatatttactaaaa

SEQ ID NO: 4318131 - DNA, 13 bp, Homo sapiens
tttattatgaaac

SEQ ID NO: 4318132 - DNA, 17 bp, Homo sapiens
tttattatgtaaatccc

SEQ ID NO: 4318133 - DNA, 17 bp, Homo sapiens
tttattggcttttctga

SEQ ID NO: 4318134 - DNA, 21 bp, Homo sapiens
tttcagatactggattgtact

SEQ ID NO: 4318135 - DNA, 13 bp, Homo sapiens
tttcattatttta

SEQ ID NO: 4318136 - DNA, 15 bp, Homo sapiens
tttcattattttatt

SEQ ID NO: 4318137 - DNA, 20 bp, Homo sapiens
tttcattattttattatgaa

SEQ ID NO: 4318138 - DNA, 13 bp, Homo sapiens
tttctgatccagt

SEQ ID NO: 4318139 - DNA, 20 bp, Homo sapiens
tttctgatccagttttgttt

SEQ ID NO: 4318140 - DNA, 22 bp, Homo sapiens
tttctgatccagttttgtttgg

SEQ ID NO: 4318141 - DNA, 16 bp, Homo sapiens
tttggaaatctttaaa

SEQ ID NO: 4318142 - DNA, 18 bp, Homo sapiens
tttggaccaaaaaccagt

SEQ ID NO: 4318143 - DNA, 21 bp, Homo sapiens
tttggaccaaaaaccagtatt

SEQ ID NO: 4318144 - DNA, 24 bp, Homo sapiens
tttggaccaaaaaccagtattgta

SEQ ID NO: 4318145 - DNA, 13 bp, Homo sapiens
ttttatgatccag

SEQ ID NO: 4318146 - DNA, 21 bp, Homo sapiens
ttttattatgaaacttgtgta

SEQ ID NO: 4318147 - DNA, 22 bp, Homo sapiens
ttttattatgaaacttgtgtaa

SEQ ID NO: 4318148 - DNA, 13 bp, Homo sapiens
ttttgtttctgta

SEQ ID NO: 4318149 - DNA, 12 bp, Homo sapiens
ttttgtttggac

SEQ ID NO: 4318150 - DNA, 22 bp, Homo sapiens
ttttgtttggaccaaaaaccag

SEQ ID NO: 4318151 - DNA, 23 bp, Homo sapiens
ttttgtttggaccaaaaaccagt

SEQ ID NO: 4318152 - DNA, 22 bp, Homo sapiens
tttttcattattttattatgaa

SEQ ID NO: 4318153 - DNA, 23 bp, Homo sapiens
tttttggcataacataaatctgt

SEQ ID NO: 4318154 - DNA, 15 bp, Homo sapiens
atggtccgtgctaag

SEQ ID NO: 4318155 - DNA, 22 bp, Homo sapiens
atgtaaatcccattattcaaag

SEQ ID NO: 4318156 - DNA, 13 bp, Homo sapiens
atgttaaaccatg

SEQ ID NO: 4318157 - DNA, 15 bp, Homo sapiens
atgtttattacagta

SEQ ID NO: 4318158 - DNA, 19 bp, Homo sapiens
atgtttattacagtataat

SEQ ID NO: 4318159 - DNA, 22 bp, Homo sapiens
atgtttattacagtataattaa

SEQ ID NO: 4318160 - DNA, 16 bp, Homo sapiens
attaaagccatgttta

SEQ ID NO: 4318161 - DNA, 17 bp, Homo sapiens
attaaagccatgtttat

SEQ ID NO: 4318162 - DNA, 14 bp, Homo sapiens
attaacatgttaaa

SEQ ID NO: 4318163 - DNA, 15 bp, Homo sapiens
attaacatgttaaac

SEQ ID NO: 4318164 - DNA, 14 bp, Homo sapiens
attaagcatatatt

SEQ ID NO: 4318165 - DNA, 21 bp, Homo sapiens
attaagcatatatttttatat

SEQ ID NO: 4318166 - DNA, 12 bp, Homo sapiens
attacagtataa

SEQ ID NO: 4318167 - DNA, 14 bp, Homo sapiens
attacagtataatt

SEQ ID NO: 4318168 - DNA, 16 bp, Homo sapiens
attacagtataattaa

SEQ ID NO: 4318169 - DNA, 16 bp, Homo sapiens
attagaattctgtata

SEQ ID NO: 4318170 - DNA, 17 bp, Homo sapiens
attagaattctgtatag

SEQ ID NO: 4318171 - DNA, 21 bp, Homo sapiens
attagaattctgtatagatta

SEQ ID NO: 4318172 - DNA, 14 bp, Homo sapiens
attatgaaacttgt

SEQ ID NO: 4318173 - DNA, 21 bp, Homo sapiens
attatgaaacttgtgtaaata

SEQ ID NO: 4318174 - DNA, 23 bp, Homo sapiens
attatgtaaatcccattattcaa

SEQ ID NO: 4318175 - DNA, 14 bp, Homo sapiens
attattcaaagttg

SEQ ID NO: 4318176 - DNA, 17 bp, Homo sapiens
attattcaaagttgcct

SEQ ID NO: 4318177 - DNA, 19 bp, Homo sapiens
attattcaaagttgcctaa

SEQ ID NO: 4318178 - DNA, 24 bp, Homo sapiens
attattcaaagttgcctaaatcca

SEQ ID NO: 4318179 - DNA, 17 bp, Homo sapiens
attcactgatttgacat

SEQ ID NO: 4318180 - DNA, 21 bp, Homo sapiens
attctcctatcacctgtcttg

SEQ ID NO: 4318181 - DNA, 19 bp, Homo sapiens
attcttaaagttgaattta

SEQ ID NO: 4318182 - DNA, 22 bp, Homo sapiens
attggggattcttaaagttgaa

SEQ ID NO: 4318183 - DNA, 14 bp, Homo sapiens
attggtgttgtact

SEQ ID NO: 4318184 - DNA, 13 bp, Homo sapiens
attgtaattatat

SEQ ID NO: 4318185 - DNA, 15 bp, Homo sapiens
attgtaattatatct

SEQ ID NO: 4318186 - DNA, 15 bp, Homo sapiens
atttctatattttca

SEQ ID NO: 4318187 - DNA, 17 bp, Homo sapiens
atttctatattttcatt

SEQ ID NO: 4318188 - DNA, 21 bp, Homo sapiens
atttctatgctgagtttgtgc

SEQ ID NO: 4318189 - DNA, 16 bp, Homo sapiens
atttgacatagtctgg

SEQ ID NO: 4318190 - DNA, 13 bp, Homo sapiens
atttggaaatctt

SEQ ID NO: 4318191 - DNA, 14 bp, Homo sapiens
attttattatgaaa

SEQ ID NO: 4318192 - DNA, 18 bp, Homo sapiens
attttattatgaaacttg

SEQ ID NO: 4318193 - DNA, 21 bp, Homo sapiens
attttattatgaaacttgtgt

SEQ ID NO: 4318194 - DNA, 12 bp, Homo sapiens
attttggaattt

SEQ ID NO: 4318195 - DNA, 14 bp, Homo sapiens
attttgtttctgta

SEQ ID NO: 4318196 - DNA, 15 bp, Homo sapiens
atttttatatttact

SEQ ID NO: 4318197 - DNA, 18 bp, Homo sapiens
atttttttgttgtttgtt

SEQ ID NO: 4318198 - DNA, 19 bp, Homo sapiens
caaaaaccagtattgtaca

SEQ ID NO: 4318199 - DNA, 20 bp, Homo sapiens
caaaaaccagtattgtacaa

SEQ ID NO: 4318200 - DNA, 14 bp, Homo sapiens
caaaaatattttat

SEQ ID NO: 4318201 - DNA, 21 bp, Homo sapiens
caaaaatattttatgatccag

SEQ ID NO: 4318202 - DNA, 22 bp, Homo sapiens
caaaaatattttatgatccagc

SEQ ID NO: 4318203 - DNA, 19 bp, Homo sapiens
caaagttgcctaaatccat

SEQ ID NO: 4318204 - DNA, 17 bp, Homo sapiens
caataaaaaattatgac

SEQ ID NO: 4318205 - DNA, 13 bp, Homo sapiens
caattttgtttct

SEQ ID NO: 4318206 - DNA, 17 bp, Homo sapiens
caattttgtttctgtac

SEQ ID NO: 4318207 - DNA, 20 bp, Homo sapiens
cacattggtgttgtactcaa

SEQ ID NO: 4318208 - DNA, 13 bp, Homo sapiens
cagatactggatt

SEQ ID NO: 4318209 - DNA, 18 bp, Homo sapiens
cagatactggattgtact

SEQ ID NO: 4318210 - DNA, 23 bp, Homo sapiens
cagattattcactgatttgacat

SEQ ID NO: 4318211 - DNA, 16 bp, Homo sapiens
cagattttattatgta

SEQ ID NO: 4318212 - DNA, 20 bp, Homo sapiens
cagattttattatgtaaatc

SEQ ID NO: 4318213 - DNA, 21 bp, Homo sapiens
cagattttattatgtaaatcc

SEQ ID NO: 4318214 - DNA, 19 bp, Homo sapiens
cagctggtgccctgctttc

SEQ ID NO: 4318215 - DNA, 23 bp, Homo sapiens
caggaatggagcctgcacggtga

SEQ ID NO: 4318216 - DNA, 14 bp, Homo sapiens
cagtataattaaca

SEQ ID NO: 4318217 - DNA, 19 bp, Homo sapiens
cagtattgtacaaagtatt

SEQ ID NO: 4318218 - DNA, 21 bp, Homo sapiens
cagttttgtttggaccaaaaa

SEQ ID NO: 4318219 - DNA, 14 bp, Homo sapiens
cataaatctgtgaa

SEQ ID NO: 4318220 - DNA, 22 bp, Homo sapiens
cataaatctgtgaacttgaaat

SEQ ID NO: 4318221 - DNA, 12 bp, Homo sapiens
cataacataaat

SEQ ID NO: 4318222 - DNA, 19 bp, Homo sapiens
cataacataaatctgtgaa

SEQ ID NO: 4318223 - DNA, 13 bp, Homo sapiens
catgtttattaca

SEQ ID NO: 4318224 - DNA, 19 bp, Homo sapiens
catgtttattacagtataa

SEQ ID NO: 4318225 - DNA, 23 bp, Homo sapiens
catgtttattacagtataattaa

SEQ ID NO: 4318226 - DNA, 18 bp, Homo sapiens
cattattcaaagttgcct

SEQ ID NO: 4318227 - DNA, 11 bp, Homo sapiens
cattattttat

SEQ ID NO: 4318228 - DNA, 21 bp, Homo sapiens
cattctcctatcacctgtctt

SEQ ID NO: 4318229 - DNA, 18 bp, Homo sapiens
catttggaaatctttaaa

SEQ ID NO: 4318230 - DNA, 19 bp, Homo sapiens
ccaaaaaccagtattgtac

SEQ ID NO: 4318231 - DNA, 13 bp, Homo sapiens
ccatgggataaat

SEQ ID NO: 4318232 - DNA, 19 bp, Homo sapiens
cccaggaatggagcctgca

SEQ ID NO: 4318233 - DNA, 20 bp, Homo sapiens
cccaggaatggagcctgcac

SEQ ID NO: 4318234 - DNA, 16 bp, Homo sapiens
ccccaccctgcctcac

SEQ ID NO: 4318235 - DNA, 17 bp, Homo sapiens
ccctgctttcagatact

SEQ ID NO: 4318236 - DNA, 14 bp, Homo sapiens
ccgtgctaaggact

SEQ ID NO: 4318237 - DNA, 16 bp, Homo sapiens
ccgtgctaaggacttg

SEQ ID NO: 4318238 - DNA, 19 bp, Homo sapiens
cctaaatccatttggaaat

SEQ ID NO: 4318239 - DNA, 12 bp, Homo sapiens
cctaaggacttc

SEQ ID NO: 4318240 - DNA, 16 bp, Homo sapiens
cctaaggacttcttta

SEQ ID NO: 4318241 - DNA, 23 bp, Homo sapiens
cctaaggacttctttaattttgg

SEQ ID NO: 4318242 - DNA, 21 bp, Homo sapiens
cctcacccacccttttttaaa

SEQ ID NO: 4318243 - DNA, 21 bp, Homo sapiens
cctgcacggtgaatggctttg

SEQ ID NO: 4318244 - DNA, 17 bp, Homo sapiens
cctttttcattatttta

SEQ ID NO: 4318245 - DNA, 21 bp, Homo sapiens
cgcgttgaaattgtaattata

SEQ ID NO: 4318246 - DNA, 17 bp, Homo sapiens
cgctaaacttttctgat

SEQ ID NO: 4318247 - DNA, 13 bp, Homo sapiens
cggatgatttcta

SEQ ID NO: 4318248 - DNA, 14 bp, Homo sapiens
cggtgaatggcttt

SEQ ID NO: 4318249 - DNA, 22 bp, Homo sapiens
cggtgaatggctttgtatagaa

SEQ ID NO: 4318250 - DNA, 12 bp, Homo sapiens
cgtgctaaggac

SEQ ID NO: 4318251 - DNA, 16 bp, Homo sapiens
cgtgctaaggacttgt

SEQ ID NO: 4318252 - DNA, 22 bp, Homo sapiens
cgttcatggaacgcgttgaaat

SEQ ID NO: 4318253 - DNA, 18 bp, Homo sapiens
cgttgaaattgtaattat

SEQ ID NO: 4318254 - DNA, 23 bp, Homo sapiens
cgttgaaattgtaattatatctg

SEQ ID NO: 4318255 - DNA, 17 bp, Homo sapiens
ctaaggacttgttagat

SEQ ID NO: 4318256 - DNA, 14 bp, Homo sapiens
ctagactggtgact

SEQ ID NO: 4318257 - DNA, 15 bp, Homo sapiens
ctagactggtgactg

SEQ ID NO: 4318258 - DNA, 12 bp, Homo sapiens
ctagttcactct

SEQ ID NO: 4318259 - DNA, 19 bp, Homo sapiens
ctatattttcattctccta

SEQ ID NO: 4318260 - DNA, 16 bp, Homo sapiens
ctgaagtcagatctgc

SEQ ID NO: 4318261 - DNA, 19 bp, Homo sapiens
ctgaggaattctgtataga

SEQ ID NO: 4318262 - DNA, 17 bp, Homo sapiens
ctgcacggtgaatggct

SEQ ID NO: 4318263 - DNA, 12 bp, Homo sapiens
ctgcctaaggac

SEQ ID NO: 4318264 - DNA, 15 bp, Homo sapiens
ctgcctaaggacttc

SEQ ID NO: 4318265 - DNA, 15 bp, Homo sapiens
ctggtgccctgcttt

SEQ ID NO: 4318266 - DNA, 16 bp, Homo sapiens
ctggtgccctgctttc

SEQ ID NO: 4318267 - DNA, 14 bp, Homo sapiens
ctgtactttttggc

SEQ ID NO: 4318268 - DNA, 15 bp, Homo sapiens
ctgtactttttggca

SEQ ID NO: 4318269 - DNA, 16 bp, Homo sapiens
ctgtatagattagaga

SEQ ID NO: 4318270 - DNA, 23 bp, Homo sapiens
ctgtcttgcctttttcattattt

SEQ ID NO: 4318271 - DNA, 17 bp, Homo sapiens
ctgtgaacttgaaattt

SEQ ID NO: 4318272 - DNA, 11 bp, Homo sapiens
cttaaagttga

SEQ ID NO: 4318273 - DNA, 17 bp, Homo sapiens
cttcagcaaaaatattt

SEQ ID NO: 4318274 - DNA, 14 bp, Homo sapiens
tctgcctaaggact

SEQ ID NO: 4318275 - DNA, 20 bp, Homo sapiens
tctgcctaaggacttcttta

SEQ ID NO: 4318276 - DNA, 14 bp, Homo sapiens
tctgtactttttgg

SEQ ID NO: 4318277 - DNA, 17 bp, Homo sapiens
tctgtactttttggcat

SEQ ID NO: 4318278 - DNA, 17 bp, Homo sapiens
tctgtatagattagaat

SEQ ID NO: 4318279 - DNA, 16 bp, Homo sapiens
tcttaaagttgaattt

SEQ ID NO: 4318280 - DNA, 19 bp, Homo sapiens
tcttaaagttgaatttatt

SEQ ID NO: 4318281 - DNA, 21 bp, Homo sapiens
tcttaaagttgaatttattgg

SEQ ID NO: 4318282 - DNA, 22 bp, Homo sapiens
tcttcagcaaaaatattttatg

SEQ ID NO: 4318283 - DNA, 15 bp, Homo sapiens
tcttgcctttttcat

SEQ ID NO: 4318284 - DNA, 17 bp, Homo sapiens
tcttgcctttttcatta

SEQ ID NO: 4318285 - DNA, 18 bp, Homo sapiens
tctttaaaaaaaaaattg

SEQ ID NO: 4318286 - DNA, 19 bp, Homo sapiens
tctttaaaaaaaaaattgg

SEQ ID NO: 4318287 - DNA, 15 bp, Homo sapiens
tgaaacggatgattt

SEQ ID NO: 4318288 - DNA, 17 bp, Homo sapiens
tgaaacggatgatttct

SEQ ID NO: 4318289 - DNA, 18 bp, Homo sapiens
tgaaacggatgatttcta

SEQ ID NO: 4318290 - DNA, 19 bp, Homo sapiens
tgaaacggatgatttctat

SEQ ID NO: 4318291 - DNA, 21 bp, Homo sapiens
tgaaattgtaattatatctga

SEQ ID NO: 4318292 - DNA, 14 bp, Homo sapiens
tgaaatttgaattt

SEQ ID NO: 4318293 - DNA, 16 bp, Homo sapiens
tgaaatttgaattttg

SEQ ID NO: 4318294 - DNA, 13 bp, Homo sapiens
tgaacttgaaatt

SEQ ID NO: 4318295 - DNA, 12 bp, Homo sapiens
tgaatggctttg

SEQ ID NO: 4318296 - DNA, 17 bp, Homo sapiens
tgaatggctttgtatag

SEQ ID NO: 4318297 - DNA, 21 bp, Homo sapiens
tgaatttattggcttttctga

SEQ ID NO: 4318298 - DNA, 22 bp, Homo sapiens
tgaatttattggcttttctgat

SEQ ID NO: 4318299 - DNA, 17 bp, Homo sapiens
tgaattttgtgttagag

SEQ ID NO: 4318300 - DNA, 16 bp, Homo sapiens
tgacatagtctggctg

SEQ ID NO: 4318301 - DNA, 14 bp, Homo sapiens
tgactgattcttca

SEQ ID NO: 4318302 - DNA, 15 bp, Homo sapiens
tgactgattcttcag

SEQ ID NO: 4318303 - DNA, 16 bp, Homo sapiens
tgactgattcttcagc

SEQ ID NO: 4318304 - DNA, 12 bp, Homo sapiens
tgactttggata

SEQ ID NO: 4318305 - DNA, 13 bp, Homo sapiens
tgactttggataa

SEQ ID NO: 4318306 - DNA, 15 bp, Homo sapiens
tgaggaattctgtat

SEQ ID NO: 4318307 - DNA, 15 bp, Homo sapiens
tgatagaggaagcct

SEQ ID NO: 4318308 - DNA, 19 bp, Homo sapiens
tgatccagcagattattca

SEQ ID NO: 4318309 - DNA, 22 bp, Homo sapiens
tgatccagttttgtttggacca

SEQ ID NO: 4318310 - DNA, 14 bp, Homo sapiens
tgcacggtgaatgg

SEQ ID NO: 4318311 - DNA, 18 bp, Homo sapiens
tgcacggtgaatggcttt

SEQ ID NO: 4318312 - DNA, 23 bp, Homo sapiens
tgcacggtgaatggctttgtata

SEQ ID NO: 4318313 - DNA, 22 bp, Homo sapiens
tgccatcaataaaaaattatga

SEQ ID NO: 4318314 - DNA, 17 bp, Homo sapiens
tgccctgctttcagata

SEQ ID NO: 4318315 - DNA, 13 bp, Homo sapiens
tgcctaaatccat

SEQ ID NO: 4318316 - DNA, 22 bp, Homo sapiens
tgcctaaatccatttggaaatc

SEQ ID NO: 4318317 - DNA, 23 bp, Homo sapiens
tgcctaaatccatttggaaatct

SEQ ID NO: 4318318 - DNA, 16 bp, Homo sapiens
tgcctaaggacttctt

SEQ ID NO: 4318319 - DNA, 21 bp, Homo sapiens
tgcctaaggacttctttaatt

SEQ ID NO: 4318320 - DNA, 23 bp, Homo sapiens
tgcctaaggacttctttaatttt

SEQ ID NO: 4318321 - DNA, 20 bp, Homo sapiens
tgcctcacccaccctttttt

SEQ ID NO: 4318322 - DNA, 13 bp, Homo sapiens
tgcctttttcatt

SEQ ID NO: 4318323 - DNA, 21 bp, Homo sapiens
tgcgctaaacttttctgatag

SEQ ID NO: 4318324 - DNA, 22 bp, Homo sapiens
tgctaaggacttgttagatcta

SEQ ID NO: 4318325 - DNA, 12 bp, Homo sapiens
tgctatttctat

SEQ ID NO: 4318326 - DNA, 13 bp, Homo sapiens
tgctatttctata

SEQ ID NO: 4318327 - DNA, 17 bp, Homo sapiens
tgctgagtttgtgctgg

SEQ ID NO: 4318328 - DNA, 17 bp, Homo sapiens
tgctttcagatactgga

SEQ ID NO: 4318329 - DNA, 21 bp, Homo sapiens
tgctttcagatactggattgt

SEQ ID NO: 4318330 - DNA, 15 bp, Homo sapiens
tggaaatctttaaaa

SEQ ID NO: 4318331 - DNA, 17 bp, Homo sapiens
tggaacgcgttgaaatt

SEQ ID NO: 4318332 - DNA, 21 bp, Homo sapiens
tggaattttcctcctttctct

SEQ ID NO: 4318333 - DNA, 15 bp, Homo sapiens
tggaccaaaaaccag

SEQ ID NO: 4318334 - DNA, 17 bp, Homo sapiens
tggactgtggtgacttt

SEQ ID NO: 4318335 - DNA, 15 bp, Homo sapiens
tggcataacataaat

SEQ ID NO: 4318336 - DNA, 13 bp, Homo sapiens
tggcttttctgat

SEQ ID NO: 4318337 - DNA, 17 bp, Homo sapiens
tggcttttctgatccag

SEQ ID NO: 4318338 - DNA, 18 bp, Homo sapiens
tggcttttctgatccagt

SEQ ID NO: 4318339 - DNA, 19 bp, Homo sapiens
tggtccgtgctaaggactt

SEQ ID NO: 4318340 - DNA, 23 bp, Homo sapiens
tggtgactttggataataaggaa

SEQ ID NO: 4318341 - DNA, 14 bp, Homo sapiens
tggtgccctgcttt

SEQ ID NO: 4318342 - DNA, 16 bp, Homo sapiens
tgtaaatacaattttg

SEQ ID NO: 4318343 - DNA, 19 bp, Homo sapiens
tgtaaatacaattttgttt

SEQ ID NO: 4318344 - DNA, 18 bp, Homo sapiens
tgtaaatcccattattca

SEQ ID NO: 4318345 - DNA, 20 bp, Homo sapiens
tgtaaatcccattattcaaa

SEQ ID NO: 4318346 - DNA, 15 bp, Homo sapiens
tgtacaaagtattaa

SEQ ID NO: 4318347 - DNA, 19 bp, Homo sapiens
tgtacaaagtattaagcat

SEQ ID NO: 4318348 - DNA, 15 bp, Homo sapiens
tgtactttttggcat

SEQ ID NO: 4318349 - DNA, 16 bp, Homo sapiens
tgtactttttggcata

SEQ ID NO: 4318350 - DNA, 21 bp, Homo sapiens
tgtattgtgcgctaaactttt

SEQ ID NO: 4318351 - DNA, 14 bp, Homo sapiens
tgtgaacttgaaat

SEQ ID NO: 4318352 - DNA, 15 bp, Homo sapiens
tgtgaacttgaaatt

SEQ ID NO: 4318353 - DNA, 22 bp, Homo sapiens
tgtgcgctaaacttttctgata

SEQ ID NO: 4318354 - DNA, 23 bp, Homo sapiens
tgtgcgctaaacttttctgatag

SEQ ID NO: 4318355 - DNA, 18 bp, Homo sapiens
tgtgctggggttatctga

SEQ ID NO: 4318356 - DNA, 16 bp, Homo sapiens
tgtgttagagattttt

SEQ ID NO: 4318357 - DNA, 21 bp, Homo sapiens
tgttgaaacggatgatttcta

SEQ ID NO: 4318358 - DNA, 17 bp, Homo sapiens
tgtttagtcttgtctca

SEQ ID NO: 4318359 - DNA, 19 bp, Homo sapiens
tgtttagtcttgtctcaga

SEQ ID NO: 4318360 - DNA, 22 bp, Homo sapiens
tgtttagtcttgtctcagattt

SEQ ID NO: 4318361 - DNA, 23 bp, Homo sapiens
tgtttagtcttgtctcagatttt

SEQ ID NO: 4318362 - DNA, 18 bp, Homo sapiens
tgtttattacagtataat

SEQ ID NO: 4318363 - DNA, 11 bp, Homo sapiens
tgtttctgtac

SEQ ID NO: 4318364 - DNA, 22 bp, Homo sapiens
tgtttctgtactttttggcata

SEQ ID NO: 4318365 - DNA, 21 bp, Homo sapiens
tgtttgtttagtcttgtctca

SEQ ID NO: 4318366 - DNA, 19 bp, Homo sapiens
ttaacatgttaaaccatgg

SEQ ID NO: 4318367 - DNA, 13 bp, Homo sapiens
ttaagcatatatt

SEQ ID NO: 4318368 - DNA, 18 bp, Homo sapiens
ttaataattatatgctat

SEQ ID NO: 4318369 - DNA, 20 bp, Homo sapiens
ttaataattatatgctattt

SEQ ID NO: 4318370 - DNA, 23 bp, Homo sapiens
ttaataattatatgctatttcta

SEQ ID NO: 4318371 - DNA, 16 bp, Homo sapiens
ttaatattaaagccat

SEQ ID NO: 4318372 - DNA, 18 bp, Homo sapiens
ttaatattaaagccatgt

SEQ ID NO: 4318373 - DNA, 19 bp, Homo sapiens
ttaatattaaagccatgtt

SEQ ID NO: 4318374 - DNA, 18 bp, Homo sapiens
ttactaaaatggactgtg

SEQ ID NO: 4318375 - DNA, 15 bp, Homo sapiens
ttagaattctgtata

SEQ ID NO: 4318376 - DNA, 17 bp, Homo sapiens
ttagaattctgtataga

SEQ ID NO: 4318377 - DNA, 16 bp, Homo sapiens
ttagagagtgttgaaa

SEQ ID NO: 4318378 - DNA, 14 bp, Homo sapiens
ttatatctgaggaa

SEQ ID NO: 4318379 - DNA, 21 bp, Homo sapiens
ttatatctgaggaattctgta

SEQ ID NO: 4318380 - DNA, 23 bp, Homo sapiens
ttatatctgaggaattctgtata

SEQ ID NO: 4318381 - DNA, 19 bp, Homo sapiens
ttatgaaacttgtgtaaat

SEQ ID NO: 4318382 - DNA, 18 bp, Homo sapiens
ttatgatccagcagatta

SEQ ID NO: 4318383 - DNA, 17 bp, Homo sapiens
ttattatgaaacttgtg

SEQ ID NO: 4318384 - DNA, 16 bp, Homo sapiens
ttattttattatgaaa

SEQ ID NO: 4318385 - DNA, 20 bp, Homo sapiens
ttattttattatgaaacttg

SEQ ID NO: 4318386 - DNA, 11 bp, Homo sapiens
ttcactgattt

SEQ ID NO: 4318387 - DNA, 16 bp, Homo sapiens
ttcagatactggattg

SEQ ID NO: 4318388 - DNA, 17 bp, Homo sapiens
ttcagcaaaaatatttt

SEQ ID NO: 4318389 - DNA, 21 bp, Homo sapiens
ttcagcaaaaatattttatga

SEQ ID NO: 4318390 - DNA, 19 bp, Homo sapiens
ttcatggaacgcgttgaaa

SEQ ID NO: 4318391 - DNA, 21 bp, Homo sapiens
ttctatattttcattctccta

SEQ ID NO: 4318392 - DNA, 13 bp, Homo sapiens
ttctgatagagga

SEQ ID NO: 4318393 - DNA, 11 bp, Homo sapiens
ttctgtataga

SEQ ID NO: 4318394 - DNA, 16 bp, Homo sapiens
aaaaaccagtattgta

SEQ ID NO: 4318395 - DNA, 14 bp, Homo sapiens
aaaagtttaatatt

SEQ ID NO: 4318396 - DNA, 18 bp, Homo sapiens
aaaccagtattgtacaaa

SEQ ID NO: 4318397 - DNA, 11 bp, Homo sapiens
aaacttttctg

SEQ ID NO: 4318398 - DNA, 14 bp, Homo sapiens
aaacttttctgata

SEQ ID NO: 4318399 - DNA, 17 bp, Homo sapiens
aaagccatgtttattac

SEQ ID NO: 4318400 - DNA, 16 bp, Homo sapiens
aaagttgaatttattg

SEQ ID NO: 4318401 - DNA, 12 bp, Homo sapiens
aaagtttaatat

SEQ ID NO: 4318402 - DNA, 14 bp, Homo sapiens
aaagtttaatatta

SEQ ID NO: 4318403 - DNA, 16 bp, Homo sapiens
aaagtttaatattaaa

SEQ ID NO: 4318404 - DNA, 19 bp, Homo sapiens
aaagtttaatattaaagcc

SEQ ID NO: 4318405 - DNA, 22 bp, Homo sapiens
aaagtttaatattaaagccatg

SEQ ID NO: 4318406 - DNA, 10 bp, Homo sapiens
aaataaataa

SEQ ID NO: 4318407 - DNA, 17 bp, Homo sapiens
aaatacaattttgtttc

SEQ ID NO: 4318408 - DNA, 21 bp, Homo sapiens
aaatccatttggaaatcttta

SEQ ID NO: 4318409 - DNA, 22 bp, Homo sapiens
aaatccatttggaaatctttaa

SEQ ID NO: 4318410 - DNA, 23 bp, Homo sapiens
aaatccatttggaaatctttaaa

SEQ ID NO: 4318411 - DNA, 16 bp, Homo sapiens
aaatcccattattcaa

SEQ ID NO: 4318412 - DNA, 20 bp, Homo sapiens
aaatcccattattcaaagtt

SEQ ID NO: 4318413 - DNA, 15 bp, Homo sapiens
aaatctgtgaacttg

SEQ ID NO: 4318414 - DNA, 21 bp, Homo sapiens
aaatctgtgaacttgaaattt

SEQ ID NO: 4318415 - DNA, 20 bp, Homo sapiens
aaatggactgtggtgacttt

SEQ ID NO: 4318416 - DNA, 23 bp, Homo sapiens
aaattggggattcttaaagttga

SEQ ID NO: 4318417 - DNA, 22 bp, Homo sapiens
aaatttgaattttgtgttagag

SEQ ID NO: 4318418 - DNA, 14 bp, Homo sapiens
aacatgttaaacca

SEQ ID NO: 4318419 - DNA, 16 bp, Homo sapiens
aacatgttaaaccatg

SEQ ID NO: 4318420 - DNA, 13 bp, Homo sapiens
aaccagtattgta

SEQ ID NO: 4318421 - DNA, 15 bp, Homo sapiens
aaccatgggataaat

SEQ ID NO: 4318422 - DNA, 17 bp, Homo sapiens
aaccatgggataaatgc

SEQ ID NO: 4318423 - DNA, 16 bp, Homo sapiens
aacctctttgtctaca

SEQ ID NO: 4318424 - DNA, 17 bp, Homo sapiens
aacggatgatttctatg

SEQ ID NO: 4318425 - DNA, 15 bp, Homo sapiens
aagccatgtttatta

SEQ ID NO: 4318426 - DNA, 23 bp, Homo sapiens
aagccatgtttattacagtataa

SEQ ID NO: 4318427 - DNA, 20 bp, Homo sapiens
aaggacttctttaattttgg

SEQ ID NO: 4318428 - DNA, 23 bp, Homo sapiens
aaggacttctttaattttggaat

SEQ ID NO: 4318429 - DNA, 21 bp, Homo sapiens
aagtcagatctgcctaaggac

SEQ ID NO: 4318430 - DNA, 23 bp, Homo sapiens
aagtcagatctgcctaaggactt

SEQ ID NO: 4318431 - DNA, 15 bp, Homo sapiens
aagttgaatttattg

SEQ ID NO: 4318432 - DNA, 18 bp, Homo sapiens
aagttgcctaaatccatt

SEQ ID NO: 4318433 - DNA, 19 bp, Homo sapiens
aagttgcctaaatccattt

SEQ ID NO: 4318434 - DNA, 15 bp, Homo sapiens
aagtttaatattaaa

SEQ ID NO: 4318435 - DNA, 15 bp, Homo sapiens
aataaaaaattatga

SEQ ID NO: 4318436 - DNA, 15 bp, Homo sapiens
aataaggaaaagttt

SEQ ID NO: 4318437 - DNA, 13 bp, Homo sapiens
aatacaattttgt

SEQ ID NO: 4318438 - DNA, 18 bp, Homo sapiens
cttctttaattttggaat

SEQ ID NO: 4318439 - DNA, 19 bp, Homo sapiens
cttctttaattttggaatt

SEQ ID NO: 4318440 - DNA, 14 bp, Homo sapiens
cttgtgtaaataca

SEQ ID NO: 4318441 - DNA, 17 bp, Homo sapiens
ctttaaaaaaaaaattg

SEQ ID NO: 4318442 - DNA, 13 bp, Homo sapiens
ctttcagatactg

SEQ ID NO: 4318443 - DNA, 15 bp, Homo sapiens
ctttcagatactgga

SEQ ID NO: 4318444 - DNA, 17 bp, Homo sapiens
ctttcagatactggatt

SEQ ID NO: 4318445 - DNA, 16 bp, Homo sapiens
ctttctctttcgttac

SEQ ID NO: 4318446 - DNA, 14 bp, Homo sapiens
ctttggataataag

SEQ ID NO: 4318447 - DNA, 15 bp, Homo sapiens
ctttgtgctggggtt

SEQ ID NO: 4318448 - DNA, 14 bp, Homo sapiens
cttttctgatccag

SEQ ID NO: 4318449 - DNA, 18 bp, Homo sapiens
cttttctgatccagtttt

SEQ ID NO: 4318450 - DNA, 12 bp, Homo sapiens
ctttttcattat

SEQ ID NO: 4318451 - DNA, 14 bp, Homo sapiens
ctttttcattattt

SEQ ID NO: 4318452 - DNA, 20 bp, Homo sapiens
ctttttggcataacataaat

SEQ ID NO: 4318453 - DNA, 22 bp, Homo sapiens
ctttttggcataacataaatct

SEQ ID NO: 4318454 - DNA, 15 bp, Homo sapiens
cttttttaaataaat

SEQ ID NO: 4318455 - DNA, 15 bp, Homo sapiens
gaaaagtttaatatt

SEQ ID NO: 4318456 - DNA, 23 bp, Homo sapiens
gaaaagtttaatattaaagccat

SEQ ID NO: 4318457 - DNA, 18 bp, Homo sapiens
gaaacggatgatttctat

SEQ ID NO: 4318458 - DNA, 15 bp, Homo sapiens
gaaatctttaaaaaa

SEQ ID NO: 4318459 - DNA, 16 bp, Homo sapiens
gaacgcgttgaaattg

SEQ ID NO: 4318460 - DNA, 22 bp, Homo sapiens
gaacttgaaatttgaattttgt

SEQ ID NO: 4318461 - DNA, 14 bp, Homo sapiens
gaatggctttgtat

SEQ ID NO: 4318462 - DNA, 16 bp, Homo sapiens
gaatggctttgtatag

SEQ ID NO: 4318463 - DNA, 17 bp, Homo sapiens
gaatggctttgtataga

SEQ ID NO: 4318464 - DNA, 20 bp, Homo sapiens
gaatggtccgtgctaaggac

SEQ ID NO: 4318465 - DNA, 23 bp, Homo sapiens
gaatggtccgtgctaaggacttg

SEQ ID NO: 4318466 - DNA, 16 bp, Homo sapiens
gaatttattggctttt

SEQ ID NO: 4318467 - DNA, 20 bp, Homo sapiens
gaatttattggcttttctga

SEQ ID NO: 4318468 - DNA, 21 bp, Homo sapiens
gaatttattggcttttctgat

SEQ ID NO: 4318469 - DNA, 20 bp, Homo sapiens
gaccaaaaaccagtattgta

SEQ ID NO: 4318470 - DNA, 16 bp, Homo sapiens
gactgattcttcagca

SEQ ID NO: 4318471 - DNA, 15 bp, Homo sapiens
gactggtgactgatt

SEQ ID NO: 4318472 - DNA, 16 bp, Homo sapiens
gacttctttaattttg

SEQ ID NO: 4318473 - DNA, 21 bp, Homo sapiens
gacttctttaattttggaatt

SEQ ID NO: 4318474 - DNA, 12 bp, Homo sapiens
gacttgttagat

SEQ ID NO: 4318475 - DNA, 19 bp, Homo sapiens
gactttggataataaggaa

SEQ ID NO: 4318476 - DNA, 16 bp, Homo sapiens
gaggaattctgtatag

SEQ ID NO: 4318477 - DNA, 11 bp, Homo sapiens
gataaatgcca

SEQ ID NO: 4318478 - DNA, 20 bp, Homo sapiens
gataataaggaaaagtttaa

SEQ ID NO: 4318479 - DNA, 20 bp, Homo sapiens
gatactggattgtactttgt

SEQ ID NO: 4318480 - DNA, 15 bp, Homo sapiens
gatagaggaagcctg

SEQ ID NO: 4318481 - DNA, 22 bp, Homo sapiens
gatagaggaagcctgattaaag

SEQ ID NO: 4318482 - DNA, 13 bp, Homo sapiens
gatgatttctatg

SEQ ID NO: 4318483 - DNA, 14 bp, Homo sapiens
gattagagagtgtt

SEQ ID NO: 4318484 - DNA, 18 bp, Homo sapiens
gattagagagtgttgaaa

SEQ ID NO: 4318485 - DNA, 13 bp, Homo sapiens
gattattcactga

SEQ ID NO: 4318486 - DNA, 15 bp, Homo sapiens
gattattcactgatt

SEQ ID NO: 4318487 - DNA, 21 bp, Homo sapiens
gattattcactgatttgacat

SEQ ID NO: 4318488 - DNA, 16 bp, Homo sapiens
gattcttaaagttgaa

SEQ ID NO: 4318489 - DNA, 23 bp, Homo sapiens
gattttattatgtaaatcccatt

SEQ ID NO: 4318490 - DNA, 21 bp, Homo sapiens
gatttttttgttgtttgttta

SEQ ID NO: 4318491 - DNA, 23 bp, Homo sapiens
gcaaaaatattttatgatccagc

SEQ ID NO: 4318492 - DNA, 21 bp, Homo sapiens
gcataacataaatctgtgaac

SEQ ID NO: 4318493 - DNA, 11 bp, Homo sapiens
gcatatatttt

SEQ ID NO: 4318494 - DNA, 13 bp, Homo sapiens
gccatgtttatta

SEQ ID NO: 4318495 - DNA, 21 bp, Homo sapiens
gcctaaatccatttggaaatc

SEQ ID NO: 4318496 - DNA, 23 bp, Homo sapiens
gcctaaatccatttggaaatctt

SEQ ID NO: 4318497 - DNA, 16 bp, Homo sapiens
gcctgattaaagaatg

SEQ ID NO: 4318498 - DNA, 16 bp, Homo sapiens
gcctttttcattattt

SEQ ID NO: 4318499 - DNA, 23 bp, Homo sapiens
gcctttttcattattttattatg

SEQ ID NO: 4318500 - DNA, 23 bp, Homo sapiens
gcgttgaaattgtaattatatct

SEQ ID NO: 4318501 - DNA, 11 bp, Homo sapiens
gctaaggactt

SEQ ID NO: 4318502 - DNA, 19 bp, Homo sapiens
gctagactggtgactgatt

SEQ ID NO: 4318503 - DNA, 20 bp, Homo sapiens
gctagactggtgactgattc

SEQ ID NO: 4318504 - DNA, 16 bp, Homo sapiens
gctatttctatatttt

SEQ ID NO: 4318505 - DNA, 18 bp, Homo sapiens
gctatttctatattttca

SEQ ID NO: 4318506 - DNA, 20 bp, Homo sapiens
gctatttctatattttcatt

SEQ ID NO: 4318507 - DNA, 14 bp, Homo sapiens
gctggggttatctg

SEQ ID NO: 4318508 - DNA, 18 bp, Homo sapiens
gctttcagatactggatt

SEQ ID NO: 4318509 - DNA, 23 bp, Homo sapiens
gctttcagatactggattgtact

SEQ ID NO: 4318510 - DNA, 16 bp, Homo sapiens
gcttttctgatccagt

SEQ ID NO: 4318511 - DNA, 21 bp, Homo sapiens
ggaacgcgttgaaattgtaat

SEQ ID NO: 4318512 - DNA, 15 bp, Homo sapiens
ggaattctgtataga

SEQ ID NO: 4318513 - DNA, 17 bp, Homo sapiens
ggaattctgtatagatt

SEQ ID NO: 4318514 - DNA, 14 bp, Homo sapiens
ggaccaaaaaccag

SEQ ID NO: 4318515 - DNA, 17 bp, Homo sapiens
ggactgtggtgactttg

SEQ ID NO: 4318516 - DNA, 18 bp, Homo sapiens
ggacttctttaattttgg

SEQ ID NO: 4318517 - DNA, 21 bp, Homo sapiens
ggacttctttaattttggaat

SEQ ID NO: 4318518 - DNA, 22 bp, Homo sapiens
ggacttctttaattttggaatt

SEQ ID NO: 4318519 - DNA, 12 bp, Homo sapiens
ggacttgttaga

SEQ ID NO: 4318520 - DNA, 22 bp, Homo sapiens
ggataataaggaaaagtttaat

SEQ ID NO: 4318521 - DNA, 15 bp, Homo sapiens
ggctgtacccaggaa

SEQ ID NO: 4318522 - DNA, 17 bp, Homo sapiens
ggcttttctgatccagt

SEQ ID NO: 4318523 - DNA, 20 bp, Homo sapiens
gggattcttaaagttgaatt

SEQ ID NO: 4318524 - DNA, 11 bp, Homo sapiens
ggggattctta

SEQ ID NO: 4318525 - DNA, 16 bp, Homo sapiens
ggtccgtgctaaggac

SEQ ID NO: 4318526 - DNA, 21 bp, Homo sapiens
ggtgactttggataataagga

SEQ ID NO: 4318527 - DNA, 16 bp, Homo sapiens
gtaaatcccattattc

SEQ ID NO: 4318528 - DNA, 12 bp, Homo sapiens
gtactttttggc

SEQ ID NO: 4318529 - DNA, 19 bp, Homo sapiens
gtataattaacatgttaaa

SEQ ID NO: 4318530 - DNA, 19 bp, Homo sapiens
gtatagaacctctttgtct

SEQ ID NO: 4318531 - DNA, 21 bp, Homo sapiens
gtattgtacaaagtattaagc

SEQ ID NO: 4318532 - DNA, 13 bp, Homo sapiens
gtctcagatttta

SEQ ID NO: 4318533 - DNA, 18 bp, Homo sapiens
gtcttgcctttttcatta

SEQ ID NO: 4318534 - DNA, 13 bp, Homo sapiens
gtgaatggctttg

SEQ ID NO: 4318535 - DNA, 18 bp, Homo sapiens
gtgaatggctttgtatag

SEQ ID NO: 4318536 - DNA, 15 bp, Homo sapiens
gtgactttggataat

SEQ ID NO: 4318537 - DNA, 21 bp, Homo sapiens
gtgcgctaaacttttctgata

SEQ ID NO: 4318538 - DNA, 14 bp, Homo sapiens
gtgctaaggacttg

SEQ ID NO: 4318539 - DNA, 22 bp, Homo sapiens
gtgctggggttatctgaagtca

SEQ ID NO: 4318540 - DNA, 13 bp, Homo sapiens
gtggtgactttgg

SEQ ID NO: 4318541 - DNA, 22 bp, Homo sapiens
gtgtaaatacaattttgtttct

SEQ ID NO: 4318542 - DNA, 21 bp, Homo sapiens
gtgttgaaacggatgatttct

SEQ ID NO: 4318543 - DNA, 22 bp, Homo sapiens
gttcatggaacgcgttgaaatt

SEQ ID NO: 4318544 - DNA, 21 bp, Homo sapiens
gttgaaacggatgatttctat

SEQ ID NO: 4318545 - DNA, 22 bp, Homo sapiens
gttgaatttattggcttttctg

SEQ ID NO: 4318546 - DNA, 15 bp, Homo sapiens
gttgcctaaatccat

SEQ ID NO: 4318547 - DNA, 17 bp, Homo sapiens
gttgcctaaatccattt

SEQ ID NO: 4318548 - DNA, 12 bp, Homo sapiens
gttgtttgttta

SEQ ID NO: 4318549 - DNA, 20 bp, Homo sapiens
gtttaatattaaagccatgt

SEQ ID NO: 4318550 - DNA, 18 bp, Homo sapiens
gtttagtcttgtctcaga

SEQ ID NO: 4318551 - DNA, 17 bp, Homo sapiens
gtttattacagtataat

SEQ ID NO: 4318552 - DNA, 15 bp, Homo sapiens
gtttctgtacttttt

SEQ ID NO: 4318553 - DNA, 18 bp, Homo sapiens
gtttggaccaaaaaccag

SEQ ID NO: 4318554 - DNA, 12 bp, Homo sapiens
gtttgtttagtc

SEQ ID NO: 4318555 - DNA, 14 bp, Homo sapiens
taaaaaaaaaattg

SEQ ID NO: 4318556 - DNA, 21 bp, Homo sapiens
taaaccatgggataaatgcca

SEQ ID NO: 4318557 - DNA, 22 bp, Homo sapiens
taaaccatgggataaatgccat

SEQ ID NO: 4318558 - DNA, 12 bp, Homo sapiens
ttctttaatttt

SEQ ID NO: 4318559 - DNA, 19 bp, Homo sapiens
ttgaaacggatgatttcta

SEQ ID NO: 4318560 - DNA, 14 bp, Homo sapiens
ttgcctaaatccat

SEQ ID NO: 4318561 - DNA, 15 bp, Homo sapiens
ttgcctttttcatta

SEQ ID NO: 4318562 - DNA, 12 bp, Homo sapiens
ttggaaatcttt

SEQ ID NO: 4318563 - DNA, 21 bp, Homo sapiens
ttggaccaaaaaccagtattg

SEQ ID NO: 4318564 - DNA, 21 bp, Homo sapiens
ttggataataaggaaaagttt

SEQ ID NO: 4318565 - DNA, 19 bp, Homo sapiens
ttggcataacataaatctg

SEQ ID NO: 4318566 - DNA, 20 bp, Homo sapiens
ttggcataacataaatctgt

SEQ ID NO: 4318567 - DNA, 22 bp, Homo sapiens
ttggcataacataaatctgtga

SEQ ID NO: 4318568 - DNA, 22 bp, Homo sapiens
ttggcttttctgatccagtttt

SEQ ID NO: 4318569 - DNA, 15 bp, Homo sapiens
ttgggtgtattgtgc

SEQ ID NO: 4318570 - DNA, 13 bp, Homo sapiens
ttgtacaaagtat

SEQ ID NO: 4318571 - DNA, 20 bp, Homo sapiens
ttgtacaaagtattaagcat

SEQ ID NO: 4318572 - DNA, 21 bp, Homo sapiens
ttgtacaaagtattaagcata

SEQ ID NO: 4318573 - DNA, 22 bp, Homo sapiens
ttgtacaaagtattaagcatat

SEQ ID NO: 4318574 - DNA, 14 bp, Homo sapiens
ttgtactcaatttt

SEQ ID NO: 4318575 - DNA, 15 bp, Homo sapiens
ttgtactcaatttta

SEQ ID NO: 4318576 - DNA, 20 bp, Homo sapiens
ttgtctacaccattatgtgc

SEQ ID NO: 4318577 - DNA, 13 bp, Homo sapiens
ttgtctcagattt

SEQ ID NO: 4318578 - DNA, 22 bp, Homo sapiens
ttgtgcgctaaacttttctgat

SEQ ID NO: 4318579 - DNA, 12 bp, Homo sapiens
ttgtttctgtac

SEQ ID NO: 4318580 - DNA, 14 bp, Homo sapiens
ttgtttctgtactt

SEQ ID NO: 4318581 - DNA, 21 bp, Homo sapiens
tttaaataaataaatagctag

SEQ ID NO: 4318582 - DNA, 14 bp, Homo sapiens
tttaatattaaagc

SEQ ID NO: 4318583 - DNA, 15 bp, Homo sapiens
tttaattttggaatt

SEQ ID NO: 4318584 - DNA, 17 bp, Homo sapiens
tttaattttggaatttt

SEQ ID NO: 4318585 - DNA, 15 bp, Homo sapiens
tttagtcttgtctca

SEQ ID NO: 4318586 - DNA, 13 bp, Homo sapiens
tttatgatccagc

SEQ ID NO: 4318587 - DNA, 22 bp, Homo sapiens
tttattacagtataattaacat

SEQ ID NO: 4318588 - DNA, 16 bp, Homo sapiens
tttattatgtaaatcc

SEQ ID NO: 4318589 - DNA, 19 bp, Homo sapiens
tttcattattttattatga

SEQ ID NO: 4318590 - DNA, 15 bp, Homo sapiens
tttctatattttcat

SEQ ID NO: 4318591 - DNA, 14 bp, Homo sapiens
tttctctttcgtta

SEQ ID NO: 4318592 - DNA, 15 bp, Homo sapiens
tttctgatccagttt

SEQ ID NO: 4318593 - DNA, 12 bp, Homo sapiens
tttgaattttgt

SEQ ID NO: 4318594 - DNA, 14 bp, Homo sapiens
tttgaattttgtgt

SEQ ID NO: 4318595 - DNA, 22 bp, Homo sapiens
tttggaattttcctcctttctc

SEQ ID NO: 4318596 - DNA, 22 bp, Homo sapiens
tttggaccaaaaaccagtattg

SEQ ID NO: 4318597 - DNA, 16 bp, Homo sapiens
tttggataataaggaa

SEQ ID NO: 4318598 - DNA, 20 bp, Homo sapiens
tttggcataacataaatctg

SEQ ID NO: 4318599 - DNA, 11 bp, Homo sapiens
tttgtatagaa

SEQ ID NO: 4318600 - DNA, 19 bp, Homo sapiens
tttgtgctggtgtatgtgt

SEQ ID NO: 4318601 - DNA, 14 bp, Homo sapiens
tttgttgtttgttt

SEQ ID NO: 4318602 - DNA, 13 bp, Homo sapiens
tttgtttctgtac

SEQ ID NO: 4318603 - DNA, 18 bp, Homo sapiens
tttgtttctgtacttttt

SEQ ID NO: 4318604 - DNA, 13 bp, Homo sapiens
ttttattatgtaa

SEQ ID NO: 4318605 - DNA, 14 bp, Homo sapiens
ttttattatgtaaa

SEQ ID NO: 4318606 - DNA, 15 bp, Homo sapiens
ttttcattattttat

SEQ ID NO: 4318607 - DNA, 18 bp, Homo sapiens
ttttgttgtttgtttagt

SEQ ID NO: 4318608 - DNA, 12 bp, Homo sapiens
ttttgtttctgt

SEQ ID NO: 4318609 - DNA, 20 bp, Homo sapiens
tttttatatttactaaaatg

SEQ ID NO: 4318610 - DNA, 13 bp, Homo sapiens
tttttcattattt

SEQ ID NO: 4318611 - DNA, 20 bp, Homo sapiens
aatagctagactggtgactg

SEQ ID NO: 4318612 - DNA, 13 bp, Homo sapiens
aatattaaagcca

SEQ ID NO: 4318613 - DNA, 14 bp, Homo sapiens
aatattaaagccat

SEQ ID NO: 4318614 - DNA, 15 bp, Homo sapiens
aatattaaagccatg

SEQ ID NO: 4318615 - DNA, 18 bp, Homo sapiens
aatattaaagccatgttt

SEQ ID NO: 4318616 - DNA, 21 bp, Homo sapiens
aatcccattattcaaagttgc

SEQ ID NO: 4318617 - DNA, 18 bp, Homo sapiens
aatctgtgaacttgaaat

SEQ ID NO: 4318618 - DNA, 19 bp, Homo sapiens
aatctgtgaacttgaaatt

SEQ ID NO: 4318619 - DNA, 20 bp, Homo sapiens
aatctttaaaaaaaaaattg

SEQ ID NO: 4318620 - DNA, 16 bp, Homo sapiens
aatgccatcaataaaa

SEQ ID NO: 4318621 - DNA, 23 bp, Homo sapiens
aatgccatcaataaaaaattatg

SEQ ID NO: 4318622 - DNA, 18 bp, Homo sapiens
aattaacatgttaaacca

SEQ ID NO: 4318623 - DNA, 20 bp, Homo sapiens
aattatatctgaggaattct

SEQ ID NO: 4318624 - DNA, 21 bp, Homo sapiens
aattatatgctatttctatat

SEQ ID NO: 4318625 - DNA, 14 bp, Homo sapiens
aattgtaattatat

SEQ ID NO: 4318626 - DNA, 16 bp, Homo sapiens
aattgtaattatatct

SEQ ID NO: 4318627 - DNA, 19 bp, Homo sapiens
aatttattggcttttctga

SEQ ID NO: 4318628 - DNA, 14 bp, Homo sapiens
aattttgtttctgt

SEQ ID NO: 4318629 - DNA, 13 bp, Homo sapiens
acaaagtattaag

SEQ ID NO: 4318630 - DNA, 15 bp, Homo sapiens
acaaagtattaagca

SEQ ID NO: 4318631 - DNA, 20 bp, Homo sapiens
acaaagtattaagcatatat

SEQ ID NO: 4318632 - DNA, 15 bp, Homo sapiens
acaacagctggtgcc

SEQ ID NO: 4318633 - DNA, 18 bp, Homo sapiens
acaattttgtttctgtac

SEQ ID NO: 4318634 - DNA, 20 bp, Homo sapiens
acagctggtgccctgctttc

SEQ ID NO: 4318635 - DNA, 15 bp, Homo sapiens
acagtataattaaca

SEQ ID NO: 4318636 - DNA, 20 bp, Homo sapiens
acagtataattaacatgtta

SEQ ID NO: 4318637 - DNA, 14 bp, Homo sapiens
acataaatctgtga

SEQ ID NO: 4318638 - DNA, 18 bp, Homo sapiens
acataaatctgtgaactt

SEQ ID NO: 4318639 - DNA, 20 bp, Homo sapiens
acatagtctggctgtaccca

SEQ ID NO: 4318640 - DNA, 16 bp, Homo sapiens
acattggtgttgtact

SEQ ID NO: 4318641 - DNA, 22 bp, Homo sapiens
acattggtgttgtactcaattt

SEQ ID NO: 4318642 - DNA, 23 bp, Homo sapiens
acattggtgttgtactcaatttt

SEQ ID NO: 4318643 - DNA, 14 bp, Homo sapiens
accagtattgtaca

SEQ ID NO: 4318644 - DNA, 23 bp, Homo sapiens
accagtattgtacaaagtattaa

SEQ ID NO: 4318645 - DNA, 21 bp, Homo sapiens
acctgtcttgcctttttcatt

SEQ ID NO: 4318646 - DNA, 14 bp, Homo sapiens
acggatgatttcta

SEQ ID NO: 4318647 - DNA, 15 bp, Homo sapiens
acggatgatttctat

SEQ ID NO: 4318648 - DNA, 16 bp, Homo sapiens
acggtgaatggctttg

SEQ ID NO: 4318649 - DNA, 15 bp, Homo sapiens
actcaattttaacaa

SEQ ID NO: 4318650 - DNA, 13 bp, Homo sapiens
actgattcttcag

SEQ ID NO: 4318651 - DNA, 22 bp, Homo sapiens
actgattcttcagcaaaaatat

SEQ ID NO: 4318652 - DNA, 22 bp, Homo sapiens
actgatttgacatagtctggct

SEQ ID NO: 4318653 - DNA, 16 bp, Homo sapiens
actggtgactgattct

SEQ ID NO: 4318654 - DNA, 20 bp, Homo sapiens
actggtgactgattcttcag

SEQ ID NO: 4318655 - DNA, 14 bp, Homo sapiens
actgtggtgacttt

SEQ ID NO: 4318656 - DNA, 21 bp, Homo sapiens
acttctttaattttggaattt

SEQ ID NO: 4318657 - DNA, 22 bp, Homo sapiens
acttgtgtaaatacaattttgt

SEQ ID NO: 4318658 - DNA, 12 bp, Homo sapiens
actttggataat

SEQ ID NO: 4318659 - DNA, 22 bp, Homo sapiens
agaacctctttgtctacaccat

SEQ ID NO: 4318660 - DNA, 12 bp, Homo sapiens
agactggtgact

SEQ ID NO: 4318661 - DNA, 15 bp, Homo sapiens
agagagtgttgaaac

SEQ ID NO: 4318662 - DNA, 23 bp, Homo sapiens
agagatttttttgttgtttgttt

SEQ ID NO: 4318663 - DNA, 18 bp, Homo sapiens
agatctgcctaaggactt

SEQ ID NO: 4318664 - DNA, 17 bp, Homo sapiens
agattttattatgtaaa

SEQ ID NO: 4318665 - DNA, 18 bp, Homo sapiens
agatttttttgttgtttg

SEQ ID NO: 4318666 - DNA, 17 bp, Homo sapiens
agcaaaaatattttatg

SEQ ID NO: 4318667 - DNA, 19 bp, Homo sapiens
agcaaaaatattttatgat

SEQ ID NO: 4318668 - DNA, 15 bp, Homo sapiens
agcagattattcact

SEQ ID NO: 4318669 - DNA, 20 bp, Homo sapiens
agcagattattcactgattt

SEQ ID NO: 4318670 - DNA, 22 bp, Homo sapiens
agccatgtttattacagtataa

SEQ ID NO: 4318671 - DNA, 13 bp, Homo sapiens
agctagactggtg

SEQ ID NO: 4318672 - DNA, 14 bp, Homo sapiens
agctggtgccctgc

SEQ ID NO: 4318673 - DNA, 23 bp, Homo sapiens
aggaaaagtttaatattaaagcc

SEQ ID NO: 4318674 - DNA, 17 bp, Homo sapiens
aggaagcctgattaaag

SEQ ID NO: 4318675 - DNA, 13 bp, Homo sapiens
aggaattctgtat

SEQ ID NO: 4318676 - DNA, 16 bp, Homo sapiens
aggacttctttaattt

SEQ ID NO: 4318677 - DNA, 14 bp, Homo sapiens
aggacttgttagat

SEQ ID NO: 4318678 - DNA, 14 bp, Homo sapiens
agtattaagcatat

SEQ ID NO: 4318679 - DNA, 17 bp, Homo sapiens
agtcagatctgcctaag

SEQ ID NO: 4318680 - DNA, 22 bp, Homo sapiens
agtcagatctgcctaaggactt

SEQ ID NO: 4318681 - DNA, 21 bp, Homo sapiens
agtcttgtctcagattttatt

SEQ ID NO: 4318682 - DNA, 19 bp, Homo sapiens
agtgagttgggtgtattgt

SEQ ID NO: 4318683 - DNA, 11 bp, Homo sapiens
agttgaattta

SEQ ID NO: 4318684 - DNA, 13 bp, Homo sapiens
agttgaatttatt

SEQ ID NO: 4318685 - DNA, 22 bp, Homo sapiens
agttgcctaaatccatttggaa

SEQ ID NO: 4318686 - DNA, 17 bp, Homo sapiens
agttgggtgtattgtgc

SEQ ID NO: 4318687 - DNA, 18 bp, Homo sapiens
agtttaatattaaagcca

SEQ ID NO: 4318688 - DNA, 20 bp, Homo sapiens
agtttaatattaaagccatg

SEQ ID NO: 4318689 - DNA, 12 bp, Homo sapiens
agttttgtttgg

SEQ ID NO: 4318690 - DNA, 16 bp, Homo sapiens
ataaaaaattatgaca

SEQ ID NO: 4318691 - DNA, 17 bp, Homo sapiens
ataaatgccatcaataa

SEQ ID NO: 4318692 - DNA, 18 bp, Homo sapiens
ataaatgccatcaataaa

SEQ ID NO: 4318693 - DNA, 19 bp, Homo sapiens
ataataaggaaaagtttaa

SEQ ID NO: 4318694 - DNA, 20 bp, Homo sapiens
ataattaacatgttaaacca

SEQ ID NO: 4318695 - DNA, 23 bp, Homo sapiens
ataattatatgctatttctatat

SEQ ID NO: 4318696 - DNA, 14 bp, Homo sapiens
atacaattttgttt

SEQ ID NO: 4318697 - DNA, 15 bp, Homo sapiens
atactggattgtact

SEQ ID NO: 4318698 - DNA, 14 bp, Homo sapiens
atagaacctctttg

SEQ ID NO: 4318699 - DNA, 13 bp, Homo sapiens
atagattagaatt

SEQ ID NO: 4318700 - DNA, 16 bp, Homo sapiens
atagattagaattctg

SEQ ID NO: 4318701 - DNA, 14 bp, Homo sapiens
atagctagactggt

SEQ ID NO: 4318702 - DNA, 13 bp, Homo sapiens
atagtctggctgt

SEQ ID NO: 4318703 - DNA, 20 bp, Homo sapiens
atatatttttatatttacta

SEQ ID NO: 4318704 - DNA, 16 bp, Homo sapiens
atatctgaggaattct

SEQ ID NO: 4318705 - DNA, 17 bp, Homo sapiens
atatctgaggaattctg

SEQ ID NO: 4318706 - DNA, 21 bp, Homo sapiens
atatctgaggaattctgtata

SEQ ID NO: 4318707 - DNA, 22 bp, Homo sapiens
atatctgaggaattctgtatag

SEQ ID NO: 4318708 - DNA, 13 bp, Homo sapiens
atattttatgatc

SEQ ID NO: 4318709 - DNA, 13 bp, Homo sapiens
atattttcattct

SEQ ID NO: 4318710 - DNA, 15 bp, Homo sapiens
atcaataaaaaatta

SEQ ID NO: 4318711 - DNA, 18 bp, Homo sapiens
atccagcagattattcac

SEQ ID NO: 4318712 - DNA, 21 bp, Homo sapiens
atccagttttgtttggaccaa

SEQ ID NO: 4318713 - DNA, 17 bp, Homo sapiens
atccatttggaaatctt

SEQ ID NO: 4318714 - DNA, 21 bp, Homo sapiens
atccatttggaaatctttaaa

SEQ ID NO: 4318715 - DNA, 15 bp, Homo sapiens
atcccattattcaaa

SEQ ID NO: 4318716 - DNA, 20 bp, Homo sapiens
atcccattattcaaagttgc

SEQ ID NO: 4318717 - DNA, 16 bp, Homo sapiens
atctgaggaattctgt

SEQ ID NO: 4318718 - DNA, 23 bp, Homo sapiens
atctgcctaaggacttctttaat

SEQ ID NO: 4318719 - DNA, 17 bp, Homo sapiens
atctgtgaacttgaaat

SEQ ID NO: 4318720 - DNA, 19 bp, Homo sapiens
atctgtgaacttgaaattt

SEQ ID NO: 4318721 - DNA, 10 bp, Homo sapiens
atgatccagc

SEQ ID NO: 4318722 - DNA, 22 bp, Homo sapiens
atgatccagcagattattcact

SEQ ID NO: 4318723 - DNA, 13 bp, Homo sapiens
atgctatttctat

SEQ ID NO: 4318724 - DNA, 15 bp, Homo sapiens
atgctatttctatat

SEQ ID NO: 4318725 - DNA, 21 bp, Homo sapiens
atgctatttctatattttcat

SEQ ID NO: 4318726 - DNA, 23 bp, Homo sapiens
atggaacgcgttgaaattgtaat

SEQ ID NO: 4318727 - DNA, 17 bp, Homo sapiens
atggactgtggtgactt

SEQ ID NO: 4318728 - DNA, 22 bp, Homo sapiens
atggactgtggtgactttggat

SEQ ID NO: 4318729 - DNA, 19 bp, Homo sapiens
atggctttgtatagaacct

SEQ ID NO: 4318730 - DNA, 16 bp, Homo sapiens
atgggataaatgccat

SEQ ID NO: 4318731 - DNA, 13 bp, Homo sapiens
taaagttgaattt

SEQ ID NO: 4318732 - DNA, 15 bp, Homo sapiens
taaagttgaatttat

SEQ ID NO: 4318733 - DNA, 19 bp, Homo sapiens
taaagttgaatttattggc

SEQ ID NO: 4318734 - DNA, 23 bp, Homo sapiens
taaagttgaatttattggctttt

SEQ ID NO: 4318735 - DNA, 14 bp, Homo sapiens
taaataaatagcta

SEQ ID NO: 4318736 - DNA, 13 bp, Homo sapiens
taaatacaatttt

SEQ ID NO: 4318737 - DNA, 19 bp, Homo sapiens
taaatagctagactggtga

SEQ ID NO: 4318738 - DNA, 15 bp, Homo sapiens
taaatccatttggaa

SEQ ID NO: 4318739 - DNA, 18 bp, Homo sapiens
taaatccatttggaaatc

SEQ ID NO: 4318740 - DNA, 22 bp, Homo sapiens
taaatccatttggaaatcttta

SEQ ID NO: 4318741 - DNA, 23 bp, Homo sapiens
taaatcccattattcaaagttgc

SEQ ID NO: 4318742 - DNA, 17 bp, Homo sapiens
taaatctgtgaacttga

SEQ ID NO: 4318743 - DNA, 18 bp, Homo sapiens
taaatctgtgaacttgaa

SEQ ID NO: 4318744 - DNA, 22 bp, Homo sapiens
taaatctgtgaacttgaaattt

SEQ ID NO: 4318745 - DNA, 16 bp, Homo sapiens
taacaacagctggtgc

SEQ ID NO: 4318746 - DNA, 12 bp, Homo sapiens
taacataaatct

SEQ ID NO: 4318747 - DNA, 14 bp, Homo sapiens
taacataaatctgt

SEQ ID NO: 4318748 - DNA, 15 bp, Homo sapiens
taacataaatctgtg

SEQ ID NO: 4318749 - DNA, 16 bp, Homo sapiens
taacataaatctgtga

SEQ ID NO: 4318750 - DNA, 20 bp, Homo sapiens
taacataaatctgtgaactt

SEQ ID NO: 4318751 - DNA, 17 bp, Homo sapiens
taacatgttaaaccatg

SEQ ID NO: 4318752 - DNA, 18 bp, Homo sapiens
taacatgttaaaccatgg

SEQ ID NO: 4318753 - DNA, 17 bp, Homo sapiens
taaggaaaagtttaata

SEQ ID NO: 4318754 - DNA, 14 bp, Homo sapiens
taaggacttcttta

SEQ ID NO: 4318755 - DNA, 19 bp, Homo sapiens
taataattatatgctattt

SEQ ID NO: 4318756 - DNA, 14 bp, Homo sapiens
taatattaaagcca

SEQ ID NO: 4318757 - DNA, 16 bp, Homo sapiens
taatattaaagccatg

SEQ ID NO: 4318758 - DNA, 21 bp, Homo sapiens
taattaacatgttaaaccatg

SEQ ID NO: 4318759 - DNA, 22 bp, Homo sapiens
taattatatctgaggaattctg

SEQ ID NO: 4318760 - DNA, 23 bp, Homo sapiens
taattatatctgaggaattctgt

SEQ ID NO: 4318761 - DNA, 14 bp, Homo sapiens
taattatatgctat

SEQ ID NO: 4318762 - DNA, 13 bp, Homo sapiens
tacaaagtattaa

SEQ ID NO: 4318763 - DNA, 14 bp, Homo sapiens
tacaaagtattaag

SEQ ID NO: 4318764 - DNA, 16 bp, Homo sapiens
tacaaagtattaagca

SEQ ID NO: 4318765 - DNA, 15 bp, Homo sapiens
tacaattttgtttct

SEQ ID NO: 4318766 - DNA, 19 bp, Homo sapiens
tacaattttgtttctgtac

SEQ ID NO: 4318767 - DNA, 14 bp, Homo sapiens
tacagtataattaa

SEQ ID NO: 4318768 - DNA, 23 bp, Homo sapiens
tacagtataattaacatgttaaa

SEQ ID NO: 4318769 - DNA, 22 bp, Homo sapiens
tactttgtgctggggttatctg

SEQ ID NO: 4318770 - DNA, 19 bp, Homo sapiens
tactttttggcataacata

SEQ ID NO: 4318771 - DNA, 14 bp, Homo sapiens
tagaacctctttgt

SEQ ID NO: 4318772 - DNA, 14 bp, Homo sapiens
tagaattctgtata

SEQ ID NO: 4318773 - DNA, 13 bp, Homo sapiens
tagactggtgact

SEQ ID NO: 4318774 - DNA, 23 bp, Homo sapiens
tagactggtgactgattcttcag

SEQ ID NO: 4318775 - DNA, 14 bp, Homo sapiens
tagagagtgttgaa

SEQ ID NO: 4318776 - DNA, 14 bp, Homo sapiens
tagatctagttcac

SEQ ID NO: 4318777 - DNA, 17 bp, Homo sapiens
tagattagaattctgta

SEQ ID NO: 4318778 - DNA, 19 bp, Homo sapiens
tagattagaattctgtata

SEQ ID NO: 4318779 - DNA, 15 bp, Homo sapiens
tagctagactggtga

SEQ ID NO: 4318780 - DNA, 18 bp, Homo sapiens
tagctagactggtgactg

SEQ ID NO: 4318781 - DNA, 21 bp, Homo sapiens
tagctagactggtgactgatt

SEQ ID NO: 4318782 - DNA, 22 bp, Homo sapiens
tagctagactggtgactgattc

SEQ ID NO: 4318783 - DNA, 17 bp, Homo sapiens
tagtcttgtctcagatt

SEQ ID NO: 4318784 - DNA, 22 bp, Homo sapiens
tagtcttgtctcagattttatt

SEQ ID NO: 4318785 - DNA, 14 bp, Homo sapiens
tataattaacatgt

SEQ ID NO: 4318786 - DNA, 19 bp, Homo sapiens
tataattaacatgttaaac

SEQ ID NO: 4318787 - DNA, 20 bp, Homo sapiens
tatagattagaattctgtat

SEQ ID NO: 4318788 - DNA, 19 bp, Homo sapiens
tatatctgaggaattctgt

SEQ ID NO: 4318789 - DNA, 23 bp, Homo sapiens
tatatctgaggaattctgtatag

SEQ ID NO: 4318790 - DNA, 16 bp, Homo sapiens
tatatgctatttctat

SEQ ID NO: 4318791 - DNA, 19 bp, Homo sapiens
tatatttactaaaatggac

SEQ ID NO: 4318792 - DNA, 20 bp, Homo sapiens
tatatttactaaaatggact

SEQ ID NO: 4318793 - DNA, 19 bp, Homo sapiens
tatatttttatatttacta

SEQ ID NO: 4318794 - DNA, 16 bp, Homo sapiens
tatctgaggaattctg

SEQ ID NO: 4318795 - DNA, 21 bp, Homo sapiens
tatctgaggaattctgtatag

SEQ ID NO: 4318796 - DNA, 19 bp, Homo sapiens
tatgaaacttgtgtaaata

SEQ ID NO: 4318797 - DNA, 21 bp, Homo sapiens
tatgaaacttgtgtaaataca

SEQ ID NO: 4318798 - DNA, 19 bp, Homo sapiens
tatgatccagcagattatt

SEQ ID NO: 4318799 - DNA, 23 bp, Homo sapiens
tatgctatttctatattttcatt

SEQ ID NO: 4318800 - DNA, 18 bp, Homo sapiens
tattaaagccatgtttat

SEQ ID NO: 4318801 - DNA, 18 bp, Homo sapiens
tattacagtataattaac

SEQ ID NO: 4318802 - DNA, 20 bp, Homo sapiens
tattacagtataattaacat

SEQ ID NO: 4318803 - DNA, 12 bp, Homo sapiens
tattatgaaact

SEQ ID NO: 4318804 - DNA, 22 bp, Homo sapiens
tattatgaaacttgtgtaaata

SEQ ID NO: 4318805 - DNA, 22 bp, Homo sapiens
tattcaaagttgcctaaatcca

SEQ ID NO: 4318806 - DNA, 23 bp, Homo sapiens
tattcaaagttgcctaaatccat

SEQ ID NO: 4318807 - DNA, 21 bp, Homo sapiens
tattggcttttctgatccagt

SEQ ID NO: 4318808 - DNA, 23 bp, Homo sapiens
tattgtacaaagtattaagcata

SEQ ID NO: 4318809 - DNA, 19 bp, Homo sapiens
tattgtgcgctaaactttt

SEQ ID NO: 4318810 - DNA, 23 bp, Homo sapiens
tattttattatgaaacttgtgta

SEQ ID NO: 4318811 - DNA, 14 bp, Homo sapiens
tcaataaaaaatta

SEQ ID NO: 4318812 - DNA, 16 bp, Homo sapiens
tcaataaaaaattatg

SEQ ID NO: 4318813 - DNA, 19 bp, Homo sapiens
tcacctgtcttgccttttt

SEQ ID NO: 4318814 - DNA, 19 bp, Homo sapiens
tcagatactggattgtact

SEQ ID NO: 4318815 - DNA, 20 bp, Homo sapiens
tcagatctgcctaaggactt

SEQ ID NO: 4318816 - DNA, 14 bp, Homo sapiens
tcagattttattat

SEQ ID NO: 4318817 - DNA, 15 bp, Homo sapiens
tcagattttattatg

SEQ ID NO: 4318818 - DNA, 16 bp, Homo sapiens
tcagattttattatgt

SEQ ID NO: 4318819 - DNA, 20 bp, Homo sapiens
tcagattttattatgtaaat

SEQ ID NO: 4318820 - DNA, 22 bp, Homo sapiens
tcagattttattatgtaaatcc

SEQ ID NO: 4318821 - DNA, 19 bp, Homo sapiens
tcagcaaaaatattttatg

SEQ ID NO: 4318822 - DNA, 21 bp, Homo sapiens
tcatggaacgcgttgaaattg

SEQ ID NO: 4318823 - DNA, 23 bp, Homo sapiens
tcattattttattatgaaacttg

SEQ ID NO: 4318824 - DNA, 15 bp, Homo sapiens
tccagcagattattc

SEQ ID NO: 4318825 - DNA, 20 bp, Homo sapiens
tccagcagattattcactga

SEQ ID NO: 4318826 - DNA, 22 bp, Homo sapiens
tccagcagattattcactgatt

SEQ ID NO: 4318827 - DNA, 17 bp, Homo sapiens
tccagttttgtttggac

SEQ ID NO: 4318828 - DNA, 12 bp, Homo sapiens
tccatttaataa

SEQ ID NO: 4318829 - DNA, 12 bp, Homo sapiens
tccatttggaaa

SEQ ID NO: 4318830 - DNA, 19 bp, Homo sapiens
tccatttggaaatctttaa

SEQ ID NO: 4318831 - DNA, 20 bp, Homo sapiens
tccatttggaaatctttaaa

SEQ ID NO: 4318832 - DNA, 13 bp, Homo sapiens
tcccattattcaa

SEQ ID NO: 4318833 - DNA, 14 bp, Homo sapiens
tccgtgctaaggac

SEQ ID NO: 4318834 - DNA, 23 bp, Homo sapiens
tccgtgctaaggacttgttagat

SEQ ID NO: 4318835 - DNA, 14 bp, Homo sapiens
tctatattttcatt

SEQ ID NO: 4318836 - DNA, 15 bp, Homo sapiens
tctatattttcattc

SEQ ID NO: 4318837 - DNA, 19 bp, Homo sapiens
tctatattttcattctcct

SEQ ID NO: 4318838 - DNA, 16 bp, Homo sapiens
tctatgctgagtttgt

SEQ ID NO: 4318839 - DNA, 20 bp, Homo sapiens
tctatgctgagtttgtgctg

SEQ ID NO: 4318840 - DNA, 13 bp, Homo sapiens
tctcagattttat

SEQ ID NO: 4318841 - DNA, 16 bp, Homo sapiens
tctcagattttattat

SEQ ID NO: 4318842 - DNA, 19 bp, Homo sapiens
tctcagattttattatgta

SEQ ID NO: 4318843 - DNA, 22 bp, Homo sapiens
tctcagattttattatgtaaat

SEQ ID NO: 4318844 - DNA, 12 bp, Homo sapiens
tctccatttaat

SEQ ID NO: 4318845 - DNA, 16 bp, Homo sapiens
tctccatttaataatt

SEQ ID NO: 4318846 - DNA, 19 bp, Homo sapiens
tctgaagtcagatctgcct

SEQ ID NO: 4318847 - DNA, 15 bp, Homo sapiens
tctgaggaattctgt

SEQ ID NO: 4318848 - DNA, 18 bp, Homo sapiens
tctgaggaattctgtata

SEQ ID NO: 4318849 - DNA, 11 bp, Homo sapiens
tctgatccagt

SEQ ID NO: 4318850 - DNA, 18 bp, Homo sapiens
agagggactgtatttctg

SEQ ID NO: 4318851 - DNA, 17 bp, Homo sapiens
agagggagacagagatg

SEQ ID NO: 4318852 - DNA, 20 bp, Homo sapiens
agaggtggccctcccaggct

SEQ ID NO: 4318853 - DNA, 18 bp, Homo sapiens
agagtatattatgtattt

SEQ ID NO: 4318854 - DNA, 20 bp, Homo sapiens
agagtcagccattcctgttc

SEQ ID NO: 4318855 - DNA, 20 bp, Homo sapiens
agagtggtaaaaaagaaatg

SEQ ID NO: 4318856 - DNA, 14 bp, Homo sapiens
agagtgtgcctgaa

SEQ ID NO: 4318857 - DNA, 15 bp, Homo sapiens
agagtttgtgtgtat

SEQ ID NO: 4318858 - DNA, 18 bp, Homo sapiens
agagtttgtgtgtatttg

SEQ ID NO: 4318859 - DNA, 23 bp, Homo sapiens
agagtttgtgtgtatttgtatta

SEQ ID NO: 4318860 - DNA, 17 bp, Homo sapiens
agataagacttgtttct

SEQ ID NO: 4318861 - DNA, 21 bp, Homo sapiens
agatacagatggagcaaatgt

SEQ ID NO: 4318862 - DNA, 13 bp, Homo sapiens
agatagaatttcc

SEQ ID NO: 4318863 - DNA, 21 bp, Homo sapiens
agatattactacttaccattt

SEQ ID NO: 4318864 - DNA, 16 bp, Homo sapiens
agatcacgctccccgc

SEQ ID NO: 4318865 - DNA, 21 bp, Homo sapiens
agatcacgctccccgcctgtt

SEQ ID NO: 4318866 - DNA, 13 bp, Homo sapiens
agatcagcctggg

SEQ ID NO: 4318867 - DNA, 12 bp, Homo sapiens
agatcagggata

SEQ ID NO: 4318868 - DNA, 12 bp, Homo sapiens
agatgaaataat

SEQ ID NO: 4318869 - DNA, 14 bp, Homo sapiens
agatgaaataattt

SEQ ID NO: 4318870 - DNA, 11 bp, Homo sapiens
agatgccaaaa

SEQ ID NO: 4318871 - DNA, 23 bp, Homo sapiens
agatgcccgcacagtaatgtaga

SEQ ID NO: 4318872 - DNA, 16 bp, Homo sapiens
agatgcttctcactgc

SEQ ID NO: 4318873 - DNA, 14 bp, Homo sapiens
agatggagaggaag

SEQ ID NO: 4318874 - DNA, 15 bp, Homo sapiens
agatggagaggaaga

SEQ ID NO: 4318875 - DNA, 17 bp, Homo sapiens
agatggagaggaagaaa

SEQ ID NO: 4318876 - DNA, 16 bp, Homo sapiens
agatgggggcaagaag

SEQ ID NO: 4318877 - DNA, 21 bp, Homo sapiens
agatgttcaatagaacatgca

SEQ ID NO: 4318878 - DNA, 17 bp, Homo sapiens
agatgttccaaatttag

SEQ ID NO: 4318879 - DNA, 19 bp, Homo sapiens
agatgtttaatgaagtcac

SEQ ID NO: 4318880 - DNA, 13 bp, Homo sapiens
agattaggctgag

SEQ ID NO: 4318881 - DNA, 16 bp, Homo sapiens
agattggatttgctgt

SEQ ID NO: 4318882 - DNA, 16 bp, Homo sapiens
atcatatataaaagtc

SEQ ID NO: 4318883 - DNA, 18 bp, Homo sapiens
atcatatgaccattgaaa

SEQ ID NO: 4318884 - DNA, 19 bp, Homo sapiens
atcatatgaccattgaaaa

SEQ ID NO: 4318885 - DNA, 23 bp, Homo sapiens
atcatatgaccattgaaaaagga

SEQ ID NO: 4318886 - DNA, 23 bp, Homo sapiens
atcatgtctgtatccccagtgcc

SEQ ID NO: 4318887 - DNA, 18 bp, Homo sapiens
atcatttggcttgctgtt

SEQ ID NO: 4318888 - DNA, 24 bp, Homo sapiens
atccatgacaggcctgaagatatt

SEQ ID NO: 4318889 - DNA, 13 bp, Homo sapiens
atccatgcttcac

SEQ ID NO: 4318890 - DNA, 15 bp, Homo sapiens
atccatgcttcactc

SEQ ID NO: 4318891 - DNA, 16 bp, Homo sapiens
atccattacgtgcatt

SEQ ID NO: 4318892 - DNA, 18 bp, Homo sapiens
atccattacgtgcattta

SEQ ID NO: 4318893 - DNA, 20 bp, Homo sapiens
atccattacgtgcatttaaa

SEQ ID NO: 4318894 - DNA, 22 bp, Homo sapiens
atccattacgtgcatttaaact

SEQ ID NO: 4318895 - DNA, 23 bp, Homo sapiens
atccattacgtgcatttaaactc

SEQ ID NO: 4318896 - DNA, 14 bp, Homo sapiens
atcccctctctgtg

SEQ ID NO: 4318897 - DNA, 15 bp, Homo sapiens
atcccctgtagagtg

SEQ ID NO: 4318898 - DNA, 21 bp, Homo sapiens
atcccgtaagaccaccttccc

SEQ ID NO: 4318899 - DNA, 15 bp, Homo sapiens
atcccttcctcctct

SEQ ID NO: 4318900 - DNA, 21 bp, Homo sapiens
atcccttcctcctctcctgga

SEQ ID NO: 4318901 - DNA, 15 bp, Homo sapiens
atcctacagtacaat

SEQ ID NO: 4318902 - DNA, 18 bp, Homo sapiens
atcctacgctatgtagaa

SEQ ID NO: 4318903 - DNA, 16 bp, Homo sapiens
atcctagccccaccca

SEQ ID NO: 4318904 - DNA, 16 bp, Homo sapiens
atcctaggcatttgct

SEQ ID NO: 4318905 - DNA, 21 bp, Homo sapiens
atcctaggcatttgctgaata

SEQ ID NO: 4318906 - DNA, 14 bp, Homo sapiens
atcctctcctttga

SEQ ID NO: 4318907 - DNA, 16 bp, Homo sapiens
atcctctcctttgaaa

SEQ ID NO: 4318908 - DNA, 16 bp, Homo sapiens
atcgcaacatgaattt

SEQ ID NO: 4318909 - DNA, 13 bp, Homo sapiens
atcgcagcttcct

SEQ ID NO: 4318910 - DNA, 21 bp, Homo sapiens
atcgctcgtgtgttctatcca

SEQ ID NO: 4318911 - DNA, 23 bp, Homo sapiens
atcgctcgtgtgttctatccaaa

SEQ ID NO: 4318912 - DNA, 11 bp, Homo sapiens
atcggaagaac

SEQ ID NO: 4318913 - DNA, 20 bp, Homo sapiens
atctaaagctttatctttgt

SEQ ID NO: 4318914 - DNA, 21 bp, Homo sapiens
atctaatgagttgctggaaaa

SEQ ID NO: 4318915 - DNA, 15 bp, Homo sapiens
atctatattaaatga

SEQ ID NO: 4318916 - DNA, 19 bp, Homo sapiens
atctatcggaagaacatga

SEQ ID NO: 4318917 - DNA, 15 bp, Homo sapiens
atctatgatatattt

SEQ ID NO: 4318918 - DNA, 23 bp, Homo sapiens
atctatgatatatttatatcata

SEQ ID NO: 4318919 - DNA, 18 bp, Homo sapiens
atctatttatatatcata

SEQ ID NO: 4318920 - DNA, 16 bp, Homo sapiens
atctcccagatcctgg

SEQ ID NO: 4318921 - DNA, 18 bp, Homo sapiens
atctcttgagcctgggag

SEQ ID NO: 4318922 - DNA, 18 bp, Homo sapiens
atctgccgctttgtctgt

SEQ ID NO: 4318923 - DNA, 22 bp, Homo sapiens
atctgccgctttgtctgtccag

SEQ ID NO: 4318924 - DNA, 14 bp, Homo sapiens
atctgcctgtaatt

SEQ ID NO: 4318925 - DNA, 20 bp, Homo sapiens
atctgcctgtaattaaacta

SEQ ID NO: 4318926 - DNA, 18 bp, Homo sapiens
atctggcacgtggccagg

SEQ ID NO: 4318927 - DNA, 20 bp, Homo sapiens
atctggcacgtggccaggag

SEQ ID NO: 4318928 - DNA, 22 bp, Homo sapiens
atctgggtctactcaaacactt

SEQ ID NO: 4318929 - DNA, 18 bp, Homo sapiens
atctgtactttgtgttta

SEQ ID NO: 4318930 - DNA, 20 bp, Homo sapiens
atcttaagaggatggatgaa

SEQ ID NO: 4318931 - DNA, 23 bp, Homo sapiens
atcttaagaggatggatgaatct

SEQ ID NO: 4318932 - DNA, 19 bp, Homo sapiens
atcttccaactcaaactct

SEQ ID NO: 4318933 - DNA, 11 bp, Homo sapiens
atcttgtgaaa

SEQ ID NO: 4318934 - DNA, 15 bp, Homo sapiens
atcttgtgaaatggc

SEQ ID NO: 4318935 - DNA, 20 bp, Homo sapiens
atcttgttattaatgtttct

SEQ ID NO: 4318936 - DNA, 12 bp, Homo sapiens
atctttcctgtc

SEQ ID NO: 4318937 - DNA, 21 bp, Homo sapiens
atctttgtttaaatgccaaaa

SEQ ID NO: 4318938 - DNA, 18 bp, Homo sapiens
atgaaatcatagtatatg

SEQ ID NO: 4318939 - DNA, 16 bp, Homo sapiens
atgaactactgctatt

SEQ ID NO: 4318940 - DNA, 15 bp, Homo sapiens
atgaagctggccctc

SEQ ID NO: 4318941 - DNA, 17 bp, Homo sapiens
atgaagctggccctcag

SEQ ID NO: 4318942 - DNA, 13 bp, Homo sapiens
atgaatattttga

SEQ ID NO: 4318943 - DNA, 16 bp, Homo sapiens
atgaatggacaaagct

SEQ ID NO: 4318944 - DNA, 20 bp, Homo sapiens
atgaatttttatgatttctt

SEQ ID NO: 4318945 - DNA, 17 bp, Homo sapiens
atgacacagcttgtgaa

SEQ ID NO: 4318946 - DNA, 19 bp, Homo sapiens
atgaccattgaaaaaggaa

SEQ ID NO: 4318947 - DNA, 12 bp, Homo sapiens
atgactattgta

SEQ ID NO: 4318948 - DNA, 13 bp, Homo sapiens
atgactattgtaa

SEQ ID NO: 4318949 - DNA, 17 bp, Homo sapiens
atgactgtgaactgggc

SEQ ID NO: 4318950 - DNA, 15 bp, Homo sapiens
atgacttttattatg

SEQ ID NO: 4318951 - DNA, 16 bp, Homo sapiens
atgagaatctgtgcag

SEQ ID NO: 4318952 - DNA, 13 bp, Homo sapiens
atgagcaaaacat

SEQ ID NO: 4318953 - DNA, 11 bp, Homo sapiens
atgagcctggc

SEQ ID NO: 4318954 - DNA, 13 bp, Homo sapiens
atgagcctggcaa

SEQ ID NO: 4318955 - DNA, 23 bp, Homo sapiens
atgagtaggatgtctcttggaaa

SEQ ID NO: 4318956 - DNA, 18 bp, Homo sapiens
atgagttacttagaatgc

SEQ ID NO: 4318957 - DNA, 14 bp, Homo sapiens
atgagtttgcttat

SEQ ID NO: 4318958 - DNA, 20 bp, Homo sapiens
atgataactactgacgaaag

SEQ ID NO: 4318959 - DNA, 12 bp, Homo sapiens
atgatacagtca

SEQ ID NO: 4318960 - DNA, 20 bp, Homo sapiens
atgatacctattaaaggaaa

SEQ ID NO: 4318961 - DNA, 18 bp, Homo sapiens
atgatcacatctaaagct

SEQ ID NO: 4318962 - DNA, 19 bp, Homo sapiens
atgatcacatctaaagctt

SEQ ID NO: 4318963 - DNA, 22 bp, Homo sapiens
atgatcactaatactaattcat

SEQ ID NO: 4318964 - DNA, 16 bp, Homo sapiens
atgatgccctgctcca

SEQ ID NO: 4318965 - DNA, 19 bp, Homo sapiens
atgatgccctgctccaggg

SEQ ID NO: 4318966 - DNA, 22 bp, Homo sapiens
atgatgccgaacattaggaatt

SEQ ID NO: 4318967 - DNA, 21 bp, Homo sapiens
atgatgctaagagtcctgggt

SEQ ID NO: 4318968 - DNA, 19 bp, Homo sapiens
atgattaaccacttcagct

SEQ ID NO: 4318969 - DNA, 14 bp, Homo sapiens
atgattataagaga

SEQ ID NO: 4318970 - DNA, 19 bp, Homo sapiens
atgattataagagagctta

SEQ ID NO: 4318971 - DNA, 19 bp, Homo sapiens
atgattggttaaaatgtga

SEQ ID NO: 4318972 - DNA, 11 bp, Homo sapiens
atgattttatt

SEQ ID NO: 4318973 - DNA, 14 bp, Homo sapiens
atgattttattaca

SEQ ID NO: 4318974 - DNA, 15 bp, Homo sapiens
atgattttattacag

SEQ ID NO: 4318975 - DNA, 18 bp, Homo sapiens
atgattttattacagaaa

SEQ ID NO: 4318976 - DNA, 22 bp, Homo sapiens
atgattttattacagaaatgtt

SEQ ID NO: 4318977 - DNA, 21 bp, Homo sapiens
atgcaaactgctttattttcc

SEQ ID NO: 4318978 - DNA, 16 bp, Homo sapiens
atgcaaagtacaatgt

SEQ ID NO: 4318979 - DNA, 15 bp, Homo sapiens
atgcaagaatttctg

SEQ ID NO: 4318980 - DNA, 20 bp, Homo sapiens
atgcaagaatttctggaaga

SEQ ID NO: 4318981 - DNA, 16 bp, Homo sapiens
atgcacagatatactt

SEQ ID NO: 4318982 - DNA, 18 bp, Homo sapiens
atgcattttcttcagaat

SEQ ID NO: 4318983 - DNA, 13 bp, Homo sapiens
atgccacgtgcca

SEQ ID NO: 4318984 - DNA, 23 bp, Homo sapiens
atgccataaaattgcagtttcat

SEQ ID NO: 4318985 - DNA, 17 bp, Homo sapiens
atgcccatttttgctaa

SEQ ID NO: 4318986 - DNA, 19 bp, Homo sapiens
atgcccgcacagtaatgta

SEQ ID NO: 4318987 - DNA, 16 bp, Homo sapiens
atgcctggtctttcct

SEQ ID NO: 4318988 - DNA, 17 bp, Homo sapiens
atgcctgttttgagacc

SEQ ID NO: 4318989 - DNA, 19 bp, Homo sapiens
atgcctgttttgagaccag

SEQ ID NO: 4318990 - DNA, 19 bp, Homo sapiens
atgctattttaaaaaatat

SEQ ID NO: 4318991 - DNA, 14 bp, Homo sapiens
atgctcaagaatgt

SEQ ID NO: 4318992 - DNA, 18 bp, Homo sapiens
atgctcaagaatgtagtc

SEQ ID NO: 4318993 - DNA, 13 bp, Homo sapiens
atgctcatgtata

SEQ ID NO: 4318994 - DNA, 14 bp, Homo sapiens
atgctcctggccca

SEQ ID NO: 4318995 - DNA, 19 bp, Homo sapiens
atgctcctggcccactgca

SEQ ID NO: 4318996 - DNA, 22 bp, Homo sapiens
atgctgaagtacagtcccagca

SEQ ID NO: 4318997 - DNA, 14 bp, Homo sapiens
atgctgagctgaag

SEQ ID NO: 4318998 - DNA, 17 bp, Homo sapiens
atgctgagctgaagaaa

SEQ ID NO: 4318999 - DNA, 18 bp, Homo sapiens
atgctgagctgaagaaat

SEQ ID NO: 4319000 - DNA, 19 bp, Homo sapiens
attatccattacgtgcatt

SEQ ID NO: 4319001 - DNA, 16 bp, Homo sapiens
attatgagtttgctta

SEQ ID NO: 4319002 - DNA, 23 bp, Homo sapiens
attatgattttatttaaactatt

SEQ ID NO: 4319003 - DNA, 18 bp, Homo sapiens
attattggtatatttgta

SEQ ID NO: 4319004 - DNA, 17 bp, Homo sapiens
attcaaggcttatctct

SEQ ID NO: 4319005 - DNA, 13 bp, Homo sapiens
attcaagtaacac

SEQ ID NO: 4319006 - DNA, 16 bp, Homo sapiens
attcaagtaacacttt

SEQ ID NO: 4319007 - DNA, 13 bp, Homo sapiens
attcaatatttac

SEQ ID NO: 4319008 - DNA, 15 bp, Homo sapiens
attcaatttggcaaa

SEQ ID NO: 4319009 - DNA, 19 bp, Homo sapiens
attcagctagaatttctgg

SEQ ID NO: 4319010 - DNA, 14 bp, Homo sapiens
attcagctctgcaa

SEQ ID NO: 4319011 - DNA, 12 bp, Homo sapiens
attcattctcat

SEQ ID NO: 4319012 - DNA, 22 bp, Homo sapiens
attcattctcataattcctaca

SEQ ID NO: 4319013 - DNA, 23 bp, Homo sapiens
attccaatgatacccaacagttt

SEQ ID NO: 4319014 - DNA, 22 bp, Homo sapiens
attccccaccctgaaagccctg

SEQ ID NO: 4319015 - DNA, 13 bp, Homo sapiens
attccctctccca

SEQ ID NO: 4319016 - DNA, 15 bp, Homo sapiens
attccctctcccacc

SEQ ID NO: 4319017 - DNA, 23 bp, Homo sapiens
attccgattagacctttatccag

SEQ ID NO: 4319018 - DNA, 13 bp, Homo sapiens
attcctacagcac

SEQ ID NO: 4319019 - DNA, 14 bp, Homo sapiens
attcctcagttgtt

SEQ ID NO: 4319020 - DNA, 14 bp, Homo sapiens
attccttaaatgaa

SEQ ID NO: 4319021 - DNA, 19 bp, Homo sapiens
attccttaaatgaactact

SEQ ID NO: 4319022 - DNA, 13 bp, Homo sapiens
attccttacttgc

SEQ ID NO: 4319023 - DNA, 14 bp, Homo sapiens
attccttacttgca

SEQ ID NO: 4319024 - DNA, 13 bp, Homo sapiens
attctataaaaac

SEQ ID NO: 4319025 - DNA, 22 bp, Homo sapiens
attctcataattcctacagcac

SEQ ID NO: 4319026 - DNA, 22 bp, Homo sapiens
attctgaaatacttttgagtat

SEQ ID NO: 4319027 - DNA, 19 bp, Homo sapiens
attctgcattgagaaggaa

SEQ ID NO: 4319028 - DNA, 20 bp, Homo sapiens
attctgcattgagaaggaac

SEQ ID NO: 4319029 - DNA, 19 bp, Homo sapiens
attctggattcacagacca

SEQ ID NO: 4319030 - DNA, 22 bp, Homo sapiens
attcttaagggaacttccacat

SEQ ID NO: 4319031 - DNA, 12 bp, Homo sapiens
attctttcccag

SEQ ID NO: 4319032 - DNA, 15 bp, Homo sapiens
attctttcccagtga

SEQ ID NO: 4319033 - DNA, 12 bp, Homo sapiens
attcttttatga

SEQ ID NO: 4319034 - DNA, 14 bp, Homo sapiens
attgaaaacactaa

SEQ ID NO: 4319035 - DNA, 10 bp, Homo sapiens
attgaaagaa

SEQ ID NO: 4319036 - DNA, 13 bp, Homo sapiens
attgaaagaaaaa

SEQ ID NO: 4319037 - DNA, 19 bp, Homo sapiens
attgacaagctaggaaaga

SEQ ID NO: 4319038 - DNA, 22 bp, Homo sapiens
attgacaagctaggaaagagga

SEQ ID NO: 4319039 - DNA, 21 bp, Homo sapiens
attgacatttgaatttggact

SEQ ID NO: 4319040 - DNA, 23 bp, Homo sapiens
attgagaaggaactgatacatct

SEQ ID NO: 4319041 - DNA, 20 bp, Homo sapiens
attgagtcttaactgtattt

SEQ ID NO: 4319042 - DNA, 13 bp, Homo sapiens
attgcaaaataga

SEQ ID NO: 4319043 - DNA, 14 bp, Homo sapiens
attgcaaaatagaa

SEQ ID NO: 4319044 - DNA, 12 bp, Homo sapiens
attgcaaatatt

SEQ ID NO: 4319045 - DNA, 13 bp, Homo sapiens
attgcagtttcat

SEQ ID NO: 4319046 - DNA, 16 bp, Homo sapiens
attgcagtttcatgta

SEQ ID NO: 4319047 - DNA, 17 bp, Homo sapiens
attgcagtttcatgtat

SEQ ID NO: 4319048 - DNA, 17 bp, Homo sapiens
attgccaatactcatgt

SEQ ID NO: 4319049 - DNA, 21 bp, Homo sapiens
attgctgaagggcattctttc

SEQ ID NO: 4319050 - DNA, 13 bp, Homo sapiens
attgcttagtaaa

SEQ ID NO: 4319051 - DNA, 23 bp, Homo sapiens
attgcttagtaaaatttatttca

SEQ ID NO: 4319052 - DNA, 19 bp, Homo sapiens
attgcttagtgaaaatact

SEQ ID NO: 4319053 - DNA, 15 bp, Homo sapiens
attgcttcctgatta

SEQ ID NO: 4319054 - DNA, 23 bp, Homo sapiens
attggaaatggatgcaaagtaca

SEQ ID NO: 4319055 - DNA, 15 bp, Homo sapiens
attggatttgctgtg

SEQ ID NO: 4319056 - DNA, 15 bp, Homo sapiens
attggcttactgaaa

SEQ ID NO: 4319057 - DNA, 19 bp, Homo sapiens
attggcttactgaaagaca

SEQ ID NO: 4319058 - DNA, 23 bp, Homo sapiens
attggctttgggttgcaggacct

SEQ ID NO: 4319059 - DNA, 19 bp, Homo sapiens
attgggggatgtgaagaaa

SEQ ID NO: 4319060 - DNA, 20 bp, Homo sapiens
attgggggatgtgaagaaat

SEQ ID NO: 4319061 - DNA, 16 bp, Homo sapiens
attgtctttcctccct

SEQ ID NO: 4319062 - DNA, 12 bp, Homo sapiens
attgtgcttctc

SEQ ID NO: 4319063 - DNA, 20 bp, Homo sapiens
attgtttatacacaactttg

SEQ ID NO: 4319064 - DNA, 21 bp, Homo sapiens
attgtttatacacaactttgc

SEQ ID NO: 4319065 - DNA, 15 bp, Homo sapiens
attgttttgaatatt

SEQ ID NO: 4319066 - DNA, 14 bp, Homo sapiens
attgtttttctttc

SEQ ID NO: 4319067 - DNA, 11 bp, Homo sapiens
atttaaactat

SEQ ID NO: 4319068 - DNA, 12 bp, Homo sapiens
atttaaactatt

SEQ ID NO: 4319069 - DNA, 22 bp, Homo sapiens
atttaaactattcagaggaaaa

SEQ ID NO: 4319070 - DNA, 21 bp, Homo sapiens
atttaaactctgccagaaaaa

SEQ ID NO: 4319071 - DNA, 17 bp, Homo sapiens
atttactgagacttcga

SEQ ID NO: 4319072 - DNA, 20 bp, Homo sapiens
atttagaagcaaagatttca

SEQ ID NO: 4319073 - DNA, 22 bp, Homo sapiens
atttagaagcaaagatttcagt

SEQ ID NO: 4319074 - DNA, 23 bp, Homo sapiens
atttagagcgtttggttaaagta

SEQ ID NO: 4319075 - DNA, 21 bp, Homo sapiens
atttagagcttttcagaacat

SEQ ID NO: 4319076 - DNA, 14 bp, Homo sapiens
atttatatatcata

SEQ ID NO: 4319077 - DNA, 17 bp, Homo sapiens
atttatatcttgttatt

SEQ ID NO: 4319078 - DNA, 23 bp, Homo sapiens
atttatatcttgttattaatgtt

SEQ ID NO: 4319079 - DNA, 16 bp, Homo sapiens
atttatcgcaacatga

SEQ ID NO: 4319080 - DNA, 19 bp, Homo sapiens
atttatcgcaacatgaatt

SEQ ID NO: 4319081 - DNA, 18 bp, Homo sapiens
atttattacttgtgcact

SEQ ID NO: 4319082 - DNA, 23 bp, Homo sapiens
atttattcaacaaatgtgggtga

SEQ ID NO: 4319083 - DNA, 23 bp, Homo sapiens
atttatttctctggcaaactttt

SEQ ID NO: 4319084 - DNA, 16 bp, Homo sapiens
atttcacgaactgttc

SEQ ID NO: 4319085 - DNA, 19 bp, Homo sapiens
atttcagtagaattttagt

SEQ ID NO: 4319086 - DNA, 18 bp, Homo sapiens
atttcattccattgccta

SEQ ID NO: 4319087 - DNA, 18 bp, Homo sapiens
atttccaaaataatctat

SEQ ID NO: 4319088 - DNA, 23 bp, Homo sapiens
atttcccttgaaattttaaacta

SEQ ID NO: 4319089 - DNA, 21 bp, Homo sapiens
atttctaggcaggtggagaga

SEQ ID NO: 4319090 - DNA, 17 bp, Homo sapiens
atttctgctttctttga

SEQ ID NO: 4319091 - DNA, 13 bp, Homo sapiens
atttctggaagaa

SEQ ID NO: 4319092 - DNA, 16 bp, Homo sapiens
atttctggaagaaagg

SEQ ID NO: 4319093 - DNA, 18 bp, Homo sapiens
atttctgtggaaaacaat

SEQ ID NO: 4319094 - DNA, 17 bp, Homo sapiens
atttctttgtagaataa

SEQ ID NO: 4319095 - DNA, 22 bp, Homo sapiens
atttgaaaacataatctgcaaa

SEQ ID NO: 4319096 - DNA, 22 bp, Homo sapiens
atttgacgttgttgtcattgtc

SEQ ID NO: 4319097 - DNA, 20 bp, Homo sapiens
atttgaggactgaagctggg

SEQ ID NO: 4319098 - DNA, 18 bp, Homo sapiens
atttgatctttgtttaaa

SEQ ID NO: 4319099 - DNA, 20 bp, Homo sapiens
atttgatctttgtttaaatg

SEQ ID NO: 4319100 - DNA, 14 bp, Homo sapiens
atttggaaaattca

SEQ ID NO: 4319101 - DNA, 18 bp, Homo sapiens
atttggcatgggacagac

SEQ ID NO: 4319102 - DNA, 19 bp, Homo sapiens
atttggcttgctgtttact

SEQ ID NO: 4319103 - DNA, 17 bp, Homo sapiens
atttgggagggaaaagg

SEQ ID NO: 4319104 - DNA, 18 bp, Homo sapiens
atttgggctctgaaataa

SEQ ID NO: 4319105 - DNA, 19 bp, Homo sapiens
atttgggctctgaaataaa

SEQ ID NO: 4319106 - DNA, 22 bp, Homo sapiens
atttgggctctgaaataaaaat

SEQ ID NO: 4319107 - DNA, 22 bp, Homo sapiens
atttgtataaattaaataaact

SEQ ID NO: 4319108 - DNA, 12 bp, Homo sapiens
atttgtattaat

SEQ ID NO: 4319109 - DNA, 14 bp, Homo sapiens
atttgtattaataa

SEQ ID NO: 4319110 - DNA, 15 bp, Homo sapiens
atttgtattaataaa

SEQ ID NO: 4319111 - DNA, 16 bp, Homo sapiens
atttgtattaataaag

SEQ ID NO: 4319112 - DNA, 18 bp, Homo sapiens
atttgtattaataaagca

SEQ ID NO: 4319113 - DNA, 20 bp, Homo sapiens
atttgtattaataaagcatt

SEQ ID NO: 4319114 - DNA, 12 bp, Homo sapiens
attttaaaatga

SEQ ID NO: 4319115 - DNA, 15 bp, Homo sapiens
attttaaattctcag

SEQ ID NO: 4319116 - DNA, 15 bp, Homo sapiens
attttaagtgcttca

SEQ ID NO: 4319117 - DNA, 17 bp, Homo sapiens
attttaataaactttga

SEQ ID NO: 4319118 - DNA, 16 bp, Homo sapiens
cactaggtgaacagca

SEQ ID NO: 4319119 - DNA, 20 bp, Homo sapiens
cactcatgcaaactgcttta

SEQ ID NO: 4319120 - DNA, 21 bp, Homo sapiens
cactcatgcaaactgctttat

SEQ ID NO: 4319121 - DNA, 16 bp, Homo sapiens
cactccagcctgggtg

SEQ ID NO: 4319122 - DNA, 14 bp, Homo sapiens
cactccccacggga

SEQ ID NO: 4319123 - DNA, 22 bp, Homo sapiens
cactgaagaaagaggaaccccc

SEQ ID NO: 4319124 - DNA, 18 bp, Homo sapiens
cactgaaggattaatgaa

SEQ ID NO: 4319125 - DNA, 14 bp, Homo sapiens
cactgattccctct

SEQ ID NO: 4319126 - DNA, 17 bp, Homo sapiens
cactgattccctctccc

SEQ ID NO: 4319127 - DNA, 19 bp, Homo sapiens
cactgattccctctcccac

SEQ ID NO: 4319128 - DNA, 22 bp, Homo sapiens
cactgattccctctcccaccca

SEQ ID NO: 4319129 - DNA, 16 bp, Homo sapiens
cactgcaaataaagcc

SEQ ID NO: 4319130 - DNA, 18 bp, Homo sapiens
cactgcaaataaagcctt

SEQ ID NO: 4319131 - DNA, 15 bp, Homo sapiens
cactgcactccagcc

SEQ ID NO: 4319132 - DNA, 18 bp, Homo sapiens
cactgcactccagcctgg

SEQ ID NO: 4319133 - DNA, 11 bp, Homo sapiens
cactggcactt

SEQ ID NO: 4319134 - DNA, 19 bp, Homo sapiens
cactggcacttgcctgctg

SEQ ID NO: 4319135 - DNA, 20 bp, Homo sapiens
cactggcacttgcctgctgc

SEQ ID NO: 4319136 - DNA, 20 bp, Homo sapiens
cactggcatcgcagcttcct

SEQ ID NO: 4319137 - DNA, 13 bp, Homo sapiens
cactgtctgcgtg

SEQ ID NO: 4319138 - DNA, 13 bp, Homo sapiens
cacttacctgctt

SEQ ID NO: 4319139 - DNA, 19 bp, Homo sapiens
cacttattgtttgaaagac

SEQ ID NO: 4319140 - DNA, 21 bp, Homo sapiens
cacttcagctgacttttctgt

SEQ ID NO: 4319141 - DNA, 21 bp, Homo sapiens
cacttcgggaggtcgaggcag

SEQ ID NO: 4319142 - DNA, 14 bp, Homo sapiens
cacttgattccttg

SEQ ID NO: 4319143 - DNA, 14 bp, Homo sapiens
cacttgcctgctgc

SEQ ID NO: 4319144 - DNA, 13 bp, Homo sapiens
cactttacctctt

SEQ ID NO: 4319145 - DNA, 14 bp, Homo sapiens
cagaaaaaaataac

SEQ ID NO: 4319146 - DNA, 17 bp, Homo sapiens
cagaaaaagaagaagga

SEQ ID NO: 4319147 - DNA, 15 bp, Homo sapiens
cagaaatagttgtct

SEQ ID NO: 4319148 - DNA, 20 bp, Homo sapiens
cagaaatagttgtctgtgct

SEQ ID NO: 4319149 - DNA, 21 bp, Homo sapiens
cagaaatagttgtctgtgctt

SEQ ID NO: 4319150 - DNA, 15 bp, Homo sapiens
cagaacgtatttagc

SEQ ID NO: 4319151 - DNA, 12 bp, Homo sapiens
cagaagacacta

SEQ ID NO: 4319152 - DNA, 20 bp, Homo sapiens
cagaagtttgagatcagcct

SEQ ID NO: 4319153 - DNA, 20 bp, Homo sapiens
cagaatggaatccatctgtc

SEQ ID NO: 4319154 - DNA, 16 bp, Homo sapiens
cagaattatccattac

SEQ ID NO: 4319155 - DNA, 14 bp, Homo sapiens
cagaattggcataa

SEQ ID NO: 4319156 - DNA, 18 bp, Homo sapiens
cagaattggcataatttg

SEQ ID NO: 4319157 - DNA, 15 bp, Homo sapiens
cagactgacactact

SEQ ID NO: 4319158 - DNA, 14 bp, Homo sapiens
cagactttgctgca

SEQ ID NO: 4319159 - DNA, 18 bp, Homo sapiens
cagactttgctgcatttt

SEQ ID NO: 4319160 - DNA, 21 bp, Homo sapiens
cagactttgctgcattttaca

SEQ ID NO: 4319161 - DNA, 17 bp, Homo sapiens
cagagcccctcatgcca

SEQ ID NO: 4319162 - DNA, 14 bp, Homo sapiens
cagagcccgggaga

SEQ ID NO: 4319163 - DNA, 12 bp, Homo sapiens
cagaggaaggaa

SEQ ID NO: 4319164 - DNA, 19 bp, Homo sapiens
cagaggaaggaaacataga

SEQ ID NO: 4319165 - DNA, 13 bp, Homo sapiens
cagaggaaggaga

SEQ ID NO: 4319166 - DNA, 15 bp, Homo sapiens
cagaggatgctgaag

SEQ ID NO: 4319167 - DNA, 14 bp, Homo sapiens
cagaggccgctgcc

SEQ ID NO: 4319168 - DNA, 19 bp, Homo sapiens
cagaggccgctgcccctga

SEQ ID NO: 4319169 - DNA, 16 bp, Homo sapiens
cagagttgctgtgccg

SEQ ID NO: 4319170 - DNA, 14 bp, Homo sapiens
cagagtttgtgtgt

SEQ ID NO: 4319171 - DNA, 15 bp, Homo sapiens
cagagtttgtgtgta

SEQ ID NO: 4319172 - DNA, 16 bp, Homo sapiens
cagagtttgtgtgtat

SEQ ID NO: 4319173 - DNA, 18 bp, Homo sapiens
cagagtttgtgtgtattt

SEQ ID NO: 4319174 - DNA, 18 bp, Homo sapiens
cagatatactttgtggac

SEQ ID NO: 4319175 - DNA, 22 bp, Homo sapiens
cagatgctgaattgagaataag

SEQ ID NO: 4319176 - DNA, 23 bp, Homo sapiens
cagattggaatgttacatctgtc

SEQ ID NO: 4319177 - DNA, 15 bp, Homo sapiens
cagatttcttaatgt

SEQ ID NO: 4319178 - DNA, 20 bp, Homo sapiens
cagatttgaggactgaagct

SEQ ID NO: 4319179 - DNA, 18 bp, Homo sapiens
cagcaaaagatgcttctc

SEQ ID NO: 4319180 - DNA, 14 bp, Homo sapiens
cagcaaacaaataa

SEQ ID NO: 4319181 - DNA, 13 bp, Homo sapiens
cagcaactcccac

SEQ ID NO: 4319182 - DNA, 14 bp, Homo sapiens
cagcaactcccacg

SEQ ID NO: 4319183 - DNA, 15 bp, Homo sapiens
cagcaactcccacga

SEQ ID NO: 4319184 - DNA, 22 bp, Homo sapiens
cagcacaccaaggtggcccgga

SEQ ID NO: 4319185 - DNA, 16 bp, Homo sapiens
cagcactactgggtgt

SEQ ID NO: 4319186 - DNA, 19 bp, Homo sapiens
cagcactactgggtgtcat

SEQ ID NO: 4319187 - DNA, 15 bp, Homo sapiens
cagcagcctggaccc

SEQ ID NO: 4319188 - DNA, 19 bp, Homo sapiens
cagcagcctggaccctgtg

SEQ ID NO: 4319189 - DNA, 20 bp, Homo sapiens
cagcaggaggttctgggcct

SEQ ID NO: 4319190 - DNA, 15 bp, Homo sapiens
cagcaggatgccctg

SEQ ID NO: 4319191 - DNA, 19 bp, Homo sapiens
cagcaggatgctaatggaa

SEQ ID NO: 4319192 - DNA, 18 bp, Homo sapiens
cagcagggagggcttctg

SEQ ID NO: 4319193 - DNA, 18 bp, Homo sapiens
cagcagggctggtcacct

SEQ ID NO: 4319194 - DNA, 20 bp, Homo sapiens
cagcagggctggtcacctcc

SEQ ID NO: 4319195 - DNA, 23 bp, Homo sapiens
cagcagggctggtcacctcccat

SEQ ID NO: 4319196 - DNA, 19 bp, Homo sapiens
cagcagtgagagttcctct

SEQ ID NO: 4319197 - DNA, 17 bp, Homo sapiens
cagcatagaagtaactt

SEQ ID NO: 4319198 - DNA, 15 bp, Homo sapiens
cagccaaagcctcct

SEQ ID NO: 4319199 - DNA, 13 bp, Homo sapiens
cagccaactcatt

SEQ ID NO: 4319200 - DNA, 17 bp, Homo sapiens
cagccacaccgctggct

SEQ ID NO: 4319201 - DNA, 17 bp, Homo sapiens
cagccattcctgttctc

SEQ ID NO: 4319202 - DNA, 19 bp, Homo sapiens
cagcccagaagaaaattct

SEQ ID NO: 4319203 - DNA, 17 bp, Homo sapiens
cagccccaatccagaga

SEQ ID NO: 4319204 - DNA, 17 bp, Homo sapiens
cagcccccacagccctg

SEQ ID NO: 4319205 - DNA, 19 bp, Homo sapiens
cagcccccacagccctgga

SEQ ID NO: 4319206 - DNA, 22 bp, Homo sapiens
cagcccccacagccctggaata

SEQ ID NO: 4319207 - DNA, 15 bp, Homo sapiens
cagccccgtcccaga

SEQ ID NO: 4319208 - DNA, 16 bp, Homo sapiens
cagccccgtcccagag

SEQ ID NO: 4319209 - DNA, 17 bp, Homo sapiens
cagccccgtcccagagg

SEQ ID NO: 4319210 - DNA, 20 bp, Homo sapiens
cagccccgtcccagaggccg

SEQ ID NO: 4319211 - DNA, 15 bp, Homo sapiens
cagcccctgccccag

SEQ ID NO: 4319212 - DNA, 17 bp, Homo sapiens
cagcccctgccccagcc

SEQ ID NO: 4319213 - DNA, 21 bp, Homo sapiens
cagccctctgtggccaggagc

SEQ ID NO: 4319214 - DNA, 11 bp, Homo sapiens
cagccctgaaa

SEQ ID NO: 4319215 - DNA, 12 bp, Homo sapiens
cagccctgaaac

SEQ ID NO: 4319216 - DNA, 13 bp, Homo sapiens
cagccctgaaacg

SEQ ID NO: 4319217 - DNA, 20 bp, Homo sapiens
cagccctgaaacgagaagtg

SEQ ID NO: 4319218 - DNA, 18 bp, Homo sapiens
cagccgtgtgtgcatgtg

SEQ ID NO: 4319219 - DNA, 15 bp, Homo sapiens
cagcctgctccagct

SEQ ID NO: 4319220 - DNA, 15 bp, Homo sapiens
cagcctggaccccca

SEQ ID NO: 4319221 - DNA, 21 bp, Homo sapiens
cagcgtggtttttatgtgtat

SEQ ID NO: 4319222 - DNA, 22 bp, Homo sapiens
cagctaccacgggtctgccatg

SEQ ID NO: 4319223 - DNA, 17 bp, Homo sapiens
cagctaccctgtgtata

SEQ ID NO: 4319224 - DNA, 23 bp, Homo sapiens
cagctagaaataagcccaacaga

SEQ ID NO: 4319225 - DNA, 16 bp, Homo sapiens
cagctagaatttctgg

SEQ ID NO: 4319226 - DNA, 20 bp, Homo sapiens
cagctagtgccaaataattg

SEQ ID NO: 4319227 - DNA, 17 bp, Homo sapiens
cagctcccccaggcaga

SEQ ID NO: 4319228 - DNA, 14 bp, Homo sapiens
cagctccccctgtc

SEQ ID NO: 4319229 - DNA, 22 bp, Homo sapiens
cagctccccctgtcccctcagc

SEQ ID NO: 4319230 - DNA, 14 bp, Homo sapiens
cagctcgatccaaa

SEQ ID NO: 4319231 - DNA, 15 bp, Homo sapiens
cagctctctctcctg

SEQ ID NO: 4319232 - DNA, 17 bp, Homo sapiens
cagctctctctcctgga

SEQ ID NO: 4319233 - DNA, 18 bp, Homo sapiens
cagctctctctcctggag

SEQ ID NO: 4319234 - DNA, 13 bp, Homo sapiens
cagctctgagccg

SEQ ID NO: 4319235 - DNA, 19 bp, Homo sapiens
cagctgactccagtataat

SEQ ID NO: 4319236 - DNA, 21 bp, Homo sapiens
cagctgacttttctgtccgag

SEQ ID NO: 4319237 - DNA, 18 bp, Homo sapiens
aaacgttgacccctttcc

SEQ ID NO: 4319238 - DNA, 21 bp, Homo sapiens
aaactagtttaagggtggaaa

SEQ ID NO: 4319239 - DNA, 23 bp, Homo sapiens
aaactcaaggaggtggtgaattt

SEQ ID NO: 4319240 - DNA, 15 bp, Homo sapiens
aaactctataaagaa

SEQ ID NO: 4319241 - DNA, 21 bp, Homo sapiens
aaactctccttttccttacca

SEQ ID NO: 4319242 - DNA, 11 bp, Homo sapiens
aaactctgcca

SEQ ID NO: 4319243 - DNA, 15 bp, Homo sapiens
aaactctgccagaaa

SEQ ID NO: 4319244 - DNA, 12 bp, Homo sapiens
aaactcttaaaa

SEQ ID NO: 4319245 - DNA, 14 bp, Homo sapiens
aaactgctttattt

SEQ ID NO: 4319246 - DNA, 22 bp, Homo sapiens
aaacttctcgcaactgaaggaa

SEQ ID NO: 4319247 - DNA, 12 bp, Homo sapiens
aaacttgtgaat

SEQ ID NO: 4319248 - DNA, 15 bp, Homo sapiens
aaacttgtgaatgct

SEQ ID NO: 4319249 - DNA, 12 bp, Homo sapiens
aaactttaaaga

SEQ ID NO: 4319250 - DNA, 16 bp, Homo sapiens
aaactttgctccaggc

SEQ ID NO: 4319251 - DNA, 19 bp, Homo sapiens
aaacttttcatttcagatt

SEQ ID NO: 4319252 - DNA, 21 bp, Homo sapiens
aaacttttcatttcagatttt

SEQ ID NO: 4319253 - DNA, 17 bp, Homo sapiens
aaagaaaaaaaaatact

SEQ ID NO: 4319254 - DNA, 9 bp, Homo sapiens
aaagaaaca

SEQ ID NO: 4319255 - DNA, 16 bp, Homo sapiens
aaagaaatgaaattga

SEQ ID NO: 4319256 - DNA, 22 bp, Homo sapiens
aaagaagaccctttgttgaaaa

SEQ ID NO: 4319257 - DNA, 22 bp, Homo sapiens
aaagacacacaggagtcctttc

SEQ ID NO: 4319258 - DNA, 16 bp, Homo sapiens
aaagacaggagtttat

SEQ ID NO: 4319259 - DNA, 17 bp, Homo sapiens
aaagacccaacttgcca

SEQ ID NO: 4319260 - DNA, 17 bp, Homo sapiens
aaagagtgttatcatat

SEQ ID NO: 4319261 - DNA, 18 bp, Homo sapiens
aaagagtgttatcatatt

SEQ ID NO: 4319262 - DNA, 15 bp, Homo sapiens
aaagatatggagaat

SEQ ID NO: 4319263 - DNA, 23 bp, Homo sapiens
aaagatatggagaattgctgaag

SEQ ID NO: 4319264 - DNA, 17 bp, Homo sapiens
aaagatcccaagatgga

SEQ ID NO: 4319265 - DNA, 19 bp, Homo sapiens
aaagatgcttctcactgcc

SEQ ID NO: 4319266 - DNA, 12 bp, Homo sapiens
aaagatttcagt

SEQ ID NO: 4319267 - DNA, 18 bp, Homo sapiens
aaagcaaacatgtgcaga

SEQ ID NO: 4319268 - DNA, 15 bp, Homo sapiens
aaagcaaatttcatt

SEQ ID NO: 4319269 - DNA, 15 bp, Homo sapiens
aaagcactagagaat

SEQ ID NO: 4319270 - DNA, 13 bp, Homo sapiens
aaagcagtaaaat

SEQ ID NO: 4319271 - DNA, 20 bp, Homo sapiens
aaagcagtaaaataaaaaac

SEQ ID NO: 4319272 - DNA, 16 bp, Homo sapiens
aaagccctatgtgaaa

SEQ ID NO: 4319273 - DNA, 22 bp, Homo sapiens
aaagccctatgtgaaaagatcc

SEQ ID NO: 4319274 - DNA, 16 bp, Homo sapiens
aaagccttttaaatca

SEQ ID NO: 4319275 - DNA, 12 bp, Homo sapiens
aaagctctttaa

SEQ ID NO: 4319276 - DNA, 19 bp, Homo sapiens
aaagcttgatttgatcttt

SEQ ID NO: 4319277 - DNA, 13 bp, Homo sapiens
aaagctttatctt

SEQ ID NO: 4319278 - DNA, 14 bp, Homo sapiens
aaagctttatcttt

SEQ ID NO: 4319279 - DNA, 18 bp, Homo sapiens
aaaggaaaaatgtagact

SEQ ID NO: 4319280 - DNA, 17 bp, Homo sapiens
aaaggagagctagcagc

SEQ ID NO: 4319281 - DNA, 21 bp, Homo sapiens
aaaggagagctagcagcaggg

SEQ ID NO: 4319282 - DNA, 16 bp, Homo sapiens
aaaggatgatggaaaa

SEQ ID NO: 4319283 - DNA, 16 bp, Homo sapiens
aaagggagaaatgcca

SEQ ID NO: 4319284 - DNA, 17 bp, Homo sapiens
aaagggagaaatgccag

SEQ ID NO: 4319285 - DNA, 16 bp, Homo sapiens
aaaggggtgattgaaa

SEQ ID NO: 4319286 - DNA, 20 bp, Homo sapiens
aaaggggtgattgaaagaaa

SEQ ID NO: 4319287 - DNA, 23 bp, Homo sapiens
aaagtcagagttaaaatatatat

SEQ ID NO: 4319288 - DNA, 17 bp, Homo sapiens
aaagtcattattcctgg

SEQ ID NO: 4319289 - DNA, 15 bp, Homo sapiens
aaagtctgagttctc

SEQ ID NO: 4319290 - DNA, 18 bp, Homo sapiens
aaagtggggtacagtaaa

SEQ ID NO: 4319291 - DNA, 13 bp, Homo sapiens
aaagtgtacatga

SEQ ID NO: 4319292 - DNA, 12 bp, Homo sapiens
aaagttgaaaat

SEQ ID NO: 4319293 - DNA, 15 bp, Homo sapiens
aaagttgaaaataca

SEQ ID NO: 4319294 - DNA, 14 bp, Homo sapiens
aaagttgcttttat

SEQ ID NO: 4319295 - DNA, 15 bp, Homo sapiens
aaagttgcttttatt

SEQ ID NO: 4319296 - DNA, 11 bp, Homo sapiens
aaataaaatga

SEQ ID NO: 4319297 - DNA, 13 bp, Homo sapiens
aaataaagaaaat

SEQ ID NO: 4319298 - DNA, 18 bp, Homo sapiens
aaataaagaatagcaatt

SEQ ID NO: 4319299 - DNA, 21 bp, Homo sapiens
aaataaagccttttaaatcat

SEQ ID NO: 4319300 - DNA, 20 bp, Homo sapiens
aaataactattttgttttaa

SEQ ID NO: 4319301 - DNA, 12 bp, Homo sapiens
aaatagaagaag

SEQ ID NO: 4319302 - DNA, 13 bp, Homo sapiens
aaatagaagaaga

SEQ ID NO: 4319303 - DNA, 15 bp, Homo sapiens
aaatagaatccaaac

SEQ ID NO: 4319304 - DNA, 17 bp, Homo sapiens
aaatagttgtctgtgct

SEQ ID NO: 4319305 - DNA, 13 bp, Homo sapiens
aaatatatataaa

SEQ ID NO: 4319306 - DNA, 16 bp, Homo sapiens
aaatatatgtatatat

SEQ ID NO: 4319307 - DNA, 19 bp, Homo sapiens
aaatatatgtatatatatt

SEQ ID NO: 4319308 - DNA, 18 bp, Homo sapiens
aaatatgaaccctttgtt

SEQ ID NO: 4319309 - DNA, 23 bp, Homo sapiens
aaatatgagtggttattgaaaat

SEQ ID NO: 4319310 - DNA, 18 bp, Homo sapiens
aaatattatgattttatt

SEQ ID NO: 4319311 - DNA, 16 bp, Homo sapiens
aaatcaaaaacttttc

SEQ ID NO: 4319312 - DNA, 19 bp, Homo sapiens
aaatcaaggatcttttgga

SEQ ID NO: 4319313 - DNA, 15 bp, Homo sapiens
aaatcacattttaag

SEQ ID NO: 4319314 - DNA, 21 bp, Homo sapiens
aaatcacccagttgtgctata

SEQ ID NO: 4319315 - DNA, 12 bp, Homo sapiens
aaatcagcctgc

SEQ ID NO: 4319316 - DNA, 22 bp, Homo sapiens
aaatcatagtatatgattgtat

SEQ ID NO: 4319317 - DNA, 19 bp, Homo sapiens
aaatcatttggttaaatca

SEQ ID NO: 4319318 - DNA, 15 bp, Homo sapiens
aaatcccatttaaaa

SEQ ID NO: 4319319 - DNA, 16 bp, Homo sapiens
aaatctgattagaagt

SEQ ID NO: 4319320 - DNA, 18 bp, Homo sapiens
aaatctggggaagaggtt

SEQ ID NO: 4319321 - DNA, 19 bp, Homo sapiens
aaatctggggaagaggttt

SEQ ID NO: 4319322 - DNA, 20 bp, Homo sapiens
aaatcttagtatagtagaaa

SEQ ID NO: 4319323 - DNA, 19 bp, Homo sapiens
aaatgaaaattacgttctt

SEQ ID NO: 4319324 - DNA, 16 bp, Homo sapiens
aaatgaaattgacaag

SEQ ID NO: 4319325 - DNA, 13 bp, Homo sapiens
aaatgaactactg

SEQ ID NO: 4319326 - DNA, 14 bp, Homo sapiens
aaatgaactactgc

SEQ ID NO: 4319327 - DNA, 15 bp, Homo sapiens
aaatgaactactgct

SEQ ID NO: 4319328 - DNA, 18 bp, Homo sapiens
aaatgaactactgctatt

SEQ ID NO: 4319329 - DNA, 17 bp, Homo sapiens
aaatgaagcagaggaag

SEQ ID NO: 4319330 - DNA, 21 bp, Homo sapiens
aaatgaagcagaggaaggaaa

SEQ ID NO: 4319331 - DNA, 16 bp, Homo sapiens
aaatgaatattttgat

SEQ ID NO: 4319332 - DNA, 19 bp, Homo sapiens
aaatgaatttcatgtgaat

SEQ ID NO: 4319333 - DNA, 17 bp, Homo sapiens
aaatgactattgtaatg

SEQ ID NO: 4319334 - DNA, 13 bp, Homo sapiens
aaatgagcctggc

SEQ ID NO: 4319335 - DNA, 18 bp, Homo sapiens
aaatgagttacttagaat

SEQ ID NO: 4319336 - DNA, 11 bp, Homo sapiens
aaatgcatttt

SEQ ID NO: 4319337 - DNA, 12 bp, Homo sapiens
aaatgcattttc

SEQ ID NO: 4319338 - DNA, 18 bp, Homo sapiens
aaatgccaaaatgtactt

SEQ ID NO: 4319339 - DNA, 23 bp, Homo sapiens
aaatgccacgtgccattgtcttt

SEQ ID NO: 4319340 - DNA, 17 bp, Homo sapiens
aaatgcccatttttgct

SEQ ID NO: 4319341 - DNA, 13 bp, Homo sapiens
aaatggacatttt

SEQ ID NO: 4319342 - DNA, 14 bp, Homo sapiens
aaatggacattttc

SEQ ID NO: 4319343 - DNA, 15 bp, Homo sapiens
aaatggacattttct

SEQ ID NO: 4319344 - DNA, 18 bp, Homo sapiens
aaatggatgacaaagaaa

SEQ ID NO: 4319345 - DNA, 19 bp, Homo sapiens
aaatggatgacaaagaaaa

SEQ ID NO: 4319346 - DNA, 14 bp, Homo sapiens
aaatgggactctga

SEQ ID NO: 4319347 - DNA, 15 bp, Homo sapiens
aaatgggactctgaa

SEQ ID NO: 4319348 - DNA, 20 bp, Homo sapiens
aaatgggactctgaactgga

SEQ ID NO: 4319349 - DNA, 13 bp, Homo sapiens
aaatggtgttgag

SEQ ID NO: 4319350 - DNA, 15 bp, Homo sapiens
aaatgtagactctga

SEQ ID NO: 4319351 - DNA, 10 bp, Homo sapiens
aaatgtattt

SEQ ID NO: 4319352 - DNA, 12 bp, Homo sapiens
aaatgtattttt

SEQ ID NO: 4319353 - DNA, 15 bp, Homo sapiens
aaatgtatttttcta

SEQ ID NO: 4319354 - DNA, 24 bp, Homo sapiens
aaatgtctagttgtaacaccatga

SEQ ID NO: 4319355 - DNA, 15 bp, Homo sapiens
aaatgtgatcaactg

SEQ ID NO: 4319356 - DNA, 18 bp, Homo sapiens
aaatgtgtatctatttat

SEQ ID NO: 4319357 - DNA, 13 bp, Homo sapiens
aataatctatatt

SEQ ID NO: 4319358 - DNA, 23 bp, Homo sapiens
aataatgcctccaattttttctt

SEQ ID NO: 4319359 - DNA, 20 bp, Homo sapiens
aataattatgagtttgctta

SEQ ID NO: 4319360 - DNA, 13 bp, Homo sapiens
aataattatttca

SEQ ID NO: 4319361 - DNA, 22 bp, Homo sapiens
aatacaacatgtagctgagttt

SEQ ID NO: 4319362 - DNA, 17 bp, Homo sapiens
aatacacatataaaaac

SEQ ID NO: 4319363 - DNA, 19 bp, Homo sapiens
aatacacatataaaaacaa

SEQ ID NO: 4319364 - DNA, 13 bp, Homo sapiens
aatacagaggcaa

SEQ ID NO: 4319365 - DNA, 12 bp, Homo sapiens
aatagaaaagta

SEQ ID NO: 4319366 - DNA, 13 bp, Homo sapiens
aatagaaaagtag

SEQ ID NO: 4319367 - DNA, 13 bp, Homo sapiens
aatagaagaagag

SEQ ID NO: 4319368 - DNA, 10 bp, Homo sapiens
aataggaatt

SEQ ID NO: 4319369 - DNA, 16 bp, Homo sapiens
aatagtcatatgtgaa

SEQ ID NO: 4319370 - DNA, 14 bp, Homo sapiens
aatagttgtctgtg

SEQ ID NO: 4319371 - DNA, 17 bp, Homo sapiens
aatagttgtctgtgctt

SEQ ID NO: 4319372 - DNA, 13 bp, Homo sapiens
aatatactgtctt

SEQ ID NO: 4319373 - DNA, 15 bp, Homo sapiens
aatatactgtcttgt

SEQ ID NO: 4319374 - DNA, 12 bp, Homo sapiens
aatatatataaa

SEQ ID NO: 4319375 - DNA, 16 bp, Homo sapiens
aatatatataaagaat

SEQ ID NO: 4319376 - DNA, 16 bp, Homo sapiens
aatatatgtatatata

SEQ ID NO: 4319377 - DNA, 13 bp, Homo sapiens
aatatattactga

SEQ ID NO: 4319378 - DNA, 15 bp, Homo sapiens
aatatcctgtaataa

SEQ ID NO: 4319379 - DNA, 20 bp, Homo sapiens
aatatgaaccctttgtttct

SEQ ID NO: 4319380 - DNA, 22 bp, Homo sapiens
aatatgacacagcttgtgaatg

SEQ ID NO: 4319381 - DNA, 21 bp, Homo sapiens
aatatgagactattatgaaat

SEQ ID NO: 4319382 - DNA, 16 bp, Homo sapiens
aatatggtgaggtcac

SEQ ID NO: 4319383 - DNA, 17 bp, Homo sapiens
aatattactcctatttt

SEQ ID NO: 4319384 - DNA, 19 bp, Homo sapiens
aatattcaagtaacacttt

SEQ ID NO: 4319385 - DNA, 14 bp, Homo sapiens
aatattgtttttct

SEQ ID NO: 4319386 - DNA, 15 bp, Homo sapiens
aatatttaaagatta

SEQ ID NO: 4319387 - DNA, 14 bp, Homo sapiens
aatattttgataat

SEQ ID NO: 4319388 - DNA, 14 bp, Homo sapiens
aatcaaaaactttt

SEQ ID NO: 4319389 - DNA, 15 bp, Homo sapiens
aatcatagtatatga

SEQ ID NO: 4319390 - DNA, 19 bp, Homo sapiens
aatcatattgagaataatt

SEQ ID NO: 4319391 - DNA, 12 bp, Homo sapiens
aatcatgctcat

SEQ ID NO: 4319392 - DNA, 16 bp, Homo sapiens
aatcatgctcatgtat

SEQ ID NO: 4319393 - DNA, 19 bp, Homo sapiens
aatcatgctcatgtatatt

SEQ ID NO: 4319394 - DNA, 13 bp, Homo sapiens
aatcatgtctgta

SEQ ID NO: 4319395 - DNA, 20 bp, Homo sapiens
aatccagagaagcgctgttg

SEQ ID NO: 4319396 - DNA, 20 bp, Homo sapiens
aatcctacgctatgtagaat

SEQ ID NO: 4319397 - DNA, 15 bp, Homo sapiens
aatcgatccatgttt

SEQ ID NO: 4319398 - DNA, 14 bp, Homo sapiens
aatctaagtatatg

SEQ ID NO: 4319399 - DNA, 17 bp, Homo sapiens
aatctatattaaatgag

SEQ ID NO: 4319400 - DNA, 17 bp, Homo sapiens
aatctatgatatattta

SEQ ID NO: 4319401 - DNA, 15 bp, Homo sapiens
aatctgggaagattt

SEQ ID NO: 4319402 - DNA, 19 bp, Homo sapiens
aatctggggaagaggtttt

SEQ ID NO: 4319403 - DNA, 22 bp, Homo sapiens
aatctggggaagaggttttatt

SEQ ID NO: 4319404 - DNA, 18 bp, Homo sapiens
aatcttagtatagtagaa

SEQ ID NO: 4319405 - DNA, 15 bp, Homo sapiens
aatcttcggccaatt

SEQ ID NO: 4319406 - DNA, 20 bp, Homo sapiens
aatgaaaagtcgttttccaa

SEQ ID NO: 4319407 - DNA, 21 bp, Homo sapiens
aatgaaaagtcgttttccaaa

SEQ ID NO: 4319408 - DNA, 13 bp, Homo sapiens
aatgaactactgc

SEQ ID NO: 4319409 - DNA, 20 bp, Homo sapiens
aatgaagcagaggaaggaaa

SEQ ID NO: 4319410 - DNA, 15 bp, Homo sapiens
aatgactattgtaat

SEQ ID NO: 4319411 - DNA, 15 bp, Homo sapiens
aatgagcctggcaag

SEQ ID NO: 4319412 - DNA, 23 bp, Homo sapiens
aatgagggtttctgatctgtact

SEQ ID NO: 4319413 - DNA, 15 bp, Homo sapiens
aatgagttacttaga

SEQ ID NO: 4319414 - DNA, 20 bp, Homo sapiens
aatgagttgctggaaaatca

SEQ ID NO: 4319415 - DNA, 22 bp, Homo sapiens
aatgagttgctggaaaatcata

SEQ ID NO: 4319416 - DNA, 21 bp, Homo sapiens
aatgatcacatctaaagcttt

SEQ ID NO: 4319417 - DNA, 22 bp, Homo sapiens
aatgatcacatctaaagcttta

SEQ ID NO: 4319418 - DNA, 15 bp, Homo sapiens
aatgatccctcagtc

SEQ ID NO: 4319419 - DNA, 17 bp, Homo sapiens
aatgattggttaaaatg

SEQ ID NO: 4319420 - DNA, 17 bp, Homo sapiens
aatgcacagatatactt

SEQ ID NO: 4319421 - DNA, 18 bp, Homo sapiens
aatgcattccagaacaaa

SEQ ID NO: 4319422 - DNA, 18 bp, Homo sapiens
aatgccaaaatgtactta

SEQ ID NO: 4319423 - DNA, 17 bp, Homo sapiens
aatgccataaaattgca

SEQ ID NO: 4319424 - DNA, 17 bp, Homo sapiens
aatgcccatttttgcta

SEQ ID NO: 4319425 - DNA, 16 bp, Homo sapiens
aatgccctatgtgtat

SEQ ID NO: 4319426 - DNA, 17 bp, Homo sapiens
aatgccctatgtgtata

SEQ ID NO: 4319427 - DNA, 18 bp, Homo sapiens
aatgctgagctgaagaaa

SEQ ID NO: 4319428 - DNA, 14 bp, Homo sapiens
aatgctggcctgac

SEQ ID NO: 4319429 - DNA, 12 bp, Homo sapiens
aatggagaaaat

SEQ ID NO: 4319430 - DNA, 13 bp, Homo sapiens
aatggagaaaatg

SEQ ID NO: 4319431 - DNA, 14 bp, Homo sapiens
aatggagaaatgaa

SEQ ID NO: 4319432 - DNA, 17 bp, Homo sapiens
aatggagtgtttgaaaa

SEQ ID NO: 4319433 - DNA, 15 bp, Homo sapiens
aatggatgacaaaga

SEQ ID NO: 4319434 - DNA, 18 bp, Homo sapiens
aatggatgacaaagaaaa

SEQ ID NO: 4319435 - DNA, 13 bp, Homo sapiens
aatggcatggaga

SEQ ID NO: 4319436 - DNA, 16 bp, Homo sapiens
aatgggagcaacatat

SEQ ID NO: 4319437 - DNA, 15 bp, Homo sapiens
aatggtcctgacttt

SEQ ID NO: 4319438 - DNA, 20 bp, Homo sapiens
aatggtttctcattaaactc

SEQ ID NO: 4319439 - DNA, 16 bp, Homo sapiens
aatgtaatgtcagact

SEQ ID NO: 4319440 - DNA, 17 bp, Homo sapiens
aatgtacttaaatgagt

SEQ ID NO: 4319441 - DNA, 22 bp, Homo sapiens
aatgtagaaatgtttcatacag

SEQ ID NO: 4319442 - DNA, 14 bp, Homo sapiens
aatgtagactctga

SEQ ID NO: 4319443 - DNA, 16 bp, Homo sapiens
aatgtagccctctcca

SEQ ID NO: 4319444 - DNA, 22 bp, Homo sapiens
aatgtcagactttgctgcattt

SEQ ID NO: 4319445 - DNA, 22 bp, Homo sapiens
aatgtctagttgtaacaccatg

SEQ ID NO: 4319446 - DNA, 17 bp, Homo sapiens
aatgtgaaaagaaaaat

SEQ ID NO: 4319447 - DNA, 21 bp, Homo sapiens
aatgtgtatctatttatatat

SEQ ID NO: 4319448 - DNA, 14 bp, Homo sapiens
aatgtgtctgtgtt

SEQ ID NO: 4319449 - DNA, 22 bp, Homo sapiens
aatgtgtttttctccagtgctg

SEQ ID NO: 4319450 - DNA, 12 bp, Homo sapiens
aatgttaagaaa

SEQ ID NO: 4319451 - DNA, 17 bp, Homo sapiens
aatgttctaaattctat

SEQ ID NO: 4319452 - DNA, 13 bp, Homo sapiens
aatgttggctgcg

SEQ ID NO: 4319453 - DNA, 21 bp, Homo sapiens
aatgtttacagggagcctcct

SEQ ID NO: 4319454 - DNA, 20 bp, Homo sapiens
aatgtttagtgtgctgctgt

SEQ ID NO: 4319455 - DNA, 15 bp, Homo sapiens
aatgtttattccttg

SEQ ID NO: 4319456 - DNA, 14 bp, Homo sapiens
aattaaaaatgaaa

SEQ ID NO: 4319457 - DNA, 20 bp, Homo sapiens
aattaaaaggatagtatttt

SEQ ID NO: 4319458 - DNA, 16 bp, Homo sapiens
aattaaactagtttaa

SEQ ID NO: 4319459 - DNA, 18 bp, Homo sapiens
aattaaagccttaagcac

SEQ ID NO: 4319460 - DNA, 22 bp, Homo sapiens
aattacgttcttacaagcttaa

SEQ ID NO: 4319461 - DNA, 19 bp, Homo sapiens
aattataaaattgaaaaca

SEQ ID NO: 4319462 - DNA, 12 bp, Homo sapiens
aattatccatta

SEQ ID NO: 4319463 - DNA, 21 bp, Homo sapiens
aattatccattacgtgcattt

SEQ ID NO: 4319464 - DNA, 15 bp, Homo sapiens
aattattgatatata

SEQ ID NO: 4319465 - DNA, 16 bp, Homo sapiens
aattattgatatatat

SEQ ID NO: 4319466 - DNA, 18 bp, Homo sapiens
aattattgatatatatta

SEQ ID NO: 4319467 - DNA, 19 bp, Homo sapiens
aattatttcagattcctca

SEQ ID NO: 4319468 - DNA, 15 bp, Homo sapiens
aattcctacagcact

SEQ ID NO: 4319469 - DNA, 16 bp, Homo sapiens
aattctctcaagactt

SEQ ID NO: 4319470 - DNA, 11 bp, Homo sapiens
aattctgaaat

SEQ ID NO: 4319471 - DNA, 17 bp, Homo sapiens
aattctgaaatactttt

SEQ ID NO: 4319472 - DNA, 21 bp, Homo sapiens
aattgaaaacactaacaaaat

SEQ ID NO: 4319473 - DNA, 12 bp, Homo sapiens
aattgagaaaag

SEQ ID NO: 4319474 - DNA, 18 bp, Homo sapiens
aattgagaataagaattt

SEQ ID NO: 4319475 - DNA, 23 bp, Homo sapiens
aattgctgaagggcattctttcc

SEQ ID NO: 4319476 - DNA, 22 bp, Homo sapiens
actaaatatgaaccctttgttt

SEQ ID NO: 4319477 - DNA, 14 bp, Homo sapiens
actaacaaaatttg

SEQ ID NO: 4319478 - DNA, 21 bp, Homo sapiens
actaagaaatgggactctgaa

SEQ ID NO: 4319479 - DNA, 22 bp, Homo sapiens
actaagagaaaccttgcaaact

SEQ ID NO: 4319480 - DNA, 23 bp, Homo sapiens
actaatgttggacagacactgtt

SEQ ID NO: 4319481 - DNA, 13 bp, Homo sapiens
actaattccttaa

SEQ ID NO: 4319482 - DNA, 21 bp, Homo sapiens
actaattccttaaatgaacta

SEQ ID NO: 4319483 - DNA, 13 bp, Homo sapiens
actacatctgcct

SEQ ID NO: 4319484 - DNA, 16 bp, Homo sapiens
actacattagggaagc

SEQ ID NO: 4319485 - DNA, 16 bp, Homo sapiens
actacgcacagctgcc

SEQ ID NO: 4319486 - DNA, 18 bp, Homo sapiens
actactgggtgtcatttc

SEQ ID NO: 4319487 - DNA, 21 bp, Homo sapiens
actactgggtgtcatttcatt

SEQ ID NO: 4319488 - DNA, 15 bp, Homo sapiens
actacttaccatttg

SEQ ID NO: 4319489 - DNA, 16 bp, Homo sapiens
actagagaatgcacag

SEQ ID NO: 4319490 - DNA, 20 bp, Homo sapiens
actagagaatgcacagatat

SEQ ID NO: 4319491 - DNA, 23 bp, Homo sapiens
actagagaatgcacagatatact

SEQ ID NO: 4319492 - DNA, 12 bp, Homo sapiens
actaggaattct

SEQ ID NO: 4319493 - DNA, 17 bp, Homo sapiens
actagggaagataatat

SEQ ID NO: 4319494 - DNA, 13 bp, Homo sapiens
actaggggaggag

SEQ ID NO: 4319495 - DNA, 18 bp, Homo sapiens
actaggtgaacagcagga

SEQ ID NO: 4319496 - DNA, 19 bp, Homo sapiens
actagtaagtaattatgca

SEQ ID NO: 4319497 - DNA, 14 bp, Homo sapiens
actattatgaaatc

SEQ ID NO: 4319498 - DNA, 13 bp, Homo sapiens
actattgtaatgc

SEQ ID NO: 4319499 - DNA, 21 bp, Homo sapiens
actatttgggctctgaaataa

SEQ ID NO: 4319500 - DNA, 23 bp, Homo sapiens
actattttgttttaatctacttt

SEQ ID NO: 4319501 - DNA, 14 bp, Homo sapiens
actatttttctatg

SEQ ID NO: 4319502 - DNA, 15 bp, Homo sapiens
actatttttctatga

SEQ ID NO: 4319503 - DNA, 14 bp, Homo sapiens
actattttttaata

SEQ ID NO: 4319504 - DNA, 16 bp, Homo sapiens
actattttttaataaa

SEQ ID NO: 4319505 - DNA, 22 bp, Homo sapiens
actcaagtgtcacctccttccc

SEQ ID NO: 4319506 - DNA, 12 bp, Homo sapiens
actcatcttagg

SEQ ID NO: 4319507 - DNA, 18 bp, Homo sapiens
actcatgcaaactgcttt

SEQ ID NO: 4319508 - DNA, 20 bp, Homo sapiens
actcatgcaaactgctttat

SEQ ID NO: 4319509 - DNA, 12 bp, Homo sapiens
actccagcctgg

SEQ ID NO: 4319510 - DNA, 14 bp, Homo sapiens
actcccccaggtgg

SEQ ID NO: 4319511 - DNA, 14 bp, Homo sapiens
actcccttctgtag

SEQ ID NO: 4319512 - DNA, 14 bp, Homo sapiens
actcctatttttgt

SEQ ID NO: 4319513 - DNA, 19 bp, Homo sapiens
actcctcttcccagagtca

SEQ ID NO: 4319514 - DNA, 14 bp, Homo sapiens
actcctggagcact

SEQ ID NO: 4319515 - DNA, 18 bp, Homo sapiens
actccttgaaatgtgtgt

SEQ ID NO: 4319516 - DNA, 12 bp, Homo sapiens
actctaaagatt

SEQ ID NO: 4319517 - DNA, 21 bp, Homo sapiens
actctaccctcttagaaaaac

SEQ ID NO: 4319518 - DNA, 22 bp, Homo sapiens
actctataaagaaacttttgaa

SEQ ID NO: 4319519 - DNA, 22 bp, Homo sapiens
actctctataagtgttcagtgt

SEQ ID NO: 4319520 - DNA, 23 bp, Homo sapiens
actctctataagtgttcagtgtt

SEQ ID NO: 4319521 - DNA, 24 bp, Homo sapiens
actctctataagtgttcagtgttg

SEQ ID NO: 4319522 - DNA, 19 bp, Homo sapiens
actctcttttgaggtccct

SEQ ID NO: 4319523 - DNA, 22 bp, Homo sapiens
actctcttttgaggtccctgta

SEQ ID NO: 4319524 - DNA, 11 bp, Homo sapiens
actctgtgtga

SEQ ID NO: 4319525 - DNA, 22 bp, Homo sapiens
actctgtgtgagcgtgtccaca

SEQ ID NO: 4319526 - DNA, 21 bp, Homo sapiens
actctgttattgatcccttct

SEQ ID NO: 4319527 - DNA, 18 bp, Homo sapiens
actcttaaaacccaagtg

SEQ ID NO: 4319528 - DNA, 15 bp, Homo sapiens
actcttaaatcattt

SEQ ID NO: 4319529 - DNA, 16 bp, Homo sapiens
actcttcatatatgct

SEQ ID NO: 4319530 - DNA, 15 bp, Homo sapiens
actcttccacctctg

SEQ ID NO: 4319531 - DNA, 13 bp, Homo sapiens
actgaagccgtgt

SEQ ID NO: 4319532 - DNA, 17 bp, Homo sapiens
actgaagctggggcttg

SEQ ID NO: 4319533 - DNA, 13 bp, Homo sapiens
actgacatcagat

SEQ ID NO: 4319534 - DNA, 19 bp, Homo sapiens
actgacatcagatttctta

SEQ ID NO: 4319535 - DNA, 20 bp, Homo sapiens
actgacatcagatttcttaa

SEQ ID NO: 4319536 - DNA, 20 bp, Homo sapiens
actgatacatctgatgcatg

SEQ ID NO: 4319537 - DNA, 16 bp, Homo sapiens
actgatggtttggaaa

SEQ ID NO: 4319538 - DNA, 18 bp, Homo sapiens
actgatggtttggaaaat

SEQ ID NO: 4319539 - DNA, 19 bp, Homo sapiens
actgattccctctcccacc

SEQ ID NO: 4319540 - DNA, 19 bp, Homo sapiens
actgatttagaagcaaaga

SEQ ID NO: 4319541 - DNA, 18 bp, Homo sapiens
actgcaaataaagccttt

SEQ ID NO: 4319542 - DNA, 18 bp, Homo sapiens
actgcactccagcctggg

SEQ ID NO: 4319543 - DNA, 20 bp, Homo sapiens
actgcactccagcctgggtg

SEQ ID NO: 4319544 - DNA, 15 bp, Homo sapiens
actgccttcctcctt

SEQ ID NO: 4319545 - DNA, 21 bp, Homo sapiens
actgctattttttttaaatca

SEQ ID NO: 4319546 - DNA, 22 bp, Homo sapiens
actggaaatgtttgtccttgca

SEQ ID NO: 4319547 - DNA, 16 bp, Homo sapiens
actggagctgctaagc

SEQ ID NO: 4319548 - DNA, 17 bp, Homo sapiens
actggcacttgcctgct

SEQ ID NO: 4319549 - DNA, 16 bp, Homo sapiens
actgggcacccctgcc

SEQ ID NO: 4319550 - DNA, 18 bp, Homo sapiens
actgggcatttcacgaac

SEQ ID NO: 4319551 - DNA, 23 bp, Homo sapiens
actggggcctggggctctagccc

SEQ ID NO: 4319552 - DNA, 22 bp, Homo sapiens
actgggggcggggcctgggcgg

SEQ ID NO: 4319553 - DNA, 22 bp, Homo sapiens
actgggtgtcatttcattccat

SEQ ID NO: 4319554 - DNA, 12 bp, Homo sapiens
actggtctgtct

SEQ ID NO: 4319555 - DNA, 14 bp, Homo sapiens
actggttgtcagaa

SEQ ID NO: 4319556 - DNA, 16 bp, Homo sapiens
actggttgtcagaatg

SEQ ID NO: 4319557 - DNA, 14 bp, Homo sapiens
actggtttgagatt

SEQ ID NO: 4319558 - DNA, 18 bp, Homo sapiens
actgtaactttttttcag

SEQ ID NO: 4319559 - DNA, 21 bp, Homo sapiens
actgtaactttttttcagttc

SEQ ID NO: 4319560 - DNA, 17 bp, Homo sapiens
actgtatttcagtattt

SEQ ID NO: 4319561 - DNA, 20 bp, Homo sapiens
actgtatttcagtattttcc

SEQ ID NO: 4319562 - DNA, 14 bp, Homo sapiens
actgtatttctgtg

SEQ ID NO: 4319563 - DNA, 17 bp, Homo sapiens
actgtatttctgtggaa

SEQ ID NO: 4319564 - DNA, 19 bp, Homo sapiens
actgtatttttgaagacta

SEQ ID NO: 4319565 - DNA, 20 bp, Homo sapiens
actgtggccatatatgctgt

SEQ ID NO: 4319566 - DNA, 17 bp, Homo sapiens
actgtgtctgaatcatg

SEQ ID NO: 4319567 - DNA, 22 bp, Homo sapiens
actgtgtgtttgggaaggtggg

SEQ ID NO: 4319568 - DNA, 14 bp, Homo sapiens
acttaccatttgct

SEQ ID NO: 4319569 - DNA, 16 bp, Homo sapiens
acttacctgcttgagc

SEQ ID NO: 4319570 - DNA, 17 bp, Homo sapiens
acttacctgcttgagct

SEQ ID NO: 4319571 - DNA, 11 bp, Homo sapiens
acttactgcat

SEQ ID NO: 4319572 - DNA, 13 bp, Homo sapiens
acttactgcattg

SEQ ID NO: 4319573 - DNA, 23 bp, Homo sapiens
acttaggtaaaataaaagactat

SEQ ID NO: 4319574 - DNA, 12 bp, Homo sapiens
acttcaggagcc

SEQ ID NO: 4319575 - DNA, 19 bp, Homo sapiens
acttccattgcaaaataga

SEQ ID NO: 4319576 - DNA, 18 bp, Homo sapiens
acttccgtcccactgaag

SEQ ID NO: 4319577 - DNA, 22 bp, Homo sapiens
acttcctaatgccctatgtgta

SEQ ID NO: 4319578 - DNA, 17 bp, Homo sapiens
acttcgggaggtcgagg

SEQ ID NO: 4319579 - DNA, 20 bp, Homo sapiens
acttcgggaggtcgaggcag

SEQ ID NO: 4319580 - DNA, 20 bp, Homo sapiens
acttctcgcaactgaaggaa

SEQ ID NO: 4319581 - DNA, 21 bp, Homo sapiens
acttctcgcaactgaaggaag

SEQ ID NO: 4319582 - DNA, 19 bp, Homo sapiens
acttctgagccccagcccc

SEQ ID NO: 4319583 - DNA, 14 bp, Homo sapiens
acttgcactgttac

SEQ ID NO: 4319584 - DNA, 20 bp, Homo sapiens
acttgcagcgccaagtggcc

SEQ ID NO: 4319585 - DNA, 16 bp, Homo sapiens
acttgccaaaatgttg

SEQ ID NO: 4319586 - DNA, 12 bp, Homo sapiens
acttgcctgctg

SEQ ID NO: 4319587 - DNA, 13 bp, Homo sapiens
acttgcctgctgc

SEQ ID NO: 4319588 - DNA, 14 bp, Homo sapiens
acttgcctgctgct

SEQ ID NO: 4319589 - DNA, 14 bp, Homo sapiens
acttgggagggggc

SEQ ID NO: 4319590 - DNA, 15 bp, Homo sapiens
acttgggccactgtg

SEQ ID NO: 4319591 - DNA, 23 bp, Homo sapiens
acttgtcctttgaggccccaact

SEQ ID NO: 4319592 - DNA, 18 bp, Homo sapiens
acttgtgaatgcttctca

SEQ ID NO: 4319593 - DNA, 16 bp, Homo sapiens
acttgtgcacttagta

SEQ ID NO: 4319594 - DNA, 22 bp, Homo sapiens
agcctgcccagttggaggagac

SEQ ID NO: 4319595 - DNA, 15 bp, Homo sapiens
agcctgctccagctg

SEQ ID NO: 4319596 - DNA, 16 bp, Homo sapiens
agcctgctccagctgt

SEQ ID NO: 4319597 - DNA, 17 bp, Homo sapiens
agcctgctccagctgtt

SEQ ID NO: 4319598 - DNA, 16 bp, Homo sapiens
agcctggacccccagc

SEQ ID NO: 4319599 - DNA, 17 bp, Homo sapiens
agcctggacccccagct

SEQ ID NO: 4319600 - DNA, 14 bp, Homo sapiens
agcctggaccctgt

SEQ ID NO: 4319601 - DNA, 21 bp, Homo sapiens
agcctggctggagagctgcta

SEQ ID NO: 4319602 - DNA, 20 bp, Homo sapiens
agcctgggaggtcaaggctg

SEQ ID NO: 4319603 - DNA, 16 bp, Homo sapiens
agccttactcacctct

SEQ ID NO: 4319604 - DNA, 13 bp, Homo sapiens
agccttttaaatc

SEQ ID NO: 4319605 - DNA, 16 bp, Homo sapiens
agcgctgttgcccgcc

SEQ ID NO: 4319606 - DNA, 18 bp, Homo sapiens
agcgtacgatggaggcct

SEQ ID NO: 4319607 - DNA, 22 bp, Homo sapiens
agcgtgagacgccaccattcct

SEQ ID NO: 4319608 - DNA, 17 bp, Homo sapiens
agcgtgggctcagcagg

SEQ ID NO: 4319609 - DNA, 20 bp, Homo sapiens
agcgtgggctcagcagggct

SEQ ID NO: 4319610 - DNA, 21 bp, Homo sapiens
agcgtggtttttatgtgtatt

SEQ ID NO: 4319611 - DNA, 20 bp, Homo sapiens
agctaatctgcctggtttta

SEQ ID NO: 4319612 - DNA, 16 bp, Homo sapiens
agctacctttttatat

SEQ ID NO: 4319613 - DNA, 11 bp, Homo sapiens
agctagaaagt

SEQ ID NO: 4319614 - DNA, 16 bp, Homo sapiens
agctagactgtgtctg

SEQ ID NO: 4319615 - DNA, 17 bp, Homo sapiens
agctagactgtgtctga

SEQ ID NO: 4319616 - DNA, 15 bp, Homo sapiens
agctatagtgaagaa

SEQ ID NO: 4319617 - DNA, 16 bp, Homo sapiens
agctatagtgaagaat

SEQ ID NO: 4319618 - DNA, 18 bp, Homo sapiens
agctattaaaatgtaact

SEQ ID NO: 4319619 - DNA, 15 bp, Homo sapiens
agctcccccaggcag

SEQ ID NO: 4319620 - DNA, 14 bp, Homo sapiens
agctccccctgtcc

SEQ ID NO: 4319621 - DNA, 16 bp, Homo sapiens
agctccccctgtcccc

SEQ ID NO: 4319622 - DNA, 16 bp, Homo sapiens
agctccctgaccccct

SEQ ID NO: 4319623 - DNA, 20 bp, Homo sapiens
agctccctgaccccctgtcc

SEQ ID NO: 4319624 - DNA, 16 bp, Homo sapiens
agctcgatccaaattg

SEQ ID NO: 4319625 - DNA, 14 bp, Homo sapiens
agctctctctcctg

SEQ ID NO: 4319626 - DNA, 15 bp, Homo sapiens
agctctctctcctgg

SEQ ID NO: 4319627 - DNA, 12 bp, Homo sapiens
agctctgagccg

SEQ ID NO: 4319628 - DNA, 18 bp, Homo sapiens
agctcttttttgtttgtt

SEQ ID NO: 4319629 - DNA, 23 bp, Homo sapiens
agctgaagaaattatacgtacat

SEQ ID NO: 4319630 - DNA, 23 bp, Homo sapiens
agctgacggtttctccccggaca

SEQ ID NO: 4319631 - DNA, 17 bp, Homo sapiens
agctgcaccctcaggca

SEQ ID NO: 4319632 - DNA, 20 bp, Homo sapiens
agctgcaccctcaggcaggt

SEQ ID NO: 4319633 - DNA, 13 bp, Homo sapiens
agctgccctgagg

SEQ ID NO: 4319634 - DNA, 19 bp, Homo sapiens
agctgctaagctaaagaaa

SEQ ID NO: 4319635 - DNA, 18 bp, Homo sapiens
agctgctgcgggaggtag

SEQ ID NO: 4319636 - DNA, 19 bp, Homo sapiens
agctggcccagttgtccat

SEQ ID NO: 4319637 - DNA, 14 bp, Homo sapiens
agctgggcaggttg

SEQ ID NO: 4319638 - DNA, 12 bp, Homo sapiens
agctgtttatgt

SEQ ID NO: 4319639 - DNA, 15 bp, Homo sapiens
agcttcctgtctgtt

SEQ ID NO: 4319640 - DNA, 18 bp, Homo sapiens
agcttgatttgatctttg

SEQ ID NO: 4319641 - DNA, 22 bp, Homo sapiens
agcttgtgctgagcctgcccag

SEQ ID NO: 4319642 - DNA, 17 bp, Homo sapiens
agcttgttccctgtctt

SEQ ID NO: 4319643 - DNA, 23 bp, Homo sapiens
agctttatctttgtgtaatctaa

SEQ ID NO: 4319644 - DNA, 16 bp, Homo sapiens
agctttctaatgttct

SEQ ID NO: 4319645 - DNA, 15 bp, Homo sapiens
agctttctgtgcatg

SEQ ID NO: 4319646 - DNA, 17 bp, Homo sapiens
agctttctgtgcatgtg

SEQ ID NO: 4319647 - DNA, 21 bp, Homo sapiens
agctttctgtgcatgtgcagg

SEQ ID NO: 4319648 - DNA, 23 bp, Homo sapiens
agctttgtttgttgtcagctgaa

SEQ ID NO: 4319649 - DNA, 13 bp, Homo sapiens
agcttttcctttc

SEQ ID NO: 4319650 - DNA, 16 bp, Homo sapiens
agcttttcctttcttt

SEQ ID NO: 4319651 - DNA, 14 bp, Homo sapiens
aggaaaaacagagg

SEQ ID NO: 4319652 - DNA, 18 bp, Homo sapiens
aggaaaaagcacaagaag

SEQ ID NO: 4319653 - DNA, 15 bp, Homo sapiens
aggaaaatcaatgct

SEQ ID NO: 4319654 - DNA, 16 bp, Homo sapiens
aggaaacatagaaaga

SEQ ID NO: 4319655 - DNA, 19 bp, Homo sapiens
aggaaattaagaactgaat

SEQ ID NO: 4319656 - DNA, 22 bp, Homo sapiens
aggaagatgggggcaagaagat

SEQ ID NO: 4319657 - DNA, 18 bp, Homo sapiens
aggaaggaaacatagaaa

SEQ ID NO: 4319658 - DNA, 22 bp, Homo sapiens
aggaaggaaacatagaaagaca

SEQ ID NO: 4319659 - DNA, 15 bp, Homo sapiens
aggaaggagaggaga

SEQ ID NO: 4319660 - DNA, 20 bp, Homo sapiens
aggaagtgcttattctctca

SEQ ID NO: 4319661 - DNA, 19 bp, Homo sapiens
aggaattcaatttggcaaa

SEQ ID NO: 4319662 - DNA, 16 bp, Homo sapiens
aggaattctttgcatt

SEQ ID NO: 4319663 - DNA, 15 bp, Homo sapiens
aggaattgtttatac

SEQ ID NO: 4319664 - DNA, 14 bp, Homo sapiens
aggacactaggaga

SEQ ID NO: 4319665 - DNA, 18 bp, Homo sapiens
aggacactaggagactgg

SEQ ID NO: 4319666 - DNA, 19 bp, Homo sapiens
aggacactaggagactggt

SEQ ID NO: 4319667 - DNA, 20 bp, Homo sapiens
aggacactaggagactggtt

SEQ ID NO: 4319668 - DNA, 19 bp, Homo sapiens
aggacatgagactaagaga

SEQ ID NO: 4319669 - DNA, 23 bp, Homo sapiens
aggaccgttttgtattgcttcct

SEQ ID NO: 4319670 - DNA, 13 bp, Homo sapiens
aggacctcaggtg

SEQ ID NO: 4319671 - DNA, 14 bp, Homo sapiens
aggactgaagctgg

SEQ ID NO: 4319672 - DNA, 21 bp, Homo sapiens
aggactttcctaaatgtttaa

SEQ ID NO: 4319673 - DNA, 18 bp, Homo sapiens
aggagaagagttgaggaa

SEQ ID NO: 4319674 - DNA, 14 bp, Homo sapiens
aggagaaggagtgc

SEQ ID NO: 4319675 - DNA, 11 bp, Homo sapiens
aggagaatatg

SEQ ID NO: 4319676 - DNA, 22 bp, Homo sapiens
aggagactgggcacccctgcct

SEQ ID NO: 4319677 - DNA, 17 bp, Homo sapiens
aggagagagggtctcca

SEQ ID NO: 4319678 - DNA, 15 bp, Homo sapiens
aggagatcttcccct

SEQ ID NO: 4319679 - DNA, 15 bp, Homo sapiens
aggagggagagccct

SEQ ID NO: 4319680 - DNA, 19 bp, Homo sapiens
aggaggtcgtttatgtgtg

SEQ ID NO: 4319681 - DNA, 18 bp, Homo sapiens
aggaggttctgggcctct

SEQ ID NO: 4319682 - DNA, 19 bp, Homo sapiens
aggaggttctgggcctctg

SEQ ID NO: 4319683 - DNA, 16 bp, Homo sapiens
aggatagtatttttat

SEQ ID NO: 4319684 - DNA, 15 bp, Homo sapiens
aggatatactgcagc

SEQ ID NO: 4319685 - DNA, 20 bp, Homo sapiens
aggatcaccccagcccccac

SEQ ID NO: 4319686 - DNA, 22 bp, Homo sapiens
aggatcaccccagcccccacag

SEQ ID NO: 4319687 - DNA, 22 bp, Homo sapiens
aggatctcttgagcctgggagg

SEQ ID NO: 4319688 - DNA, 17 bp, Homo sapiens
aggatgagcaaaacatt

SEQ ID NO: 4319689 - DNA, 16 bp, Homo sapiens
aggatgatggaaaaat

SEQ ID NO: 4319690 - DNA, 15 bp, Homo sapiens
aggatgccctgttgg

SEQ ID NO: 4319691 - DNA, 20 bp, Homo sapiens
aggatgctgaagtacagtcc

SEQ ID NO: 4319692 - DNA, 21 bp, Homo sapiens
aggatgggagagctagaaagt

SEQ ID NO: 4319693 - DNA, 19 bp, Homo sapiens
aggattgggggatgtgaag

SEQ ID NO: 4319694 - DNA, 14 bp, Homo sapiens
aggcaaaaccttgt

SEQ ID NO: 4319695 - DNA, 23 bp, Homo sapiens
aggcacataggctggtggccttg

SEQ ID NO: 4319696 - DNA, 20 bp, Homo sapiens
aggcacttttattttcattg

SEQ ID NO: 4319697 - DNA, 23 bp, Homo sapiens
aggcagaaatagttgtctgtgct

SEQ ID NO: 4319698 - DNA, 14 bp, Homo sapiens
aggcagctctgagc

SEQ ID NO: 4319699 - DNA, 12 bp, Homo sapiens
aggcaggatggc

SEQ ID NO: 4319700 - DNA, 15 bp, Homo sapiens
aggcaggtggagaga

SEQ ID NO: 4319701 - DNA, 15 bp, Homo sapiens
aggcatctgcatggg

SEQ ID NO: 4319702 - DNA, 17 bp, Homo sapiens
aggccaaacatggccag

SEQ ID NO: 4319703 - DNA, 13 bp, Homo sapiens
aggccagaaaaag

SEQ ID NO: 4319704 - DNA, 20 bp, Homo sapiens
aggccgatggggaaggagaa

SEQ ID NO: 4319705 - DNA, 18 bp, Homo sapiens
aggccggagacccacagc

SEQ ID NO: 4319706 - DNA, 12 bp, Homo sapiens
aggcctccctgt

SEQ ID NO: 4319707 - DNA, 11 bp, Homo sapiens
aggcctctgcc

SEQ ID NO: 4319708 - DNA, 13 bp, Homo sapiens
aggcctctgcccc

SEQ ID NO: 4319709 - DNA, 19 bp, Homo sapiens
aggcctctgccccaagagc

SEQ ID NO: 4319710 - DNA, 14 bp, Homo sapiens
aggcgaataaatgt

SEQ ID NO: 4319711 - DNA, 19 bp, Homo sapiens
aggcgaataaatgttcaaa

SEQ ID NO: 4319712 - DNA, 13 bp, Homo sapiens
atacccaacagtt

SEQ ID NO: 4319713 - DNA, 14 bp, Homo sapiens
ataccgagaatgat

SEQ ID NO: 4319714 - DNA, 17 bp, Homo sapiens
atacctattaaaggaaa

SEQ ID NO: 4319715 - DNA, 14 bp, Homo sapiens
ataccttctcccag

SEQ ID NO: 4319716 - DNA, 17 bp, Homo sapiens
ataccttctcccaggcc

SEQ ID NO: 4319717 - DNA, 14 bp, Homo sapiens
atactaatttattg

SEQ ID NO: 4319718 - DNA, 17 bp, Homo sapiens
atactaatttattgccg

SEQ ID NO: 4319719 - DNA, 23 bp, Homo sapiens
atactagtgggatcaacaatgat

SEQ ID NO: 4319720 - DNA, 22 bp, Homo sapiens
atactctaaaatggacattttc

SEQ ID NO: 4319721 - DNA, 16 bp, Homo sapiens
atactgtcttgtctca

SEQ ID NO: 4319722 - DNA, 16 bp, Homo sapiens
atacttaaatatttgt

SEQ ID NO: 4319723 - DNA, 14 bp, Homo sapiens
atagaaacatacac

SEQ ID NO: 4319724 - DNA, 15 bp, Homo sapiens
atagaaagacatggg

SEQ ID NO: 4319725 - DNA, 15 bp, Homo sapiens
atagaaagagttcta

SEQ ID NO: 4319726 - DNA, 13 bp, Homo sapiens
atagaaagcaaac

SEQ ID NO: 4319727 - DNA, 16 bp, Homo sapiens
atagaatatactgtct

SEQ ID NO: 4319728 - DNA, 15 bp, Homo sapiens
atagagaatacacat

SEQ ID NO: 4319729 - DNA, 17 bp, Homo sapiens
atagagaatacacatat

SEQ ID NO: 4319730 - DNA, 20 bp, Homo sapiens
atagagaccaggagggagag

SEQ ID NO: 4319731 - DNA, 18 bp, Homo sapiens
atagaggtatattggaag

SEQ ID NO: 4319732 - DNA, 19 bp, Homo sapiens
atagaggtatattggaaga

SEQ ID NO: 4319733 - DNA, 17 bp, Homo sapiens
atagagtaatgatgtaa

SEQ ID NO: 4319734 - DNA, 13 bp, Homo sapiens
atagatttgaaaa

SEQ ID NO: 4319735 - DNA, 16 bp, Homo sapiens
atagcatggggcccct

SEQ ID NO: 4319736 - DNA, 20 bp, Homo sapiens
atagctcccaaaagaatgga

SEQ ID NO: 4319737 - DNA, 14 bp, Homo sapiens
atagctttcacaag

SEQ ID NO: 4319738 - DNA, 19 bp, Homo sapiens
ataggtgcaaacaaacaag

SEQ ID NO: 4319739 - DNA, 16 bp, Homo sapiens
atagtaccagaagcaa

SEQ ID NO: 4319740 - DNA, 22 bp, Homo sapiens
atagtatatgattgtatttaaa

SEQ ID NO: 4319741 - DNA, 16 bp, Homo sapiens
atagtatttttatcca

SEQ ID NO: 4319742 - DNA, 23 bp, Homo sapiens
atagtgctacctgcacctctgga

SEQ ID NO: 4319743 - DNA, 15 bp, Homo sapiens
atagttgtctgtgct

SEQ ID NO: 4319744 - DNA, 16 bp, Homo sapiens
atagtttccaagaaat

SEQ ID NO: 4319745 - DNA, 18 bp, Homo sapiens
atataaaaacaatatatt

SEQ ID NO: 4319746 - DNA, 14 bp, Homo sapiens
atataaaatatttt

SEQ ID NO: 4319747 - DNA, 18 bp, Homo sapiens
atataaaggcaaggaaat

SEQ ID NO: 4319748 - DNA, 13 bp, Homo sapiens
atataaagtatag

SEQ ID NO: 4319749 - DNA, 14 bp, Homo sapiens
atataaagtataga

SEQ ID NO: 4319750 - DNA, 18 bp, Homo sapiens
atataagaatgagcctgt

SEQ ID NO: 4319751 - DNA, 17 bp, Homo sapiens
atatataaaagtctgag

SEQ ID NO: 4319752 - DNA, 23 bp, Homo sapiens
atatataaaagtctgagttctct

SEQ ID NO: 4319753 - DNA, 14 bp, Homo sapiens
atatataaaatatt

SEQ ID NO: 4319754 - DNA, 15 bp, Homo sapiens
atatataaagaatat

SEQ ID NO: 4319755 - DNA, 18 bp, Homo sapiens
atatataaagtatagaga

SEQ ID NO: 4319756 - DNA, 13 bp, Homo sapiens
atatatataaagt

SEQ ID NO: 4319757 - DNA, 11 bp, Homo sapiens
atatatatata

SEQ ID NO: 4319758 - DNA, 13 bp, Homo sapiens
atatatatataaa

SEQ ID NO: 4319759 - DNA, 14 bp, Homo sapiens
atatatatataaag

SEQ ID NO: 4319760 - DNA, 15 bp, Homo sapiens
atatatatataaagt

SEQ ID NO: 4319761 - DNA, 15 bp, Homo sapiens
atatatatatataaa

SEQ ID NO: 4319762 - DNA, 17 bp, Homo sapiens
atatatattataaatat

SEQ ID NO: 4319763 - DNA, 13 bp, Homo sapiens
atatatcatagta

SEQ ID NO: 4319764 - DNA, 22 bp, Homo sapiens
atatatgctgtatttctttgta

SEQ ID NO: 4319765 - DNA, 23 bp, Homo sapiens
atatatgtatatatattctcagc

SEQ ID NO: 4319766 - DNA, 14 bp, Homo sapiens
atatattactgatt

SEQ ID NO: 4319767 - DNA, 18 bp, Homo sapiens
atatattactgatttaga

SEQ ID NO: 4319768 - DNA, 19 bp, Homo sapiens
atatattactgatttagaa

SEQ ID NO: 4319769 - DNA, 13 bp, Homo sapiens
atatattctcagc

SEQ ID NO: 4319770 - DNA, 20 bp, Homo sapiens
atatatttatatcatatata

SEQ ID NO: 4319771 - DNA, 17 bp, Homo sapiens
atatcatagtataaatc

SEQ ID NO: 4319772 - DNA, 15 bp, Homo sapiens
atatcatatataaaa

SEQ ID NO: 4319773 - DNA, 17 bp, Homo sapiens
atatcatatataaaagt

SEQ ID NO: 4319774 - DNA, 15 bp, Homo sapiens
atatccaaacaagac

SEQ ID NO: 4319775 - DNA, 21 bp, Homo sapiens
atatgagactattatgaaatc

SEQ ID NO: 4319776 - DNA, 24 bp, Homo sapiens
atatgagactattatgaaatcata

SEQ ID NO: 4319777 - DNA, 14 bp, Homo sapiens
atatgattggttca

SEQ ID NO: 4319778 - DNA, 18 bp, Homo sapiens
atatgattgtatttaaag

SEQ ID NO: 4319779 - DNA, 20 bp, Homo sapiens
atatgatttaaatcagccgt

SEQ ID NO: 4319780 - DNA, 22 bp, Homo sapiens
atatgcaagtaagaaataatgc

SEQ ID NO: 4319781 - DNA, 21 bp, Homo sapiens
atatgcagaacgtatttagcc

SEQ ID NO: 4319782 - DNA, 14 bp, Homo sapiens
atatgctgagaaat

SEQ ID NO: 4319783 - DNA, 14 bp, Homo sapiens
atatgctgtatttc

SEQ ID NO: 4319784 - DNA, 19 bp, Homo sapiens
atatgctgtatttctttgt

SEQ ID NO: 4319785 - DNA, 21 bp, Homo sapiens
atatgcttccagaatggggct

SEQ ID NO: 4319786 - DNA, 18 bp, Homo sapiens
atatggagaattgctgaa

SEQ ID NO: 4319787 - DNA, 20 bp, Homo sapiens
atatgtatatatattctcag

SEQ ID NO: 4319788 - DNA, 15 bp, Homo sapiens
atatgtattaatact

SEQ ID NO: 4319789 - DNA, 24 bp, Homo sapiens
atatgtgcttctcagttgcagaaa

SEQ ID NO: 4319790 - DNA, 22 bp, Homo sapiens
atattaaggaagacaatgtgaa

SEQ ID NO: 4319791 - DNA, 13 bp, Homo sapiens
atattactgattt

SEQ ID NO: 4319792 - DNA, 14 bp, Homo sapiens
atattactgattta

SEQ ID NO: 4319793 - DNA, 17 bp, Homo sapiens
atattactgatttagaa

SEQ ID NO: 4319794 - DNA, 15 bp, Homo sapiens
atattataaatatat

SEQ ID NO: 4319795 - DNA, 16 bp, Homo sapiens
atattatgattttatt

SEQ ID NO: 4319796 - DNA, 20 bp, Homo sapiens
atattatgattttatttaaa

SEQ ID NO: 4319797 - DNA, 21 bp, Homo sapiens
atattatgtatttatattttg

SEQ ID NO: 4319798 - DNA, 20 bp, Homo sapiens
atattcaagtaacactttaa

SEQ ID NO: 4319799 - DNA, 20 bp, Homo sapiens
atattcatgcttcttcctta

SEQ ID NO: 4319800 - DNA, 21 bp, Homo sapiens
atattgaaagttgcttttatt

SEQ ID NO: 4319801 - DNA, 11 bp, Homo sapiens
atattgagaat

SEQ ID NO: 4319802 - DNA, 14 bp, Homo sapiens
atattggtgctgag

SEQ ID NO: 4319803 - DNA, 14 bp, Homo sapiens
atattgtgtaaata

SEQ ID NO: 4319804 - DNA, 17 bp, Homo sapiens
atattgtttttctttct

SEQ ID NO: 4319805 - DNA, 14 bp, Homo sapiens
atcaaaaactgact

SEQ ID NO: 4319806 - DNA, 16 bp, Homo sapiens
atcaaaaactgacttt

SEQ ID NO: 4319807 - DNA, 13 bp, Homo sapiens
atcaaaaactttt

SEQ ID NO: 4319808 - DNA, 14 bp, Homo sapiens
atcaaaaacttttc

SEQ ID NO: 4319809 - DNA, 22 bp, Homo sapiens
atcaaaaacttttcatttcaga

SEQ ID NO: 4319810 - DNA, 23 bp, Homo sapiens
atcaaaaacttttcatttcagat

SEQ ID NO: 4319811 - DNA, 16 bp, Homo sapiens
atcaaagacacacagg

SEQ ID NO: 4319812 - DNA, 19 bp, Homo sapiens
atcaaagaggttttaaaaa

SEQ ID NO: 4319813 - DNA, 20 bp, Homo sapiens
atcaacaaaagggagaacat

SEQ ID NO: 4319814 - DNA, 13 bp, Homo sapiens
atcacagcctctg

SEQ ID NO: 4319815 - DNA, 15 bp, Homo sapiens
atcacagtgggaaga

SEQ ID NO: 4319816 - DNA, 16 bp, Homo sapiens
atcacccagttgtgct

SEQ ID NO: 4319817 - DNA, 16 bp, Homo sapiens
atcaccccagccccca

SEQ ID NO: 4319818 - DNA, 13 bp, Homo sapiens
atcacgctccccg

SEQ ID NO: 4319819 - DNA, 15 bp, Homo sapiens
atcacgctccccgcc

SEQ ID NO: 4319820 - DNA, 13 bp, Homo sapiens
atcactctgtcct

SEQ ID NO: 4319821 - DNA, 15 bp, Homo sapiens
atcactgattccctc

SEQ ID NO: 4319822 - DNA, 18 bp, Homo sapiens
atcactgattccctctcc

SEQ ID NO: 4319823 - DNA, 23 bp, Homo sapiens
atcactgcattcattctgagccc

SEQ ID NO: 4319824 - DNA, 11 bp, Homo sapiens
atcagcctggg

SEQ ID NO: 4319825 - DNA, 14 bp, Homo sapiens
atcagggaggaaga

SEQ ID NO: 4319826 - DNA, 15 bp, Homo sapiens
atcagggaggaagat

SEQ ID NO: 4319827 - DNA, 21 bp, Homo sapiens
atcaggggatgtacatctctc

SEQ ID NO: 4319828 - DNA, 15 bp, Homo sapiens
atcagtctttgtcaa

SEQ ID NO: 4319829 - DNA, 20 bp, Homo sapiens
atcagttaaaatcacatttt

SEQ ID NO: 4319830 - DNA, 17 bp, Homo sapiens
atcataggtatttcaaa

SEQ ID NO: 4319831 - DNA, 13 bp, Homo sapiens
cccaacccctgag

SEQ ID NO: 4319832 - DNA, 17 bp, Homo sapiens
cccaagatggagaggaa

SEQ ID NO: 4319833 - DNA, 20 bp, Homo sapiens
cccaagccactagcccactc

SEQ ID NO: 4319834 - DNA, 12 bp, Homo sapiens
cccaagctagac

SEQ ID NO: 4319835 - DNA, 13 bp, Homo sapiens
cccaagctagact

SEQ ID NO: 4319836 - DNA, 18 bp, Homo sapiens
cccaagctagactgtgtc

SEQ ID NO: 4319837 - DNA, 19 bp, Homo sapiens
cccaagctagactgtgtct

SEQ ID NO: 4319838 - DNA, 20 bp, Homo sapiens
cccaagctagactgtgtctg

SEQ ID NO: 4319839 - DNA, 15 bp, Homo sapiens
cccaaggaggtggct

SEQ ID NO: 4319840 - DNA, 15 bp, Homo sapiens
cccaaggctgcgtct

SEQ ID NO: 4319841 - DNA, 20 bp, Homo sapiens
cccaaggctgcgtctggagg

SEQ ID NO: 4319842 - DNA, 21 bp, Homo sapiens
cccaaggctgcgtctggaggg

SEQ ID NO: 4319843 - DNA, 22 bp, Homo sapiens
cccaaggctgcgtctggagggg

SEQ ID NO: 4319844 - DNA, 17 bp, Homo sapiens
cccaatccatgcttcac

SEQ ID NO: 4319845 - DNA, 20 bp, Homo sapiens
cccacaagccttactcacct

SEQ ID NO: 4319846 - DNA, 21 bp, Homo sapiens
cccacaagccttactcacctc

SEQ ID NO: 4319847 - DNA, 14 bp, Homo sapiens
cccacacccacctc

SEQ ID NO: 4319848 - DNA, 11 bp, Homo sapiens
cccacagccct

SEQ ID NO: 4319849 - DNA, 16 bp, Homo sapiens
cccacagccctgaaac

SEQ ID NO: 4319850 - DNA, 13 bp, Homo sapiens
cccaccccagagt

SEQ ID NO: 4319851 - DNA, 15 bp, Homo sapiens
cccaccccagagttg

SEQ ID NO: 4319852 - DNA, 15 bp, Homo sapiens
cccaccgaggagccc

SEQ ID NO: 4319853 - DNA, 18 bp, Homo sapiens
cccaccgaggagccccag

SEQ ID NO: 4319854 - DNA, 20 bp, Homo sapiens
cccaccgaggagccccagcc

SEQ ID NO: 4319855 - DNA, 20 bp, Homo sapiens
cccacgactgcccggcaggg

SEQ ID NO: 4319856 - DNA, 21 bp, Homo sapiens
cccacgactgcccggcagggt

SEQ ID NO: 4319857 - DNA, 22 bp, Homo sapiens
cccactgaaggattaatgaaaa

SEQ ID NO: 4319858 - DNA, 17 bp, Homo sapiens
cccagaacctttttata

SEQ ID NO: 4319859 - DNA, 21 bp, Homo sapiens
cccagagaagctggaagcctg

SEQ ID NO: 4319860 - DNA, 22 bp, Homo sapiens
cccagagaagctggaagcctgc

SEQ ID NO: 4319861 - DNA, 18 bp, Homo sapiens
cccagaggccgctgcccc

SEQ ID NO: 4319862 - DNA, 18 bp, Homo sapiens
cccagcacatttcctctc

SEQ ID NO: 4319863 - DNA, 12 bp, Homo sapiens
cccagccatgtg

SEQ ID NO: 4319864 - DNA, 17 bp, Homo sapiens
cccagcccccacagccc

SEQ ID NO: 4319865 - DNA, 18 bp, Homo sapiens
cccagcccccacagccct

SEQ ID NO: 4319866 - DNA, 21 bp, Homo sapiens
cccagcccccacagccctgga

SEQ ID NO: 4319867 - DNA, 16 bp, Homo sapiens
cccagccccgtcccag

SEQ ID NO: 4319868 - DNA, 22 bp, Homo sapiens
cccagccctctgtggccaggag

SEQ ID NO: 4319869 - DNA, 14 bp, Homo sapiens
cccagccgctcgga

SEQ ID NO: 4319870 - DNA, 17 bp, Homo sapiens
cccagctctctctcctg

SEQ ID NO: 4319871 - DNA, 18 bp, Homo sapiens
cccagctctctctcctgg

SEQ ID NO: 4319872 - DNA, 17 bp, Homo sapiens
cccaggcctctgcccca

SEQ ID NO: 4319873 - DNA, 19 bp, Homo sapiens
cccagggagacgggatgga

SEQ ID NO: 4319874 - DNA, 14 bp, Homo sapiens
cccaggtgagacct

SEQ ID NO: 4319875 - DNA, 20 bp, Homo sapiens
cccagtcccccaaccccagc

SEQ ID NO: 4319876 - DNA, 23 bp, Homo sapiens
cccagtgagtctctggggcaggc

SEQ ID NO: 4319877 - DNA, 22 bp, Homo sapiens
cccagtgctcctggcccttcta

SEQ ID NO: 4319878 - DNA, 17 bp, Homo sapiens
cccagttgtccatgaca

SEQ ID NO: 4319879 - DNA, 14 bp, Homo sapiens
cccatgaagctggc

SEQ ID NO: 4319880 - DNA, 21 bp, Homo sapiens
cccatgaagctggccctcagc

SEQ ID NO: 4319881 - DNA, 23 bp, Homo sapiens
cccatgaagctggccctcagctc

SEQ ID NO: 4319882 - DNA, 14 bp, Homo sapiens
ccccaaccccagcc

SEQ ID NO: 4319883 - DNA, 20 bp, Homo sapiens
ccccaatccagagaagcgct

SEQ ID NO: 4319884 - DNA, 18 bp, Homo sapiens
ccccaccccagagttggg

SEQ ID NO: 4319885 - DNA, 12 bp, Homo sapiens
ccccagagcccc

SEQ ID NO: 4319886 - DNA, 19 bp, Homo sapiens
ccccagccccaatccagag

SEQ ID NO: 4319887 - DNA, 14 bp, Homo sapiens
ccccagcccccaca

SEQ ID NO: 4319888 - DNA, 18 bp, Homo sapiens
ccccagccccgtcccaga

SEQ ID NO: 4319889 - DNA, 14 bp, Homo sapiens
ccccagctttgccc

SEQ ID NO: 4319890 - DNA, 14 bp, Homo sapiens
cccccaaccccagc

SEQ ID NO: 4319891 - DNA, 14 bp, Homo sapiens
ccccctgctgctgc

SEQ ID NO: 4319892 - DNA, 17 bp, Homo sapiens
ccccctttctctgcctg

SEQ ID NO: 4319893 - DNA, 21 bp, Homo sapiens
ccccgccccctccctgctccc

SEQ ID NO: 4319894 - DNA, 19 bp, Homo sapiens
ccccggcggggtgcctgct

SEQ ID NO: 4319895 - DNA, 13 bp, Homo sapiens
ccccgttgtgcct

SEQ ID NO: 4319896 - DNA, 14 bp, Homo sapiens
cccctccctgctcc

SEQ ID NO: 4319897 - DNA, 18 bp, Homo sapiens
cccctctcacaggcagct

SEQ ID NO: 4319898 - DNA, 18 bp, Homo sapiens
cccctctctgtggctcca

SEQ ID NO: 4319899 - DNA, 20 bp, Homo sapiens
cccctgaaacatgtgcccct

SEQ ID NO: 4319900 - DNA, 13 bp, Homo sapiens
cccctgccccagc

SEQ ID NO: 4319901 - DNA, 11 bp, Homo sapiens
cccctgcctcc

SEQ ID NO: 4319902 - DNA, 18 bp, Homo sapiens
cccctgcctcctgcctcc

SEQ ID NO: 4319903 - DNA, 20 bp, Homo sapiens
cccctgcctcctgcctcccg

SEQ ID NO: 4319904 - DNA, 17 bp, Homo sapiens
cccctgtcccctcagct

SEQ ID NO: 4319905 - DNA, 14 bp, Homo sapiens
ccccttctgggcat

SEQ ID NO: 4319906 - DNA, 22 bp, Homo sapiens
ccccttctgggcatctgttctg

SEQ ID NO: 4319907 - DNA, 11 bp, Homo sapiens
cccctttcccc

SEQ ID NO: 4319908 - DNA, 12 bp, Homo sapiens
cccctttccccc

SEQ ID NO: 4319909 - DNA, 18 bp, Homo sapiens
cccctttctctgcctggc

SEQ ID NO: 4319910 - DNA, 16 bp, Homo sapiens
cccgccccctccctgc

SEQ ID NO: 4319911 - DNA, 19 bp, Homo sapiens
cccgccccctccctgctcc

SEQ ID NO: 4319912 - DNA, 16 bp, Homo sapiens
cccgccctccacccac

SEQ ID NO: 4319913 - DNA, 19 bp, Homo sapiens
cccgccgcttttctcctct

SEQ ID NO: 4319914 - DNA, 14 bp, Homo sapiens
cccgcctgttcccc

SEQ ID NO: 4319915 - DNA, 14 bp, Homo sapiens
cccggaagaaccag

SEQ ID NO: 4319916 - DNA, 15 bp, Homo sapiens
cccggaagaaccaga

SEQ ID NO: 4319917 - DNA, 14 bp, Homo sapiens
cccgtaatgcttag

SEQ ID NO: 4319918 - DNA, 13 bp, Homo sapiens
cccgtcccagagg

SEQ ID NO: 4319919 - DNA, 15 bp, Homo sapiens
cccgtcccagaggcc

SEQ ID NO: 4319920 - DNA, 22 bp, Homo sapiens
ccctaaagcagtaaaataaaaa

SEQ ID NO: 4319921 - DNA, 20 bp, Homo sapiens
ccctacagttgaaaaacagc

SEQ ID NO: 4319922 - DNA, 12 bp, Homo sapiens
ccctcccaggct

SEQ ID NO: 4319923 - DNA, 21 bp, Homo sapiens
ccctccccaaatggctgcttt

SEQ ID NO: 4319924 - DNA, 22 bp, Homo sapiens
ccctccccaaatggctgctttg

SEQ ID NO: 4319925 - DNA, 16 bp, Homo sapiens
ccctcccccagagccc

SEQ ID NO: 4319926 - DNA, 17 bp, Homo sapiens
ccctcccccagagcccc

SEQ ID NO: 4319927 - DNA, 15 bp, Homo sapiens
ccctctgtggccagg

SEQ ID NO: 4319928 - DNA, 22 bp, Homo sapiens
ccctgaaacatgtgcccctgcc

SEQ ID NO: 4319929 - DNA, 18 bp, Homo sapiens
ccctgaaacgagaagtgc

SEQ ID NO: 4319930 - DNA, 21 bp, Homo sapiens
ccctgaaacgagaagtgccct

SEQ ID NO: 4319931 - DNA, 16 bp, Homo sapiens
ccctgaaagccctgag

SEQ ID NO: 4319932 - DNA, 13 bp, Homo sapiens
ccctgccccagcc

SEQ ID NO: 4319933 - DNA, 19 bp, Homo sapiens
ccctgccccagcccaagtc

SEQ ID NO: 4319934 - DNA, 20 bp, Homo sapiens
ccctgccccagcccaagtcc

SEQ ID NO: 4319935 - DNA, 18 bp, Homo sapiens
ccctgcccttccctggtg

SEQ ID NO: 4319936 - DNA, 13 bp, Homo sapiens
ccctgcctcctgc

SEQ ID NO: 4319937 - DNA, 22 bp, Homo sapiens
ccctgcctcctgcctcccgcct

SEQ ID NO: 4319938 - DNA, 12 bp, Homo sapiens
ccctgctcccag

SEQ ID NO: 4319939 - DNA, 14 bp, Homo sapiens
ccctgctcccagct

SEQ ID NO: 4319940 - DNA, 16 bp, Homo sapiens
ccctgcttctccagcc

SEQ ID NO: 4319941 - DNA, 18 bp, Homo sapiens
ccctgcttctccagcctg

SEQ ID NO: 4319942 - DNA, 14 bp, Homo sapiens
ccctggcccagagt

SEQ ID NO: 4319943 - DNA, 20 bp, Homo sapiens
ccctggtgcccttccctgga

SEQ ID NO: 4319944 - DNA, 23 bp, Homo sapiens
ccctggtgggcctcgacgtccct

SEQ ID NO: 4319945 - DNA, 20 bp, Homo sapiens
ccctggttgggtggcaattc

SEQ ID NO: 4319946 - DNA, 24 bp, Homo sapiens
ccctgtatgtctacctctgacttc

SEQ ID NO: 4319947 - DNA, 19 bp, Homo sapiens
ccctgtcccctcagctcca

SEQ ID NO: 4319948 - DNA, 10 bp, Homo sapiens
ccctgtccct

SEQ ID NO: 4319949 - DNA, 13 bp, Homo sapiens
ccctgtcctaggt

SEQ ID NO: 4319950 - DNA, 20 bp, Homo sapiens
ccctgtctcaaaaaaagaaa

SEQ ID NO: 4319951 - DNA, 14 bp, Homo sapiens
ccctgtctctgcat

SEQ ID NO: 4319952 - DNA, 18 bp, Homo sapiens
ccctgttgggggcttcag

SEQ ID NO: 4319953 - DNA, 19 bp, Homo sapiens
cccttacctcggtgccttc

SEQ ID NO: 4319954 - DNA, 15 bp, Homo sapiens
cccttcagcttgctt

SEQ ID NO: 4319955 - DNA, 14 bp, Homo sapiens
cccttcctccctgt

SEQ ID NO: 4319956 - DNA, 20 bp, Homo sapiens
cccttcctccctgtctctgc

SEQ ID NO: 4319957 - DNA, 21 bp, Homo sapiens
cccttcctccctgtctctgca

SEQ ID NO: 4319958 - DNA, 15 bp, Homo sapiens
cccttctaccccacc

SEQ ID NO: 4319959 - DNA, 16 bp, Homo sapiens
cccttctaccccacct

SEQ ID NO: 4319960 - DNA, 17 bp, Homo sapiens
cccttctaccccacctg

SEQ ID NO: 4319961 - DNA, 22 bp, Homo sapiens
cccttctgggcatctgttctgg

SEQ ID NO: 4319962 - DNA, 16 bp, Homo sapiens
cccttctttgcttctt

SEQ ID NO: 4319963 - DNA, 17 bp, Homo sapiens
cccttgaaattttaaac

SEQ ID NO: 4319964 - DNA, 12 bp, Homo sapiens
cccttggatcag

SEQ ID NO: 4319965 - DNA, 17 bp, Homo sapiens
cccttggatcagaggtc

SEQ ID NO: 4319966 - DNA, 21 bp, Homo sapiens
cccttggggtggtgctgggtc

SEQ ID NO: 4319967 - DNA, 21 bp, Homo sapiens
ccctttcccccaccccagagt

SEQ ID NO: 4319968 - DNA, 14 bp, Homo sapiens
ccctttctctgcct

SEQ ID NO: 4319969 - DNA, 15 bp, Homo sapiens
ccctttctctgcctg

SEQ ID NO: 4319970 - DNA, 16 bp, Homo sapiens
ccctttctctgcctgg

SEQ ID NO: 4319971 - DNA, 15 bp, Homo sapiens
ccgaatatattactg

SEQ ID NO: 4319972 - DNA, 19 bp, Homo sapiens
ccgaatatattactgattt

SEQ ID NO: 4319973 - DNA, 20 bp, Homo sapiens
ccgaatatattactgattta

SEQ ID NO: 4319974 - DNA, 19 bp, Homo sapiens
ccgagctttgaaaattcag

SEQ ID NO: 4319975 - DNA, 15 bp, Homo sapiens
ccgaggagccccagc

SEQ ID NO: 4319976 - DNA, 21 bp, Homo sapiens
ccgaggagccccagccccgtc

SEQ ID NO: 4319977 - DNA, 18 bp, Homo sapiens
ccgaggtgttgccagtgc

SEQ ID NO: 4319978 - DNA, 23 bp, Homo sapiens
ccgcagccacaccgctggctccg

SEQ ID NO: 4319979 - DNA, 16 bp, Homo sapiens
ccgccaccctgtctca

SEQ ID NO: 4319980 - DNA, 13 bp, Homo sapiens
ccgccccctgaaa

SEQ ID NO: 4319981 - DNA, 16 bp, Homo sapiens
ccgctcggaggcccca

SEQ ID NO: 4319982 - DNA, 20 bp, Homo sapiens
ccgctcggaggccccaaagg

SEQ ID NO: 4319983 - DNA, 22 bp, Homo sapiens
ccgctcggaggccccaaaggaa

SEQ ID NO: 4319984 - DNA, 21 bp, Homo sapiens
ccgctctcttttctgtacttc

SEQ ID NO: 4319985 - DNA, 18 bp, Homo sapiens
ccgctttgtctgtccagc

SEQ ID NO: 4319986 - DNA, 23 bp, Homo sapiens
ccggaagaaccagaagtgcagcc

SEQ ID NO: 4319987 - DNA, 13 bp, Homo sapiens
ccggagacccaca

SEQ ID NO: 4319988 - DNA, 17 bp, Homo sapiens
ccggagacccacagccc

SEQ ID NO: 4319989 - DNA, 19 bp, Homo sapiens
ccggagacccacagccctg

SEQ ID NO: 4319990 - DNA, 23 bp, Homo sapiens
ccggagacccacagccctgaaac

SEQ ID NO: 4319991 - DNA, 23 bp, Homo sapiens
ccggaggaaccgaggtgttgcca

SEQ ID NO: 4319992 - DNA, 19 bp, Homo sapiens
ccggcggggtgcctgctgt

SEQ ID NO: 4319993 - DNA, 14 bp, Homo sapiens
ccggtgcagggcct

SEQ ID NO: 4319994 - DNA, 19 bp, Homo sapiens
ccgtaagaccaccttccct

SEQ ID NO: 4319995 - DNA, 12 bp, Homo sapiens
ccgtcccagagg

SEQ ID NO: 4319996 - DNA, 18 bp, Homo sapiens
ccgtcctggactctgtgt

SEQ ID NO: 4319997 - DNA, 19 bp, Homo sapiens
ccgtgcccttgcccttgga

SEQ ID NO: 4319998 - DNA, 16 bp, Homo sapiens
cctaaagcagtaaaat

SEQ ID NO: 4319999 - DNA, 13 bp, Homo sapiens
cctaacctttggg

SEQ ID NO: 4320000 - DNA, 14 bp, Homo sapiens
cctaatggcatgga

SEQ ID NO: 4320001 - DNA, 18 bp, Homo sapiens
cctaatggcatggagact

SEQ ID NO: 4320002 - DNA, 20 bp, Homo sapiens
cctaatggcatggagactct

SEQ ID NO: 4320003 - DNA, 22 bp, Homo sapiens
cctaatggcatggagactctga

SEQ ID NO: 4320004 - DNA, 15 bp, Homo sapiens
cctacagcactactg

SEQ ID NO: 4320005 - DNA, 21 bp, Homo sapiens
cctacagcactactgggtgtc

SEQ ID NO: 4320006 - DNA, 22 bp, Homo sapiens
cctacagttgaaaaacagctga

SEQ ID NO: 4320007 - DNA, 14 bp, Homo sapiens
cctactcctggagc

SEQ ID NO: 4320008 - DNA, 19 bp, Homo sapiens
cctagaagcacggctgtgg

SEQ ID NO: 4320009 - DNA, 17 bp, Homo sapiens
cctagcactttgggagg

SEQ ID NO: 4320010 - DNA, 18 bp, Homo sapiens
cctagcccttctacccca

SEQ ID NO: 4320011 - DNA, 23 bp, Homo sapiens
cctaggtcatgaaggacactctg

SEQ ID NO: 4320012 - DNA, 23 bp, Homo sapiens
cctatctagcatttatttctctg

SEQ ID NO: 4320013 - DNA, 15 bp, Homo sapiens
cctattaaaggaaaa

SEQ ID NO: 4320014 - DNA, 22 bp, Homo sapiens
cctattggcttactgaaagaca

SEQ ID NO: 4320015 - DNA, 14 bp, Homo sapiens
cctcagctccctga

SEQ ID NO: 4320016 - DNA, 16 bp, Homo sapiens
cctcagctccctgacc

SEQ ID NO: 4320017 - DNA, 21 bp, Homo sapiens
cctcagctccctgaccccctg

SEQ ID NO: 4320018 - DNA, 16 bp, Homo sapiens
cctcaggtgagaagca

SEQ ID NO: 4320019 - DNA, 18 bp, Homo sapiens
cctcaggtgagaagcaga

SEQ ID NO: 4320020 - DNA, 22 bp, Homo sapiens
cctcagttccacggttgctaaa

SEQ ID NO: 4320021 - DNA, 13 bp, Homo sapiens
cctccacccacta

SEQ ID NO: 4320022 - DNA, 13 bp, Homo sapiens
cctccccaaatgg

SEQ ID NO: 4320023 - DNA, 18 bp, Homo sapiens
cctccccaaatggctgct

SEQ ID NO: 4320024 - DNA, 21 bp, Homo sapiens
cctccccgcagtgggaagtga

SEQ ID NO: 4320025 - DNA, 14 bp, Homo sapiens
cctccccgccccct

SEQ ID NO: 4320026 - DNA, 17 bp, Homo sapiens
cctccccgccccctgaa

SEQ ID NO: 4320027 - DNA, 20 bp, Homo sapiens
cctcccgccaccctgtctca

SEQ ID NO: 4320028 - DNA, 14 bp, Homo sapiens
cctcccttctttgc

SEQ ID NO: 4320029 - DNA, 23 bp, Homo sapiens
cctcctaatggcatggagactct

SEQ ID NO: 4320030 - DNA, 21 bp, Homo sapiens
cctcctccagccgccatgctc

SEQ ID NO: 4320031 - DNA, 15 bp, Homo sapiens
cctcctgcccagtcc

SEQ ID NO: 4320032 - DNA, 17 bp, Homo sapiens
cctcctgcccagtcccc

SEQ ID NO: 4320033 - DNA, 20 bp, Homo sapiens
cctcctgggcatgtttgtct

SEQ ID NO: 4320034 - DNA, 16 bp, Homo sapiens
cctccttcatttcagc

SEQ ID NO: 4320035 - DNA, 12 bp, Homo sapiens
cctccttcccca

SEQ ID NO: 4320036 - DNA, 16 bp, Homo sapiens
cctcggctgtctcctg

SEQ ID NO: 4320037 - DNA, 20 bp, Homo sapiens
cctctcacaggcagctctga

SEQ ID NO: 4320038 - DNA, 20 bp, Homo sapiens
cctctccccaatccatgctt

SEQ ID NO: 4320039 - DNA, 22 bp, Homo sapiens
cctctccccaatccatgcttca

SEQ ID NO: 4320040 - DNA, 15 bp, Homo sapiens
cctctcgtttctgcc

SEQ ID NO: 4320041 - DNA, 16 bp, Homo sapiens
cctctcgtttctgccc

SEQ ID NO: 4320042 - DNA, 19 bp, Homo sapiens
cctctctccacacggagct

SEQ ID NO: 4320043 - DNA, 15 bp, Homo sapiens
cctctctgtggctcc

SEQ ID NO: 4320044 - DNA, 16 bp, Homo sapiens
cctctctgtggctcca

SEQ ID NO: 4320045 - DNA, 24 bp, Homo sapiens
cctctctttcaattgcagatgcca

SEQ ID NO: 4320046 - DNA, 19 bp, Homo sapiens
cctctctttgttctcagct

SEQ ID NO: 4320047 - DNA, 23 bp, Homo sapiens
cctctgaaaaccaatgttctctc

SEQ ID NO: 4320048 - DNA, 11 bp, Homo sapiens
cctctgcacaa

SEQ ID NO: 4320049 - DNA, 16 bp, Homo sapiens
cctctgccccaagagc

SEQ ID NO: 4320050 - DNA, 22 bp, Homo sapiens
cctctgcctgggatgcccttcc

SEQ ID NO: 4320051 - DNA, 16 bp, Homo sapiens
cctctgggatctgcca

SEQ ID NO: 4320052 - DNA, 18 bp, Homo sapiens
cctctgggatctgccaac

SEQ ID NO: 4320053 - DNA, 18 bp, Homo sapiens
cctctgtggccaggagcc

SEQ ID NO: 4320054 - DNA, 19 bp, Homo sapiens
cctctgtggccaggagccc

SEQ ID NO: 4320055 - DNA, 21 bp, Homo sapiens
cctctgtggccaggagccctg

SEQ ID NO: 4320056 - DNA, 14 bp, Homo sapiens
cctcttagaaaaac

SEQ ID NO: 4320057 - DNA, 13 bp, Homo sapiens
cctctttgccctg

SEQ ID NO: 4320058 - DNA, 18 bp, Homo sapiens
cctgaaacatgtgcccct

SEQ ID NO: 4320059 - DNA, 23 bp, Homo sapiens
cctgaaacatgtgcccctgccaa

SEQ ID NO: 4320060 - DNA, 14 bp, Homo sapiens
cctgaaagccctga

SEQ ID NO: 4320061 - DNA, 22 bp, Homo sapiens
cctgaagtcaaaccttaagata

SEQ ID NO: 4320062 - DNA, 23 bp, Homo sapiens
cctgacacagtgctcgaccttga

SEQ ID NO: 4320063 - DNA, 16 bp, Homo sapiens
cctgactggttgtcag

SEQ ID NO: 4320064 - DNA, 20 bp, Homo sapiens
cctgactggttgtcagaatg

SEQ ID NO: 4320065 - DNA, 23 bp, Homo sapiens
cctgactggttgtcagaatggaa

SEQ ID NO: 4320066 - DNA, 21 bp, Homo sapiens
ctagccatgtagtgctctcag

SEQ ID NO: 4320067 - DNA, 12 bp, Homo sapiens
ctagccccaccc

SEQ ID NO: 4320068 - DNA, 14 bp, Homo sapiens
ctagccccacccag

SEQ ID NO: 4320069 - DNA, 17 bp, Homo sapiens
ctagccccacccagagg

SEQ ID NO: 4320070 - DNA, 23 bp, Homo sapiens
ctaggaaagaggaggcagaaaga

SEQ ID NO: 4320071 - DNA, 17 bp, Homo sapiens
ctaggggaggagagagg

SEQ ID NO: 4320072 - DNA, 17 bp, Homo sapiens
ctaggtgaacagcagga

SEQ ID NO: 4320073 - DNA, 23 bp, Homo sapiens
ctataaaaaccacccacaaagaa

SEQ ID NO: 4320074 - DNA, 14 bp, Homo sapiens
ctataaagaaactt

SEQ ID NO: 4320075 - DNA, 13 bp, Homo sapiens
ctataaatgacta

SEQ ID NO: 4320076 - DNA, 17 bp, Homo sapiens
ctataaatgactattgt

SEQ ID NO: 4320077 - DNA, 21 bp, Homo sapiens
ctataaatgactattgtaatg

SEQ ID NO: 4320078 - DNA, 17 bp, Homo sapiens
ctataagtgttcagtgt

SEQ ID NO: 4320079 - DNA, 20 bp, Homo sapiens
ctatagcagtgttctctctg

SEQ ID NO: 4320080 - DNA, 20 bp, Homo sapiens
ctatatttttaaagaaggag

SEQ ID NO: 4320081 - DNA, 15 bp, Homo sapiens
ctatcaaaaactgac

SEQ ID NO: 4320082 - DNA, 16 bp, Homo sapiens
ctatcagggaggaaga

SEQ ID NO: 4320083 - DNA, 17 bp, Homo sapiens
ctatccgccctgcagca

SEQ ID NO: 4320084 - DNA, 18 bp, Homo sapiens
ctatctatacctgccttt

SEQ ID NO: 4320085 - DNA, 22 bp, Homo sapiens
ctatggagcaaaacaaagctga

SEQ ID NO: 4320086 - DNA, 22 bp, Homo sapiens
ctatggcctatgtgcgaagcaa

SEQ ID NO: 4320087 - DNA, 14 bp, Homo sapiens
ctatgtgaaaagat

SEQ ID NO: 4320088 - DNA, 16 bp, Homo sapiens
ctatgtgcgaagcaag

SEQ ID NO: 4320089 - DNA, 13 bp, Homo sapiens
ctattattgaaat

SEQ ID NO: 4320090 - DNA, 15 bp, Homo sapiens
ctattgaagatacac

SEQ ID NO: 4320091 - DNA, 16 bp, Homo sapiens
ctattgctgcttgagg

SEQ ID NO: 4320092 - DNA, 13 bp, Homo sapiens
ctattttaaaaaa

SEQ ID NO: 4320093 - DNA, 14 bp, Homo sapiens
ctattttaaaaaat

SEQ ID NO: 4320094 - DNA, 18 bp, Homo sapiens
ctcaaaaaaagaaaaaga

SEQ ID NO: 4320095 - DNA, 21 bp, Homo sapiens
ctcaaaatggtgttgagattt

SEQ ID NO: 4320096 - DNA, 16 bp, Homo sapiens
ctcaaacacttattgt

SEQ ID NO: 4320097 - DNA, 23 bp, Homo sapiens
ctcaaacacttattgtttgaaag

SEQ ID NO: 4320098 - DNA, 21 bp, Homo sapiens
ctcaacacctctgcacaagct

SEQ ID NO: 4320099 - DNA, 14 bp, Homo sapiens
ctcaagacttctcc

SEQ ID NO: 4320100 - DNA, 14 bp, Homo sapiens
ctcaaggctgtgca

SEQ ID NO: 4320101 - DNA, 16 bp, Homo sapiens
ctcaaggctgtgcagg

SEQ ID NO: 4320102 - DNA, 15 bp, Homo sapiens
ctcaagtgtcacctc

SEQ ID NO: 4320103 - DNA, 22 bp, Homo sapiens
ctcaagtgtcacctccttcccc

SEQ ID NO: 4320104 - DNA, 14 bp, Homo sapiens
ctcacctctctcta

SEQ ID NO: 4320105 - DNA, 16 bp, Homo sapiens
ctcacctctctctaag

SEQ ID NO: 4320106 - DNA, 22 bp, Homo sapiens
ctcactgttttataattagtcg

SEQ ID NO: 4320107 - DNA, 21 bp, Homo sapiens
ctcactttttttttttgtttg

SEQ ID NO: 4320108 - DNA, 12 bp, Homo sapiens
ctcagcaggcca

SEQ ID NO: 4320109 - DNA, 18 bp, Homo sapiens
ctcagcagggctggtcac

SEQ ID NO: 4320110 - DNA, 20 bp, Homo sapiens
ctcagcagggctggtcacct

SEQ ID NO: 4320111 - DNA, 22 bp, Homo sapiens
ctcagcagggctggtcacctcc

SEQ ID NO: 4320112 - DNA, 23 bp, Homo sapiens
ctcagcagggctggtcacctccc

SEQ ID NO: 4320113 - DNA, 18 bp, Homo sapiens
ctcagctccccctgtccc

SEQ ID NO: 4320114 - DNA, 19 bp, Homo sapiens
ctcagctccccctgtcccc

SEQ ID NO: 4320115 - DNA, 13 bp, Homo sapiens
ctcagctccctga

SEQ ID NO: 4320116 - DNA, 21 bp, Homo sapiens
ctcaggaggcgaataaatgtt

SEQ ID NO: 4320117 - DNA, 16 bp, Homo sapiens
ctcaggtgagaagcag

SEQ ID NO: 4320118 - DNA, 14 bp, Homo sapiens
ctcagtgccacacc

SEQ ID NO: 4320119 - DNA, 12 bp, Homo sapiens
ctcagtgtattt

SEQ ID NO: 4320120 - DNA, 18 bp, Homo sapiens
ctcagtgtattttaaatt

SEQ ID NO: 4320121 - DNA, 16 bp, Homo sapiens
ctcagttgcagaaaat

SEQ ID NO: 4320122 - DNA, 14 bp, Homo sapiens
ctcagttgttaact

SEQ ID NO: 4320123 - DNA, 13 bp, Homo sapiens
ctcatcttgtgaa

SEQ ID NO: 4320124 - DNA, 14 bp, Homo sapiens
ctcatcttgtgaaa

SEQ ID NO: 4320125 - DNA, 16 bp, Homo sapiens
ctcatgcaaactgctt

SEQ ID NO: 4320126 - DNA, 20 bp, Homo sapiens
ctccaaatcaaggatctttt

SEQ ID NO: 4320127 - DNA, 18 bp, Homo sapiens
ctccacaaagagaccagg

SEQ ID NO: 4320128 - DNA, 21 bp, Homo sapiens
ctccacaaagagaccaggggc

SEQ ID NO: 4320129 - DNA, 12 bp, Homo sapiens
ctccacttctcc

SEQ ID NO: 4320130 - DNA, 20 bp, Homo sapiens
ctccagacgtaggggagggg

SEQ ID NO: 4320131 - DNA, 19 bp, Homo sapiens
ctccagcctggacccccag

SEQ ID NO: 4320132 - DNA, 21 bp, Homo sapiens
ctccagcctggacccccagct

SEQ ID NO: 4320133 - DNA, 22 bp, Homo sapiens
ctccagcctggacccccagctt

SEQ ID NO: 4320134 - DNA, 15 bp, Homo sapiens
ctccaggcatcactg

SEQ ID NO: 4320135 - DNA, 18 bp, Homo sapiens
ctccagtataatctcctc

SEQ ID NO: 4320136 - DNA, 22 bp, Homo sapiens
ctccagtgttccccccatagag

SEQ ID NO: 4320137 - DNA, 13 bp, Homo sapiens
ctcccaaaagaat

SEQ ID NO: 4320138 - DNA, 15 bp, Homo sapiens
ctcccaagccactag

SEQ ID NO: 4320139 - DNA, 23 bp, Homo sapiens
ctcccaaggctgcgtctggaggg

SEQ ID NO: 4320140 - DNA, 24 bp, Homo sapiens
ctcccacctatccgccctgcagca

SEQ ID NO: 4320141 - DNA, 13 bp, Homo sapiens
ctcccagatcctg

SEQ ID NO: 4320142 - DNA, 15 bp, Homo sapiens
ctcccaggcctctgc

SEQ ID NO: 4320143 - DNA, 19 bp, Homo sapiens
ctccccaatccatgcttca

SEQ ID NO: 4320144 - DNA, 23 bp, Homo sapiens
ctccccagaattcacgcctctcc

SEQ ID NO: 4320145 - DNA, 12 bp, Homo sapiens
ctcccccagagc

SEQ ID NO: 4320146 - DNA, 15 bp, Homo sapiens
ctcccccagagcccc

SEQ ID NO: 4320147 - DNA, 13 bp, Homo sapiens
ctcccccaggcag

SEQ ID NO: 4320148 - DNA, 12 bp, Homo sapiens
ctccccctgtcc

SEQ ID NO: 4320149 - DNA, 14 bp, Homo sapiens
ctccccgccccctg

SEQ ID NO: 4320150 - DNA, 15 bp, Homo sapiens
ctccccgccccctga

SEQ ID NO: 4320151 - DNA, 18 bp, Homo sapiens
ctccccgccccctgaaac

SEQ ID NO: 4320152 - DNA, 16 bp, Homo sapiens
ctccccgcctgttccc

SEQ ID NO: 4320153 - DNA, 17 bp, Homo sapiens
ctccccgcctgttcccc

SEQ ID NO: 4320154 - DNA, 21 bp, Homo sapiens
ctcccctccccgccccctgaa

SEQ ID NO: 4320155 - DNA, 15 bp, Homo sapiens
ctcccgccaccctgt

SEQ ID NO: 4320156 - DNA, 20 bp, Homo sapiens
ctcccgccaccctgtctcag

SEQ ID NO: 4320157 - DNA, 16 bp, Homo sapiens
ctccctcccccagagc

SEQ ID NO: 4320158 - DNA, 16 bp, Homo sapiens
ctccctcctgatgttt

SEQ ID NO: 4320159 - DNA, 14 bp, Homo sapiens
ctccctgctcccag

SEQ ID NO: 4320160 - DNA, 16 bp, Homo sapiens
ctccctgtctctgcat

SEQ ID NO: 4320161 - DNA, 18 bp, Homo sapiens
ctccctgtctctgcatct

SEQ ID NO: 4320162 - DNA, 12 bp, Homo sapiens
ctccctgtttga

SEQ ID NO: 4320163 - DNA, 22 bp, Homo sapiens
ctccctgtttgaagcctgccct

SEQ ID NO: 4320164 - DNA, 21 bp, Homo sapiens
ctcccttctttgcttcttttt

SEQ ID NO: 4320165 - DNA, 22 bp, Homo sapiens
ctcctaatggcatggagactct

SEQ ID NO: 4320166 - DNA, 23 bp, Homo sapiens
ctcctaatggcatggagactctg

SEQ ID NO: 4320167 - DNA, 15 bp, Homo sapiens
ctcctagagaggaga

SEQ ID NO: 4320168 - DNA, 17 bp, Homo sapiens
ctcctagagaggagaaa

SEQ ID NO: 4320169 - DNA, 16 bp, Homo sapiens
ctcctcttcccagagt

SEQ ID NO: 4320170 - DNA, 23 bp, Homo sapiens
ctcctgataaaacaacagctcga

SEQ ID NO: 4320171 - DNA, 16 bp, Homo sapiens
ctcctgatgtttttcc

SEQ ID NO: 4320172 - DNA, 13 bp, Homo sapiens
ctcctgcccagtc

SEQ ID NO: 4320173 - DNA, 15 bp, Homo sapiens
ctcctgcccagtccc

SEQ ID NO: 4320174 - DNA, 13 bp, Homo sapiens
ctcctgcctcccg

SEQ ID NO: 4320175 - DNA, 15 bp, Homo sapiens
ctcctggagcactgt

SEQ ID NO: 4320176 - DNA, 18 bp, Homo sapiens
ctcctggagtctgaagcc

SEQ ID NO: 4320177 - DNA, 21 bp, Homo sapiens
ctcctggagtctgaagcctgc

SEQ ID NO: 4320178 - DNA, 23 bp, Homo sapiens
ctcctggagtctgaagcctgcag

SEQ ID NO: 4320179 - DNA, 18 bp, Homo sapiens
ctccttcactctaaaaat

SEQ ID NO: 4320180 - DNA, 12 bp, Homo sapiens
ctccttccccag

SEQ ID NO: 4320181 - DNA, 12 bp, Homo sapiens
ctccttttatgt

SEQ ID NO: 4320182 - DNA, 16 bp, Homo sapiens
ctcgacgtcccttgga

SEQ ID NO: 4320183 - DNA, 15 bp, Homo sapiens
ctcggaggccccaaa

SEQ ID NO: 4320184 - DNA, 16 bp, Homo sapiens
ctcggctgtctcctgt

SEQ ID NO: 4320185 - DNA, 20 bp, Homo sapiens
ctgtgaactgggcatttcac

SEQ ID NO: 4320186 - DNA, 14 bp, Homo sapiens
ctgtgcacactaag

SEQ ID NO: 4320187 - DNA, 18 bp, Homo sapiens
ctgtgcacactaagaaat

SEQ ID NO: 4320188 - DNA, 12 bp, Homo sapiens
ctgtgcatgtgc

SEQ ID NO: 4320189 - DNA, 15 bp, Homo sapiens
ctgtgcatgtgcagg

SEQ ID NO: 4320190 - DNA, 14 bp, Homo sapiens
ctgtgcttccttgg

SEQ ID NO: 4320191 - DNA, 22 bp, Homo sapiens
ctgtggaaccaaagctggccca

SEQ ID NO: 4320192 - DNA, 18 bp, Homo sapiens
ctgtggccaggagccctg

SEQ ID NO: 4320193 - DNA, 19 bp, Homo sapiens
ctgtggccaggagccctgg

SEQ ID NO: 4320194 - DNA, 11 bp, Homo sapiens
ctgtggctcca

SEQ ID NO: 4320195 - DNA, 13 bp, Homo sapiens
ctgtggctccaac

SEQ ID NO: 4320196 - DNA, 22 bp, Homo sapiens
ctgtgtaaaatgagtaggatgt

SEQ ID NO: 4320197 - DNA, 22 bp, Homo sapiens
ctgtgtacataaagtcatcaaa

SEQ ID NO: 4320198 - DNA, 23 bp, Homo sapiens
ctgtgtacataaagtcatcaaag

SEQ ID NO: 4320199 - DNA, 16 bp, Homo sapiens
ctgtgtagttccctct

SEQ ID NO: 4320200 - DNA, 18 bp, Homo sapiens
ctgtgtagttccctctgc

SEQ ID NO: 4320201 - DNA, 19 bp, Homo sapiens
ctgtgtagttccctctgcc

SEQ ID NO: 4320202 - DNA, 20 bp, Homo sapiens
ctgtgtagttccctctgcct

SEQ ID NO: 4320203 - DNA, 22 bp, Homo sapiens
ctgtgtctgaatcatgtctgta

SEQ ID NO: 4320204 - DNA, 12 bp, Homo sapiens
ctgtgtctggca

SEQ ID NO: 4320205 - DNA, 14 bp, Homo sapiens
ctgtgtctggcagg

SEQ ID NO: 4320206 - DNA, 21 bp, Homo sapiens
ctgtgtgcaactaactgactc

SEQ ID NO: 4320207 - DNA, 14 bp, Homo sapiens
ctgtgttgcttcaa

SEQ ID NO: 4320208 - DNA, 23 bp, Homo sapiens
ctgttactgcttctctttgtgca

SEQ ID NO: 4320209 - DNA, 13 bp, Homo sapiens
ctgttactgtctt

SEQ ID NO: 4320210 - DNA, 20 bp, Homo sapiens
ctgttcacactgcagagact

SEQ ID NO: 4320211 - DNA, 12 bp, Homo sapiens
ctgttcccccgc

SEQ ID NO: 4320212 - DNA, 22 bp, Homo sapiens
ctgttctggtttttaaccattg

SEQ ID NO: 4320213 - DNA, 19 bp, Homo sapiens
ctgttgcccgccctccacc

SEQ ID NO: 4320214 - DNA, 17 bp, Homo sapiens
ctgttgtttctataaat

SEQ ID NO: 4320215 - DNA, 13 bp, Homo sapiens
ctgtttcccaagc

SEQ ID NO: 4320216 - DNA, 21 bp, Homo sapiens
cttaactgtatttcagtattt

SEQ ID NO: 4320217 - DNA, 19 bp, Homo sapiens
cttaatgtctgtcagaaga

SEQ ID NO: 4320218 - DNA, 24 bp, Homo sapiens
cttaatgtctgtcagaagacacta

SEQ ID NO: 4320219 - DNA, 19 bp, Homo sapiens
cttacaagcttaaagcttg

SEQ ID NO: 4320220 - DNA, 16 bp, Homo sapiens
cttacacgtgcgtgtg

SEQ ID NO: 4320221 - DNA, 21 bp, Homo sapiens
cttacagtttattttctgtgt

SEQ ID NO: 4320222 - DNA, 13 bp, Homo sapiens
cttacctcggtgc

SEQ ID NO: 4320223 - DNA, 18 bp, Homo sapiens
cttactcacctctctcta

SEQ ID NO: 4320224 - DNA, 15 bp, Homo sapiens
cttactgaaagacag

SEQ ID NO: 4320225 - DNA, 19 bp, Homo sapiens
cttagacactttacctctt

SEQ ID NO: 4320226 - DNA, 22 bp, Homo sapiens
cttagactcctcttcccagagt

SEQ ID NO: 4320227 - DNA, 14 bp, Homo sapiens
cttagtaaaaagcc

SEQ ID NO: 4320228 - DNA, 15 bp, Homo sapiens
cttagtaaaatttat

SEQ ID NO: 4320229 - DNA, 19 bp, Homo sapiens
cttagtaaaatttatttca

SEQ ID NO: 4320230 - DNA, 16 bp, Homo sapiens
cttagtagtttttaca

SEQ ID NO: 4320231 - DNA, 17 bp, Homo sapiens
cttagtagtttttacaa

SEQ ID NO: 4320232 - DNA, 12 bp, Homo sapiens
cttagttaaaaa

SEQ ID NO: 4320233 - DNA, 22 bp, Homo sapiens
cttagttgatattcaaggcttt

SEQ ID NO: 4320234 - DNA, 18 bp, Homo sapiens
cttatcctacagtacaat

SEQ ID NO: 4320235 - DNA, 17 bp, Homo sapiens
cttattcaatatttact

SEQ ID NO: 4320236 - DNA, 12 bp, Homo sapiens
cttattctctca

SEQ ID NO: 4320237 - DNA, 18 bp, Homo sapiens
cttattgttttaaaaagt

SEQ ID NO: 4320238 - DNA, 15 bp, Homo sapiens
cttatttttatgtgg

SEQ ID NO: 4320239 - DNA, 20 bp, Homo sapiens
cttcaaggatatactgcagc

SEQ ID NO: 4320240 - DNA, 15 bp, Homo sapiens
cttcacggaagagcc

SEQ ID NO: 4320241 - DNA, 13 bp, Homo sapiens
cttcagaattatc

SEQ ID NO: 4320242 - DNA, 16 bp, Homo sapiens
cttcagagtttgtgtg

SEQ ID NO: 4320243 - DNA, 15 bp, Homo sapiens
cttcagctgactttt

SEQ ID NO: 4320244 - DNA, 15 bp, Homo sapiens
cttcaggtctctgtg

SEQ ID NO: 4320245 - DNA, 20 bp, Homo sapiens
cttccccagctcccccaggc

SEQ ID NO: 4320246 - DNA, 17 bp, Homo sapiens
cttcccccgctaattca

SEQ ID NO: 4320247 - DNA, 18 bp, Homo sapiens
cttccccctttctctgcc

SEQ ID NO: 4320248 - DNA, 21 bp, Homo sapiens
cttccccctttctctgcctgg

SEQ ID NO: 4320249 - DNA, 17 bp, Homo sapiens
cttccctacagttgaaa

SEQ ID NO: 4320250 - DNA, 13 bp, Homo sapiens
cttcccttcctca

SEQ ID NO: 4320251 - DNA, 13 bp, Homo sapiens
cttcctccctgtc

SEQ ID NO: 4320252 - DNA, 19 bp, Homo sapiens
cttcctccctgtctctgca

SEQ ID NO: 4320253 - DNA, 22 bp, Homo sapiens
cttcctgattaccagtctgatt

SEQ ID NO: 4320254 - DNA, 18 bp, Homo sapiens
cttcctgtccccagggga

SEQ ID NO: 4320255 - DNA, 18 bp, Homo sapiens
cttccttggttcatgctt

SEQ ID NO: 4320256 - DNA, 19 bp, Homo sapiens
cttcgggaaaattcaaagg

SEQ ID NO: 4320257 - DNA, 19 bp, Homo sapiens
cttcgggaggtcgaggcag

SEQ ID NO: 4320258 - DNA, 21 bp, Homo sapiens
cttctcactgccatgccagct

SEQ ID NO: 4320259 - DNA, 17 bp, Homo sapiens
cttctcagttgcagaaa

SEQ ID NO: 4320260 - DNA, 16 bp, Homo sapiens
cttctcatcttgtgaa

SEQ ID NO: 4320261 - DNA, 20 bp, Homo sapiens
cttctcccaggcctctgccc

SEQ ID NO: 4320262 - DNA, 14 bp, Homo sapiens
cttctccccagaat

SEQ ID NO: 4320263 - DNA, 17 bp, Homo sapiens
cttctccctagcccttc

SEQ ID NO: 4320264 - DNA, 19 bp, Homo sapiens
cttctcgcaactgaaggaa

SEQ ID NO: 4320265 - DNA, 13 bp, Homo sapiens
cttctgagcccca

SEQ ID NO: 4320266 - DNA, 20 bp, Homo sapiens
cttctgccatttctgagatc

SEQ ID NO: 4320267 - DNA, 14 bp, Homo sapiens
cttctggcttcctt

SEQ ID NO: 4320268 - DNA, 20 bp, Homo sapiens
cttctgtagtttttaattaa

SEQ ID NO: 4320269 - DNA, 21 bp, Homo sapiens
cttcttttactggactgtctg

SEQ ID NO: 4320270 - DNA, 13 bp, Homo sapiens
cttctttttctta

SEQ ID NO: 4320271 - DNA, 17 bp, Homo sapiens
cttctttttcttaccct

SEQ ID NO: 4320272 - DNA, 19 bp, Homo sapiens
cttgaaattttaaactata

SEQ ID NO: 4320273 - DNA, 23 bp, Homo sapiens
cttgaatgggcatgaatggagat

SEQ ID NO: 4320274 - DNA, 16 bp, Homo sapiens
cttgagcctgggaggt

SEQ ID NO: 4320275 - DNA, 13 bp, Homo sapiens
cttgagctcagga

SEQ ID NO: 4320276 - DNA, 16 bp, Homo sapiens
cttgagctttctgtgc

SEQ ID NO: 4320277 - DNA, 17 bp, Homo sapiens
cttgagctttctgtgca

SEQ ID NO: 4320278 - DNA, 22 bp, Homo sapiens
cttgatttgatctttgtttaaa

SEQ ID NO: 4320279 - DNA, 13 bp, Homo sapiens
cttgcactgtcca

SEQ ID NO: 4320280 - DNA, 14 bp, Homo sapiens
cttgcactgtccag

SEQ ID NO: 4320281 - DNA, 20 bp, Homo sapiens
cttgcagcgccaagtggcca

SEQ ID NO: 4320282 - DNA, 16 bp, Homo sapiens
cttgccaaaatgttgg

SEQ ID NO: 4320283 - DNA, 13 bp, Homo sapiens
cttgcccttggag

SEQ ID NO: 4320284 - DNA, 20 bp, Homo sapiens
cttgcggaatcactctgtcc

SEQ ID NO: 4320285 - DNA, 12 bp, Homo sapiens
cttgcttctgca

SEQ ID NO: 4320286 - DNA, 14 bp, Homo sapiens
cttgcttctgcagc

SEQ ID NO: 4320287 - DNA, 16 bp, Homo sapiens
cttgcttctgcagcaa

SEQ ID NO: 4320288 - DNA, 20 bp, Homo sapiens
cttgcttctgcagcaactcc

SEQ ID NO: 4320289 - DNA, 21 bp, Homo sapiens
cttggaagtttcatatattgt

SEQ ID NO: 4320290 - DNA, 15 bp, Homo sapiens
cttggatcagaggtc

SEQ ID NO: 4320291 - DNA, 18 bp, Homo sapiens
cttgggccactgtgaaga

SEQ ID NO: 4320292 - DNA, 20 bp, Homo sapiens
cttgggccactgtgaagaga

SEQ ID NO: 4320293 - DNA, 14 bp, Homo sapiens
cttggggctcagcc

SEQ ID NO: 4320294 - DNA, 23 bp, Homo sapiens
cttggggggctgaggtgggagga

SEQ ID NO: 4320295 - DNA, 21 bp, Homo sapiens
cttgggtcctactcctggagc

SEQ ID NO: 4320296 - DNA, 17 bp, Homo sapiens
cttggtaagtgaattta

SEQ ID NO: 4320297 - DNA, 23 bp, Homo sapiens
cttggtcccattagctgaggttt

SEQ ID NO: 4320298 - DNA, 24 bp, Homo sapiens
cttggtctaccaatctgggaagat

SEQ ID NO: 4320299 - DNA, 22 bp, Homo sapiens
cttgtggaggagggagagccct

SEQ ID NO: 4320300 - DNA, 23 bp, Homo sapiens
cttgtggaggagggagagccctg

SEQ ID NO: 4320301 - DNA, 23 bp, Homo sapiens
cttgttccactgcaaataaagcc

SEQ ID NO: 4320302 - DNA, 21 bp, Homo sapiens
cttgttctgtgatgaggggag

SEQ ID NO: 4320303 - DNA, 23 bp, Homo sapiens
gatagcatggggcccctggccca

SEQ ID NO: 4320304 - DNA, 16 bp, Homo sapiens
gatatactttgtggac

SEQ ID NO: 4320305 - DNA, 15 bp, Homo sapiens
gatatgctgagaaat

SEQ ID NO: 4320306 - DNA, 13 bp, Homo sapiens
gatatggagaatt

SEQ ID NO: 4320307 - DNA, 19 bp, Homo sapiens
gatatggagaattgctgaa

SEQ ID NO: 4320308 - DNA, 18 bp, Homo sapiens
gatattcaaggctttaaa

SEQ ID NO: 4320309 - DNA, 14 bp, Homo sapiens
gatcaacaatgatt

SEQ ID NO: 4320310 - DNA, 15 bp, Homo sapiens
gatcaacaatgattt

SEQ ID NO: 4320311 - DNA, 22 bp, Homo sapiens
gatcagaggtcatcccttcctc

SEQ ID NO: 4320312 - DNA, 15 bp, Homo sapiens
gatcagcctgggcaa

SEQ ID NO: 4320313 - DNA, 18 bp, Homo sapiens
gatcataggtatttcaaa

SEQ ID NO: 4320314 - DNA, 15 bp, Homo sapiens
gatcatatgaccatt

SEQ ID NO: 4320315 - DNA, 20 bp, Homo sapiens
gatccaaattgtgcttctcc

SEQ ID NO: 4320316 - DNA, 24 bp, Homo sapiens
gatccatagtgctacctgcacctc

SEQ ID NO: 4320317 - DNA, 22 bp, Homo sapiens
gatcccaagatggagaggaaga

SEQ ID NO: 4320318 - DNA, 20 bp, Homo sapiens
gatcctggaaacagcagtgt

SEQ ID NO: 4320319 - DNA, 16 bp, Homo sapiens
gatctgtactttgtgt

SEQ ID NO: 4320320 - DNA, 13 bp, Homo sapiens
gatctttgtttaa

SEQ ID NO: 4320321 - DNA, 19 bp, Homo sapiens
gatctttgtttaaatgcca

SEQ ID NO: 4320322 - DNA, 15 bp, Homo sapiens
gatgacaaagaaaat

SEQ ID NO: 4320323 - DNA, 20 bp, Homo sapiens
gatgacaaagaaaatgagaa

SEQ ID NO: 4320324 - DNA, 21 bp, Homo sapiens
gatgacaaagaaaatgagaat

SEQ ID NO: 4320325 - DNA, 23 bp, Homo sapiens
gatgcaaagtacaatgtgttttt

SEQ ID NO: 4320326 - DNA, 21 bp, Homo sapiens
gatgcaggcacttattgtaaa

SEQ ID NO: 4320327 - DNA, 22 bp, Homo sapiens
gatgcaggcacttattgtaaat

SEQ ID NO: 4320328 - DNA, 19 bp, Homo sapiens
gatgccaaaaaagatgcca

SEQ ID NO: 4320329 - DNA, 22 bp, Homo sapiens
gatgcccaccgaggagccccag

SEQ ID NO: 4320330 - DNA, 13 bp, Homo sapiens
gatgcccttcccc

SEQ ID NO: 4320331 - DNA, 20 bp, Homo sapiens
gatgcctgttttgagaccag

SEQ ID NO: 4320332 - DNA, 16 bp, Homo sapiens
gatgctgaagtacagt

SEQ ID NO: 4320333 - DNA, 16 bp, Homo sapiens
gatggagaggaagaaa

SEQ ID NO: 4320334 - DNA, 22 bp, Homo sapiens
gatggatttccagccaaagcct

SEQ ID NO: 4320335 - DNA, 13 bp, Homo sapiens
gatgtagtcacat

SEQ ID NO: 4320336 - DNA, 16 bp, Homo sapiens
gatgtctcttggaaat

SEQ ID NO: 4320337 - DNA, 15 bp, Homo sapiens
gatgtgaaggacatg

SEQ ID NO: 4320338 - DNA, 19 bp, Homo sapiens
gattaaccacttcagctga

SEQ ID NO: 4320339 - DNA, 17 bp, Homo sapiens
gattatcagtagaaaga

SEQ ID NO: 4320340 - DNA, 22 bp, Homo sapiens
gattatcagtagaaagagtgtt

SEQ ID NO: 4320341 - DNA, 15 bp, Homo sapiens
gattcattctcataa

SEQ ID NO: 4320342 - DNA, 23 bp, Homo sapiens
gattccctctcccacccaaggag

SEQ ID NO: 4320343 - DNA, 11 bp, Homo sapiens
gattccctggt

SEQ ID NO: 4320344 - DNA, 15 bp, Homo sapiens
gattgaaaattcgcc

SEQ ID NO: 4320345 - DNA, 15 bp, Homo sapiens
gattgaaagaaaaaa

SEQ ID NO: 4320346 - DNA, 20 bp, Homo sapiens
gattggttaaaatgtgattt

SEQ ID NO: 4320347 - DNA, 16 bp, Homo sapiens
gattgtatttaaaggt

SEQ ID NO: 4320348 - DNA, 12 bp, Homo sapiens
gatttaaatcag

SEQ ID NO: 4320349 - DNA, 18 bp, Homo sapiens
gatttacaggacttctct

SEQ ID NO: 4320350 - DNA, 23 bp, Homo sapiens
gatttagaagcaaagatttcagt

SEQ ID NO: 4320351 - DNA, 19 bp, Homo sapiens
gatttcccttttttcttcc

SEQ ID NO: 4320352 - DNA, 20 bp, Homo sapiens
gatttcccttttttcttccc

SEQ ID NO: 4320353 - DNA, 13 bp, Homo sapiens
gatttcttaatgt

SEQ ID NO: 4320354 - DNA, 15 bp, Homo sapiens
gatttcttaatgtct

SEQ ID NO: 4320355 - DNA, 16 bp, Homo sapiens
gatttgaaaaactttt

SEQ ID NO: 4320356 - DNA, 18 bp, Homo sapiens
gatttgaaaaacttttag

SEQ ID NO: 4320357 - DNA, 22 bp, Homo sapiens
gatttgatctttgtttaaatgc

SEQ ID NO: 4320358 - DNA, 12 bp, Homo sapiens
gatttggaaaat

SEQ ID NO: 4320359 - DNA, 17 bp, Homo sapiens
gatttggaaaattcaca

SEQ ID NO: 4320360 - DNA, 23 bp, Homo sapiens
gattttaaaaagggtaacttgtt

SEQ ID NO: 4320361 - DNA, 23 bp, Homo sapiens
gatttttcttcaggtaacactac

SEQ ID NO: 4320362 - DNA, 17 bp, Homo sapiens
gatttttttttttcata

SEQ ID NO: 4320363 - DNA, 16 bp, Homo sapiens
gcaaaatagaagaaga

SEQ ID NO: 4320364 - DNA, 19 bp, Homo sapiens
gcaaacccatgaagctggc

SEQ ID NO: 4320365 - DNA, 23 bp, Homo sapiens
gcaaactctataaagaaactttt

SEQ ID NO: 4320366 - DNA, 14 bp, Homo sapiens
gcaaactgctttat

SEQ ID NO: 4320367 - DNA, 21 bp, Homo sapiens
gcaaagatttcagtagaattt

SEQ ID NO: 4320368 - DNA, 19 bp, Homo sapiens
gcaaataaagccttttaaa

SEQ ID NO: 4320369 - DNA, 18 bp, Homo sapiens
gcaaattatttattactt

SEQ ID NO: 4320370 - DNA, 15 bp, Homo sapiens
gcaacctttcccttc

SEQ ID NO: 4320371 - DNA, 19 bp, Homo sapiens
gcaagaatttctggaagaa

SEQ ID NO: 4320372 - DNA, 21 bp, Homo sapiens
gcaagaatttctggaagaaag

SEQ ID NO: 4320373 - DNA, 13 bp, Homo sapiens
gcaagagggacag

SEQ ID NO: 4320374 - DNA, 14 bp, Homo sapiens
gcaagagggacaga

SEQ ID NO: 4320375 - DNA, 18 bp, Homo sapiens
gcaagagggacagagccc

SEQ ID NO: 4320376 - DNA, 19 bp, Homo sapiens
gcaagagggacagagcccg

SEQ ID NO: 4320377 - DNA, 13 bp, Homo sapiens
gcaaggagaatat

SEQ ID NO: 4320378 - DNA, 21 bp, Homo sapiens
gcaaggttgtagtcaagaggt

SEQ ID NO: 4320379 - DNA, 14 bp, Homo sapiens
gcaagtcattgagt

SEQ ID NO: 4320380 - DNA, 11 bp, Homo sapiens
gcaattccaat

SEQ ID NO: 4320381 - DNA, 18 bp, Homo sapiens
gcaattggaacaaagtga

SEQ ID NO: 4320382 - DNA, 24 bp, Homo sapiens
gcacaagaagcgtgagacgccacc

SEQ ID NO: 4320383 - DNA, 13 bp, Homo sapiens
gcacactaagaaa

SEQ ID NO: 4320384 - DNA, 14 bp, Homo sapiens
gcacagtaatgtag

SEQ ID NO: 4320385 - DNA, 21 bp, Homo sapiens
gcacataggctggtggccttg

SEQ ID NO: 4320386 - DNA, 23 bp, Homo sapiens
gcacataggctggtggccttggg

SEQ ID NO: 4320387 - DNA, 20 bp, Homo sapiens
gcacatgctgagtctcccaa

SEQ ID NO: 4320388 - DNA, 22 bp, Homo sapiens
gcacatgctgagtctcccaagg

SEQ ID NO: 4320389 - DNA, 23 bp, Homo sapiens
gcacatgctgagtctcccaaggc

SEQ ID NO: 4320390 - DNA, 16 bp, Homo sapiens
gcacatttcctctcta

SEQ ID NO: 4320391 - DNA, 19 bp, Homo sapiens
gcaccactgcactccagcc

SEQ ID NO: 4320392 - DNA, 14 bp, Homo sapiens
gcaccagggagagg

SEQ ID NO: 4320393 - DNA, 16 bp, Homo sapiens
gcaccagggagaggcc

SEQ ID NO: 4320394 - DNA, 12 bp, Homo sapiens
gcaccataactt

SEQ ID NO: 4320395 - DNA, 14 bp, Homo sapiens
gcacccctgcctcc

SEQ ID NO: 4320396 - DNA, 12 bp, Homo sapiens
gcacctgagcct

SEQ ID NO: 4320397 - DNA, 13 bp, Homo sapiens
gcacctgagcctg

SEQ ID NO: 4320398 - DNA, 13 bp, Homo sapiens
gcacgggcctgta

SEQ ID NO: 4320399 - DNA, 17 bp, Homo sapiens
gcacgtggccaggagcc

SEQ ID NO: 4320400 - DNA, 12 bp, Homo sapiens
gcactactgggt

SEQ ID NO: 4320401 - DNA, 16 bp, Homo sapiens
gcactactgggtgtca

SEQ ID NO: 4320402 - DNA, 18 bp, Homo sapiens
gcactactgggtgtcatt

SEQ ID NO: 4320403 - DNA, 16 bp, Homo sapiens
gcactagagaatgcac

SEQ ID NO: 4320404 - DNA, 17 bp, Homo sapiens
gcactccagcctgggtg

SEQ ID NO: 4320405 - DNA, 19 bp, Homo sapiens
gcacttttattttcattgt

SEQ ID NO: 4320406 - DNA, 10 bp, Homo sapiens
gcagaaagat

SEQ ID NO: 4320407 - DNA, 19 bp, Homo sapiens
gcagaaatagttgtctgtg

SEQ ID NO: 4320408 - DNA, 17 bp, Homo sapiens
gcagaatgtttttaaaa

SEQ ID NO: 4320409 - DNA, 19 bp, Homo sapiens
gcagagccaccagggcact

SEQ ID NO: 4320410 - DNA, 11 bp, Homo sapiens
gcagaggaagg

SEQ ID NO: 4320411 - DNA, 15 bp, Homo sapiens
gcagaggaaggaaac

SEQ ID NO: 4320412 - DNA, 22 bp, Homo sapiens
gcagagtcagccattcctgttc

SEQ ID NO: 4320413 - DNA, 13 bp, Homo sapiens
gcagatgccaaaa

SEQ ID NO: 4320414 - DNA, 12 bp, Homo sapiens
gcagcaactccc

SEQ ID NO: 4320415 - DNA, 16 bp, Homo sapiens
gcagcagaaccttggc

SEQ ID NO: 4320416 - DNA, 19 bp, Homo sapiens
gcagcccctctcacaggca

SEQ ID NO: 4320417 - DNA, 14 bp, Homo sapiens
gcagcctggaccct

SEQ ID NO: 4320418 - DNA, 12 bp, Homo sapiens
gcagctctgagc

SEQ ID NO: 4320419 - DNA, 17 bp, Homo sapiens
gcagcttcctgtctgtt

SEQ ID NO: 4320420 - DNA, 13 bp, Homo sapiens
gcaggaggtgcct

SEQ ID NO: 4320421 - DNA, 15 bp, Homo sapiens
gcccttggagctgcc

SEQ ID NO: 4320422 - DNA, 17 bp, Homo sapiens
gccctttcttgcactgt

SEQ ID NO: 4320423 - DNA, 21 bp, Homo sapiens
gccgacagcacagatgtgaag

SEQ ID NO: 4320424 - DNA, 18 bp, Homo sapiens
gccgagattgcaccactg

SEQ ID NO: 4320425 - DNA, 22 bp, Homo sapiens
gccgcgctttcccctcctccct

SEQ ID NO: 4320426 - DNA, 18 bp, Homo sapiens
gccgctcggaggccccaa

SEQ ID NO: 4320427 - DNA, 13 bp, Homo sapiens
gccgctgcccctg

SEQ ID NO: 4320428 - DNA, 16 bp, Homo sapiens
gccgctgcccctgagt

SEQ ID NO: 4320429 - DNA, 18 bp, Homo sapiens
gccgctttgtctgtccag

SEQ ID NO: 4320430 - DNA, 21 bp, Homo sapiens
gccggagacccacagccctga

SEQ ID NO: 4320431 - DNA, 21 bp, Homo sapiens
gccgggcgcggtggctcacgc

SEQ ID NO: 4320432 - DNA, 18 bp, Homo sapiens
gccgtcctggactctgtg

SEQ ID NO: 4320433 - DNA, 22 bp, Homo sapiens
gccgtgtgtgcatgtgccgagg

SEQ ID NO: 4320434 - DNA, 11 bp, Homo sapiens
gcctacctctc

SEQ ID NO: 4320435 - DNA, 22 bp, Homo sapiens
gcctacctctcgtttctgccca

SEQ ID NO: 4320436 - DNA, 23 bp, Homo sapiens
gcctatgtgcgaagcaagaagaa

SEQ ID NO: 4320437 - DNA, 21 bp, Homo sapiens
gcctcccacgactgcccggca

SEQ ID NO: 4320438 - DNA, 16 bp, Homo sapiens
gcctcccgccaccctg

SEQ ID NO: 4320439 - DNA, 17 bp, Homo sapiens
gcctcccgccaccctgt

SEQ ID NO: 4320440 - DNA, 15 bp, Homo sapiens
gcctcctgcccagtc

SEQ ID NO: 4320441 - DNA, 17 bp, Homo sapiens
gcctcctgcccagtccc

SEQ ID NO: 4320442 - DNA, 19 bp, Homo sapiens
gcctcctgtgcctcccttt

SEQ ID NO: 4320443 - DNA, 16 bp, Homo sapiens
gcctcggctgtctcct

SEQ ID NO: 4320444 - DNA, 17 bp, Homo sapiens
gcctcggctgtctcctg

SEQ ID NO: 4320445 - DNA, 16 bp, Homo sapiens
gcctctgccccaagag

SEQ ID NO: 4320446 - DNA, 20 bp, Homo sapiens
gcctgcccagttggaggaga

SEQ ID NO: 4320447 - DNA, 13 bp, Homo sapiens
gcctgctccagct

SEQ ID NO: 4320448 - DNA, 18 bp, Homo sapiens
gcctgctccagctgttca

SEQ ID NO: 4320449 - DNA, 13 bp, Homo sapiens
gcctggaccccca

SEQ ID NO: 4320450 - DNA, 17 bp, Homo sapiens
gcctggacccccagctt

SEQ ID NO: 4320451 - DNA, 22 bp, Homo sapiens
gcctggcggaggtggagtggcc

SEQ ID NO: 4320452 - DNA, 23 bp, Homo sapiens
gcctggcgggatgggccaccgcc

SEQ ID NO: 4320453 - DNA, 18 bp, Homo sapiens
gcctggctggagagctgc

SEQ ID NO: 4320454 - DNA, 14 bp, Homo sapiens
gcctgggatgccct

SEQ ID NO: 4320455 - DNA, 18 bp, Homo sapiens
gcctgggatgcccttccc

SEQ ID NO: 4320456 - DNA, 20 bp, Homo sapiens
gcctgggatgcccttccccc

SEQ ID NO: 4320457 - DNA, 19 bp, Homo sapiens
gcctggttcgtgccatgcc

SEQ ID NO: 4320458 - DNA, 20 bp, Homo sapiens
gcctggttcgtgccatgccc

SEQ ID NO: 4320459 - DNA, 20 bp, Homo sapiens
gcctgttcccccgccgcttt

SEQ ID NO: 4320460 - DNA, 16 bp, Homo sapiens
gcctgttttgagacca

SEQ ID NO: 4320461 - DNA, 20 bp, Homo sapiens
gccttagagcatctctgcct

SEQ ID NO: 4320462 - DNA, 15 bp, Homo sapiens
gccttcgggaaaatt

SEQ ID NO: 4320463 - DNA, 12 bp, Homo sapiens
gccttgatttcc

SEQ ID NO: 4320464 - DNA, 15 bp, Homo sapiens
gcctttttctggcct

SEQ ID NO: 4320465 - DNA, 11 bp, Homo sapiens
gcgaataaatg

SEQ ID NO: 4320466 - DNA, 12 bp, Homo sapiens
gcgaataaatgt

SEQ ID NO: 4320467 - DNA, 15 bp, Homo sapiens
gcgaataaatgttca

SEQ ID NO: 4320468 - DNA, 16 bp, Homo sapiens
gcgaataaatgttcaa

SEQ ID NO: 4320469 - DNA, 17 bp, Homo sapiens
gcgcacttacctgcttg

SEQ ID NO: 4320470 - DNA, 15 bp, Homo sapiens
gcgctcatctggctt

SEQ ID NO: 4320471 - DNA, 16 bp, Homo sapiens
gcgctgttgatcccct

SEQ ID NO: 4320472 - DNA, 22 bp, Homo sapiens
gcgctgttgcccgccctccacc

SEQ ID NO: 4320473 - DNA, 19 bp, Homo sapiens
gcgcttgggaggggccgga

SEQ ID NO: 4320474 - DNA, 21 bp, Homo sapiens
gcggaggtggagtggccactg

SEQ ID NO: 4320475 - DNA, 15 bp, Homo sapiens
gcggctggcagccca

SEQ ID NO: 4320476 - DNA, 16 bp, Homo sapiens
gcgggatgggccaccg

SEQ ID NO: 4320477 - DNA, 14 bp, Homo sapiens
gcgggcaaggagtg

SEQ ID NO: 4320478 - DNA, 15 bp, Homo sapiens
gcggggcagagccac

SEQ ID NO: 4320479 - DNA, 21 bp, Homo sapiens
gcgtcccccgttgtgcctggt

SEQ ID NO: 4320480 - DNA, 11 bp, Homo sapiens
gcgtgagacgc

SEQ ID NO: 4320481 - DNA, 20 bp, Homo sapiens
gctaaagggagaaatgccag

SEQ ID NO: 4320482 - DNA, 16 bp, Homo sapiens
gctaaatgtgaatgat

SEQ ID NO: 4320483 - DNA, 19 bp, Homo sapiens
gctaaattataaaattgaa

SEQ ID NO: 4320484 - DNA, 19 bp, Homo sapiens
gctaactgggaagaacaag

SEQ ID NO: 4320485 - DNA, 15 bp, Homo sapiens
gctaagctaaagaaa

SEQ ID NO: 4320486 - DNA, 23 bp, Homo sapiens
gctaatctgcctggttttattta

SEQ ID NO: 4320487 - DNA, 16 bp, Homo sapiens
gctacacatatgtgct

SEQ ID NO: 4320488 - DNA, 12 bp, Homo sapiens
gctaggaaagag

SEQ ID NO: 4320489 - DNA, 15 bp, Homo sapiens
gctaggaaagaggag

SEQ ID NO: 4320490 - DNA, 22 bp, Homo sapiens
gctattgaagatacacaagagg

SEQ ID NO: 4320491 - DNA, 17 bp, Homo sapiens
gctcagcaaaagatgct

SEQ ID NO: 4320492 - DNA, 22 bp, Homo sapiens
gctcagcaaaagatgcttctca

SEQ ID NO: 4320493 - DNA, 18 bp, Homo sapiens
gctcagcagggctggtca

SEQ ID NO: 4320494 - DNA, 13 bp, Homo sapiens
gctcaggaggcga

SEQ ID NO: 4320495 - DNA, 18 bp, Homo sapiens
gctccaacccgttgggtc

SEQ ID NO: 4320496 - DNA, 20 bp, Homo sapiens
gctccagctgttcagctggt

SEQ ID NO: 4320497 - DNA, 21 bp, Homo sapiens
gctccagctgttcagctggtt

SEQ ID NO: 4320498 - DNA, 20 bp, Homo sapiens
gctccaggcatcactgattc

SEQ ID NO: 4320499 - DNA, 21 bp, Homo sapiens
gctcccagctctctctcctgg

SEQ ID NO: 4320500 - DNA, 17 bp, Homo sapiens
gctccccagtgctcctg

SEQ ID NO: 4320501 - DNA, 12 bp, Homo sapiens
gctcccccaggc

SEQ ID NO: 4320502 - DNA, 15 bp, Homo sapiens
gctcccccaggcaga

SEQ ID NO: 4320503 - DNA, 12 bp, Homo sapiens
gctccccctgtc

SEQ ID NO: 4320504 - DNA, 16 bp, Homo sapiens
gctccctgaccccctg

SEQ ID NO: 4320505 - DNA, 14 bp, Homo sapiens
gctcctggcccact

SEQ ID NO: 4320506 - DNA, 19 bp, Homo sapiens
gctcctggcccactgcatc

SEQ ID NO: 4320507 - DNA, 18 bp, Homo sapiens
gctcggaggccccaaagg

SEQ ID NO: 4320508 - DNA, 19 bp, Homo sapiens
gctcggaggccccaaagga

SEQ ID NO: 4320509 - DNA, 21 bp, Homo sapiens
gctcggaggccccaaaggaaa

SEQ ID NO: 4320510 - DNA, 14 bp, Homo sapiens
gctctagtgggaag

SEQ ID NO: 4320511 - DNA, 16 bp, Homo sapiens
gctctctaagaaaaga

SEQ ID NO: 4320512 - DNA, 17 bp, Homo sapiens
gctctctaagaaaagag

SEQ ID NO: 4320513 - DNA, 21 bp, Homo sapiens
gctctctaagaaaagagagga

SEQ ID NO: 4320514 - DNA, 14 bp, Homo sapiens
gctctgaaataaaa

SEQ ID NO: 4320515 - DNA, 15 bp, Homo sapiens
gctctgaaataaaaa

SEQ ID NO: 4320516 - DNA, 21 bp, Homo sapiens
gctctgttccaaggtgagtct

SEQ ID NO: 4320517 - DNA, 21 bp, Homo sapiens
gctgaaggattatatgtatta

SEQ ID NO: 4320518 - DNA, 17 bp, Homo sapiens
gctgaatacagaggcaa

SEQ ID NO: 4320519 - DNA, 20 bp, Homo sapiens
gctgacggtttctccccgga

SEQ ID NO: 4320520 - DNA, 23 bp, Homo sapiens
gctgagggtgagtgggtgaataa

SEQ ID NO: 4320521 - DNA, 15 bp, Homo sapiens
gctgagtctcccaag

SEQ ID NO: 4320522 - DNA, 17 bp, Homo sapiens
gctgagtgctatgtgtg

SEQ ID NO: 4320523 - DNA, 23 bp, Homo sapiens
gctgagtgggggatcacagcctc

SEQ ID NO: 4320524 - DNA, 14 bp, Homo sapiens
gctgatgtttacaa

SEQ ID NO: 4320525 - DNA, 19 bp, Homo sapiens
gctgatttcccttttttct

SEQ ID NO: 4320526 - DNA, 22 bp, Homo sapiens
gctgccgagtccgggccggggc

SEQ ID NO: 4320527 - DNA, 17 bp, Homo sapiens
gctgctaagctaaagaa

SEQ ID NO: 4320528 - DNA, 24 bp, Homo sapiens
gctgctgcaagtcattgagtgact

SEQ ID NO: 4320529 - DNA, 15 bp, Homo sapiens
gctgctgctgcccca

SEQ ID NO: 4320530 - DNA, 20 bp, Homo sapiens
gctgcttggagtgccccaag

SEQ ID NO: 4320531 - DNA, 21 bp, Homo sapiens
gctgcttggagtgccccaagg

SEQ ID NO: 4320532 - DNA, 22 bp, Homo sapiens
gctggaaaatcatattgagaat

SEQ ID NO: 4320533 - DNA, 23 bp, Homo sapiens
gctggaaaatcatattgagaata

SEQ ID NO: 4320534 - DNA, 14 bp, Homo sapiens
gctggaagcctgcc

SEQ ID NO: 4320535 - DNA, 13 bp, Homo sapiens
gctggccctcagc

SEQ ID NO: 4320536 - DNA, 16 bp, Homo sapiens
gctggccctcagctcc

SEQ ID NO: 4320537 - DNA, 20 bp, Homo sapiens
gctggccctcagctccctga

SEQ ID NO: 4320538 - DNA, 13 bp, Homo sapiens
gctggcctgactg

SEQ ID NO: 4320539 - DNA, 20 bp, Homo sapiens
ggggcgggtgatgagacctg

SEQ ID NO: 4320540 - DNA, 21 bp, Homo sapiens
ggggcgggtgatgagacctgg

SEQ ID NO: 4320541 - DNA, 12 bp, Homo sapiens
gggtatgtgttg

SEQ ID NO: 4320542 - DNA, 12 bp, Homo sapiens
gggtattggaaa

SEQ ID NO: 4320543 - DNA, 23 bp, Homo sapiens
gggtcattacttctgagccccag

SEQ ID NO: 4320544 - DNA, 22 bp, Homo sapiens
gggtcctactcctggagcactg

SEQ ID NO: 4320545 - DNA, 23 bp, Homo sapiens
gggtgattgaaagaaaaaaaaat

SEQ ID NO: 4320546 - DNA, 17 bp, Homo sapiens
gggtggagggaaggtga

SEQ ID NO: 4320547 - DNA, 15 bp, Homo sapiens
gggtggcaccagcag

SEQ ID NO: 4320548 - DNA, 19 bp, Homo sapiens
gggtggcaccagcagcctg

SEQ ID NO: 4320549 - DNA, 18 bp, Homo sapiens
gggtgtcatttcattcca

SEQ ID NO: 4320550 - DNA, 15 bp, Homo sapiens
ggtaaaaaagaaatg

SEQ ID NO: 4320551 - DNA, 18 bp, Homo sapiens
ggtaaaaaagaaatgaaa

SEQ ID NO: 4320552 - DNA, 13 bp, Homo sapiens
ggtaaaatgtatt

SEQ ID NO: 4320553 - DNA, 23 bp, Homo sapiens
ggtaacttgtttttattgcattt

SEQ ID NO: 4320554 - DNA, 23 bp, Homo sapiens
ggtaagaaagccaccttgttaca

SEQ ID NO: 4320555 - DNA, 18 bp, Homo sapiens
ggtatatcctctggaaaa

SEQ ID NO: 4320556 - DNA, 19 bp, Homo sapiens
ggtatcaactaggggagga

SEQ ID NO: 4320557 - DNA, 23 bp, Homo sapiens
ggtatgtatattttcagtgggtt

SEQ ID NO: 4320558 - DNA, 18 bp, Homo sapiens
ggtcatcccttcctcctc

SEQ ID NO: 4320559 - DNA, 19 bp, Homo sapiens
ggtcattacttctgagccc

SEQ ID NO: 4320560 - DNA, 21 bp, Homo sapiens
ggtcattacttctgagcccca

SEQ ID NO: 4320561 - DNA, 12 bp, Homo sapiens
ggtccctgtatg

SEQ ID NO: 4320562 - DNA, 16 bp, Homo sapiens
ggtcctactcctggag

SEQ ID NO: 4320563 - DNA, 14 bp, Homo sapiens
ggtctctccctccc

SEQ ID NO: 4320564 - DNA, 18 bp, Homo sapiens
ggtgaagtgcctgctggg

SEQ ID NO: 4320565 - DNA, 23 bp, Homo sapiens
ggtgaggctgggcagggcctggc

SEQ ID NO: 4320566 - DNA, 18 bp, Homo sapiens
ggtgagtctgaaccaata

SEQ ID NO: 4320567 - DNA, 18 bp, Homo sapiens
ggtgcagcccttcctccc

SEQ ID NO: 4320568 - DNA, 13 bp, Homo sapiens
ggtgcatctggca

SEQ ID NO: 4320569 - DNA, 20 bp, Homo sapiens
ggtgcatctggcacgtggcc

SEQ ID NO: 4320570 - DNA, 22 bp, Homo sapiens
ggtgcgtcccccgttgtgcctg

SEQ ID NO: 4320571 - DNA, 19 bp, Homo sapiens
ggtgctgggaatacatctg

SEQ ID NO: 4320572 - DNA, 23 bp, Homo sapiens
ggtggcccggaagaaccagaagt

SEQ ID NO: 4320573 - DNA, 13 bp, Homo sapiens
ggtgggggcctcg

SEQ ID NO: 4320574 - DNA, 14 bp, Homo sapiens
ggtgtcatttcatt

SEQ ID NO: 4320575 - DNA, 18 bp, Homo sapiens
ggtgtcatttcattccat

SEQ ID NO: 4320576 - DNA, 21 bp, Homo sapiens
ggtgtgcggcctttggcttca

SEQ ID NO: 4320577 - DNA, 13 bp, Homo sapiens
ggtgtgggggaag

SEQ ID NO: 4320578 - DNA, 15 bp, Homo sapiens
ggttaaatcatttgg

SEQ ID NO: 4320579 - DNA, 21 bp, Homo sapiens
ggttacccagttagctctcaa

SEQ ID NO: 4320580 - DNA, 20 bp, Homo sapiens
ggttattgaaaatatgatgt

SEQ ID NO: 4320581 - DNA, 20 bp, Homo sapiens
ggttcattttctgatgccca

SEQ ID NO: 4320582 - DNA, 13 bp, Homo sapiens
ggttgaggtttca

SEQ ID NO: 4320583 - DNA, 13 bp, Homo sapiens
ggttggtgggggc

SEQ ID NO: 4320584 - DNA, 20 bp, Homo sapiens
ggttgtcagaatggaatcca

SEQ ID NO: 4320585 - DNA, 18 bp, Homo sapiens
ggtttctcattaaactct

SEQ ID NO: 4320586 - DNA, 20 bp, Homo sapiens
ggtttctccccggacactcg

SEQ ID NO: 4320587 - DNA, 20 bp, Homo sapiens
ggtttctgatctgtactttg

SEQ ID NO: 4320588 - DNA, 14 bp, Homo sapiens
ggtttggaaaataa

SEQ ID NO: 4320589 - DNA, 19 bp, Homo sapiens
ggtttggaaaataacttta

SEQ ID NO: 4320590 - DNA, 12 bp, Homo sapiens
gtaaaataaaaa

SEQ ID NO: 4320591 - DNA, 13 bp, Homo sapiens
gtaaacacataaa

SEQ ID NO: 4320592 - DNA, 19 bp, Homo sapiens
gtaaagaggcttccaagca

SEQ ID NO: 4320593 - DNA, 16 bp, Homo sapiens
gtaaatattatgattt

SEQ ID NO: 4320594 - DNA, 19 bp, Homo sapiens
gtaaatattatgattttat

SEQ ID NO: 4320595 - DNA, 12 bp, Homo sapiens
gtaacactacag

SEQ ID NO: 4320596 - DNA, 22 bp, Homo sapiens
gtaacctatttatcgcaacatg

SEQ ID NO: 4320597 - DNA, 19 bp, Homo sapiens
gtaacttgtttttattgca

SEQ ID NO: 4320598 - DNA, 18 bp, Homo sapiens
gtaactttttttcagttc

SEQ ID NO: 4320599 - DNA, 15 bp, Homo sapiens
gtaagtaattatgca

SEQ ID NO: 4320600 - DNA, 21 bp, Homo sapiens
gtaataaaaagagatgaaata

SEQ ID NO: 4320601 - DNA, 22 bp, Homo sapiens
gtaatcgggcgcccgaagaggg

SEQ ID NO: 4320602 - DNA, 22 bp, Homo sapiens
gtaatctgagggttaatttcta

SEQ ID NO: 4320603 - DNA, 20 bp, Homo sapiens
gtaatgtagggttatatttg

SEQ ID NO: 4320604 - DNA, 15 bp, Homo sapiens
gtacaagctcaggag

SEQ ID NO: 4320605 - DNA, 23 bp, Homo sapiens
gtacaatcgacatcctagcccca

SEQ ID NO: 4320606 - DNA, 22 bp, Homo sapiens
gtacagctgacggtttctcccc

SEQ ID NO: 4320607 - DNA, 15 bp, Homo sapiens
gtacctcccctcccc

SEQ ID NO: 4320608 - DNA, 22 bp, Homo sapiens
gtacgatggaggcctacctctc

SEQ ID NO: 4320609 - DNA, 18 bp, Homo sapiens
gtactctgtgtctggcag

SEQ ID NO: 4320610 - DNA, 19 bp, Homo sapiens
gtactctgtgtctggcagg

SEQ ID NO: 4320611 - DNA, 20 bp, Homo sapiens
gtactctgtgtctggcaggc

SEQ ID NO: 4320612 - DNA, 21 bp, Homo sapiens
gtactttataaccaaagcaat

SEQ ID NO: 4320613 - DNA, 19 bp, Homo sapiens
gtagaaagacatctgcctg

SEQ ID NO: 4320614 - DNA, 20 bp, Homo sapiens
gtagaaagacatctgcctgt

SEQ ID NO: 4320615 - DNA, 13 bp, Homo sapiens
gtagaggaaaatc

SEQ ID NO: 4320616 - DNA, 13 bp, Homo sapiens
gtagcctctggga

SEQ ID NO: 4320617 - DNA, 19 bp, Homo sapiens
gtaggactttcctaaatgt

SEQ ID NO: 4320618 - DNA, 22 bp, Homo sapiens
gtaggggaggggttgccacagg

SEQ ID NO: 4320619 - DNA, 14 bp, Homo sapiens
gtagtatcaacttc

SEQ ID NO: 4320620 - DNA, 21 bp, Homo sapiens
gtagtccttggcatagacatg

SEQ ID NO: 4320621 - DNA, 16 bp, Homo sapiens
gtagttccctctgcct

SEQ ID NO: 4320622 - DNA, 21 bp, Homo sapiens
gtataatctcctctgctcatt

SEQ ID NO: 4320623 - DNA, 16 bp, Homo sapiens
gtataatgctttctga

SEQ ID NO: 4320624 - DNA, 12 bp, Homo sapiens
gtatatatattc

SEQ ID NO: 4320625 - DNA, 20 bp, Homo sapiens
gtatatgattataatgctat

SEQ ID NO: 4320626 - DNA, 13 bp, Homo sapiens
gtatccccagtgc

SEQ ID NO: 4320627 - DNA, 16 bp, Homo sapiens
gtatccccagtgcccg

SEQ ID NO: 4320628 - DNA, 16 bp, Homo sapiens
gtatgtccttcagctg

SEQ ID NO: 4320629 - DNA, 16 bp, Homo sapiens
gtatgtgttgccaaag

SEQ ID NO: 4320630 - DNA, 16 bp, Homo sapiens
gtattaataaagcatt

SEQ ID NO: 4320631 - DNA, 21 bp, Homo sapiens
gtattaataaagcattcttta

SEQ ID NO: 4320632 - DNA, 18 bp, Homo sapiens
gtattcaccctgggcagt

SEQ ID NO: 4320633 - DNA, 10 bp, Homo sapiens
gtattggaaa

SEQ ID NO: 4320634 - DNA, 19 bp, Homo sapiens
gtatttatgtaatgaagta

SEQ ID NO: 4320635 - DNA, 19 bp, Homo sapiens
gtatttcagtattttccag

SEQ ID NO: 4320636 - DNA, 19 bp, Homo sapiens
gtatttctttgtagaataa

SEQ ID NO: 4320637 - DNA, 14 bp, Homo sapiens
gtatttgaaactga

SEQ ID NO: 4320638 - DNA, 20 bp, Homo sapiens
gtatttgtattaataaagca

SEQ ID NO: 4320639 - DNA, 21 bp, Homo sapiens
gtatttgtattaataaagcat

SEQ ID NO: 4320640 - DNA, 21 bp, Homo sapiens
gtattttccagccttatgtgt

SEQ ID NO: 4320641 - DNA, 22 bp, Homo sapiens
gtattttgtttttgtcttaaaa

SEQ ID NO: 4320642 - DNA, 13 bp, Homo sapiens
gtatttttatcca

SEQ ID NO: 4320643 - DNA, 15 bp, Homo sapiens
gtcaagtgaaaaagg

SEQ ID NO: 4320644 - DNA, 23 bp, Homo sapiens
gtcacctccttccccagctcccc

SEQ ID NO: 4320645 - DNA, 15 bp, Homo sapiens
gtcagaagacactaa

SEQ ID NO: 4320646 - DNA, 21 bp, Homo sapiens
gtcagaatggaatccatctgt

SEQ ID NO: 4320647 - DNA, 14 bp, Homo sapiens
gtcagccatgggaa

SEQ ID NO: 4320648 - DNA, 17 bp, Homo sapiens
gtcagtggctttgcata

SEQ ID NO: 4320649 - DNA, 14 bp, Homo sapiens
gtcatcccttcctc

SEQ ID NO: 4320650 - DNA, 16 bp, Homo sapiens
gtcatcccttcctcct

SEQ ID NO: 4320651 - DNA, 24 bp, Homo sapiens
gtcatcccttcctcctctcctgga

SEQ ID NO: 4320652 - DNA, 18 bp, Homo sapiens
gtcatgaaggacactctg

SEQ ID NO: 4320653 - DNA, 21 bp, Homo sapiens
gtcatgctgtccgtgcttgct

SEQ ID NO: 4320654 - DNA, 13 bp, Homo sapiens
gtcatttctttta

SEQ ID NO: 4320655 - DNA, 23 bp, Homo sapiens
gtccaactcttccacctctgggg

SEQ ID NO: 4320656 - DNA, 12 bp, Homo sapiens
gtgttcccccca

SEQ ID NO: 4320657 - DNA, 14 bp, Homo sapiens
gtgttgacatagcc

SEQ ID NO: 4320658 - DNA, 22 bp, Homo sapiens
gtgttgctttggatacacacat

SEQ ID NO: 4320659 - DNA, 14 bp, Homo sapiens
gtgttgggagggat

SEQ ID NO: 4320660 - DNA, 23 bp, Homo sapiens
gttaaaatcacattttaagtgct

SEQ ID NO: 4320661 - DNA, 14 bp, Homo sapiens
gttaaagcttattt

SEQ ID NO: 4320662 - DNA, 23 bp, Homo sapiens
gttaaagcttatttttatgtggt

SEQ ID NO: 4320663 - DNA, 13 bp, Homo sapiens
gttaaatcatttg

SEQ ID NO: 4320664 - DNA, 20 bp, Homo sapiens
gttacaatggcctttatcct

SEQ ID NO: 4320665 - DNA, 17 bp, Homo sapiens
gttacgtataatgcttt

SEQ ID NO: 4320666 - DNA, 16 bp, Homo sapiens
gttactcttaatttta

SEQ ID NO: 4320667 - DNA, 22 bp, Homo sapiens
gttacttagaatgccataaaat

SEQ ID NO: 4320668 - DNA, 23 bp, Homo sapiens
gttagaccgctctcttttctgta

SEQ ID NO: 4320669 - DNA, 20 bp, Homo sapiens
gttagcccaatggagaaatg

SEQ ID NO: 4320670 - DNA, 21 bp, Homo sapiens
gttagcccaatggagaaatga

SEQ ID NO: 4320671 - DNA, 22 bp, Homo sapiens
gttagcccaatggagaaatgaa

SEQ ID NO: 4320672 - DNA, 12 bp, Homo sapiens
gttcagtgttga

SEQ ID NO: 4320673 - DNA, 18 bp, Homo sapiens
gttcagtgttgacatagc

SEQ ID NO: 4320674 - DNA, 21 bp, Homo sapiens
gttcatatgcagaacgtattt

SEQ ID NO: 4320675 - DNA, 18 bp, Homo sapiens
gttccacggttgctaaat

SEQ ID NO: 4320676 - DNA, 22 bp, Homo sapiens
gttccactgcaaataaagcctt

SEQ ID NO: 4320677 - DNA, 16 bp, Homo sapiens
gttccctgtcttgtcc

SEQ ID NO: 4320678 - DNA, 18 bp, Homo sapiens
gttcctctttgccctgag

SEQ ID NO: 4320679 - DNA, 16 bp, Homo sapiens
gttcgatttaagccat

SEQ ID NO: 4320680 - DNA, 21 bp, Homo sapiens
gttctatccaaacatgtattt

SEQ ID NO: 4320681 - DNA, 20 bp, Homo sapiens
gttctcagctccccctgtcc

SEQ ID NO: 4320682 - DNA, 22 bp, Homo sapiens
gttctctttgccttgatgttgt

SEQ ID NO: 4320683 - DNA, 22 bp, Homo sapiens
gttctggtttttaaccattgtc

SEQ ID NO: 4320684 - DNA, 14 bp, Homo sapiens
gttctgtgtacata

SEQ ID NO: 4320685 - DNA, 12 bp, Homo sapiens
gttgaaaataca

SEQ ID NO: 4320686 - DNA, 18 bp, Homo sapiens
gttgaaaatacattctta

SEQ ID NO: 4320687 - DNA, 15 bp, Homo sapiens
gttgacatagccttt

SEQ ID NO: 4320688 - DNA, 17 bp, Homo sapiens
gttgacccctttccccc

SEQ ID NO: 4320689 - DNA, 19 bp, Homo sapiens
gttgacccctttcccccac

SEQ ID NO: 4320690 - DNA, 23 bp, Homo sapiens
gttgacccctttcccccacccca

SEQ ID NO: 4320691 - DNA, 23 bp, Homo sapiens
gttgatattcaaggctttaaaag

SEQ ID NO: 4320692 - DNA, 14 bp, Homo sapiens
gttgcagaaaatga

SEQ ID NO: 4320693 - DNA, 13 bp, Homo sapiens
gttgccaaagctg

SEQ ID NO: 4320694 - DNA, 12 bp, Homo sapiens
gttgccacaggc

SEQ ID NO: 4320695 - DNA, 19 bp, Homo sapiens
gttgccacaggcctccctg

SEQ ID NO: 4320696 - DNA, 17 bp, Homo sapiens
gttgcccgccctccacc

SEQ ID NO: 4320697 - DNA, 21 bp, Homo sapiens
gttgcgccatctgtgcacact

SEQ ID NO: 4320698 - DNA, 20 bp, Homo sapiens
gttgctaaattataaaattg

SEQ ID NO: 4320699 - DNA, 19 bp, Homo sapiens
gttgctttggatacacaca

SEQ ID NO: 4320700 - DNA, 15 bp, Homo sapiens
gttggacagacactg

SEQ ID NO: 4320701 - DNA, 17 bp, Homo sapiens
gttggaggagactgggc

SEQ ID NO: 4320702 - DNA, 17 bp, Homo sapiens
gttggcccttctgccct

SEQ ID NO: 4320703 - DNA, 16 bp, Homo sapiens
gttgggtcccttgctg

SEQ ID NO: 4320704 - DNA, 19 bp, Homo sapiens
gttgggtggcaattccaat

SEQ ID NO: 4320705 - DNA, 11 bp, Homo sapiens
gttgtcagaat

SEQ ID NO: 4320706 - DNA, 22 bp, Homo sapiens
gttgtcagaatggaatccatct

SEQ ID NO: 4320707 - DNA, 21 bp, Homo sapiens
gttgtgttgttatcatttaag

SEQ ID NO: 4320708 - DNA, 17 bp, Homo sapiens
gtttaagggtggaaaaa

SEQ ID NO: 4320709 - DNA, 21 bp, Homo sapiens
gtttaagggtggaaaaatgcc

SEQ ID NO: 4320710 - DNA, 19 bp, Homo sapiens
gtttaatgaagtcactatt

SEQ ID NO: 4320711 - DNA, 20 bp, Homo sapiens
gtttacagggagcctcctgc

SEQ ID NO: 4320712 - DNA, 15 bp, Homo sapiens
gtttagaagcgctca

SEQ ID NO: 4320713 - DNA, 15 bp, Homo sapiens
gtttagtgtgctgct

SEQ ID NO: 4320714 - DNA, 21 bp, Homo sapiens
gtttatatattgaaagttgct

SEQ ID NO: 4320715 - DNA, 16 bp, Homo sapiens
gtttccaacctggagt

SEQ ID NO: 4320716 - DNA, 23 bp, Homo sapiens
gtttcccaagctagactgtgtct

SEQ ID NO: 4320717 - DNA, 22 bp, Homo sapiens
gtttctataaatgactattgta

SEQ ID NO: 4320718 - DNA, 17 bp, Homo sapiens
gtttctcattaaactct

SEQ ID NO: 4320719 - DNA, 19 bp, Homo sapiens
gtttctgatctgtactttg

SEQ ID NO: 4320720 - DNA, 21 bp, Homo sapiens
gtttctgatctgtactttgtg

SEQ ID NO: 4320721 - DNA, 23 bp, Homo sapiens
gtttctgatctgtactttgtgtt

SEQ ID NO: 4320722 - DNA, 12 bp, Homo sapiens
gtttctgcccag

SEQ ID NO: 4320723 - DNA, 22 bp, Homo sapiens
gtttctgcccagccctctgtgg

SEQ ID NO: 4320724 - DNA, 13 bp, Homo sapiens
gtttcttgtttat

SEQ ID NO: 4320725 - DNA, 12 bp, Homo sapiens
gtttgaaaactg

SEQ ID NO: 4320726 - DNA, 19 bp, Homo sapiens
gtttgctaaattgagaggg

SEQ ID NO: 4320727 - DNA, 22 bp, Homo sapiens
gtttgtgtgtatttgtattaat

SEQ ID NO: 4320728 - DNA, 17 bp, Homo sapiens
gtttgttcctttgaaga

SEQ ID NO: 4320729 - DNA, 15 bp, Homo sapiens
gttttaaatgtgttg

SEQ ID NO: 4320730 - DNA, 20 bp, Homo sapiens
gttttaccaagtgctgtctt

SEQ ID NO: 4320731 - DNA, 21 bp, Homo sapiens
gttttactcttaaatcatttg

SEQ ID NO: 4320732 - DNA, 15 bp, Homo sapiens
gttttatttacattt

SEQ ID NO: 4320733 - DNA, 23 bp, Homo sapiens
gttttatttatatcttgttatta

SEQ ID NO: 4320734 - DNA, 19 bp, Homo sapiens
gtttttaattaaaaacttt

SEQ ID NO: 4320735 - DNA, 20 bp, Homo sapiens
gtttttacaaaactgctttg

SEQ ID NO: 4320736 - DNA, 15 bp, Homo sapiens
gtttttatgtgtatt

SEQ ID NO: 4320737 - DNA, 19 bp, Homo sapiens
gtttttatgtgtattagga

SEQ ID NO: 4320738 - DNA, 16 bp, Homo sapiens
gtttttatttcacagt

SEQ ID NO: 4320739 - DNA, 16 bp, Homo sapiens
gtttttctccagtgct

SEQ ID NO: 4320740 - DNA, 17 bp, Homo sapiens
gtttttttttttccaga

SEQ ID NO: 4320741 - DNA, 11 bp, Homo sapiens
taaaaaagaaa

SEQ ID NO: 4320742 - DNA, 15 bp, Homo sapiens
taaaaaagaaatgaa

SEQ ID NO: 4320743 - DNA, 16 bp, Homo sapiens
taaaaaagaaatgaaa

SEQ ID NO: 4320744 - DNA, 16 bp, Homo sapiens
taaaaacaatatattt

SEQ ID NO: 4320745 - DNA, 18 bp, Homo sapiens
taaaaacaatatatttgt

SEQ ID NO: 4320746 - DNA, 15 bp, Homo sapiens
taaaaagggtaactt

SEQ ID NO: 4320747 - DNA, 13 bp, Homo sapiens
taaaaagttatat

SEQ ID NO: 4320748 - DNA, 21 bp, Homo sapiens
taaaaataaatagaaaagtag

SEQ ID NO: 4320749 - DNA, 17 bp, Homo sapiens
taaaaattatgaaatat

SEQ ID NO: 4320750 - DNA, 16 bp, Homo sapiens
taaaacaacagctcga

SEQ ID NO: 4320751 - DNA, 13 bp, Homo sapiens
taaaactctcctt

SEQ ID NO: 4320752 - DNA, 17 bp, Homo sapiens
taaaagagatctgggca

SEQ ID NO: 4320753 - DNA, 19 bp, Homo sapiens
taaaagagatctgggcatt

SEQ ID NO: 4320754 - DNA, 23 bp, Homo sapiens
taaaaggatagtatttttatcca

SEQ ID NO: 4320755 - DNA, 16 bp, Homo sapiens
taaaagtctgagttct

SEQ ID NO: 4320756 - DNA, 17 bp, Homo sapiens
taaaagtggcatagaga

SEQ ID NO: 4320757 - DNA, 22 bp, Homo sapiens
taaaagtggcatagagaataca

SEQ ID NO: 4320758 - DNA, 19 bp, Homo sapiens
taaaatcacattttaagtg

SEQ ID NO: 4320759 - DNA, 16 bp, Homo sapiens
taaaatggatagaaaa

SEQ ID NO: 4320760 - DNA, 22 bp, Homo sapiens
taaaatggatagaaaaaaacta

SEQ ID NO: 4320761 - DNA, 18 bp, Homo sapiens
taaaatgtgatttttctt

SEQ ID NO: 4320762 - DNA, 24 bp, Homo sapiens
taaaattgcagtttcatgtatgta

SEQ ID NO: 4320763 - DNA, 19 bp, Homo sapiens
taaacaaaatttcacagtt

SEQ ID NO: 4320764 - DNA, 22 bp, Homo sapiens
taaacaatgatgccctgctcca

SEQ ID NO: 4320765 - DNA, 21 bp, Homo sapiens
taaacacataaatgaaagaaa

SEQ ID NO: 4320766 - DNA, 18 bp, Homo sapiens
taaaccgccaaggctggg

SEQ ID NO: 4320767 - DNA, 14 bp, Homo sapiens
taaactatattttc

SEQ ID NO: 4320768 - DNA, 14 bp, Homo sapiens
taaactctaaagat

SEQ ID NO: 4320769 - DNA, 17 bp, Homo sapiens
taaactgttttcaagtc

SEQ ID NO: 4320770 - DNA, 14 bp, Homo sapiens
taaagaaaattctc

SEQ ID NO: 4320771 - DNA, 18 bp, Homo sapiens
taaagaaaattctctcaa

SEQ ID NO: 4320772 - DNA, 22 bp, Homo sapiens
taaagaaactgcttacagttta

SEQ ID NO: 4320773 - DNA, 21 bp, Homo sapiens
tattgagtcttaactgtattt

SEQ ID NO: 4320774 - DNA, 14 bp, Homo sapiens
tattgagtttgtag

SEQ ID NO: 4320775 - DNA, 19 bp, Homo sapiens
tattgagtttgtaggtaaa

SEQ ID NO: 4320776 - DNA, 14 bp, Homo sapiens
tattgatatatatt

SEQ ID NO: 4320777 - DNA, 18 bp, Homo sapiens
tattgatatatattataa

SEQ ID NO: 4320778 - DNA, 23 bp, Homo sapiens
tattgatcccttctcctgccctt

SEQ ID NO: 4320779 - DNA, 16 bp, Homo sapiens
tattgcactaggaatt

SEQ ID NO: 4320780 - DNA, 15 bp, Homo sapiens
tattgcatttgctgt

SEQ ID NO: 4320781 - DNA, 17 bp, Homo sapiens
tattgcatttgctgttg

SEQ ID NO: 4320782 - DNA, 14 bp, Homo sapiens
tattgtaatgccaa

SEQ ID NO: 4320783 - DNA, 15 bp, Homo sapiens
tatttaaactattca

SEQ ID NO: 4320784 - DNA, 18 bp, Homo sapiens
tatttaactacatctgcc

SEQ ID NO: 4320785 - DNA, 18 bp, Homo sapiens
tatttagccattacccac

SEQ ID NO: 4320786 - DNA, 13 bp, Homo sapiens
tatttatatatca

SEQ ID NO: 4320787 - DNA, 20 bp, Homo sapiens
tatttatcgcaacatgaatt

SEQ ID NO: 4320788 - DNA, 18 bp, Homo sapiens
tatttatgtaatgaagta

SEQ ID NO: 4320789 - DNA, 22 bp, Homo sapiens
tatttattgcttagtgaaaata

SEQ ID NO: 4320790 - DNA, 17 bp, Homo sapiens
tatttcagtattttcca

SEQ ID NO: 4320791 - DNA, 22 bp, Homo sapiens
tatttgtattaataaagcattc

SEQ ID NO: 4320792 - DNA, 22 bp, Homo sapiens
tattttccctattagagaagag

SEQ ID NO: 4320793 - DNA, 18 bp, Homo sapiens
tattttctgtgtaaaatg

SEQ ID NO: 4320794 - DNA, 21 bp, Homo sapiens
tattttctgtgtaaaatgagt

SEQ ID NO: 4320795 - DNA, 18 bp, Homo sapiens
tattttgaggtagaggaa

SEQ ID NO: 4320796 - DNA, 19 bp, Homo sapiens
tattttgataataatattg

SEQ ID NO: 4320797 - DNA, 12 bp, Homo sapiens
tatttttatcca

SEQ ID NO: 4320798 - DNA, 12 bp, Homo sapiens
tatttttgtaaa

SEQ ID NO: 4320799 - DNA, 13 bp, Homo sapiens
tatttttgtaaac

SEQ ID NO: 4320800 - DNA, 18 bp, Homo sapiens
tattttttttaaatcaaa

SEQ ID NO: 4320801 - DNA, 21 bp, Homo sapiens
tcaaaaacttttcatttcaga

SEQ ID NO: 4320802 - DNA, 22 bp, Homo sapiens
tcaaaacggttttactgcagct

SEQ ID NO: 4320803 - DNA, 16 bp, Homo sapiens
tcaaaagctgggcagg

SEQ ID NO: 4320804 - DNA, 17 bp, Homo sapiens
tcaaaatggtgttgaga

SEQ ID NO: 4320805 - DNA, 19 bp, Homo sapiens
tcaaacacttattgtttga

SEQ ID NO: 4320806 - DNA, 18 bp, Homo sapiens
tcaaaccctccacttctc

SEQ ID NO: 4320807 - DNA, 19 bp, Homo sapiens
tcaaaccctccacttctcc

SEQ ID NO: 4320808 - DNA, 12 bp, Homo sapiens
tcaaagaggttt

SEQ ID NO: 4320809 - DNA, 20 bp, Homo sapiens
tcaacaaaagggagaacatg

SEQ ID NO: 4320810 - DNA, 21 bp, Homo sapiens
tcaacaaggtatacctcagtt

SEQ ID NO: 4320811 - DNA, 15 bp, Homo sapiens
tcaacaatgattttc

SEQ ID NO: 4320812 - DNA, 13 bp, Homo sapiens
tcaactaaaagtg

SEQ ID NO: 4320813 - DNA, 13 bp, Homo sapiens
tcaagacttctcc

SEQ ID NO: 4320814 - DNA, 19 bp, Homo sapiens
tcaagaggtttttctcccc

SEQ ID NO: 4320815 - DNA, 13 bp, Homo sapiens
tcaagcttttcct

SEQ ID NO: 4320816 - DNA, 15 bp, Homo sapiens
tcaagtaacacttta

SEQ ID NO: 4320817 - DNA, 15 bp, Homo sapiens
tcaagtgaaaaagga

SEQ ID NO: 4320818 - DNA, 14 bp, Homo sapiens
tcaagtgtcacctc

SEQ ID NO: 4320819 - DNA, 23 bp, Homo sapiens
tcaagtgtcacctccttccccag

SEQ ID NO: 4320820 - DNA, 13 bp, Homo sapiens
tcaatatgcttac

SEQ ID NO: 4320821 - DNA, 17 bp, Homo sapiens
tcaatatttactgagac

SEQ ID NO: 4320822 - DNA, 13 bp, Homo sapiens
tcaatcccagcct

SEQ ID NO: 4320823 - DNA, 12 bp, Homo sapiens
tcaattctcaaa

SEQ ID NO: 4320824 - DNA, 12 bp, Homo sapiens
tcaatttggagc

SEQ ID NO: 4320825 - DNA, 23 bp, Homo sapiens
tcaatttggagcattaactaaat

SEQ ID NO: 4320826 - DNA, 12 bp, Homo sapiens
tcacagttctgt

SEQ ID NO: 4320827 - DNA, 15 bp, Homo sapiens
tcacagttctgtaat

SEQ ID NO: 4320828 - DNA, 13 bp, Homo sapiens
tcacagttgacaa

SEQ ID NO: 4320829 - DNA, 14 bp, Homo sapiens
tcacatctaaagct

SEQ ID NO: 4320830 - DNA, 17 bp, Homo sapiens
tcacatctaaagcttta

SEQ ID NO: 4320831 - DNA, 16 bp, Homo sapiens
tcacatgttggtgctg

SEQ ID NO: 4320832 - DNA, 22 bp, Homo sapiens
tcacattttaagtgcttcacat

SEQ ID NO: 4320833 - DNA, 12 bp, Homo sapiens
tcacccaccata

SEQ ID NO: 4320834 - DNA, 14 bp, Homo sapiens
tcaccccagccccc

SEQ ID NO: 4320835 - DNA, 19 bp, Homo sapiens
tcaccccagcccccacagc

SEQ ID NO: 4320836 - DNA, 11 bp, Homo sapiens
tcacctcccat

SEQ ID NO: 4320837 - DNA, 12 bp, Homo sapiens
tcacctcccatc

SEQ ID NO: 4320838 - DNA, 13 bp, Homo sapiens
tcacctcccatcc

SEQ ID NO: 4320839 - DNA, 18 bp, Homo sapiens
tcacctccttccccagct

SEQ ID NO: 4320840 - DNA, 22 bp, Homo sapiens
tcacctccttccccagctcccc

SEQ ID NO: 4320841 - DNA, 13 bp, Homo sapiens
tcacctctctcta

SEQ ID NO: 4320842 - DNA, 14 bp, Homo sapiens
tcacggaagagcct

SEQ ID NO: 4320843 - DNA, 22 bp, Homo sapiens
tcactcatgcaaactgctttat

SEQ ID NO: 4320844 - DNA, 23 bp, Homo sapiens
tcactcatgcaaactgctttatt

SEQ ID NO: 4320845 - DNA, 16 bp, Homo sapiens
tcactgattccctctc

SEQ ID NO: 4320846 - DNA, 18 bp, Homo sapiens
tcactgattccctctccc

SEQ ID NO: 4320847 - DNA, 21 bp, Homo sapiens
tcactgcattcattctgagcc

SEQ ID NO: 4320848 - DNA, 13 bp, Homo sapiens
tcagaagacacta

SEQ ID NO: 4320849 - DNA, 14 bp, Homo sapiens
tcagaagacactaa

SEQ ID NO: 4320850 - DNA, 18 bp, Homo sapiens
tcagaatggaatccatct

SEQ ID NO: 4320851 - DNA, 19 bp, Homo sapiens
tcagaattggcataatttg

SEQ ID NO: 4320852 - DNA, 22 bp, Homo sapiens
tcagaattggcataatttgtct

SEQ ID NO: 4320853 - DNA, 20 bp, Homo sapiens
tcagactctcagcccagaag

SEQ ID NO: 4320854 - DNA, 12 bp, Homo sapiens
tcagactttgct

SEQ ID NO: 4320855 - DNA, 17 bp, Homo sapiens
tcagaggtcatcccttc

SEQ ID NO: 4320856 - DNA, 23 bp, Homo sapiens
tcagaggtcatcccttcctcctc

SEQ ID NO: 4320857 - DNA, 16 bp, Homo sapiens
tcagagttaaaatata

SEQ ID NO: 4320858 - DNA, 16 bp, Homo sapiens
tcagagtttgtgtgta

SEQ ID NO: 4320859 - DNA, 15 bp, Homo sapiens
tcagatgctgaattg

SEQ ID NO: 4320860 - DNA, 20 bp, Homo sapiens
tcagatttcttaatgtctgt

SEQ ID NO: 4320861 - DNA, 12 bp, Homo sapiens
tcagattttaaa

SEQ ID NO: 4320862 - DNA, 15 bp, Homo sapiens
tcagcaaaagatgct

SEQ ID NO: 4320863 - DNA, 15 bp, Homo sapiens
tcagcaatattgcct

SEQ ID NO: 4320864 - DNA, 21 bp, Homo sapiens
tcagcaatattgcctgtgctt

SEQ ID NO: 4320865 - DNA, 23 bp, Homo sapiens
tcagcacagctctcctcctccat

SEQ ID NO: 4320866 - DNA, 11 bp, Homo sapiens
tcagcagggct

SEQ ID NO: 4320867 - DNA, 23 bp, Homo sapiens
tcagcagggctggtcacctccca

SEQ ID NO: 4320868 - DNA, 12 bp, Homo sapiens
tcagcagtctag

SEQ ID NO: 4320869 - DNA, 18 bp, Homo sapiens
tcagccattcctgttctc

SEQ ID NO: 4320870 - DNA, 22 bp, Homo sapiens
tcagcgtggtttttatgtgtat

SEQ ID NO: 4320871 - DNA, 17 bp, Homo sapiens
tcagctagaatttctgg

SEQ ID NO: 4320872 - DNA, 20 bp, Homo sapiens
tcagctccccctgtcccctc

SEQ ID NO: 4320873 - DNA, 23 bp, Homo sapiens
tcagctccccctgtcccctcagc

SEQ ID NO: 4320874 - DNA, 22 bp, Homo sapiens
tcagctccctgaccccctgtcc

SEQ ID NO: 4320875 - DNA, 23 bp, Homo sapiens
tcagctctgcaagaattgaagca

SEQ ID NO: 4320876 - DNA, 14 bp, Homo sapiens
tcagcttaatttaa

SEQ ID NO: 4320877 - DNA, 18 bp, Homo sapiens
tcaggcaggtgggatgga

SEQ ID NO: 4320878 - DNA, 17 bp, Homo sapiens
tcaggctccccagtgct

SEQ ID NO: 4320879 - DNA, 15 bp, Homo sapiens
tcagggaggaagatg

SEQ ID NO: 4320880 - DNA, 16 bp, Homo sapiens
tcagggatagcgctgt

SEQ ID NO: 4320881 - DNA, 17 bp, Homo sapiens
tcagggttaagcctgta

SEQ ID NO: 4320882 - DNA, 17 bp, Homo sapiens
tcaggtaacactacaga

SEQ ID NO: 4320883 - DNA, 21 bp, Homo sapiens
tcaggtaacactacagagtac

SEQ ID NO: 4320884 - DNA, 20 bp, Homo sapiens
tcaggtctctgtgggtggga

SEQ ID NO: 4320885 - DNA, 13 bp, Homo sapiens
tcagtaagccgtg

SEQ ID NO: 4320886 - DNA, 18 bp, Homo sapiens
tcagtagaattttagtcc

SEQ ID NO: 4320887 - DNA, 15 bp, Homo sapiens
tcagtattttccagc

SEQ ID NO: 4320888 - DNA, 14 bp, Homo sapiens
tcagtcttcatacc

SEQ ID NO: 4320889 - DNA, 12 bp, Homo sapiens
tcagtgtatttt

SEQ ID NO: 4320890 - DNA, 22 bp, Homo sapiens
tcagtgttgacatagcctttgt

SEQ ID NO: 4320891 - DNA, 17 bp, Homo sapiens
tcagttcatatgcagaa

SEQ ID NO: 4320892 - DNA, 17 bp, Homo sapiens
tctctttttcttttcta

SEQ ID NO: 4320893 - DNA, 17 bp, Homo sapiens
tctgaaccaatagaaag

SEQ ID NO: 4320894 - DNA, 16 bp, Homo sapiens
tctgaatcatgtctgt

SEQ ID NO: 4320895 - DNA, 21 bp, Homo sapiens
tctgaatgctgagctgaagaa

SEQ ID NO: 4320896 - DNA, 15 bp, Homo sapiens
tctgaattgagaaaa

SEQ ID NO: 4320897 - DNA, 16 bp, Homo sapiens
tctgaattgagaaaag

SEQ ID NO: 4320898 - DNA, 20 bp, Homo sapiens
tctgactgatggtttggaaa

SEQ ID NO: 4320899 - DNA, 22 bp, Homo sapiens
tctgactgatggtttggaaaat

SEQ ID NO: 4320900 - DNA, 15 bp, Homo sapiens
tctgacttctgtggt

SEQ ID NO: 4320901 - DNA, 21 bp, Homo sapiens
tctgagagcgaattgtgtgga

SEQ ID NO: 4320902 - DNA, 24 bp, Homo sapiens
tctgagatcaaaacggttttactg

SEQ ID NO: 4320903 - DNA, 16 bp, Homo sapiens
tctgagccccagcccc

SEQ ID NO: 4320904 - DNA, 17 bp, Homo sapiens
tctgagccccagcccca

SEQ ID NO: 4320905 - DNA, 13 bp, Homo sapiens
tctgagtgagttt

SEQ ID NO: 4320906 - DNA, 17 bp, Homo sapiens
tctgatctgtactttgt

SEQ ID NO: 4320907 - DNA, 16 bp, Homo sapiens
tctgatgcccaccgag

SEQ ID NO: 4320908 - DNA, 21 bp, Homo sapiens
tctgatgcccaccgaggagcc

SEQ ID NO: 4320909 - DNA, 20 bp, Homo sapiens
tctgcaagaattgaagcagg

SEQ ID NO: 4320910 - DNA, 21 bp, Homo sapiens
tctgcagggtgaagcaccagg

SEQ ID NO: 4320911 - DNA, 23 bp, Homo sapiens
tctgcagggtgaagcaccaggga

SEQ ID NO: 4320912 - DNA, 14 bp, Homo sapiens
tctgcatctgactc

SEQ ID NO: 4320913 - DNA, 19 bp, Homo sapiens
tctgcattgagaaggaact

SEQ ID NO: 4320914 - DNA, 23 bp, Homo sapiens
tctgcattgagaaggaactgata

SEQ ID NO: 4320915 - DNA, 18 bp, Homo sapiens
tctgcccagccctctgtg

SEQ ID NO: 4320916 - DNA, 19 bp, Homo sapiens
tctgcccagccctctgtgg

SEQ ID NO: 4320917 - DNA, 14 bp, Homo sapiens
tctgccccaagagc

SEQ ID NO: 4320918 - DNA, 20 bp, Homo sapiens
tctgccgctttgtctgtcca

SEQ ID NO: 4320919 - DNA, 11 bp, Homo sapiens
tctgcctggca

SEQ ID NO: 4320920 - DNA, 18 bp, Homo sapiens
tctgcctgggatgccctt

SEQ ID NO: 4320921 - DNA, 21 bp, Homo sapiens
tctgcctgggatgcccttccc

SEQ ID NO: 4320922 - DNA, 16 bp, Homo sapiens
tctgcgtgactatttt

SEQ ID NO: 4320923 - DNA, 22 bp, Homo sapiens
tctgctcggcttcttggacctt

SEQ ID NO: 4320924 - DNA, 20 bp, Homo sapiens
tctgctctcatccattcctc

SEQ ID NO: 4320925 - DNA, 23 bp, Homo sapiens
tctggaggggcccctgcttctcc

SEQ ID NO: 4320926 - DNA, 20 bp, Homo sapiens
tctggcaaacttttctttct

SEQ ID NO: 4320927 - DNA, 17 bp, Homo sapiens
tctggcacgtggccagg

SEQ ID NO: 4320928 - DNA, 22 bp, Homo sapiens
tctggcacgtggccaggagcca

SEQ ID NO: 4320929 - DNA, 21 bp, Homo sapiens
tctggcaggctactctgccca

SEQ ID NO: 4320930 - DNA, 18 bp, Homo sapiens
tctgggaagatttgaaaa

SEQ ID NO: 4320931 - DNA, 14 bp, Homo sapiens
tctgggatctgcca

SEQ ID NO: 4320932 - DNA, 20 bp, Homo sapiens
tctggggaagaggttttatt

SEQ ID NO: 4320933 - DNA, 21 bp, Homo sapiens
tctggggaagaggttttattt

SEQ ID NO: 4320934 - DNA, 14 bp, Homo sapiens
tctggtggtgctgg

SEQ ID NO: 4320935 - DNA, 14 bp, Homo sapiens
tctgtactttgtgt

SEQ ID NO: 4320936 - DNA, 15 bp, Homo sapiens
tctgtagccactagt

SEQ ID NO: 4320937 - DNA, 14 bp, Homo sapiens
tctgtatccccagt

SEQ ID NO: 4320938 - DNA, 16 bp, Homo sapiens
tctgtatccccagtgc

SEQ ID NO: 4320939 - DNA, 14 bp, Homo sapiens
tctgtcagaagaca

SEQ ID NO: 4320940 - DNA, 17 bp, Homo sapiens
tctgtcagaagacacta

SEQ ID NO: 4320941 - DNA, 18 bp, Homo sapiens
tctgtcagaagacactaa

SEQ ID NO: 4320942 - DNA, 23 bp, Homo sapiens
tctgtccagccgtgtgtgcatgt

SEQ ID NO: 4320943 - DNA, 19 bp, Homo sapiens
tctgtctttcatctcccag

SEQ ID NO: 4320944 - DNA, 17 bp, Homo sapiens
tctgtgcacactaagaa

SEQ ID NO: 4320945 - DNA, 19 bp, Homo sapiens
tctgtgcacactaagaaat

SEQ ID NO: 4320946 - DNA, 22 bp, Homo sapiens
tctgtgcacactaagaaatggg

SEQ ID NO: 4320947 - DNA, 15 bp, Homo sapiens
tctgtggccaggagc

SEQ ID NO: 4320948 - DNA, 12 bp, Homo sapiens
tctgtggctcca

SEQ ID NO: 4320949 - DNA, 14 bp, Homo sapiens
tctgtgtaaaatga

SEQ ID NO: 4320950 - DNA, 15 bp, Homo sapiens
tctgtgtaaaatgag

SEQ ID NO: 4320951 - DNA, 16 bp, Homo sapiens
tctgtttcccaagcta

SEQ ID NO: 4320952 - DNA, 13 bp, Homo sapiens
tcttaaaaagtgg

SEQ ID NO: 4320953 - DNA, 18 bp, Homo sapiens
tcttaaaaagtggaaaaa

SEQ ID NO: 4320954 - DNA, 23 bp, Homo sapiens
tcttaactgtatttcagtatttt

SEQ ID NO: 4320955 - DNA, 13 bp, Homo sapiens
tcttaatgtctgt

SEQ ID NO: 4320956 - DNA, 18 bp, Homo sapiens
tcttaatgtctgtcagaa

SEQ ID NO: 4320957 - DNA, 14 bp, Homo sapiens
tcttacaagcttaa

SEQ ID NO: 4320958 - DNA, 20 bp, Homo sapiens
tcttactggggcctggggct

SEQ ID NO: 4320959 - DNA, 23 bp, Homo sapiens
tcttaggttggcaaaaaggcagg

SEQ ID NO: 4320960 - DNA, 18 bp, Homo sapiens
tcttatataagatcactg

SEQ ID NO: 4320961 - DNA, 16 bp, Homo sapiens
tcttcagtaagccgtg

SEQ ID NO: 4320962 - DNA, 19 bp, Homo sapiens
tcttcataccccagaaatt

SEQ ID NO: 4320963 - DNA, 12 bp, Homo sapiens
tcttcccagagt

SEQ ID NO: 4320964 - DNA, 13 bp, Homo sapiens
tcttcccagagtc

SEQ ID NO: 4320965 - DNA, 17 bp, Homo sapiens
tcttcccagagtcacaa

SEQ ID NO: 4320966 - DNA, 19 bp, Homo sapiens
tcttccctacagttgaaaa

SEQ ID NO: 4320967 - DNA, 16 bp, Homo sapiens
tcttctccaattctga

SEQ ID NO: 4320968 - DNA, 15 bp, Homo sapiens
tcttctttattgcac

SEQ ID NO: 4320969 - DNA, 17 bp, Homo sapiens
tcttctttattgcacta

SEQ ID NO: 4320970 - DNA, 14 bp, Homo sapiens
tcttgagggacaat

SEQ ID NO: 4320971 - DNA, 21 bp, Homo sapiens
tcttgtattttaataaacttt

SEQ ID NO: 4320972 - DNA, 23 bp, Homo sapiens
tcttgtccatgtggttcttcaaa

SEQ ID NO: 4320973 - DNA, 18 bp, Homo sapiens
tcttgtgatgtattcttt

SEQ ID NO: 4320974 - DNA, 14 bp, Homo sapiens
tctttattgcacta

SEQ ID NO: 4320975 - DNA, 15 bp, Homo sapiens
tctttattgcactag

SEQ ID NO: 4320976 - DNA, 21 bp, Homo sapiens
tctttattgcactaggaattc

SEQ ID NO: 4320977 - DNA, 23 bp, Homo sapiens
tctttcaattgcagatgccaaaa

SEQ ID NO: 4320978 - DNA, 15 bp, Homo sapiens
tctttcatctcccag

SEQ ID NO: 4320979 - DNA, 15 bp, Homo sapiens
tctttctattccaaa

SEQ ID NO: 4320980 - DNA, 24 bp, Homo sapiens
tctttcttttcttttttaaagtaa

SEQ ID NO: 4320981 - DNA, 22 bp, Homo sapiens
tctttcttttgattcttcctaa

SEQ ID NO: 4320982 - DNA, 22 bp, Homo sapiens
tctttgattctccttttatgtg

SEQ ID NO: 4320983 - DNA, 17 bp, Homo sapiens
tctttgcttctttttct

SEQ ID NO: 4320984 - DNA, 17 bp, Homo sapiens
tctttggacactcacac

SEQ ID NO: 4320985 - DNA, 19 bp, Homo sapiens
tctttggataataggaatt

SEQ ID NO: 4320986 - DNA, 19 bp, Homo sapiens
tctttgtagaataaatggt

SEQ ID NO: 4320987 - DNA, 22 bp, Homo sapiens
tctttgtcaatgctctaacaaa

SEQ ID NO: 4320988 - DNA, 12 bp, Homo sapiens
tctttgttctca

SEQ ID NO: 4320989 - DNA, 18 bp, Homo sapiens
tctttgttctcagctccc

SEQ ID NO: 4320990 - DNA, 16 bp, Homo sapiens
tcttttattatcagtt

SEQ ID NO: 4320991 - DNA, 21 bp, Homo sapiens
tcttttcctccccattcctac

SEQ ID NO: 4320992 - DNA, 16 bp, Homo sapiens
tcttttctgtacttcc

SEQ ID NO: 4320993 - DNA, 18 bp, Homo sapiens
tcttttctgtacttcctg

SEQ ID NO: 4320994 - DNA, 11 bp, Homo sapiens
tcttttggaaa

SEQ ID NO: 4320995 - DNA, 15 bp, Homo sapiens
tctttttcttttcta

SEQ ID NO: 4320996 - DNA, 20 bp, Homo sapiens
tcttttttaaagtaaacttg

SEQ ID NO: 4320997 - DNA, 22 bp, Homo sapiens
tcttttttgtttgtttctttgt

SEQ ID NO: 4320998 - DNA, 17 bp, Homo sapiens
tgaaaaagtgtacatga

SEQ ID NO: 4320999 - DNA, 19 bp, Homo sapiens
tgaaaactcattacttttc

SEQ ID NO: 4321000 - DNA, 22 bp, Homo sapiens
tgaaaagaaaaatgagcctggc

SEQ ID NO: 4321001 - DNA, 16 bp, Homo sapiens
tgaaaagatcccaaga

SEQ ID NO: 4321002 - DNA, 21 bp, Homo sapiens
tgaaaagatcccaagatggag

SEQ ID NO: 4321003 - DNA, 14 bp, Homo sapiens
tgaaaatgtcaaag

SEQ ID NO: 4321004 - DNA, 14 bp, Homo sapiens
tgaaaattcagtgg

SEQ ID NO: 4321005 - DNA, 20 bp, Homo sapiens
tgaaacatgtgcccctgcca

SEQ ID NO: 4321006 - DNA, 12 bp, Homo sapiens
tgaaagaaaaaa

SEQ ID NO: 4321007 - DNA, 11 bp, Homo sapiens
tgaaagaaacc

SEQ ID NO: 4321008 - DNA, 13 bp, Homo sapiens
tgaaagacttatg

SEQ ID NO: 4321009 - DNA, 18 bp, Homo sapiens
tgaaagccctgagctttc

SEQ ID NO: 4321010 - DNA, 18 bp, Homo sapiens
tgcctgaaagctgggagc

SEQ ID NO: 4321011 - DNA, 21 bp, Homo sapiens
tgcctgctgggtgccaggtgc

SEQ ID NO: 4321012 - DNA, 9 bp, Homo sapiens
tgcctggca

SEQ ID NO: 4321013 - DNA, 18 bp, Homo sapiens
tgcctggttcgtgccatg

SEQ ID NO: 4321014 - DNA, 15 bp, Homo sapiens
tgcctggttttattt

SEQ ID NO: 4321015 - DNA, 22 bp, Homo sapiens
tgcctgtaattaaactagttta

SEQ ID NO: 4321016 - DNA, 13 bp, Homo sapiens
tgcctgtgcttct

SEQ ID NO: 4321017 - DNA, 13 bp, Homo sapiens
tgccttcctcctt

SEQ ID NO: 4321018 - DNA, 14 bp, Homo sapiens
tgccttcctcctta

SEQ ID NO: 4321019 - DNA, 20 bp, Homo sapiens
tgccttttaagtttgaaact

SEQ ID NO: 4321020 - DNA, 13 bp, Homo sapiens
tgcgaaaggatga

SEQ ID NO: 4321021 - DNA, 16 bp, Homo sapiens
tgcgcacttacctgct

SEQ ID NO: 4321022 - DNA, 23 bp, Homo sapiens
tgcggatgataactactgacgaa

SEQ ID NO: 4321023 - DNA, 17 bp, Homo sapiens
tgcggcctttggcttca

SEQ ID NO: 4321024 - DNA, 20 bp, Homo sapiens
tgcgtcccccgttgtgcctg

SEQ ID NO: 4321025 - DNA, 20 bp, Homo sapiens
tgcgtctggaggggcccctg

SEQ ID NO: 4321026 - DNA, 21 bp, Homo sapiens
tgcgtgactattttttaataa

SEQ ID NO: 4321027 - DNA, 22 bp, Homo sapiens
tgcgtgactattttttaataaa

SEQ ID NO: 4321028 - DNA, 23 bp, Homo sapiens
tgcgtgactattttttaataaaa

SEQ ID NO: 4321029 - DNA, 16 bp, Homo sapiens
tgctaaattataaaat

SEQ ID NO: 4321030 - DNA, 23 bp, Homo sapiens
tgctaaattataaaattgaaaac

SEQ ID NO: 4321031 - DNA, 15 bp, Homo sapiens
tgctaaattgagagg

SEQ ID NO: 4321032 - DNA, 17 bp, Homo sapiens
tgctaactgggaagaac

SEQ ID NO: 4321033 - DNA, 22 bp, Homo sapiens
tgctaatatactttttttgtta

SEQ ID NO: 4321034 - DNA, 19 bp, Homo sapiens
tgctacacatatgtgcttc

SEQ ID NO: 4321035 - DNA, 22 bp, Homo sapiens
tgctatatttttaaagaaggag

SEQ ID NO: 4321036 - DNA, 14 bp, Homo sapiens
tgctatgtgtgctt

SEQ ID NO: 4321037 - DNA, 15 bp, Homo sapiens
tgctatgtgtgctta

SEQ ID NO: 4321038 - DNA, 15 bp, Homo sapiens
tgctattttaaaaaa

SEQ ID NO: 4321039 - DNA, 18 bp, Homo sapiens
tgctattttaaaaaatat

SEQ ID NO: 4321040 - DNA, 21 bp, Homo sapiens
tgctattttttttaaatcaaa

SEQ ID NO: 4321041 - DNA, 18 bp, Homo sapiens
tgctccaggcatcactga

SEQ ID NO: 4321042 - DNA, 16 bp, Homo sapiens
tgctccagggagattt

SEQ ID NO: 4321043 - DNA, 20 bp, Homo sapiens
tgctccatttttaaccactt

SEQ ID NO: 4321044 - DNA, 17 bp, Homo sapiens
tgctctgaagtgtccta

SEQ ID NO: 4321045 - DNA, 23 bp, Homo sapiens
tgctctgggagacttactgcatt

SEQ ID NO: 4321046 - DNA, 21 bp, Homo sapiens
tgctgaaagtcctgctttcct

SEQ ID NO: 4321047 - DNA, 19 bp, Homo sapiens
tgctgaagtacagtcccag

SEQ ID NO: 4321048 - DNA, 16 bp, Homo sapiens
tgctgaattgagaata

SEQ ID NO: 4321049 - DNA, 21 bp, Homo sapiens
tgctgactgttttctcttgag

SEQ ID NO: 4321050 - DNA, 16 bp, Homo sapiens
tgctgagcctgcccag

SEQ ID NO: 4321051 - DNA, 18 bp, Homo sapiens
tgctgagctgaagaaatt

SEQ ID NO: 4321052 - DNA, 17 bp, Homo sapiens
tgctgagtctcccaagg

SEQ ID NO: 4321053 - DNA, 17 bp, Homo sapiens
tgctgcaaacccatgaa

SEQ ID NO: 4321054 - DNA, 14 bp, Homo sapiens
tgctgcataaaatt

SEQ ID NO: 4321055 - DNA, 22 bp, Homo sapiens
tgctgccttgctgcataaaatt

SEQ ID NO: 4321056 - DNA, 17 bp, Homo sapiens
tgctgctgttctgtgta

SEQ ID NO: 4321057 - DNA, 19 bp, Homo sapiens
tgctggcctgactggttgt

SEQ ID NO: 4321058 - DNA, 17 bp, Homo sapiens
tgctgggcttgtctgta

SEQ ID NO: 4321059 - DNA, 17 bp, Homo sapiens
tgctgtaacctgaagtc

SEQ ID NO: 4321060 - DNA, 13 bp, Homo sapiens
tgctgtatttctt

SEQ ID NO: 4321061 - DNA, 22 bp, Homo sapiens
tgctgtcttgatgactgctgat

SEQ ID NO: 4321062 - DNA, 18 bp, Homo sapiens
tgctgtgccgtgtccaag

SEQ ID NO: 4321063 - DNA, 15 bp, Homo sapiens
tgctgttactgcttc

SEQ ID NO: 4321064 - DNA, 18 bp, Homo sapiens
tgctgttgtttctataaa

SEQ ID NO: 4321065 - DNA, 21 bp, Homo sapiens
tgctgtttactcccttctgta

SEQ ID NO: 4321066 - DNA, 21 bp, Homo sapiens
tgcttacagtttattttctgt

SEQ ID NO: 4321067 - DNA, 23 bp, Homo sapiens
tgcttacagtttattttctgtgt

SEQ ID NO: 4321068 - DNA, 21 bp, Homo sapiens
tgcttattgcttagtaaaatt

SEQ ID NO: 4321069 - DNA, 21 bp, Homo sapiens
tgcttcactcatgcaaactgc

SEQ ID NO: 4321070 - DNA, 22 bp, Homo sapiens
tgcttcactcatgcaaactgct

SEQ ID NO: 4321071 - DNA, 13 bp, Homo sapiens
tgcttcagagttt

SEQ ID NO: 4321072 - DNA, 18 bp, Homo sapiens
tgcttcagagtttgtgtg

SEQ ID NO: 4321073 - DNA, 23 bp, Homo sapiens
tgcttcctgattaccagtctgat

SEQ ID NO: 4321074 - DNA, 22 bp, Homo sapiens
tgcttccttggttcatgcttct

SEQ ID NO: 4321075 - DNA, 21 bp, Homo sapiens
tgcttctcagttgcagaaaat

SEQ ID NO: 4321076 - DNA, 19 bp, Homo sapiens
tgcttctcatcttgtgaaa

SEQ ID NO: 4321077 - DNA, 15 bp, Homo sapiens
tgcttctccagcctg

SEQ ID NO: 4321078 - DNA, 14 bp, Homo sapiens
tgcttctctttgtg

SEQ ID NO: 4321079 - DNA, 21 bp, Homo sapiens
tgcttctgcagcaactcccac

SEQ ID NO: 4321080 - DNA, 13 bp, Homo sapiens
tgcttctttttct

SEQ ID NO: 4321081 - DNA, 15 bp, Homo sapiens
tgcttgagctcagga

SEQ ID NO: 4321082 - DNA, 16 bp, Homo sapiens
tgcttgagctttctgt

SEQ ID NO: 4321083 - DNA, 21 bp, Homo sapiens
tgcttgaggcaactcatctta

SEQ ID NO: 4321084 - DNA, 16 bp, Homo sapiens
tgcttggagtgcccca

SEQ ID NO: 4321085 - DNA, 15 bp, Homo sapiens
tgctttattttccct

SEQ ID NO: 4321086 - DNA, 20 bp, Homo sapiens
tgctttgagaccagaagaaa

SEQ ID NO: 4321087 - DNA, 24 bp, Homo sapiens
tgctttgagaccagaagaaaagac

SEQ ID NO: 4321088 - DNA, 16 bp, Homo sapiens
tgctttggatacacac

SEQ ID NO: 4321089 - DNA, 15 bp, Homo sapiens
tggaaaaatgcccat

SEQ ID NO: 4321090 - DNA, 15 bp, Homo sapiens
tggaaatgttaagaa

SEQ ID NO: 4321091 - DNA, 16 bp, Homo sapiens
tggaaatgttaagaaa

SEQ ID NO: 4321092 - DNA, 20 bp, Homo sapiens
tggaacaaagtgaaggacat

SEQ ID NO: 4321093 - DNA, 12 bp, Homo sapiens
tggaagaaaggc

SEQ ID NO: 4321094 - DNA, 16 bp, Homo sapiens
tggaagaaaggctgtg

SEQ ID NO: 4321095 - DNA, 19 bp, Homo sapiens
tggaagaaaggctgtggaa

SEQ ID NO: 4321096 - DNA, 19 bp, Homo sapiens
tggacaagacatgcttggg

SEQ ID NO: 4321097 - DNA, 19 bp, Homo sapiens
tggaccaattattgatata

SEQ ID NO: 4321098 - DNA, 20 bp, Homo sapiens
tggaccaattattgatatat

SEQ ID NO: 4321099 - DNA, 23 bp, Homo sapiens
tggaccctgtggatgataaaaca

SEQ ID NO: 4321100 - DNA, 20 bp, Homo sapiens
tggacgctgccgggagactg

SEQ ID NO: 4321101 - DNA, 11 bp, Homo sapiens
tggagaaaatg

SEQ ID NO: 4321102 - DNA, 19 bp, Homo sapiens
tggagaaatgaagcagagg

SEQ ID NO: 4321103 - DNA, 13 bp, Homo sapiens
tggagaagcggct

SEQ ID NO: 4321104 - DNA, 19 bp, Homo sapiens
tggagacggaatctgccgc

SEQ ID NO: 4321105 - DNA, 16 bp, Homo sapiens
tggagactctgagagc

SEQ ID NO: 4321106 - DNA, 12 bp, Homo sapiens
tggagaggaaga

SEQ ID NO: 4321107 - DNA, 15 bp, Homo sapiens
tggagaggaagaaac

SEQ ID NO: 4321108 - DNA, 23 bp, Homo sapiens
tggagatgcccgcacagtaatgt

SEQ ID NO: 4321109 - DNA, 13 bp, Homo sapiens
tggagcaaaacaa

SEQ ID NO: 4321110 - DNA, 20 bp, Homo sapiens
tggagcattaactaaatgct

SEQ ID NO: 4321111 - DNA, 20 bp, Homo sapiens
tggagctgccgtgcctgtgt

SEQ ID NO: 4321112 - DNA, 22 bp, Homo sapiens
tggagctgctaagctaaagaaa

SEQ ID NO: 4321113 - DNA, 17 bp, Homo sapiens
tggaggagggagagccc

SEQ ID NO: 4321114 - DNA, 19 bp, Homo sapiens
tggaggagggagagccctg

SEQ ID NO: 4321115 - DNA, 17 bp, Homo sapiens
tggagtgccccaaggag

SEQ ID NO: 4321116 - DNA, 22 bp, Homo sapiens
tggagtgccccaaggaggtggc

SEQ ID NO: 4321117 - DNA, 15 bp, Homo sapiens
tggagtggccactgg

SEQ ID NO: 4321118 - DNA, 15 bp, Homo sapiens
tggagtgtttgaaaa

SEQ ID NO: 4321119 - DNA, 21 bp, Homo sapiens
tggagtgtttgaaaactgaca

SEQ ID NO: 4321120 - DNA, 16 bp, Homo sapiens
tggataataggaattc

SEQ ID NO: 4321121 - DNA, 21 bp, Homo sapiens
tggatacacacatagtttctt

SEQ ID NO: 4321122 - DNA, 17 bp, Homo sapiens
tggatatagaaaatctt

SEQ ID NO: 4321123 - DNA, 14 bp, Homo sapiens
tggatcagaggtca

SEQ ID NO: 4321124 - DNA, 20 bp, Homo sapiens
tggatcagaggtcatccctt

SEQ ID NO: 4321125 - DNA, 16 bp, Homo sapiens
tggatgacaaagaaaa

SEQ ID NO: 4321126 - DNA, 22 bp, Homo sapiens
tggatggagcccagttggaaaa

SEQ ID NO: 4321127 - DNA, 16 bp, Homo sapiens
tgtatccccagtgccc

SEQ ID NO: 4321128 - DNA, 20 bp, Homo sapiens
tgtatgccttcgggaaaatt

SEQ ID NO: 4321129 - DNA, 16 bp, Homo sapiens
tgtatttagtagttat

SEQ ID NO: 4321130 - DNA, 13 bp, Homo sapiens
tgtatttatgtaa

SEQ ID NO: 4321131 - DNA, 22 bp, Homo sapiens
tgtatttatgtaatgaagtaaa

SEQ ID NO: 4321132 - DNA, 14 bp, Homo sapiens
tgtatttcagtatt

SEQ ID NO: 4321133 - DNA, 19 bp, Homo sapiens
tgtatttcagtattttcca

SEQ ID NO: 4321134 - DNA, 14 bp, Homo sapiens
tgtatttctgtgga

SEQ ID NO: 4321135 - DNA, 13 bp, Homo sapiens
tgtatttgtatta

SEQ ID NO: 4321136 - DNA, 21 bp, Homo sapiens
tgtatttgtattaataaagca

SEQ ID NO: 4321137 - DNA, 22 bp, Homo sapiens
tgtcaatcttaagaggatggat

SEQ ID NO: 4321138 - DNA, 13 bp, Homo sapiens
tgtcacctccttc

SEQ ID NO: 4321139 - DNA, 17 bp, Homo sapiens
tgtcacctccttcccca

SEQ ID NO: 4321140 - DNA, 21 bp, Homo sapiens
tgtcacctccttccccagctc

SEQ ID NO: 4321141 - DNA, 22 bp, Homo sapiens
tgtcacctccttccccagctcc

SEQ ID NO: 4321142 - DNA, 19 bp, Homo sapiens
tgtcagaagacactaattc

SEQ ID NO: 4321143 - DNA, 15 bp, Homo sapiens
tgtcagaatggaatc

SEQ ID NO: 4321144 - DNA, 23 bp, Homo sapiens
tgtcagataagccggtgggggga

SEQ ID NO: 4321145 - DNA, 22 bp, Homo sapiens
tgtcagccatgggaaatgagcc

SEQ ID NO: 4321146 - DNA, 23 bp, Homo sapiens
tgtcatatgctcctagagaggag

SEQ ID NO: 4321147 - DNA, 14 bp, Homo sapiens
tgtcatttctttta

SEQ ID NO: 4321148 - DNA, 20 bp, Homo sapiens
tgtccaagggccgtgccctt

SEQ ID NO: 4321149 - DNA, 14 bp, Homo sapiens
tgtccagccgtgtg

SEQ ID NO: 4321150 - DNA, 13 bp, Homo sapiens
tgtccagttataa

SEQ ID NO: 4321151 - DNA, 17 bp, Homo sapiens
tgtccatgcttctcatc

SEQ ID NO: 4321152 - DNA, 14 bp, Homo sapiens
tgtcccctcagctc

SEQ ID NO: 4321153 - DNA, 14 bp, Homo sapiens
tgtccgagctttga

SEQ ID NO: 4321154 - DNA, 14 bp, Homo sapiens
tgtccttgcacctg

SEQ ID NO: 4321155 - DNA, 22 bp, Homo sapiens
tgtcctttgaggccccaactca

SEQ ID NO: 4321156 - DNA, 21 bp, Homo sapiens
tgtctcaaaaaaagaaaaaga

SEQ ID NO: 4321157 - DNA, 19 bp, Homo sapiens
tgtctctcttcagactctc

SEQ ID NO: 4321158 - DNA, 14 bp, Homo sapiens
tgtctgaattgaga

SEQ ID NO: 4321159 - DNA, 15 bp, Homo sapiens
tgtctgaattgagaa

SEQ ID NO: 4321160 - DNA, 16 bp, Homo sapiens
tgtctgagatgctggt

SEQ ID NO: 4321161 - DNA, 14 bp, Homo sapiens
tgtctgctctcatc

SEQ ID NO: 4321162 - DNA, 23 bp, Homo sapiens
tgtctgctctcatccattcctct

SEQ ID NO: 4321163 - DNA, 15 bp, Homo sapiens
tgtctgtgtgctgta

SEQ ID NO: 4321164 - DNA, 14 bp, Homo sapiens
tgtctgtgttgctt

SEQ ID NO: 4321165 - DNA, 20 bp, Homo sapiens
tgtctgtgttgcttcaaatt

SEQ ID NO: 4321166 - DNA, 13 bp, Homo sapiens
tgtcttgttctgt

SEQ ID NO: 4321167 - DNA, 17 bp, Homo sapiens
tgtctttcatctcccag

SEQ ID NO: 4321168 - DNA, 14 bp, Homo sapiens
tgtctttcctccct

SEQ ID NO: 4321169 - DNA, 19 bp, Homo sapiens
tgtctttggataataggaa

SEQ ID NO: 4321170 - DNA, 15 bp, Homo sapiens
tgtgaaaagaaaaat

SEQ ID NO: 4321171 - DNA, 14 bp, Homo sapiens
tgtgaagaaataag

SEQ ID NO: 4321172 - DNA, 20 bp, Homo sapiens
tgtgaaggacatgagactaa

SEQ ID NO: 4321173 - DNA, 14 bp, Homo sapiens
tgtgaatgcttctc

SEQ ID NO: 4321174 - DNA, 15 bp, Homo sapiens
tgtgaatgcttctca

SEQ ID NO: 4321175 - DNA, 14 bp, Homo sapiens
tgtgagatgtaatt

SEQ ID NO: 4321176 - DNA, 18 bp, Homo sapiens
tgtgagcgtgtccacaga

SEQ ID NO: 4321177 - DNA, 16 bp, Homo sapiens
tgtgatgaggggaggg

SEQ ID NO: 4321178 - DNA, 14 bp, Homo sapiens
tgtgattacctctc

SEQ ID NO: 4321179 - DNA, 17 bp, Homo sapiens
tgtgatttttcttcagg

SEQ ID NO: 4321180 - DNA, 13 bp, Homo sapiens
tgtgcacactaag

SEQ ID NO: 4321181 - DNA, 17 bp, Homo sapiens
tgtgcagtcatcaacaa

SEQ ID NO: 4321182 - DNA, 12 bp, Homo sapiens
tgtgcccctgcc

SEQ ID NO: 4321183 - DNA, 16 bp, Homo sapiens
tgtgcgaagcaagaag

SEQ ID NO: 4321184 - DNA, 20 bp, Homo sapiens
tgtgctatatttttaaagaa

SEQ ID NO: 4321185 - DNA, 21 bp, Homo sapiens
tgtgctgagcctgcccagttg

SEQ ID NO: 4321186 - DNA, 13 bp, Homo sapiens
tgtgctgctgttc

SEQ ID NO: 4321187 - DNA, 15 bp, Homo sapiens
tgtgctgctgttctg

SEQ ID NO: 4321188 - DNA, 19 bp, Homo sapiens
tgtgctgctgttctgtgta

SEQ ID NO: 4321189 - DNA, 12 bp, Homo sapiens
tgtgcttctccc

SEQ ID NO: 4321190 - DNA, 16 bp, Homo sapiens
tgtgcttctccccaga

SEQ ID NO: 4321191 - DNA, 18 bp, Homo sapiens
tgtgcttctccccagaat

SEQ ID NO: 4321192 - DNA, 22 bp, Homo sapiens
tgtggaagggccaatggagaaa

SEQ ID NO: 4321193 - DNA, 18 bp, Homo sapiens
tgtggagaactcagtgcc

SEQ ID NO: 4321194 - DNA, 19 bp, Homo sapiens
tgtggagaactcagtgcca

SEQ ID NO: 4321195 - DNA, 20 bp, Homo sapiens
tgtggaggagggagagccct

SEQ ID NO: 4321196 - DNA, 23 bp, Homo sapiens
tgtggaggagggagagccctgtc

SEQ ID NO: 4321197 - DNA, 14 bp, Homo sapiens
tgtggatgataaaa

SEQ ID NO: 4321198 - DNA, 11 bp, Homo sapiens
tgtggccagga

SEQ ID NO: 4321199 - DNA, 13 bp, Homo sapiens
tgtgggtgggaga

SEQ ID NO: 4321200 - DNA, 15 bp, Homo sapiens
tgtgtaaaatgagta

SEQ ID NO: 4321201 - DNA, 22 bp, Homo sapiens
tgtgtagttccctctgcctggg

SEQ ID NO: 4321202 - DNA, 22 bp, Homo sapiens
tgtgtagttgtctctcttcaga

SEQ ID NO: 4321203 - DNA, 15 bp, Homo sapiens
tgtgtatttgtatta

SEQ ID NO: 4321204 - DNA, 19 bp, Homo sapiens
tgtgtatttgtattaataa

SEQ ID NO: 4321205 - DNA, 19 bp, Homo sapiens
tgtgtcagcatagaagtaa

SEQ ID NO: 4321206 - DNA, 16 bp, Homo sapiens
tgtgtctgaatcatgt

SEQ ID NO: 4321207 - DNA, 19 bp, Homo sapiens
tgtgtctgaatcatgtctg

SEQ ID NO: 4321208 - DNA, 20 bp, Homo sapiens
tgtgtctgaatcatgtctgt

SEQ ID NO: 4321209 - DNA, 13 bp, Homo sapiens
tgtgtctgctctc

SEQ ID NO: 4321210 - DNA, 12 bp, Homo sapiens
tgtgtctgtagg

SEQ ID NO: 4321211 - DNA, 15 bp, Homo sapiens
tgtgtgcagacaatt

SEQ ID NO: 4321212 - DNA, 13 bp, Homo sapiens
tgtgtgcatgtgc

SEQ ID NO: 4321213 - DNA, 19 bp, Homo sapiens
tgtgtggagaactcagtgc

SEQ ID NO: 4321214 - DNA, 20 bp, Homo sapiens
tgtgttcaatgaaataaaag

SEQ ID NO: 4321215 - DNA, 20 bp, Homo sapiens
tgtgtttttctccagtgctg

SEQ ID NO: 4321216 - DNA, 12 bp, Homo sapiens
tgttaaagctta

SEQ ID NO: 4321217 - DNA, 20 bp, Homo sapiens
tgttacaaattttttaattt

SEQ ID NO: 4321218 - DNA, 15 bp, Homo sapiens
tgttacattattcca

SEQ ID NO: 4321219 - DNA, 19 bp, Homo sapiens
tgttactgcttctctttgt

SEQ ID NO: 4321220 - DNA, 21 bp, Homo sapiens
tgttactgcttctctttgtgc

SEQ ID NO: 4321221 - DNA, 16 bp, Homo sapiens
tgttactgtcttcagt

SEQ ID NO: 4321222 - DNA, 21 bp, Homo sapiens
tgttagatagaatttccaata

SEQ ID NO: 4321223 - DNA, 21 bp, Homo sapiens
tgttattaatgtttcttctcc

SEQ ID NO: 4321224 - DNA, 16 bp, Homo sapiens
tgttcaagcttttcct

SEQ ID NO: 4321225 - DNA, 16 bp, Homo sapiens
tgttcaatagaacatg

SEQ ID NO: 4321226 - DNA, 11 bp, Homo sapiens
tgttcagctgg

SEQ ID NO: 4321227 - DNA, 16 bp, Homo sapiens
tgttcagtgttgacat

SEQ ID NO: 4321228 - DNA, 18 bp, Homo sapiens
tgttcagtgttgacatag

SEQ ID NO: 4321229 - DNA, 22 bp, Homo sapiens
tgttcagtgttgacatagcctt

SEQ ID NO: 4321230 - DNA, 23 bp, Homo sapiens
tgttcagtgttgacatagccttt

SEQ ID NO: 4321231 - DNA, 17 bp, Homo sapiens
tgttccaaatgaatgtt

SEQ ID NO: 4321232 - DNA, 21 bp, Homo sapiens
tgttcccactcagcagtgaga

SEQ ID NO: 4321233 - DNA, 20 bp, Homo sapiens
tgttccccccatagagacca

SEQ ID NO: 4321234 - DNA, 16 bp, Homo sapiens
tgttcccccgccgctt

SEQ ID NO: 4321235 - DNA, 18 bp, Homo sapiens
tgttctatccaaacatgt

SEQ ID NO: 4321236 - DNA, 18 bp, Homo sapiens
tgttctcagctccccctg

SEQ ID NO: 4321237 - DNA, 18 bp, Homo sapiens
tgttctctctgaatgctg

SEQ ID NO: 4321238 - DNA, 16 bp, Homo sapiens
tgttctctcttctcca

SEQ ID NO: 4321239 - DNA, 16 bp, Homo sapiens
tgttgaaaaatgttgc

SEQ ID NO: 4321240 - DNA, 15 bp, Homo sapiens
tgttgacatagcctt

SEQ ID NO: 4321241 - DNA, 17 bp, Homo sapiens
tgttgacatagcctttg

SEQ ID NO: 4321242 - DNA, 19 bp, Homo sapiens
tgttgacatagcctttgtg

SEQ ID NO: 4321243 - DNA, 12 bp, Homo sapiens
tgttgccagtgc

SEQ ID NO: 4321244 - DNA, 13 bp, Homo sapiens
tgttgccagtgct

SEQ ID NO: 4321245 - DNA, 22 bp, Homo sapiens
tgttggacagacactgttgcaa

SEQ ID NO: 4321246 - DNA, 14 bp, Homo sapiens
ttgagaggggctat

SEQ ID NO: 4321247 - DNA, 15 bp, Homo sapiens
ttgagattgccccag

SEQ ID NO: 4321248 - DNA, 20 bp, Homo sapiens
ttgagattgccccaggtctg

SEQ ID NO: 4321249 - DNA, 23 bp, Homo sapiens
ttgagcaggtatcaactagggga

SEQ ID NO: 4321250 - DNA, 11 bp, Homo sapiens
ttgagcctggg

SEQ ID NO: 4321251 - DNA, 14 bp, Homo sapiens
ttgaggaactgtac

SEQ ID NO: 4321252 - DNA, 15 bp, Homo sapiens
ttgaggccccaactc

SEQ ID NO: 4321253 - DNA, 14 bp, Homo sapiens
ttgaggtagaggaa

SEQ ID NO: 4321254 - DNA, 20 bp, Homo sapiens
ttgagtttgtaggtaaaatg

SEQ ID NO: 4321255 - DNA, 13 bp, Homo sapiens
ttgatatatatta

SEQ ID NO: 4321256 - DNA, 14 bp, Homo sapiens
ttgatatatattat

SEQ ID NO: 4321257 - DNA, 22 bp, Homo sapiens
ttgatcagatgctgaattgaga

SEQ ID NO: 4321258 - DNA, 12 bp, Homo sapiens
ttgatcccctct

SEQ ID NO: 4321259 - DNA, 15 bp, Homo sapiens
ttgatctttgtttaa

SEQ ID NO: 4321260 - DNA, 18 bp, Homo sapiens
ttgatctttgtttaaatg

SEQ ID NO: 4321261 - DNA, 19 bp, Homo sapiens
ttgatctttgtttaaatgc

SEQ ID NO: 4321262 - DNA, 22 bp, Homo sapiens
ttgatctttgtttaaatgccaa

SEQ ID NO: 4321263 - DNA, 15 bp, Homo sapiens
ttgatgactgctgat

SEQ ID NO: 4321264 - DNA, 17 bp, Homo sapiens
ttgcaaaatagaagaag

SEQ ID NO: 4321265 - DNA, 19 bp, Homo sapiens
ttgcaaaatagaagaagag

SEQ ID NO: 4321266 - DNA, 18 bp, Homo sapiens
ttgcaaattatttattac

SEQ ID NO: 4321267 - DNA, 14 bp, Homo sapiens
ttgcaccactgcac

SEQ ID NO: 4321268 - DNA, 14 bp, Homo sapiens
ttgcaccattttca

SEQ ID NO: 4321269 - DNA, 16 bp, Homo sapiens
ttgcacctgagcctgt

SEQ ID NO: 4321270 - DNA, 16 bp, Homo sapiens
ttgcactaggaattct

SEQ ID NO: 4321271 - DNA, 22 bp, Homo sapiens
ttgcactaggaattctttgcat

SEQ ID NO: 4321272 - DNA, 13 bp, Homo sapiens
ttgcactgtccag

SEQ ID NO: 4321273 - DNA, 15 bp, Homo sapiens
ttgcagatgccaaaa

SEQ ID NO: 4321274 - DNA, 19 bp, Homo sapiens
ttgcagcttgtgctgagcc

SEQ ID NO: 4321275 - DNA, 16 bp, Homo sapiens
ttgcataatactaatt

SEQ ID NO: 4321276 - DNA, 17 bp, Homo sapiens
ttgcataatactaattt

SEQ ID NO: 4321277 - DNA, 20 bp, Homo sapiens
ttgcatccacttcaggagcc

SEQ ID NO: 4321278 - DNA, 21 bp, Homo sapiens
ttgcatccacttcaggagccc

SEQ ID NO: 4321279 - DNA, 18 bp, Homo sapiens
ttgcattccttacttgca

SEQ ID NO: 4321280 - DNA, 20 bp, Homo sapiens
ttgcattccttacttgcact

SEQ ID NO: 4321281 - DNA, 21 bp, Homo sapiens
ttgcattccttacttgcactg

SEQ ID NO: 4321282 - DNA, 13 bp, Homo sapiens
ttgcatttgctgt

SEQ ID NO: 4321283 - DNA, 21 bp, Homo sapiens
ttgccaagctaatctgcctgg

SEQ ID NO: 4321284 - DNA, 11 bp, Homo sapiens
ttgccacaggc

SEQ ID NO: 4321285 - DNA, 18 bp, Homo sapiens
ttgcccgccctccaccca

SEQ ID NO: 4321286 - DNA, 23 bp, Homo sapiens
ttgcccgccctccacccactagg

SEQ ID NO: 4321287 - DNA, 19 bp, Homo sapiens
ttgccgacagcacagatgt

SEQ ID NO: 4321288 - DNA, 13 bp, Homo sapiens
ttgcctctttctc

SEQ ID NO: 4321289 - DNA, 24 bp, Homo sapiens
ttgcctgctgcttggagtgcccca

SEQ ID NO: 4321290 - DNA, 13 bp, Homo sapiens
ttgctcagagaaa

SEQ ID NO: 4321291 - DNA, 11 bp, Homo sapiens
ttgctccaggc

SEQ ID NO: 4321292 - DNA, 21 bp, Homo sapiens
ttgctgaagggcattctttcc

SEQ ID NO: 4321293 - DNA, 15 bp, Homo sapiens
ttgctgcattttaca

SEQ ID NO: 4321294 - DNA, 23 bp, Homo sapiens
ttgctggaaaatcatattgagaa

SEQ ID NO: 4321295 - DNA, 16 bp, Homo sapiens
ttgctgtgactagata

SEQ ID NO: 4321296 - DNA, 14 bp, Homo sapiens
ttgctgttactgct

SEQ ID NO: 4321297 - DNA, 15 bp, Homo sapiens
ttgcttcaaattggt

SEQ ID NO: 4321298 - DNA, 18 bp, Homo sapiens
ttgcttcaaattggtctg

SEQ ID NO: 4321299 - DNA, 13 bp, Homo sapiens
ttgcttctgcagc

SEQ ID NO: 4321300 - DNA, 16 bp, Homo sapiens
ttgctttggatacaca

SEQ ID NO: 4321301 - DNA, 17 bp, Homo sapiens
ttgctttttgctgtgta

SEQ ID NO: 4321302 - DNA, 17 bp, Homo sapiens
ttggaaataaaaatgtt

SEQ ID NO: 4321303 - DNA, 22 bp, Homo sapiens
ttggaagaagttttttactttg

SEQ ID NO: 4321304 - DNA, 17 bp, Homo sapiens
ttggaatgttacatctg

SEQ ID NO: 4321305 - DNA, 17 bp, Homo sapiens
ttggagcattaactaaa

SEQ ID NO: 4321306 - DNA, 15 bp, Homo sapiens
ttggaggagactggg

SEQ ID NO: 4321307 - DNA, 16 bp, Homo sapiens
ttggaggagactgggc

SEQ ID NO: 4321308 - DNA, 18 bp, Homo sapiens
ttggataataggaattca

SEQ ID NO: 4321309 - DNA, 13 bp, Homo sapiens
ttggatttgctgt

SEQ ID NO: 4321310 - DNA, 18 bp, Homo sapiens
ttggatttgctgtgacta

SEQ ID NO: 4321311 - DNA, 16 bp, Homo sapiens
ttggcaaattcctagt

SEQ ID NO: 4321312 - DNA, 16 bp, Homo sapiens
ttggcataatttgtct

SEQ ID NO: 4321313 - DNA, 16 bp, Homo sapiens
ttggctgcgtactcca

SEQ ID NO: 4321314 - DNA, 24 bp, Homo sapiens
ttggctgcgtactccactggtctg

SEQ ID NO: 4321315 - DNA, 15 bp, Homo sapiens
ttggcttgctgttta

SEQ ID NO: 4321316 - DNA, 17 bp, Homo sapiens
ttgggatgcggggcaga

SEQ ID NO: 4321317 - DNA, 18 bp, Homo sapiens
ttggtatatttgtagata

SEQ ID NO: 4321318 - DNA, 14 bp, Homo sapiens
ttgtacaagctcag

SEQ ID NO: 4321319 - DNA, 15 bp, Homo sapiens
ttgtaccccccaacc

SEQ ID NO: 4321320 - DNA, 21 bp, Homo sapiens
ttgtaccccccaacccctgag

SEQ ID NO: 4321321 - DNA, 19 bp, Homo sapiens
ttgtagaataaatggtttc

SEQ ID NO: 4321322 - DNA, 22 bp, Homo sapiens
ttgtagaataaatggtttctca

SEQ ID NO: 4321323 - DNA, 14 bp, Homo sapiens
ttgtagtaaatatt

SEQ ID NO: 4321324 - DNA, 14 bp, Homo sapiens
ttgtagttcttagt

SEQ ID NO: 4321325 - DNA, 15 bp, Homo sapiens
ttgtattaataaagc

SEQ ID NO: 4321326 - DNA, 17 bp, Homo sapiens
ttgtattaataaagcat

SEQ ID NO: 4321327 - DNA, 22 bp, Homo sapiens
ttgtcagaatggaatccatctg

SEQ ID NO: 4321328 - DNA, 20 bp, Homo sapiens
ttgtcattgtccagctggga

SEQ ID NO: 4321329 - DNA, 22 bp, Homo sapiens
ttgtctattattgaaatagttt

SEQ ID NO: 4321330 - DNA, 15 bp, Homo sapiens
ttgtctctcttcaga

SEQ ID NO: 4321331 - DNA, 22 bp, Homo sapiens
ttgtctgaattgagaaaagagt

SEQ ID NO: 4321332 - DNA, 23 bp, Homo sapiens
ttgtgaaatggccaggatcctct

SEQ ID NO: 4321333 - DNA, 21 bp, Homo sapiens
ttgtgctatatttttaaagaa

SEQ ID NO: 4321334 - DNA, 18 bp, Homo sapiens
ttgtgctgagcctgccca

SEQ ID NO: 4321335 - DNA, 18 bp, Homo sapiens
ttgtgcttctccccagaa

SEQ ID NO: 4321336 - DNA, 23 bp, Homo sapiens
ttgtggaggagggagagccctgt

SEQ ID NO: 4321337 - DNA, 13 bp, Homo sapiens
ttgtgggtgggag

SEQ ID NO: 4321338 - DNA, 16 bp, Homo sapiens
ttgtggttttatggag

SEQ ID NO: 4321339 - DNA, 22 bp, Homo sapiens
ttgtgtattgagtcttaactgt

SEQ ID NO: 4321340 - DNA, 22 bp, Homo sapiens
ttgtgtggagaactcagtgcca

SEQ ID NO: 4321341 - DNA, 18 bp, Homo sapiens
ttgtgtgtatttgtatta

SEQ ID NO: 4321342 - DNA, 18 bp, Homo sapiens
ttgttcaagcttttcctt

SEQ ID NO: 4321343 - DNA, 15 bp, Homo sapiens
ttgttcctttgaaga

SEQ ID NO: 4321344 - DNA, 17 bp, Homo sapiens
ttgttcttgtattttaa

SEQ ID NO: 4321345 - DNA, 16 bp, Homo sapiens
ttgttgtcattgtcca

SEQ ID NO: 4321346 - DNA, 17 bp, Homo sapiens
ttgttgtcattgtccag

SEQ ID NO: 4321347 - DNA, 13 bp, Homo sapiens
ttgtttaaatgcc

SEQ ID NO: 4321348 - DNA, 16 bp, Homo sapiens
ttgtttatacacaact

SEQ ID NO: 4321349 - DNA, 20 bp, Homo sapiens
ttgtttatacacaactttgc

SEQ ID NO: 4321350 - DNA, 13 bp, Homo sapiens
ttgtttattgagt

SEQ ID NO: 4321351 - DNA, 15 bp, Homo sapiens
ttgtttattgagttt

SEQ ID NO: 4321352 - DNA, 18 bp, Homo sapiens
ttgtttctataaatgact

SEQ ID NO: 4321353 - DNA, 17 bp, Homo sapiens
ttgtttcttgtttattg

SEQ ID NO: 4321354 - DNA, 13 bp, Homo sapiens
ttgtttgtttctt

SEQ ID NO: 4321355 - DNA, 14 bp, Homo sapiens
ttgtttgtttcttt

SEQ ID NO: 4321356 - DNA, 15 bp, Homo sapiens
tttaaaaaatatata

SEQ ID NO: 4321357 - DNA, 14 bp, Homo sapiens
tttaaaaagggtaa

SEQ ID NO: 4321358 - DNA, 16 bp, Homo sapiens
tttaaaaagggtaact

SEQ ID NO: 4321359 - DNA, 15 bp, Homo sapiens
tttaaaaccagttac

SEQ ID NO: 4321360 - DNA, 16 bp, Homo sapiens
tttaaacaaaatttca

SEQ ID NO: 4321361 - DNA, 15 bp, Homo sapiens
tttaaagtaaacttg

SEQ ID NO: 4321362 - DNA, 18 bp, Homo sapiens
tttaaagtaaacttgtgt

SEQ ID NO: 4321363 - DNA, 16 bp, Homo sapiens
tttaaatcaaaaactt

SEQ ID NO: 4321364 - DNA, 13 bp, Homo sapiens
tttaaatgccaaa

SEQ ID NO: 4321365 - DNA, 17 bp, Homo sapiens
actgatagtgtccaaat

SEQ ID NO: 4321366 - DNA, 21 bp, Homo sapiens
actgatggtttggaaaataac

SEQ ID NO: 4321367 - DNA, 15 bp, Homo sapiens
actgcaaataaagcc

SEQ ID NO: 4321368 - DNA, 16 bp, Homo sapiens
actgcaaataaagcct

SEQ ID NO: 4321369 - DNA, 19 bp, Homo sapiens
actgcattcattctgagcc

SEQ ID NO: 4321370 - DNA, 20 bp, Homo sapiens
actgcattcattctgagccc

SEQ ID NO: 4321371 - DNA, 14 bp, Homo sapiens
actgccagtggaga

SEQ ID NO: 4321372 - DNA, 18 bp, Homo sapiens
actgctattttttttaaa

SEQ ID NO: 4321373 - DNA, 22 bp, Homo sapiens
actgctattttttttaaatcaa

SEQ ID NO: 4321374 - DNA, 15 bp, Homo sapiens
actgcttctctttgt

SEQ ID NO: 4321375 - DNA, 20 bp, Homo sapiens
actgctttattttccctact

SEQ ID NO: 4321376 - DNA, 17 bp, Homo sapiens
actgctttgtgcatatg

SEQ ID NO: 4321377 - DNA, 13 bp, Homo sapiens
actggaattaaaa

SEQ ID NO: 4321378 - DNA, 12 bp, Homo sapiens
actggagctgct

SEQ ID NO: 4321379 - DNA, 15 bp, Homo sapiens
actgggcacccctgc

SEQ ID NO: 4321380 - DNA, 17 bp, Homo sapiens
actgggcacccctgcct

SEQ ID NO: 4321381 - DNA, 17 bp, Homo sapiens
actgggggcgggactgg

SEQ ID NO: 4321382 - DNA, 19 bp, Homo sapiens
actgggggcggggcctggg

SEQ ID NO: 4321383 - DNA, 14 bp, Homo sapiens
actgggtgtcattt

SEQ ID NO: 4321384 - DNA, 20 bp, Homo sapiens
actgggtgtcatttcattcc

SEQ ID NO: 4321385 - DNA, 13 bp, Homo sapiens
actggttgtcaga

SEQ ID NO: 4321386 - DNA, 21 bp, Homo sapiens
actggttgtcagaatggaatc

SEQ ID NO: 4321387 - DNA, 13 bp, Homo sapiens
actgtaacttttt

SEQ ID NO: 4321388 - DNA, 14 bp, Homo sapiens
actgtaactttttt

SEQ ID NO: 4321389 - DNA, 12 bp, Homo sapiens
actgtatttctg

SEQ ID NO: 4321390 - DNA, 15 bp, Homo sapiens
actgtatttctgtgg

SEQ ID NO: 4321391 - DNA, 18 bp, Homo sapiens
actgtatttctgtggaaa

SEQ ID NO: 4321392 - DNA, 13 bp, Homo sapiens
actgtccagctgg

SEQ ID NO: 4321393 - DNA, 12 bp, Homo sapiens
actgtcttcagt

SEQ ID NO: 4321394 - DNA, 15 bp, Homo sapiens
actgtgaactgggca

SEQ ID NO: 4321395 - DNA, 18 bp, Homo sapiens
actgtgaactgggcattt

SEQ ID NO: 4321396 - DNA, 20 bp, Homo sapiens
actgtgaactgggcatttca

SEQ ID NO: 4321397 - DNA, 16 bp, Homo sapiens
actgtgaagagaacca

SEQ ID NO: 4321398 - DNA, 23 bp, Homo sapiens
actgtggccatatatgctgtatt

SEQ ID NO: 4321399 - DNA, 19 bp, Homo sapiens
actgtgtctgaatcatgtc

SEQ ID NO: 4321400 - DNA, 20 bp, Homo sapiens
actgtgtctgaatcatgtct

SEQ ID NO: 4321401 - DNA, 15 bp, Homo sapiens
actgttcacactgca

SEQ ID NO: 4321402 - DNA, 15 bp, Homo sapiens
actgttgtacaagct

SEQ ID NO: 4321403 - DNA, 19 bp, Homo sapiens
actgttgtccttaaaattc

SEQ ID NO: 4321404 - DNA, 14 bp, Homo sapiens
acttaaatatttgt

SEQ ID NO: 4321405 - DNA, 11 bp, Homo sapiens
acttaaatgag

SEQ ID NO: 4321406 - DNA, 17 bp, Homo sapiens
acttacctgaataatta

SEQ ID NO: 4321407 - DNA, 12 bp, Homo sapiens
acttactgcatt

SEQ ID NO: 4321408 - DNA, 14 bp, Homo sapiens
acttagaatgccat

SEQ ID NO: 4321409 - DNA, 15 bp, Homo sapiens
acttagaatgccata

SEQ ID NO: 4321410 - DNA, 16 bp, Homo sapiens
acttagtagtttttac

SEQ ID NO: 4321411 - DNA, 17 bp, Homo sapiens
acttagtagtttttaca

SEQ ID NO: 4321412 - DNA, 19 bp, Homo sapiens
acttagtagtttttacaaa

SEQ ID NO: 4321413 - DNA, 22 bp, Homo sapiens
acttagtagtttttacaaaact

SEQ ID NO: 4321414 - DNA, 13 bp, Homo sapiens
acttattgtaaat

SEQ ID NO: 4321415 - DNA, 16 bp, Homo sapiens
acttcagctgactttt

SEQ ID NO: 4321416 - DNA, 18 bp, Homo sapiens
acttccattgcaaaatag

SEQ ID NO: 4321417 - DNA, 22 bp, Homo sapiens
acttccattgcaaaatagaaga

SEQ ID NO: 4321418 - DNA, 17 bp, Homo sapiens
acttctcgcaactgaag

SEQ ID NO: 4321419 - DNA, 21 bp, Homo sapiens
acttctcttaaacttgtgaat

SEQ ID NO: 4321420 - DNA, 15 bp, Homo sapiens
acttctgagccccag

SEQ ID NO: 4321421 - DNA, 20 bp, Homo sapiens
acttctgagccccagcccca

SEQ ID NO: 4321422 - DNA, 11 bp, Homo sapiens
acttgccaaaa

SEQ ID NO: 4321423 - DNA, 14 bp, Homo sapiens
acttgggccactgt

SEQ ID NO: 4321424 - DNA, 11 bp, Homo sapiens
acttgtgaatg

SEQ ID NO: 4321425 - DNA, 12 bp, Homo sapiens
acttgtgaatgc

SEQ ID NO: 4321426 - DNA, 13 bp, Homo sapiens
acttgtgaatgct

SEQ ID NO: 4321427 - DNA, 22 bp, Homo sapiens
acttgtttctttctgtctctct

SEQ ID NO: 4321428 - DNA, 14 bp, Homo sapiens
actttaacctccct

SEQ ID NO: 4321429 - DNA, 21 bp, Homo sapiens
actttaacctccctcaacaag

SEQ ID NO: 4321430 - DNA, 17 bp, Homo sapiens
actttaattaggatcat

SEQ ID NO: 4321431 - DNA, 21 bp, Homo sapiens
actttatttattgcttagtga

SEQ ID NO: 4321432 - DNA, 20 bp, Homo sapiens
actttcgtatcataatttct

SEQ ID NO: 4321433 - DNA, 14 bp, Homo sapiens
actttgaataaaag

SEQ ID NO: 4321434 - DNA, 16 bp, Homo sapiens
actttgaataaaagaa

SEQ ID NO: 4321435 - DNA, 20 bp, Homo sapiens
actttgcaaattatttatta

SEQ ID NO: 4321436 - DNA, 22 bp, Homo sapiens
actttgcaaattatttattact

SEQ ID NO: 4321437 - DNA, 13 bp, Homo sapiens
actttgctccagg

SEQ ID NO: 4321438 - DNA, 14 bp, Homo sapiens
actttgctgcattt

SEQ ID NO: 4321439 - DNA, 16 bp, Homo sapiens
actttgctgttactgc

SEQ ID NO: 4321440 - DNA, 20 bp, Homo sapiens
actttgctgttactgcttct

SEQ ID NO: 4321441 - DNA, 18 bp, Homo sapiens
actttgtaccccccaacc

SEQ ID NO: 4321442 - DNA, 17 bp, Homo sapiens
actttgtggaccaatta

SEQ ID NO: 4321443 - DNA, 22 bp, Homo sapiens
actttgtggaccaattattgat

SEQ ID NO: 4321444 - DNA, 22 bp, Homo sapiens
acttttattatgggtatgtgtt

SEQ ID NO: 4321445 - DNA, 23 bp, Homo sapiens
acttttattatgggtatgtgttg

SEQ ID NO: 4321446 - DNA, 19 bp, Homo sapiens
acttttcatttcagatttt

SEQ ID NO: 4321447 - DNA, 17 bp, Homo sapiens
acttttccattcccaat

SEQ ID NO: 4321448 - DNA, 11 bp, Homo sapiens
acttttgaaaa

SEQ ID NO: 4321449 - DNA, 21 bp, Homo sapiens
acttttgagtatggctatcta

SEQ ID NO: 4321450 - DNA, 20 bp, Homo sapiens
agaaaaaaaaaaacttacac

SEQ ID NO: 4321451 - DNA, 15 bp, Homo sapiens
agaaaaaaataacta

SEQ ID NO: 4321452 - DNA, 17 bp, Homo sapiens
agaaaaaatattttccc

SEQ ID NO: 4321453 - DNA, 17 bp, Homo sapiens
agaaaaaatattttcct

SEQ ID NO: 4321454 - DNA, 13 bp, Homo sapiens
agaaaaagaaaaa

SEQ ID NO: 4321455 - DNA, 13 bp, Homo sapiens
agaaaaagaagaa

SEQ ID NO: 4321456 - DNA, 18 bp, Homo sapiens
agaaaaatattcaagtaa

SEQ ID NO: 4321457 - DNA, 18 bp, Homo sapiens
agaaaagagtgagaacta

SEQ ID NO: 4321458 - DNA, 23 bp, Homo sapiens
agaaaatgaatggacaaagctca

SEQ ID NO: 4321459 - DNA, 21 bp, Homo sapiens
accccagcccccacagccctg

SEQ ID NO: 4321460 - DNA, 19 bp, Homo sapiens
accccccaacccctgagga

SEQ ID NO: 4321461 - DNA, 16 bp, Homo sapiens
acccccttctgggcat

SEQ ID NO: 4321462 - DNA, 19 bp, Homo sapiens
acccctgcctcctgcctcc

SEQ ID NO: 4321463 - DNA, 11 bp, Homo sapiens
acccctttccc

SEQ ID NO: 4321464 - DNA, 15 bp, Homo sapiens
acccctttcccccac

SEQ ID NO: 4321465 - DNA, 15 bp, Homo sapiens
acccgccccgccccc

SEQ ID NO: 4321466 - DNA, 14 bp, Homo sapiens
accctaaaatttta

SEQ ID NO: 4321467 - DNA, 14 bp, Homo sapiens
accctcaggcaggt

SEQ ID NO: 4321468 - DNA, 11 bp, Homo sapiens
accctgtctca

SEQ ID NO: 4321469 - DNA, 14 bp, Homo sapiens
accctttgttgaaa

SEQ ID NO: 4321470 - DNA, 16 bp, Homo sapiens
accgaatatattactg

SEQ ID NO: 4321471 - DNA, 19 bp, Homo sapiens
accgaatatattactgatt

SEQ ID NO: 4321472 - DNA, 14 bp, Homo sapiens
accgaggagcccca

SEQ ID NO: 4321473 - DNA, 18 bp, Homo sapiens
accgaggagccccagccc

SEQ ID NO: 4321474 - DNA, 16 bp, Homo sapiens
accgaggtgttgccag

SEQ ID NO: 4321475 - DNA, 18 bp, Homo sapiens
accgccgactttgtaccc

SEQ ID NO: 4321476 - DNA, 20 bp, Homo sapiens
accgctctcttttctgtact

SEQ ID NO: 4321477 - DNA, 14 bp, Homo sapiens
accgttttgtattg

SEQ ID NO: 4321478 - DNA, 17 bp, Homo sapiens
acctaatgctggcctga

SEQ ID NO: 4321479 - DNA, 16 bp, Homo sapiens
acctattaaaggaaaa

SEQ ID NO: 4321480 - DNA, 14 bp, Homo sapiens
acctattgaattac

SEQ ID NO: 4321481 - DNA, 22 bp, Homo sapiens
acctatttatcgcaacatgaat

SEQ ID NO: 4321482 - DNA, 19 bp, Homo sapiens
acctcaagtttttgttttg

SEQ ID NO: 4321483 - DNA, 18 bp, Homo sapiens
acctcaggtgagaagcag

SEQ ID NO: 4321484 - DNA, 23 bp, Homo sapiens
acctcccacctatccgccctgca

SEQ ID NO: 4321485 - DNA, 18 bp, Homo sapiens
acctcctaatggcatgga

SEQ ID NO: 4321486 - DNA, 15 bp, Homo sapiens
acctccttccccagc

SEQ ID NO: 4321487 - DNA, 17 bp, Homo sapiens
acctccttccccagctc

SEQ ID NO: 4321488 - DNA, 19 bp, Homo sapiens
acctccttccccagctccc

SEQ ID NO: 4321489 - DNA, 19 bp, Homo sapiens
acctcggtgccttcctctt

SEQ ID NO: 4321490 - DNA, 20 bp, Homo sapiens
acctctctctaagtttagaa

SEQ ID NO: 4321491 - DNA, 19 bp, Homo sapiens
acctgaataattactacat

SEQ ID NO: 4321492 - DNA, 15 bp, Homo sapiens
acctgcacctctgga

SEQ ID NO: 4321493 - DNA, 21 bp, Homo sapiens
acctgcttgagctttctgtgc

SEQ ID NO: 4321494 - DNA, 17 bp, Homo sapiens
acctgtctcctttctca

SEQ ID NO: 4321495 - DNA, 12 bp, Homo sapiens
accttcccttcc

SEQ ID NO: 4321496 - DNA, 18 bp, Homo sapiens
accttcccttcctcagca

SEQ ID NO: 4321497 - DNA, 16 bp, Homo sapiens
accttctcccaggcct

SEQ ID NO: 4321498 - DNA, 19 bp, Homo sapiens
accttgcaaactctataaa

SEQ ID NO: 4321499 - DNA, 17 bp, Homo sapiens
acgacccttttgagcct

SEQ ID NO: 4321500 - DNA, 19 bp, Homo sapiens
acgactgttgtacaagctc

SEQ ID NO: 4321501 - DNA, 15 bp, Homo sapiens
acgattttaaaatga

SEQ ID NO: 4321502 - DNA, 16 bp, Homo sapiens
acgattttaaaatgac

SEQ ID NO: 4321503 - DNA, 18 bp, Homo sapiens
acgccaggggaaaatcag

SEQ ID NO: 4321504 - DNA, 16 bp, Homo sapiens
acgcgtgcatatgcta

SEQ ID NO: 4321505 - DNA, 14 bp, Homo sapiens
acgctccccgcctg

SEQ ID NO: 4321506 - DNA, 21 bp, Homo sapiens
acgctgccgggagactgccag

SEQ ID NO: 4321507 - DNA, 23 bp, Homo sapiens
acgctgccgggagactgccagtg

SEQ ID NO: 4321508 - DNA, 18 bp, Homo sapiens
acggaaacatagaaacat

SEQ ID NO: 4321509 - DNA, 23 bp, Homo sapiens
acggaaacatagaaacatacaca

SEQ ID NO: 4321510 - DNA, 15 bp, Homo sapiens
acggaagagccttgc

SEQ ID NO: 4321511 - DNA, 17 bp, Homo sapiens
acggacactcaaaagct

SEQ ID NO: 4321512 - DNA, 19 bp, Homo sapiens
acggacactcaaaagctgg

SEQ ID NO: 4321513 - DNA, 18 bp, Homo sapiens
acggcttttacttaaacc

SEQ ID NO: 4321514 - DNA, 20 bp, Homo sapiens
acgggagcattggcccctga

SEQ ID NO: 4321515 - DNA, 19 bp, Homo sapiens
acggttgctaaattataaa

SEQ ID NO: 4321516 - DNA, 21 bp, Homo sapiens
acggttgctaaattataaaat

SEQ ID NO: 4321517 - DNA, 14 bp, Homo sapiens
acggtttctccccg

SEQ ID NO: 4321518 - DNA, 13 bp, Homo sapiens
acgtacatacaca

SEQ ID NO: 4321519 - DNA, 21 bp, Homo sapiens
acgtacatacacacatacata

SEQ ID NO: 4321520 - DNA, 21 bp, Homo sapiens
acgtgaaatgctcaagaatgt

SEQ ID NO: 4321521 - DNA, 11 bp, Homo sapiens
acgtgcattta

SEQ ID NO: 4321522 - DNA, 13 bp, Homo sapiens
acgtggccaggag

SEQ ID NO: 4321523 - DNA, 19 bp, Homo sapiens
acgttgacccctttccccc

SEQ ID NO: 4321524 - DNA, 12 bp, Homo sapiens
acgttgttgtca

SEQ ID NO: 4321525 - DNA, 20 bp, Homo sapiens
acgttgttgtcattgtccag

SEQ ID NO: 4321526 - DNA, 22 bp, Homo sapiens
actaaaagtggcatagagaata

SEQ ID NO: 4321527 - DNA, 20 bp, Homo sapiens
actaaaagttcttctccaat

SEQ ID NO: 4321528 - DNA, 16 bp, Homo sapiens
actaacaaaatttgaa

SEQ ID NO: 4321529 - DNA, 17 bp, Homo sapiens
actaacaaaatttgaat

SEQ ID NO: 4321530 - DNA, 18 bp, Homo sapiens
actaacaaaatttgaata

SEQ ID NO: 4321531 - DNA, 20 bp, Homo sapiens
actaactcatagattgcaaa

SEQ ID NO: 4321532 - DNA, 16 bp, Homo sapiens
actaagagaaaccttg

SEQ ID NO: 4321533 - DNA, 19 bp, Homo sapiens
actaattccttaaatgaac

SEQ ID NO: 4321534 - DNA, 13 bp, Homo sapiens
actaatttattgc

SEQ ID NO: 4321535 - DNA, 17 bp, Homo sapiens
actactcccccaggtgg

SEQ ID NO: 4321536 - DNA, 17 bp, Homo sapiens
actactgacgaaagagt

SEQ ID NO: 4321537 - DNA, 20 bp, Homo sapiens
actactgctattttttttaa

SEQ ID NO: 4321538 - DNA, 12 bp, Homo sapiens
actactgggtgt

SEQ ID NO: 4321539 - DNA, 16 bp, Homo sapiens
actactgggtgtcatt

SEQ ID NO: 4321540 - DNA, 12 bp, Homo sapiens
actagagaatgc

SEQ ID NO: 4321541 - DNA, 23 bp, Homo sapiens
actagcatttagagcttttcaga

SEQ ID NO: 4321542 - DNA, 10 bp, Homo sapiens
actaggaatt

SEQ ID NO: 4321543 - DNA, 11 bp, Homo sapiens
actaggaattc

SEQ ID NO: 4321544 - DNA, 22 bp, Homo sapiens
actagttgtctgaattgagaaa

SEQ ID NO: 4321545 - DNA, 17 bp, Homo sapiens
actattatgaaatcata

SEQ ID NO: 4321546 - DNA, 15 bp, Homo sapiens
actattcagaggaaa

SEQ ID NO: 4321547 - DNA, 22 bp, Homo sapiens
actatttcccttgaaattttaa

SEQ ID NO: 4321548 - DNA, 13 bp, Homo sapiens
actcaaaagctgg

SEQ ID NO: 4321549 - DNA, 18 bp, Homo sapiens
actcaaaagctgggcagg

SEQ ID NO: 4321550 - DNA, 17 bp, Homo sapiens
actcaaacacttattgt

SEQ ID NO: 4321551 - DNA, 16 bp, Homo sapiens
actcaaactcttaaaa

SEQ ID NO: 4321552 - DNA, 17 bp, Homo sapiens
actcaaactcttaaaac

SEQ ID NO: 4321553 - DNA, 23 bp, Homo sapiens
actcaagtgtcacctccttcccc

SEQ ID NO: 4321554 - DNA, 12 bp, Homo sapiens
actcacctctct

SEQ ID NO: 4321555 - DNA, 17 bp, Homo sapiens
actcatgcaaactgctt

SEQ ID NO: 4321556 - DNA, 22 bp, Homo sapiens
actcatgcaaactgctttattt

SEQ ID NO: 4321557 - DNA, 22 bp, Homo sapiens
agaagagttgaggaactgtaca

SEQ ID NO: 4321558 - DNA, 23 bp, Homo sapiens
agaagatcacgctccccgcctgt

SEQ ID NO: 4321559 - DNA, 16 bp, Homo sapiens
agaagcagaggaagga

SEQ ID NO: 4321560 - DNA, 19 bp, Homo sapiens
agaagcgctgttgcccgcc

SEQ ID NO: 4321561 - DNA, 19 bp, Homo sapiens
agaagcgtgagacgccacc

SEQ ID NO: 4321562 - DNA, 21 bp, Homo sapiens
agaaggaactgatacatctga

SEQ ID NO: 4321563 - DNA, 15 bp, Homo sapiens
agaagtataaggtgc

SEQ ID NO: 4321564 - DNA, 11 bp, Homo sapiens
agaagtgccct

SEQ ID NO: 4321565 - DNA, 22 bp, Homo sapiens
agaagtttgagatcagcctggg

SEQ ID NO: 4321566 - DNA, 20 bp, Homo sapiens
agaataaatggtttctcatt

SEQ ID NO: 4321567 - DNA, 13 bp, Homo sapiens
agaataagaattt

SEQ ID NO: 4321568 - DNA, 15 bp, Homo sapiens
agaataattatttca

SEQ ID NO: 4321569 - DNA, 16 bp, Homo sapiens
agaatagcctattgtc

SEQ ID NO: 4321570 - DNA, 18 bp, Homo sapiens
agaataggtgcaaacaaa

SEQ ID NO: 4321571 - DNA, 21 bp, Homo sapiens
agaataggtgcaaacaaacaa

SEQ ID NO: 4321572 - DNA, 17 bp, Homo sapiens
agaatatactgtcttgt

SEQ ID NO: 4321573 - DNA, 11 bp, Homo sapiens
agaatatatat

SEQ ID NO: 4321574 - DNA, 20 bp, Homo sapiens
agaatctgtgcagtcatcaa

SEQ ID NO: 4321575 - DNA, 22 bp, Homo sapiens
agaatgccataaaattgcagtt

SEQ ID NO: 4321576 - DNA, 21 bp, Homo sapiens
agaatgtagccctctccaaat

SEQ ID NO: 4321577 - DNA, 19 bp, Homo sapiens
agaatgtagtcagactgac

SEQ ID NO: 4321578 - DNA, 14 bp, Homo sapiens
agaatgtcttggtg

SEQ ID NO: 4321579 - DNA, 22 bp, Homo sapiens
agaattatccattacgtgcatt

SEQ ID NO: 4321580 - DNA, 15 bp, Homo sapiens
agaattgactgattt

SEQ ID NO: 4321581 - DNA, 23 bp, Homo sapiens
agaattgctgaagggcattcttt

SEQ ID NO: 4321582 - DNA, 16 bp, Homo sapiens
agaatttctggaagaa

SEQ ID NO: 4321583 - DNA, 18 bp, Homo sapiens
agaatttctggaagaaag

SEQ ID NO: 4321584 - DNA, 16 bp, Homo sapiens
agacacgctcttctat

SEQ ID NO: 4321585 - DNA, 22 bp, Homo sapiens
agacacggggcaggaccttcct

SEQ ID NO: 4321586 - DNA, 22 bp, Homo sapiens
agacactaattccttaaatgaa

SEQ ID NO: 4321587 - DNA, 15 bp, Homo sapiens
agacactgttgcaaa

SEQ ID NO: 4321588 - DNA, 16 bp, Homo sapiens
agacactttacctctt

SEQ ID NO: 4321589 - DNA, 13 bp, Homo sapiens
agacagggagaag

SEQ ID NO: 4321590 - DNA, 13 bp, Homo sapiens
agacatctgcctg

SEQ ID NO: 4321591 - DNA, 13 bp, Homo sapiens
agaccaccttccc

SEQ ID NO: 4321592 - DNA, 14 bp, Homo sapiens
agaccaccttccct

SEQ ID NO: 4321593 - DNA, 23 bp, Homo sapiens
agaccaccttcccttcctcagca

SEQ ID NO: 4321594 - DNA, 19 bp, Homo sapiens
agaccaggagggagagcct

SEQ ID NO: 4321595 - DNA, 23 bp, Homo sapiens
agaccaggagggagagcctctgt

SEQ ID NO: 4321596 - DNA, 15 bp, Homo sapiens
agacccacagccctg

SEQ ID NO: 4321597 - DNA, 17 bp, Homo sapiens
agacccacagccctgaa

SEQ ID NO: 4321598 - DNA, 19 bp, Homo sapiens
agacccacagccctgaaac

SEQ ID NO: 4321599 - DNA, 14 bp, Homo sapiens
agaccgctctcttt

SEQ ID NO: 4321600 - DNA, 15 bp, Homo sapiens
agacctctccttcct

SEQ ID NO: 4321601 - DNA, 18 bp, Homo sapiens
agaccttctccctagccc

SEQ ID NO: 4321602 - DNA, 20 bp, Homo sapiens
agaccttctccctagccctt

SEQ ID NO: 4321603 - DNA, 13 bp, Homo sapiens
agacctttatcca

SEQ ID NO: 4321604 - DNA, 15 bp, Homo sapiens
agacgccaccattcc

SEQ ID NO: 4321605 - DNA, 20 bp, Homo sapiens
agacgccaccattcctggaa

SEQ ID NO: 4321606 - DNA, 17 bp, Homo sapiens
agacgtaggggaggggt

SEQ ID NO: 4321607 - DNA, 18 bp, Homo sapiens
agactattatgaaatcat

SEQ ID NO: 4321608 - DNA, 21 bp, Homo sapiens
agactcctcttcccagagtca

SEQ ID NO: 4321609 - DNA, 16 bp, Homo sapiens
agactctcagcccaga

SEQ ID NO: 4321610 - DNA, 17 bp, Homo sapiens
agactctcagcccagaa

SEQ ID NO: 4321611 - DNA, 18 bp, Homo sapiens
agactctcagcccagaag

SEQ ID NO: 4321612 - DNA, 16 bp, Homo sapiens
agactgggcacccctg

SEQ ID NO: 4321613 - DNA, 17 bp, Homo sapiens
agactgggcacccctgc

SEQ ID NO: 4321614 - DNA, 21 bp, Homo sapiens
agactgggcacccctgcctcc

SEQ ID NO: 4321615 - DNA, 23 bp, Homo sapiens
agactgggcacccctgcctcctg

SEQ ID NO: 4321616 - DNA, 16 bp, Homo sapiens
agactgtggaaccaaa

SEQ ID NO: 4321617 - DNA, 19 bp, Homo sapiens
agacttacctgaataatta

SEQ ID NO: 4321618 - DNA, 15 bp, Homo sapiens
agactttgctgcatt

SEQ ID NO: 4321619 - DNA, 22 bp, Homo sapiens
agactttgctgcattttacaca

SEQ ID NO: 4321620 - DNA, 16 bp, Homo sapiens
agactttgctgttact

SEQ ID NO: 4321621 - DNA, 13 bp, Homo sapiens
agagaatacacat

SEQ ID NO: 4321622 - DNA, 17 bp, Homo sapiens
agagaatacacatataa

SEQ ID NO: 4321623 - DNA, 14 bp, Homo sapiens
agagactaatgttg

SEQ ID NO: 4321624 - DNA, 15 bp, Homo sapiens
agagaggagaaaggg

SEQ ID NO: 4321625 - DNA, 13 bp, Homo sapiens
agagatgtgcaga

SEQ ID NO: 4321626 - DNA, 16 bp, Homo sapiens
agagcatctctgcctc

SEQ ID NO: 4321627 - DNA, 14 bp, Homo sapiens
agagcccgggagag

SEQ ID NO: 4321628 - DNA, 23 bp, Homo sapiens
agagccctattggcttactgaaa

SEQ ID NO: 4321629 - DNA, 11 bp, Homo sapiens
agagccctgtc

SEQ ID NO: 4321630 - DNA, 23 bp, Homo sapiens
agagcctctgttttgtaaactaa

SEQ ID NO: 4321631 - DNA, 13 bp, Homo sapiens
agagcgtttggtt

SEQ ID NO: 4321632 - DNA, 13 bp, Homo sapiens
agagctagaaagt

SEQ ID NO: 4321633 - DNA, 20 bp, Homo sapiens
agagctagcagcagggaggg

SEQ ID NO: 4321634 - DNA, 18 bp, Homo sapiens
agagcttttcagaacatc

SEQ ID NO: 4321635 - DNA, 17 bp, Homo sapiens
agaggaaaaacagagga

SEQ ID NO: 4321636 - DNA, 18 bp, Homo sapiens
agaggaagttagagataa

SEQ ID NO: 4321637 - DNA, 13 bp, Homo sapiens
agaggagaggggc

SEQ ID NO: 4321638 - DNA, 14 bp, Homo sapiens
agaggaggcagaaa

SEQ ID NO: 4321639 - DNA, 15 bp, Homo sapiens
agaggaggcagaaag

SEQ ID NO: 4321640 - DNA, 17 bp, Homo sapiens
agaggaggcagaaagat

SEQ ID NO: 4321641 - DNA, 17 bp, Homo sapiens
agaggatctaggatggg

SEQ ID NO: 4321642 - DNA, 13 bp, Homo sapiens
agaggccgctgcc

SEQ ID NO: 4321643 - DNA, 18 bp, Homo sapiens
agaggcctcggctgtctc

SEQ ID NO: 4321644 - DNA, 19 bp, Homo sapiens
agaggcctcggctgtctcc

SEQ ID NO: 4321645 - DNA, 22 bp, Homo sapiens
agaggcctcggctgtctcctgt

SEQ ID NO: 4321646 - DNA, 18 bp, Homo sapiens
atgctgagtctcccaagg

SEQ ID NO: 4321647 - DNA, 13 bp, Homo sapiens
atgctgtatttct

SEQ ID NO: 4321648 - DNA, 21 bp, Homo sapiens
atgctgtatttctttgtagaa

SEQ ID NO: 4321649 - DNA, 22 bp, Homo sapiens
atgctgtatttctttgtagaat

SEQ ID NO: 4321650 - DNA, 12 bp, Homo sapiens
atgcttccagaa

SEQ ID NO: 4321651 - DNA, 19 bp, Homo sapiens
atgcttctactgtgacact

SEQ ID NO: 4321652 - DNA, 13 bp, Homo sapiens
atgcttctcactg

SEQ ID NO: 4321653 - DNA, 20 bp, Homo sapiens
atgcttctcactgccatgcc

SEQ ID NO: 4321654 - DNA, 19 bp, Homo sapiens
atgcttctcatcttgtgaa

SEQ ID NO: 4321655 - DNA, 15 bp, Homo sapiens
atgcttcttccttac

SEQ ID NO: 4321656 - DNA, 20 bp, Homo sapiens
atgctttgagaccagaagaa

SEQ ID NO: 4321657 - DNA, 21 bp, Homo sapiens
atggaatgattggttaaaatg

SEQ ID NO: 4321658 - DNA, 15 bp, Homo sapiens
atggacgctgccggg

SEQ ID NO: 4321659 - DNA, 13 bp, Homo sapiens
atggagaaaatga

SEQ ID NO: 4321660 - DNA, 22 bp, Homo sapiens
atggagaaatgaagcagaggaa

SEQ ID NO: 4321661 - DNA, 23 bp, Homo sapiens
atggagaaatgaagcagaggaag

SEQ ID NO: 4321662 - DNA, 14 bp, Homo sapiens
atggagactctgag

SEQ ID NO: 4321663 - DNA, 14 bp, Homo sapiens
atggagaggaagaa

SEQ ID NO: 4321664 - DNA, 20 bp, Homo sapiens
atggagcaaaacaaagctga

SEQ ID NO: 4321665 - DNA, 15 bp, Homo sapiens
atggagcaaatgtcc

SEQ ID NO: 4321666 - DNA, 19 bp, Homo sapiens
atggagcccagttggaaaa

SEQ ID NO: 4321667 - DNA, 13 bp, Homo sapiens
atggatagaaaaa

SEQ ID NO: 4321668 - DNA, 15 bp, Homo sapiens
atggatagaaaaaaa

SEQ ID NO: 4321669 - DNA, 18 bp, Homo sapiens
atggatttccagccaaag

SEQ ID NO: 4321670 - DNA, 14 bp, Homo sapiens
atggcatggagact

SEQ ID NO: 4321671 - DNA, 20 bp, Homo sapiens
atggccaaaagtcagagtta

SEQ ID NO: 4321672 - DNA, 16 bp, Homo sapiens
atggccagactccctt

SEQ ID NO: 4321673 - DNA, 12 bp, Homo sapiens
atggctgctttg

SEQ ID NO: 4321674 - DNA, 13 bp, Homo sapiens
atgggaaataaag

SEQ ID NO: 4321675 - DNA, 15 bp, Homo sapiens
atgggaaataaagaa

SEQ ID NO: 4321676 - DNA, 18 bp, Homo sapiens
atgggcacaatcttggtc

SEQ ID NO: 4321677 - DNA, 14 bp, Homo sapiens
atgggcatgaatgg

SEQ ID NO: 4321678 - DNA, 13 bp, Homo sapiens
atgggccaccgcc

SEQ ID NO: 4321679 - DNA, 20 bp, Homo sapiens
atgggctatcagggaggaag

SEQ ID NO: 4321680 - DNA, 14 bp, Homo sapiens
atgggggcaagaag

SEQ ID NO: 4321681 - DNA, 15 bp, Homo sapiens
atgggggcaagaaga

SEQ ID NO: 4321682 - DNA, 14 bp, Homo sapiens
atggtacccccttc

SEQ ID NO: 4321683 - DNA, 18 bp, Homo sapiens
atggtagggtataatgtg

SEQ ID NO: 4321684 - DNA, 23 bp, Homo sapiens
atggttggtaacacaaattttca

SEQ ID NO: 4321685 - DNA, 19 bp, Homo sapiens
atgtaacctatttatcgca

SEQ ID NO: 4321686 - DNA, 22 bp, Homo sapiens
atgtaatgaagtaaagccatta

SEQ ID NO: 4321687 - DNA, 16 bp, Homo sapiens
atgtacatctctccct

SEQ ID NO: 4321688 - DNA, 15 bp, Homo sapiens
atgtacgataaagta

SEQ ID NO: 4321689 - DNA, 12 bp, Homo sapiens
atgtacttaaat

SEQ ID NO: 4321690 - DNA, 18 bp, Homo sapiens
atgtagactctgacttcc

SEQ ID NO: 4321691 - DNA, 17 bp, Homo sapiens
atgtaggcacttttatt

SEQ ID NO: 4321692 - DNA, 17 bp, Homo sapiens
atgtagtgctctcagtc

SEQ ID NO: 4321693 - DNA, 15 bp, Homo sapiens
atgtatatatattct

SEQ ID NO: 4321694 - DNA, 13 bp, Homo sapiens
atgtatattttca

SEQ ID NO: 4321695 - DNA, 19 bp, Homo sapiens
atgtatgtggtatgtatat

SEQ ID NO: 4321696 - DNA, 21 bp, Homo sapiens
atgtatgtggtatgtatattt

SEQ ID NO: 4321697 - DNA, 13 bp, Homo sapiens
atgtatttatgta

SEQ ID NO: 4321698 - DNA, 22 bp, Homo sapiens
atgtcagactttgctgcatttt

SEQ ID NO: 4321699 - DNA, 14 bp, Homo sapiens
atgtctcttggaaa

SEQ ID NO: 4321700 - DNA, 18 bp, Homo sapiens
atgtctcttggaaatgtt

SEQ ID NO: 4321701 - DNA, 19 bp, Homo sapiens
atgtctcttggaaatgtta

SEQ ID NO: 4321702 - DNA, 23 bp, Homo sapiens
atgtctcttggaaatgttaagaa

SEQ ID NO: 4321703 - DNA, 19 bp, Homo sapiens
atgtctgtcagaagacact

SEQ ID NO: 4321704 - DNA, 17 bp, Homo sapiens
atgtgatcaactgttca

SEQ ID NO: 4321705 - DNA, 14 bp, Homo sapiens
atgtgcagagttga

SEQ ID NO: 4321706 - DNA, 15 bp, Homo sapiens
atgtgcagatatcca

SEQ ID NO: 4321707 - DNA, 12 bp, Homo sapiens
atgtgcccctgc

SEQ ID NO: 4321708 - DNA, 20 bp, Homo sapiens
atgtgcgaagcaagaagaat

SEQ ID NO: 4321709 - DNA, 21 bp, Homo sapiens
atgtgcgaagcaagaagaatt

SEQ ID NO: 4321710 - DNA, 22 bp, Homo sapiens
atgtgcttctcagttgcagaaa

SEQ ID NO: 4321711 - DNA, 23 bp, Homo sapiens
atgtgcttctcagttgcagaaaa

SEQ ID NO: 4321712 - DNA, 23 bp, Homo sapiens
atgtggtcttatgattttattac

SEQ ID NO: 4321713 - DNA, 19 bp, Homo sapiens
atgtgtctgtgttgcttca

SEQ ID NO: 4321714 - DNA, 16 bp, Homo sapiens
atgtgtgtagactgta

SEQ ID NO: 4321715 - DNA, 18 bp, Homo sapiens
atgtgtgtagactgtaac

SEQ ID NO: 4321716 - DNA, 14 bp, Homo sapiens
atgtgttgccaaag

SEQ ID NO: 4321717 - DNA, 15 bp, Homo sapiens
atgttacatctgtct

SEQ ID NO: 4321718 - DNA, 15 bp, Homo sapiens
atgttagagtcattt

SEQ ID NO: 4321719 - DNA, 18 bp, Homo sapiens
atgttagagtcatttctg

SEQ ID NO: 4321720 - DNA, 15 bp, Homo sapiens
atgttccagcttcta

SEQ ID NO: 4321721 - DNA, 18 bp, Homo sapiens
atgttggacagacactgt

SEQ ID NO: 4321722 - DNA, 22 bp, Homo sapiens
atgttggctgcgtactccactg

SEQ ID NO: 4321723 - DNA, 19 bp, Homo sapiens
atgttgtgttgttatcatt

SEQ ID NO: 4321724 - DNA, 15 bp, Homo sapiens
atgtttaatgaagtc

SEQ ID NO: 4321725 - DNA, 21 bp, Homo sapiens
atgtttacagggagcctcctg

SEQ ID NO: 4321726 - DNA, 20 bp, Homo sapiens
atgtttagtgtgctgctgtt

SEQ ID NO: 4321727 - DNA, 19 bp, Homo sapiens
atgtttcctaactgtgatt

SEQ ID NO: 4321728 - DNA, 21 bp, Homo sapiens
atgtttgtctgtgtgctgtaa

SEQ ID NO: 4321729 - DNA, 20 bp, Homo sapiens
atgtttttataaaaataaat

SEQ ID NO: 4321730 - DNA, 21 bp, Homo sapiens
atgtttttataaaaataaata

SEQ ID NO: 4321731 - DNA, 13 bp, Homo sapiens
attaaaaacttta

SEQ ID NO: 4321732 - DNA, 14 bp, Homo sapiens
attaaaaactttaa

SEQ ID NO: 4321733 - DNA, 16 bp, Homo sapiens
attaaataaactgttt

SEQ ID NO: 4321734 - DNA, 22 bp, Homo sapiens
attaaatgaatattttgataat

SEQ ID NO: 4321735 - DNA, 17 bp, Homo sapiens
attaacaaagcaacctt

SEQ ID NO: 4321736 - DNA, 18 bp, Homo sapiens
attaacaagaactcatta

SEQ ID NO: 4321737 - DNA, 18 bp, Homo sapiens
attaaccacttcagctga

SEQ ID NO: 4321738 - DNA, 13 bp, Homo sapiens
attaagaactgaa

SEQ ID NO: 4321739 - DNA, 22 bp, Homo sapiens
attaagtcagtggctttgcata

SEQ ID NO: 4321740 - DNA, 11 bp, Homo sapiens
attaataaagc

SEQ ID NO: 4321741 - DNA, 14 bp, Homo sapiens
attaataaagcatt

SEQ ID NO: 4321742 - DNA, 15 bp, Homo sapiens
attaataaagcattc

SEQ ID NO: 4321743 - DNA, 13 bp, Homo sapiens
attaataactgaa

SEQ ID NO: 4321744 - DNA, 14 bp, Homo sapiens
attaataactgaat

SEQ ID NO: 4321745 - DNA, 17 bp, Homo sapiens
attaataactgaataaa

SEQ ID NO: 4321746 - DNA, 20 bp, Homo sapiens
attaataactgaataaaaaa

SEQ ID NO: 4321747 - DNA, 19 bp, Homo sapiens
attaatatcctgtaataaa

SEQ ID NO: 4321748 - DNA, 16 bp, Homo sapiens
attaccagtctgatta

SEQ ID NO: 4321749 - DNA, 13 bp, Homo sapiens
attacgtgcattt

SEQ ID NO: 4321750 - DNA, 15 bp, Homo sapiens
attacgtgcatttaa

SEQ ID NO: 4321751 - DNA, 22 bp, Homo sapiens
attacgttcttacaagcttaaa

SEQ ID NO: 4321752 - DNA, 20 bp, Homo sapiens
attactcctatttttgtaaa

SEQ ID NO: 4321753 - DNA, 19 bp, Homo sapiens
attactgatttagaagcaa

SEQ ID NO: 4321754 - DNA, 15 bp, Homo sapiens
attacttgtgcactt

SEQ ID NO: 4321755 - DNA, 18 bp, Homo sapiens
attagcttgtctattatt

SEQ ID NO: 4321756 - DNA, 16 bp, Homo sapiens
attaggaattgtttat

SEQ ID NO: 4321757 - DNA, 19 bp, Homo sapiens
attagtaactgttcctact

SEQ ID NO: 4321758 - DNA, 19 bp, Homo sapiens
attagtcgggcatgagtct

SEQ ID NO: 4321759 - DNA, 20 bp, Homo sapiens
attagtcgggcatgagtctg

SEQ ID NO: 4321760 - DNA, 18 bp, Homo sapiens
attataccatgtgtgcta

SEQ ID NO: 4321761 - DNA, 19 bp, Homo sapiens
attataccatgtgtgctaa

SEQ ID NO: 4321762 - DNA, 17 bp, Homo sapiens
attatacgtacatacac

SEQ ID NO: 4321763 - DNA, 13 bp, Homo sapiens
attatccattacg

SEQ ID NO: 4321764 - DNA, 14 bp, Homo sapiens
attttatttaaact

SEQ ID NO: 4321765 - DNA, 17 bp, Homo sapiens
attttatttaaactatt

SEQ ID NO: 4321766 - DNA, 19 bp, Homo sapiens
attttatttaaactattca

SEQ ID NO: 4321767 - DNA, 13 bp, Homo sapiens
attttcattgtga

SEQ ID NO: 4321768 - DNA, 14 bp, Homo sapiens
attttcattgtgat

SEQ ID NO: 4321769 - DNA, 13 bp, Homo sapiens
attttccagcctt

SEQ ID NO: 4321770 - DNA, 19 bp, Homo sapiens
attttccagccttatgtgt

SEQ ID NO: 4321771 - DNA, 19 bp, Homo sapiens
attttccctattagagaag

SEQ ID NO: 4321772 - DNA, 15 bp, Homo sapiens
attttcttttattat

SEQ ID NO: 4321773 - DNA, 16 bp, Homo sapiens
attttgataataatat

SEQ ID NO: 4321774 - DNA, 22 bp, Homo sapiens
attttggaagaagttttttact

SEQ ID NO: 4321775 - DNA, 22 bp, Homo sapiens
attttgtttttgtcttaaaaag

SEQ ID NO: 4321776 - DNA, 20 bp, Homo sapiens
atttttaacctcaaaatggt

SEQ ID NO: 4321777 - DNA, 22 bp, Homo sapiens
atttttggtggtggtgggtttg

SEQ ID NO: 4321778 - DNA, 12 bp, Homo sapiens
attttttaataa

SEQ ID NO: 4321779 - DNA, 14 bp, Homo sapiens
attttttaataaaa

SEQ ID NO: 4321780 - DNA, 17 bp, Homo sapiens
attttttttaaatcaaa

SEQ ID NO: 4321781 - DNA, 21 bp, Homo sapiens
attttttttaaatcaaaaact

SEQ ID NO: 4321782 - DNA, 16 bp, Homo sapiens
attttttttttaagtg

SEQ ID NO: 4321783 - DNA, 17 bp, Homo sapiens
caaaaccaccctaacct

SEQ ID NO: 4321784 - DNA, 23 bp, Homo sapiens
caaaagaggcttttgggccaaaa

SEQ ID NO: 4321785 - DNA, 19 bp, Homo sapiens
caaaagctgggcaggttgg

SEQ ID NO: 4321786 - DNA, 19 bp, Homo sapiens
caaaataaagaatagcaat

SEQ ID NO: 4321787 - DNA, 20 bp, Homo sapiens
caaaataatctatattaaat

SEQ ID NO: 4321788 - DNA, 18 bp, Homo sapiens
caaaatagaagaagagga

SEQ ID NO: 4321789 - DNA, 16 bp, Homo sapiens
caaaatctgattagaa

SEQ ID NO: 4321790 - DNA, 17 bp, Homo sapiens
caaaatgtaatgtcaga

SEQ ID NO: 4321791 - DNA, 18 bp, Homo sapiens
caaaatgtacttaaatga

SEQ ID NO: 4321792 - DNA, 20 bp, Homo sapiens
caaaatttcacagttctgta

SEQ ID NO: 4321793 - DNA, 18 bp, Homo sapiens
caaaatttgaataataaa

SEQ ID NO: 4321794 - DNA, 15 bp, Homo sapiens
caaacacttattgtt

SEQ ID NO: 4321795 - DNA, 18 bp, Homo sapiens
caaacatgtatttatgta

SEQ ID NO: 4321796 - DNA, 13 bp, Homo sapiens
caaacccatgaag

SEQ ID NO: 4321797 - DNA, 21 bp, Homo sapiens
caaacccatgaagctggccct

SEQ ID NO: 4321798 - DNA, 22 bp, Homo sapiens
caaacccatgaagctggccctc

SEQ ID NO: 4321799 - DNA, 18 bp, Homo sapiens
caaactgctttattttcc

SEQ ID NO: 4321800 - DNA, 14 bp, Homo sapiens
caaacttttctttc

SEQ ID NO: 4321801 - DNA, 16 bp, Homo sapiens
caaagaaaatgagaat

SEQ ID NO: 4321802 - DNA, 16 bp, Homo sapiens
caaagacacacaggag

SEQ ID NO: 4321803 - DNA, 14 bp, Homo sapiens
caaagagaccaggg

SEQ ID NO: 4321804 - DNA, 15 bp, Homo sapiens
caaagagaccagggg

SEQ ID NO: 4321805 - DNA, 17 bp, Homo sapiens
caaagcctcctccagcc

SEQ ID NO: 4321806 - DNA, 18 bp, Homo sapiens
caaagcctcctccagccg

SEQ ID NO: 4321807 - DNA, 15 bp, Homo sapiens
caaagctgatttccc

SEQ ID NO: 4321808 - DNA, 21 bp, Homo sapiens
caaaggaaaaagcacaagaag

SEQ ID NO: 4321809 - DNA, 22 bp, Homo sapiens
caaaggaaaaagcacaagaagc

SEQ ID NO: 4321810 - DNA, 20 bp, Homo sapiens
caaagtacaatgtgtttttc

SEQ ID NO: 4321811 - DNA, 12 bp, Homo sapiens
caaataaagcct

SEQ ID NO: 4321812 - DNA, 15 bp, Homo sapiens
caaataaagcctttt

SEQ ID NO: 4321813 - DNA, 22 bp, Homo sapiens
caaataaagccttttaaatcat

SEQ ID NO: 4321814 - DNA, 14 bp, Homo sapiens
caaatatatgtata

SEQ ID NO: 4321815 - DNA, 19 bp, Homo sapiens
caaatatatgtatatatat

SEQ ID NO: 4321816 - DNA, 15 bp, Homo sapiens
caaatcactgcattc

SEQ ID NO: 4321817 - DNA, 22 bp, Homo sapiens
caaatgaatgttgtctgtttgt

SEQ ID NO: 4321818 - DNA, 18 bp, Homo sapiens
caaatgatacagtcagga

SEQ ID NO: 4321819 - DNA, 14 bp, Homo sapiens
caaatggctgcttt

SEQ ID NO: 4321820 - DNA, 21 bp, Homo sapiens
caaatgtcctaacagagaaat

SEQ ID NO: 4321821 - DNA, 21 bp, Homo sapiens
caaatgtgggtgaagtgcctg

SEQ ID NO: 4321822 - DNA, 17 bp, Homo sapiens
caaatgtttacagggag

SEQ ID NO: 4321823 - DNA, 18 bp, Homo sapiens
caaatgtttacagggagc

SEQ ID NO: 4321824 - DNA, 13 bp, Homo sapiens
caaattatttatt

SEQ ID NO: 4321825 - DNA, 15 bp, Homo sapiens
caaattctcaccaaa

SEQ ID NO: 4321826 - DNA, 18 bp, Homo sapiens
caaattgtgcttctcccc

SEQ ID NO: 4321827 - DNA, 12 bp, Homo sapiens
caaattgtttac

SEQ ID NO: 4321828 - DNA, 13 bp, Homo sapiens
caaattttttaat

SEQ ID NO: 4321829 - DNA, 19 bp, Homo sapiens
caacaaaagggagaacatg

SEQ ID NO: 4321830 - DNA, 13 bp, Homo sapiens
caacaccagcccc

SEQ ID NO: 4321831 - DNA, 18 bp, Homo sapiens
caacaccagcccctgccc

SEQ ID NO: 4321832 - DNA, 22 bp, Homo sapiens
caacaccagcccctgccccagc

SEQ ID NO: 4321833 - DNA, 18 bp, Homo sapiens
caacagctcgatccaaat

SEQ ID NO: 4321834 - DNA, 15 bp, Homo sapiens
caacaggtaaacaca

SEQ ID NO: 4321835 - DNA, 20 bp, Homo sapiens
caacatcagctttctaatgt

SEQ ID NO: 4321836 - DNA, 17 bp, Homo sapiens
caacatcttacttgtcc

SEQ ID NO: 4321837 - DNA, 20 bp, Homo sapiens
caacatgtagctgagtttaa

SEQ ID NO: 4321838 - DNA, 15 bp, Homo sapiens
caaccccagccgctc

SEQ ID NO: 4321839 - DNA, 22 bp, Homo sapiens
caactaaaagtggcatagagaa

SEQ ID NO: 4321840 - DNA, 14 bp, Homo sapiens
caactaggggagga

SEQ ID NO: 4321841 - DNA, 16 bp, Homo sapiens
caactaggggaggaga

SEQ ID NO: 4321842 - DNA, 18 bp, Homo sapiens
caactaggggaggagaga

SEQ ID NO: 4321843 - DNA, 19 bp, Homo sapiens
caactcaagtgtcacctcc

SEQ ID NO: 4321844 - DNA, 17 bp, Homo sapiens
caactcttccacctctg

SEQ ID NO: 4321845 - DNA, 19 bp, Homo sapiens
caactcttccacctctggg

SEQ ID NO: 4321846 - DNA, 23 bp, Homo sapiens
caactcttccacctctggggaag

SEQ ID NO: 4321847 - DNA, 19 bp, Homo sapiens
caacttcctccttcactct

SEQ ID NO: 4321848 - DNA, 18 bp, Homo sapiens
caacttgccaaaatgttg

SEQ ID NO: 4321849 - DNA, 21 bp, Homo sapiens
caacttgccaaaatgttggct

SEQ ID NO: 4321850 - DNA, 12 bp, Homo sapiens
caactttgcaaa

SEQ ID NO: 4321851 - DNA, 17 bp, Homo sapiens
caagaacattatcttag

SEQ ID NO: 4321852 - DNA, 15 bp, Homo sapiens
caagaactcattatt

SEQ ID NO: 4321853 - DNA, 19 bp, Homo sapiens
caagaagaattgactgatt

SEQ ID NO: 4321854 - DNA, 21 bp, Homo sapiens
caagaagatcacgctccccgc

SEQ ID NO: 4321855 - DNA, 20 bp, Homo sapiens
caagagcaggaggtgcctga

SEQ ID NO: 4321856 - DNA, 12 bp, Homo sapiens
caagagggacag

SEQ ID NO: 4321857 - DNA, 13 bp, Homo sapiens
caagagggacaga

SEQ ID NO: 4321858 - DNA, 15 bp, Homo sapiens
caagagggacagagc

SEQ ID NO: 4321859 - DNA, 17 bp, Homo sapiens
caagagggacagagccc

SEQ ID NO: 4321860 - DNA, 18 bp, Homo sapiens
caagagggacagagcccg

SEQ ID NO: 4321861 - DNA, 22 bp, Homo sapiens
caagagggacagagcccgggag

SEQ ID NO: 4321862 - DNA, 17 bp, Homo sapiens
caagagggactgtattt

SEQ ID NO: 4321863 - DNA, 20 bp, Homo sapiens
caagatggagaggaagaaac

SEQ ID NO: 4321864 - DNA, 15 bp, Homo sapiens
caagcattactttaa

SEQ ID NO: 4321865 - DNA, 18 bp, Homo sapiens
caagcattactttaacct

SEQ ID NO: 4321866 - DNA, 22 bp, Homo sapiens
caagcattactttaacctccct

SEQ ID NO: 4321867 - DNA, 14 bp, Homo sapiens
caagcatttttcca

SEQ ID NO: 4321868 - DNA, 23 bp, Homo sapiens
caagccactagcccactccccag

SEQ ID NO: 4321869 - DNA, 17 bp, Homo sapiens
caagccttactcacctc

SEQ ID NO: 4321870 - DNA, 18 bp, Homo sapiens
caagccttactcacctct

SEQ ID NO: 4321871 - DNA, 19 bp, Homo sapiens
caagccttactcacctctc

SEQ ID NO: 4321872 - DNA, 18 bp, Homo sapiens
caagctagactgtgtctg

SEQ ID NO: 4321873 - DNA, 14 bp, Homo sapiens
caagctaggaaaga

SEQ ID NO: 4321874 - DNA, 16 bp, Homo sapiens
caagctaggaaagagg

SEQ ID NO: 4321875 - DNA, 14 bp, Homo sapiens
caagctgcaccctc

SEQ ID NO: 4321876 - DNA, 20 bp, Homo sapiens
caaggaaattaagaactgaa

SEQ ID NO: 4321877 - DNA, 21 bp, Homo sapiens
caaggaaattaagaactgaat

SEQ ID NO: 4321878 - DNA, 18 bp, Homo sapiens
caaggaggtggtgaattt

SEQ ID NO: 4321879 - DNA, 19 bp, Homo sapiens
caaggaggtggtgaatttt

SEQ ID NO: 4321880 - DNA, 15 bp, Homo sapiens
caaggccagaaaaag

SEQ ID NO: 4321881 - DNA, 19 bp, Homo sapiens
caaggccagaaaaagaaga

SEQ ID NO: 4321882 - DNA, 11 bp, Homo sapiens
cagctgggacc

SEQ ID NO: 4321883 - DNA, 15 bp, Homo sapiens
cagctggtatattgt

SEQ ID NO: 4321884 - DNA, 16 bp, Homo sapiens
cagctgttcagctggt

SEQ ID NO: 4321885 - DNA, 18 bp, Homo sapiens
cagcttcctgtctgttta

SEQ ID NO: 4321886 - DNA, 21 bp, Homo sapiens
cagcttcctgtctgtttatat

SEQ ID NO: 4321887 - DNA, 23 bp, Homo sapiens
cagctttgcccaacaccagcccc

SEQ ID NO: 4321888 - DNA, 22 bp, Homo sapiens
cagctttgtttgttgtcagctg

SEQ ID NO: 4321889 - DNA, 24 bp, Homo sapiens
caggaatcctacgctatgtagaat

SEQ ID NO: 4321890 - DNA, 16 bp, Homo sapiens
caggacctcaggtgag

SEQ ID NO: 4321891 - DNA, 23 bp, Homo sapiens
caggacctcaggtgagaagcaga

SEQ ID NO: 4321892 - DNA, 22 bp, Homo sapiens
caggacttctctttatgtcaat

SEQ ID NO: 4321893 - DNA, 24 bp, Homo sapiens
caggagccctactgaagggaacag

SEQ ID NO: 4321894 - DNA, 12 bp, Homo sapiens
caggagccctgg

SEQ ID NO: 4321895 - DNA, 16 bp, Homo sapiens
caggaggcgaataaat

SEQ ID NO: 4321896 - DNA, 12 bp, Homo sapiens
caggagggagag

SEQ ID NO: 4321897 - DNA, 18 bp, Homo sapiens
caggagggagagcctctg

SEQ ID NO: 4321898 - DNA, 22 bp, Homo sapiens
aaaaaactgctgactgttttct

SEQ ID NO: 4321899 - DNA, 22 bp, Homo sapiens
aaaaaatttgagaaagccttca

SEQ ID NO: 4321900 - DNA, 15 bp, Homo sapiens
aaaaagaccttctcc

SEQ ID NO: 4321901 - DNA, 23 bp, Homo sapiens
aaaaagccctatgtgaaaagatc

SEQ ID NO: 4321902 - DNA, 18 bp, Homo sapiens
aaaaaggaaaaatgtaga

SEQ ID NO: 4321903 - DNA, 12 bp, Homo sapiens
aaaaaggcagga

SEQ ID NO: 4321904 - DNA, 15 bp, Homo sapiens
aaaaagtgtacatga

SEQ ID NO: 4321905 - DNA, 14 bp, Homo sapiens
aaaaataactattt

SEQ ID NO: 4321906 - DNA, 16 bp, Homo sapiens
aaaaatattcaagtaa

SEQ ID NO: 4321907 - DNA, 19 bp, Homo sapiens
aaaaatattcaagtaacac

SEQ ID NO: 4321908 - DNA, 22 bp, Homo sapiens
aaaaatattcaagtaacacttt

SEQ ID NO: 4321909 - DNA, 17 bp, Homo sapiens
aaaaatcacccagttgt

SEQ ID NO: 4321910 - DNA, 22 bp, Homo sapiens
aaaaatgcccatttttgctaat

SEQ ID NO: 4321911 - DNA, 13 bp, Homo sapiens
aaaacaatatatt

SEQ ID NO: 4321912 - DNA, 14 bp, Homo sapiens
aaaacaatatattt

SEQ ID NO: 4321913 - DNA, 15 bp, Homo sapiens
aaaacaatatatttg

SEQ ID NO: 4321914 - DNA, 21 bp, Homo sapiens
aaaaccacccacaaagaaaca

SEQ ID NO: 4321915 - DNA, 22 bp, Homo sapiens
aaaactctccttttccttacca

SEQ ID NO: 4321916 - DNA, 17 bp, Homo sapiens
aaaactgacatcagatt

SEQ ID NO: 4321917 - DNA, 22 bp, Homo sapiens
aaaactgacatcagatttctta

SEQ ID NO: 4321918 - DNA, 17 bp, Homo sapiens
aaaactgctttgtgcat

SEQ ID NO: 4321919 - DNA, 18 bp, Homo sapiens
aaaactgctttgtgcata

SEQ ID NO: 4321920 - DNA, 20 bp, Homo sapiens
aaaacttttcatttcagatt

SEQ ID NO: 4321921 - DNA, 13 bp, Homo sapiens
aaaagaaatgaaa

SEQ ID NO: 4321922 - DNA, 23 bp, Homo sapiens
aaaagactattttctattttccc

SEQ ID NO: 4321923 - DNA, 19 bp, Homo sapiens
aaaagagatctgggcatta

SEQ ID NO: 4321924 - DNA, 14 bp, Homo sapiens
aaaagcacaagaag

SEQ ID NO: 4321925 - DNA, 16 bp, Homo sapiens
aaaagtactgaagacc

SEQ ID NO: 4321926 - DNA, 19 bp, Homo sapiens
aaaagtcagagttaaaata

SEQ ID NO: 4321927 - DNA, 16 bp, Homo sapiens
aaaagtcgttttccaa

SEQ ID NO: 4321928 - DNA, 19 bp, Homo sapiens
aaaagtcgttttccaaact

SEQ ID NO: 4321929 - DNA, 22 bp, Homo sapiens
aaaagttatataaaggcaagga

SEQ ID NO: 4321930 - DNA, 20 bp, Homo sapiens
aaaataaagaatagcaatta

SEQ ID NO: 4321931 - DNA, 20 bp, Homo sapiens
aaaataactattttgtttta

SEQ ID NO: 4321932 - DNA, 20 bp, Homo sapiens
aaaatacattcttaaactag

SEQ ID NO: 4321933 - DNA, 19 bp, Homo sapiens
aaaatacttaaatatttgt

SEQ ID NO: 4321934 - DNA, 18 bp, Homo sapiens
aaaatagaagaagaggaa

SEQ ID NO: 4321935 - DNA, 21 bp, Homo sapiens
aaaatcagcctgctccagctg

SEQ ID NO: 4321936 - DNA, 15 bp, Homo sapiens
aaaatcatattgaga

SEQ ID NO: 4321937 - DNA, 22 bp, Homo sapiens
aaaatcccttacctcggtgcct

SEQ ID NO: 4321938 - DNA, 23 bp, Homo sapiens
aaaatggatagaaaaaaactaaa

SEQ ID NO: 4321939 - DNA, 13 bp, Homo sapiens
aaaatgtattttt

SEQ ID NO: 4321940 - DNA, 15 bp, Homo sapiens
aaaatgttgctctgg

SEQ ID NO: 4321941 - DNA, 15 bp, Homo sapiens
aaaattagccaagtg

SEQ ID NO: 4321942 - DNA, 13 bp, Homo sapiens
aaaattatgaaat

SEQ ID NO: 4321943 - DNA, 16 bp, Homo sapiens
aaaattcccaaatatt

SEQ ID NO: 4321944 - DNA, 19 bp, Homo sapiens
aaaattgcagtttcatgta

SEQ ID NO: 4321945 - DNA, 14 bp, Homo sapiens
aaaatttatttcat

SEQ ID NO: 4321946 - DNA, 17 bp, Homo sapiens
aaacaatatatttgtca

SEQ ID NO: 4321947 - DNA, 16 bp, Homo sapiens
aaacacataaatgaaa

SEQ ID NO: 4321948 - DNA, 23 bp, Homo sapiens
aaacactaacaaaatttgaataa

SEQ ID NO: 4321949 - DNA, 15 bp, Homo sapiens
aaacacttattgttt

SEQ ID NO: 4321950 - DNA, 14 bp, Homo sapiens
aaacagaggatgct

SEQ ID NO: 4321951 - DNA, 20 bp, Homo sapiens
aaacatgtgcagatatccaa

SEQ ID NO: 4321952 - DNA, 16 bp, Homo sapiens
aaacatgtgcccctgc

SEQ ID NO: 4321953 - DNA, 18 bp, Homo sapiens
aaaccacccacaaagaaa

SEQ ID NO: 4321954 - DNA, 20 bp, Homo sapiens
aaaccacccacaaagaaaca

SEQ ID NO: 4321955 - DNA, 12 bp, Homo sapiens
aaaccagttacc

SEQ ID NO: 4321956 - DNA, 17 bp, Homo sapiens
aaaccccatctctacaa

SEQ ID NO: 4321957 - DNA, 16 bp, Homo sapiens
aaacccccttttccct

SEQ ID NO: 4321958 - DNA, 15 bp, Homo sapiens
aaaccgccaaggctg

SEQ ID NO: 4321959 - DNA, 21 bp, Homo sapiens
aaaccttgcaaactctataaa

SEQ ID NO: 4321960 - DNA, 15 bp, Homo sapiens
aaaccttgtgactca

SEQ ID NO: 4321961 - DNA, 23 bp, Homo sapiens
aaaccttgtgactcagtgtattt

SEQ ID NO: 4321962 - DNA, 16 bp, Homo sapiens
aaacgagaagtgccct

SEQ ID NO: 4321963 - DNA, 15 bp, Homo sapiens
aaacgggctcagcaa

SEQ ID NO: 4321964 - DNA, 12 bp, Homo sapiens
aaatgttaagaa

SEQ ID NO: 4321965 - DNA, 15 bp, Homo sapiens
aaatgttcaaactgt

SEQ ID NO: 4321966 - DNA, 16 bp, Homo sapiens
aaattaaataaactgt

SEQ ID NO: 4321967 - DNA, 14 bp, Homo sapiens
aaattattggtata

SEQ ID NO: 4321968 - DNA, 23 bp, Homo sapiens
aaattatttattacttgtgcact

SEQ ID NO: 4321969 - DNA, 19 bp, Homo sapiens
aaattccgattagaccttt

SEQ ID NO: 4321970 - DNA, 20 bp, Homo sapiens
aaattctctcaagacttctc

SEQ ID NO: 4321971 - DNA, 12 bp, Homo sapiens
aaattgaaaaca

SEQ ID NO: 4321972 - DNA, 22 bp, Homo sapiens
aaattgcagtttcatgtatgta

SEQ ID NO: 4321973 - DNA, 23 bp, Homo sapiens
aaattttaaggccacggccttgt

SEQ ID NO: 4321974 - DNA, 15 bp, Homo sapiens
aaattttagatatta

SEQ ID NO: 4321975 - DNA, 20 bp, Homo sapiens
aacaaaatgtaatgtcagac

SEQ ID NO: 4321976 - DNA, 22 bp, Homo sapiens
aacaaggtatacctcagttcca

SEQ ID NO: 4321977 - DNA, 15 bp, Homo sapiens
aacaatgatgccctg

SEQ ID NO: 4321978 - DNA, 22 bp, Homo sapiens
aacaatgattttcttgaatggg

SEQ ID NO: 4321979 - DNA, 19 bp, Homo sapiens
aacaatttgcataatacta

SEQ ID NO: 4321980 - DNA, 19 bp, Homo sapiens
aacacaaacgggctcagca

SEQ ID NO: 4321981 - DNA, 17 bp, Homo sapiens
aacacataaatgaaaga

SEQ ID NO: 4321982 - DNA, 15 bp, Homo sapiens
aacaccagcccctgc

SEQ ID NO: 4321983 - DNA, 18 bp, Homo sapiens
aacaccagcccctgcccc

SEQ ID NO: 4321984 - DNA, 22 bp, Homo sapiens
aacaccagcccctgccccagcc

SEQ ID NO: 4321985 - DNA, 20 bp, Homo sapiens
aacactaacaaaatttgaat

SEQ ID NO: 4321986 - DNA, 13 bp, Homo sapiens
aacagaattttaa

SEQ ID NO: 4321987 - DNA, 19 bp, Homo sapiens
aacagacaccatcttttgt

SEQ ID NO: 4321988 - DNA, 15 bp, Homo sapiens
aacagacactacatt

SEQ ID NO: 4321989 - DNA, 13 bp, Homo sapiens
aacagaggatgct

SEQ ID NO: 4321990 - DNA, 17 bp, Homo sapiens
aacagcaggatgccctg

SEQ ID NO: 4321991 - DNA, 15 bp, Homo sapiens
aacaggtaaacacat

SEQ ID NO: 4321992 - DNA, 16 bp, Homo sapiens
aacaggtaaacacata

SEQ ID NO: 4321993 - DNA, 16 bp, Homo sapiens
aacagtgcaagatttt

SEQ ID NO: 4321994 - DNA, 16 bp, Homo sapiens
aacagttagctggagc

SEQ ID NO: 4321995 - DNA, 23 bp, Homo sapiens
aacatacacaaggccagaaaaag

SEQ ID NO: 4321996 - DNA, 13 bp, Homo sapiens
aacatagaaagac

SEQ ID NO: 4321997 - DNA, 15 bp, Homo sapiens
aacatagaaagacat

SEQ ID NO: 4321998 - DNA, 17 bp, Homo sapiens
aacatcagctttctaat

SEQ ID NO: 4321999 - DNA, 20 bp, Homo sapiens
aacatcagctttctaatgtt

SEQ ID NO: 4322000 - DNA, 12 bp, Homo sapiens
aacatgaatctc

SEQ ID NO: 4322001 - DNA, 20 bp, Homo sapiens
aacatgaatttttatgattt

SEQ ID NO: 4322002 - DNA, 12 bp, Homo sapiens
aacatggccaat

SEQ ID NO: 4322003 - DNA, 17 bp, Homo sapiens
aacatggccagactccc

SEQ ID NO: 4322004 - DNA, 16 bp, Homo sapiens
aacatgtatttatgta

SEQ ID NO: 4322005 - DNA, 14 bp, Homo sapiens
aacatgtgcccctg

SEQ ID NO: 4322006 - DNA, 13 bp, Homo sapiens
aacattaggaatt

SEQ ID NO: 4322007 - DNA, 20 bp, Homo sapiens
aacattaggaattgtttata

SEQ ID NO: 4322008 - DNA, 22 bp, Homo sapiens
aaccaaagcaattaaatgatat

SEQ ID NO: 4322009 - DNA, 17 bp, Homo sapiens
aaccaaagctggcccag

SEQ ID NO: 4322010 - DNA, 14 bp, Homo sapiens
aaccaatagaaagc

SEQ ID NO: 4322011 - DNA, 21 bp, Homo sapiens
aaccatgtatgtggtatgtat

SEQ ID NO: 4322012 - DNA, 18 bp, Homo sapiens
aaccattgtcttgttctg

SEQ ID NO: 4322013 - DNA, 19 bp, Homo sapiens
aaccattgtcttgttctgt

SEQ ID NO: 4322014 - DNA, 23 bp, Homo sapiens
aacccacagaaggggatgggaaa

SEQ ID NO: 4322015 - DNA, 21 bp, Homo sapiens
aacccagcagttctctgccaa

SEQ ID NO: 4322016 - DNA, 14 bp, Homo sapiens
aacccatgaagctg

SEQ ID NO: 4322017 - DNA, 14 bp, Homo sapiens
aacccggtgcatct

SEQ ID NO: 4322018 - DNA, 19 bp, Homo sapiens
aaccctaaagcagtaaaat

SEQ ID NO: 4322019 - DNA, 15 bp, Homo sapiens
aaccttgcaaactct

SEQ ID NO: 4322020 - DNA, 14 bp, Homo sapiens
aacctttgggccaa

SEQ ID NO: 4322021 - DNA, 18 bp, Homo sapiens
aacgtaattgtacaagca

SEQ ID NO: 4322022 - DNA, 12 bp, Homo sapiens
aacgtatttagc

SEQ ID NO: 4322023 - DNA, 16 bp, Homo sapiens
aacgtatttagccatt

SEQ ID NO: 4322024 - DNA, 23 bp, Homo sapiens
aacgttgacccctttcccccacc

SEQ ID NO: 4322025 - DNA, 22 bp, Homo sapiens
aactaaatgctcatacacagtt

SEQ ID NO: 4322026 - DNA, 19 bp, Homo sapiens
aactactgacgaaagagtc

SEQ ID NO: 4322027 - DNA, 22 bp, Homo sapiens
aactactgctattttttttaaa

SEQ ID NO: 4322028 - DNA, 17 bp, Homo sapiens
aactagggaagataata

SEQ ID NO: 4322029 - DNA, 14 bp, Homo sapiens
aactaggggaggag

SEQ ID NO: 4322030 - DNA, 17 bp, Homo sapiens
aactaggggaggagaga

SEQ ID NO: 4322031 - DNA, 18 bp, Homo sapiens
aactattttgttttaatc

SEQ ID NO: 4322032 - DNA, 21 bp, Homo sapiens
aactcaactgggctctgtccc

SEQ ID NO: 4322033 - DNA, 14 bp, Homo sapiens
aactctataaagaa

SEQ ID NO: 4322034 - DNA, 22 bp, Homo sapiens
aactctataaagaaacttttga

SEQ ID NO: 4322035 - DNA, 14 bp, Homo sapiens
aactgaagccgtgt

SEQ ID NO: 4322036 - DNA, 12 bp, Homo sapiens
aactgaaggaag

SEQ ID NO: 4322037 - DNA, 18 bp, Homo sapiens
aactgaataaaaaataaa

SEQ ID NO: 4322038 - DNA, 18 bp, Homo sapiens
aactgaatccatatttca

SEQ ID NO: 4322039 - DNA, 20 bp, Homo sapiens
aactgaatgtttattccttg

SEQ ID NO: 4322040 - DNA, 18 bp, Homo sapiens
aactgacatcagatttct

SEQ ID NO: 4322041 - DNA, 23 bp, Homo sapiens
aactgatacatctgatgcatgct

SEQ ID NO: 4322042 - DNA, 20 bp, Homo sapiens
aactgctgactgttttctct

SEQ ID NO: 4322043 - DNA, 21 bp, Homo sapiens
aactgctgactgttttctctt

SEQ ID NO: 4322044 - DNA, 23 bp, Homo sapiens
aactgctgactgttttctcttga

SEQ ID NO: 4322045 - DNA, 16 bp, Homo sapiens
aactgctttgggagat

SEQ ID NO: 4322046 - DNA, 17 bp, Homo sapiens
aactggagctgctaagc

SEQ ID NO: 4322047 - DNA, 20 bp, Homo sapiens
aactggagctgctaagctaa

SEQ ID NO: 4322048 - DNA, 14 bp, Homo sapiens
aactgtatttcagt

SEQ ID NO: 4322049 - DNA, 16 bp, Homo sapiens
aactgtatttcagtat

SEQ ID NO: 4322050 - DNA, 22 bp, Homo sapiens
aactgtatttcagtattttcca

SEQ ID NO: 4322051 - DNA, 21 bp, Homo sapiens
aactgtatttttgaagactat

SEQ ID NO: 4322052 - DNA, 18 bp, Homo sapiens
aacttgtttttattgcat

SEQ ID NO: 4322053 - DNA, 20 bp, Homo sapiens
aacttgtttttattgcattt

SEQ ID NO: 4322054 - DNA, 21 bp, Homo sapiens
aacttgtttttattgcatttg

SEQ ID NO: 4322055 - DNA, 16 bp, Homo sapiens
aactttgcaaattatt

SEQ ID NO: 4322056 - DNA, 18 bp, Homo sapiens
aacttttaggttgttacc

SEQ ID NO: 4322057 - DNA, 14 bp, Homo sapiens
aagaaaaaaaaata

SEQ ID NO: 4322058 - DNA, 21 bp, Homo sapiens
aagaaaaaaaaatacttaaat

SEQ ID NO: 4322059 - DNA, 17 bp, Homo sapiens
aagaaaaatgagcctgg

SEQ ID NO: 4322060 - DNA, 19 bp, Homo sapiens
aagaaactgcttacagttt

SEQ ID NO: 4322061 - DNA, 16 bp, Homo sapiens
aagaaacttttgaaaa

SEQ ID NO: 4322062 - DNA, 12 bp, Homo sapiens
aagaaataagta

SEQ ID NO: 4322063 - DNA, 18 bp, Homo sapiens
aagaaatgggactctgaa

SEQ ID NO: 4322064 - DNA, 12 bp, Homo sapiens
aagaacatgaat

SEQ ID NO: 4322065 - DNA, 22 bp, Homo sapiens
aagaaccaaaagttttcctgag

SEQ ID NO: 4322066 - DNA, 11 bp, Homo sapiens
aagaagaggaa

SEQ ID NO: 4322067 - DNA, 13 bp, Homo sapiens
aagaagaggaagt

SEQ ID NO: 4322068 - DNA, 21 bp, Homo sapiens
aagaagctttaatatttaaat

SEQ ID NO: 4322069 - DNA, 14 bp, Homo sapiens
aagaatgagcctgt

SEQ ID NO: 4322070 - DNA, 18 bp, Homo sapiens
aagaatgagcctgtccaa

SEQ ID NO: 4322071 - DNA, 16 bp, Homo sapiens
aagaattgactgattt

SEQ ID NO: 4322072 - DNA, 16 bp, Homo sapiens
aagaatttctggaaga

SEQ ID NO: 4322073 - DNA, 23 bp, Homo sapiens
aagacacacaggagtcctttctt

SEQ ID NO: 4322074 - DNA, 17 bp, Homo sapiens
aagacactaattcctta

SEQ ID NO: 4322075 - DNA, 13 bp, Homo sapiens
aagaccaccttcc

SEQ ID NO: 4322076 - DNA, 14 bp, Homo sapiens
aagacccagcagat

SEQ ID NO: 4322077 - DNA, 22 bp, Homo sapiens
aagaccctttgttgaaaaatgt

SEQ ID NO: 4322078 - DNA, 22 bp, Homo sapiens
aagaccttctccctagcccttc

SEQ ID NO: 4322079 - DNA, 17 bp, Homo sapiens
aagactcattccctaga

SEQ ID NO: 4322080 - DNA, 15 bp, Homo sapiens
aagagatctgggcat

SEQ ID NO: 4322081 - DNA, 19 bp, Homo sapiens
aagagattgtggtttcatt

SEQ ID NO: 4322082 - DNA, 16 bp, Homo sapiens
aattggtcatggtaga

SEQ ID NO: 4322083 - DNA, 16 bp, Homo sapiens
aattgtttatacacaa

SEQ ID NO: 4322084 - DNA, 20 bp, Homo sapiens
aatttagagcgtttggttaa

SEQ ID NO: 4322085 - DNA, 20 bp, Homo sapiens
aatttcacagttctgtaatg

SEQ ID NO: 4322086 - DNA, 11 bp, Homo sapiens
aatttccaaaa

SEQ ID NO: 4322087 - DNA, 14 bp, Homo sapiens
aatttccaaaataa

SEQ ID NO: 4322088 - DNA, 22 bp, Homo sapiens
aatttccaaaataatctatatt

SEQ ID NO: 4322089 - DNA, 17 bp, Homo sapiens
aatttctggaagaaagg

SEQ ID NO: 4322090 - DNA, 18 bp, Homo sapiens
aatttctttttggtaaat

SEQ ID NO: 4322091 - DNA, 18 bp, Homo sapiens
aatttgaaaataattgtt

SEQ ID NO: 4322092 - DNA, 15 bp, Homo sapiens
aatttggcaaaacaa

SEQ ID NO: 4322093 - DNA, 14 bp, Homo sapiens
acaaaacttttcta

SEQ ID NO: 4322094 - DNA, 16 bp, Homo sapiens
acaaaagggagaacat

SEQ ID NO: 4322095 - DNA, 19 bp, Homo sapiens
acaaaatttcacagttctg

SEQ ID NO: 4322096 - DNA, 22 bp, Homo sapiens
acaaaatttcacagttctgtaa

SEQ ID NO: 4322097 - DNA, 12 bp, Homo sapiens
acaaaatttgaa

SEQ ID NO: 4322098 - DNA, 21 bp, Homo sapiens
acaaacttctcgcaactgaag

SEQ ID NO: 4322099 - DNA, 11 bp, Homo sapiens
acaaagaaaat

SEQ ID NO: 4322100 - DNA, 19 bp, Homo sapiens
acaaagaaaatgagaatct

SEQ ID NO: 4322101 - DNA, 18 bp, Homo sapiens
acaaagagaccaggggcg

SEQ ID NO: 4322102 - DNA, 11 bp, Homo sapiens
acaaagcaaat

SEQ ID NO: 4322103 - DNA, 23 bp, Homo sapiens
acaaattccgattagacctttat

SEQ ID NO: 4322104 - DNA, 15 bp, Homo sapiens
acaactttgcaaatt

SEQ ID NO: 4322105 - DNA, 18 bp, Homo sapiens
acaagagggactgtattt

SEQ ID NO: 4322106 - DNA, 19 bp, Homo sapiens
acaagagggactgtatttc

SEQ ID NO: 4322107 - DNA, 20 bp, Homo sapiens
acaagagggactgtatttct

SEQ ID NO: 4322108 - DNA, 17 bp, Homo sapiens
acaagccttactcacct

SEQ ID NO: 4322109 - DNA, 18 bp, Homo sapiens
acaagccttactcacctc

SEQ ID NO: 4322110 - DNA, 20 bp, Homo sapiens
acaagccttactcacctctc

SEQ ID NO: 4322111 - DNA, 23 bp, Homo sapiens
acaagctaggaaagaggaggcag

SEQ ID NO: 4322112 - DNA, 19 bp, Homo sapiens
acaagctgcaccctcaggc

SEQ ID NO: 4322113 - DNA, 19 bp, Homo sapiens
acaagcttaaagcttgatt

SEQ ID NO: 4322114 - DNA, 16 bp, Homo sapiens
acaaggattgaaaatt

SEQ ID NO: 4322115 - DNA, 17 bp, Homo sapiens
acaaggattgaaaattc

SEQ ID NO: 4322116 - DNA, 20 bp, Homo sapiens
acaaggccagaaaaagaaga

SEQ ID NO: 4322117 - DNA, 22 bp, Homo sapiens
acaaggccagaaaaagaagaag

SEQ ID NO: 4322118 - DNA, 22 bp, Homo sapiens
acaaggtatacctcagttccac

SEQ ID NO: 4322119 - DNA, 13 bp, Homo sapiens
acaatatatttgt

SEQ ID NO: 4322120 - DNA, 19 bp, Homo sapiens
acaatgattttcttgaatg

SEQ ID NO: 4322121 - DNA, 19 bp, Homo sapiens
acaatttgcataatactaa

SEQ ID NO: 4322122 - DNA, 18 bp, Homo sapiens
acacaaacgggctcagca

SEQ ID NO: 4322123 - DNA, 14 bp, Homo sapiens
acacaactttgcaa

SEQ ID NO: 4322124 - DNA, 18 bp, Homo sapiens
acacaaggccagaaaaag

SEQ ID NO: 4322125 - DNA, 20 bp, Homo sapiens
acacaaggccagaaaaagaa

SEQ ID NO: 4322126 - DNA, 17 bp, Homo sapiens
acacagcttgtgaatgt

SEQ ID NO: 4322127 - DNA, 18 bp, Homo sapiens
acacagcttgtgaatgtt

SEQ ID NO: 4322128 - DNA, 18 bp, Homo sapiens
acacaggagtcctttctt

SEQ ID NO: 4322129 - DNA, 13 bp, Homo sapiens
acacataaatgaa

SEQ ID NO: 4322130 - DNA, 14 bp, Homo sapiens
acacataaatgaaa

SEQ ID NO: 4322131 - DNA, 15 bp, Homo sapiens
acacataaatgaaag

SEQ ID NO: 4322132 - DNA, 13 bp, Homo sapiens
acacatataaaaa

SEQ ID NO: 4322133 - DNA, 16 bp, Homo sapiens
acacatataaaaacaa

SEQ ID NO: 4322134 - DNA, 14 bp, Homo sapiens
acacatatgtgctt

SEQ ID NO: 4322135 - DNA, 21 bp, Homo sapiens
acacatgtgctgatgtttaca

SEQ ID NO: 4322136 - DNA, 13 bp, Homo sapiens
acaccagcccctg

SEQ ID NO: 4322137 - DNA, 22 bp, Homo sapiens
acacccgccctgcccttccctg

SEQ ID NO: 4322138 - DNA, 18 bp, Homo sapiens
acacctctgcacaagctg

SEQ ID NO: 4322139 - DNA, 19 bp, Homo sapiens
acacctctgcacaagctgc

SEQ ID NO: 4322140 - DNA, 19 bp, Homo sapiens
acactaacaaaatttgaat

SEQ ID NO: 4322141 - DNA, 20 bp, Homo sapiens
acactaacaaaatttgaata

SEQ ID NO: 4322142 - DNA, 12 bp, Homo sapiens
acactaagaaat

SEQ ID NO: 4322143 - DNA, 23 bp, Homo sapiens
acactaagtgagagttggggaga

SEQ ID NO: 4322144 - DNA, 17 bp, Homo sapiens
acactaattccttaaat

SEQ ID NO: 4322145 - DNA, 22 bp, Homo sapiens
acactaattccttaaatgaact

SEQ ID NO: 4322146 - DNA, 14 bp, Homo sapiens
acactacattagaa

SEQ ID NO: 4322147 - DNA, 16 bp, Homo sapiens
acactaggagactggt

SEQ ID NO: 4322148 - DNA, 13 bp, Homo sapiens
acactatagtttt

SEQ ID NO: 4322149 - DNA, 21 bp, Homo sapiens
acactcaaaagctgggcaggt

SEQ ID NO: 4322150 - DNA, 21 bp, Homo sapiens
acactgttgtccttaaaattc

SEQ ID NO: 4322151 - DNA, 19 bp, Homo sapiens
acacttattgtttgaaaga

SEQ ID NO: 4322152 - DNA, 20 bp, Homo sapiens
acacttattgtttgaaagac

SEQ ID NO: 4322153 - DNA, 13 bp, Homo sapiens
acagaaggggatg

SEQ ID NO: 4322154 - DNA, 20 bp, Homo sapiens
acagaaggggatgggaaata

SEQ ID NO: 4322155 - DNA, 17 bp, Homo sapiens
acagacactgttgcaaa

SEQ ID NO: 4322156 - DNA, 21 bp, Homo sapiens
acagaccaagtccaagcccgt

SEQ ID NO: 4322157 - DNA, 21 bp, Homo sapiens
acagagcaagtgagaccctgt

SEQ ID NO: 4322158 - DNA, 13 bp, Homo sapiens
acagagcagatca

SEQ ID NO: 4322159 - DNA, 15 bp, Homo sapiens
acagatatactttgt

SEQ ID NO: 4322160 - DNA, 20 bp, Homo sapiens
acagatggagcaaatgtcct

SEQ ID NO: 4322161 - DNA, 15 bp, Homo sapiens
acagatttgaggact

SEQ ID NO: 4322162 - DNA, 21 bp, Homo sapiens
acagatttgaggactgaagct

SEQ ID NO: 4322163 - DNA, 14 bp, Homo sapiens
acagcacagatgtg

SEQ ID NO: 4322164 - DNA, 18 bp, Homo sapiens
acagcaggatgccctgtt

SEQ ID NO: 4322165 - DNA, 20 bp, Homo sapiens
acagcaggatgccctgttgg

SEQ ID NO: 4322166 - DNA, 10 bp, Homo sapiens
acagccctga

SEQ ID NO: 4322167 - DNA, 21 bp, Homo sapiens
acagccctgaaacgagaagtg

SEQ ID NO: 4322168 - DNA, 13 bp, Homo sapiens
acagccctggaat

SEQ ID NO: 4322169 - DNA, 13 bp, Homo sapiens
acagcttgtgaat

SEQ ID NO: 4322170 - DNA, 17 bp, Homo sapiens
acaggcagctctgagcc

SEQ ID NO: 4322171 - DNA, 18 bp, Homo sapiens
acaggcagctctgagccg

SEQ ID NO: 4322172 - DNA, 11 bp, Homo sapiens
acaggcctccc

SEQ ID NO: 4322173 - DNA, 14 bp, Homo sapiens
acaggcctgaagat

SEQ ID NO: 4322174 - DNA, 16 bp, Homo sapiens
acagggaaatgtgtat

SEQ ID NO: 4322175 - DNA, 19 bp, Homo sapiens
acagggagcctcctgccca

SEQ ID NO: 4322176 - DNA, 18 bp, Homo sapiens
acagtaaagaggcttcca

SEQ ID NO: 4322177 - DNA, 17 bp, Homo sapiens
acagtcatcgctcgtgt

SEQ ID NO: 4322178 - DNA, 21 bp, Homo sapiens
acagtcatcgctcgtgtgttc

SEQ ID NO: 4322179 - DNA, 15 bp, Homo sapiens
acagtcccagcacat

SEQ ID NO: 4322180 - DNA, 16 bp, Homo sapiens
acagtcccagcacatt

SEQ ID NO: 4322181 - DNA, 19 bp, Homo sapiens
acagtttattttctgtgta

SEQ ID NO: 4322182 - DNA, 21 bp, Homo sapiens
acagtttattttctgtgtaaa

SEQ ID NO: 4322183 - DNA, 23 bp, Homo sapiens
acagtttattttctgtgtaaaat

SEQ ID NO: 4322184 - DNA, 15 bp, Homo sapiens
acagtttatttttat

SEQ ID NO: 4322185 - DNA, 15 bp, Homo sapiens
acataaagtcatcaa

SEQ ID NO: 4322186 - DNA, 14 bp, Homo sapiens
acatacaaatatat

SEQ ID NO: 4322187 - DNA, 15 bp, Homo sapiens
acatacaaatatatg

SEQ ID NO: 4322188 - DNA, 21 bp, Homo sapiens
acatacacaaggccagaaaaa

SEQ ID NO: 4322189 - DNA, 13 bp, Homo sapiens
acatagaaacata

SEQ ID NO: 4322190 - DNA, 16 bp, Homo sapiens
acatagaggtatattg

SEQ ID NO: 4322191 - DNA, 11 bp, Homo sapiens
acatagccttt

SEQ ID NO: 4322192 - DNA, 13 bp, Homo sapiens
acatagcctttgt

SEQ ID NO: 4322193 - DNA, 19 bp, Homo sapiens
acataggctggtggccttg

SEQ ID NO: 4322194 - DNA, 20 bp, Homo sapiens
acataggctggtggccttgg

SEQ ID NO: 4322195 - DNA, 12 bp, Homo sapiens
acatagtttctt

SEQ ID NO: 4322196 - DNA, 11 bp, Homo sapiens
acatcagattt

SEQ ID NO: 4322197 - DNA, 15 bp, Homo sapiens
acatcagatttctta

SEQ ID NO: 4322198 - DNA, 19 bp, Homo sapiens
acatcagatttcttaatgt

SEQ ID NO: 4322199 - DNA, 14 bp, Homo sapiens
acatcctagcccca

SEQ ID NO: 4322200 - DNA, 22 bp, Homo sapiens
acatcgttcgatttaagccatc

SEQ ID NO: 4322201 - DNA, 13 bp, Homo sapiens
acttgtttctttc

SEQ ID NO: 4322202 - DNA, 17 bp, Homo sapiens
acttgtttctttctgtc

SEQ ID NO: 4322203 - DNA, 20 bp, Homo sapiens
acttgtttttattgcatttg

SEQ ID NO: 4322204 - DNA, 16 bp, Homo sapiens
actttaaaaccagtta

SEQ ID NO: 4322205 - DNA, 22 bp, Homo sapiens
actttaggatgagcaaaacatt

SEQ ID NO: 4322206 - DNA, 17 bp, Homo sapiens
actttgaataaaagaat

SEQ ID NO: 4322207 - DNA, 12 bp, Homo sapiens
actttgcaaatt

SEQ ID NO: 4322208 - DNA, 15 bp, Homo sapiens
actttgctgcatttt

SEQ ID NO: 4322209 - DNA, 19 bp, Homo sapiens
actttgctgcattttacac

SEQ ID NO: 4322210 - DNA, 22 bp, Homo sapiens
actttgtaccccccaacccctg

SEQ ID NO: 4322211 - DNA, 18 bp, Homo sapiens
actttgtggaccaattat

SEQ ID NO: 4322212 - DNA, 21 bp, Homo sapiens
actttgtggaccaattattga

SEQ ID NO: 4322213 - DNA, 16 bp, Homo sapiens
acttttattttcattg

SEQ ID NO: 4322214 - DNA, 22 bp, Homo sapiens
acttttattttcattgtgattt

SEQ ID NO: 4322215 - DNA, 15 bp, Homo sapiens
acttttcatttcaga

SEQ ID NO: 4322216 - DNA, 18 bp, Homo sapiens
acttttcatttcagattt

SEQ ID NO: 4322217 - DNA, 21 bp, Homo sapiens
acttttcatttcagattttaa

SEQ ID NO: 4322218 - DNA, 16 bp, Homo sapiens
acttttctttcttttc

SEQ ID NO: 4322219 - DNA, 23 bp, Homo sapiens
acttttgaaaaagtgtacatgaa

SEQ ID NO: 4322220 - DNA, 16 bp, Homo sapiens
actttttgtatttagt

SEQ ID NO: 4322221 - DNA, 17 bp, Homo sapiens
actttttgtatttagta

SEQ ID NO: 4322222 - DNA, 14 bp, Homo sapiens
actttttttcagtt

SEQ ID NO: 4322223 - DNA, 15 bp, Homo sapiens
actttttttcagttc

SEQ ID NO: 4322224 - DNA, 23 bp, Homo sapiens
agaaaaaatattttcctgccagg

SEQ ID NO: 4322225 - DNA, 18 bp, Homo sapiens
agaaaaatgagcctggca

SEQ ID NO: 4322226 - DNA, 15 bp, Homo sapiens
agaaaagtagacaat

SEQ ID NO: 4322227 - DNA, 14 bp, Homo sapiens
agaaaattctcctg

SEQ ID NO: 4322228 - DNA, 20 bp, Homo sapiens
agaaaattctctcaagactt

SEQ ID NO: 4322229 - DNA, 15 bp, Homo sapiens
agaaacaaagcaaat

SEQ ID NO: 4322230 - DNA, 15 bp, Homo sapiens
agaaaccttgcaaac

SEQ ID NO: 4322231 - DNA, 23 bp, Homo sapiens
agaaaccttgcaaactctataaa

SEQ ID NO: 4322232 - DNA, 14 bp, Homo sapiens
agaaactgcttaca

SEQ ID NO: 4322233 - DNA, 11 bp, Homo sapiens
agaaacttttg

SEQ ID NO: 4322234 - DNA, 23 bp, Homo sapiens
agaaagaagaccctttgttgaaa

SEQ ID NO: 4322235 - DNA, 14 bp, Homo sapiens
agaaagatgacaaa

SEQ ID NO: 4322236 - DNA, 16 bp, Homo sapiens
agaaagatttggaaaa

SEQ ID NO: 4322237 - DNA, 18 bp, Homo sapiens
agaaagatttggaaaatt

SEQ ID NO: 4322238 - DNA, 20 bp, Homo sapiens
agaaagatttggaaaattca

SEQ ID NO: 4322239 - DNA, 22 bp, Homo sapiens
agaaagatttggaaaattcaca

SEQ ID NO: 4322240 - DNA, 21 bp, Homo sapiens
agaaaggggtgattgaaagaa

SEQ ID NO: 4322241 - DNA, 23 bp, Homo sapiens
agaaagttgctaactgggaagaa

SEQ ID NO: 4322242 - DNA, 18 bp, Homo sapiens
agaaataatgcctccaat

SEQ ID NO: 4322243 - DNA, 15 bp, Homo sapiens
agaaatgaaattgac

SEQ ID NO: 4322244 - DNA, 16 bp, Homo sapiens
agaaatgggactctga

SEQ ID NO: 4322245 - DNA, 15 bp, Homo sapiens
agaaatgtttttaac

SEQ ID NO: 4322246 - DNA, 20 bp, Homo sapiens
agaaattatacgtacataca

SEQ ID NO: 4322247 - DNA, 17 bp, Homo sapiens
agaacatgcaagaattt

SEQ ID NO: 4322248 - DNA, 14 bp, Homo sapiens
agaaccccaggtga

SEQ ID NO: 4322249 - DNA, 13 bp, Homo sapiens
agaacctttttat

SEQ ID NO: 4322250 - DNA, 16 bp, Homo sapiens
agaacgtatttagcca

SEQ ID NO: 4322251 - DNA, 18 bp, Homo sapiens
agaactacgcacagctgc

SEQ ID NO: 4322252 - DNA, 15 bp, Homo sapiens
agaagaaaagactta

SEQ ID NO: 4322253 - DNA, 16 bp, Homo sapiens
agaagaaaatggatga

SEQ ID NO: 4322254 - DNA, 13 bp, Homo sapiens
agaagacactaat

SEQ ID NO: 4322255 - DNA, 19 bp, Homo sapiens
agaagaccctttgttgaaa

SEQ ID NO: 4322256 - DNA, 21 bp, Homo sapiens
agaagaccctttgttgaaaaa

SEQ ID NO: 4322257 - DNA, 23 bp, Homo sapiens
agaagaccctttgttgaaaaatg

SEQ ID NO: 4322258 - DNA, 20 bp, Homo sapiens
agaagaggaagttagagata

SEQ ID NO: 4322259 - DNA, 18 bp, Homo sapiens
agaagcaaagatttcagt

SEQ ID NO: 4322260 - DNA, 17 bp, Homo sapiens
agaagcaaggtctcaga

SEQ ID NO: 4322261 - DNA, 16 bp, Homo sapiens
agaagcgctcatctgg

SEQ ID NO: 4322262 - DNA, 14 bp, Homo sapiens
agaagtaacttact

SEQ ID NO: 4322263 - DNA, 13 bp, Homo sapiens
agaagtgcagccc

SEQ ID NO: 4322264 - DNA, 13 bp, Homo sapiens
agaataattattt

SEQ ID NO: 4322265 - DNA, 17 bp, Homo sapiens
agaatacacatataaaa

SEQ ID NO: 4322266 - DNA, 23 bp, Homo sapiens
agaatagcctattgtctttcatt

SEQ ID NO: 4322267 - DNA, 20 bp, Homo sapiens
agaataggtgcaaacaaaca

SEQ ID NO: 4322268 - DNA, 15 bp, Homo sapiens
agaatatactgtctt

SEQ ID NO: 4322269 - DNA, 12 bp, Homo sapiens
agaatatatata

SEQ ID NO: 4322270 - DNA, 14 bp, Homo sapiens
agaatctgtgcagt

SEQ ID NO: 4322271 - DNA, 16 bp, Homo sapiens
agaatgaaaactcatt

SEQ ID NO: 4322272 - DNA, 12 bp, Homo sapiens
agaatgagcctg

SEQ ID NO: 4322273 - DNA, 16 bp, Homo sapiens
agaatgcacagatata

SEQ ID NO: 4322274 - DNA, 17 bp, Homo sapiens
agaatgcacagatatac

SEQ ID NO: 4322275 - DNA, 18 bp, Homo sapiens
agaatgcacagatatact

SEQ ID NO: 4322276 - DNA, 22 bp, Homo sapiens
agaatgcacagatatactttgt

SEQ ID NO: 4322277 - DNA, 18 bp, Homo sapiens
agaatggaatccatctgt

SEQ ID NO: 4322278 - DNA, 16 bp, Homo sapiens
agaatgtagtcagact

SEQ ID NO: 4322279 - DNA, 16 bp, Homo sapiens
agaattatccattacg

SEQ ID NO: 4322280 - DNA, 17 bp, Homo sapiens
agaattggcataatttg

SEQ ID NO: 4322281 - DNA, 14 bp, Homo sapiens
agacaatcattgtt

SEQ ID NO: 4322282 - DNA, 15 bp, Homo sapiens
agacaatcattgttt

SEQ ID NO: 4322283 - DNA, 23 bp, Homo sapiens
agacaatcattgttttgaatatt

SEQ ID NO: 4322284 - DNA, 20 bp, Homo sapiens
agacaatgtgaaaagaaaaa

SEQ ID NO: 4322285 - DNA, 12 bp, Homo sapiens
agacacacagga

SEQ ID NO: 4322286 - DNA, 21 bp, Homo sapiens
agacaccatcttttgtgagat

SEQ ID NO: 4322287 - DNA, 16 bp, Homo sapiens
agacactaattcctta

SEQ ID NO: 4322288 - DNA, 13 bp, Homo sapiens
agacactgttgca

SEQ ID NO: 4322289 - DNA, 17 bp, Homo sapiens
agacactgttgcaaagg

SEQ ID NO: 4322290 - DNA, 13 bp, Homo sapiens
agacatgcttggg

SEQ ID NO: 4322291 - DNA, 17 bp, Homo sapiens
agaccaagtccaagccc

SEQ ID NO: 4322292 - DNA, 16 bp, Homo sapiens
agaccagaagaaaaga

SEQ ID NO: 4322293 - DNA, 20 bp, Homo sapiens
agaccagaagaaaagactta

SEQ ID NO: 4322294 - DNA, 16 bp, Homo sapiens
agaccaggagggagag

SEQ ID NO: 4322295 - DNA, 14 bp, Homo sapiens
agacccacagccct

SEQ ID NO: 4322296 - DNA, 17 bp, Homo sapiens
agaccgctctcttttct

SEQ ID NO: 4322297 - DNA, 19 bp, Homo sapiens
agaccttctccctagccct

SEQ ID NO: 4322298 - DNA, 14 bp, Homo sapiens
agactatttttcta

SEQ ID NO: 4322299 - DNA, 22 bp, Homo sapiens
agactcactagcccaagtaatc

SEQ ID NO: 4322300 - DNA, 20 bp, Homo sapiens
agactctcagcccagaagaa

SEQ ID NO: 4322301 - DNA, 14 bp, Homo sapiens
agactgacactact

SEQ ID NO: 4322302 - DNA, 20 bp, Homo sapiens
agactgtaactttttttcag

SEQ ID NO: 4322303 - DNA, 23 bp, Homo sapiens
agactgtgtctgaatcatgtctg

SEQ ID NO: 4322304 - DNA, 20 bp, Homo sapiens
agactttgctgcattttaca

SEQ ID NO: 4322305 - DNA, 10 bp, Homo sapiens
agagaagaga

SEQ ID NO: 4322306 - DNA, 21 bp, Homo sapiens
agagaagagattgtggtttca

SEQ ID NO: 4322307 - DNA, 21 bp, Homo sapiens
agagaatacacatataaaaac

SEQ ID NO: 4322308 - DNA, 23 bp, Homo sapiens
agagaatacacatataaaaacaa

SEQ ID NO: 4322309 - DNA, 20 bp, Homo sapiens
agagaatgcacagatatact

SEQ ID NO: 4322310 - DNA, 13 bp, Homo sapiens
agagaccaggagg

SEQ ID NO: 4322311 - DNA, 15 bp, Homo sapiens
agagaccaggaggga

SEQ ID NO: 4322312 - DNA, 13 bp, Homo sapiens
agagatctgggca

SEQ ID NO: 4322313 - DNA, 18 bp, Homo sapiens
agagcaggaggtgcctga

SEQ ID NO: 4322314 - DNA, 20 bp, Homo sapiens
agagccctgtccctgccctc

SEQ ID NO: 4322315 - DNA, 11 bp, Homo sapiens
agagccttgcg

SEQ ID NO: 4322316 - DNA, 21 bp, Homo sapiens
agagccttgcggaaggttcta

SEQ ID NO: 4322317 - DNA, 22 bp, Homo sapiens
agaggaaaaacagaggatgctg

SEQ ID NO: 4322318 - DNA, 11 bp, Homo sapiens
agaggaaaatc

SEQ ID NO: 4322319 - DNA, 13 bp, Homo sapiens
aggctatcctgct

SEQ ID NO: 4322320 - DNA, 14 bp, Homo sapiens
aggctccccagtgc

SEQ ID NO: 4322321 - DNA, 12 bp, Homo sapiens
aggctgggcagg

SEQ ID NO: 4322322 - DNA, 17 bp, Homo sapiens
aggctgggggaagaagc

SEQ ID NO: 4322323 - DNA, 15 bp, Homo sapiens
aggctgtggaagggc

SEQ ID NO: 4322324 - DNA, 14 bp, Homo sapiens
aggcttttgggcca

SEQ ID NO: 4322325 - DNA, 16 bp, Homo sapiens
agggaacagcctgagc

SEQ ID NO: 4322326 - DNA, 17 bp, Homo sapiens
agggaacagcctgagcc

SEQ ID NO: 4322327 - DNA, 19 bp, Homo sapiens
agggaacccccaaatttaa

SEQ ID NO: 4322328 - DNA, 18 bp, Homo sapiens
agggacagagcccgggag

SEQ ID NO: 4322329 - DNA, 18 bp, Homo sapiens
agggactgtatttctgtg

SEQ ID NO: 4322330 - DNA, 14 bp, Homo sapiens
agggagaaatgcca

SEQ ID NO: 4322331 - DNA, 14 bp, Homo sapiens
agggagacagagat

SEQ ID NO: 4322332 - DNA, 14 bp, Homo sapiens
agggagagcctctg

SEQ ID NO: 4322333 - DNA, 19 bp, Homo sapiens
agggagaggcctcggctgt

SEQ ID NO: 4322334 - DNA, 11 bp, Homo sapiens
agggagcctcc

SEQ ID NO: 4322335 - DNA, 15 bp, Homo sapiens
agggagcctcctgcc

SEQ ID NO: 4322336 - DNA, 22 bp, Homo sapiens
agggagcctcctgcccagtccc

SEQ ID NO: 4322337 - DNA, 11 bp, Homo sapiens
agggaggaaga

SEQ ID NO: 4322338 - DNA, 15 bp, Homo sapiens
agggagggcttctgc

SEQ ID NO: 4322339 - DNA, 21 bp, Homo sapiens
agggagtctggggtgggaggg

SEQ ID NO: 4322340 - DNA, 18 bp, Homo sapiens
agggcactgtctgcgtga

SEQ ID NO: 4322341 - DNA, 14 bp, Homo sapiens
agggcattctttcc

SEQ ID NO: 4322342 - DNA, 22 bp, Homo sapiens
agggccaatggagaaaatgaat

SEQ ID NO: 4322343 - DNA, 16 bp, Homo sapiens
agggccgtgcccttgc

SEQ ID NO: 4322344 - DNA, 17 bp, Homo sapiens
agggccgtgcccttgcc

SEQ ID NO: 4322345 - DNA, 15 bp, Homo sapiens
agggcgggcaaggag

SEQ ID NO: 4322346 - DNA, 19 bp, Homo sapiens
aggggaggagagagggtct

SEQ ID NO: 4322347 - DNA, 17 bp, Homo sapiens
aggggcgcttgggaggg

SEQ ID NO: 4322348 - DNA, 15 bp, Homo sapiens
aggggtgattgaaag

SEQ ID NO: 4322349 - DNA, 20 bp, Homo sapiens
aggggtgattgaaagaaaaa

SEQ ID NO: 4322350 - DNA, 19 bp, Homo sapiens
aggggttgccacaggcctc

SEQ ID NO: 4322351 - DNA, 21 bp, Homo sapiens
aggggttgccacaggcctccc

SEQ ID NO: 4322352 - DNA, 22 bp, Homo sapiens
agggtaacttgtttttattgca

SEQ ID NO: 4322353 - DNA, 15 bp, Homo sapiens
agggtgaagcaccag

SEQ ID NO: 4322354 - DNA, 16 bp, Homo sapiens
aggtaaaatgtatttt

SEQ ID NO: 4322355 - DNA, 17 bp, Homo sapiens
aggtaaacacataaatg

SEQ ID NO: 4322356 - DNA, 19 bp, Homo sapiens
aggtaaacacataaatgaa

SEQ ID NO: 4322357 - DNA, 12 bp, Homo sapiens
aggtaacactac

SEQ ID NO: 4322358 - DNA, 21 bp, Homo sapiens
aggtaatgtagggttatattt

SEQ ID NO: 4322359 - DNA, 12 bp, Homo sapiens
aggtagaggaaa

SEQ ID NO: 4322360 - DNA, 16 bp, Homo sapiens
aggtagaggaaaatca

SEQ ID NO: 4322361 - DNA, 22 bp, Homo sapiens
aggtatcaactaggggaggaga

SEQ ID NO: 4322362 - DNA, 21 bp, Homo sapiens
aggtatgattataagagagct

SEQ ID NO: 4322363 - DNA, 14 bp, Homo sapiens
aggtatttcaaaac

SEQ ID NO: 4322364 - DNA, 17 bp, Homo sapiens
aggtcgtttatgtgtgc

SEQ ID NO: 4322365 - DNA, 20 bp, Homo sapiens
aggtctacattcttggttgt

SEQ ID NO: 4322366 - DNA, 17 bp, Homo sapiens
aggtgaacagcaggatg

SEQ ID NO: 4322367 - DNA, 21 bp, Homo sapiens
aggtgagaagcagaggaagga

SEQ ID NO: 4322368 - DNA, 21 bp, Homo sapiens
aggtgcgtcccccgttgtgcc

SEQ ID NO: 4322369 - DNA, 20 bp, Homo sapiens
aggtgctgggaatacatctg

SEQ ID NO: 4322370 - DNA, 16 bp, Homo sapiens
aggtggccctcccagg

SEQ ID NO: 4322371 - DNA, 21 bp, Homo sapiens
aggtggccctcccaggctggt

SEQ ID NO: 4322372 - DNA, 15 bp, Homo sapiens
aggtgggtgaggctg

SEQ ID NO: 4322373 - DNA, 17 bp, Homo sapiens
aggtgggtgaggctggg

SEQ ID NO: 4322374 - DNA, 21 bp, Homo sapiens
aggttcgggattccctggtgg

SEQ ID NO: 4322375 - DNA, 14 bp, Homo sapiens
aggttggtgggggc

SEQ ID NO: 4322376 - DNA, 14 bp, Homo sapiens
aggtttttctcccc

SEQ ID NO: 4322377 - DNA, 14 bp, Homo sapiens
agtaaaataaaaaa

SEQ ID NO: 4322378 - DNA, 16 bp, Homo sapiens
agtaaaatttatttca

SEQ ID NO: 4322379 - DNA, 18 bp, Homo sapiens
agtaaacttgtgtattga

SEQ ID NO: 4322380 - DNA, 18 bp, Homo sapiens
agtaaagaggcttccaag

SEQ ID NO: 4322381 - DNA, 13 bp, Homo sapiens
agtaaagccatta

SEQ ID NO: 4322382 - DNA, 23 bp, Homo sapiens
agtaaagccattaaatgaatatt

SEQ ID NO: 4322383 - DNA, 23 bp, Homo sapiens
agtaaatattatgattttattta

SEQ ID NO: 4322384 - DNA, 23 bp, Homo sapiens
agtaacaggaaaccacttatcac

SEQ ID NO: 4322385 - DNA, 16 bp, Homo sapiens
agtaactgttcctact

SEQ ID NO: 4322386 - DNA, 15 bp, Homo sapiens
agtaagtaaccatat

SEQ ID NO: 4322387 - DNA, 20 bp, Homo sapiens
agtaagtaattatgcactaa

SEQ ID NO: 4322388 - DNA, 12 bp, Homo sapiens
agtaatgtagaa

SEQ ID NO: 4322389 - DNA, 15 bp, Homo sapiens
agtaattatgcacta

SEQ ID NO: 4322390 - DNA, 21 bp, Homo sapiens
agtacagctgacggtttctcc

SEQ ID NO: 4322391 - DNA, 17 bp, Homo sapiens
agtacagtcccagcaca

SEQ ID NO: 4322392 - DNA, 14 bp, Homo sapiens
agtaccagaagcaa

SEQ ID NO: 4322393 - DNA, 13 bp, Homo sapiens
agtagaaagagtg

SEQ ID NO: 4322394 - DNA, 16 bp, Homo sapiens
agtagaattttagtcc

SEQ ID NO: 4322395 - DNA, 22 bp, Homo sapiens
agtagcctctgggatctgccaa

SEQ ID NO: 4322396 - DNA, 14 bp, Homo sapiens
agtagtttttacaa

SEQ ID NO: 4322397 - DNA, 16 bp, Homo sapiens
agtatagagagaagtt

SEQ ID NO: 4322398 - DNA, 15 bp, Homo sapiens
agtatagatggccaa

SEQ ID NO: 4322399 - DNA, 15 bp, Homo sapiens
agtatagtagaaaga

SEQ ID NO: 4322400 - DNA, 22 bp, Homo sapiens
agtatcaacttcccagtgatct

SEQ ID NO: 4322401 - DNA, 23 bp, Homo sapiens
agtatgagaaaaatattcaagta

SEQ ID NO: 4322402 - DNA, 23 bp, Homo sapiens
agtatgtatgccttcgggaaaat

SEQ ID NO: 4322403 - DNA, 14 bp, Homo sapiens
agtatttttatcca

SEQ ID NO: 4322404 - DNA, 15 bp, Homo sapiens
agtcaactggggaaa

SEQ ID NO: 4322405 - DNA, 16 bp, Homo sapiens
agtcaactggggaaaa

SEQ ID NO: 4322406 - DNA, 22 bp, Homo sapiens
agtcaactggggaaaaggatga

SEQ ID NO: 4322407 - DNA, 16 bp, Homo sapiens
agtcaagtgaaaaagg

SEQ ID NO: 4322408 - DNA, 16 bp, Homo sapiens
agtcactattttggct

SEQ ID NO: 4322409 - DNA, 16 bp, Homo sapiens
agtcacttaacttaca

SEQ ID NO: 4322410 - DNA, 14 bp, Homo sapiens
agtcatcaacaaaa

SEQ ID NO: 4322411 - DNA, 18 bp, Homo sapiens
agtcatcaacaaaaggga

SEQ ID NO: 4322412 - DNA, 12 bp, Homo sapiens
agtcattcctaa

SEQ ID NO: 4322413 - DNA, 20 bp, Homo sapiens
agtcatttctgatgttccag

SEQ ID NO: 4322414 - DNA, 18 bp, Homo sapiens
agtcccccaaccccagcc

SEQ ID NO: 4322415 - DNA, 16 bp, Homo sapiens
agtcctgctttcctat

SEQ ID NO: 4322416 - DNA, 14 bp, Homo sapiens
agtcctttcttttg

SEQ ID NO: 4322417 - DNA, 13 bp, Homo sapiens
agtctcccaaggc

SEQ ID NO: 4322418 - DNA, 18 bp, Homo sapiens
agtctctggggcaggctg

SEQ ID NO: 4322419 - DNA, 23 bp, Homo sapiens
agtctgaaccaatagaaagcaaa

SEQ ID NO: 4322420 - DNA, 13 bp, Homo sapiens
agtctgaagcctg

SEQ ID NO: 4322421 - DNA, 18 bp, Homo sapiens
agtctgaagcctgcaggt

SEQ ID NO: 4322422 - DNA, 16 bp, Homo sapiens
agtcttaactgtattt

SEQ ID NO: 4322423 - DNA, 17 bp, Homo sapiens
agtgaaaaaggaggaag

SEQ ID NO: 4322424 - DNA, 17 bp, Homo sapiens
agtgagaccctgtctca

SEQ ID NO: 4322425 - DNA, 16 bp, Homo sapiens
agtgccataccttctc

SEQ ID NO: 4322426 - DNA, 20 bp, Homo sapiens
agtgccataccttctcccag

SEQ ID NO: 4322427 - DNA, 18 bp, Homo sapiens
agtgcccggtgcagggcc

SEQ ID NO: 4322428 - DNA, 19 bp, Homo sapiens
agtgcccggtgcagggcct

SEQ ID NO: 4322429 - DNA, 19 bp, Homo sapiens
agtgcctgctgggtgccag

SEQ ID NO: 4322430 - DNA, 23 bp, Homo sapiens
agtgcctgctgggtgccaggtgc

SEQ ID NO: 4322431 - DNA, 13 bp, Homo sapiens
agtgctcctggcc

SEQ ID NO: 4322432 - DNA, 17 bp, Homo sapiens
agtgctcgaccttgata

SEQ ID NO: 4322433 - DNA, 20 bp, Homo sapiens
agtgctgtccatgcttctca

SEQ ID NO: 4322434 - DNA, 23 bp, Homo sapiens
agtgctgtcttgatgactgctga

SEQ ID NO: 4322435 - DNA, 18 bp, Homo sapiens
agtgcttcagagtttgtg

SEQ ID NO: 4322436 - DNA, 19 bp, Homo sapiens
agtggaaaaatagcctgcc

SEQ ID NO: 4322437 - DNA, 13 bp, Homo sapiens
agtgggaagaata

SEQ ID NO: 4322438 - DNA, 13 bp, Homo sapiens
ccacaggcctccc

SEQ ID NO: 4322439 - DNA, 18 bp, Homo sapiens
ccacaggcctccctgttt

SEQ ID NO: 4322440 - DNA, 22 bp, Homo sapiens
ccaccagggcactgtctgcgtg

SEQ ID NO: 4322441 - DNA, 12 bp, Homo sapiens
ccacccaaggag

SEQ ID NO: 4322442 - DNA, 13 bp, Homo sapiens
ccacccaaggaga

SEQ ID NO: 4322443 - DNA, 15 bp, Homo sapiens
ccacccagaggtggc

SEQ ID NO: 4322444 - DNA, 12 bp, Homo sapiens
ccaccccagagt

SEQ ID NO: 4322445 - DNA, 17 bp, Homo sapiens
ccaccctgaaagccctg

SEQ ID NO: 4322446 - DNA, 18 bp, Homo sapiens
ccaccctgaaagccctga

SEQ ID NO: 4322447 - DNA, 17 bp, Homo sapiens
ccaccgaatatattact

SEQ ID NO: 4322448 - DNA, 12 bp, Homo sapiens
ccaccgaggagc

SEQ ID NO: 4322449 - DNA, 15 bp, Homo sapiens
ccaccgaggagcccc

SEQ ID NO: 4322450 - DNA, 23 bp, Homo sapiens
ccaccgaggagccccagccccgt

SEQ ID NO: 4322451 - DNA, 23 bp, Homo sapiens
ccaccttcccttcctcagcaggc

SEQ ID NO: 4322452 - DNA, 15 bp, Homo sapiens
ccacgggtctgccat

SEQ ID NO: 4322453 - DNA, 14 bp, Homo sapiens
ccactcccaagcca

SEQ ID NO: 4322454 - DNA, 19 bp, Homo sapiens
ccactgcaaataaagcctt

SEQ ID NO: 4322455 - DNA, 18 bp, Homo sapiens
ccactgcactccagcctg

SEQ ID NO: 4322456 - DNA, 23 bp, Homo sapiens
ccactgcactccagcctgggtga

SEQ ID NO: 4322457 - DNA, 21 bp, Homo sapiens
ccactgcatcgtttcatcttc

SEQ ID NO: 4322458 - DNA, 19 bp, Homo sapiens
ccactggcacttgcctgct

SEQ ID NO: 4322459 - DNA, 22 bp, Homo sapiens
ccactggcacttgcctgctgct

SEQ ID NO: 4322460 - DNA, 16 bp, Homo sapiens
ccactggcatcgcagc

SEQ ID NO: 4322461 - DNA, 22 bp, Homo sapiens
ccactggcatcgcagcttcctg

SEQ ID NO: 4322462 - DNA, 14 bp, Homo sapiens
ccactgtgaagaga

SEQ ID NO: 4322463 - DNA, 15 bp, Homo sapiens
ccactgtgaagagaa

SEQ ID NO: 4322464 - DNA, 15 bp, Homo sapiens
ccacttcaggagccc

SEQ ID NO: 4322465 - DNA, 20 bp, Homo sapiens
ccagaaaaaaataactattt

SEQ ID NO: 4322466 - DNA, 21 bp, Homo sapiens
ccagaaaaaaataactatttt

SEQ ID NO: 4322467 - DNA, 14 bp, Homo sapiens
ccagaaaaagaaga

SEQ ID NO: 4322468 - DNA, 15 bp, Homo sapiens
ccagaaaaagaagaa

SEQ ID NO: 4322469 - DNA, 19 bp, Homo sapiens
ccagaaaaagaagaaggag

SEQ ID NO: 4322470 - DNA, 12 bp, Homo sapiens
ccagaagaaaag

SEQ ID NO: 4322471 - DNA, 18 bp, Homo sapiens
ccagaagaaaattctcct

SEQ ID NO: 4322472 - DNA, 22 bp, Homo sapiens
ccagaagtttgagatcagcctg

SEQ ID NO: 4322473 - DNA, 23 bp, Homo sapiens
ccagaagtttgagatcagcctgg

SEQ ID NO: 4322474 - DNA, 13 bp, Homo sapiens
ccagactcccttg

SEQ ID NO: 4322475 - DNA, 20 bp, Homo sapiens
ccagagaagctggaagcctg

SEQ ID NO: 4322476 - DNA, 16 bp, Homo sapiens
ccagagaattcttaga

SEQ ID NO: 4322477 - DNA, 17 bp, Homo sapiens
ccagaggccgctgcccc

SEQ ID NO: 4322478 - DNA, 15 bp, Homo sapiens
ccagaggtggccctc

SEQ ID NO: 4322479 - DNA, 16 bp, Homo sapiens
ccagaggtggccctcc

SEQ ID NO: 4322480 - DNA, 19 bp, Homo sapiens
ccagaggtggccctcccag

SEQ ID NO: 4322481 - DNA, 23 bp, Homo sapiens
ccagagttgggatgcggggcaga

SEQ ID NO: 4322482 - DNA, 11 bp, Homo sapiens
ccagcagcctg

SEQ ID NO: 4322483 - DNA, 15 bp, Homo sapiens
ccagcagcctggacc

SEQ ID NO: 4322484 - DNA, 21 bp, Homo sapiens
ccagcaggaggttctgggcct

SEQ ID NO: 4322485 - DNA, 22 bp, Homo sapiens
ccagcaggaggttctgggcctc

SEQ ID NO: 4322486 - DNA, 17 bp, Homo sapiens
ccagcagttctctgcca

SEQ ID NO: 4322487 - DNA, 19 bp, Homo sapiens
ccagccaaagcctcctcca

SEQ ID NO: 4322488 - DNA, 13 bp, Homo sapiens
ccagcccaagtcc

SEQ ID NO: 4322489 - DNA, 14 bp, Homo sapiens
ccagcccaagtcca

SEQ ID NO: 4322490 - DNA, 17 bp, Homo sapiens
ccagccccaatccagag

SEQ ID NO: 4322491 - DNA, 14 bp, Homo sapiens
ccagcccccacagc

SEQ ID NO: 4322492 - DNA, 19 bp, Homo sapiens
ccagccccgtcccagaggc

SEQ ID NO: 4322493 - DNA, 20 bp, Homo sapiens
ccagccccgtcccagaggcc

SEQ ID NO: 4322494 - DNA, 21 bp, Homo sapiens
ccagccccgtcccagaggccg

SEQ ID NO: 4322495 - DNA, 22 bp, Homo sapiens
ccagcccctgccccagcccaag

SEQ ID NO: 4322496 - DNA, 21 bp, Homo sapiens
ccagccctccccgcagtggga

SEQ ID NO: 4322497 - DNA, 15 bp, Homo sapiens
ccagccctctgtggc

SEQ ID NO: 4322498 - DNA, 23 bp, Homo sapiens
ccagccctctgtggccaggagcc

SEQ ID NO: 4322499 - DNA, 19 bp, Homo sapiens
ccagccgccatgctcctgg

SEQ ID NO: 4322500 - DNA, 17 bp, Homo sapiens
ccagccgtgtgtgcatg

SEQ ID NO: 4322501 - DNA, 18 bp, Homo sapiens
ccagccgtgtgtgcatgt

SEQ ID NO: 4322502 - DNA, 20 bp, Homo sapiens
ccagccgtgtgtgcatgtgc

SEQ ID NO: 4322503 - DNA, 21 bp, Homo sapiens
ccagctagtgccaaataattg

SEQ ID NO: 4322504 - DNA, 15 bp, Homo sapiens
ccagctcccccaggc

SEQ ID NO: 4322505 - DNA, 17 bp, Homo sapiens
ccagctcccccaggcag

SEQ ID NO: 4322506 - DNA, 19 bp, Homo sapiens
ccagctcccccaggcagaa

SEQ ID NO: 4322507 - DNA, 18 bp, Homo sapiens
ccaggaagtgcttattct

SEQ ID NO: 4322508 - DNA, 17 bp, Homo sapiens
ccaggagggagagcctc

SEQ ID NO: 4322509 - DNA, 22 bp, Homo sapiens
ccaggagggagagcctctgttt

SEQ ID NO: 4322510 - DNA, 16 bp, Homo sapiens
ccaggcagaaatagtt

SEQ ID NO: 4322511 - DNA, 22 bp, Homo sapiens
ccaggcagaaatagttgtctgt

SEQ ID NO: 4322512 - DNA, 18 bp, Homo sapiens
ccaggcatcactgattcc

SEQ ID NO: 4322513 - DNA, 21 bp, Homo sapiens
ccaggcatcactgattccctc

SEQ ID NO: 4322514 - DNA, 20 bp, Homo sapiens
ccaggggaaaatcagcctgc

SEQ ID NO: 4322515 - DNA, 21 bp, Homo sapiens
ccaggggaaaatcagcctgct

SEQ ID NO: 4322516 - DNA, 15 bp, Homo sapiens
ccaggtgagacctca

SEQ ID NO: 4322517 - DNA, 13 bp, Homo sapiens
ccaggtttaagct

SEQ ID NO: 4322518 - DNA, 20 bp, Homo sapiens
ccagtcccccaaccccagcc

SEQ ID NO: 4322519 - DNA, 12 bp, Homo sapiens
ccagtctgatta

SEQ ID NO: 4322520 - DNA, 19 bp, Homo sapiens
ccagtgagtctctggggca

SEQ ID NO: 4322521 - DNA, 20 bp, Homo sapiens
ccagtgcccggtgcagggcc

SEQ ID NO: 4322522 - DNA, 23 bp, Homo sapiens
ccagtgcccggtgcagggcctgg

SEQ ID NO: 4322523 - DNA, 16 bp, Homo sapiens
ccagtgctcctggccc

SEQ ID NO: 4322524 - DNA, 12 bp, Homo sapiens
ccagtggagacg

SEQ ID NO: 4322525 - DNA, 19 bp, Homo sapiens
ccagtgttccccccataga

SEQ ID NO: 4322526 - DNA, 19 bp, Homo sapiens
ccagttggaggagactggg

SEQ ID NO: 4322527 - DNA, 19 bp, Homo sapiens
ccagttggcccttctgccc

SEQ ID NO: 4322528 - DNA, 21 bp, Homo sapiens
ccataagtttaactgtatttt

SEQ ID NO: 4322529 - DNA, 13 bp, Homo sapiens
ccataccttctcc

SEQ ID NO: 4322530 - DNA, 17 bp, Homo sapiens
ccataccttctcccagg

SEQ ID NO: 4322531 - DNA, 18 bp, Homo sapiens
ccataccttctcccaggc

SEQ ID NO: 4322532 - DNA, 16 bp, Homo sapiens
ccatagagaccaggag

SEQ ID NO: 4322533 - DNA, 18 bp, Homo sapiens
ccatagagtaatgatgta

SEQ ID NO: 4322534 - DNA, 19 bp, Homo sapiens
ccatagcttgattgctcag

SEQ ID NO: 4322535 - DNA, 18 bp, Homo sapiens
ccataggctgtgtttaca

SEQ ID NO: 4322536 - DNA, 13 bp, Homo sapiens
ccatcaccagaca

SEQ ID NO: 4322537 - DNA, 16 bp, Homo sapiens
ccatcccctgtagagt

SEQ ID NO: 4322538 - DNA, 16 bp, Homo sapiens
ccatcccgtaagacca

SEQ ID NO: 4322539 - DNA, 18 bp, Homo sapiens
ccatcccgtaagaccacc

SEQ ID NO: 4322540 - DNA, 12 bp, Homo sapiens
ccatctctgtga

SEQ ID NO: 4322541 - DNA, 20 bp, Homo sapiens
ccatctctgtgattacctct

SEQ ID NO: 4322542 - DNA, 13 bp, Homo sapiens
ccatgaagctggc

SEQ ID NO: 4322543 - DNA, 20 bp, Homo sapiens
ccatgacaggcctgaagata

SEQ ID NO: 4322544 - DNA, 22 bp, Homo sapiens
ccatgatacctattaaaggaaa

SEQ ID NO: 4322545 - DNA, 16 bp, Homo sapiens
ccatggtacccccttc

SEQ ID NO: 4322546 - DNA, 18 bp, Homo sapiens
ccatggtacccccttctg

SEQ ID NO: 4322547 - DNA, 22 bp, Homo sapiens
ccattaataactgaataaaaaa

SEQ ID NO: 4322548 - DNA, 14 bp, Homo sapiens
ccattcctgttctc

SEQ ID NO: 4322549 - DNA, 17 bp, Homo sapiens
ccattgcaaaatagaag

SEQ ID NO: 4322550 - DNA, 15 bp, Homo sapiens
ccatttaaagaaaga

SEQ ID NO: 4322551 - DNA, 17 bp, Homo sapiens
ccatttcaattctcaaa

SEQ ID NO: 4322552 - DNA, 18 bp, Homo sapiens
ccatttgctactgtacat

SEQ ID NO: 4322553 - DNA, 23 bp, Homo sapiens
cccaaattagggcaattggaaca

SEQ ID NO: 4322554 - DNA, 12 bp, Homo sapiens
cccaaccccagc

SEQ ID NO: 4322555 - DNA, 22 bp, Homo sapiens
cccaaccccagccgctcggagg

SEQ ID NO: 4322556 - DNA, 23 bp, Homo sapiens
cgccaggggaaaatcagcctgct

SEQ ID NO: 4322557 - DNA, 15 bp, Homo sapiens
cgccatctgtgcaca

SEQ ID NO: 4322558 - DNA, 22 bp, Homo sapiens
cgcccacaagccttactcacct

SEQ ID NO: 4322559 - DNA, 12 bp, Homo sapiens
cgccccctgaaa

SEQ ID NO: 4322560 - DNA, 15 bp, Homo sapiens
cgcccgagctgttta

SEQ ID NO: 4322561 - DNA, 12 bp, Homo sapiens
cgccctgcagca

SEQ ID NO: 4322562 - DNA, 13 bp, Homo sapiens
cgcctgttccccc

SEQ ID NO: 4322563 - DNA, 21 bp, Homo sapiens
cgcctgttcccccgccgcttt

SEQ ID NO: 4322564 - DNA, 22 bp, Homo sapiens
cgctacggggaaaatgcatttt

SEQ ID NO: 4322565 - DNA, 13 bp, Homo sapiens
cgctatgtagaat

SEQ ID NO: 4322566 - DNA, 19 bp, Homo sapiens
cgctccccgcctgttcccc

SEQ ID NO: 4322567 - DNA, 16 bp, Homo sapiens
cgctcgatgactgtga

SEQ ID NO: 4322568 - DNA, 15 bp, Homo sapiens
cgctcgtgtgttcta

SEQ ID NO: 4322569 - DNA, 11 bp, Homo sapiens
cgctgcccctg

SEQ ID NO: 4322570 - DNA, 16 bp, Homo sapiens
cgctgccgagtccggg

SEQ ID NO: 4322571 - DNA, 16 bp, Homo sapiens
cgctgccgggagactg

SEQ ID NO: 4322572 - DNA, 20 bp, Homo sapiens
cgctgccgggagactgccag

SEQ ID NO: 4322573 - DNA, 22 bp, Homo sapiens
cgctgttgcccgccctccaccc

SEQ ID NO: 4322574 - DNA, 22 bp, Homo sapiens
cgcttcaaggatatactgcagc

SEQ ID NO: 4322575 - DNA, 14 bp, Homo sapiens
cgcttgcttctgca

SEQ ID NO: 4322576 - DNA, 17 bp, Homo sapiens
cgctttgtctgtccagc

SEQ ID NO: 4322577 - DNA, 23 bp, Homo sapiens
cggaagaaccagaagtgcagccc

SEQ ID NO: 4322578 - DNA, 13 bp, Homo sapiens
cggacaaagttca

SEQ ID NO: 4322579 - DNA, 14 bp, Homo sapiens
cggagacccacagc

SEQ ID NO: 4322580 - DNA, 18 bp, Homo sapiens
cggagacccacagccctg

SEQ ID NO: 4322581 - DNA, 19 bp, Homo sapiens
cggagacccacagccctga

SEQ ID NO: 4322582 - DNA, 15 bp, Homo sapiens
cggaggccccaaagg

SEQ ID NO: 4322583 - DNA, 14 bp, Homo sapiens
cggctgtctcctgt

SEQ ID NO: 4322584 - DNA, 17 bp, Homo sapiens
cggcttcttggaccttg

SEQ ID NO: 4322585 - DNA, 15 bp, Homo sapiens
cggcttggcttggct

SEQ ID NO: 4322586 - DNA, 15 bp, Homo sapiens
cgggaaaattcaaag

SEQ ID NO: 4322587 - DNA, 14 bp, Homo sapiens
cgggactgggggcg

SEQ ID NO: 4322588 - DNA, 22 bp, Homo sapiens
cgggagcattggcccctgagcc

SEQ ID NO: 4322589 - DNA, 17 bp, Homo sapiens
cgggaggtcgaggcagg

SEQ ID NO: 4322590 - DNA, 20 bp, Homo sapiens
cgggaggtcgaggcaggagg

SEQ ID NO: 4322591 - DNA, 14 bp, Homo sapiens
cgggattccctggt

SEQ ID NO: 4322592 - DNA, 16 bp, Homo sapiens
cgggattccctggtgg

SEQ ID NO: 4322593 - DNA, 17 bp, Homo sapiens
cgggcgcccgaagaggg

SEQ ID NO: 4322594 - DNA, 17 bp, Homo sapiens
cgggcgggtggcgctgc

SEQ ID NO: 4322595 - DNA, 15 bp, Homo sapiens
cgggctcagcaaaag

SEQ ID NO: 4322596 - DNA, 17 bp, Homo sapiens
cggggaaaatgcatttt

SEQ ID NO: 4322597 - DNA, 18 bp, Homo sapiens
cggggccgcagccacacc

SEQ ID NO: 4322598 - DNA, 16 bp, Homo sapiens
cgggtgatgagacctg

SEQ ID NO: 4322599 - DNA, 19 bp, Homo sapiens
cgggtgatgagacctgggg

SEQ ID NO: 4322600 - DNA, 16 bp, Homo sapiens
cggtgcagggcctggc

SEQ ID NO: 4322601 - DNA, 17 bp, Homo sapiens
cggtgcagggcctggca

SEQ ID NO: 4322602 - DNA, 23 bp, Homo sapiens
cggttgctaaattataaaattga

SEQ ID NO: 4322603 - DNA, 16 bp, Homo sapiens
cgtaagaccaccttcc

SEQ ID NO: 4322604 - DNA, 13 bp, Homo sapiens
cgtaatgcttaga

SEQ ID NO: 4322605 - DNA, 16 bp, Homo sapiens
cgtatcataatttctt

SEQ ID NO: 4322606 - DNA, 15 bp, Homo sapiens
cgtcccagaggccgc

SEQ ID NO: 4322607 - DNA, 23 bp, Homo sapiens
cgtcccagaggccgctgcccctg

SEQ ID NO: 4322608 - DNA, 14 bp, Homo sapiens
cgtcctggactctg

SEQ ID NO: 4322609 - DNA, 14 bp, Homo sapiens
cgtctggaggggcc

SEQ ID NO: 4322610 - DNA, 21 bp, Homo sapiens
cgtcttgacgggagcattggc

SEQ ID NO: 4322611 - DNA, 14 bp, Homo sapiens
cgtctttacccctg

SEQ ID NO: 4322612 - DNA, 21 bp, Homo sapiens
cgtgactattttttaataaaa

SEQ ID NO: 4322613 - DNA, 23 bp, Homo sapiens
cgtgagacgccaccattcctgga

SEQ ID NO: 4322614 - DNA, 18 bp, Homo sapiens
cgtgcccttgcccttgga

SEQ ID NO: 4322615 - DNA, 14 bp, Homo sapiens
cgtgcttgctggtg

SEQ ID NO: 4322616 - DNA, 15 bp, Homo sapiens
cgtgtgttctatcca

SEQ ID NO: 4322617 - DNA, 20 bp, Homo sapiens
cgttcttacaagcttaaagc

SEQ ID NO: 4322618 - DNA, 16 bp, Homo sapiens
cgttgacccctttccc

SEQ ID NO: 4322619 - DNA, 19 bp, Homo sapiens
cgttgacccctttccccca

SEQ ID NO: 4322620 - DNA, 22 bp, Homo sapiens
cgttgagcgtacgatggaggcc

SEQ ID NO: 4322621 - DNA, 13 bp, Homo sapiens
cgttgtgcctggt

SEQ ID NO: 4322622 - DNA, 12 bp, Homo sapiens
cgtttctgccca

SEQ ID NO: 4322623 - DNA, 18 bp, Homo sapiens
cgtttctgcccagccctc

SEQ ID NO: 4322624 - DNA, 20 bp, Homo sapiens
cgtttctgcccagccctctg

SEQ ID NO: 4322625 - DNA, 19 bp, Homo sapiens
ctaaaagttaagtgtcatt

SEQ ID NO: 4322626 - DNA, 16 bp, Homo sapiens
ctaaaatggacatttt

SEQ ID NO: 4322627 - DNA, 17 bp, Homo sapiens
ctaaaatggacattttc

SEQ ID NO: 4322628 - DNA, 15 bp, Homo sapiens
ctaaagaaactgctt

SEQ ID NO: 4322629 - DNA, 12 bp, Homo sapiens
ctaaagctttat

SEQ ID NO: 4322630 - DNA, 23 bp, Homo sapiens
ctaaatatgaaccctttgtttct

SEQ ID NO: 4322631 - DNA, 17 bp, Homo sapiens
ctaaattataaaattga

SEQ ID NO: 4322632 - DNA, 21 bp, Homo sapiens
ctaaattataaaattgaaaac

SEQ ID NO: 4322633 - DNA, 15 bp, Homo sapiens
ctaacaaaatttgaa

SEQ ID NO: 4322634 - DNA, 16 bp, Homo sapiens
ctaacaaaatttgaat

SEQ ID NO: 4322635 - DNA, 22 bp, Homo sapiens
ctaacaaaatttgaataataaa

SEQ ID NO: 4322636 - DNA, 16 bp, Homo sapiens
ctaactgactctgtta

SEQ ID NO: 4322637 - DNA, 21 bp, Homo sapiens
ctaactgactctgttattgat

SEQ ID NO: 4322638 - DNA, 19 bp, Homo sapiens
ctaagaaatgggactctga

SEQ ID NO: 4322639 - DNA, 16 bp, Homo sapiens
ctaagtacccttgggg

SEQ ID NO: 4322640 - DNA, 23 bp, Homo sapiens
ctaagtttagaagcgctcatctg

SEQ ID NO: 4322641 - DNA, 18 bp, Homo sapiens
ctaatgagttgctggaaa

SEQ ID NO: 4322642 - DNA, 21 bp, Homo sapiens
ctaatgctggcctgactggtt

SEQ ID NO: 4322643 - DNA, 18 bp, Homo sapiens
ctaatggagtgtttgaaa

SEQ ID NO: 4322644 - DNA, 20 bp, Homo sapiens
ctaatggagtgtttgaaaac

SEQ ID NO: 4322645 - DNA, 15 bp, Homo sapiens
ctaatgttggacaga

SEQ ID NO: 4322646 - DNA, 18 bp, Homo sapiens
ctaattcagcatgtgttc

SEQ ID NO: 4322647 - DNA, 20 bp, Homo sapiens
ctaattcatacctccctcct

SEQ ID NO: 4322648 - DNA, 13 bp, Homo sapiens
ctaattcatttat

SEQ ID NO: 4322649 - DNA, 19 bp, Homo sapiens
ctacaaaaagcataaaaat

SEQ ID NO: 4322650 - DNA, 21 bp, Homo sapiens
ctacacatatgtgcttctcag

SEQ ID NO: 4322651 - DNA, 20 bp, Homo sapiens
ctacagagtacgtgaaatgc

SEQ ID NO: 4322652 - DNA, 15 bp, Homo sapiens
ctacagcactactgg

SEQ ID NO: 4322653 - DNA, 20 bp, Homo sapiens
ctacagcactactgggtgtc

SEQ ID NO: 4322654 - DNA, 21 bp, Homo sapiens
ctacagttgaaaaacagctga

SEQ ID NO: 4322655 - DNA, 22 bp, Homo sapiens
ctacagttgaaaaacagctgag

SEQ ID NO: 4322656 - DNA, 13 bp, Homo sapiens
ctacattaaacaa

SEQ ID NO: 4322657 - DNA, 23 bp, Homo sapiens
ctacattattgcttattgcttag

SEQ ID NO: 4322658 - DNA, 18 bp, Homo sapiens
ctaccaatctgggaagat

SEQ ID NO: 4322659 - DNA, 12 bp, Homo sapiens
ctaccccacctg

SEQ ID NO: 4322660 - DNA, 13 bp, Homo sapiens
ctaccccacctga

SEQ ID NO: 4322661 - DNA, 19 bp, Homo sapiens
ctaccccacctgacctctg

SEQ ID NO: 4322662 - DNA, 15 bp, Homo sapiens
ctacctttttatatt

SEQ ID NO: 4322663 - DNA, 15 bp, Homo sapiens
ctacgctatgtagaa

SEQ ID NO: 4322664 - DNA, 18 bp, Homo sapiens
ctacggggaaaatgcatt

SEQ ID NO: 4322665 - DNA, 12 bp, Homo sapiens
ctactctgccca

SEQ ID NO: 4322666 - DNA, 16 bp, Homo sapiens
ctactgacgaaagagt

SEQ ID NO: 4322667 - DNA, 12 bp, Homo sapiens
ctactgctattt

SEQ ID NO: 4322668 - DNA, 13 bp, Homo sapiens
ctactgtacataa

SEQ ID NO: 4322669 - DNA, 19 bp, Homo sapiens
ctagaaattccccaccctg

SEQ ID NO: 4322670 - DNA, 18 bp, Homo sapiens
ctagaggacactaggaga

SEQ ID NO: 4322671 - DNA, 22 bp, Homo sapiens
ctagagggcaggttagagacag

SEQ ID NO: 4322672 - DNA, 22 bp, Homo sapiens
ctagcagcagggagggcttctg

SEQ ID NO: 4322673 - DNA, 18 bp, Homo sapiens
ctagcatttatttctctg

SEQ ID NO: 4322674 - DNA, 23 bp, Homo sapiens
ctgcagggtgaagcaccagggag

SEQ ID NO: 4322675 - DNA, 20 bp, Homo sapiens
ctgcaggtccggggaggagg

SEQ ID NO: 4322676 - DNA, 21 bp, Homo sapiens
ctgcaggtccggggaggaggt

SEQ ID NO: 4322677 - DNA, 23 bp, Homo sapiens
ctgcatgcctggtctttcctctg

SEQ ID NO: 4322678 - DNA, 18 bp, Homo sapiens
ctgcattcattctgagcc

SEQ ID NO: 4322679 - DNA, 21 bp, Homo sapiens
ctgccaaggccggagacccac

SEQ ID NO: 4322680 - DNA, 15 bp, Homo sapiens
ctgccatgccagctt

SEQ ID NO: 4322681 - DNA, 17 bp, Homo sapiens
ctgccatgccagcttat

SEQ ID NO: 4322682 - DNA, 14 bp, Homo sapiens
ctgccatgctctgg

SEQ ID NO: 4322683 - DNA, 15 bp, Homo sapiens
ctgccatttctgaga

SEQ ID NO: 4322684 - DNA, 13 bp, Homo sapiens
ctgcccagtcccc

SEQ ID NO: 4322685 - DNA, 14 bp, Homo sapiens
ctgcccagtccccc

SEQ ID NO: 4322686 - DNA, 18 bp, Homo sapiens
ctgcccagtcccccaacc

SEQ ID NO: 4322687 - DNA, 13 bp, Homo sapiens
ctgccccaagagc

SEQ ID NO: 4322688 - DNA, 16 bp, Homo sapiens
ctgccccagcccaagt

SEQ ID NO: 4322689 - DNA, 20 bp, Homo sapiens
ctgccctcaggctccccagt

SEQ ID NO: 4322690 - DNA, 19 bp, Homo sapiens
ctgccgctttgtctgtcca

SEQ ID NO: 4322691 - DNA, 22 bp, Homo sapiens
ctgccgctttgtctgtccagcc

SEQ ID NO: 4322692 - DNA, 14 bp, Homo sapiens
ctgccgtgcctgtg

SEQ ID NO: 4322693 - DNA, 19 bp, Homo sapiens
ctgcctccaacccagcagt

SEQ ID NO: 4322694 - DNA, 13 bp, Homo sapiens
ctgcctcttctct

SEQ ID NO: 4322695 - DNA, 15 bp, Homo sapiens
ctgcctcttctctac

SEQ ID NO: 4322696 - DNA, 20 bp, Homo sapiens
ctgcctgggatgcccttccc

SEQ ID NO: 4322697 - DNA, 22 bp, Homo sapiens
ctgcctgggatgcccttccccc

SEQ ID NO: 4322698 - DNA, 21 bp, Homo sapiens
ctgccttttaagtttgaaact

SEQ ID NO: 4322699 - DNA, 17 bp, Homo sapiens
ctgcgattttgcctgtg

SEQ ID NO: 4322700 - DNA, 18 bp, Homo sapiens
ctgctaagctaaagaaac

SEQ ID NO: 4322701 - DNA, 11 bp, Homo sapiens
ctgctcccagc

SEQ ID NO: 4322702 - DNA, 12 bp, Homo sapiens
ctgctcccagct

SEQ ID NO: 4322703 - DNA, 20 bp, Homo sapiens
ctgctcccagctctctctcc

SEQ ID NO: 4322704 - DNA, 24 bp, Homo sapiens
ctgctcccagctctctctcctgga

SEQ ID NO: 4322705 - DNA, 19 bp, Homo sapiens
ctgctctcatccattcctc

SEQ ID NO: 4322706 - DNA, 20 bp, Homo sapiens
ctgctctcatccattcctct

SEQ ID NO: 4322707 - DNA, 17 bp, Homo sapiens
ctgctgaaagtcctgct

SEQ ID NO: 4322708 - DNA, 14 bp, Homo sapiens
ctgctgcttggagt

SEQ ID NO: 4322709 - DNA, 19 bp, Homo sapiens
ctgctgcttggagtgcccc

SEQ ID NO: 4322710 - DNA, 15 bp, Homo sapiens
ctgcttctccagcct

SEQ ID NO: 4322711 - DNA, 14 bp, Homo sapiens
ctgcttctctttgt

SEQ ID NO: 4322712 - DNA, 20 bp, Homo sapiens
ctgcttgagctttctgtgca

SEQ ID NO: 4322713 - DNA, 22 bp, Homo sapiens
ctgcttgagctttctgtgcatg

SEQ ID NO: 4322714 - DNA, 20 bp, Homo sapiens
ctgcttgaggcaactcatct

SEQ ID NO: 4322715 - DNA, 21 bp, Homo sapiens
ctgcttgaggcaactcatctt

SEQ ID NO: 4322716 - DNA, 15 bp, Homo sapiens
ctgcttggagtgccc

SEQ ID NO: 4322717 - DNA, 19 bp, Homo sapiens
ctgcttggagtgccccaag

SEQ ID NO: 4322718 - DNA, 23 bp, Homo sapiens
ctggaaacagacagggagaagtt

SEQ ID NO: 4322719 - DNA, 18 bp, Homo sapiens
ctggcacgtggccaggag

SEQ ID NO: 4322720 - DNA, 16 bp, Homo sapiens
ctggcacttgcctgct

SEQ ID NO: 4322721 - DNA, 18 bp, Homo sapiens
ctggcacttgcctgctgc

SEQ ID NO: 4322722 - DNA, 11 bp, Homo sapiens
ctggcagccca

SEQ ID NO: 4322723 - DNA, 13 bp, Homo sapiens
ctggccctcagct

SEQ ID NO: 4322724 - DNA, 14 bp, Homo sapiens
ctggccctcagctc

SEQ ID NO: 4322725 - DNA, 19 bp, Homo sapiens
ctggccctcagctccctga

SEQ ID NO: 4322726 - DNA, 20 bp, Homo sapiens
ctggccctcagctccctgac

SEQ ID NO: 4322727 - DNA, 21 bp, Homo sapiens
ctggccctcagctccctgacc

SEQ ID NO: 4322728 - DNA, 18 bp, Homo sapiens
ctggctggagagctgcta

SEQ ID NO: 4322729 - DNA, 18 bp, Homo sapiens
ctggcttccttctctcaa

SEQ ID NO: 4322730 - DNA, 20 bp, Homo sapiens
ctgggaagatttgaaaacaa

SEQ ID NO: 4322731 - DNA, 21 bp, Homo sapiens
ctgggaagatttgaaaacaaa

SEQ ID NO: 4322732 - DNA, 15 bp, Homo sapiens
ctgggaatacatctg

SEQ ID NO: 4322733 - DNA, 19 bp, Homo sapiens
ctgggaatacatctgtgga

SEQ ID NO: 4322734 - DNA, 16 bp, Homo sapiens
ctgggacctaatgctg

SEQ ID NO: 4322735 - DNA, 18 bp, Homo sapiens
ctgggagacttactgcat

SEQ ID NO: 4322736 - DNA, 18 bp, Homo sapiens
ctgggaggtcaaggctgc

SEQ ID NO: 4322737 - DNA, 19 bp, Homo sapiens
ctgggaggtcaaggctgca

SEQ ID NO: 4322738 - DNA, 19 bp, Homo sapiens
ctgggatgcccttccccct

SEQ ID NO: 4322739 - DNA, 20 bp, Homo sapiens
ctgggatgcccttccccctt

SEQ ID NO: 4322740 - DNA, 23 bp, Homo sapiens
ctgggatggacgctgccgggaga

SEQ ID NO: 4322741 - DNA, 16 bp, Homo sapiens
ctgggcacccctgcct

SEQ ID NO: 4322742 - DNA, 21 bp, Homo sapiens
ctgggcacccctgcctcctgc

SEQ ID NO: 4322743 - DNA, 15 bp, Homo sapiens
ctgggcagggcctgg

SEQ ID NO: 4322744 - DNA, 14 bp, Homo sapiens
ctgggcatctgttc

SEQ ID NO: 4322745 - DNA, 15 bp, Homo sapiens
ctgggcatctgttct

SEQ ID NO: 4322746 - DNA, 18 bp, Homo sapiens
ctgggcatctgttctggt

SEQ ID NO: 4322747 - DNA, 18 bp, Homo sapiens
ctgggcggggccgcagcc

SEQ ID NO: 4322748 - DNA, 23 bp, Homo sapiens
ctgggcggggccgcagccacacc

SEQ ID NO: 4322749 - DNA, 15 bp, Homo sapiens
ctgggggaagaagct

SEQ ID NO: 4322750 - DNA, 15 bp, Homo sapiens
ctgggggcggggcct

SEQ ID NO: 4322751 - DNA, 16 bp, Homo sapiens
ctgggggcggggcctg

SEQ ID NO: 4322752 - DNA, 17 bp, Homo sapiens
ctggggtttagaacccc

SEQ ID NO: 4322753 - DNA, 20 bp, Homo sapiens
ctggggtttagaaccccagg

SEQ ID NO: 4322754 - DNA, 15 bp, Homo sapiens
ctgggtaaatgtggt

SEQ ID NO: 4322755 - DNA, 15 bp, Homo sapiens
ctgggtattggaaat

SEQ ID NO: 4322756 - DNA, 21 bp, Homo sapiens
ctgggtcattacttctgagcc

SEQ ID NO: 4322757 - DNA, 16 bp, Homo sapiens
ctgggtgccaggtgct

SEQ ID NO: 4322758 - DNA, 18 bp, Homo sapiens
ctgggtggcaccagcagc

SEQ ID NO: 4322759 - DNA, 23 bp, Homo sapiens
ctgggtggcaccagcagcctgga

SEQ ID NO: 4322760 - DNA, 20 bp, Homo sapiens
ctgggtgtcatttcattcca

SEQ ID NO: 4322761 - DNA, 14 bp, Homo sapiens
ctggtatattgtgt

SEQ ID NO: 4322762 - DNA, 20 bp, Homo sapiens
ctggtgcccttccctggagg

SEQ ID NO: 4322763 - DNA, 15 bp, Homo sapiens
ctggtggccttgggc

SEQ ID NO: 4322764 - DNA, 13 bp, Homo sapiens
ctggtgggcctcg

SEQ ID NO: 4322765 - DNA, 14 bp, Homo sapiens
ctggttgtcagaat

SEQ ID NO: 4322766 - DNA, 20 bp, Homo sapiens
ctggtttttaaccattgtct

SEQ ID NO: 4322767 - DNA, 19 bp, Homo sapiens
ctgtaatcctagcactttg

SEQ ID NO: 4322768 - DNA, 20 bp, Homo sapiens
ctgtaatcctagcactttgg

SEQ ID NO: 4322769 - DNA, 21 bp, Homo sapiens
ctgtaattaaactagtttaag

SEQ ID NO: 4322770 - DNA, 17 bp, Homo sapiens
ctgtacataaacaatga

SEQ ID NO: 4322771 - DNA, 15 bp, Homo sapiens
ctgtagagtgggagc

SEQ ID NO: 4322772 - DNA, 18 bp, Homo sapiens
ctgtagtttttaattaaa

SEQ ID NO: 4322773 - DNA, 13 bp, Homo sapiens
ctgtatttcagta

SEQ ID NO: 4322774 - DNA, 16 bp, Homo sapiens
ctgtatttcagtattt

SEQ ID NO: 4322775 - DNA, 22 bp, Homo sapiens
ctgtatttctttgtagaataaa

SEQ ID NO: 4322776 - DNA, 15 bp, Homo sapiens
ctgtcagaagacact

SEQ ID NO: 4322777 - DNA, 23 bp, Homo sapiens
ctgtccccggcggggtgcctgct

SEQ ID NO: 4322778 - DNA, 20 bp, Homo sapiens
ctgtcccctcagctccagac

SEQ ID NO: 4322779 - DNA, 19 bp, Homo sapiens
ctgtctccctccccaaatg

SEQ ID NO: 4322780 - DNA, 24 bp, Homo sapiens
ctgtctccctccccaaatggctgc

SEQ ID NO: 4322781 - DNA, 15 bp, Homo sapiens
ctgtctcctgtcccc

SEQ ID NO: 4322782 - DNA, 13 bp, Homo sapiens
ctgtctctctctc

SEQ ID NO: 4322783 - DNA, 18 bp, Homo sapiens
ctgtctctctctcttttt

SEQ ID NO: 4322784 - DNA, 12 bp, Homo sapiens
ctgtctctgcat

SEQ ID NO: 4322785 - DNA, 14 bp, Homo sapiens
ctgtctctgcatct

SEQ ID NO: 4322786 - DNA, 16 bp, Homo sapiens
ctgtctgatcagggtg

SEQ ID NO: 4322787 - DNA, 18 bp, Homo sapiens
ctgtcttcagtaagccgt

SEQ ID NO: 4322788 - DNA, 18 bp, Homo sapiens
ctgtcttgatgactgctg

SEQ ID NO: 4322789 - DNA, 19 bp, Homo sapiens
ctgtcttgatgactgctga

SEQ ID NO: 4322790 - DNA, 17 bp, Homo sapiens
ctgtctttcatctccca

SEQ ID NO: 4322791 - DNA, 15 bp, Homo sapiens
ctgtgaactgggcat

SEQ ID NO: 4322792 - DNA, 14 bp, Homo sapiens
gaactactgctatt

SEQ ID NO: 4322793 - DNA, 14 bp, Homo sapiens
gaactgttcacact

SEQ ID NO: 4322794 - DNA, 17 bp, Homo sapiens
gaactgttcacactgca

SEQ ID NO: 4322795 - DNA, 17 bp, Homo sapiens
gaacttgggccactgtg

SEQ ID NO: 4322796 - DNA, 11 bp, Homo sapiens
gaagaaaagac

SEQ ID NO: 4322797 - DNA, 12 bp, Homo sapiens
gaagacactaat

SEQ ID NO: 4322798 - DNA, 21 bp, Homo sapiens
gaagacactaattccttaaat

SEQ ID NO: 4322799 - DNA, 22 bp, Homo sapiens
gaagacactaattccttaaatg

SEQ ID NO: 4322800 - DNA, 15 bp, Homo sapiens
gaagacccagcagat

SEQ ID NO: 4322801 - DNA, 21 bp, Homo sapiens
gaagaccctttgttgaaaaat

SEQ ID NO: 4322802 - DNA, 17 bp, Homo sapiens
gaagatcacgctccccg

SEQ ID NO: 4322803 - DNA, 15 bp, Homo sapiens
gaagatttgaaaaca

SEQ ID NO: 4322804 - DNA, 17 bp, Homo sapiens
gaagcaaagatttcagt

SEQ ID NO: 4322805 - DNA, 14 bp, Homo sapiens
gaagcaagaagaat

SEQ ID NO: 4322806 - DNA, 15 bp, Homo sapiens
gaagcagaggaagga

SEQ ID NO: 4322807 - DNA, 16 bp, Homo sapiens
gaagcctgcccttgtc

SEQ ID NO: 4322808 - DNA, 14 bp, Homo sapiens
gaagcgctcatctg

SEQ ID NO: 4322809 - DNA, 16 bp, Homo sapiens
gaagctggaagcctgc

SEQ ID NO: 4322810 - DNA, 18 bp, Homo sapiens
gaaggaaacatagaaaga

SEQ ID NO: 4322811 - DNA, 23 bp, Homo sapiens
gaaggaggtcgtttatgtgtgca

SEQ ID NO: 4322812 - DNA, 16 bp, Homo sapiens
gaaggattaatgaaaa

SEQ ID NO: 4322813 - DNA, 21 bp, Homo sapiens
gaagggaacccccaaatttaa

SEQ ID NO: 4322814 - DNA, 16 bp, Homo sapiens
gaagggcattctttcc

SEQ ID NO: 4322815 - DNA, 23 bp, Homo sapiens
gaagggccaatggagaaaatgaa

SEQ ID NO: 4322816 - DNA, 22 bp, Homo sapiens
gaaggggatgggaaataaagaa

SEQ ID NO: 4322817 - DNA, 21 bp, Homo sapiens
gaaggtgggtgaggctgggca

SEQ ID NO: 4322818 - DNA, 19 bp, Homo sapiens
gaagtaaagccattaaatg

SEQ ID NO: 4322819 - DNA, 19 bp, Homo sapiens
gaagtcaaaccttaagata

SEQ ID NO: 4322820 - DNA, 22 bp, Homo sapiens
gaagtgcctgctgggtgccagg

SEQ ID NO: 4322821 - DNA, 20 bp, Homo sapiens
gaagttagagataattctga

SEQ ID NO: 4322822 - DNA, 20 bp, Homo sapiens
gaagtttgagatcagcctgg

SEQ ID NO: 4322823 - DNA, 11 bp, Homo sapiens
gaataaatgtt

SEQ ID NO: 4322824 - DNA, 12 bp, Homo sapiens
gaataaatgttc

SEQ ID NO: 4322825 - DNA, 13 bp, Homo sapiens
gaataaatgttca

SEQ ID NO: 4322826 - DNA, 18 bp, Homo sapiens
gaataaatgttcaaactg

SEQ ID NO: 4322827 - DNA, 21 bp, Homo sapiens
gaatacagaggcaactgcatt

SEQ ID NO: 4322828 - DNA, 16 bp, Homo sapiens
gaatagcctattgtct

SEQ ID NO: 4322829 - DNA, 16 bp, Homo sapiens
gaataggtgcaaacaa

SEQ ID NO: 4322830 - DNA, 17 bp, Homo sapiens
gaatatattactgattt

SEQ ID NO: 4322831 - DNA, 22 bp, Homo sapiens
gaatcatgtctgtatccccagt

SEQ ID NO: 4322832 - DNA, 15 bp, Homo sapiens
gaatgaatacagcat

SEQ ID NO: 4322833 - DNA, 12 bp, Homo sapiens
gaatgagcctgt

SEQ ID NO: 4322834 - DNA, 19 bp, Homo sapiens
gaatgatcatctgtaatct

SEQ ID NO: 4322835 - DNA, 20 bp, Homo sapiens
gaatgatgatcctaggcatt

SEQ ID NO: 4322836 - DNA, 17 bp, Homo sapiens
gaatggaatccatctgt

SEQ ID NO: 4322837 - DNA, 18 bp, Homo sapiens
gaatgtagccctctccaa

SEQ ID NO: 4322838 - DNA, 15 bp, Homo sapiens
gaatgtcttggtgtt

SEQ ID NO: 4322839 - DNA, 14 bp, Homo sapiens
gaattatccattac

SEQ ID NO: 4322840 - DNA, 23 bp, Homo sapiens
gaattatccattacgtgcattta

SEQ ID NO: 4322841 - DNA, 16 bp, Homo sapiens
gaattctttgcattcc

SEQ ID NO: 4322842 - DNA, 18 bp, Homo sapiens
gaattctttgcattcctt

SEQ ID NO: 4322843 - DNA, 14 bp, Homo sapiens
gaattgagaaaaga

SEQ ID NO: 4322844 - DNA, 21 bp, Homo sapiens
gaattgtagttcttagtccca

SEQ ID NO: 4322845 - DNA, 12 bp, Homo sapiens
gaattgtgtgga

SEQ ID NO: 4322846 - DNA, 19 bp, Homo sapiens
gaatttctggaagaaaggc

SEQ ID NO: 4322847 - DNA, 18 bp, Homo sapiens
gacaaaagaaaattttcc

SEQ ID NO: 4322848 - DNA, 12 bp, Homo sapiens
gacaaagaaaat

SEQ ID NO: 4322849 - DNA, 20 bp, Homo sapiens
gacaatcattgttttgaata

SEQ ID NO: 4322850 - DNA, 19 bp, Homo sapiens
gacaatgtgaaaagaaaaa

SEQ ID NO: 4322851 - DNA, 17 bp, Homo sapiens
gacacagcttgtgaatg

SEQ ID NO: 4322852 - DNA, 18 bp, Homo sapiens
gacacagcttgtgaatgt

SEQ ID NO: 4322853 - DNA, 23 bp, Homo sapiens
gacacgctcttctattttattcc

SEQ ID NO: 4322854 - DNA, 16 bp, Homo sapiens
gacactaattccttaa

SEQ ID NO: 4322855 - DNA, 17 bp, Homo sapiens
gacactgttgcaaaggt

SEQ ID NO: 4322856 - DNA, 15 bp, Homo sapiens
gacactttacctctt

SEQ ID NO: 4322857 - DNA, 15 bp, Homo sapiens
gacagcacagatgtg

SEQ ID NO: 4322858 - DNA, 14 bp, Homo sapiens
gacagggagaagtt

SEQ ID NO: 4322859 - DNA, 12 bp, Homo sapiens
gacatagccttt

SEQ ID NO: 4322860 - DNA, 15 bp, Homo sapiens
gacatagcctttgtg

SEQ ID NO: 4322861 - DNA, 16 bp, Homo sapiens
gacatagcctttgtgc

SEQ ID NO: 4322862 - DNA, 12 bp, Homo sapiens
gacatcagattt

SEQ ID NO: 4322863 - DNA, 19 bp, Homo sapiens
gacatcagatttcttaatg

SEQ ID NO: 4322864 - DNA, 23 bp, Homo sapiens
gacatcctagccccacccagagg

SEQ ID NO: 4322865 - DNA, 17 bp, Homo sapiens
gacatctgcctgtaatt

SEQ ID NO: 4322866 - DNA, 20 bp, Homo sapiens
gaccaattattgatatatat

SEQ ID NO: 4322867 - DNA, 13 bp, Homo sapiens
gaccaccttccct

SEQ ID NO: 4322868 - DNA, 17 bp, Homo sapiens
gaccaccttcccttcct

SEQ ID NO: 4322869 - DNA, 14 bp, Homo sapiens
gaccagcccacagc

SEQ ID NO: 4322870 - DNA, 15 bp, Homo sapiens
gaccagcccacagca

SEQ ID NO: 4322871 - DNA, 21 bp, Homo sapiens
gaccattgaaaaaggaaaaat

SEQ ID NO: 4322872 - DNA, 18 bp, Homo sapiens
gaccccctgtcctaggtc

SEQ ID NO: 4322873 - DNA, 16 bp, Homo sapiens
gaccctattgctgctt

SEQ ID NO: 4322874 - DNA, 24 bp, Homo sapiens
gaccctttgttgaaaaatgttgct

SEQ ID NO: 4322875 - DNA, 20 bp, Homo sapiens
gacctcaaatcactgcattc

SEQ ID NO: 4322876 - DNA, 21 bp, Homo sapiens
gacctcaggtgagaagcagag

SEQ ID NO: 4322877 - DNA, 18 bp, Homo sapiens
gacctctgcaagaggggg

SEQ ID NO: 4322878 - DNA, 12 bp, Homo sapiens
gaccttctccct

SEQ ID NO: 4322879 - DNA, 14 bp, Homo sapiens
gacgaaagagtcat

SEQ ID NO: 4322880 - DNA, 16 bp, Homo sapiens
gacgccaccattcctg

SEQ ID NO: 4322881 - DNA, 22 bp, Homo sapiens
gacgctgccgggagactgccag

SEQ ID NO: 4322882 - DNA, 14 bp, Homo sapiens
gacggaatctgccg

SEQ ID NO: 4322883 - DNA, 20 bp, Homo sapiens
gacgggagcattggcccctg

SEQ ID NO: 4322884 - DNA, 15 bp, Homo sapiens
gacgtaggggagggg

SEQ ID NO: 4322885 - DNA, 14 bp, Homo sapiens
gacgtcccttggat

SEQ ID NO: 4322886 - DNA, 21 bp, Homo sapiens
gacgttgttgtcattgtccag

SEQ ID NO: 4322887 - DNA, 14 bp, Homo sapiens
gactaacttgaaaa

SEQ ID NO: 4322888 - DNA, 20 bp, Homo sapiens
gactaatgttggacagacac

SEQ ID NO: 4322889 - DNA, 17 bp, Homo sapiens
gactactcccccaggtg

SEQ ID NO: 4322890 - DNA, 19 bp, Homo sapiens
gactattttttaataaaag

SEQ ID NO: 4322891 - DNA, 17 bp, Homo sapiens
gactcgctcactcccat

SEQ ID NO: 4322892 - DNA, 15 bp, Homo sapiens
gactctcagcccaga

SEQ ID NO: 4322893 - DNA, 16 bp, Homo sapiens
gactctcagcccagaa

SEQ ID NO: 4322894 - DNA, 13 bp, Homo sapiens
gactctgttattg

SEQ ID NO: 4322895 - DNA, 20 bp, Homo sapiens
gactgatggtttggaaaata

SEQ ID NO: 4322896 - DNA, 21 bp, Homo sapiens
gactgatggtttggaaaataa

SEQ ID NO: 4322897 - DNA, 20 bp, Homo sapiens
gactgcaagcatttttccat

SEQ ID NO: 4322898 - DNA, 17 bp, Homo sapiens
gactgccagtggagacg

SEQ ID NO: 4322899 - DNA, 15 bp, Homo sapiens
gactgcccggcaggg

SEQ ID NO: 4322900 - DNA, 17 bp, Homo sapiens
gactgggcacccctgcc

SEQ ID NO: 4322901 - DNA, 18 bp, Homo sapiens
gactgggcacccctgcct

SEQ ID NO: 4322902 - DNA, 15 bp, Homo sapiens
gactggttgtcagaa

SEQ ID NO: 4322903 - DNA, 14 bp, Homo sapiens
gactgtaacttttt

SEQ ID NO: 4322904 - DNA, 14 bp, Homo sapiens
gactgtgtctgaat

SEQ ID NO: 4322905 - DNA, 18 bp, Homo sapiens
gactgttgtacaagctca

SEQ ID NO: 4322906 - DNA, 13 bp, Homo sapiens
gacttactgcatt

SEQ ID NO: 4322907 - DNA, 18 bp, Homo sapiens
gacttgtttctttctgtc

SEQ ID NO: 4322908 - DNA, 15 bp, Homo sapiens
gactttgctgcattt

SEQ ID NO: 4322909 - DNA, 21 bp, Homo sapiens
gactttgctgttactgcttct

SEQ ID NO: 4322910 - DNA, 22 bp, Homo sapiens
gactttgtaccccccaacccct

SEQ ID NO: 4322911 - DNA, 19 bp, Homo sapiens
gcaggcacttattgtaaat

SEQ ID NO: 4322912 - DNA, 13 bp, Homo sapiens
gcagggcctggca

SEQ ID NO: 4322913 - DNA, 14 bp, Homo sapiens
gcagggcctggcat

SEQ ID NO: 4322914 - DNA, 16 bp, Homo sapiens
gcagggcctggcatag

SEQ ID NO: 4322915 - DNA, 19 bp, Homo sapiens
gcagggctggtcacctccc

SEQ ID NO: 4322916 - DNA, 22 bp, Homo sapiens
gcagggctggtcacctcccatc

SEQ ID NO: 4322917 - DNA, 15 bp, Homo sapiens
gcaggttagagacag

SEQ ID NO: 4322918 - DNA, 16 bp, Homo sapiens
gcagtaaaataaaaaa

SEQ ID NO: 4322919 - DNA, 17 bp, Homo sapiens
gcagtcatcaacaaaag

SEQ ID NO: 4322920 - DNA, 13 bp, Homo sapiens
gcataaaattcta

SEQ ID NO: 4322921 - DNA, 18 bp, Homo sapiens
gcataatactaatttatt

SEQ ID NO: 4322922 - DNA, 19 bp, Homo sapiens
gcataatactaatttattg

SEQ ID NO: 4322923 - DNA, 21 bp, Homo sapiens
gcatagagaatacacatataa

SEQ ID NO: 4322924 - DNA, 19 bp, Homo sapiens
gcatatgctacacatatgt

SEQ ID NO: 4322925 - DNA, 22 bp, Homo sapiens
gcatcactgattccctctccca

SEQ ID NO: 4322926 - DNA, 13 bp, Homo sapiens
gcatctgcatggg

SEQ ID NO: 4322927 - DNA, 16 bp, Homo sapiens
gcatgagtctgtttcc

SEQ ID NO: 4322928 - DNA, 18 bp, Homo sapiens
gcatgtttgtctgtgtgc

SEQ ID NO: 4322929 - DNA, 15 bp, Homo sapiens
gcattaactaaatgc

SEQ ID NO: 4322930 - DNA, 20 bp, Homo sapiens
gcattaactaaatgctcata

SEQ ID NO: 4322931 - DNA, 17 bp, Homo sapiens
gcattccttacttgcac

SEQ ID NO: 4322932 - DNA, 18 bp, Homo sapiens
gcattctcggtacttctg

SEQ ID NO: 4322933 - DNA, 11 bp, Homo sapiens
gcattctttcc

SEQ ID NO: 4322934 - DNA, 13 bp, Homo sapiens
gcattctttccca

SEQ ID NO: 4322935 - DNA, 18 bp, Homo sapiens
gcattctttcccagtgag

SEQ ID NO: 4322936 - DNA, 23 bp, Homo sapiens
gcatttgctgaatacagaggcaa

SEQ ID NO: 4322937 - DNA, 14 bp, Homo sapiens
gcattttcttcaga

SEQ ID NO: 4322938 - DNA, 22 bp, Homo sapiens
gcattttgctaaatgtgaatga

SEQ ID NO: 4322939 - DNA, 16 bp, Homo sapiens
gcatttttccatctgt

SEQ ID NO: 4322940 - DNA, 20 bp, Homo sapiens
gccaaaatgtacttaaatga

SEQ ID NO: 4322941 - DNA, 16 bp, Homo sapiens
gccaaaatgttggctg

SEQ ID NO: 4322942 - DNA, 18 bp, Homo sapiens
gccaaacatggccagact

SEQ ID NO: 4322943 - DNA, 20 bp, Homo sapiens
gccaaacatggccagactcc

SEQ ID NO: 4322944 - DNA, 19 bp, Homo sapiens
gccaaagctggctttttgt

SEQ ID NO: 4322945 - DNA, 13 bp, Homo sapiens
gccaacagacact

SEQ ID NO: 4322946 - DNA, 21 bp, Homo sapiens
gccaaggctgggggaagaagc

SEQ ID NO: 4322947 - DNA, 23 bp, Homo sapiens
gccaaggtgggaggattgcttga

SEQ ID NO: 4322948 - DNA, 13 bp, Homo sapiens
gccaagtggccac

SEQ ID NO: 4322949 - DNA, 23 bp, Homo sapiens
gccaagtggccactggcatcgca

SEQ ID NO: 4322950 - DNA, 16 bp, Homo sapiens
gccaataaacctgtaa

SEQ ID NO: 4322951 - DNA, 18 bp, Homo sapiens
gccaatggagaaaatgaa

SEQ ID NO: 4322952 - DNA, 13 bp, Homo sapiens
gccacaggcctcc

SEQ ID NO: 4322953 - DNA, 16 bp, Homo sapiens
gccacaggcctccctg

SEQ ID NO: 4322954 - DNA, 17 bp, Homo sapiens
gccacaggcctccctgt

SEQ ID NO: 4322955 - DNA, 14 bp, Homo sapiens
gccaccattcctgg

SEQ ID NO: 4322956 - DNA, 14 bp, Homo sapiens
gccaccttgttaca

SEQ ID NO: 4322957 - DNA, 16 bp, Homo sapiens
gccactcattcctgta

SEQ ID NO: 4322958 - DNA, 20 bp, Homo sapiens
gccactggcacttgcctgct

SEQ ID NO: 4322959 - DNA, 21 bp, Homo sapiens
gccactggcacttgcctgctg

SEQ ID NO: 4322960 - DNA, 23 bp, Homo sapiens
gccactggcacttgcctgctgct

SEQ ID NO: 4322961 - DNA, 20 bp, Homo sapiens
gccactggcatcgcagcttc

SEQ ID NO: 4322962 - DNA, 22 bp, Homo sapiens
gccacttagacactttacctct

SEQ ID NO: 4322963 - DNA, 15 bp, Homo sapiens
gccagaaaaagaaga

SEQ ID NO: 4322964 - DNA, 19 bp, Homo sapiens
gccagaaaaagaagaagga

SEQ ID NO: 4322965 - DNA, 23 bp, Homo sapiens
gccaggcggacaaagttcagtgt

SEQ ID NO: 4322966 - DNA, 17 bp, Homo sapiens
gccaggggaaaatcagc

SEQ ID NO: 4322967 - DNA, 15 bp, Homo sapiens
gccaggtgctgggaa

SEQ ID NO: 4322968 - DNA, 20 bp, Homo sapiens
gccagtgctaagctgccctg

SEQ ID NO: 4322969 - DNA, 15 bp, Homo sapiens
gccataccttctccc

SEQ ID NO: 4322970 - DNA, 14 bp, Homo sapiens
gccatatatgctgt

SEQ ID NO: 4322971 - DNA, 21 bp, Homo sapiens
gccatcatcagcttaatttaa

SEQ ID NO: 4322972 - DNA, 14 bp, Homo sapiens
gccatgctcctggc

SEQ ID NO: 4322973 - DNA, 12 bp, Homo sapiens
gccatgcttttt

SEQ ID NO: 4322974 - DNA, 16 bp, Homo sapiens
gccatgctttttggtg

SEQ ID NO: 4322975 - DNA, 15 bp, Homo sapiens
gccattaaatgaata

SEQ ID NO: 4322976 - DNA, 21 bp, Homo sapiens
gccattaaatgaatattttga

SEQ ID NO: 4322977 - DNA, 16 bp, Homo sapiens
gccattcctgttctct

SEQ ID NO: 4322978 - DNA, 16 bp, Homo sapiens
gcccaagtccaaatgt

SEQ ID NO: 4322979 - DNA, 18 bp, Homo sapiens
gcccaatggagaaatgaa

SEQ ID NO: 4322980 - DNA, 20 bp, Homo sapiens
gcccacaagccttactcacc

SEQ ID NO: 4322981 - DNA, 22 bp, Homo sapiens
gcccacaagccttactcacctc

SEQ ID NO: 4322982 - DNA, 15 bp, Homo sapiens
gcccacccctcaaca

SEQ ID NO: 4322983 - DNA, 19 bp, Homo sapiens
gcccaccgaggagccccag

SEQ ID NO: 4322984 - DNA, 20 bp, Homo sapiens
gcccaccgaggagccccagc

SEQ ID NO: 4322985 - DNA, 22 bp, Homo sapiens
gcccaccgaggagccccagccc

SEQ ID NO: 4322986 - DNA, 17 bp, Homo sapiens
gcccagccctctgtggc

SEQ ID NO: 4322987 - DNA, 18 bp, Homo sapiens
gcccagccctctgtggcc

SEQ ID NO: 4322988 - DNA, 20 bp, Homo sapiens
gcccagccctctgtggccag

SEQ ID NO: 4322989 - DNA, 17 bp, Homo sapiens
gcccagttggaggagac

SEQ ID NO: 4322990 - DNA, 18 bp, Homo sapiens
gcccagttggaggagact

SEQ ID NO: 4322991 - DNA, 16 bp, Homo sapiens
gccccaatccagagaa

SEQ ID NO: 4322992 - DNA, 15 bp, Homo sapiens
gccccacccagaggt

SEQ ID NO: 4322993 - DNA, 12 bp, Homo sapiens
gccccagcccaa

SEQ ID NO: 4322994 - DNA, 14 bp, Homo sapiens
gccccagcccaagt

SEQ ID NO: 4322995 - DNA, 12 bp, Homo sapiens
gccccagcccca

SEQ ID NO: 4322996 - DNA, 16 bp, Homo sapiens
gcccccacagccctgg

SEQ ID NO: 4322997 - DNA, 19 bp, Homo sapiens
gcccccacagccctggaat

SEQ ID NO: 4322998 - DNA, 23 bp, Homo sapiens
gccccccgaggctaaccctgatc

SEQ ID NO: 4322999 - DNA, 18 bp, Homo sapiens
gccccctccctgctccca

SEQ ID NO: 4323000 - DNA, 20 bp, Homo sapiens
gccccctccctgctcccagc

SEQ ID NO: 4323001 - DNA, 15 bp, Homo sapiens
gcccccttcctgtcc

SEQ ID NO: 4323002 - DNA, 18 bp, Homo sapiens
gccccgccccctccctgc

SEQ ID NO: 4323003 - DNA, 13 bp, Homo sapiens
gccccgtcccaga

SEQ ID NO: 4323004 - DNA, 14 bp, Homo sapiens
gccccgtcccagag

SEQ ID NO: 4323005 - DNA, 15 bp, Homo sapiens
gccccgtcccagagg

SEQ ID NO: 4323006 - DNA, 16 bp, Homo sapiens
gcccctcatgccacag

SEQ ID NO: 4323007 - DNA, 16 bp, Homo sapiens
gcccctgagcccagag

SEQ ID NO: 4323008 - DNA, 20 bp, Homo sapiens
gcccctgccccagcccaagt

SEQ ID NO: 4323009 - DNA, 21 bp, Homo sapiens
gcccctgccccagcccaagtc

SEQ ID NO: 4323010 - DNA, 19 bp, Homo sapiens
gcccctgcttctccagcct

SEQ ID NO: 4323011 - DNA, 23 bp, Homo sapiens
gcccggaagaaccagaagtgcag

SEQ ID NO: 4323012 - DNA, 17 bp, Homo sapiens
gcccggtgcagggcctg

SEQ ID NO: 4323013 - DNA, 20 bp, Homo sapiens
gcccggtgcagggcctggca

SEQ ID NO: 4323014 - DNA, 18 bp, Homo sapiens
gccctactgaagggaaca

SEQ ID NO: 4323015 - DNA, 17 bp, Homo sapiens
gccctcagctccctgac

SEQ ID NO: 4323016 - DNA, 13 bp, Homo sapiens
gccctccacccac

SEQ ID NO: 4323017 - DNA, 14 bp, Homo sapiens
gccctcccaggctg

SEQ ID NO: 4323018 - DNA, 15 bp, Homo sapiens
gccctctgtggccag

SEQ ID NO: 4323019 - DNA, 17 bp, Homo sapiens
gccctctgtggccagga

SEQ ID NO: 4323020 - DNA, 17 bp, Homo sapiens
gccctgcagcagaacct

SEQ ID NO: 4323021 - DNA, 19 bp, Homo sapiens
gccctgttgggggcttcag

SEQ ID NO: 4323022 - DNA, 22 bp, Homo sapiens
gcccttccccctttctctgcct

SEQ ID NO: 4323023 - DNA, 24 bp, Homo sapiens
gcccttccccctttctctgcctgg

SEQ ID NO: 4323024 - DNA, 16 bp, Homo sapiens
gcccttcctccctgtc

SEQ ID NO: 4323025 - DNA, 17 bp, Homo sapiens
gcccttctaccccacct

SEQ ID NO: 4323026 - DNA, 22 bp, Homo sapiens
gcccttctaccccacctgacct

SEQ ID NO: 4323027 - DNA, 12 bp, Homo sapiens
gcccttctgccc

SEQ ID NO: 4323028 - DNA, 14 bp, Homo sapiens
gcccttctgccctt

SEQ ID NO: 4323029 - DNA, 21 bp, Homo sapiens
ggagtgccccaaggaggtggc

SEQ ID NO: 4323030 - DNA, 16 bp, Homo sapiens
ggagtgtttgaaaact

SEQ ID NO: 4323031 - DNA, 16 bp, Homo sapiens
ggatatgattggttca

SEQ ID NO: 4323032 - DNA, 15 bp, Homo sapiens
ggatcaacaatgatt

SEQ ID NO: 4323033 - DNA, 19 bp, Homo sapiens
ggatcaccccagcccccac

SEQ ID NO: 4323034 - DNA, 12 bp, Homo sapiens
ggatgccctgtt

SEQ ID NO: 4323035 - DNA, 22 bp, Homo sapiens
ggatggacgctgccgggagact

SEQ ID NO: 4323036 - DNA, 21 bp, Homo sapiens
ggatggagcccagttggaaaa

SEQ ID NO: 4323037 - DNA, 14 bp, Homo sapiens
ggatgtacatctct

SEQ ID NO: 4323038 - DNA, 16 bp, Homo sapiens
ggatgtgaagaaataa

SEQ ID NO: 4323039 - DNA, 12 bp, Homo sapiens
ggattaatgaaa

SEQ ID NO: 4323040 - DNA, 13 bp, Homo sapiens
ggattaatgaaaa

SEQ ID NO: 4323041 - DNA, 14 bp, Homo sapiens
ggattccctggtgg

SEQ ID NO: 4323042 - DNA, 19 bp, Homo sapiens
ggcaacatcttacttgtcc

SEQ ID NO: 4323043 - DNA, 19 bp, Homo sapiens
ggcaactgcattggctttg

SEQ ID NO: 4323044 - DNA, 19 bp, Homo sapiens
ggcaattccaatatttctg

SEQ ID NO: 4323045 - DNA, 12 bp, Homo sapiens
ggcaattggaac

SEQ ID NO: 4323046 - DNA, 14 bp, Homo sapiens
ggcacgtggccagg

SEQ ID NO: 4323047 - DNA, 15 bp, Homo sapiens
ggcacgtggccagga

SEQ ID NO: 4323048 - DNA, 18 bp, Homo sapiens
ggcacgtggccaggagcc

SEQ ID NO: 4323049 - DNA, 16 bp, Homo sapiens
ggcacttgcctgctgc

SEQ ID NO: 4323050 - DNA, 19 bp, Homo sapiens
ggcagaaagatttggaaaa

SEQ ID NO: 4323051 - DNA, 21 bp, Homo sapiens
ggcagaaagatttggaaaatt

SEQ ID NO: 4323052 - DNA, 22 bp, Homo sapiens
ggcagaaatagttgtctgtgct

SEQ ID NO: 4323053 - DNA, 20 bp, Homo sapiens
ggcagagccaccagggcact

SEQ ID NO: 4323054 - DNA, 16 bp, Homo sapiens
ggcagcaacagcagag

SEQ ID NO: 4323055 - DNA, 20 bp, Homo sapiens
ggcagcctttttctggcctt

SEQ ID NO: 4323056 - DNA, 15 bp, Homo sapiens
ggcaggttggtgggg

SEQ ID NO: 4323057 - DNA, 17 bp, Homo sapiens
ggcaggttggtgggggc

SEQ ID NO: 4323058 - DNA, 20 bp, Homo sapiens
ggcagtgagtgccatgcttt

SEQ ID NO: 4323059 - DNA, 13 bp, Homo sapiens
ggcatgagtctgt

SEQ ID NO: 4323060 - DNA, 17 bp, Homo sapiens
ggccaaacatggccaga

SEQ ID NO: 4323061 - DNA, 22 bp, Homo sapiens
ggccaaacatggccagactccc

SEQ ID NO: 4323062 - DNA, 17 bp, Homo sapiens
ggccaatggagaaaatg

SEQ ID NO: 4323063 - DNA, 19 bp, Homo sapiens
ggccacatccccaccccag

SEQ ID NO: 4323064 - DNA, 23 bp, Homo sapiens
ggccactggcacttgcctgctgc

SEQ ID NO: 4323065 - DNA, 13 bp, Homo sapiens
ggccagaaaaaga

SEQ ID NO: 4323066 - DNA, 16 bp, Homo sapiens
ggccaggagccctggc

SEQ ID NO: 4323067 - DNA, 20 bp, Homo sapiens
ggccatatatgctgtatttc

SEQ ID NO: 4323068 - DNA, 20 bp, Homo sapiens
ggccatggtacccccttctg

SEQ ID NO: 4323069 - DNA, 20 bp, Homo sapiens
ggcccctgcttctccagcct

SEQ ID NO: 4323070 - DNA, 16 bp, Homo sapiens
ggcccctggcccagag

SEQ ID NO: 4323071 - DNA, 23 bp, Homo sapiens
ggcccgcaagagggacagagccc

SEQ ID NO: 4323072 - DNA, 18 bp, Homo sapiens
ggccctcagctccctgac

SEQ ID NO: 4323073 - DNA, 12 bp, Homo sapiens
ggccctcccagg

SEQ ID NO: 4323074 - DNA, 20 bp, Homo sapiens
ggccgaggaatgtgaagcca

SEQ ID NO: 4323075 - DNA, 19 bp, Homo sapiens
ggccgatggggaaggagaa

SEQ ID NO: 4323076 - DNA, 12 bp, Homo sapiens
ggccgggactgg

SEQ ID NO: 4323077 - DNA, 15 bp, Homo sapiens
ggccgtgcccttgcc

SEQ ID NO: 4323078 - DNA, 22 bp, Homo sapiens
ggcctacctctcgtttctgccc

SEQ ID NO: 4323079 - DNA, 23 bp, Homo sapiens
ggcctatgtgcgaagcaagaaga

SEQ ID NO: 4323080 - DNA, 19 bp, Homo sapiens
ggcctcgacgtcccttgga

SEQ ID NO: 4323081 - DNA, 18 bp, Homo sapiens
ggcctcggctgtctcctg

SEQ ID NO: 4323082 - DNA, 20 bp, Homo sapiens
ggcctgggcggggccgcagc

SEQ ID NO: 4323083 - DNA, 20 bp, Homo sapiens
ggccttgggccttggggctc

SEQ ID NO: 4323084 - DNA, 14 bp, Homo sapiens
ggcctttggcttca

SEQ ID NO: 4323085 - DNA, 12 bp, Homo sapiens
ggcgaataaatg

SEQ ID NO: 4323086 - DNA, 15 bp, Homo sapiens
ggcgcggtggctcac

SEQ ID NO: 4323087 - DNA, 16 bp, Homo sapiens
ggcggggtgcctgctg

SEQ ID NO: 4323088 - DNA, 21 bp, Homo sapiens
ggctaatggagtgtttgaaaa

SEQ ID NO: 4323089 - DNA, 18 bp, Homo sapiens
ggctatcagggaggaaga

SEQ ID NO: 4323090 - DNA, 15 bp, Homo sapiens
ggctcagcagggctg

SEQ ID NO: 4323091 - DNA, 16 bp, Homo sapiens
ggctcagcagggctgg

SEQ ID NO: 4323092 - DNA, 19 bp, Homo sapiens
ggctcagcagggctggtca

SEQ ID NO: 4323093 - DNA, 17 bp, Homo sapiens
ggctctgaaataaaaat

SEQ ID NO: 4323094 - DNA, 15 bp, Homo sapiens
ggctctgtccccctg

SEQ ID NO: 4323095 - DNA, 17 bp, Homo sapiens
ggctgctacccagaacc

SEQ ID NO: 4323096 - DNA, 14 bp, Homo sapiens
ggctggtggccttg

SEQ ID NO: 4323097 - DNA, 13 bp, Homo sapiens
ggctgtctcctgt

SEQ ID NO: 4323098 - DNA, 15 bp, Homo sapiens
ggctgtctcctgtcc

SEQ ID NO: 4323099 - DNA, 17 bp, Homo sapiens
ggctgttaaccacccgc

SEQ ID NO: 4323100 - DNA, 21 bp, Homo sapiens
ggcttaagtaccaatctctgc

SEQ ID NO: 4323101 - DNA, 19 bp, Homo sapiens
ggcttcgttagaccgctct

SEQ ID NO: 4323102 - DNA, 22 bp, Homo sapiens
ggcttttcgcttgcttctgcag

SEQ ID NO: 4323103 - DNA, 23 bp, Homo sapiens
gggaaaatcagcctgctccagct

SEQ ID NO: 4323104 - DNA, 15 bp, Homo sapiens
gggaaaatgcatttt

SEQ ID NO: 4323105 - DNA, 15 bp, Homo sapiens
gggaaatgagccagc

SEQ ID NO: 4323106 - DNA, 15 bp, Homo sapiens
gggaacagcctgagc

SEQ ID NO: 4323107 - DNA, 16 bp, Homo sapiens
gggaacagcctgagcc

SEQ ID NO: 4323108 - DNA, 12 bp, Homo sapiens
gggaaggtgggt

SEQ ID NO: 4323109 - DNA, 20 bp, Homo sapiens
gggaattttccccgtgacat

SEQ ID NO: 4323110 - DNA, 18 bp, Homo sapiens
gggacagatttgaggact

SEQ ID NO: 4323111 - DNA, 17 bp, Homo sapiens
gggagcctcctgcccag

SEQ ID NO: 4323112 - DNA, 22 bp, Homo sapiens
gggaggagatttttttttttca

SEQ ID NO: 4323113 - DNA, 23 bp, Homo sapiens
gggaggatctcttgagcctggga

SEQ ID NO: 4323114 - DNA, 19 bp, Homo sapiens
gggaggccaaggtgggagg

SEQ ID NO: 4323115 - DNA, 19 bp, Homo sapiens
gggaggggttgccacaggc

SEQ ID NO: 4323116 - DNA, 21 bp, Homo sapiens
gggatatgatttaaatcagcc

SEQ ID NO: 4323117 - DNA, 15 bp, Homo sapiens
gggatgcccttcccc

SEQ ID NO: 4323118 - DNA, 14 bp, Homo sapiens
gggatgggccaccg

SEQ ID NO: 4323119 - DNA, 17 bp, Homo sapiens
gggatgtacatctctcc

SEQ ID NO: 4323120 - DNA, 15 bp, Homo sapiens
gggatgtgaagaaat

SEQ ID NO: 4323121 - DNA, 19 bp, Homo sapiens
gggattccctggtgggcct

SEQ ID NO: 4323122 - DNA, 13 bp, Homo sapiens
gggattgccacta

SEQ ID NO: 4323123 - DNA, 21 bp, Homo sapiens
gggcaagaagatcacgctccc

SEQ ID NO: 4323124 - DNA, 17 bp, Homo sapiens
gggcaattggaacaaag

SEQ ID NO: 4323125 - DNA, 13 bp, Homo sapiens
gggcacagggtct

SEQ ID NO: 4323126 - DNA, 22 bp, Homo sapiens
gggcacatgctgagtctcccaa

SEQ ID NO: 4323127 - DNA, 14 bp, Homo sapiens
gggcacccctgcct

SEQ ID NO: 4323128 - DNA, 13 bp, Homo sapiens
gggcagagccacc

SEQ ID NO: 4323129 - DNA, 22 bp, Homo sapiens
gggcagggaaggaatcctggtg

SEQ ID NO: 4323130 - DNA, 17 bp, Homo sapiens
gggcaggttggtggggg

SEQ ID NO: 4323131 - DNA, 23 bp, Homo sapiens
gggcatgtttgtctgtgtgctgt

SEQ ID NO: 4323132 - DNA, 19 bp, Homo sapiens
gggcccctgcttctccagc

SEQ ID NO: 4323133 - DNA, 21 bp, Homo sapiens
gggcccctgcttctccagcct

SEQ ID NO: 4323134 - DNA, 15 bp, Homo sapiens
gggcccctggcccag

SEQ ID NO: 4323135 - DNA, 22 bp, Homo sapiens
gggccgaggaatgtgaagccag

SEQ ID NO: 4323136 - DNA, 14 bp, Homo sapiens
gggcctggcggagg

SEQ ID NO: 4323137 - DNA, 15 bp, Homo sapiens
gggcctggcggaggt

SEQ ID NO: 4323138 - DNA, 15 bp, Homo sapiens
gggcctgggcggggc

SEQ ID NO: 4323139 - DNA, 18 bp, Homo sapiens
gggcggggccgggactgg

SEQ ID NO: 4323140 - DNA, 21 bp, Homo sapiens
gggctattgggccctagagga

SEQ ID NO: 4323141 - DNA, 10 bp, Homo sapiens
gggctcagca

SEQ ID NO: 4323142 - DNA, 17 bp, Homo sapiens
gggcttcaggtctctgt

SEQ ID NO: 4323143 - DNA, 15 bp, Homo sapiens
ggggaaaatgcattt

SEQ ID NO: 4323144 - DNA, 23 bp, Homo sapiens
ggggatgggaaataaagaaaatt

SEQ ID NO: 4323145 - DNA, 21 bp, Homo sapiens
ggggcacatgctgagtctccc

SEQ ID NO: 4323146 - DNA, 17 bp, Homo sapiens
ggggcctgggcggggcc

SEQ ID NO: 4323147 - DNA, 17 bp, Homo sapiens
taaagaaacttttgaaa

SEQ ID NO: 4323148 - DNA, 23 bp, Homo sapiens
taaagaaggaggtcgtttatgtg

SEQ ID NO: 4323149 - DNA, 18 bp, Homo sapiens
taaagaggcttccaagca

SEQ ID NO: 4323150 - DNA, 17 bp, Homo sapiens
taaagatatggagaatt

SEQ ID NO: 4323151 - DNA, 20 bp, Homo sapiens
taaagatatggagaattgct

SEQ ID NO: 4323152 - DNA, 20 bp, Homo sapiens
taaagattagggaaaatgga

SEQ ID NO: 4323153 - DNA, 20 bp, Homo sapiens
taaagcagtaaaataaaaaa

SEQ ID NO: 4323154 - DNA, 17 bp, Homo sapiens
taaagcttatttttatg

SEQ ID NO: 4323155 - DNA, 16 bp, Homo sapiens
taaagctttatctttg

SEQ ID NO: 4323156 - DNA, 15 bp, Homo sapiens
taaagggagaaatgc

SEQ ID NO: 4323157 - DNA, 16 bp, Homo sapiens
taaagtaacagtatgt

SEQ ID NO: 4323158 - DNA, 14 bp, Homo sapiens
taaagttgaaaata

SEQ ID NO: 4323159 - DNA, 16 bp, Homo sapiens
taaagttgaaaataca

SEQ ID NO: 4323160 - DNA, 13 bp, Homo sapiens
taaataaaatgga

SEQ ID NO: 4323161 - DNA, 20 bp, Homo sapiens
taaataaaatggatagaaaa

SEQ ID NO: 4323162 - DNA, 16 bp, Homo sapiens
taaataaatagaaaga

SEQ ID NO: 4323163 - DNA, 18 bp, Homo sapiens
taaatatgaaccctttgt

SEQ ID NO: 4323164 - DNA, 19 bp, Homo sapiens
taaatcagccgtgtaacca

SEQ ID NO: 4323165 - DNA, 21 bp, Homo sapiens
taaatcatttggttaaatcat

SEQ ID NO: 4323166 - DNA, 15 bp, Homo sapiens
taaatctggggaaga

SEQ ID NO: 4323167 - DNA, 13 bp, Homo sapiens
taaatgaaagaaa

SEQ ID NO: 4323168 - DNA, 16 bp, Homo sapiens
taaatgaatattttga

SEQ ID NO: 4323169 - DNA, 14 bp, Homo sapiens
taaatgactattgt

SEQ ID NO: 4323170 - DNA, 23 bp, Homo sapiens
taaatgagggtttctgatctgta

SEQ ID NO: 4323171 - DNA, 15 bp, Homo sapiens
taaatgagttactta

SEQ ID NO: 4323172 - DNA, 11 bp, Homo sapiens
taaatgttcaa

SEQ ID NO: 4323173 - DNA, 12 bp, Homo sapiens
taaatgttcaaa

SEQ ID NO: 4323174 - DNA, 13 bp, Homo sapiens
taaattaaataaa

SEQ ID NO: 4323175 - DNA, 20 bp, Homo sapiens
taaattataaaattgaaaac

SEQ ID NO: 4323176 - DNA, 15 bp, Homo sapiens
taaattggtcatggt

SEQ ID NO: 4323177 - DNA, 16 bp, Homo sapiens
taacaaaatttgaata

SEQ ID NO: 4323178 - DNA, 16 bp, Homo sapiens
taacagagaaatagag

SEQ ID NO: 4323179 - DNA, 22 bp, Homo sapiens
taacagctccatacttctttca

SEQ ID NO: 4323180 - DNA, 20 bp, Homo sapiens
taaccattgtcttgttctgt

SEQ ID NO: 4323181 - DNA, 19 bp, Homo sapiens
taacctccctcaacaaggt

SEQ ID NO: 4323182 - DNA, 13 bp, Homo sapiens
taactaaatgctc

SEQ ID NO: 4323183 - DNA, 15 bp, Homo sapiens
taactacatctgcct

SEQ ID NO: 4323184 - DNA, 16 bp, Homo sapiens
taactacatctgcctc

SEQ ID NO: 4323185 - DNA, 17 bp, Homo sapiens
taactattttgttttaa

SEQ ID NO: 4323186 - DNA, 18 bp, Homo sapiens
taactattttgttttaat

SEQ ID NO: 4323187 - DNA, 17 bp, Homo sapiens
taactgactctgttatt

SEQ ID NO: 4323188 - DNA, 14 bp, Homo sapiens
taactgggaagaac

SEQ ID NO: 4323189 - DNA, 17 bp, Homo sapiens
taacttgaaaagaaaac

SEQ ID NO: 4323190 - DNA, 16 bp, Homo sapiens
taactttttttcagtt

SEQ ID NO: 4323191 - DNA, 20 bp, Homo sapiens
taagaaagccaccttgttac

SEQ ID NO: 4323192 - DNA, 21 bp, Homo sapiens
taagaaagccaccttgttaca

SEQ ID NO: 4323193 - DNA, 22 bp, Homo sapiens
taagaaagccaccttgttacaa

SEQ ID NO: 4323194 - DNA, 12 bp, Homo sapiens
taagaactgaat

SEQ ID NO: 4323195 - DNA, 16 bp, Homo sapiens
taagaatgagcctgtc

SEQ ID NO: 4323196 - DNA, 18 bp, Homo sapiens
taagactcattccctaga

SEQ ID NO: 4323197 - DNA, 22 bp, Homo sapiens
taagagaaaccttgcaaactct

SEQ ID NO: 4323198 - DNA, 20 bp, Homo sapiens
taagccatcatcagcttaat

SEQ ID NO: 4323199 - DNA, 22 bp, Homo sapiens
taagctgttactgtcttcagta

SEQ ID NO: 4323200 - DNA, 18 bp, Homo sapiens
taagggtggaaaaatgcc

SEQ ID NO: 4323201 - DNA, 16 bp, Homo sapiens
taagtctacattaaac

SEQ ID NO: 4323202 - DNA, 19 bp, Homo sapiens
taataaaagtactgaagac

SEQ ID NO: 4323203 - DNA, 14 bp, Homo sapiens
taataaagcattct

SEQ ID NO: 4323204 - DNA, 21 bp, Homo sapiens
taatagaatatactgtcttgt

SEQ ID NO: 4323205 - DNA, 13 bp, Homo sapiens
taataggaattca

SEQ ID NO: 4323206 - DNA, 15 bp, Homo sapiens
taatatcctgtaata

SEQ ID NO: 4323207 - DNA, 18 bp, Homo sapiens
taatcatgctcatgtata

SEQ ID NO: 4323208 - DNA, 20 bp, Homo sapiens
taatctaagtatatgtgaga

SEQ ID NO: 4323209 - DNA, 20 bp, Homo sapiens
taatctactttttgtattta

SEQ ID NO: 4323210 - DNA, 12 bp, Homo sapiens
taatctatatta

SEQ ID NO: 4323211 - DNA, 15 bp, Homo sapiens
taatctatattaaat

SEQ ID NO: 4323212 - DNA, 18 bp, Homo sapiens
taatctatattaaatgag

SEQ ID NO: 4323213 - DNA, 21 bp, Homo sapiens
taatctgcaaagaatgagaag

SEQ ID NO: 4323214 - DNA, 19 bp, Homo sapiens
taatctgcctggttttatt

SEQ ID NO: 4323215 - DNA, 17 bp, Homo sapiens
taatgaagtcactattt

SEQ ID NO: 4323216 - DNA, 18 bp, Homo sapiens
taatgagttgctggaaaa

SEQ ID NO: 4323217 - DNA, 14 bp, Homo sapiens
taatgatgtaacag

SEQ ID NO: 4323218 - DNA, 18 bp, Homo sapiens
taatgccaatatgacaca

SEQ ID NO: 4323219 - DNA, 21 bp, Homo sapiens
taatgctattttaaaaaatat

SEQ ID NO: 4323220 - DNA, 19 bp, Homo sapiens
taatgcttagagaatgttc

SEQ ID NO: 4323221 - DNA, 16 bp, Homo sapiens
taatgctttctgagtg

SEQ ID NO: 4323222 - DNA, 15 bp, Homo sapiens
taatggagtgtttga

SEQ ID NO: 4323223 - DNA, 18 bp, Homo sapiens
taatggagtgtttgaaaa

SEQ ID NO: 4323224 - DNA, 15 bp, Homo sapiens
taatggcatggagac

SEQ ID NO: 4323225 - DNA, 16 bp, Homo sapiens
taatggccatggtacc

SEQ ID NO: 4323226 - DNA, 21 bp, Homo sapiens
taatggccatggtaccccctt

SEQ ID NO: 4323227 - DNA, 11 bp, Homo sapiens
taatgtagaaa

SEQ ID NO: 4323228 - DNA, 14 bp, Homo sapiens
taatgtgtctgtgt

SEQ ID NO: 4323229 - DNA, 19 bp, Homo sapiens
taatgttctaaattctata

SEQ ID NO: 4323230 - DNA, 18 bp, Homo sapiens
taattaaactagtttaag

SEQ ID NO: 4323231 - DNA, 22 bp, Homo sapiens
taattacttttgaaccatgtat

SEQ ID NO: 4323232 - DNA, 15 bp, Homo sapiens
taattccttaaatga

SEQ ID NO: 4323233 - DNA, 16 bp, Homo sapiens
taattccttaaatgaa

SEQ ID NO: 4323234 - DNA, 23 bp, Homo sapiens
taattgatcagatgctgaattga

SEQ ID NO: 4323235 - DNA, 20 bp, Homo sapiens
taatttagagcgtttggtta

SEQ ID NO: 4323236 - DNA, 22 bp, Homo sapiens
taatttgaaaacataatctgca

SEQ ID NO: 4323237 - DNA, 17 bp, Homo sapiens
taatttgtcttagttga

SEQ ID NO: 4323238 - DNA, 15 bp, Homo sapiens
tacaaaaagcataaa

SEQ ID NO: 4323239 - DNA, 20 bp, Homo sapiens
tacaaaaagcataaaaatta

SEQ ID NO: 4323240 - DNA, 17 bp, Homo sapiens
tacaaagcgtgcacaag

SEQ ID NO: 4323241 - DNA, 14 bp, Homo sapiens
tacaaattctactt

SEQ ID NO: 4323242 - DNA, 14 bp, Homo sapiens
tacaagcagttaat

SEQ ID NO: 4323243 - DNA, 15 bp, Homo sapiens
tacaatcgacatcct

SEQ ID NO: 4323244 - DNA, 15 bp, Homo sapiens
tacaatggcctttat

SEQ ID NO: 4323245 - DNA, 17 bp, Homo sapiens
tacaatgtgtttttctc

SEQ ID NO: 4323246 - DNA, 21 bp, Homo sapiens
tacaatgtgtttttctccagt

SEQ ID NO: 4323247 - DNA, 17 bp, Homo sapiens
tacacaactttgcaaat

SEQ ID NO: 4323248 - DNA, 20 bp, Homo sapiens
tacacaagagggactgtatt

SEQ ID NO: 4323249 - DNA, 18 bp, Homo sapiens
tacacaaggccagaaaaa

SEQ ID NO: 4323250 - DNA, 23 bp, Homo sapiens
tacacaaggccagaaaaagaaga

SEQ ID NO: 4323251 - DNA, 16 bp, Homo sapiens
tacacatataaaaaca

SEQ ID NO: 4323252 - DNA, 17 bp, Homo sapiens
tacacatatgtgcttct

SEQ ID NO: 4323253 - DNA, 20 bp, Homo sapiens
tacacatatgtgcttctcag

SEQ ID NO: 4323254 - DNA, 21 bp, Homo sapiens
tacacatatgtgcttctcagt

SEQ ID NO: 4323255 - DNA, 23 bp, Homo sapiens
tacacgtgcgtgtgagtgtgtgt

SEQ ID NO: 4323256 - DNA, 17 bp, Homo sapiens
tacagcactactgggtg

SEQ ID NO: 4323257 - DNA, 23 bp, Homo sapiens
tacagcactactgggtgtcattt

SEQ ID NO: 4323258 - DNA, 17 bp, Homo sapiens
tacagggagcctcctgc

SEQ ID NO: 4323259 - DNA, 21 bp, Homo sapiens
tacagggagcctcctgcccag

SEQ ID NO: 4323260 - DNA, 22 bp, Homo sapiens
tacagtaaagaggcttccaagc

SEQ ID NO: 4323261 - DNA, 15 bp, Homo sapiens
tacagtatctcaggg

SEQ ID NO: 4323262 - DNA, 17 bp, Homo sapiens
tacagttgaaaaacagc

SEQ ID NO: 4323263 - DNA, 22 bp, Homo sapiens
tacagtttattttctgtgtaaa

SEQ ID NO: 4323264 - DNA, 17 bp, Homo sapiens
tacataaagtcatcaaa

SEQ ID NO: 4323265 - DNA, 13 bp, Homo sapiens
tacatacatacaa

SEQ ID NO: 4323266 - DNA, 19 bp, Homo sapiens
tacatctgatgcatgcttt

SEQ ID NO: 4323267 - DNA, 15 bp, Homo sapiens
tacatgaagaatgta

SEQ ID NO: 4323268 - DNA, 15 bp, Homo sapiens
tacattaaacaatga

SEQ ID NO: 4323269 - DNA, 12 bp, Homo sapiens
taccagaagcaa

SEQ ID NO: 4323270 - DNA, 22 bp, Homo sapiens
taccagtctgattataccatgt

SEQ ID NO: 4323271 - DNA, 21 bp, Homo sapiens
taccatttgctactgtacata

SEQ ID NO: 4323272 - DNA, 16 bp, Homo sapiens
tacccagaaccttttt

SEQ ID NO: 4323273 - DNA, 15 bp, Homo sapiens
taccccacctgacct

SEQ ID NO: 4323274 - DNA, 17 bp, Homo sapiens
tacccccttctgggcat

SEQ ID NO: 4323275 - DNA, 13 bp, Homo sapiens
taccctctccagg

SEQ ID NO: 4323276 - DNA, 20 bp, Homo sapiens
taccctgcgattttgcctgt

SEQ ID NO: 4323277 - DNA, 16 bp, Homo sapiens
tacctattaaaggaaa

SEQ ID NO: 4323278 - DNA, 19 bp, Homo sapiens
tacctccctcctgatgttt

SEQ ID NO: 4323279 - DNA, 20 bp, Homo sapiens
tacctcctaatggcatggag

SEQ ID NO: 4323280 - DNA, 18 bp, Homo sapiens
tacctctcgtttctgccc

SEQ ID NO: 4323281 - DNA, 19 bp, Homo sapiens
tacctctcgtttctgccca

SEQ ID NO: 4323282 - DNA, 16 bp, Homo sapiens
tacctgccttttaagt

SEQ ID NO: 4323283 - DNA, 17 bp, Homo sapiens
tacctgccttttaagtt

SEQ ID NO: 4323284 - DNA, 20 bp, Homo sapiens
tacctgccttttaagtttga

SEQ ID NO: 4323285 - DNA, 15 bp, Homo sapiens
taccttctcccaggc

SEQ ID NO: 4323286 - DNA, 16 bp, Homo sapiens
taccttctcccaggcc

SEQ ID NO: 4323287 - DNA, 17 bp, Homo sapiens
taccttctcccaggcct

SEQ ID NO: 4323288 - DNA, 15 bp, Homo sapiens
tacgataaagtaaca

SEQ ID NO: 4323289 - DNA, 15 bp, Homo sapiens
tacgatggaggccta

SEQ ID NO: 4323290 - DNA, 20 bp, Homo sapiens
tacgatggaggcctacctct

SEQ ID NO: 4323291 - DNA, 18 bp, Homo sapiens
tacggggaaaatgcattt

SEQ ID NO: 4323292 - DNA, 23 bp, Homo sapiens
tacgtacatacacacatacatac

SEQ ID NO: 4323293 - DNA, 13 bp, Homo sapiens
tactaatttattg

SEQ ID NO: 4323294 - DNA, 19 bp, Homo sapiens
tactagtgggatcaacaat

SEQ ID NO: 4323295 - DNA, 21 bp, Homo sapiens
tactagtgggatcaacaatga

SEQ ID NO: 4323296 - DNA, 20 bp, Homo sapiens
tactcaaacacttattgttt

SEQ ID NO: 4323297 - DNA, 20 bp, Homo sapiens
tactcaaatggcattgggct

SEQ ID NO: 4323298 - DNA, 13 bp, Homo sapiens
tactcacctctct

SEQ ID NO: 4323299 - DNA, 18 bp, Homo sapiens
tactcctatttttgtaaa

SEQ ID NO: 4323300 - DNA, 20 bp, Homo sapiens
tactcctatttttgtaaact

SEQ ID NO: 4323301 - DNA, 13 bp, Homo sapiens
tactgaaagacag

SEQ ID NO: 4323302 - DNA, 15 bp, Homo sapiens
tactgaaagacagga

SEQ ID NO: 4323303 - DNA, 16 bp, Homo sapiens
tactgcttctctttgt

SEQ ID NO: 4323304 - DNA, 17 bp, Homo sapiens
tactgcttctctttgtg

SEQ ID NO: 4323305 - DNA, 20 bp, Homo sapiens
tactgggtgtcatttcattc

SEQ ID NO: 4323306 - DNA, 19 bp, Homo sapiens
tactgtacataaacaatga

SEQ ID NO: 4323307 - DNA, 14 bp, Homo sapiens
tactgtcttgtctc

SEQ ID NO: 4323308 - DNA, 19 bp, Homo sapiens
tactgtcttgtctcacttt

SEQ ID NO: 4323309 - DNA, 16 bp, Homo sapiens
tacttagaatgccata

SEQ ID NO: 4323310 - DNA, 17 bp, Homo sapiens
tacttagaatgccataa

SEQ ID NO: 4323311 - DNA, 20 bp, Homo sapiens
tacttagaatgccataaaat

SEQ ID NO: 4323312 - DNA, 21 bp, Homo sapiens
tacttagaatgccataaaatt

SEQ ID NO: 4323313 - DNA, 22 bp, Homo sapiens
tacttagaatgccataaaattg

SEQ ID NO: 4323314 - DNA, 13 bp, Homo sapiens
tacttccattgca

SEQ ID NO: 4323315 - DNA, 15 bp, Homo sapiens
tacttcctgagtggc

SEQ ID NO: 4323316 - DNA, 19 bp, Homo sapiens
tacttctgagccccagccc

SEQ ID NO: 4323317 - DNA, 14 bp, Homo sapiens
tacttgtcctttga

SEQ ID NO: 4323318 - DNA, 22 bp, Homo sapiens
tactttgtggaccaattattga

SEQ ID NO: 4323319 - DNA, 21 bp, Homo sapiens
tactttttgtatttagtagtt

SEQ ID NO: 4323320 - DNA, 20 bp, Homo sapiens
tagaaagagtgttatcatat

SEQ ID NO: 4323321 - DNA, 16 bp, Homo sapiens
tagaagaagaggaagt

SEQ ID NO: 4323322 - DNA, 16 bp, Homo sapiens
tagaagcgctcatctg

SEQ ID NO: 4323323 - DNA, 20 bp, Homo sapiens
tagaatgtcttggtgttatc

SEQ ID NO: 4323324 - DNA, 20 bp, Homo sapiens
tagacaatcattgttttgaa

SEQ ID NO: 4323325 - DNA, 23 bp, Homo sapiens
tagacaatcattgttttgaatat

SEQ ID NO: 4323326 - DNA, 17 bp, Homo sapiens
tagacactccccacggg

SEQ ID NO: 4323327 - DNA, 22 bp, Homo sapiens
tagaccttatgttagagtcatt

SEQ ID NO: 4323328 - DNA, 22 bp, Homo sapiens
tagactcctcttcccagagtca

SEQ ID NO: 4323329 - DNA, 23 bp, Homo sapiens
tagactgtaactttttttcagtt

SEQ ID NO: 4323330 - DNA, 20 bp, Homo sapiens
tagactgtgtctgaatcatg

SEQ ID NO: 4323331 - DNA, 22 bp, Homo sapiens
tagagaatacacatataaaaac

SEQ ID NO: 4323332 - DNA, 13 bp, Homo sapiens
tagagaatgcaca

SEQ ID NO: 4323333 - DNA, 14 bp, Homo sapiens
tagagaatgcacag

SEQ ID NO: 4323334 - DNA, 14 bp, Homo sapiens
tagagaccaggagg

SEQ ID NO: 4323335 - DNA, 19 bp, Homo sapiens
tagagcgtttggttaaagt

SEQ ID NO: 4323336 - DNA, 20 bp, Homo sapiens
tagagcgtttggttaaagta

SEQ ID NO: 4323337 - DNA, 13 bp, Homo sapiens
tagaggaaaatca

SEQ ID NO: 4323338 - DNA, 20 bp, Homo sapiens
tagaggaaaatcaatgcttt

SEQ ID NO: 4323339 - DNA, 17 bp, Homo sapiens
tagaggacactaggaga

SEQ ID NO: 4323340 - DNA, 15 bp, Homo sapiens
tagagtaatgatgta

SEQ ID NO: 4323341 - DNA, 21 bp, Homo sapiens
tagataatttattatacacct

SEQ ID NO: 4323342 - DNA, 20 bp, Homo sapiens
tagatgcctgttttgagacc

SEQ ID NO: 4323343 - DNA, 20 bp, Homo sapiens
tagattgcaaatattggtta

SEQ ID NO: 4323344 - DNA, 17 bp, Homo sapiens
tagattgccaatactca

SEQ ID NO: 4323345 - DNA, 22 bp, Homo sapiens
tagattttagaccctattgctg

SEQ ID NO: 4323346 - DNA, 16 bp, Homo sapiens
tagcactttgggaggc

SEQ ID NO: 4323347 - DNA, 12 bp, Homo sapiens
tagcatttattt

SEQ ID NO: 4323348 - DNA, 22 bp, Homo sapiens
tagcattttgctaaatgtgaat

SEQ ID NO: 4323349 - DNA, 15 bp, Homo sapiens
tagccattacccacg

SEQ ID NO: 4323350 - DNA, 14 bp, Homo sapiens
tagcccaaaaccaa

SEQ ID NO: 4323351 - DNA, 15 bp, Homo sapiens
tagcccaaggctcag

SEQ ID NO: 4323352 - DNA, 16 bp, Homo sapiens
tagcccaatggagaaa

SEQ ID NO: 4323353 - DNA, 15 bp, Homo sapiens
tagccccacccagag

SEQ ID NO: 4323354 - DNA, 17 bp, Homo sapiens
tagccccacccagaggt

SEQ ID NO: 4323355 - DNA, 19 bp, Homo sapiens
tagcccttctaccccacct

SEQ ID NO: 4323356 - DNA, 19 bp, Homo sapiens
tagcctctgggatctgcca

SEQ ID NO: 4323357 - DNA, 15 bp, Homo sapiens
tagctcccaaaagaa

SEQ ID NO: 4323358 - DNA, 20 bp, Homo sapiens
taggaattcaatttggcaaa

SEQ ID NO: 4323359 - DNA, 19 bp, Homo sapiens
taggaattctttgcattcc

SEQ ID NO: 4323360 - DNA, 19 bp, Homo sapiens
taggaattgtttatacaca

SEQ ID NO: 4323361 - DNA, 22 bp, Homo sapiens
taggatcatatgaccattgaaa

SEQ ID NO: 4323362 - DNA, 13 bp, Homo sapiens
taggatgtctctt

SEQ ID NO: 4323363 - DNA, 23 bp, Homo sapiens
taggattgggggatgtgaagaaa

SEQ ID NO: 4323364 - DNA, 21 bp, Homo sapiens
taggcacttttattttcattg

SEQ ID NO: 4323365 - DNA, 16 bp, Homo sapiens
taggcatttgctgaat

SEQ ID NO: 4323366 - DNA, 20 bp, Homo sapiens
tagggaaaaaccagcgtgtg

SEQ ID NO: 4323367 - DNA, 13 bp, Homo sapiens
taggggaggagag

SEQ ID NO: 4323368 - DNA, 15 bp, Homo sapiens
taggtaaaatgtatt

SEQ ID NO: 4323369 - DNA, 15 bp, Homo sapiens
taggtcaagtaataa

SEQ ID NO: 4323370 - DNA, 21 bp, Homo sapiens
taggttggcaaaaaggcagga

SEQ ID NO: 4323371 - DNA, 12 bp, Homo sapiens
taggttgttacc

SEQ ID NO: 4323372 - DNA, 23 bp, Homo sapiens
tagtaaaaagccctatgtgaaaa

SEQ ID NO: 4323373 - DNA, 17 bp, Homo sapiens
tagtaagtaattatgca

SEQ ID NO: 4323374 - DNA, 20 bp, Homo sapiens
tagtagaaagacatctgcct

SEQ ID NO: 4323375 - DNA, 20 bp, Homo sapiens
tagtatttaactacatctgc

SEQ ID NO: 4323376 - DNA, 22 bp, Homo sapiens
tagtatttaactacatctgcct

SEQ ID NO: 4323377 - DNA, 23 bp, Homo sapiens
tagtatttaactacatctgcctc

SEQ ID NO: 4323378 - DNA, 20 bp, Homo sapiens
tagtcatatgtgaagacaga

SEQ ID NO: 4323379 - DNA, 21 bp, Homo sapiens
tagtccaaatgtgatcaactg

SEQ ID NO: 4323380 - DNA, 10 bp, Homo sapiens
tagtccttgg

SEQ ID NO: 4323381 - DNA, 15 bp, Homo sapiens
tagtcgggcatgagt

SEQ ID NO: 4323382 - DNA, 14 bp, Homo sapiens
tcagttgcagaaaa

SEQ ID NO: 4323383 - DNA, 17 bp, Homo sapiens
tcagttgcagaaaatga

SEQ ID NO: 4323384 - DNA, 12 bp, Homo sapiens
tcataatttctt

SEQ ID NO: 4323385 - DNA, 18 bp, Homo sapiens
tcatacagctattaaaat

SEQ ID NO: 4323386 - DNA, 19 bp, Homo sapiens
tcatagatttgaaaaactt

SEQ ID NO: 4323387 - DNA, 16 bp, Homo sapiens
tcataggtatttcaaa

SEQ ID NO: 4323388 - DNA, 19 bp, Homo sapiens
tcatatgaccattgaaaaa

SEQ ID NO: 4323389 - DNA, 22 bp, Homo sapiens
tcatatgcagaacgtatttagc

SEQ ID NO: 4323390 - DNA, 13 bp, Homo sapiens
tcatatgtgaaga

SEQ ID NO: 4323391 - DNA, 19 bp, Homo sapiens
tcatatgtgaagacagagc

SEQ ID NO: 4323392 - DNA, 14 bp, Homo sapiens
tcatattggtgctg

SEQ ID NO: 4323393 - DNA, 13 bp, Homo sapiens
tcatcaaagtggg

SEQ ID NO: 4323394 - DNA, 18 bp, Homo sapiens
tcatcaacaaaagggaga

SEQ ID NO: 4323395 - DNA, 22 bp, Homo sapiens
tcatcaacaaaagggagaacat

SEQ ID NO: 4323396 - DNA, 13 bp, Homo sapiens
tcatccattcctc

SEQ ID NO: 4323397 - DNA, 19 bp, Homo sapiens
tcatcccttcctcctctcc

SEQ ID NO: 4323398 - DNA, 20 bp, Homo sapiens
tcatctggcttttcgcttgc

SEQ ID NO: 4323399 - DNA, 13 bp, Homo sapiens
tcatcttgtgaaa

SEQ ID NO: 4323400 - DNA, 14 bp, Homo sapiens
tcatcttgtgaaat

SEQ ID NO: 4323401 - DNA, 18 bp, Homo sapiens
tcatgcaaactgctttat

SEQ ID NO: 4323402 - DNA, 18 bp, Homo sapiens
tcatgcactcacaaagat

SEQ ID NO: 4323403 - DNA, 16 bp, Homo sapiens
tcatgtatatttagtt

SEQ ID NO: 4323404 - DNA, 20 bp, Homo sapiens
tcatgtctgtatccccagtg

SEQ ID NO: 4323405 - DNA, 22 bp, Homo sapiens
tcatgtctgtatccccagtgcc

SEQ ID NO: 4323406 - DNA, 23 bp, Homo sapiens
tcatgtctgtatccccagtgccc

SEQ ID NO: 4323407 - DNA, 23 bp, Homo sapiens
tcatgtttctcccataggctgtg

SEQ ID NO: 4323408 - DNA, 13 bp, Homo sapiens
tcattacttctga

SEQ ID NO: 4323409 - DNA, 14 bp, Homo sapiens
tcattccattgcct

SEQ ID NO: 4323410 - DNA, 15 bp, Homo sapiens
tcattccattgccta

SEQ ID NO: 4323411 - DNA, 18 bp, Homo sapiens
tcattctcataattccta

SEQ ID NO: 4323412 - DNA, 13 bp, Homo sapiens
tcattctgagccc

SEQ ID NO: 4323413 - DNA, 21 bp, Homo sapiens
tcattctgcattgagaaggaa

SEQ ID NO: 4323414 - DNA, 12 bp, Homo sapiens
tcattgttttga

SEQ ID NO: 4323415 - DNA, 13 bp, Homo sapiens
tcatttcagattt

SEQ ID NO: 4323416 - DNA, 16 bp, Homo sapiens
tcatttcattccattg

SEQ ID NO: 4323417 - DNA, 17 bp, Homo sapiens
tcatttggcttgctgtt

SEQ ID NO: 4323418 - DNA, 13 bp, Homo sapiens
tcatttggttaaa

SEQ ID NO: 4323419 - DNA, 20 bp, Homo sapiens
tccaaaataatctatattaa

SEQ ID NO: 4323420 - DNA, 22 bp, Homo sapiens
tccaaaataatctatattaaat

SEQ ID NO: 4323421 - DNA, 20 bp, Homo sapiens
tccaaatgaatgttgtctgt

SEQ ID NO: 4323422 - DNA, 15 bp, Homo sapiens
tccaatatttctgct

SEQ ID NO: 4323423 - DNA, 15 bp, Homo sapiens
tccaattctgaaata

SEQ ID NO: 4323424 - DNA, 19 bp, Homo sapiens
tccaattctgaaatacttt

SEQ ID NO: 4323425 - DNA, 20 bp, Homo sapiens
tccacacggagctcctggca

SEQ ID NO: 4323426 - DNA, 21 bp, Homo sapiens
tccacagagtttgtagtaaat

SEQ ID NO: 4323427 - DNA, 20 bp, Homo sapiens
tccactgcaaataaagcctt

SEQ ID NO: 4323428 - DNA, 21 bp, Homo sapiens
tccactgcaaataaagccttt

SEQ ID NO: 4323429 - DNA, 15 bp, Homo sapiens
tccacttcaggagcc

SEQ ID NO: 4323430 - DNA, 18 bp, Homo sapiens
tccacttcaggagcccta

SEQ ID NO: 4323431 - DNA, 16 bp, Homo sapiens
tccagccgtgtgtgca

SEQ ID NO: 4323432 - DNA, 12 bp, Homo sapiens
tccagcctggac

SEQ ID NO: 4323433 - DNA, 20 bp, Homo sapiens
tccagcctggacccccagct

SEQ ID NO: 4323434 - DNA, 18 bp, Homo sapiens
tccagctgggacctaatg

SEQ ID NO: 4323435 - DNA, 17 bp, Homo sapiens
tccagggagcttattca

SEQ ID NO: 4323436 - DNA, 16 bp, Homo sapiens
tccagtactttataac

SEQ ID NO: 4323437 - DNA, 16 bp, Homo sapiens
tccatagtgctacctg

SEQ ID NO: 4323438 - DNA, 21 bp, Homo sapiens
tccatctcagactgtggaacc

SEQ ID NO: 4323439 - DNA, 15 bp, Homo sapiens
tccatgacaggcctg

SEQ ID NO: 4323440 - DNA, 20 bp, Homo sapiens
tccatgacaggcctgaagat

SEQ ID NO: 4323441 - DNA, 14 bp, Homo sapiens
tccattacgtgcat

SEQ ID NO: 4323442 - DNA, 16 bp, Homo sapiens
tccattacgtgcattt

SEQ ID NO: 4323443 - DNA, 18 bp, Homo sapiens
tccattgcaaaatagaag

SEQ ID NO: 4323444 - DNA, 21 bp, Homo sapiens
tccattgcaaaatagaagaag

SEQ ID NO: 4323445 - DNA, 18 bp, Homo sapiens
tccattgcctagctcttt

SEQ ID NO: 4323446 - DNA, 18 bp, Homo sapiens
tcccaagatggagaggaa

SEQ ID NO: 4323447 - DNA, 21 bp, Homo sapiens
tcccaagatggagaggaagaa

SEQ ID NO: 4323448 - DNA, 14 bp, Homo sapiens
tcccacaaaggaga

SEQ ID NO: 4323449 - DNA, 18 bp, Homo sapiens
tcccacacccacctctgc

SEQ ID NO: 4323450 - DNA, 21 bp, Homo sapiens
tcccacacccacctctgccac

SEQ ID NO: 4323451 - DNA, 22 bp, Homo sapiens
tcccacgactgttgtacaagct

SEQ ID NO: 4323452 - DNA, 23 bp, Homo sapiens
tcccagaggccgctgcccctgag

SEQ ID NO: 4323453 - DNA, 13 bp, Homo sapiens
tcccagctctctc

SEQ ID NO: 4323454 - DNA, 16 bp, Homo sapiens
tcccagctctctctcc

SEQ ID NO: 4323455 - DNA, 18 bp, Homo sapiens
tcccagctctctctcctg

SEQ ID NO: 4323456 - DNA, 15 bp, Homo sapiens
tcccaggcctctgcc

SEQ ID NO: 4323457 - DNA, 19 bp, Homo sapiens
tcccaggtaatttaaattg

SEQ ID NO: 4323458 - DNA, 17 bp, Homo sapiens
tcccagtgatctgttca

SEQ ID NO: 4323459 - DNA, 23 bp, Homo sapiens
tcccatgttgggtttgagacaga

SEQ ID NO: 4323460 - DNA, 15 bp, Homo sapiens
tccccagctccccca

SEQ ID NO: 4323461 - DNA, 18 bp, Homo sapiens
tccccagctcccccaggc

SEQ ID NO: 4323462 - DNA, 18 bp, Homo sapiens
tccccagtgcccggtgca

SEQ ID NO: 4323463 - DNA, 17 bp, Homo sapiens
tcccccaccccagagtt

SEQ ID NO: 4323464 - DNA, 18 bp, Homo sapiens
tcccccaccccagagttg

SEQ ID NO: 4323465 - DNA, 16 bp, Homo sapiens
tcccccgttgtgcctg

SEQ ID NO: 4323466 - DNA, 15 bp, Homo sapiens
tccccctgtcccctc

SEQ ID NO: 4323467 - DNA, 16 bp, Homo sapiens
tccccctgtcccctca

SEQ ID NO: 4323468 - DNA, 17 bp, Homo sapiens
tccccctttctctgcct

SEQ ID NO: 4323469 - DNA, 16 bp, Homo sapiens
tccccgccccctgaaa

SEQ ID NO: 4323470 - DNA, 19 bp, Homo sapiens
tcccctccccgccccctga

SEQ ID NO: 4323471 - DNA, 22 bp, Homo sapiens
tcccctccccgccccctgaaac

SEQ ID NO: 4323472 - DNA, 23 bp, Homo sapiens
tccctagatctttctattccaaa

SEQ ID NO: 4323473 - DNA, 16 bp, Homo sapiens
tccctattagagaaga

SEQ ID NO: 4323474 - DNA, 18 bp, Homo sapiens
tccctattagagaagaga

SEQ ID NO: 4323475 - DNA, 22 bp, Homo sapiens
tccctcaacaaggtatacctca

SEQ ID NO: 4323476 - DNA, 20 bp, Homo sapiens
tccctccccaaatggctgct

SEQ ID NO: 4323477 - DNA, 16 bp, Homo sapiens
tccctctcccacccaa

SEQ ID NO: 4323478 - DNA, 20 bp, Homo sapiens
tccctctctccacacggagc

SEQ ID NO: 4323479 - DNA, 11 bp, Homo sapiens
tccctctgcct

SEQ ID NO: 4323480 - DNA, 15 bp, Homo sapiens
tccctctgcctggga

SEQ ID NO: 4323481 - DNA, 17 bp, Homo sapiens
tccctctgcctgggatg

SEQ ID NO: 4323482 - DNA, 19 bp, Homo sapiens
tccctctgcctgggatgcc

SEQ ID NO: 4323483 - DNA, 23 bp, Homo sapiens
tccctctgcctgggatgcccttc

SEQ ID NO: 4323484 - DNA, 13 bp, Homo sapiens
tccctgctcccag

SEQ ID NO: 4323485 - DNA, 20 bp, Homo sapiens
tccctgtatgtctacctctg

SEQ ID NO: 4323486 - DNA, 12 bp, Homo sapiens
tccctgtcccag

SEQ ID NO: 4323487 - DNA, 18 bp, Homo sapiens
tccctgtctctgcatctg

SEQ ID NO: 4323488 - DNA, 19 bp, Homo sapiens
tcccttcctcctctcctgg

SEQ ID NO: 4323489 - DNA, 19 bp, Homo sapiens
tcccttctgtagtttttaa

SEQ ID NO: 4323490 - DNA, 17 bp, Homo sapiens
tcccttgaaattttaaa

SEQ ID NO: 4323491 - DNA, 14 bp, Homo sapiens
tcccttttctcctc

SEQ ID NO: 4323492 - DNA, 19 bp, Homo sapiens
tccgtgcttgctggtgcct

SEQ ID NO: 4323493 - DNA, 21 bp, Homo sapiens
tcctagaaattccccaccctg

SEQ ID NO: 4323494 - DNA, 15 bp, Homo sapiens
tcctagagaggagaa

SEQ ID NO: 4323495 - DNA, 18 bp, Homo sapiens
tcctagagaggagaaagg

SEQ ID NO: 4323496 - DNA, 14 bp, Homo sapiens
tcctagccccaccc

SEQ ID NO: 4323497 - DNA, 18 bp, Homo sapiens
tcctagccccacccagag

SEQ ID NO: 4323498 - DNA, 20 bp, Homo sapiens
tcctagccccacccagaggt

SEQ ID NO: 4323499 - DNA, 19 bp, Homo sapiens
tcctaggcatttgctgaat

SEQ ID NO: 4323500 - DNA, 21 bp, Homo sapiens
tgaaaggctatcctgctgaaa

SEQ ID NO: 4323501 - DNA, 17 bp, Homo sapiens
tgaaagtcctgctttcc

SEQ ID NO: 4323502 - DNA, 13 bp, Homo sapiens
tgaaagttgcttt

SEQ ID NO: 4323503 - DNA, 22 bp, Homo sapiens
tgaaataaaaattatgaaatat

SEQ ID NO: 4323504 - DNA, 18 bp, Homo sapiens
tgaaatacttttgagtat

SEQ ID NO: 4323505 - DNA, 16 bp, Homo sapiens
tgaacagcaggatgcc

SEQ ID NO: 4323506 - DNA, 19 bp, Homo sapiens
tgaacagcaggatgccctg

SEQ ID NO: 4323507 - DNA, 14 bp, Homo sapiens
tgaaccaatagaaa

SEQ ID NO: 4323508 - DNA, 18 bp, Homo sapiens
tgaaccaatagaaagcaa

SEQ ID NO: 4323509 - DNA, 16 bp, Homo sapiens
tgaactggagctgcta

SEQ ID NO: 4323510 - DNA, 14 bp, Homo sapiens
tgaacttgggaggg

SEQ ID NO: 4323511 - DNA, 15 bp, Homo sapiens
tgaagcagaggaagg

SEQ ID NO: 4323512 - DNA, 14 bp, Homo sapiens
tgaagctggccctc

SEQ ID NO: 4323513 - DNA, 19 bp, Homo sapiens
tgaaggacactctgcaggg

SEQ ID NO: 4323514 - DNA, 23 bp, Homo sapiens
tgaaggacatgagactaagagaa

SEQ ID NO: 4323515 - DNA, 20 bp, Homo sapiens
tgaagggaacagcctgagcc

SEQ ID NO: 4323516 - DNA, 17 bp, Homo sapiens
tgaagggcattctttcc

SEQ ID NO: 4323517 - DNA, 19 bp, Homo sapiens
tgaagtaaagccattaaat

SEQ ID NO: 4323518 - DNA, 17 bp, Homo sapiens
tgaagtacagtcccagc

SEQ ID NO: 4323519 - DNA, 23 bp, Homo sapiens
tgaagtacagtcccagcacattt

SEQ ID NO: 4323520 - DNA, 20 bp, Homo sapiens
tgaagtcaaaccttaagata

SEQ ID NO: 4323521 - DNA, 15 bp, Homo sapiens
tgaatattttgataa

SEQ ID NO: 4323522 - DNA, 16 bp, Homo sapiens
tgaatattttgataat

SEQ ID NO: 4323523 - DNA, 15 bp, Homo sapiens
tgaatcatgtctgta

SEQ ID NO: 4323524 - DNA, 16 bp, Homo sapiens
tgaatcatgtctgtat

SEQ ID NO: 4323525 - DNA, 22 bp, Homo sapiens
tgaatgctgagctgaagaaatt

SEQ ID NO: 4323526 - DNA, 17 bp, Homo sapiens
tgaatggacaaagctca

SEQ ID NO: 4323527 - DNA, 18 bp, Homo sapiens
tgaatgggcatgaatgga

SEQ ID NO: 4323528 - DNA, 20 bp, Homo sapiens
tgaatgtttagtgtgctgct

SEQ ID NO: 4323529 - DNA, 23 bp, Homo sapiens
tgaatgtttagtgtgctgctgtt

SEQ ID NO: 4323530 - DNA, 21 bp, Homo sapiens
tgaatgtttccaacctggagt

SEQ ID NO: 4323531 - DNA, 22 bp, Homo sapiens
tgaatgtttccaacctggagta

SEQ ID NO: 4323532 - DNA, 20 bp, Homo sapiens
tgaattgagaaaagagtgag

SEQ ID NO: 4323533 - DNA, 17 bp, Homo sapiens
tgaatttttatgatttc

SEQ ID NO: 4323534 - DNA, 20 bp, Homo sapiens
tgaatttttatgatttcttg

SEQ ID NO: 4323535 - DNA, 15 bp, Homo sapiens
tgacaaagaaaatga

SEQ ID NO: 4323536 - DNA, 19 bp, Homo sapiens
tgacaaagaaaatgagaat

SEQ ID NO: 4323537 - DNA, 20 bp, Homo sapiens
tgacaagctaggaaagagga

SEQ ID NO: 4323538 - DNA, 20 bp, Homo sapiens
tgacacagtgctcgaccttg

SEQ ID NO: 4323539 - DNA, 15 bp, Homo sapiens
tgacataattgtcca

SEQ ID NO: 4323540 - DNA, 14 bp, Homo sapiens
tgacatagcctttg

SEQ ID NO: 4323541 - DNA, 15 bp, Homo sapiens
tgacatagcctttgt

SEQ ID NO: 4323542 - DNA, 13 bp, Homo sapiens
tgacatcagattt

SEQ ID NO: 4323543 - DNA, 14 bp, Homo sapiens
tgacatcagatttc

SEQ ID NO: 4323544 - DNA, 15 bp, Homo sapiens
tgacatcagatttct

SEQ ID NO: 4323545 - DNA, 19 bp, Homo sapiens
tgaccattgaaaaaggaaa

SEQ ID NO: 4323546 - DNA, 13 bp, Homo sapiens
tgaccccctgtcc

SEQ ID NO: 4323547 - DNA, 13 bp, Homo sapiens
tgacccctttccc

SEQ ID NO: 4323548 - DNA, 17 bp, Homo sapiens
tgacctctgcaagaggg

SEQ ID NO: 4323549 - DNA, 15 bp, Homo sapiens
tgacggtttctcccc

SEQ ID NO: 4323550 - DNA, 17 bp, Homo sapiens
tgacgttgttgtcattg

SEQ ID NO: 4323551 - DNA, 18 bp, Homo sapiens
tgactattgtaatgccaa

SEQ ID NO: 4323552 - DNA, 19 bp, Homo sapiens
tgactattgtaatgccaat

SEQ ID NO: 4323553 - DNA, 20 bp, Homo sapiens
tgactgatggtttggaaaat

SEQ ID NO: 4323554 - DNA, 21 bp, Homo sapiens
tgactgcaagcatttttccat

SEQ ID NO: 4323555 - DNA, 17 bp, Homo sapiens
tgactggttgtcagaat

SEQ ID NO: 4323556 - DNA, 14 bp, Homo sapiens
tgactgtgaactgg

SEQ ID NO: 4323557 - DNA, 19 bp, Homo sapiens
tgacttaggtaaaataaaa

SEQ ID NO: 4323558 - DNA, 22 bp, Homo sapiens
tgacttccgtcccactgaagga

SEQ ID NO: 4323559 - DNA, 20 bp, Homo sapiens
tgacttctgtggtccctctg

SEQ ID NO: 4323560 - DNA, 12 bp, Homo sapiens
tgagaaaagagt

SEQ ID NO: 4323561 - DNA, 17 bp, Homo sapiens
tgagaaattattagatt

SEQ ID NO: 4323562 - DNA, 16 bp, Homo sapiens
tgagaaggaactgata

SEQ ID NO: 4323563 - DNA, 14 bp, Homo sapiens
tgagaccagaagaa

SEQ ID NO: 4323564 - DNA, 20 bp, Homo sapiens
tgagaccagaagaaaagact

SEQ ID NO: 4323565 - DNA, 20 bp, Homo sapiens
tgagacgccaccattcctgg

SEQ ID NO: 4323566 - DNA, 21 bp, Homo sapiens
tgagacgccaccattcctgga

SEQ ID NO: 4323567 - DNA, 16 bp, Homo sapiens
tgagactaagagaaac

SEQ ID NO: 4323568 - DNA, 19 bp, Homo sapiens
tgagagcgaattgtgtgga

SEQ ID NO: 4323569 - DNA, 22 bp, Homo sapiens
tgagagcgaattgtgtggagaa

SEQ ID NO: 4323570 - DNA, 17 bp, Homo sapiens
tgagaggttagaatgat

SEQ ID NO: 4323571 - DNA, 21 bp, Homo sapiens
tgagatgctggtaatggccat

SEQ ID NO: 4323572 - DNA, 15 bp, Homo sapiens
tgagccccagcccca

SEQ ID NO: 4323573 - DNA, 12 bp, Homo sapiens
tgagcctgccca

SEQ ID NO: 4323574 - DNA, 16 bp, Homo sapiens
tgagcctggcaagaat

SEQ ID NO: 4323575 - DNA, 13 bp, Homo sapiens
tgagcctgtccaa

SEQ ID NO: 4323576 - DNA, 10 bp, Homo sapiens
tgagctttct

SEQ ID NO: 4323577 - DNA, 16 bp, Homo sapiens
tgagctttctgtgcat

SEQ ID NO: 4323578 - DNA, 18 bp, Homo sapiens
tgagctttctgtgcatgt

SEQ ID NO: 4323579 - DNA, 21 bp, Homo sapiens
tgagctttctgtgcatgtgca

SEQ ID NO: 4323580 - DNA, 24 bp, Homo sapiens
tgaggccccaactcaagtgtcacc

SEQ ID NO: 4323581 - DNA, 13 bp, Homo sapiens
tgaggctcagtct

SEQ ID NO: 4323582 - DNA, 16 bp, Homo sapiens
tgaggctcagtctctc

SEQ ID NO: 4323583 - DNA, 22 bp, Homo sapiens
tgaggctctctaagaaaagaga

SEQ ID NO: 4323584 - DNA, 14 bp, Homo sapiens
tgaggtaaagatat

SEQ ID NO: 4323585 - DNA, 13 bp, Homo sapiens
tgaggtagaggaa

SEQ ID NO: 4323586 - DNA, 12 bp, Homo sapiens
tgaggtggtagg

SEQ ID NO: 4323587 - DNA, 23 bp, Homo sapiens
tgaggttagcccaatggagaaat

SEQ ID NO: 4323588 - DNA, 16 bp, Homo sapiens
tgagtaggatgtctct

SEQ ID NO: 4323589 - DNA, 21 bp, Homo sapiens
tgagtaggatgtctcttggaa

SEQ ID NO: 4323590 - DNA, 15 bp, Homo sapiens
tgagtctcccaaggc

SEQ ID NO: 4323591 - DNA, 23 bp, Homo sapiens
tgagtctcccaaggctgcgtctg

SEQ ID NO: 4323592 - DNA, 15 bp, Homo sapiens
tgagtctgtttccca

SEQ ID NO: 4323593 - DNA, 17 bp, Homo sapiens
tgagtcttaactgtatt

SEQ ID NO: 4323594 - DNA, 23 bp, Homo sapiens
tgagtgactttaggatgagcaaa

SEQ ID NO: 4323595 - DNA, 21 bp, Homo sapiens
tgagtgggggatcacagcctc

SEQ ID NO: 4323596 - DNA, 23 bp, Homo sapiens
tgagtgggggatcacagcctctg

SEQ ID NO: 4323597 - DNA, 20 bp, Homo sapiens
tgagtgtgtgtgtgtgtctg

SEQ ID NO: 4323598 - DNA, 17 bp, Homo sapiens
tgagttacttagaatgc

SEQ ID NO: 4323599 - DNA, 19 bp, Homo sapiens
tgagttacttagaatgcca

SEQ ID NO: 4323600 - DNA, 19 bp, Homo sapiens
tgagttgctggaaaatcat

SEQ ID NO: 4323601 - DNA, 18 bp, Homo sapiens
tgagtttgtaggtaaaat

SEQ ID NO: 4323602 - DNA, 21 bp, Homo sapiens
tgagtttgtaggtaaaatgta

SEQ ID NO: 4323603 - DNA, 20 bp, Homo sapiens
tgataactactgacgaaaga

SEQ ID NO: 4323604 - DNA, 15 bp, Homo sapiens
tgatacccaacagtt

SEQ ID NO: 4323605 - DNA, 17 bp, Homo sapiens
tgatacccaacagttta

SEQ ID NO: 4323606 - DNA, 17 bp, Homo sapiens
tgatactaaaagttctt

SEQ ID NO: 4323607 - DNA, 19 bp, Homo sapiens
tgatagcatggggcccctg

SEQ ID NO: 4323608 - DNA, 16 bp, Homo sapiens
tgatatatattataaa

SEQ ID NO: 4323609 - DNA, 14 bp, Homo sapiens
tgatatgctgagaa

SEQ ID NO: 4323610 - DNA, 18 bp, Homo sapiens
tgatattcaaggctttaa

SEQ ID NO: 4323611 - DNA, 22 bp, Homo sapiens
tgatattcaaggctttaaaagt

SEQ ID NO: 4323612 - DNA, 19 bp, Homo sapiens
tgatcacatctaaagcttt

SEQ ID NO: 4323613 - DNA, 20 bp, Homo sapiens
tgatcacatctaaagcttta

SEQ ID NO: 4323614 - DNA, 21 bp, Homo sapiens
tgatcacatctaaagctttat

SEQ ID NO: 4323615 - DNA, 17 bp, Homo sapiens
tgatcagatgctgaatt

SEQ ID NO: 4323616 - DNA, 20 bp, Homo sapiens
tgatcataggtatttcaaaa

SEQ ID NO: 4323617 - DNA, 15 bp, Homo sapiens
tggcaaaataaagaa

SEQ ID NO: 4323618 - DNA, 16 bp, Homo sapiens
tggcaaggagaatatg

SEQ ID NO: 4323619 - DNA, 18 bp, Homo sapiens
tggcaccagcagcctgga

SEQ ID NO: 4323620 - DNA, 17 bp, Homo sapiens
tggcacgtggccaggag

SEQ ID NO: 4323621 - DNA, 18 bp, Homo sapiens
tggcacgtggccaggagc

SEQ ID NO: 4323622 - DNA, 16 bp, Homo sapiens
tggcacttgcctgctg

SEQ ID NO: 4323623 - DNA, 18 bp, Homo sapiens
tggcacttgcctgctgct

SEQ ID NO: 4323624 - DNA, 23 bp, Homo sapiens
tggcacttgcctgctgcttggag

SEQ ID NO: 4323625 - DNA, 19 bp, Homo sapiens
tggcaggctactctgccca

SEQ ID NO: 4323626 - DNA, 22 bp, Homo sapiens
tggcaggctactctgcccaccc

SEQ ID NO: 4323627 - DNA, 14 bp, Homo sapiens
tggcatagacatgg

SEQ ID NO: 4323628 - DNA, 16 bp, Homo sapiens
tggcatagagaataca

SEQ ID NO: 4323629 - DNA, 14 bp, Homo sapiens
tggcatggagactc

SEQ ID NO: 4323630 - DNA, 15 bp, Homo sapiens
tggcatgggacagac

SEQ ID NO: 4323631 - DNA, 18 bp, Homo sapiens
tggccatatatgctgtat

SEQ ID NO: 4323632 - DNA, 21 bp, Homo sapiens
tggccatatatgctgtatttc

SEQ ID NO: 4323633 - DNA, 13 bp, Homo sapiens
tggcccacgcact

SEQ ID NO: 4323634 - DNA, 13 bp, Homo sapiens
tggcccactgcat

SEQ ID NO: 4323635 - DNA, 15 bp, Homo sapiens
tggcccagttgtcca

SEQ ID NO: 4323636 - DNA, 16 bp, Homo sapiens
tggcccagttgtccat

SEQ ID NO: 4323637 - DNA, 16 bp, Homo sapiens
tggcccctgagcccag

SEQ ID NO: 4323638 - DNA, 19 bp, Homo sapiens
tggcccgcaagagggacag

SEQ ID NO: 4323639 - DNA, 21 bp, Homo sapiens
tggcccgcaagagggacagag

SEQ ID NO: 4323640 - DNA, 15 bp, Homo sapiens
tggccctcagctccc

SEQ ID NO: 4323641 - DNA, 13 bp, Homo sapiens
tggccctcccagg

SEQ ID NO: 4323642 - DNA, 17 bp, Homo sapiens
tggccctcccaggctgg

SEQ ID NO: 4323643 - DNA, 15 bp, Homo sapiens
tggcctgactggttg

SEQ ID NO: 4323644 - DNA, 21 bp, Homo sapiens
tggcctgactggttgtcagaa

SEQ ID NO: 4323645 - DNA, 13 bp, Homo sapiens
tggcgctgccgag

SEQ ID NO: 4323646 - DNA, 20 bp, Homo sapiens
tggctaatggagtgtttgaa

SEQ ID NO: 4323647 - DNA, 13 bp, Homo sapiens
tggctcacgcctg

SEQ ID NO: 4323648 - DNA, 17 bp, Homo sapiens
tggctggagagctgcta

SEQ ID NO: 4323649 - DNA, 14 bp, Homo sapiens
tggcttcacggaag

SEQ ID NO: 4323650 - DNA, 17 bp, Homo sapiens
tggcttcacggaagagc

SEQ ID NO: 4323651 - DNA, 23 bp, Homo sapiens
tggcttcacggaagagccttgcg

SEQ ID NO: 4323652 - DNA, 20 bp, Homo sapiens
tggctttctcccactgagtt

SEQ ID NO: 4323653 - DNA, 21 bp, Homo sapiens
tggcttttcgcttgcttctgc

SEQ ID NO: 4323654 - DNA, 20 bp, Homo sapiens
tgggaagatttgaaaacaaa

SEQ ID NO: 4323655 - DNA, 22 bp, Homo sapiens
tgggaaggtgggtgaggctggg

SEQ ID NO: 4323656 - DNA, 17 bp, Homo sapiens
tgggaatacatctgtgg

SEQ ID NO: 4323657 - DNA, 23 bp, Homo sapiens
tgggactctgaactggagctgct

SEQ ID NO: 4323658 - DNA, 21 bp, Homo sapiens
tgggaggatctcttgagcctg

SEQ ID NO: 4323659 - DNA, 18 bp, Homo sapiens
tgggaggattgcttgagc

SEQ ID NO: 4323660 - DNA, 22 bp, Homo sapiens
tgggaggattgcttgagctcag

SEQ ID NO: 4323661 - DNA, 15 bp, Homo sapiens
tgggaggggccggag

SEQ ID NO: 4323662 - DNA, 20 bp, Homo sapiens
tgggaggtcaaggctgcagt

SEQ ID NO: 4323663 - DNA, 23 bp, Homo sapiens
tgggaggtcaaggctgcagtgag

SEQ ID NO: 4323664 - DNA, 19 bp, Homo sapiens
tgggatggacgctgccggg

SEQ ID NO: 4323665 - DNA, 17 bp, Homo sapiens
tgggcacccctgcctcc

SEQ ID NO: 4323666 - DNA, 19 bp, Homo sapiens
tgggcacccctgcctcctg

SEQ ID NO: 4323667 - DNA, 12 bp, Homo sapiens
tgggcagggcct

SEQ ID NO: 4323668 - DNA, 13 bp, Homo sapiens
tgggcagggcctg

SEQ ID NO: 4323669 - DNA, 15 bp, Homo sapiens
tgggcatctgttctg

SEQ ID NO: 4323670 - DNA, 18 bp, Homo sapiens
tgggccacgattttaaaa

SEQ ID NO: 4323671 - DNA, 21 bp, Homo sapiens
tgggccgggggcggggccggg

SEQ ID NO: 4323672 - DNA, 18 bp, Homo sapiens
tgggcctcgacgtccctt

SEQ ID NO: 4323673 - DNA, 20 bp, Homo sapiens
tgggctattgaagatacaca

SEQ ID NO: 4323674 - DNA, 17 bp, Homo sapiens
tgggctcagcagggctg

SEQ ID NO: 4323675 - DNA, 23 bp, Homo sapiens
tgggctcagcagggctggtcacc

SEQ ID NO: 4323676 - DNA, 17 bp, Homo sapiens
tggggaagaggttttat

SEQ ID NO: 4323677 - DNA, 23 bp, Homo sapiens
tggggaagaggttttatttacat

SEQ ID NO: 4323678 - DNA, 22 bp, Homo sapiens
tggggaaggagaaggagtgcca

SEQ ID NO: 4323679 - DNA, 15 bp, Homo sapiens
tggggattgccacta

SEQ ID NO: 4323680 - DNA, 16 bp, Homo sapiens
tggggcccctggccca

SEQ ID NO: 4323681 - DNA, 22 bp, Homo sapiens
tggggctgcgaaaacgttgacc

SEQ ID NO: 4323682 - DNA, 21 bp, Homo sapiens
tgggggatcacagcctctgaa

SEQ ID NO: 4323683 - DNA, 13 bp, Homo sapiens
tgggtaagaaagc

SEQ ID NO: 4323684 - DNA, 22 bp, Homo sapiens
tgggtaagaaagccaccttgtt

SEQ ID NO: 4323685 - DNA, 20 bp, Homo sapiens
tgggtcattacttctgagcc

SEQ ID NO: 4323686 - DNA, 18 bp, Homo sapiens
tgggtcctactcctggag

SEQ ID NO: 4323687 - DNA, 22 bp, Homo sapiens
tgggtcttcttttactggactg

SEQ ID NO: 4323688 - DNA, 13 bp, Homo sapiens
tgggtgccaggtg

SEQ ID NO: 4323689 - DNA, 17 bp, Homo sapiens
tgggtggcaccagcagc

SEQ ID NO: 4323690 - DNA, 13 bp, Homo sapiens
tggtaaaaaagaa

SEQ ID NO: 4323691 - DNA, 18 bp, Homo sapiens
tggtaagtgaatttatga

SEQ ID NO: 4323692 - DNA, 19 bp, Homo sapiens
tggtacaatcgacatccta

SEQ ID NO: 4323693 - DNA, 16 bp, Homo sapiens
tggtacccccttctgg

SEQ ID NO: 4323694 - DNA, 16 bp, Homo sapiens
tggtactctgtgtctg

SEQ ID NO: 4323695 - DNA, 20 bp, Homo sapiens
tggtagagtgtgcctgaagt

SEQ ID NO: 4323696 - DNA, 19 bp, Homo sapiens
tggtagggtataatgtgtc

SEQ ID NO: 4323697 - DNA, 17 bp, Homo sapiens
tggtatattgtgtaaat

SEQ ID NO: 4323698 - DNA, 17 bp, Homo sapiens
tggtcaaaagctggatt

SEQ ID NO: 4323699 - DNA, 22 bp, Homo sapiens
tggtccctctgtgtctgctctc

SEQ ID NO: 4323700 - DNA, 14 bp, Homo sapiens
tggtctttcctctg

SEQ ID NO: 4323701 - DNA, 20 bp, Homo sapiens
tggtgctgagtgctatgtgt

SEQ ID NO: 4323702 - DNA, 18 bp, Homo sapiens
tggtgggggcctcggtgt

SEQ ID NO: 4323703 - DNA, 22 bp, Homo sapiens
tggtgtttgggccacgatttta

SEQ ID NO: 4323704 - DNA, 14 bp, Homo sapiens
tggttaaaatgtga

SEQ ID NO: 4323705 - DNA, 12 bp, Homo sapiens
tggttcatgctt

SEQ ID NO: 4323706 - DNA, 22 bp, Homo sapiens
tggttggtaacacaaattttca

SEQ ID NO: 4323707 - DNA, 21 bp, Homo sapiens
tggttgtaccctctccaggca

SEQ ID NO: 4323708 - DNA, 17 bp, Homo sapiens
tggtttctcattaaact

SEQ ID NO: 4323709 - DNA, 21 bp, Homo sapiens
tggtttttaaaaaactgctga

SEQ ID NO: 4323710 - DNA, 23 bp, Homo sapiens
tgtaaaatgagtaggatgtctct

SEQ ID NO: 4323711 - DNA, 18 bp, Homo sapiens
tgtaatctaagtatatgt

SEQ ID NO: 4323712 - DNA, 21 bp, Homo sapiens
tgtaatctaagtatatgtgag

SEQ ID NO: 4323713 - DNA, 15 bp, Homo sapiens
tgtaatgaagtaaag

SEQ ID NO: 4323714 - DNA, 21 bp, Homo sapiens
tgtacataaagtcatcaaagt

SEQ ID NO: 4323715 - DNA, 14 bp, Homo sapiens
tgtacatgaagaat

SEQ ID NO: 4323716 - DNA, 17 bp, Homo sapiens
tgtacatgaagaatgta

SEQ ID NO: 4323717 - DNA, 19 bp, Homo sapiens
tgtacatgaagaatgtagc

SEQ ID NO: 4323718 - DNA, 16 bp, Homo sapiens
tgtaccccccaacccc

SEQ ID NO: 4323719 - DNA, 23 bp, Homo sapiens
tgtaccccccaacccctgaggaa

SEQ ID NO: 4323720 - DNA, 14 bp, Homo sapiens
tgtaccctctccag

SEQ ID NO: 4323721 - DNA, 14 bp, Homo sapiens
tgtacttaaatgag

SEQ ID NO: 4323722 - DNA, 21 bp, Homo sapiens
tgtacttaaatgagttactta

SEQ ID NO: 4323723 - DNA, 21 bp, Homo sapiens
tgtagaataaatggtttctca

SEQ ID NO: 4323724 - DNA, 12 bp, Homo sapiens
tgtagactctga

SEQ ID NO: 4323725 - DNA, 22 bp, Homo sapiens
tgtagactgtaactttttttca

SEQ ID NO: 4323726 - DNA, 13 bp, Homo sapiens
tgtagagtgggag

SEQ ID NO: 4323727 - DNA, 14 bp, Homo sapiens
tgtagagtgggagc

SEQ ID NO: 4323728 - DNA, 19 bp, Homo sapiens
tgtagataccgagaatgat

SEQ ID NO: 4323729 - DNA, 20 bp, Homo sapiens
tgtagccactagtaagtaat

SEQ ID NO: 4323730 - DNA, 13 bp, Homo sapiens
tgtaggtaaaatg

SEQ ID NO: 4323731 - DNA, 17 bp, Homo sapiens
tgtagtaaatattatga

SEQ ID NO: 4323732 - DNA, 15 bp, Homo sapiens
tgtagttccctctgc

SEQ ID NO: 4323733 - DNA, 18 bp, Homo sapiens
tgtagtttttgctgaagg

SEQ ID NO: 4323734 - DNA, 19 bp, Homo sapiens
ttcactctaaaaatagaat

SEQ ID NO: 4323735 - DNA, 20 bp, Homo sapiens
ttcagaattatccattacgt

SEQ ID NO: 4323736 - DNA, 16 bp, Homo sapiens
ttcagagtttgtgtgt

SEQ ID NO: 4323737 - DNA, 22 bp, Homo sapiens
ttcagagtttgtgtgtatttgt

SEQ ID NO: 4323738 - DNA, 24 bp, Homo sapiens
ttcagctctgcaagaattgaagca

SEQ ID NO: 4323739 - DNA, 13 bp, Homo sapiens
ttcagtattttcc

SEQ ID NO: 4323740 - DNA, 14 bp, Homo sapiens
ttcagtattttcca

SEQ ID NO: 4323741 - DNA, 18 bp, Homo sapiens
ttcagtattttccagcct

SEQ ID NO: 4323742 - DNA, 22 bp, Homo sapiens
ttcatatgcagaacgtatttag

SEQ ID NO: 4323743 - DNA, 21 bp, Homo sapiens
ttcatgaattagaagaaaatg

SEQ ID NO: 4323744 - DNA, 22 bp, Homo sapiens
ttcatgaattagaagaaaatgg

SEQ ID NO: 4323745 - DNA, 14 bp, Homo sapiens
ttcatggcaacatc

SEQ ID NO: 4323746 - DNA, 17 bp, Homo sapiens
ttcatgtatgtatataa

SEQ ID NO: 4323747 - DNA, 15 bp, Homo sapiens
ttcattcacttctct

SEQ ID NO: 4323748 - DNA, 17 bp, Homo sapiens
ttcattcacttctctta

SEQ ID NO: 4323749 - DNA, 21 bp, Homo sapiens
ttcattccattgcctagctct

SEQ ID NO: 4323750 - DNA, 14 bp, Homo sapiens
ttcattgtgattta

SEQ ID NO: 4323751 - DNA, 15 bp, Homo sapiens
ttcatttcagatttt

SEQ ID NO: 4323752 - DNA, 20 bp, Homo sapiens
ttccaaaataatctatatta

SEQ ID NO: 4323753 - DNA, 17 bp, Homo sapiens
ttccaaatgaatgttgt

SEQ ID NO: 4323754 - DNA, 19 bp, Homo sapiens
ttccactgcaaataaagcc

SEQ ID NO: 4323755 - DNA, 15 bp, Homo sapiens
ttccagagttgttgt

SEQ ID NO: 4323756 - DNA, 16 bp, Homo sapiens
ttccagccttatgtgt

SEQ ID NO: 4323757 - DNA, 23 bp, Homo sapiens
ttccattaataactgaataaaaa

SEQ ID NO: 4323758 - DNA, 22 bp, Homo sapiens
ttccattgcaaaatagaagaag

SEQ ID NO: 4323759 - DNA, 21 bp, Homo sapiens
ttcccaagctagactgtgtct

SEQ ID NO: 4323760 - DNA, 17 bp, Homo sapiens
ttcccactcagcagtga

SEQ ID NO: 4323761 - DNA, 22 bp, Homo sapiens
ttcccagagtcacaagtagcct

SEQ ID NO: 4323762 - DNA, 19 bp, Homo sapiens
ttcccaggtaatttaaatt

SEQ ID NO: 4323763 - DNA, 22 bp, Homo sapiens
ttccccagctcccccaggcaga

SEQ ID NO: 4323764 - DNA, 18 bp, Homo sapiens
ttcccccaccccagagtt

SEQ ID NO: 4323765 - DNA, 18 bp, Homo sapiens
ttccccctttctctgcct

SEQ ID NO: 4323766 - DNA, 23 bp, Homo sapiens
ttccccctttctctgcctggcaa

SEQ ID NO: 4323767 - DNA, 11 bp, Homo sapiens
ttccctctgcc

SEQ ID NO: 4323768 - DNA, 22 bp, Homo sapiens
ttccctctgcctgggatgccct

SEQ ID NO: 4323769 - DNA, 23 bp, Homo sapiens
ttccctggtgcccttccctggag

SEQ ID NO: 4323770 - DNA, 15 bp, Homo sapiens
ttcccttcctcagca

SEQ ID NO: 4323771 - DNA, 14 bp, Homo sapiens
ttcccttttttctt

SEQ ID NO: 4323772 - DNA, 16 bp, Homo sapiens
ttcccttttttcttcc

SEQ ID NO: 4323773 - DNA, 21 bp, Homo sapiens
ttcctacagcactactgggtg

SEQ ID NO: 4323774 - DNA, 23 bp, Homo sapiens
ttcctacagcactactgggtgtc

SEQ ID NO: 4323775 - DNA, 15 bp, Homo sapiens
ttcctactttgtata

SEQ ID NO: 4323776 - DNA, 20 bp, Homo sapiens
ttcctcagttgttaacttct

SEQ ID NO: 4323777 - DNA, 21 bp, Homo sapiens
ttcctccctgtctctgcatct

SEQ ID NO: 4323778 - DNA, 12 bp, Homo sapiens
ttcctcccttct

SEQ ID NO: 4323779 - DNA, 13 bp, Homo sapiens
ttcctcctctcct

SEQ ID NO: 4323780 - DNA, 21 bp, Homo sapiens
ttcctgattaccagtctgatt

SEQ ID NO: 4323781 - DNA, 23 bp, Homo sapiens
ttcctgattaccagtctgattat

SEQ ID NO: 4323782 - DNA, 12 bp, Homo sapiens
ttccttaaatga

SEQ ID NO: 4323783 - DNA, 14 bp, Homo sapiens
ttccttaaatgaac

SEQ ID NO: 4323784 - DNA, 15 bp, Homo sapiens
ttccttacttgcact

SEQ ID NO: 4323785 - DNA, 15 bp, Homo sapiens
ttcgcttgcttctgc

SEQ ID NO: 4323786 - DNA, 21 bp, Homo sapiens
ttcggccaatttatgcagagt

SEQ ID NO: 4323787 - DNA, 21 bp, Homo sapiens
ttctaaattctataaaaacca

SEQ ID NO: 4323788 - DNA, 14 bp, Homo sapiens
ttctacaaagcact

SEQ ID NO: 4323789 - DNA, 13 bp, Homo sapiens
ttctataaaaacc

SEQ ID NO: 4323790 - DNA, 13 bp, Homo sapiens
ttctataaatgac

SEQ ID NO: 4323791 - DNA, 16 bp, Homo sapiens
ttctataaatgactat

SEQ ID NO: 4323792 - DNA, 17 bp, Homo sapiens
ttctatccaaacatgta

SEQ ID NO: 4323793 - DNA, 15 bp, Homo sapiens
ttctcagctccccct

SEQ ID NO: 4323794 - DNA, 16 bp, Homo sapiens
ttctcagctccccctg

SEQ ID NO: 4323795 - DNA, 17 bp, Homo sapiens
ttctcagctccccctgt

SEQ ID NO: 4323796 - DNA, 22 bp, Homo sapiens
ttctcagttgcagaaaatgaac

SEQ ID NO: 4323797 - DNA, 18 bp, Homo sapiens
ttctcataattcctacag

SEQ ID NO: 4323798 - DNA, 21 bp, Homo sapiens
ttctccaattctgaaatactt

SEQ ID NO: 4323799 - DNA, 21 bp, Homo sapiens
ttctccacctcccacaaagga

SEQ ID NO: 4323800 - DNA, 21 bp, Homo sapiens
ttctcccaggcctctgcccca

SEQ ID NO: 4323801 - DNA, 14 bp, Homo sapiens
ttctccccggacac

SEQ ID NO: 4323802 - DNA, 22 bp, Homo sapiens
ttctccctagcccttctacccc

SEQ ID NO: 4323803 - DNA, 15 bp, Homo sapiens
ttctcgcaactgaag

SEQ ID NO: 4323804 - DNA, 21 bp, Homo sapiens
ttctctatgtacgataaagta

SEQ ID NO: 4323805 - DNA, 10 bp, Homo sapiens
ttctctgcct

SEQ ID NO: 4323806 - DNA, 13 bp, Homo sapiens
ttctctgcctggc

SEQ ID NO: 4323807 - DNA, 12 bp, Homo sapiens
ttctctttgtgc

SEQ ID NO: 4323808 - DNA, 15 bp, Homo sapiens
ttctgagccccagcc

SEQ ID NO: 4323809 - DNA, 18 bp, Homo sapiens
ttctgcagcaactcccac

SEQ ID NO: 4323810 - DNA, 19 bp, Homo sapiens
ttctgcattgagaaggaac

SEQ ID NO: 4323811 - DNA, 13 bp, Homo sapiens
ttctggccttgac

SEQ ID NO: 4323812 - DNA, 19 bp, Homo sapiens
ttctgggcatctgttctgg

SEQ ID NO: 4323813 - DNA, 14 bp, Homo sapiens
ttctggtgggttga

SEQ ID NO: 4323814 - DNA, 15 bp, Homo sapiens
ttctgtacttcctga

SEQ ID NO: 4323815 - DNA, 14 bp, Homo sapiens
ttctgtagttttta

SEQ ID NO: 4323816 - DNA, 21 bp, Homo sapiens
ttctgtccgagctttgaaaat

SEQ ID NO: 4323817 - DNA, 17 bp, Homo sapiens
ttctgtgcatgtgcagg

SEQ ID NO: 4323818 - DNA, 15 bp, Homo sapiens
ttctgtggaaaacaa

SEQ ID NO: 4323819 - DNA, 18 bp, Homo sapiens
ttctgtggaaaacaattt

SEQ ID NO: 4323820 - DNA, 17 bp, Homo sapiens
ttctgtgtaaaatgagt

SEQ ID NO: 4323821 - DNA, 15 bp, Homo sapiens
ttctgtgtacataaa

SEQ ID NO: 4323822 - DNA, 16 bp, Homo sapiens
ttcttaatgtctgtca

SEQ ID NO: 4323823 - DNA, 18 bp, Homo sapiens
ttcttaatgtctgtcaga

SEQ ID NO: 4323824 - DNA, 16 bp, Homo sapiens
ttcttacaagcttaaa

SEQ ID NO: 4323825 - DNA, 17 bp, Homo sapiens
ttcttcagaattatcca

SEQ ID NO: 4323826 - DNA, 16 bp, Homo sapiens
ttcttcaggtaacact

SEQ ID NO: 4323827 - DNA, 17 bp, Homo sapiens
ttcttcaggtaacacta

SEQ ID NO: 4323828 - DNA, 15 bp, Homo sapiens
ttcttggttgttaat

SEQ ID NO: 4323829 - DNA, 13 bp, Homo sapiens
ttctttcccagtg

SEQ ID NO: 4323830 - DNA, 23 bp, Homo sapiens
ttctttgattctccttttatgtg

SEQ ID NO: 4323831 - DNA, 15 bp, Homo sapiens
ttcttttattatcag

SEQ ID NO: 4323832 - DNA, 16 bp, Homo sapiens
ttcttttgaaatgcca

SEQ ID NO: 4323833 - DNA, 12 bp, Homo sapiens
ttcttttggaaa

SEQ ID NO: 4323834 - DNA, 17 bp, Homo sapiens
ttcttttttaatagaat

SEQ ID NO: 4323835 - DNA, 13 bp, Homo sapiens
ttgaaaaactttt

SEQ ID NO: 4323836 - DNA, 12 bp, Homo sapiens
ttgaaaaagtgt

SEQ ID NO: 4323837 - DNA, 17 bp, Homo sapiens
ttgaaaaagtgtacatg

SEQ ID NO: 4323838 - DNA, 12 bp, Homo sapiens
ttgaaaacacta

SEQ ID NO: 4323839 - DNA, 18 bp, Homo sapiens
ttgaaaacataatctgca

SEQ ID NO: 4323840 - DNA, 20 bp, Homo sapiens
ttgaaaactgacatcagatt

SEQ ID NO: 4323841 - DNA, 14 bp, Homo sapiens
ttgaaacctgctct

SEQ ID NO: 4323842 - DNA, 18 bp, Homo sapiens
ttgaaagaaaaaaaaata

SEQ ID NO: 4323843 - DNA, 18 bp, Homo sapiens
ttgaagatacacaagagg

SEQ ID NO: 4323844 - DNA, 13 bp, Homo sapiens
ttgacccctttcc

SEQ ID NO: 4323845 - DNA, 15 bp, Homo sapiens
ttgacccctttcccc

SEQ ID NO: 4323846 - DNA, 17 bp, Homo sapiens
ttgacccctttccccca

SEQ ID NO: 4323847 - DNA, 17 bp, Homo sapiens
ttgagaataagaatttg

SEQ ID NO: 4323848 - DNA, 16 bp, Homo sapiens
ttgagaccagaagaaa

SEQ ID NO: 4323849 - DNA, 20 bp, Homo sapiens
ttgagaccagaagaaaagac

SEQ ID NO: 4323850 - DNA, 22 bp, Homo sapiens
ttgagaccagaagaaaagactt

SEQ ID NO: 4323851 - DNA, 14 bp, Homo sapiens
ttgagaccagaagg

SEQ ID NO: 4323852 - DNA, 16 bp, Homo sapiens
ttttgtttgtttcttt

SEQ ID NO: 4323853 - DNA, 20 bp, Homo sapiens
tttttataaaaataaataga

SEQ ID NO: 4323854 - DNA, 12 bp, Homo sapiens
tttttatgtgta

SEQ ID NO: 4323855 - DNA, 21 bp, Homo sapiens
tttttcagttcatatgcagaa

SEQ ID NO: 4323856 - DNA, 13 bp, Homo sapiens
tttttccatctgt

SEQ ID NO: 4323857 - DNA, 12 bp, Homo sapiens
tttttctccccg

SEQ ID NO: 4323858 - DNA, 15 bp, Homo sapiens
tttttgtaaactgga

SEQ ID NO: 4323859 - DNA, 13 bp, Homo sapiens
tttttgtttgatg

SEQ ID NO: 4323860 - DNA, 23 bp, Homo sapiens
ttttttaaacaaaatttcacagt

SEQ ID NO: 4323861 - DNA, 12 bp, Homo sapiens
ttttttaaagta

SEQ ID NO: 4323862 - DNA, 16 bp, Homo sapiens
ttttttccagagttgt

SEQ ID NO: 4323863 - DNA, 12 bp, Homo sapiens
tttttttcagtt

SEQ ID NO: 4323864 - DNA, 22 bp, Homo sapiens
tctgcgtgactattttttaata

SEQ ID NO: 4323865 - DNA, 16 bp, Homo sapiens
tctgctcattaaactg

SEQ ID NO: 4323866 - DNA, 23 bp, Homo sapiens
tctgctcggcttcttggaccttg

SEQ ID NO: 4323867 - DNA, 22 bp, Homo sapiens
tctgctttctttgattctcctt

SEQ ID NO: 4323868 - DNA, 17 bp, Homo sapiens
tctggattcacagacca

SEQ ID NO: 4323869 - DNA, 18 bp, Homo sapiens
tctggcaaacttttcttt

SEQ ID NO: 4323870 - DNA, 16 bp, Homo sapiens
tctggcacgtggccag

SEQ ID NO: 4323871 - DNA, 19 bp, Homo sapiens
tctggcacgtggccaggag

SEQ ID NO: 4323872 - DNA, 12 bp, Homo sapiens
tctggccttgac

SEQ ID NO: 4323873 - DNA, 18 bp, Homo sapiens
tctgggcatctgttctgg

SEQ ID NO: 4323874 - DNA, 19 bp, Homo sapiens
tctgggcatctgttctggt

SEQ ID NO: 4323875 - DNA, 14 bp, Homo sapiens
tctgggcctctgaa

SEQ ID NO: 4323876 - DNA, 18 bp, Homo sapiens
tctgtatccccagtgccc

SEQ ID NO: 4323877 - DNA, 21 bp, Homo sapiens
tctgtatccccagtgcccggt

SEQ ID NO: 4323878 - DNA, 17 bp, Homo sapiens
tctgtgcagtcatcaac

SEQ ID NO: 4323879 - DNA, 16 bp, Homo sapiens
tctgtggaaaacaatt

SEQ ID NO: 4323880 - DNA, 12 bp, Homo sapiens
tctgtggccagg

SEQ ID NO: 4323881 - DNA, 20 bp, Homo sapiens
tctgtggccaggagccctgg

SEQ ID NO: 4323882 - DNA, 13 bp, Homo sapiens
tctgtgtacataa

SEQ ID NO: 4323883 - DNA, 13 bp, Homo sapiens
tctgtgtctgctc

SEQ ID NO: 4323884 - DNA, 14 bp, Homo sapiens
tctgtgtctggcag

SEQ ID NO: 4323885 - DNA, 14 bp, Homo sapiens
tctgtttcccaagc

SEQ ID NO: 4323886 - DNA, 15 bp, Homo sapiens
tcttaactgtatttc

SEQ ID NO: 4323887 - DNA, 18 bp, Homo sapiens
tcttaactgtatttcagt

SEQ ID NO: 4323888 - DNA, 20 bp, Homo sapiens
tcttaattttaaagacccaa

SEQ ID NO: 4323889 - DNA, 19 bp, Homo sapiens
tcttacaagcttaaagctt

SEQ ID NO: 4323890 - DNA, 15 bp, Homo sapiens
tcttaccctctcttt

SEQ ID NO: 4323891 - DNA, 21 bp, Homo sapiens
tcttaccctctctttcaattg

SEQ ID NO: 4323892 - DNA, 19 bp, Homo sapiens
tcttatataagatcactga

SEQ ID NO: 4323893 - DNA, 12 bp, Homo sapiens
tcttcagaatta

SEQ ID NO: 4323894 - DNA, 18 bp, Homo sapiens
tcttcagactctcagccc

SEQ ID NO: 4323895 - DNA, 22 bp, Homo sapiens
tcttccctacagttgaaaaaca

SEQ ID NO: 4323896 - DNA, 22 bp, Homo sapiens
tcttcggccaatttatgcagag

SEQ ID NO: 4323897 - DNA, 16 bp, Homo sapiens
tcttctttattgcact

SEQ ID NO: 4323898 - DNA, 20 bp, Homo sapiens
tcttctttattgcactagga

SEQ ID NO: 4323899 - DNA, 23 bp, Homo sapiens
tcttgacgggagcattggcccct

SEQ ID NO: 4323900 - DNA, 15 bp, Homo sapiens
tcttgatgactgctg

SEQ ID NO: 4323901 - DNA, 18 bp, Homo sapiens
tcttggaaatgttaagaa

SEQ ID NO: 4323902 - DNA, 19 bp, Homo sapiens
tcttggaaatgttaagaaa

SEQ ID NO: 4323903 - DNA, 20 bp, Homo sapiens
tcttgggtgttagtgtcagc

SEQ ID NO: 4323904 - DNA, 20 bp, Homo sapiens
tcttgttattaatgtttctt

SEQ ID NO: 4323905 - DNA, 13 bp, Homo sapiens
tcttgtttattga

SEQ ID NO: 4323906 - DNA, 15 bp, Homo sapiens
tctttatgtcaatct

SEQ ID NO: 4323907 - DNA, 22 bp, Homo sapiens
tctttattgcactaggaattct

SEQ ID NO: 4323908 - DNA, 11 bp, Homo sapiens
tctttcctgtc

SEQ ID NO: 4323909 - DNA, 20 bp, Homo sapiens
tctttgattctccttttatg

SEQ ID NO: 4323910 - DNA, 21 bp, Homo sapiens
tctttgattctccttttatgt

SEQ ID NO: 4323911 - DNA, 22 bp, Homo sapiens
tctttgcattccttacttgcac

SEQ ID NO: 4323912 - DNA, 17 bp, Homo sapiens
tctttgccttgatgttg

SEQ ID NO: 4323913 - DNA, 20 bp, Homo sapiens
tctttgtagaataaatggtt

SEQ ID NO: 4323914 - DNA, 17 bp, Homo sapiens
tctttgtcaatgctcta

SEQ ID NO: 4323915 - DNA, 13 bp, Homo sapiens
tctttgtgtaatc

SEQ ID NO: 4323916 - DNA, 19 bp, Homo sapiens
tctttgttctcagctcccc

SEQ ID NO: 4323917 - DNA, 15 bp, Homo sapiens
tctttgtttaaatgc

SEQ ID NO: 4323918 - DNA, 22 bp, Homo sapiens
tcttttattatcagttaaaatc

SEQ ID NO: 4323919 - DNA, 18 bp, Homo sapiens
tcttttgaggtccctgta

SEQ ID NO: 4323920 - DNA, 16 bp, Homo sapiens
tcttttggacctggct

SEQ ID NO: 4323921 - DNA, 23 bp, Homo sapiens
tcttttttgtttgtttctttgtg

SEQ ID NO: 4323922 - DNA, 12 bp, Homo sapiens
tgaaaaactttt

SEQ ID NO: 4323923 - DNA, 16 bp, Homo sapiens
tgaaaaaggaggaaga

SEQ ID NO: 4323924 - DNA, 22 bp, Homo sapiens
tgaaaaaggaggaagagaaaaa

SEQ ID NO: 4323925 - DNA, 21 bp, Homo sapiens
tgaaaaagtgtacatgaagaa

SEQ ID NO: 4323926 - DNA, 12 bp, Homo sapiens
tgaaaactgaca

SEQ ID NO: 4323927 - DNA, 18 bp, Homo sapiens
tgaaaactgacatcagat

SEQ ID NO: 4323928 - DNA, 20 bp, Homo sapiens
tgaaaagaaaaatgagcctg

SEQ ID NO: 4323929 - DNA, 20 bp, Homo sapiens
tgaaaagatcccaagatgga

SEQ ID NO: 4323930 - DNA, 17 bp, Homo sapiens
tgaaaagtcgttttcca

SEQ ID NO: 4323931 - DNA, 22 bp, Homo sapiens
tgaaaagtcgttttccaaactg

SEQ ID NO: 4323932 - DNA, 20 bp, Homo sapiens
tgaaaatatgatgtttcaca

SEQ ID NO: 4323933 - DNA, 19 bp, Homo sapiens
tgaaaattacgttcttaca

SEQ ID NO: 4323934 - DNA, 17 bp, Homo sapiens
tgaaacatgtgcccctg

SEQ ID NO: 4323935 - DNA, 14 bp, Homo sapiens
tgaaacgagaagtg

SEQ ID NO: 4323936 - DNA, 18 bp, Homo sapiens
tgaaacgagaagtgccct

SEQ ID NO: 4323937 - DNA, 19 bp, Homo sapiens
tgaaagaaaaaaaaatact

SEQ ID NO: 4323938 - DNA, 20 bp, Homo sapiens
tgaaagaaaaaaaaatactt

SEQ ID NO: 4323939 - DNA, 17 bp, Homo sapiens
tgaaagacaggagttta

SEQ ID NO: 4323940 - DNA, 17 bp, Homo sapiens
tgaaaggctatcctgct

SEQ ID NO: 4323941 - DNA, 12 bp, Homo sapiens
tgaaagttgctt

SEQ ID NO: 4323942 - DNA, 16 bp, Homo sapiens
tgaaagttgcttttat

SEQ ID NO: 4323943 - DNA, 17 bp, Homo sapiens
tgaaagttgcttttatt

SEQ ID NO: 4323944 - DNA, 19 bp, Homo sapiens
tgaaagttgcttttattgc

SEQ ID NO: 4323945 - DNA, 14 bp, Homo sapiens
ttgctgcttgaggc

SEQ ID NO: 4323946 - DNA, 16 bp, Homo sapiens
ttgctgcttgaggcaa

SEQ ID NO: 4323947 - DNA, 19 bp, Homo sapiens
ttgctggtgcctcttttca

SEQ ID NO: 4323948 - DNA, 14 bp, Homo sapiens
ttgctgtgccgtgt

SEQ ID NO: 4323949 - DNA, 20 bp, Homo sapiens
ttgctgtgtagttccctctg

SEQ ID NO: 4323950 - DNA, 21 bp, Homo sapiens
ttgctgtgtagttccctctgc

SEQ ID NO: 4323951 - DNA, 22 bp, Homo sapiens
ttgcttctgcagcaactcccac

SEQ ID NO: 4323952 - DNA, 20 bp, Homo sapiens
ttggaagaagttttttactt

SEQ ID NO: 4323953 - DNA, 18 bp, Homo sapiens
ttggacctatcaaaaact

SEQ ID NO: 4323954 - DNA, 20 bp, Homo sapiens
ttggacctggctaatggagt

SEQ ID NO: 4323955 - DNA, 24 bp, Homo sapiens
ttggagcattaactaaatgctcat

SEQ ID NO: 4323956 - DNA, 14 bp, Homo sapiens
ttggaggagactgg

SEQ ID NO: 4323957 - DNA, 17 bp, Homo sapiens
ttggaggagactgggca

SEQ ID NO: 4323958 - DNA, 12 bp, Homo sapiens
ttggagtgcccc

SEQ ID NO: 4323959 - DNA, 17 bp, Homo sapiens
ttggcataatttgtctt

SEQ ID NO: 4323960 - DNA, 19 bp, Homo sapiens
ttggggattgccactaagt

SEQ ID NO: 4323961 - DNA, 22 bp, Homo sapiens
ttggggggctgaggtgggagga

SEQ ID NO: 4323962 - DNA, 19 bp, Homo sapiens
ttggtcatggtagattttt

SEQ ID NO: 4323963 - DNA, 15 bp, Homo sapiens
ttgtagttcttagtc

SEQ ID NO: 4323964 - DNA, 18 bp, Homo sapiens
ttgtagtttttgctgaag

SEQ ID NO: 4323965 - DNA, 14 bp, Homo sapiens
ttgtattaataaag

SEQ ID NO: 4323966 - DNA, 18 bp, Homo sapiens
ttgtattaataaagcatt

SEQ ID NO: 4323967 - DNA, 15 bp, Homo sapiens
ttgtattgcttcctg

SEQ ID NO: 4323968 - DNA, 14 bp, Homo sapiens
ttgtcaaaattgtt

SEQ ID NO: 4323969 - DNA, 18 bp, Homo sapiens
ttgtcaatgctctaacaa

SEQ ID NO: 4323970 - DNA, 23 bp, Homo sapiens
ttgtcagaatggaatccatctgt

SEQ ID NO: 4323971 - DNA, 14 bp, Homo sapiens
ttgtccttaaaatt

SEQ ID NO: 4323972 - DNA, 20 bp, Homo sapiens
ttgtcctttgaggccccaac

SEQ ID NO: 4323973 - DNA, 13 bp, Homo sapiens
ttgtctattattg

SEQ ID NO: 4323974 - DNA, 21 bp, Homo sapiens
ttgtctccctggcaaggagaa

SEQ ID NO: 4323975 - DNA, 14 bp, Homo sapiens
ttgtctctcttcag

SEQ ID NO: 4323976 - DNA, 12 bp, Homo sapiens
ttgtctgtccag

SEQ ID NO: 4323977 - DNA, 23 bp, Homo sapiens
ttgtctgtgcttccttggttcat

SEQ ID NO: 4323978 - DNA, 17 bp, Homo sapiens
ttgtctgtgtgctgtaa

SEQ ID NO: 4323979 - DNA, 15 bp, Homo sapiens
ttgtcttaaaaagtg

SEQ ID NO: 4323980 - DNA, 14 bp, Homo sapiens
ttgtcttgttctgt

SEQ ID NO: 4323981 - DNA, 16 bp, Homo sapiens
ttgtgaatgcttctca

SEQ ID NO: 4323982 - DNA, 21 bp, Homo sapiens
ttgtgaatgtttagtgtgctg

SEQ ID NO: 4323983 - DNA, 18 bp, Homo sapiens
ttgtgcctggttcgtgcc

SEQ ID NO: 4323984 - DNA, 15 bp, Homo sapiens
ttgtgctatattttt

SEQ ID NO: 4323985 - DNA, 14 bp, Homo sapiens
ttgtgcttctcccc

SEQ ID NO: 4323986 - DNA, 16 bp, Homo sapiens
ttgtgcttctccccag

SEQ ID NO: 4323987 - DNA, 17 bp, Homo sapiens
ttgtgcttctccccaga

SEQ ID NO: 4323988 - DNA, 21 bp, Homo sapiens
ttgtggaggagggagagccct

SEQ ID NO: 4323989 - DNA, 14 bp, Homo sapiens
ttgtgtaatctaag

SEQ ID NO: 4323990 - DNA, 11 bp, Homo sapiens
ttgtgtattga

SEQ ID NO: 4323991 - DNA, 14 bp, Homo sapiens
ttgtgtgtatttgt

SEQ ID NO: 4323992 - DNA, 18 bp, Homo sapiens
ttgtgtttagctaccttt

SEQ ID NO: 4323993 - DNA, 23 bp, Homo sapiens
ttgtgtttagctacctttttata

SEQ ID NO: 4323994 - DNA, 15 bp, Homo sapiens
ttacaaaactgcttt

SEQ ID NO: 4323995 - DNA, 21 bp, Homo sapiens
ttacaaaactgctttgtgcat

SEQ ID NO: 4323996 - DNA, 16 bp, Homo sapiens
ttacaagcttaaagct

SEQ ID NO: 4323997 - DNA, 21 bp, Homo sapiens
ttacaagcttaaagcttgatt

SEQ ID NO: 4323998 - DNA, 19 bp, Homo sapiens
ttacaggacttctctttat

SEQ ID NO: 4323999 - DNA, 18 bp, Homo sapiens
ttacagggagcctcctgc

SEQ ID NO: 4324000 - DNA, 22 bp, Homo sapiens
ttaccaagtatgaagtataaat

SEQ ID NO: 4324001 - DNA, 15 bp, Homo sapiens
ttaccagtctgatta

SEQ ID NO: 4324002 - DNA, 21 bp, Homo sapiens
ttaccatttgctactgtacat

SEQ ID NO: 4324003 - DNA, 22 bp, Homo sapiens
ttaccctgcgattttgcctgtg

SEQ ID NO: 4324004 - DNA, 13 bp, Homo sapiens
ttacgtataatgc

SEQ ID NO: 4324005 - DNA, 22 bp, Homo sapiens
ttacgtgcatttaaactctgcc

SEQ ID NO: 4324006 - DNA, 16 bp, Homo sapiens
ttactcccttctgtag

SEQ ID NO: 4324007 - DNA, 21 bp, Homo sapiens
ttactcccttctgtagttttt

SEQ ID NO: 4324008 - DNA, 21 bp, Homo sapiens
ttactcttaaatcatttggtt

SEQ ID NO: 4324009 - DNA, 12 bp, Homo sapiens
ttactgaaagac

SEQ ID NO: 4324010 - DNA, 18 bp, Homo sapiens
ttactgaaagacaggagt

SEQ ID NO: 4324011 - DNA, 15 bp, Homo sapiens
ttactgatttagaag

SEQ ID NO: 4324012 - DNA, 18 bp, Homo sapiens
ttactgccttcctcctta

SEQ ID NO: 4324013 - DNA, 17 bp, Homo sapiens
ttactgctctagaaagt

SEQ ID NO: 4324014 - DNA, 19 bp, Homo sapiens
ttactggactgtctgatca

SEQ ID NO: 4324015 - DNA, 20 bp, Homo sapiens
ttagaagcaaagatttcagt

SEQ ID NO: 4324016 - DNA, 22 bp, Homo sapiens
ttagaccgctctcttttctgta

SEQ ID NO: 4324017 - DNA, 15 bp, Homo sapiens
ttagacctttatcca

SEQ ID NO: 4324018 - DNA, 22 bp, Homo sapiens
ttagactgtggccatatatgct

SEQ ID NO: 4324019 - DNA, 15 bp, Homo sapiens
ttagagataattctg

SEQ ID NO: 4324020 - DNA, 21 bp, Homo sapiens
ttagatgtttaccttcagcca

SEQ ID NO: 4324021 - DNA, 18 bp, Homo sapiens
ttagcccaatggagaaat

SEQ ID NO: 4324022 - DNA, 20 bp, Homo sapiens
ttagctacctttttatattt

SEQ ID NO: 4324023 - DNA, 13 bp, Homo sapiens
ttaggttgttacc

SEQ ID NO: 4324024 - DNA, 15 bp, Homo sapiens
ttagtatagtagaaa

SEQ ID NO: 4324025 - DNA, 19 bp, Homo sapiens
ttagtatagtagaaagaca

SEQ ID NO: 4324026 - DNA, 22 bp, Homo sapiens
ttagtgtgctgctgttctgtgt

SEQ ID NO: 4324027 - DNA, 18 bp, Homo sapiens
ttagttacgtataatgct

SEQ ID NO: 4324028 - DNA, 13 bp, Homo sapiens
ttagttataaaac

SEQ ID NO: 4324029 - DNA, 16 bp, Homo sapiens
ttagttcctcattagc

SEQ ID NO: 4324030 - DNA, 21 bp, Homo sapiens
ttagttgatattcaaggcttt

SEQ ID NO: 4324031 - DNA, 17 bp, Homo sapiens
ttataaaactatgtgtt

SEQ ID NO: 4324032 - DNA, 15 bp, Homo sapiens
ttataaaattgaaaa

SEQ ID NO: 4324033 - DNA, 18 bp, Homo sapiens
ttataaaattgaaaacac

SEQ ID NO: 4324034 - DNA, 20 bp, Homo sapiens
ttataaaattgaaaacacta

SEQ ID NO: 4324035 - DNA, 19 bp, Homo sapiens
ttataaatatatataaaga

SEQ ID NO: 4324036 - DNA, 15 bp, Homo sapiens
ttataaccaaagcaa

SEQ ID NO: 4324037 - DNA, 19 bp, Homo sapiens
ttataagagagcttattgt

SEQ ID NO: 4324038 - DNA, 14 bp, Homo sapiens
ttataagcgtattt

SEQ ID NO: 4324039 - DNA, 22 bp, Homo sapiens
ttataattagtcgggcatgagt

SEQ ID NO: 4324040 - DNA, 16 bp, Homo sapiens
ttatacacaactttgc

SEQ ID NO: 4324041 - DNA, 18 bp, Homo sapiens
ttatagctcccaaaagaa

SEQ ID NO: 4324042 - DNA, 15 bp, Homo sapiens
ttatcagtagaaaga

SEQ ID NO: 4324043 - DNA, 16 bp, Homo sapiens
ttatcagtagaaagag

SEQ ID NO: 4324044 - DNA, 14 bp, Homo sapiens
ttatcatattggtg

SEQ ID NO: 4324045 - DNA, 18 bp, Homo sapiens
ttatctatcggaagaaca

SEQ ID NO: 4324046 - DNA, 20 bp, Homo sapiens
ttatctatcggaagaacatg

SEQ ID NO: 4324047 - DNA, 14 bp, Homo sapiens
ttatctcactgttt

SEQ ID NO: 4324048 - DNA, 18 bp, Homo sapiens
ttatgaaattaacaagaa

SEQ ID NO: 4324049 - DNA, 17 bp, Homo sapiens
tgggaggtcaaggctgc

SEQ ID NO: 4324050 - DNA, 18 bp, Homo sapiens
tgggaggtcaaggctgca

SEQ ID NO: 4324051 - DNA, 13 bp, Homo sapiens
tgggatctgccaa

SEQ ID NO: 4324052 - DNA, 17 bp, Homo sapiens
tgggatgcccttccccc

SEQ ID NO: 4324053 - DNA, 17 bp, Homo sapiens
tgggcatctgttctggt

SEQ ID NO: 4324054 - DNA, 16 bp, Homo sapiens
tgggccacgattttaa

SEQ ID NO: 4324055 - DNA, 14 bp, Homo sapiens
tgggccctagagga

SEQ ID NO: 4324056 - DNA, 21 bp, Homo sapiens
tgggctattgaagatacacaa

SEQ ID NO: 4324057 - DNA, 17 bp, Homo sapiens
tgggcttgtctgtagat

SEQ ID NO: 4324058 - DNA, 21 bp, Homo sapiens
tgggcttgtctgtagatttta

SEQ ID NO: 4324059 - DNA, 21 bp, Homo sapiens
tggggaaaaggatgatggaaa

SEQ ID NO: 4324060 - DNA, 16 bp, Homo sapiens
tggggagggagtctgg

SEQ ID NO: 4324061 - DNA, 22 bp, Homo sapiens
tggggcttggggattgccacta

SEQ ID NO: 4324062 - DNA, 18 bp, Homo sapiens
tgggggatgtgaagaaat

SEQ ID NO: 4324063 - DNA, 13 bp, Homo sapiens
tgggggcaagaag

SEQ ID NO: 4324064 - DNA, 18 bp, Homo sapiens
tgggggcggggcctgggc

SEQ ID NO: 4324065 - DNA, 23 bp, Homo sapiens
tggggtttagaaccccaggtgag

SEQ ID NO: 4324066 - DNA, 17 bp, Homo sapiens
tgggtaaatgtggtgag

SEQ ID NO: 4324067 - DNA, 19 bp, Homo sapiens
tgggtatgtgttgccaaag

SEQ ID NO: 4324068 - DNA, 16 bp, Homo sapiens
tgggtcccttgctgca

SEQ ID NO: 4324069 - DNA, 16 bp, Homo sapiens
tgggtcctactcctgg

SEQ ID NO: 4324070 - DNA, 20 bp, Homo sapiens
tgggtcctactcctggagca

SEQ ID NO: 4324071 - DNA, 17 bp, Homo sapiens
tgggtctggtggtgctg

SEQ ID NO: 4324072 - DNA, 16 bp, Homo sapiens
tgggtgaagtgcctgc

SEQ ID NO: 4324073 - DNA, 19 bp, Homo sapiens
tgggtgaggctgggcaggg

SEQ ID NO: 4324074 - DNA, 20 bp, Homo sapiens
tgggtgaggctgggcagggc

SEQ ID NO: 4324075 - DNA, 15 bp, Homo sapiens
tgggtttgagacaga

SEQ ID NO: 4324076 - DNA, 14 bp, Homo sapiens
tggtaaaaaagaaa

SEQ ID NO: 4324077 - DNA, 17 bp, Homo sapiens
tggtaaaaaagaaatga

SEQ ID NO: 4324078 - DNA, 22 bp, Homo sapiens
tggtaaatatgagactattatg

SEQ ID NO: 4324079 - DNA, 17 bp, Homo sapiens
tggtacccccttctggg

SEQ ID NO: 4324080 - DNA, 20 bp, Homo sapiens
tggtactctgtgtctggcag

SEQ ID NO: 4324081 - DNA, 17 bp, Homo sapiens
tggtagatttttttcat

SEQ ID NO: 4324082 - DNA, 15 bp, Homo sapiens
tggtatatttgtaga

SEQ ID NO: 4324083 - DNA, 22 bp, Homo sapiens
tggtcgtcatgctgtccgtgct

SEQ ID NO: 4324084 - DNA, 21 bp, Homo sapiens
tggtctaccaatctgggaaga

SEQ ID NO: 4324085 - DNA, 16 bp, Homo sapiens
tggtgctgagtgctat

SEQ ID NO: 4324086 - DNA, 15 bp, Homo sapiens
tggtggaagtcttgg

SEQ ID NO: 4324087 - DNA, 23 bp, Homo sapiens
tggttcagtttttttttttccag

SEQ ID NO: 4324088 - DNA, 19 bp, Homo sapiens
tggttgggtggcaattcca

SEQ ID NO: 4324089 - DNA, 12 bp, Homo sapiens
tggttgtcagaa

SEQ ID NO: 4324090 - DNA, 14 bp, Homo sapiens
tggtttagtctttt

SEQ ID NO: 4324091 - DNA, 13 bp, Homo sapiens
tggtttgagattg

SEQ ID NO: 4324092 - DNA, 23 bp, Homo sapiens
tggtttttaaaaaactgctgact

SEQ ID NO: 4324093 - DNA, 15 bp, Homo sapiens
tggtttttatttcac

SEQ ID NO: 4324094 - DNA, 21 bp, Homo sapiens
tgtaatgtaggcacttttatt

SEQ ID NO: 4324095 - DNA, 12 bp, Homo sapiens
tgtaatgtcaga

SEQ ID NO: 4324096 - DNA, 13 bp, Homo sapiens
tgtaatgtcagac

SEQ ID NO: 4324097 - DNA, 15 bp, Homo sapiens
tgtaattaaactagt

SEQ ID NO: 4324098 - DNA, 22 bp, Homo sapiens
tgtaattatgtaacctatttat

SEQ ID NO: 4324099 - DNA, 14 bp, Homo sapiens
tgtacataaacaat

SEQ ID NO: 4324100 - DNA, 16 bp, Homo sapiens
tgtacatgaagaatgt

SEQ ID NO: 4324101 - DNA, 20 bp, Homo sapiens
tgtacttaaatgagttactt

SEQ ID NO: 4324102 - DNA, 15 bp, Homo sapiens
tgtagaataaatggt

SEQ ID NO: 4324103 - DNA, 13 bp, Homo sapiens
tgtagagagtggg

SEQ ID NO: 4324104 - DNA, 22 bp, Homo sapiens
tgtagccctctccaaatcaagg

SEQ ID NO: 4324105 - DNA, 17 bp, Homo sapiens
tgtaggcacttttattt

SEQ ID NO: 4324106 - DNA, 21 bp, Homo sapiens
tgtaggcacttttattttcat

SEQ ID NO: 4324107 - DNA, 15 bp, Homo sapiens
tgtaggtaaaatgta

SEQ ID NO: 4324108 - DNA, 13 bp, Homo sapiens
tgtagtcaagagg

SEQ ID NO: 4324109 - DNA, 21 bp, Homo sapiens
tgtagttccctctgcctggga

SEQ ID NO: 4324110 - DNA, 17 bp, Homo sapiens
tgtagtttttaattaaa

SEQ ID NO: 4324111 - DNA, 21 bp, Homo sapiens
tgtataaatctttcttttgat

SEQ ID NO: 4324112 - DNA, 19 bp, Homo sapiens
tgtatagtaccagaagcaa

SEQ ID NO: 4324113 - DNA, 21 bp, Homo sapiens
tgtatataatcatgctcatgt

SEQ ID NO: 4324114 - DNA, 18 bp, Homo sapiens
tgtatatatattctcagc

SEQ ID NO: 4324115 - DNA, 12 bp, Homo sapiens
tgtatgtagcct

SEQ ID NO: 4324116 - DNA, 11 bp, Homo sapiens
tgtattaataa

SEQ ID NO: 4324117 - DNA, 15 bp, Homo sapiens
tgtattaataaagca

SEQ ID NO: 4324118 - DNA, 17 bp, Homo sapiens
tgtattaataaagcatt

SEQ ID NO: 4324119 - DNA, 20 bp, Homo sapiens
tgtattgagtcttaactgta

SEQ ID NO: 4324120 - DNA, 21 bp, Homo sapiens
tgtatttaaaggtacaatcaa

SEQ ID NO: 4324121 - DNA, 20 bp, Homo sapiens
tgtatttcagtattttccag

SEQ ID NO: 4324122 - DNA, 14 bp, Homo sapiens
tgtatttctttgta

SEQ ID NO: 4324123 - DNA, 17 bp, Homo sapiens
tgtatttgtattaataa

SEQ ID NO: 4324124 - DNA, 19 bp, Homo sapiens
tgtatttttctacattatt

SEQ ID NO: 4324125 - DNA, 22 bp, Homo sapiens
tgtatttttctacattattgct

SEQ ID NO: 4324126 - DNA, 21 bp, Homo sapiens
tgtcaccagctggtatattgt

SEQ ID NO: 4324127 - DNA, 16 bp, Homo sapiens
tgtcacctccttcccc

SEQ ID NO: 4324128 - DNA, 18 bp, Homo sapiens
tgtcacctccttccccag

SEQ ID NO: 4324129 - DNA, 20 bp, Homo sapiens
tgtcagaatggaatccatct

SEQ ID NO: 4324130 - DNA, 22 bp, Homo sapiens
tgtcagaatggaatccatctgt

SEQ ID NO: 4324131 - DNA, 24 bp, Homo sapiens
tgtcagaatggaatccatctgtct

SEQ ID NO: 4324132 - DNA, 20 bp, Homo sapiens
tgtcagactttgctgcattt

SEQ ID NO: 4324133 - DNA, 16 bp, Homo sapiens
tgtcagctgaacctgg

SEQ ID NO: 4324134 - DNA, 12 bp, Homo sapiens
tgtcatgtgtct

SEQ ID NO: 4324135 - DNA, 16 bp, Homo sapiens
tgtcatttcattccat

SEQ ID NO: 4324136 - DNA, 12 bp, Homo sapiens
tgtcatttgctt

SEQ ID NO: 4324137 - DNA, 21 bp, Homo sapiens
tgtccaagggccgtgcccttg

SEQ ID NO: 4324138 - DNA, 24 bp, Homo sapiens
tgtccagccgtgtgtgcatgtgcc

SEQ ID NO: 4324139 - DNA, 20 bp, Homo sapiens
tgtccagctgggacctaatg

SEQ ID NO: 4324140 - DNA, 23 bp, Homo sapiens
tgtccccggcggggtgcctgctg

SEQ ID NO: 4324141 - DNA, 19 bp, Homo sapiens
tgtccttgcacctgagcct

SEQ ID NO: 4324142 - DNA, 20 bp, Homo sapiens
tgtccttgcacctgagcctg

SEQ ID NO: 4324143 - DNA, 17 bp, Homo sapiens
tgtcctttgaggcccca

SEQ ID NO: 4324144 - DNA, 16 bp, Homo sapiens
tgtctacctctgactt

SEQ ID NO: 4324145 - DNA, 12 bp, Homo sapiens
tgtctctgcatc

SEQ ID NO: 4324146 - DNA, 17 bp, Homo sapiens
tgtctgaatcatgtctg

SEQ ID NO: 4324147 - DNA, 19 bp, Homo sapiens
tgtctgaatcatgtctgta

SEQ ID NO: 4324148 - DNA, 20 bp, Homo sapiens
tgtctgaattgagaaaagag

SEQ ID NO: 4324149 - DNA, 23 bp, Homo sapiens
tgtctggcaggctactctgccca

SEQ ID NO: 4324150 - DNA, 16 bp, Homo sapiens
tgtctgtatccccagt

SEQ ID NO: 4324151 - DNA, 14 bp, Homo sapiens
tgtctgtgtgctgt

SEQ ID NO: 4324152 - DNA, 16 bp, Homo sapiens
tgtctgtttgttctct

SEQ ID NO: 4324153 - DNA, 22 bp, Homo sapiens
tgtcttggacctatcaaaaact

SEQ ID NO: 4324154 - DNA, 21 bp, Homo sapiens
tgtctttcctcccttctttgc

SEQ ID NO: 4324155 - DNA, 17 bp, Homo sapiens
tgtgaaaagaaaaatga

SEQ ID NO: 4324156 - DNA, 21 bp, Homo sapiens
tgtgaaaagaaaaatgagcct

SEQ ID NO: 4324157 - DNA, 15 bp, Homo sapiens
tgtgaagaaataagt

SEQ ID NO: 4324158 - DNA, 14 bp, Homo sapiens
tgtgaagagaacca

SEQ ID NO: 4324159 - DNA, 16 bp, Homo sapiens
tgtgaagccagatctc

SEQ ID NO: 4324160 - DNA, 16 bp, Homo sapiens
tgtgaaggacatgaga

SEQ ID NO: 4324161 - DNA, 21 bp, Homo sapiens
tgtgacacttatctcactgtt

SEQ ID NO: 4324162 - DNA, 22 bp, Homo sapiens
tgtgactcagtgtattttaaat

SEQ ID NO: 4324163 - DNA, 23 bp, Homo sapiens
tgtgaggggtttcttttggaaat

SEQ ID NO: 4324164 - DNA, 16 bp, Homo sapiens
tgtgcacactaagaaa

SEQ ID NO: 4324165 - DNA, 12 bp, Homo sapiens
tgtgcagacaat

SEQ ID NO: 4324166 - DNA, 11 bp, Homo sapiens
tgtgcatgtgc

SEQ ID NO: 4324167 - DNA, 13 bp, Homo sapiens
tgtgcatgtgcag

SEQ ID NO: 4324168 - DNA, 17 bp, Homo sapiens
tgtgcctcccttttctc

SEQ ID NO: 4324169 - DNA, 14 bp, Homo sapiens
tgacaaaagaaaat

SEQ ID NO: 4324170 - DNA, 13 bp, Homo sapiens
tgacaaagaaaat

SEQ ID NO: 4324171 - DNA, 14 bp, Homo sapiens
tgacaaagaaaatg

SEQ ID NO: 4324172 - DNA, 16 bp, Homo sapiens
tgacaaagaaaatgag

SEQ ID NO: 4324173 - DNA, 18 bp, Homo sapiens
tgacaaagaaaatgagaa

SEQ ID NO: 4324174 - DNA, 19 bp, Homo sapiens
tgacaagctaggaaagagg

SEQ ID NO: 4324175 - DNA, 15 bp, Homo sapiens
tgacacagcttgtga

SEQ ID NO: 4324176 - DNA, 19 bp, Homo sapiens
tgacacagcttgtgaatgt

SEQ ID NO: 4324177 - DNA, 17 bp, Homo sapiens
tgacacttatctcactg

SEQ ID NO: 4324178 - DNA, 22 bp, Homo sapiens
tgacagagcaagtgagaccctg

SEQ ID NO: 4324179 - DNA, 18 bp, Homo sapiens
tgacaggcctgaagatat

SEQ ID NO: 4324180 - DNA, 18 bp, Homo sapiens
tgacatcagatttcttaa

SEQ ID NO: 4324181 - DNA, 18 bp, Homo sapiens
tgaccattgaaaaaggaa

SEQ ID NO: 4324182 - DNA, 22 bp, Homo sapiens
tgaccattgaaaaaggaaaaat

SEQ ID NO: 4324183 - DNA, 12 bp, Homo sapiens
tgacccctttcc

SEQ ID NO: 4324184 - DNA, 14 bp, Homo sapiens
tgacctctgcaaga

SEQ ID NO: 4324185 - DNA, 12 bp, Homo sapiens
tgacgaaagagt

SEQ ID NO: 4324186 - DNA, 20 bp, Homo sapiens
tgactattgtaatgccaata

SEQ ID NO: 4324187 - DNA, 16 bp, Homo sapiens
tgactattttttaata

SEQ ID NO: 4324188 - DNA, 16 bp, Homo sapiens
tgactcagtgtatttt

SEQ ID NO: 4324189 - DNA, 22 bp, Homo sapiens
tgactgatggtttggaaaataa

SEQ ID NO: 4324190 - DNA, 18 bp, Homo sapiens
tgactggttgtcagaatg

SEQ ID NO: 4324191 - DNA, 21 bp, Homo sapiens
tgactggttgtcagaatggaa

SEQ ID NO: 4324192 - DNA, 21 bp, Homo sapiens
tgactgttttctcttgagagg

SEQ ID NO: 4324193 - DNA, 18 bp, Homo sapiens
tgacttttattatgggta

SEQ ID NO: 4324194 - DNA, 16 bp, Homo sapiens
tgagaataattatttc

SEQ ID NO: 4324195 - DNA, 21 bp, Homo sapiens
tgagaatctgtgcagtcatca

SEQ ID NO: 4324196 - DNA, 13 bp, Homo sapiens
tgagacagacacc

SEQ ID NO: 4324197 - DNA, 14 bp, Homo sapiens
tgagaccaacctgg

SEQ ID NO: 4324198 - DNA, 19 bp, Homo sapiens
tgagaccagaagaaaagac

SEQ ID NO: 4324199 - DNA, 19 bp, Homo sapiens
tgagacctcaaatcactgc

SEQ ID NO: 4324200 - DNA, 15 bp, Homo sapiens
tgagactaagagaaa

SEQ ID NO: 4324201 - DNA, 16 bp, Homo sapiens
tgagaggttagaatga

SEQ ID NO: 4324202 - DNA, 14 bp, Homo sapiens
tgagatcagcctgg

SEQ ID NO: 4324203 - DNA, 19 bp, Homo sapiens
tgagattgccccaggtctg

SEQ ID NO: 4324204 - DNA, 21 bp, Homo sapiens
tgagcaggtatcaactagggg

SEQ ID NO: 4324205 - DNA, 14 bp, Homo sapiens
tgagccccagcccc

SEQ ID NO: 4324206 - DNA, 23 bp, Homo sapiens
tgagcccccttcctgtccccagg

SEQ ID NO: 4324207 - DNA, 19 bp, Homo sapiens
tgagcctgggaggtcaagg

SEQ ID NO: 4324208 - DNA, 23 bp, Homo sapiens
tgagcctgtccaatttctgctgt

SEQ ID NO: 4324209 - DNA, 18 bp, Homo sapiens
tgagctatagtgaagaat

SEQ ID NO: 4324210 - DNA, 11 bp, Homo sapiens
tgagctcagga

SEQ ID NO: 4324211 - DNA, 15 bp, Homo sapiens
tgagctgaagaaatt

SEQ ID NO: 4324212 - DNA, 15 bp, Homo sapiens
tgagctttctgtgca

SEQ ID NO: 4324213 - DNA, 17 bp, Homo sapiens
tgagctttctgtgcatg

SEQ ID NO: 4324214 - DNA, 23 bp, Homo sapiens
tgaggaagatgggggcaagaaga

SEQ ID NO: 4324215 - DNA, 15 bp, Homo sapiens
tgaggactgaagctg

SEQ ID NO: 4324216 - DNA, 16 bp, Homo sapiens
tgaggactgaagctgg

SEQ ID NO: 4324217 - DNA, 18 bp, Homo sapiens
tgaggactgaagctgggg

SEQ ID NO: 4324218 - DNA, 16 bp, Homo sapiens
tgaggctgggcagggc

SEQ ID NO: 4324219 - DNA, 21 bp, Homo sapiens
tgagggtttctgatctgtact

SEQ ID NO: 4324220 - DNA, 16 bp, Homo sapiens
tgaggtagaggaaaat

SEQ ID NO: 4324221 - DNA, 12 bp, Homo sapiens
tgaggtgggagg

SEQ ID NO: 4324222 - DNA, 13 bp, Homo sapiens
tgaggtgggagga

SEQ ID NO: 4324223 - DNA, 21 bp, Homo sapiens
tgaggtgggaggatctcttga

SEQ ID NO: 4324224 - DNA, 22 bp, Homo sapiens
tgaggttagcccaatggagaaa

SEQ ID NO: 4324225 - DNA, 13 bp, Homo sapiens
tgagtccagaagt

SEQ ID NO: 4324226 - DNA, 22 bp, Homo sapiens
tgagtctgaaccaatagaaagc

SEQ ID NO: 4324227 - DNA, 14 bp, Homo sapiens
tgagtctgtttccc

SEQ ID NO: 4324228 - DNA, 17 bp, Homo sapiens
tgagtctgtttcccaag

SEQ ID NO: 4324229 - DNA, 20 bp, Homo sapiens
tgagtctgtttcccaagcta

SEQ ID NO: 4324230 - DNA, 14 bp, Homo sapiens
tgagtcttaactgt

SEQ ID NO: 4324231 - DNA, 18 bp, Homo sapiens
tgagtcttaactgtattt

SEQ ID NO: 4324232 - DNA, 20 bp, Homo sapiens
tgagtcttaactgtatttca

SEQ ID NO: 4324233 - DNA, 22 bp, Homo sapiens
tgagtgactttaggatgagcaa

SEQ ID NO: 4324234 - DNA, 15 bp, Homo sapiens
tgagtgagttttact

SEQ ID NO: 4324235 - DNA, 16 bp, Homo sapiens
tgagtgccatgctttt

SEQ ID NO: 4324236 - DNA, 17 bp, Homo sapiens
tgagtgccatgcttttt

SEQ ID NO: 4324237 - DNA, 21 bp, Homo sapiens
tgagtgggtgaataatacagt

SEQ ID NO: 4324238 - DNA, 14 bp, Homo sapiens
tgagttctgacact

SEQ ID NO: 4324239 - DNA, 15 bp, Homo sapiens
tgagttctgacactg

SEQ ID NO: 4324240 - DNA, 19 bp, Homo sapiens
tgagttgattcagctctgc

SEQ ID NO: 4324241 - DNA, 15 bp, Homo sapiens
tgagttgctggaaaa

SEQ ID NO: 4324242 - DNA, 16 bp, Homo sapiens
tgagttgctggaaaat

SEQ ID NO: 4324243 - DNA, 17 bp, Homo sapiens
tgagttgctggaaaatc

SEQ ID NO: 4324244 - DNA, 23 bp, Homo sapiens
tgagttgctggaaaatcatattg

SEQ ID NO: 4324245 - DNA, 16 bp, Homo sapiens
tgagtttgtaggtaaa

SEQ ID NO: 4324246 - DNA, 13 bp, Homo sapiens
tgcccttccccct

SEQ ID NO: 4324247 - DNA, 14 bp, Homo sapiens
tgcccttccccctt

SEQ ID NO: 4324248 - DNA, 22 bp, Homo sapiens
tgcccttccccctttctctgcc

SEQ ID NO: 4324249 - DNA, 23 bp, Homo sapiens
tgcccttccccctttctctgcct

SEQ ID NO: 4324250 - DNA, 12 bp, Homo sapiens
tgcccttccctg

SEQ ID NO: 4324251 - DNA, 15 bp, Homo sapiens
tgcccttccctggag

SEQ ID NO: 4324252 - DNA, 14 bp, Homo sapiens
tgcccttgtctgag

SEQ ID NO: 4324253 - DNA, 17 bp, Homo sapiens
tgccgaacattaggaat

SEQ ID NO: 4324254 - DNA, 15 bp, Homo sapiens
tgccgtcctggactc

SEQ ID NO: 4324255 - DNA, 21 bp, Homo sapiens
tgccgtgtccaagggccgtgc

SEQ ID NO: 4324256 - DNA, 19 bp, Homo sapiens
tgcctcttttcagtagtga

SEQ ID NO: 4324257 - DNA, 18 bp, Homo sapiens
tgcctgctgggtgccagg

SEQ ID NO: 4324258 - DNA, 19 bp, Homo sapiens
tgcctggtgcactgtgtct

SEQ ID NO: 4324259 - DNA, 16 bp, Homo sapiens
tgcctggttcgtgcca

SEQ ID NO: 4324260 - DNA, 19 bp, Homo sapiens
tgcctggttcgtgccatgc

SEQ ID NO: 4324261 - DNA, 13 bp, Homo sapiens
tgcctgtgtcctg

SEQ ID NO: 4324262 - DNA, 21 bp, Homo sapiens
tgcctgttttgagaccagaag

SEQ ID NO: 4324263 - DNA, 22 bp, Homo sapiens
tgcctgttttgagaccagaagg

SEQ ID NO: 4324264 - DNA, 18 bp, Homo sapiens
tgccttcgggaaaattca

SEQ ID NO: 4324265 - DNA, 21 bp, Homo sapiens
tgccttgatgttgtgttgtta

SEQ ID NO: 4324266 - DNA, 18 bp, Homo sapiens
tgcgaaaacgttgacccc

SEQ ID NO: 4324267 - DNA, 15 bp, Homo sapiens
tgcgaagcaagaaga

SEQ ID NO: 4324268 - DNA, 16 bp, Homo sapiens
tgcgaagcaagaagaa

SEQ ID NO: 4324269 - DNA, 19 bp, Homo sapiens
tgcgcacttacctgcttga

SEQ ID NO: 4324270 - DNA, 21 bp, Homo sapiens
tgcgcacttacctgcttgagc

SEQ ID NO: 4324271 - DNA, 15 bp, Homo sapiens
tgcgtactccactgg

SEQ ID NO: 4324272 - DNA, 21 bp, Homo sapiens
tgcgtcccccgttgtgcctgg

SEQ ID NO: 4324273 - DNA, 22 bp, Homo sapiens
tgcgtcccccgttgtgcctggt

SEQ ID NO: 4324274 - DNA, 15 bp, Homo sapiens
tgcgtctggaggggc

SEQ ID NO: 4324275 - DNA, 22 bp, Homo sapiens
tgcgtctggaggggcccctgct

SEQ ID NO: 4324276 - DNA, 18 bp, Homo sapiens
tgctaactgggaagaaca

SEQ ID NO: 4324277 - DNA, 19 bp, Homo sapiens
tgctaagctaaagaaactg

SEQ ID NO: 4324278 - DNA, 21 bp, Homo sapiens
tgctaagctaaagaaactgct

SEQ ID NO: 4324279 - DNA, 22 bp, Homo sapiens
tgctaagctaaagaaactgctt

SEQ ID NO: 4324280 - DNA, 23 bp, Homo sapiens
tgctaagctaaagaaactgctta

SEQ ID NO: 4324281 - DNA, 19 bp, Homo sapiens
tgctacccagaaccttttt

SEQ ID NO: 4324282 - DNA, 18 bp, Homo sapiens
tgctatatttttaaagaa

SEQ ID NO: 4324283 - DNA, 21 bp, Homo sapiens
tgctatatttttaaagaagga

SEQ ID NO: 4324284 - DNA, 20 bp, Homo sapiens
tgctattttttttaaatcaa

SEQ ID NO: 4324285 - DNA, 15 bp, Homo sapiens
tgctcattaaactga

SEQ ID NO: 4324286 - DNA, 23 bp, Homo sapiens
tgctcattaaactgattccagga

SEQ ID NO: 4324287 - DNA, 19 bp, Homo sapiens
tgctcctagagaggagaaa

SEQ ID NO: 4324288 - DNA, 19 bp, Homo sapiens
tgctcctggcccactgcat

SEQ ID NO: 4324289 - DNA, 18 bp, Homo sapiens
tgctcggcttcttggacc

SEQ ID NO: 4324290 - DNA, 16 bp, Homo sapiens
tgctctgggagactta

SEQ ID NO: 4324291 - DNA, 13 bp, Homo sapiens
tgctgaagggcat

SEQ ID NO: 4324292 - DNA, 22 bp, Homo sapiens
tcgatgactgtgaactgggcat

SEQ ID NO: 4324293 - DNA, 17 bp, Homo sapiens
tcgcccacaagccttac

SEQ ID NO: 4324294 - DNA, 13 bp, Homo sapiens
tcgcttgcttctg

SEQ ID NO: 4324295 - DNA, 14 bp, Homo sapiens
tcgcttgcttctgc

SEQ ID NO: 4324296 - DNA, 19 bp, Homo sapiens
tcgcttgcttctgcagcaa

SEQ ID NO: 4324297 - DNA, 20 bp, Homo sapiens
tcggcttcttggaccttggc

SEQ ID NO: 4324298 - DNA, 21 bp, Homo sapiens
tcgggactcagattggaatgt

SEQ ID NO: 4324299 - DNA, 17 bp, Homo sapiens
tcgggaggtcgaggcag

SEQ ID NO: 4324300 - DNA, 19 bp, Homo sapiens
tcggggaccagcccacagc

SEQ ID NO: 4324301 - DNA, 13 bp, Homo sapiens
tcgtttatgtgtg

SEQ ID NO: 4324302 - DNA, 13 bp, Homo sapiens
tctaaaaatagaa

SEQ ID NO: 4324303 - DNA, 18 bp, Homo sapiens
tctaaagcttctataaaa

SEQ ID NO: 4324304 - DNA, 15 bp, Homo sapiens
tctaaagctttatct

SEQ ID NO: 4324305 - DNA, 21 bp, Homo sapiens
tctaaagctttatctttgtgt

SEQ ID NO: 4324306 - DNA, 20 bp, Homo sapiens
tctaacagctccatacttct

SEQ ID NO: 4324307 - DNA, 20 bp, Homo sapiens
tctaatatccccaaattagg

SEQ ID NO: 4324308 - DNA, 20 bp, Homo sapiens
tctaatgttctaaattctat

SEQ ID NO: 4324309 - DNA, 20 bp, Homo sapiens
tctacattcttggttgttaa

SEQ ID NO: 4324310 - DNA, 19 bp, Homo sapiens
tctaccaatctgggaagat

SEQ ID NO: 4324311 - DNA, 22 bp, Homo sapiens
tctaccccacctgacctctgca

SEQ ID NO: 4324312 - DNA, 17 bp, Homo sapiens
tctacgttaagataaag

SEQ ID NO: 4324313 - DNA, 12 bp, Homo sapiens
tctactgtgaca

SEQ ID NO: 4324314 - DNA, 20 bp, Homo sapiens
tctactttttgtatttagta

SEQ ID NO: 4324315 - DNA, 15 bp, Homo sapiens
tctagcatttatttc

SEQ ID NO: 4324316 - DNA, 18 bp, Homo sapiens
tctataagtgttcagtgt

SEQ ID NO: 4324317 - DNA, 19 bp, Homo sapiens
tctataagtgttcagtgtt

SEQ ID NO: 4324318 - DNA, 21 bp, Homo sapiens
tctataagtgttcagtgttga

SEQ ID NO: 4324319 - DNA, 14 bp, Homo sapiens
tctatacctgcctt

SEQ ID NO: 4324320 - DNA, 15 bp, Homo sapiens
tctatacctgccttt

SEQ ID NO: 4324321 - DNA, 20 bp, Homo sapiens
tctatacctgtctcctttct

SEQ ID NO: 4324322 - DNA, 14 bp, Homo sapiens
tctatattaaatga

SEQ ID NO: 4324323 - DNA, 15 bp, Homo sapiens
tctatattaaatgag

SEQ ID NO: 4324324 - DNA, 15 bp, Homo sapiens
tctatccaaacatgt

SEQ ID NO: 4324325 - DNA, 14 bp, Homo sapiens
tctatggagacttt

SEQ ID NO: 4324326 - DNA, 20 bp, Homo sapiens
tctatggagactttgctgtt

SEQ ID NO: 4324327 - DNA, 16 bp, Homo sapiens
tctattattgaaatag

SEQ ID NO: 4324328 - DNA, 14 bp, Homo sapiens
tctatttacctcct

SEQ ID NO: 4324329 - DNA, 22 bp, Homo sapiens
tctatttacctcctaatggcat

SEQ ID NO: 4324330 - DNA, 14 bp, Homo sapiens
tctcacaggcagct

SEQ ID NO: 4324331 - DNA, 16 bp, Homo sapiens
tctcagcccagaagaa

SEQ ID NO: 4324332 - DNA, 18 bp, Homo sapiens
tctcagcccagaagaaaa

SEQ ID NO: 4324333 - DNA, 18 bp, Homo sapiens
tctcagctccccctgtcc

SEQ ID NO: 4324334 - DNA, 19 bp, Homo sapiens
tctcagctccccctgtccc

SEQ ID NO: 4324335 - DNA, 21 bp, Homo sapiens
tctcagctccccctgtcccct

SEQ ID NO: 4324336 - DNA, 22 bp, Homo sapiens
tctcagctccccctgtcccctc

SEQ ID NO: 4324337 - DNA, 14 bp, Homo sapiens
tctcagggcctggt

SEQ ID NO: 4324338 - DNA, 17 bp, Homo sapiens
tctcagtacctcccctc

SEQ ID NO: 4324339 - DNA, 14 bp, Homo sapiens
tctcagttgcagaa

SEQ ID NO: 4324340 - DNA, 15 bp, Homo sapiens
tctcatccattcctc

SEQ ID NO: 4324341 - DNA, 14 bp, Homo sapiens
tctcatcttgtgaa

SEQ ID NO: 4324342 - DNA, 19 bp, Homo sapiens
tctccaattctgaaatact

SEQ ID NO: 4324343 - DNA, 20 bp, Homo sapiens
tctccaattctgaaatactt

SEQ ID NO: 4324344 - DNA, 22 bp, Homo sapiens
tctccacacggagctcctggca

SEQ ID NO: 4324345 - DNA, 15 bp, Homo sapiens
tctccagcctggacc

SEQ ID NO: 4324346 - DNA, 22 bp, Homo sapiens
tctccagcctggacccccagct

SEQ ID NO: 4324347 - DNA, 21 bp, Homo sapiens
tctccagtgctgtccatgctt

SEQ ID NO: 4324348 - DNA, 12 bp, Homo sapiens
tctcccacccaa

SEQ ID NO: 4324349 - DNA, 15 bp, Homo sapiens
tctcccacccaagga

SEQ ID NO: 4324350 - DNA, 16 bp, Homo sapiens
tctcccacccaaggag

SEQ ID NO: 4324351 - DNA, 15 bp, Homo sapiens
tctcccagatcctgg

SEQ ID NO: 4324352 - DNA, 16 bp, Homo sapiens
tctcccaggcctctgc

SEQ ID NO: 4324353 - DNA, 13 bp, Homo sapiens
tctccctagccct

SEQ ID NO: 4324354 - DNA, 22 bp, Homo sapiens
tctccctccccaaatggctgct

SEQ ID NO: 4324355 - DNA, 14 bp, Homo sapiens
tctccctcccccag

SEQ ID NO: 4324356 - DNA, 20 bp, Homo sapiens
tctccctcccccagagcccc

SEQ ID NO: 4324357 - DNA, 12 bp, Homo sapiens
tctcctcctcca

SEQ ID NO: 4324358 - DNA, 18 bp, Homo sapiens
tctcctggagtctgaagc

SEQ ID NO: 4324359 - DNA, 22 bp, Homo sapiens
tctcctggagtctgaagcctgc

SEQ ID NO: 4324360 - DNA, 15 bp, Homo sapiens
tctcctgtccccggc

SEQ ID NO: 4324361 - DNA, 13 bp, Homo sapiens
tctcgcaactgaa

SEQ ID NO: 4324362 - DNA, 18 bp, Homo sapiens
tctcgcaactgaaggaag

SEQ ID NO: 4324363 - DNA, 16 bp, Homo sapiens
tctcgtattttgtccc

SEQ ID NO: 4324364 - DNA, 12 bp, Homo sapiens
tctctaagaaaa

SEQ ID NO: 4324365 - DNA, 22 bp, Homo sapiens
tctctaagtttagaagcgctca

SEQ ID NO: 4324366 - DNA, 18 bp, Homo sapiens
tctctataagtgttcagt

SEQ ID NO: 4324367 - DNA, 20 bp, Homo sapiens
tctctataagtgttcagtgt

SEQ ID NO: 4324368 - DNA, 22 bp, Homo sapiens
tctctataagtgttcagtgttg

SEQ ID NO: 4324369 - DNA, 15 bp, Homo sapiens
tctctccacacggag

SEQ ID NO: 4324370 - DNA, 19 bp, Homo sapiens
tctctccctcccccagagc

SEQ ID NO: 4324371 - DNA, 13 bp, Homo sapiens
tctctctttttct

SEQ ID NO: 4324372 - DNA, 23 bp, Homo sapiens
tctctgaatgctgagctgaagaa

SEQ ID NO: 4324373 - DNA, 13 bp, Homo sapiens
tctctgccaaagc

SEQ ID NO: 4324374 - DNA, 14 bp, Homo sapiens
tctctgcctggcaa

SEQ ID NO: 4324375 - DNA, 15 bp, Homo sapiens
tctctggcaaacttt

SEQ ID NO: 4324376 - DNA, 17 bp, Homo sapiens
tctctgtggctccaacc

SEQ ID NO: 4324377 - DNA, 22 bp, Homo sapiens
tctcttcagactctcagcccag

SEQ ID NO: 4324378 - DNA, 16 bp, Homo sapiens
tactttgtgtttagct

SEQ ID NO: 4324379 - DNA, 15 bp, Homo sapiens
tagaaaaaaactaaa

SEQ ID NO: 4324380 - DNA, 22 bp, Homo sapiens
tagaaaaaaactaaagttgaaa

SEQ ID NO: 4324381 - DNA, 13 bp, Homo sapiens
tagaaacatacac

SEQ ID NO: 4324382 - DNA, 17 bp, Homo sapiens
tagaaagacatctgcct

SEQ ID NO: 4324383 - DNA, 18 bp, Homo sapiens
tagaaagacatctgcctg

SEQ ID NO: 4324384 - DNA, 21 bp, Homo sapiens
tagaaagagtgttatcatatt

SEQ ID NO: 4324385 - DNA, 22 bp, Homo sapiens
tagaaagtatagatggccaaag

SEQ ID NO: 4324386 - DNA, 23 bp, Homo sapiens
tagaaagttgctaactgggaaga

SEQ ID NO: 4324387 - DNA, 15 bp, Homo sapiens
tagaaatgtttcata

SEQ ID NO: 4324388 - DNA, 15 bp, Homo sapiens
tagaaccccaggtga

SEQ ID NO: 4324389 - DNA, 14 bp, Homo sapiens
tagaagaagaggaa

SEQ ID NO: 4324390 - DNA, 15 bp, Homo sapiens
tagaagaagaggaag

SEQ ID NO: 4324391 - DNA, 20 bp, Homo sapiens
tagaagcaaagatttcagta

SEQ ID NO: 4324392 - DNA, 14 bp, Homo sapiens
tagaataaatggtt

SEQ ID NO: 4324393 - DNA, 15 bp, Homo sapiens
tagaataaatggttt

SEQ ID NO: 4324394 - DNA, 15 bp, Homo sapiens
tagaatgtcttggtg

SEQ ID NO: 4324395 - DNA, 17 bp, Homo sapiens
tagacaatcattgtttt

SEQ ID NO: 4324396 - DNA, 13 bp, Homo sapiens
tagactctgactt

SEQ ID NO: 4324397 - DNA, 13 bp, Homo sapiens
tagactgtgtctg

SEQ ID NO: 4324398 - DNA, 21 bp, Homo sapiens
tagactgtgtctgaatcatgt

SEQ ID NO: 4324399 - DNA, 22 bp, Homo sapiens
tagactgtgtctgaatcatgtc

SEQ ID NO: 4324400 - DNA, 23 bp, Homo sapiens
tagagagtgggtcacatttgtta

SEQ ID NO: 4324401 - DNA, 17 bp, Homo sapiens
tagaggtatattggaag

SEQ ID NO: 4324402 - DNA, 16 bp, Homo sapiens
tagagtaatgatgtaa

SEQ ID NO: 4324403 - DNA, 15 bp, Homo sapiens
tagattgtcttaatg

SEQ ID NO: 4324404 - DNA, 13 bp, Homo sapiens
tagatttgaaaaa

SEQ ID NO: 4324405 - DNA, 16 bp, Homo sapiens
tagcatggggcccctg

SEQ ID NO: 4324406 - DNA, 22 bp, Homo sapiens
tagcatggggcccctggcccag

SEQ ID NO: 4324407 - DNA, 21 bp, Homo sapiens
tagcatttagagcttttcaga

SEQ ID NO: 4324408 - DNA, 18 bp, Homo sapiens
tagcatttatttctctgg

SEQ ID NO: 4324409 - DNA, 16 bp, Homo sapiens
tagcattttgctaaat

SEQ ID NO: 4324410 - DNA, 18 bp, Homo sapiens
tagcccaatggagaaatg

SEQ ID NO: 4324411 - DNA, 13 bp, Homo sapiens
tagccccacccag

SEQ ID NO: 4324412 - DNA, 19 bp, Homo sapiens
tagccctctccaaatcaag

SEQ ID NO: 4324413 - DNA, 20 bp, Homo sapiens
tagcctaatacaacatgtag

SEQ ID NO: 4324414 - DNA, 20 bp, Homo sapiens
tagcctctgggatctgccaa

SEQ ID NO: 4324415 - DNA, 22 bp, Homo sapiens
tagcctctgggatctgccaaca

SEQ ID NO: 4324416 - DNA, 19 bp, Homo sapiens
tagctcaatcacactggaa

SEQ ID NO: 4324417 - DNA, 16 bp, Homo sapiens
tagctcccaaaagaat

SEQ ID NO: 4324418 - DNA, 14 bp, Homo sapiens
taggaattcaattt

SEQ ID NO: 4324419 - DNA, 16 bp, Homo sapiens
taggaattctttgcat

SEQ ID NO: 4324420 - DNA, 21 bp, Homo sapiens
taggacaaaaagaccttctcc

SEQ ID NO: 4324421 - DNA, 17 bp, Homo sapiens
taggatgagcaaaacat

SEQ ID NO: 4324422 - DNA, 22 bp, Homo sapiens
taggattgggggatgtgaagaa

SEQ ID NO: 4324423 - DNA, 19 bp, Homo sapiens
taggcagcaacagcagagc

SEQ ID NO: 4324424 - DNA, 18 bp, Homo sapiens
taggcaggtggagagagt

SEQ ID NO: 4324425 - DNA, 11 bp, Homo sapiens
tagggaaaaac

SEQ ID NO: 4324426 - DNA, 19 bp, Homo sapiens
tagggaaaaaccagcgtgt

SEQ ID NO: 4324427 - DNA, 13 bp, Homo sapiens
tagggaagataat

SEQ ID NO: 4324428 - DNA, 12 bp, Homo sapiens
taggggaggaga

SEQ ID NO: 4324429 - DNA, 13 bp, Homo sapiens
tagggttatattt

SEQ ID NO: 4324430 - DNA, 14 bp, Homo sapiens
taggtaaaatgtat

SEQ ID NO: 4324431 - DNA, 16 bp, Homo sapiens
taggtaaaatgtattt

SEQ ID NO: 4324432 - DNA, 22 bp, Homo sapiens
taggttgttaccaagtatgaag

SEQ ID NO: 4324433 - DNA, 12 bp, Homo sapiens
tagtaaatatta

SEQ ID NO: 4324434 - DNA, 22 bp, Homo sapiens
tagtaaatattatgattttatt

SEQ ID NO: 4324435 - DNA, 22 bp, Homo sapiens
tagtagaaagacatctgcctgt

SEQ ID NO: 4324436 - DNA, 16 bp, Homo sapiens
tagtatagtagaaaga

SEQ ID NO: 4324437 - DNA, 20 bp, Homo sapiens
tagtattcttgagggacaat

SEQ ID NO: 4324438 - DNA, 21 bp, Homo sapiens
tagtcaagaggtttttctccc

SEQ ID NO: 4324439 - DNA, 19 bp, Homo sapiens
tagtcagactgacactact

SEQ ID NO: 4324440 - DNA, 16 bp, Homo sapiens
tagtgccaaataattg

SEQ ID NO: 4324441 - DNA, 15 bp, Homo sapiens
tagttacgtataatg

SEQ ID NO: 4324442 - DNA, 15 bp, Homo sapiens
tagttccctctgcct

SEQ ID NO: 4324443 - DNA, 18 bp, Homo sapiens
tagttccctctgcctggg

SEQ ID NO: 4324444 - DNA, 15 bp, Homo sapiens
tagttgtctgtgctt

SEQ ID NO: 4324445 - DNA, 18 bp, Homo sapiens
tagtttccaagaaatttt

SEQ ID NO: 4324446 - DNA, 16 bp, Homo sapiens
tagtttccctggtgcc

SEQ ID NO: 4324447 - DNA, 21 bp, Homo sapiens
tagttttgcatcacattgtca

SEQ ID NO: 4324448 - DNA, 16 bp, Homo sapiens
tagtttttaattaaaa

SEQ ID NO: 4324449 - DNA, 17 bp, Homo sapiens
tataaaattgaaaacac

SEQ ID NO: 4324450 - DNA, 22 bp, Homo sapiens
tataaaattgaaaacactaaca

SEQ ID NO: 4324451 - DNA, 18 bp, Homo sapiens
tataaatgactattgtaa

SEQ ID NO: 4324452 - DNA, 19 bp, Homo sapiens
tataaattaaataaactgt

SEQ ID NO: 4324453 - DNA, 22 bp, Homo sapiens
tataagatcactgaagaaagag

SEQ ID NO: 4324454 - DNA, 17 bp, Homo sapiens
tataagcgtatttagac

SEQ ID NO: 4324455 - DNA, 14 bp, Homo sapiens
tataaggtaatgta

SEQ ID NO: 4324456 - DNA, 17 bp, Homo sapiens
tataagtgttcagtgtt

SEQ ID NO: 4324457 - DNA, 18 bp, Homo sapiens
tataatcatgctcatgta

SEQ ID NO: 4324458 - DNA, 20 bp, Homo sapiens
tataatcatgctcatgtata

SEQ ID NO: 4324459 - DNA, 18 bp, Homo sapiens
tataatctcctctgctca

SEQ ID NO: 4324460 - DNA, 24 bp, Homo sapiens
tataattagtcgggcatgagtctg

SEQ ID NO: 4324461 - DNA, 18 bp, Homo sapiens
tataccatgtgtgctaat

SEQ ID NO: 4324462 - DNA, 14 bp, Homo sapiens
tatactgcagcttt

SEQ ID NO: 4324463 - DNA, 14 bp, Homo sapiens
tatactgtcttgtc

SEQ ID NO: 4324464 - DNA, 18 bp, Homo sapiens
tatactgtcttgtctcac

SEQ ID NO: 4324465 - DNA, 14 bp, Homo sapiens
tatactttgtggac

SEQ ID NO: 4324466 - DNA, 20 bp, Homo sapiens
tatagctcccaaaagaatgg

SEQ ID NO: 4324467 - DNA, 23 bp, Homo sapiens
tatagtagaaagacatctgcctg

SEQ ID NO: 4324468 - DNA, 20 bp, Homo sapiens
tatagtttggaaataaaaat

SEQ ID NO: 4324469 - DNA, 17 bp, Homo sapiens
tatataaggtaatgtag

SEQ ID NO: 4324470 - DNA, 20 bp, Homo sapiens
tatataatcatgctcatgta

SEQ ID NO: 4324471 - DNA, 15 bp, Homo sapiens
tatatataaagtata

SEQ ID NO: 4324472 - DNA, 15 bp, Homo sapiens
tatatatagttagat

SEQ ID NO: 4324473 - DNA, 14 bp, Homo sapiens
tatatatatataaa

SEQ ID NO: 4324474 - DNA, 15 bp, Homo sapiens
tatatatatatataa

SEQ ID NO: 4324475 - DNA, 13 bp, Homo sapiens
tatatattctcag

SEQ ID NO: 4324476 - DNA, 12 bp, Homo sapiens
tatatgctgtat

SEQ ID NO: 4324477 - DNA, 14 bp, Homo sapiens
tatatgctgtattt

SEQ ID NO: 4324478 - DNA, 16 bp, Homo sapiens
tatatgctgtatttct

SEQ ID NO: 4324479 - DNA, 17 bp, Homo sapiens
tatattactgatttaga

SEQ ID NO: 4324480 - DNA, 20 bp, Homo sapiens
tatattataaatatatataa

SEQ ID NO: 4324481 - DNA, 20 bp, Homo sapiens
tcaatttggagcattaacta

SEQ ID NO: 4324482 - DNA, 20 bp, Homo sapiens
tcacaaattccgattagacc

SEQ ID NO: 4324483 - DNA, 23 bp, Homo sapiens
tcacaaattccgattagaccttt

SEQ ID NO: 4324484 - DNA, 20 bp, Homo sapiens
tcacaagtctcctagacact

SEQ ID NO: 4324485 - DNA, 21 bp, Homo sapiens
tcacaagtctcctagacactc

SEQ ID NO: 4324486 - DNA, 18 bp, Homo sapiens
tcacactgcagagactaa

SEQ ID NO: 4324487 - DNA, 20 bp, Homo sapiens
tcacagaccaagtccaagcc

SEQ ID NO: 4324488 - DNA, 18 bp, Homo sapiens
tcacaggcagctctgagc

SEQ ID NO: 4324489 - DNA, 15 bp, Homo sapiens
tcacagtgggaagaa

SEQ ID NO: 4324490 - DNA, 16 bp, Homo sapiens
tcacagtgggaagaat

SEQ ID NO: 4324491 - DNA, 18 bp, Homo sapiens
tcacagtgggaagaatag

SEQ ID NO: 4324492 - DNA, 15 bp, Homo sapiens
tcacatctaaagctt

SEQ ID NO: 4324493 - DNA, 21 bp, Homo sapiens
tcacatttgtatgtgtgtaga

SEQ ID NO: 4324494 - DNA, 14 bp, Homo sapiens
tcacattttaagtg

SEQ ID NO: 4324495 - DNA, 23 bp, Homo sapiens
tcacattttaagtgcttcacatt

SEQ ID NO: 4324496 - DNA, 14 bp, Homo sapiens
tcacctccttcccc

SEQ ID NO: 4324497 - DNA, 17 bp, Homo sapiens
tcacctccttccccagc

SEQ ID NO: 4324498 - DNA, 20 bp, Homo sapiens
tcacctccttccccagctcc

SEQ ID NO: 4324499 - DNA, 13 bp, Homo sapiens
tcacgaactgttc

SEQ ID NO: 4324500 - DNA, 20 bp, Homo sapiens
tcacgcctgtaatcctagca

SEQ ID NO: 4324501 - DNA, 12 bp, Homo sapiens
tcacgctccccg

SEQ ID NO: 4324502 - DNA, 16 bp, Homo sapiens
tcacggaagagccttg

SEQ ID NO: 4324503 - DNA, 19 bp, Homo sapiens
taagaaatgggactctgaa

SEQ ID NO: 4324504 - DNA, 18 bp, Homo sapiens
taagaactgaatccatat

SEQ ID NO: 4324505 - DNA, 12 bp, Homo sapiens
taagaccacctt

SEQ ID NO: 4324506 - DNA, 18 bp, Homo sapiens
taagagaaaccttgcaaa

SEQ ID NO: 4324507 - DNA, 22 bp, Homo sapiens
taagaggatggatgaatctgga

SEQ ID NO: 4324508 - DNA, 21 bp, Homo sapiens
taagataatggataatcttcg

SEQ ID NO: 4324509 - DNA, 23 bp, Homo sapiens
taagcgaatgtgtacaaagtgta

SEQ ID NO: 4324510 - DNA, 19 bp, Homo sapiens
taagcttctagacactcct

SEQ ID NO: 4324511 - DNA, 21 bp, Homo sapiens
taaggatcaccccagccccca

SEQ ID NO: 4324512 - DNA, 19 bp, Homo sapiens
taagggtggaaaaatgccc

SEQ ID NO: 4324513 - DNA, 17 bp, Homo sapiens
taagtacccttggggtg

SEQ ID NO: 4324514 - DNA, 17 bp, Homo sapiens
taagtgacagtcactta

SEQ ID NO: 4324515 - DNA, 20 bp, Homo sapiens
taagtgcttcacatttgtat

SEQ ID NO: 4324516 - DNA, 15 bp, Homo sapiens
taagtgtcatttctt

SEQ ID NO: 4324517 - DNA, 15 bp, Homo sapiens
taagtgttcagtgtt

SEQ ID NO: 4324518 - DNA, 16 bp, Homo sapiens
taagtgttcagtgttg

SEQ ID NO: 4324519 - DNA, 22 bp, Homo sapiens
taagtgttcagtgttgacatag

SEQ ID NO: 4324520 - DNA, 18 bp, Homo sapiens
taataaactttgaataaa

SEQ ID NO: 4324521 - DNA, 11 bp, Homo sapiens
taataaagcat

SEQ ID NO: 4324522 - DNA, 13 bp, Homo sapiens
taataaagcattc

SEQ ID NO: 4324523 - DNA, 12 bp, Homo sapiens
taataactgaat

SEQ ID NO: 4324524 - DNA, 19 bp, Homo sapiens
taataactgaataaaaaat

SEQ ID NO: 4324525 - DNA, 19 bp, Homo sapiens
taataatattgtttttctt

SEQ ID NO: 4324526 - DNA, 22 bp, Homo sapiens
taatacaacatgtagctgagtt

SEQ ID NO: 4324527 - DNA, 12 bp, Homo sapiens
taataggaattc

SEQ ID NO: 4324528 - DNA, 23 bp, Homo sapiens
taatattgtttttctttctacaa

SEQ ID NO: 4324529 - DNA, 19 bp, Homo sapiens
taatgctattttaaaaaat

SEQ ID NO: 4324530 - DNA, 22 bp, Homo sapiens
taatgctattttaaaaaatata

SEQ ID NO: 4324531 - DNA, 18 bp, Homo sapiens
taatgctggcctgactgg

SEQ ID NO: 4324532 - DNA, 20 bp, Homo sapiens
taatgcttagagaatgttct

SEQ ID NO: 4324533 - DNA, 13 bp, Homo sapiens
taatggagtgttt

SEQ ID NO: 4324534 - DNA, 17 bp, Homo sapiens
taatggagtgtttgaaa

SEQ ID NO: 4324535 - DNA, 19 bp, Homo sapiens
taatggagtgtttgaaaac

SEQ ID NO: 4324536 - DNA, 14 bp, Homo sapiens
taatgtagaaatgt

SEQ ID NO: 4324537 - DNA, 14 bp, Homo sapiens
taatgtctgtcaga

SEQ ID NO: 4324538 - DNA, 15 bp, Homo sapiens
taatgtctgtcagaa

SEQ ID NO: 4324539 - DNA, 21 bp, Homo sapiens
taatgtctgtcagaagacact

SEQ ID NO: 4324540 - DNA, 15 bp, Homo sapiens
taatgtgtctgtgtt

SEQ ID NO: 4324541 - DNA, 12 bp, Homo sapiens
taattaaaaact

SEQ ID NO: 4324542 - DNA, 14 bp, Homo sapiens
taattaaaaacttt

SEQ ID NO: 4324543 - DNA, 17 bp, Homo sapiens
taattaaaaactttaaa

SEQ ID NO: 4324544 - DNA, 17 bp, Homo sapiens
taattaaactagtttaa

SEQ ID NO: 4324545 - DNA, 16 bp, Homo sapiens
taattaggatcatatg

SEQ ID NO: 4324546 - DNA, 16 bp, Homo sapiens
taattatgtaacctat

SEQ ID NO: 4324547 - DNA, 17 bp, Homo sapiens
taattcatacctccctc

SEQ ID NO: 4324548 - DNA, 16 bp, Homo sapiens
taattcctacagcact

SEQ ID NO: 4324549 - DNA, 18 bp, Homo sapiens
taattccttaaatgaact

SEQ ID NO: 4324550 - DNA, 21 bp, Homo sapiens
taattccttaaatgaactact

SEQ ID NO: 4324551 - DNA, 16 bp, Homo sapiens
taattgtacaagcagt

SEQ ID NO: 4324552 - DNA, 15 bp, Homo sapiens
taatttgtcttagtt

SEQ ID NO: 4324553 - DNA, 20 bp, Homo sapiens
tacaaaactgctttgtgcat

SEQ ID NO: 4324554 - DNA, 20 bp, Homo sapiens
tacaaattttttaatttcca

SEQ ID NO: 4324555 - DNA, 23 bp, Homo sapiens
tacaatcgacatcctagccccac

SEQ ID NO: 4324556 - DNA, 14 bp, Homo sapiens
tacacaactttgca

SEQ ID NO: 4324557 - DNA, 22 bp, Homo sapiens
tacacaagagggactgtatttc

SEQ ID NO: 4324558 - DNA, 20 bp, Homo sapiens
tacacaaggccagaaaaaga

SEQ ID NO: 4324559 - DNA, 21 bp, Homo sapiens
tacacaaggccagaaaaagaa

SEQ ID NO: 4324560 - DNA, 14 bp, Homo sapiens
tacacatataaaaa

SEQ ID NO: 4324561 - DNA, 14 bp, Homo sapiens
tacacatgtgctga

SEQ ID NO: 4324562 - DNA, 21 bp, Homo sapiens
tacacatgtgctgatgtttac

SEQ ID NO: 4324563 - DNA, 19 bp, Homo sapiens
tacagaaatgtttttaaca

SEQ ID NO: 4324564 - DNA, 22 bp, Homo sapiens
tacagcactactgggtgtcatt

SEQ ID NO: 4324565 - DNA, 14 bp, Homo sapiens
tacagctattaaaa

SEQ ID NO: 4324566 - DNA, 18 bp, Homo sapiens
tacagctattaaaatgta

SEQ ID NO: 4324567 - DNA, 15 bp, Homo sapiens
tacagggagcctcct

SEQ ID NO: 4324568 - DNA, 16 bp, Homo sapiens
tacagggagcctcctg

SEQ ID NO: 4324569 - DNA, 18 bp, Homo sapiens
tacagggagcctcctgcc

SEQ ID NO: 4324570 - DNA, 20 bp, Homo sapiens
tacagggagcctcctgccca

SEQ ID NO: 4324571 - DNA, 18 bp, Homo sapiens
tacagtatctcagggcct

SEQ ID NO: 4324572 - DNA, 22 bp, Homo sapiens
tacagtcccagcacatttcctc

SEQ ID NO: 4324573 - DNA, 20 bp, Homo sapiens
tacagttgaaaaacagctga

SEQ ID NO: 4324574 - DNA, 16 bp, Homo sapiens
tacataaagtcatcaa

SEQ ID NO: 4324575 - DNA, 19 bp, Homo sapiens
tacataaagtcatcaaagt

SEQ ID NO: 4324576 - DNA, 14 bp, Homo sapiens
tacatgaagaatgt

SEQ ID NO: 4324577 - DNA, 19 bp, Homo sapiens
tacattcttggttgttaat

SEQ ID NO: 4324578 - DNA, 16 bp, Homo sapiens
taccaagtgctgtctt

SEQ ID NO: 4324579 - DNA, 13 bp, Homo sapiens
taccaatctggga

SEQ ID NO: 4324580 - DNA, 16 bp, Homo sapiens
taccaatctgggaaga

SEQ ID NO: 4324581 - DNA, 18 bp, Homo sapiens
taccagaagcaaggtctc

SEQ ID NO: 4324582 - DNA, 17 bp, Homo sapiens
taccagctaccctgtgt

SEQ ID NO: 4324583 - DNA, 13 bp, Homo sapiens
taccagtctgatt

SEQ ID NO: 4324584 - DNA, 17 bp, Homo sapiens
taccatgtgtgctaata

SEQ ID NO: 4324585 - DNA, 14 bp, Homo sapiens
taccatttttcatt

SEQ ID NO: 4324586 - DNA, 19 bp, Homo sapiens
tacccataagtaatattta

SEQ ID NO: 4324587 - DNA, 11 bp, Homo sapiens
taccccacaca

SEQ ID NO: 4324588 - DNA, 17 bp, Homo sapiens
taccccccaacccctga

SEQ ID NO: 4324589 - DNA, 14 bp, Homo sapiens
taccctctccaggc

SEQ ID NO: 4324590 - DNA, 16 bp, Homo sapiens
tacccttttcctttgt

SEQ ID NO: 4324591 - DNA, 17 bp, Homo sapiens
tacctattaaaggaaaa

SEQ ID NO: 4324592 - DNA, 18 bp, Homo sapiens
tacctattaaaggaaaac

SEQ ID NO: 4324593 - DNA, 23 bp, Homo sapiens
tacctcccctccccgccccctga

SEQ ID NO: 4324594 - DNA, 17 bp, Homo sapiens
tacctcctaatggcatg

SEQ ID NO: 4324595 - DNA, 18 bp, Homo sapiens
tacctcggtgccttcctc

SEQ ID NO: 4324596 - DNA, 20 bp, Homo sapiens
tacctctcgtttctgcccag

SEQ ID NO: 4324597 - DNA, 23 bp, Homo sapiens
tacctgcttgagctttctgtgca

SEQ ID NO: 4324598 - DNA, 14 bp, Homo sapiens
taccttctcccagg

SEQ ID NO: 4324599 - DNA, 22 bp, Homo sapiens
tacgccaggggaaaatcagcct

SEQ ID NO: 4324600 - DNA, 15 bp, Homo sapiens
tacgctatgtagaat

SEQ ID NO: 4324601 - DNA, 13 bp, Homo sapiens
tacgtacatacac

SEQ ID NO: 4324602 - DNA, 17 bp, Homo sapiens
tacgtataatgctttct

SEQ ID NO: 4324603 - DNA, 18 bp, Homo sapiens
tacgtataatgctttctg

SEQ ID NO: 4324604 - DNA, 16 bp, Homo sapiens
tactaatttattgccg

SEQ ID NO: 4324605 - DNA, 14 bp, Homo sapiens
tactagcatttaga

SEQ ID NO: 4324606 - DNA, 13 bp, Homo sapiens
tactcctattttt

SEQ ID NO: 4324607 - DNA, 14 bp, Homo sapiens
tactcctatttttg

SEQ ID NO: 4324608 - DNA, 21 bp, Homo sapiens
tactcctatttttgtaaactg

SEQ ID NO: 4324609 - DNA, 23 bp, Homo sapiens
tactctaaagcttctataaaata

SEQ ID NO: 4324610 - DNA, 19 bp, Homo sapiens
gtgccataccttctcccag

SEQ ID NO: 4324611 - DNA, 21 bp, Homo sapiens
gtgccataccttctcccaggc

SEQ ID NO: 4324612 - DNA, 18 bp, Homo sapiens
gtgcccggtgcagggcct

SEQ ID NO: 4324613 - DNA, 19 bp, Homo sapiens
gtgcccggtgcagggcctg

SEQ ID NO: 4324614 - DNA, 22 bp, Homo sapiens
gtgccgagaaggaagcctccca

SEQ ID NO: 4324615 - DNA, 16 bp, Homo sapiens
gtgcctgaaagctggg

SEQ ID NO: 4324616 - DNA, 20 bp, Homo sapiens
gtgcctgctgggtgccaggt

SEQ ID NO: 4324617 - DNA, 22 bp, Homo sapiens
gtgcctgctgggtgccaggtgc

SEQ ID NO: 4324618 - DNA, 18 bp, Homo sapiens
gtgcgcacttacctgctt

SEQ ID NO: 4324619 - DNA, 20 bp, Homo sapiens
gtgctagtcaactggggaaa

SEQ ID NO: 4324620 - DNA, 17 bp, Homo sapiens
gtgctctgaagtgtcct

SEQ ID NO: 4324621 - DNA, 15 bp, Homo sapiens
gtgctgagcctgccc

SEQ ID NO: 4324622 - DNA, 14 bp, Homo sapiens
gtgctgagtgctat

SEQ ID NO: 4324623 - DNA, 22 bp, Homo sapiens
gtgctgggtcattacttctgag

SEQ ID NO: 4324624 - DNA, 13 bp, Homo sapiens
gtgcttccttggt

SEQ ID NO: 4324625 - DNA, 21 bp, Homo sapiens
gtggaagggccaatggagaaa

SEQ ID NO: 4324626 - DNA, 22 bp, Homo sapiens
gtggaagggccaatggagaaaa

SEQ ID NO: 4324627 - DNA, 22 bp, Homo sapiens
gtggagaactcagtgccacacc

SEQ ID NO: 4324628 - DNA, 11 bp, Homo sapiens
gtggccaggag

SEQ ID NO: 4324629 - DNA, 14 bp, Homo sapiens
gtggccctcccagg

SEQ ID NO: 4324630 - DNA, 14 bp, Homo sapiens
gtggccttgggcct

SEQ ID NO: 4324631 - DNA, 16 bp, Homo sapiens
gtggccttgggccttg

SEQ ID NO: 4324632 - DNA, 12 bp, Homo sapiens
gtgggagctgag

SEQ ID NO: 4324633 - DNA, 19 bp, Homo sapiens
gtgggctcagcagggctgg

SEQ ID NO: 4324634 - DNA, 20 bp, Homo sapiens
gtgggggatcacagcctctg

SEQ ID NO: 4324635 - DNA, 23 bp, Homo sapiens
gtggggtacagtaaagaggcttc

SEQ ID NO: 4324636 - DNA, 14 bp, Homo sapiens
gtgggtgaggctgg

SEQ ID NO: 4324637 - DNA, 20 bp, Homo sapiens
gtgggtgggaatgcaagtga

SEQ ID NO: 4324638 - DNA, 22 bp, Homo sapiens
gtgggtgggatgggcagggaag

SEQ ID NO: 4324639 - DNA, 22 bp, Homo sapiens
gtggtactctgtgtctggcagg

SEQ ID NO: 4324640 - DNA, 17 bp, Homo sapiens
gtgtacatgaagaatgt

SEQ ID NO: 4324641 - DNA, 17 bp, Homo sapiens
gtgtagactgtaacttt

SEQ ID NO: 4324642 - DNA, 18 bp, Homo sapiens
gtgtagactgtaactttt

SEQ ID NO: 4324643 - DNA, 14 bp, Homo sapiens
gtgtagttccctct

SEQ ID NO: 4324644 - DNA, 15 bp, Homo sapiens
gtgtagttccctctg

SEQ ID NO: 4324645 - DNA, 21 bp, Homo sapiens
gtgtagttccctctgcctggg

SEQ ID NO: 4324646 - DNA, 13 bp, Homo sapiens
gtgtatttgtatt

SEQ ID NO: 4324647 - DNA, 15 bp, Homo sapiens
gtgtatttgtattaa

SEQ ID NO: 4324648 - DNA, 19 bp, Homo sapiens
gtgtatttgtattaataaa

SEQ ID NO: 4324649 - DNA, 17 bp, Homo sapiens
gtgtcattggggggacc

SEQ ID NO: 4324650 - DNA, 16 bp, Homo sapiens
gtgtcatttcattcca

SEQ ID NO: 4324651 - DNA, 17 bp, Homo sapiens
gtgtcatttcattccat

SEQ ID NO: 4324652 - DNA, 23 bp, Homo sapiens
gtgtccacagagtttgtagtaaa

SEQ ID NO: 4324653 - DNA, 19 bp, Homo sapiens
gtgtctgaatcatgtctgt

SEQ ID NO: 4324654 - DNA, 20 bp, Homo sapiens
gtgtctgaatcatgtctgta

SEQ ID NO: 4324655 - DNA, 17 bp, Homo sapiens
gtgtgactactccccca

SEQ ID NO: 4324656 - DNA, 11 bp, Homo sapiens
gtgtgcatgtg

SEQ ID NO: 4324657 - DNA, 14 bp, Homo sapiens
gtgtgcatgtgccg

SEQ ID NO: 4324658 - DNA, 14 bp, Homo sapiens
gtgtgctgctgttc

SEQ ID NO: 4324659 - DNA, 23 bp, Homo sapiens
gtgtgtatttgtattaataaagc

SEQ ID NO: 4324660 - DNA, 20 bp, Homo sapiens
gtgtgttttgagagtatatt

SEQ ID NO: 4324661 - DNA, 21 bp, Homo sapiens
gtgtgttttgagagtatatta

SEQ ID NO: 4324662 - DNA, 16 bp, Homo sapiens
gtgttacattattcca

SEQ ID NO: 4324663 - DNA, 13 bp, Homo sapiens
gtgttcagtgttg

SEQ ID NO: 4324664 - DNA, 16 bp, Homo sapiens
gtgttcagtgttgaca

SEQ ID NO: 4324665 - DNA, 18 bp, Homo sapiens
gtgttcagtgttgacata

SEQ ID NO: 4324666 - DNA, 21 bp, Homo sapiens
gtgttcagtgttgacatagcc

SEQ ID NO: 4324667 - DNA, 23 bp, Homo sapiens
gtgttctatccaaacatgtattt

SEQ ID NO: 4324668 - DNA, 15 bp, Homo sapiens
gtgttgacatagcct

SEQ ID NO: 4324669 - DNA, 21 bp, Homo sapiens
gtgttgttatcatttaagatt

SEQ ID NO: 4324670 - DNA, 15 bp, Homo sapiens
gtgtttttctccagt

SEQ ID NO: 4324671 - DNA, 18 bp, Homo sapiens
gtgtttttctccagtgct

SEQ ID NO: 4324672 - DNA, 15 bp, Homo sapiens
gttaaaatcacattt

SEQ ID NO: 4324673 - DNA, 17 bp, Homo sapiens
gttaagtgtcatttctt

SEQ ID NO: 4324674 - DNA, 19 bp, Homo sapiens
gttaccaagtatgaagtat

SEQ ID NO: 4324675 - DNA, 23 bp, Homo sapiens
gttacccaaaatctgattagaag

SEQ ID NO: 4324676 - DNA, 17 bp, Homo sapiens
gttactgcttctctttg

SEQ ID NO: 4324677 - DNA, 15 bp, Homo sapiens
gttactgttgcagct

SEQ ID NO: 4324678 - DNA, 16 bp, Homo sapiens
gttacttagaatgcca

SEQ ID NO: 4324679 - DNA, 17 bp, Homo sapiens
gttacttagaatgccat

SEQ ID NO: 4324680 - DNA, 22 bp, Homo sapiens
gttagaccgctctcttttctgt

SEQ ID NO: 4324681 - DNA, 17 bp, Homo sapiens
gttatagattgtcttaa

SEQ ID NO: 4324682 - DNA, 16 bp, Homo sapiens
gttattaatgtttctt

SEQ ID NO: 4324683 - DNA, 16 bp, Homo sapiens
gttatttgtataaatt

SEQ ID NO: 4324684 - DNA, 13 bp, Homo sapiens
gttcagtgttgac

SEQ ID NO: 4324685 - DNA, 15 bp, Homo sapiens
gttcagtgttgacat

SEQ ID NO: 4324686 - DNA, 16 bp, Homo sapiens
gttcagtgttgacata

SEQ ID NO: 4324687 - DNA, 17 bp, Homo sapiens
gttcagtgttgacatag

SEQ ID NO: 4324688 - DNA, 21 bp, Homo sapiens
gttcagtgttgacatagcctt

SEQ ID NO: 4324689 - DNA, 21 bp, Homo sapiens
gttcagtttttttttttccag

SEQ ID NO: 4324690 - DNA, 18 bp, Homo sapiens
gttcattctgcattgaga

SEQ ID NO: 4324691 - DNA, 15 bp, Homo sapiens
gttccaaatgaatgt

SEQ ID NO: 4324692 - DNA, 15 bp, Homo sapiens
gttccacggttgcta

SEQ ID NO: 4324693 - DNA, 21 bp, Homo sapiens
gttccactgcaaataaagcct

SEQ ID NO: 4324694 - DNA, 14 bp, Homo sapiens
gttccctctgcctg

SEQ ID NO: 4324695 - DNA, 17 bp, Homo sapiens
gttccctctgcctggga

SEQ ID NO: 4324696 - DNA, 18 bp, Homo sapiens
gttccctctgcctgggat

SEQ ID NO: 4324697 - DNA, 19 bp, Homo sapiens
gttcctctttgccctgagg

SEQ ID NO: 4324698 - DNA, 17 bp, Homo sapiens
gttcctttgaagaattg

SEQ ID NO: 4324699 - DNA, 14 bp, Homo sapiens
gttcgggattccct

SEQ ID NO: 4324700 - DNA, 13 bp, Homo sapiens
gttctcagctccc

SEQ ID NO: 4324701 - DNA, 15 bp, Homo sapiens
gttctcagctccccc

SEQ ID NO: 4324702 - DNA, 18 bp, Homo sapiens
gttctcagctccccctgt

SEQ ID NO: 4324703 - DNA, 16 bp, Homo sapiens
gttctctctgaatgct

SEQ ID NO: 4324704 - DNA, 17 bp, Homo sapiens
gttcttacaagcttaaa

SEQ ID NO: 4324705 - DNA, 19 bp, Homo sapiens
gttcttgtattttaataaa

SEQ ID NO: 4324706 - DNA, 20 bp, Homo sapiens
gttcttgtattttaataaac

SEQ ID NO: 4324707 - DNA, 13 bp, Homo sapiens
gttgacatagcct

SEQ ID NO: 4324708 - DNA, 17 bp, Homo sapiens
gttgacatagcctttgt

SEQ ID NO: 4324709 - DNA, 14 bp, Homo sapiens
gttgccaaagctgg

SEQ ID NO: 4324710 - DNA, 11 bp, Homo sapiens
gttgccacagg

SEQ ID NO: 4324711 - DNA, 15 bp, Homo sapiens
gttgccacaggcctc

SEQ ID NO: 4324712 - DNA, 12 bp, Homo sapiens
gttgccagtgct

SEQ ID NO: 4324713 - DNA, 16 bp, Homo sapiens
gttgctaaattataaa

SEQ ID NO: 4324714 - DNA, 22 bp, Homo sapiens
gttgctaaattataaaattgaa

SEQ ID NO: 4324715 - DNA, 14 bp, Homo sapiens
gttggcaaaaaggc

SEQ ID NO: 4324716 - DNA, 20 bp, Homo sapiens
gttggggagaaactgaagcc

SEQ ID NO: 4324717 - DNA, 15 bp, Homo sapiens
gttgggtcccttgct

SEQ ID NO: 4324718 - DNA, 14 bp, Homo sapiens
gttgtacaagctca

SEQ ID NO: 4324719 - DNA, 23 bp, Homo sapiens
gttgtcagaatggaatccatctg

SEQ ID NO: 4324720 - DNA, 15 bp, Homo sapiens
gttgtcattgtccag

SEQ ID NO: 4324721 - DNA, 18 bp, Homo sapiens
gttgtcattgtccagctg

SEQ ID NO: 4324722 - DNA, 17 bp, Homo sapiens
gttgtccttaaaattcc

SEQ ID NO: 4324723 - DNA, 18 bp, Homo sapiens
gttgtctgaattgagaaa

SEQ ID NO: 4324724 - DNA, 23 bp, Homo sapiens
gttgtgcctggttcgtgccatgc

SEQ ID NO: 4324725 - DNA, 11 bp, Homo sapiens
gttgtgctata

SEQ ID NO: 4324726 - DNA, 15 bp, Homo sapiens
gttgttgtttgccaa

SEQ ID NO: 4324727 - DNA, 17 bp, Homo sapiens
gttgtttctataaatga

SEQ ID NO: 4324728 - DNA, 19 bp, Homo sapiens
gtttaaatgccaaaatgta

SEQ ID NO: 4324729 - DNA, 17 bp, Homo sapiens
gtttaccatttttcatt

SEQ ID NO: 4324730 - DNA, 20 bp, Homo sapiens
gtttactcccttctgtagtt

SEQ ID NO: 4324731 - DNA, 17 bp, Homo sapiens
ccaccgaggagccccag

SEQ ID NO: 4324732 - DNA, 13 bp, Homo sapiens
ccacctgacctct

SEQ ID NO: 4324733 - DNA, 15 bp, Homo sapiens
ccacctgacctctgc

SEQ ID NO: 4324734 - DNA, 16 bp, Homo sapiens
ccacctgacctctgca

SEQ ID NO: 4324735 - DNA, 13 bp, Homo sapiens
ccacgattttaaa

SEQ ID NO: 4324736 - DNA, 17 bp, Homo sapiens
ccacgggtctgccatgc

SEQ ID NO: 4324737 - DNA, 21 bp, Homo sapiens
ccacgggtctgccatgctctg

SEQ ID NO: 4324738 - DNA, 21 bp, Homo sapiens
ccacggttgctaaattataaa

SEQ ID NO: 4324739 - DNA, 17 bp, Homo sapiens
ccactaagtacagctga

SEQ ID NO: 4324740 - DNA, 22 bp, Homo sapiens
ccactagtaagtaattatgcac

SEQ ID NO: 4324741 - DNA, 16 bp, Homo sapiens
ccactgcaaataaagc

SEQ ID NO: 4324742 - DNA, 23 bp, Homo sapiens
ccactgcatcgtttcatcttcca

SEQ ID NO: 4324743 - DNA, 18 bp, Homo sapiens
ccactggcacttgcctgc

SEQ ID NO: 4324744 - DNA, 21 bp, Homo sapiens
ccactggcacttgcctgctgc

SEQ ID NO: 4324745 - DNA, 14 bp, Homo sapiens
ccacttcaggagcc

SEQ ID NO: 4324746 - DNA, 16 bp, Homo sapiens
ccacttcaggagccct

SEQ ID NO: 4324747 - DNA, 16 bp, Homo sapiens
ccagaaaaaaataact

SEQ ID NO: 4324748 - DNA, 18 bp, Homo sapiens
ccagaaaaagaagaagga

SEQ ID NO: 4324749 - DNA, 22 bp, Homo sapiens
ccagaaattattggtatatttg

SEQ ID NO: 4324750 - DNA, 16 bp, Homo sapiens
ccagagaagcgctgtt

SEQ ID NO: 4324751 - DNA, 19 bp, Homo sapiens
ccagaggccgctgcccctg

SEQ ID NO: 4324752 - DNA, 20 bp, Homo sapiens
ccagaggtggccctcccagg

SEQ ID NO: 4324753 - DNA, 15 bp, Homo sapiens
ccagagttgctgtgc

SEQ ID NO: 4324754 - DNA, 17 bp, Homo sapiens
ccagcacatttcctctc

SEQ ID NO: 4324755 - DNA, 14 bp, Homo sapiens
ccagcagatgttta

SEQ ID NO: 4324756 - DNA, 12 bp, Homo sapiens
ccagcagcctgg

SEQ ID NO: 4324757 - DNA, 14 bp, Homo sapiens
ccagcagcctggac

SEQ ID NO: 4324758 - DNA, 18 bp, Homo sapiens
ccagcagttctctgccaa

SEQ ID NO: 4324759 - DNA, 12 bp, Homo sapiens
ccagcccaagtc

SEQ ID NO: 4324760 - DNA, 18 bp, Homo sapiens
ccagccccaatccagaga

SEQ ID NO: 4324761 - DNA, 21 bp, Homo sapiens
ccagccccaatccagagaagc

SEQ ID NO: 4324762 - DNA, 22 bp, Homo sapiens
ccagccccaatccagagaagcg

SEQ ID NO: 4324763 - DNA, 15 bp, Homo sapiens
ccagcccctgcccca

SEQ ID NO: 4324764 - DNA, 21 bp, Homo sapiens
ccagccctctgtggccaggag

SEQ ID NO: 4324765 - DNA, 22 bp, Homo sapiens
ccagccctctgtggccaggagc

SEQ ID NO: 4324766 - DNA, 18 bp, Homo sapiens
ccagccgccatgctcctg

SEQ ID NO: 4324767 - DNA, 16 bp, Homo sapiens
ccagccgctcggaggc

SEQ ID NO: 4324768 - DNA, 14 bp, Homo sapiens
ccagccgtgtgtgc

SEQ ID NO: 4324769 - DNA, 19 bp, Homo sapiens
ccagcctggacccccagct

SEQ ID NO: 4324770 - DNA, 21 bp, Homo sapiens
ccagccttatgtgttacatta

SEQ ID NO: 4324771 - DNA, 18 bp, Homo sapiens
ccagctcccccaggcaga

SEQ ID NO: 4324772 - DNA, 18 bp, Homo sapiens
ccagctctctctcctgga

SEQ ID NO: 4324773 - DNA, 14 bp, Homo sapiens
ccagctgggaccta

SEQ ID NO: 4324774 - DNA, 21 bp, Homo sapiens
ccagctgggacctaatgctgg

SEQ ID NO: 4324775 - DNA, 21 bp, Homo sapiens
ccagctggttgtaccctctcc

SEQ ID NO: 4324776 - DNA, 16 bp, Homo sapiens
ccagctgttcagctgg

SEQ ID NO: 4324777 - DNA, 15 bp, Homo sapiens
ccagctttgcccaac

SEQ ID NO: 4324778 - DNA, 12 bp, Homo sapiens
gccctatgtgta

SEQ ID NO: 4324779 - DNA, 17 bp, Homo sapiens
gccctccacccactagg

SEQ ID NO: 4324780 - DNA, 17 bp, Homo sapiens
gccctctccaaatcaag

SEQ ID NO: 4324781 - DNA, 16 bp, Homo sapiens
gccctctgtggccagg

SEQ ID NO: 4324782 - DNA, 19 bp, Homo sapiens
gccctctgtggccaggagc

SEQ ID NO: 4324783 - DNA, 24 bp, Homo sapiens
gccctctgtggccaggagccctgg

SEQ ID NO: 4324784 - DNA, 18 bp, Homo sapiens
gccctggcccgcaagagg

SEQ ID NO: 4324785 - DNA, 17 bp, Homo sapiens
gccctgttgggggcttc

SEQ ID NO: 4324786 - DNA, 20 bp, Homo sapiens
gcccttaaggatcaccccag

SEQ ID NO: 4324787 - DNA, 23 bp, Homo sapiens
gcccttaaggatcaccccagccc

SEQ ID NO: 4324788 - DNA, 20 bp, Homo sapiens
gcccttacacgtgcgtgtga

SEQ ID NO: 4324789 - DNA, 14 bp, Homo sapiens
gcccttcccccttt

SEQ ID NO: 4324790 - DNA, 15 bp, Homo sapiens
gcccttccctggagg

SEQ ID NO: 4324791 - DNA, 19 bp, Homo sapiens
gcccttcctccctgtctct

SEQ ID NO: 4324792 - DNA, 19 bp, Homo sapiens
gcccttgcccttggagctg

SEQ ID NO: 4324793 - DNA, 13 bp, Homo sapiens
gcccttgtctgag

SEQ ID NO: 4324794 - DNA, 19 bp, Homo sapiens
gccgaggaatgtgaagcca

SEQ ID NO: 4324795 - DNA, 14 bp, Homo sapiens
gtagccaaaggttc

SEQ ID NO: 4324796 - DNA, 22 bp, Homo sapiens
gtaggtgcgcacttacctgctt

SEQ ID NO: 4324797 - DNA, 16 bp, Homo sapiens
gtagtgctctcagtct

SEQ ID NO: 4324798 - DNA, 15 bp, Homo sapiens
gtagttccctctgcc

SEQ ID NO: 4324799 - DNA, 19 bp, Homo sapiens
gtagttccctctgcctggg

SEQ ID NO: 4324800 - DNA, 20 bp, Homo sapiens
gtagttccctctgcctggga

SEQ ID NO: 4324801 - DNA, 15 bp, Homo sapiens
gtagttcttagtccc

SEQ ID NO: 4324802 - DNA, 18 bp, Homo sapiens
gtagtttttaattaaaaa

SEQ ID NO: 4324803 - DNA, 16 bp, Homo sapiens
gtagtttttgctgaag

SEQ ID NO: 4324804 - DNA, 17 bp, Homo sapiens
gtataaatctatgatat

SEQ ID NO: 4324805 - DNA, 21 bp, Homo sapiens
gtataaattaaataaactgtt

SEQ ID NO: 4324806 - DNA, 14 bp, Homo sapiens
gtataatctcctct

SEQ ID NO: 4324807 - DNA, 14 bp, Homo sapiens
gtataatgtgtctg

SEQ ID NO: 4324808 - DNA, 15 bp, Homo sapiens
gtataatgtgtctgt

SEQ ID NO: 4324809 - DNA, 16 bp, Homo sapiens
gtataatgtgtctgtg

SEQ ID NO: 4324810 - DNA, 12 bp, Homo sapiens
gtatacctcagt

SEQ ID NO: 4324811 - DNA, 14 bp, Homo sapiens
gtatagtagaaaga

SEQ ID NO: 4324812 - DNA, 17 bp, Homo sapiens
gtatataatcatgctca

SEQ ID NO: 4324813 - DNA, 23 bp, Homo sapiens
gtatattatgtatttatattttg

SEQ ID NO: 4324814 - DNA, 18 bp, Homo sapiens
gtatatttagttacgtat

SEQ ID NO: 4324815 - DNA, 15 bp, Homo sapiens
gtatccccagtgccc

SEQ ID NO: 4324816 - DNA, 22 bp, Homo sapiens
gtatccccagtgcccggtgcag

SEQ ID NO: 4324817 - DNA, 16 bp, Homo sapiens
gtatgtggtatgtata

SEQ ID NO: 4324818 - DNA, 11 bp, Homo sapiens
gtattaataaa

SEQ ID NO: 4324819 - DNA, 12 bp, Homo sapiens
gtattaataaag

SEQ ID NO: 4324820 - DNA, 15 bp, Homo sapiens
gtattaataaagcat

SEQ ID NO: 4324821 - DNA, 16 bp, Homo sapiens
gtattcttgagggaca

SEQ ID NO: 4324822 - DNA, 19 bp, Homo sapiens
gtatttagactgtggccat

SEQ ID NO: 4324823 - DNA, 16 bp, Homo sapiens
gtatttagccattacc

SEQ ID NO: 4324824 - DNA, 17 bp, Homo sapiens
gtatttatctgcaaggt

SEQ ID NO: 4324825 - DNA, 14 bp, Homo sapiens
gtatttcagtattt

SEQ ID NO: 4324826 - DNA, 13 bp, Homo sapiens
gtatttgtattaa

SEQ ID NO: 4324827 - DNA, 15 bp, Homo sapiens
gtatttgtattaata

SEQ ID NO: 4324828 - DNA, 19 bp, Homo sapiens
gtatttgtattaataaagc

SEQ ID NO: 4324829 - DNA, 12 bp, Homo sapiens
gtattttccagc

SEQ ID NO: 4324830 - DNA, 23 bp, Homo sapiens
gtattttccagccttatgtgtta

SEQ ID NO: 4324831 - DNA, 19 bp, Homo sapiens
gtattttgtttttgtctta

SEQ ID NO: 4324832 - DNA, 15 bp, Homo sapiens
gtcaaaagctggatt

SEQ ID NO: 4324833 - DNA, 19 bp, Homo sapiens
gtcaagtgaaaaaggagga

SEQ ID NO: 4324834 - DNA, 13 bp, Homo sapiens
gtcacctcccatc

SEQ ID NO: 4324835 - DNA, 13 bp, Homo sapiens
gtcacctccttcc

SEQ ID NO: 4324836 - DNA, 16 bp, Homo sapiens
gtcacctccttcccca

SEQ ID NO: 4324837 - DNA, 13 bp, Homo sapiens
gtcagaaactgtt

SEQ ID NO: 4324838 - DNA, 13 bp, Homo sapiens
gtcagactttgct

SEQ ID NO: 4324839 - DNA, 22 bp, Homo sapiens
gtcagccatgggaaatgagcca

SEQ ID NO: 4324840 - DNA, 13 bp, Homo sapiens
gtcatcccttcct

SEQ ID NO: 4324841 - DNA, 23 bp, Homo sapiens
gtcatcccttcctcctctcctgg

SEQ ID NO: 4324842 - DNA, 23 bp, Homo sapiens
gtcatcgctcgtgtgttctatcc

SEQ ID NO: 4324843 - DNA, 19 bp, Homo sapiens
gtcatgaaggacactctgc

SEQ ID NO: 4324844 - DNA, 20 bp, Homo sapiens
gtcatgaattcttatgctta

SEQ ID NO: 4324845 - DNA, 16 bp, Homo sapiens
gtcatggtagattttt

SEQ ID NO: 4324846 - DNA, 23 bp, Homo sapiens
gtcatgttggtcaaaagctggat

SEQ ID NO: 4324847 - DNA, 17 bp, Homo sapiens
gtcattacttctgagcc

SEQ ID NO: 4324848 - DNA, 21 bp, Homo sapiens
gtcattacttctgagccccag

SEQ ID NO: 4324849 - DNA, 12 bp, Homo sapiens
gtcattgtccag

SEQ ID NO: 4324850 - DNA, 16 bp, Homo sapiens
gtcattgtccagctgg

SEQ ID NO: 4324851 - DNA, 12 bp, Homo sapiens
gtcatttcattc

SEQ ID NO: 4324852 - DNA, 21 bp, Homo sapiens
gtcatttcattccattgccta

SEQ ID NO: 4324853 - DNA, 19 bp, Homo sapiens
gtccaaatgtgatcaactg

SEQ ID NO: 4324854 - DNA, 21 bp, Homo sapiens
gtccagccgtgtgtgcatgtg

SEQ ID NO: 4324855 - DNA, 22 bp, Homo sapiens
gtccagccgtgtgtgcatgtgc

SEQ ID NO: 4324856 - DNA, 16 bp, Homo sapiens
gtcccattagctgagg

SEQ ID NO: 4324857 - DNA, 17 bp, Homo sapiens
gtcccccaaccccagcc

SEQ ID NO: 4324858 - DNA, 20 bp, Homo sapiens
gtcccccaaccccagccgct

SEQ ID NO: 4324859 - DNA, 16 bp, Homo sapiens
gtcccccgttgtgcct

SEQ ID NO: 4324860 - DNA, 18 bp, Homo sapiens
gtcccccgttgtgcctgg

SEQ ID NO: 4324861 - DNA, 18 bp, Homo sapiens
gtcccctcagctccagac

SEQ ID NO: 4324862 - DNA, 11 bp, Homo sapiens
gtccctgtatg

SEQ ID NO: 4324863 - DNA, 21 bp, Homo sapiens
gtcccttggatcagaggtcat

SEQ ID NO: 4324864 - DNA, 20 bp, Homo sapiens
gtcccttgtttccagctaga

SEQ ID NO: 4324865 - DNA, 13 bp, Homo sapiens
gtccgagctttga

SEQ ID NO: 4324866 - DNA, 21 bp, Homo sapiens
gtccggtccctgtcccagtgc

SEQ ID NO: 4324867 - DNA, 19 bp, Homo sapiens
gtccgtgcttgctggtgcc

SEQ ID NO: 4324868 - DNA, 15 bp, Homo sapiens
gtcctactcctggag

SEQ ID NO: 4324869 - DNA, 19 bp, Homo sapiens
gtccttgcacctgagcctg

SEQ ID NO: 4324870 - DNA, 22 bp, Homo sapiens
gtcgtttatgtgtgcagacaat

SEQ ID NO: 4324871 - DNA, 17 bp, Homo sapiens
gtcgttttccaaactga

SEQ ID NO: 4324872 - DNA, 23 bp, Homo sapiens
gtctcactttggactgggacagt

SEQ ID NO: 4324873 - DNA, 17 bp, Homo sapiens
gtctcagtacctcccct

SEQ ID NO: 4324874 - DNA, 23 bp, Homo sapiens
gtctccctccccaaatggctgct

SEQ ID NO: 4324875 - DNA, 20 bp, Homo sapiens
gtctctccctcccccagagc

SEQ ID NO: 4324876 - DNA, 14 bp, Homo sapiens
gtctctctctcttt

SEQ ID NO: 4324877 - DNA, 15 bp, Homo sapiens
gtctctctctctttt

SEQ ID NO: 4324878 - DNA, 16 bp, Homo sapiens
gtctctctctcttttt

SEQ ID NO: 4324879 - DNA, 23 bp, Homo sapiens
gtctctctctctttttcttttct

SEQ ID NO: 4324880 - DNA, 21 bp, Homo sapiens
gtctctcttcagactctcagc

SEQ ID NO: 4324881 - DNA, 14 bp, Homo sapiens
gtctctgcatctga

SEQ ID NO: 4324882 - DNA, 21 bp, Homo sapiens
gtctctggggcaggctgcttc

SEQ ID NO: 4324883 - DNA, 16 bp, Homo sapiens
gtctgaatcatgtctg

SEQ ID NO: 4324884 - DNA, 16 bp, Homo sapiens
gtctgtcagaagacac

SEQ ID NO: 4324885 - DNA, 17 bp, Homo sapiens
gtctgtcagaagacact

SEQ ID NO: 4324886 - DNA, 15 bp, Homo sapiens
gtctgtgtgctgtaa

SEQ ID NO: 4324887 - DNA, 16 bp, Homo sapiens
gtcttaactgtatttc

SEQ ID NO: 4324888 - DNA, 19 bp, Homo sapiens
gtcttaactgtatttcagt

SEQ ID NO: 4324889 - DNA, 22 bp, Homo sapiens
gtcttaggcagcaacagcagag

SEQ ID NO: 4324890 - DNA, 16 bp, Homo sapiens
gtcttcagtaagccgt

SEQ ID NO: 4324891 - DNA, 21 bp, Homo sapiens
gtcttgacgggagcattggcc

SEQ ID NO: 4324892 - DNA, 15 bp, Homo sapiens
gtcttggtattctta

SEQ ID NO: 4324893 - DNA, 17 bp, Homo sapiens
gtctttacccctgctga

SEQ ID NO: 4324894 - DNA, 22 bp, Homo sapiens
gtctttcattttgcctgagtgt

SEQ ID NO: 4324895 - DNA, 20 bp, Homo sapiens
gtctttggataataggaatt

SEQ ID NO: 4324896 - DNA, 22 bp, Homo sapiens
gtcttttcctccccattcctac

SEQ ID NO: 4324897 - DNA, 23 bp, Homo sapiens
gtcttttcctccccattcctaca

SEQ ID NO: 4324898 - DNA, 14 bp, Homo sapiens
gtgaaaagaaaaat

SEQ ID NO: 4324899 - DNA, 15 bp, Homo sapiens
gtgaaggacatgaga

SEQ ID NO: 4324900 - DNA, 21 bp, Homo sapiens
gtgaatgatgatcctaggcat

SEQ ID NO: 4324901 - DNA, 23 bp, Homo sapiens
gtgaatgtttagtgtgctgctgt

SEQ ID NO: 4324902 - DNA, 18 bp, Homo sapiens
gtgaccatgttttgttta

SEQ ID NO: 4324903 - DNA, 19 bp, Homo sapiens
gtgactattttttaataaa

SEQ ID NO: 4324904 - DNA, 20 bp, Homo sapiens
gtgactattttttaataaaa

SEQ ID NO: 4324905 - DNA, 12 bp, Homo sapiens
gtgaggctgggc

SEQ ID NO: 4324906 - DNA, 13 bp, Homo sapiens
gtgattacctctc

SEQ ID NO: 4324907 - DNA, 14 bp, Homo sapiens
gtgattgaaagaaa

SEQ ID NO: 4324908 - DNA, 17 bp, Homo sapiens
gtgcacactaagaaatg

SEQ ID NO: 4324909 - DNA, 24 bp, Homo sapiens
gtgcagcccctctcacaggcagct

SEQ ID NO: 4324910 - DNA, 21 bp, Homo sapiens
gtgcatatgctacacatatgt

SEQ ID NO: 4324911 - DNA, 14 bp, Homo sapiens
gtgcatatgttaaa

SEQ ID NO: 4324912 - DNA, 13 bp, Homo sapiens
gtgcatgtgcagg

SEQ ID NO: 4324913 - DNA, 13 bp, Homo sapiens
ctttgctccaggc

SEQ ID NO: 4324914 - DNA, 14 bp, Homo sapiens
ctttgctgttactg

SEQ ID NO: 4324915 - DNA, 18 bp, Homo sapiens
ctttgctgttactgcttc

SEQ ID NO: 4324916 - DNA, 18 bp, Homo sapiens
ctttggataataggaatt

SEQ ID NO: 4324917 - DNA, 19 bp, Homo sapiens
ctttggataataggaattc

SEQ ID NO: 4324918 - DNA, 12 bp, Homo sapiens
ctttgtaccccc

SEQ ID NO: 4324919 - DNA, 19 bp, Homo sapiens
ctttgtaccccccaacccc

SEQ ID NO: 4324920 - DNA, 14 bp, Homo sapiens
ctttgtagaataaa

SEQ ID NO: 4324921 - DNA, 13 bp, Homo sapiens
ctttgtctgtcca

SEQ ID NO: 4324922 - DNA, 13 bp, Homo sapiens
ctttgttgaaaaa

SEQ ID NO: 4324923 - DNA, 13 bp, Homo sapiens
ctttgtttcttgt

SEQ ID NO: 4324924 - DNA, 17 bp, Homo sapiens
ctttgtttcttgtttat

SEQ ID NO: 4324925 - DNA, 20 bp, Homo sapiens
ctttgtttgttgtcagctga

SEQ ID NO: 4324926 - DNA, 13 bp, Homo sapiens
cttttatcaaaca

SEQ ID NO: 4324927 - DNA, 15 bp, Homo sapiens
cttttatgaaattaa

SEQ ID NO: 4324928 - DNA, 15 bp, Homo sapiens
cttttattatcagtt

SEQ ID NO: 4324929 - DNA, 15 bp, Homo sapiens
cttttcatttcagat

SEQ ID NO: 4324930 - DNA, 17 bp, Homo sapiens
cttttcatttcagattt

SEQ ID NO: 4324931 - DNA, 13 bp, Homo sapiens
cttttccttacca

SEQ ID NO: 4324932 - DNA, 17 bp, Homo sapiens
cttttctatttacctcc

SEQ ID NO: 4324933 - DNA, 13 bp, Homo sapiens
cttttctgtactt

SEQ ID NO: 4324934 - DNA, 18 bp, Homo sapiens
cttttcttttttaaagta

SEQ ID NO: 4324935 - DNA, 22 bp, Homo sapiens
cttttgaaccatgtatgtggta

SEQ ID NO: 4324936 - DNA, 17 bp, Homo sapiens
cttttgaggtccctgta

SEQ ID NO: 4324937 - DNA, 17 bp, Homo sapiens
cttttgagtatggctat

SEQ ID NO: 4324938 - DNA, 19 bp, Homo sapiens
cttttgtccattccattaa

SEQ ID NO: 4324939 - DNA, 20 bp, Homo sapiens
ctttttatatttaaaaaatt

SEQ ID NO: 4324940 - DNA, 21 bp, Homo sapiens
ctttttcttaccctctctttc

SEQ ID NO: 4324941 - DNA, 22 bp, Homo sapiens
ctttttgctgtgtagttccctc

SEQ ID NO: 4324942 - DNA, 13 bp, Homo sapiens
cttttttaaagta

SEQ ID NO: 4324943 - DNA, 18 bp, Homo sapiens
cttttttaaagtaaactt

SEQ ID NO: 4324944 - DNA, 12 bp, Homo sapiens
cttttttcttcc

SEQ ID NO: 4324945 - DNA, 20 bp, Homo sapiens
gagactttgctgttactgct

SEQ ID NO: 4324946 - DNA, 17 bp, Homo sapiens
gagagagtggtaaaaaa

SEQ ID NO: 4324947 - DNA, 21 bp, Homo sapiens
gagagccctgtccctgccctc

SEQ ID NO: 4324948 - DNA, 14 bp, Homo sapiens
gagagctagaaagt

SEQ ID NO: 4324949 - DNA, 15 bp, Homo sapiens
gagagctagcagcag

SEQ ID NO: 4324950 - DNA, 22 bp, Homo sapiens
gagagcttattgttttaaaaag

SEQ ID NO: 4324951 - DNA, 13 bp, Homo sapiens
gagaggggcacag

SEQ ID NO: 4324952 - DNA, 14 bp, Homo sapiens
gagaggttagaatg

SEQ ID NO: 4324953 - DNA, 15 bp, Homo sapiens
gagagtatattatgt

SEQ ID NO: 4324954 - DNA, 13 bp, Homo sapiens
gagatcagcctgg

SEQ ID NO: 4324955 - DNA, 16 bp, Homo sapiens
gagatgtaattgtttt

SEQ ID NO: 4324956 - DNA, 20 bp, Homo sapiens
gagattatcagtagaaagag

SEQ ID NO: 4324957 - DNA, 19 bp, Homo sapiens
gagatttacgtggaaccct

SEQ ID NO: 4324958 - DNA, 16 bp, Homo sapiens
gagcaaaacaaagctg

SEQ ID NO: 4324959 - DNA, 17 bp, Homo sapiens
gagcaaaacaaagctga

SEQ ID NO: 4324960 - DNA, 15 bp, Homo sapiens
gagcaggaggtgcct

SEQ ID NO: 4324961 - DNA, 20 bp, Homo sapiens
gagcattaactaaatgctca

SEQ ID NO: 4324962 - DNA, 22 bp, Homo sapiens
gagccaccagggcactgtctgc

SEQ ID NO: 4324963 - DNA, 14 bp, Homo sapiens
gagccccagccccg

SEQ ID NO: 4324964 - DNA, 13 bp, Homo sapiens
gagcccccttcct

SEQ ID NO: 4324965 - DNA, 17 bp, Homo sapiens
gagcccgggagagactc

SEQ ID NO: 4324966 - DNA, 21 bp, Homo sapiens
gagccctactgaagggaacag

SEQ ID NO: 4324967 - DNA, 15 bp, Homo sapiens
gagcctcctgcccag

SEQ ID NO: 4324968 - DNA, 22 bp, Homo sapiens
gagcctgcccagttggaggaga

SEQ ID NO: 4324969 - DNA, 10 bp, Homo sapiens
gagcctggca

SEQ ID NO: 4324970 - DNA, 15 bp, Homo sapiens
gagcctggcaagaat

SEQ ID NO: 4324971 - DNA, 12 bp, Homo sapiens
gagcctgtccaa

SEQ ID NO: 4324972 - DNA, 17 bp, Homo sapiens
gagcgtttggttaaagt

SEQ ID NO: 4324973 - DNA, 15 bp, Homo sapiens
gagctagcagcaggg

SEQ ID NO: 4324974 - DNA, 17 bp, Homo sapiens
gagctagcagcagggag

SEQ ID NO: 4324975 - DNA, 16 bp, Homo sapiens
gagctatagtgaagaa

SEQ ID NO: 4324976 - DNA, 12 bp, Homo sapiens
gagctgaagaaa

SEQ ID NO: 4324977 - DNA, 20 bp, Homo sapiens
gagctgctaagctaaagaaa

SEQ ID NO: 4324978 - DNA, 23 bp, Homo sapiens
gagctgctaagctaaagaaactg

SEQ ID NO: 4324979 - DNA, 15 bp, Homo sapiens
gagctgtttatgttt

SEQ ID NO: 4324980 - DNA, 16 bp, Homo sapiens
gagctgtttatgtttt

SEQ ID NO: 4324981 - DNA, 17 bp, Homo sapiens
gagctttctgtgcatgt

SEQ ID NO: 4324982 - DNA, 18 bp, Homo sapiens
gagctttctgtgcatgtg

SEQ ID NO: 4324983 - DNA, 20 bp, Homo sapiens
gagctttgaaaattcagtgg

SEQ ID NO: 4324984 - DNA, 16 bp, Homo sapiens
gagcttttcagaacat

SEQ ID NO: 4324985 - DNA, 15 bp, Homo sapiens
gaggaactgtacaga

SEQ ID NO: 4324986 - DNA, 15 bp, Homo sapiens
gaggaatgtgaagcc

SEQ ID NO: 4324987 - DNA, 17 bp, Homo sapiens
gaggacactaggagact

SEQ ID NO: 4324988 - DNA, 12 bp, Homo sapiens
gaggactgaagc

SEQ ID NO: 4324989 - DNA, 18 bp, Homo sapiens
gaggactgaagctggggc

SEQ ID NO: 4324990 - DNA, 12 bp, Homo sapiens
gaggagaaaggg

SEQ ID NO: 4324991 - DNA, 12 bp, Homo sapiens
gaggagactggg

SEQ ID NO: 4324992 - DNA, 22 bp, Homo sapiens
gaggatctcttgagcctgggag

SEQ ID NO: 4324993 - DNA, 14 bp, Homo sapiens
gaggccccaaagga

SEQ ID NO: 4324994 - DNA, 13 bp, Homo sapiens
gaggccccaactc

SEQ ID NO: 4324995 - DNA, 15 bp, Homo sapiens
gaggccgctgcccct

SEQ ID NO: 4324996 - DNA, 14 bp, Homo sapiens
gaggcctacctctc

SEQ ID NO: 4324997 - DNA, 17 bp, Homo sapiens
gaggcctcggctgtctc

SEQ ID NO: 4324998 - DNA, 16 bp, Homo sapiens
gaggcgaataaatgtt

SEQ ID NO: 4324999 - DNA, 18 bp, Homo sapiens
gaggctctctaagaaaag

SEQ ID NO: 4325000 - DNA, 19 bp, Homo sapiens
gaggctctctaagaaaaga

SEQ ID NO: 4325001 - DNA, 17 bp, Homo sapiens
gaggcttccaagcatta

SEQ ID NO: 4325002 - DNA, 15 bp, Homo sapiens
gagggaaaagggaag

SEQ ID NO: 4325003 - DNA, 15 bp, Homo sapiens
gagggacagagcccg

SEQ ID NO: 4325004 - DNA, 21 bp, Homo sapiens
gagggtttctgatctgtactt

SEQ ID NO: 4325005 - DNA, 17 bp, Homo sapiens
gaggtcaaggctgcagt

SEQ ID NO: 4325006 - DNA, 20 bp, Homo sapiens
gaggtcacatgttggtgctg

SEQ ID NO: 4325007 - DNA, 23 bp, Homo sapiens
gaggtctctccctcccccagagc

SEQ ID NO: 4325008 - DNA, 21 bp, Homo sapiens
gaggtggccctcccaggctgg

SEQ ID NO: 4325009 - DNA, 21 bp, Homo sapiens
gaggttagcccaatggagaaa

SEQ ID NO: 4325010 - DNA, 17 bp, Homo sapiens
gaggttcgggattccct

SEQ ID NO: 4325011 - DNA, 15 bp, Homo sapiens
gaggttctgggcctc

SEQ ID NO: 4325012 - DNA, 23 bp, Homo sapiens
gagtaggatgtctcttggaaatg

SEQ ID NO: 4325013 - DNA, 15 bp, Homo sapiens
gagtcagccattcct

SEQ ID NO: 4325014 - DNA, 17 bp, Homo sapiens
gagtcctgggtaaatgt

SEQ ID NO: 4325015 - DNA, 14 bp, Homo sapiens
gagtctcccaaggc

SEQ ID NO: 4325016 - DNA, 18 bp, Homo sapiens
gagtctgtttcccaagct

SEQ ID NO: 4325017 - DNA, 20 bp, Homo sapiens
gagtctgtttcccaagctag

SEQ ID NO: 4325018 - DNA, 18 bp, Homo sapiens
gagtcttaactgtatttc

SEQ ID NO: 4325019 - DNA, 22 bp, Homo sapiens
gagtcttaactgtatttcagta

SEQ ID NO: 4325020 - DNA, 23 bp, Homo sapiens
gagtcttaactgtatttcagtat

SEQ ID NO: 4325021 - DNA, 19 bp, Homo sapiens
gagtggggagggagtctgg

SEQ ID NO: 4325022 - DNA, 19 bp, Homo sapiens
gagtggtaaaaaagaaatg

SEQ ID NO: 4325023 - DNA, 20 bp, Homo sapiens
gagtgtgcctgaagtcccag

SEQ ID NO: 4325024 - DNA, 14 bp, Homo sapiens
gagtgtgtgtgtgt

SEQ ID NO: 4325025 - DNA, 21 bp, Homo sapiens
gagtgttatcatattggtgct

SEQ ID NO: 4325026 - DNA, 15 bp, Homo sapiens
gagtgtttgaaaact

SEQ ID NO: 4325027 - DNA, 22 bp, Homo sapiens
gagttacttagaatgccataaa

SEQ ID NO: 4325028 - DNA, 23 bp, Homo sapiens
gagttctatggagactttgctgt

SEQ ID NO: 4325029 - DNA, 17 bp, Homo sapiens
gagttctctttcttagt

SEQ ID NO: 4325030 - DNA, 19 bp, Homo sapiens
gagttgaggaactgtacag

SEQ ID NO: 4325031 - DNA, 15 bp, Homo sapiens
gagttgattcagctc

SEQ ID NO: 4325032 - DNA, 16 bp, Homo sapiens
gagttgattcagctct

SEQ ID NO: 4325033 - DNA, 13 bp, Homo sapiens
gagtttgtagtaa

SEQ ID NO: 4325034 - DNA, 17 bp, Homo sapiens
gataactactgacgaaa

SEQ ID NO: 4325035 - DNA, 22 bp, Homo sapiens
gataagacttgtttctttctgt

SEQ ID NO: 4325036 - DNA, 15 bp, Homo sapiens
gataataggaattca

SEQ ID NO: 4325037 - DNA, 20 bp, Homo sapiens
gatacacaagagggactgta

SEQ ID NO: 4325038 - DNA, 23 bp, Homo sapiens
gatacacaagagggactgtattt

SEQ ID NO: 4325039 - DNA, 22 bp, Homo sapiens
gatacacacatagtttcttttt

SEQ ID NO: 4325040 - DNA, 23 bp, Homo sapiens
gatacccaacagtttatttttat

SEQ ID NO: 4325041 - DNA, 22 bp, Homo sapiens
gatactaaaagttcttctccaa

SEQ ID NO: 4325042 - DNA, 15 bp, Homo sapiens
gatatccaaacaaga

SEQ ID NO: 4325043 - DNA, 14 bp, Homo sapiens
gatcaaagacacac

SEQ ID NO: 4325044 - DNA, 13 bp, Homo sapiens
gatcaactgttca

SEQ ID NO: 4325045 - DNA, 14 bp, Homo sapiens
gatcacagcctctg

SEQ ID NO: 4325046 - DNA, 17 bp, Homo sapiens
gatcacatctaaagctt

SEQ ID NO: 4325047 - DNA, 16 bp, Homo sapiens
gatcaccccagccccc

SEQ ID NO: 4325048 - DNA, 22 bp, Homo sapiens
gatcaccccagcccccacagcc

SEQ ID NO: 4325049 - DNA, 14 bp, Homo sapiens
gatcacgctccccg

SEQ ID NO: 4325050 - DNA, 12 bp, Homo sapiens
gatcagcctggg

SEQ ID NO: 4325051 - DNA, 14 bp, Homo sapiens
gatcagtctttgtc

SEQ ID NO: 4325052 - DNA, 17 bp, Homo sapiens
gatcccaagatggagag

SEQ ID NO: 4325053 - DNA, 20 bp, Homo sapiens
gatcccctctctgtggctcc

SEQ ID NO: 4325054 - DNA, 16 bp, Homo sapiens
gatctcttgagcctgg

SEQ ID NO: 4325055 - DNA, 19 bp, Homo sapiens
gatctcttgagcctgggag

SEQ ID NO: 4325056 - DNA, 15 bp, Homo sapiens
gatctgtactttgtg

SEQ ID NO: 4325057 - DNA, 17 bp, Homo sapiens
gatctgtactttgtgtt

SEQ ID NO: 4325058 - DNA, 12 bp, Homo sapiens
gatctgttcagt

SEQ ID NO: 4325059 - DNA, 12 bp, Homo sapiens
gatgactgctga

SEQ ID NO: 4325060 - DNA, 14 bp, Homo sapiens
gatgactgctgatt

SEQ ID NO: 4325061 - DNA, 13 bp, Homo sapiens
gatgagacctggg

SEQ ID NO: 4325062 - DNA, 14 bp, Homo sapiens
gatgagacctgggg

SEQ ID NO: 4325063 - DNA, 13 bp, Homo sapiens
gatgatcctaggc

SEQ ID NO: 4325064 - DNA, 18 bp, Homo sapiens
ctggaggaacacagagaa

SEQ ID NO: 4325065 - DNA, 14 bp, Homo sapiens
ctggaggggcccct

SEQ ID NO: 4325066 - DNA, 23 bp, Homo sapiens
ctggaggtctctccctcccccag

SEQ ID NO: 4325067 - DNA, 15 bp, Homo sapiens
ctggagtctgaagcc

SEQ ID NO: 4325068 - DNA, 15 bp, Homo sapiens
ctggcacgtggccag

SEQ ID NO: 4325069 - DNA, 19 bp, Homo sapiens
ctggcacgtggccaggagc

SEQ ID NO: 4325070 - DNA, 20 bp, Homo sapiens
ctggcacgtggccaggagcc

SEQ ID NO: 4325071 - DNA, 16 bp, Homo sapiens
ctggcaggctactctg

SEQ ID NO: 4325072 - DNA, 13 bp, Homo sapiens
ctggcatagagta

SEQ ID NO: 4325073 - DNA, 14 bp, Homo sapiens
ctggcatagagtag

SEQ ID NO: 4325074 - DNA, 20 bp, Homo sapiens
ctggcatcgcagcttcctgt

SEQ ID NO: 4325075 - DNA, 12 bp, Homo sapiens
ctggcccactgc

SEQ ID NO: 4325076 - DNA, 23 bp, Homo sapiens
ctggcccgcaagagggacagagc

SEQ ID NO: 4325077 - DNA, 13 bp, Homo sapiens
ctggcctgactgg

SEQ ID NO: 4325078 - DNA, 13 bp, Homo sapiens
ctggcggaggtgg

SEQ ID NO: 4325079 - DNA, 19 bp, Homo sapiens
ctggcgggatgggccaccg

SEQ ID NO: 4325080 - DNA, 14 bp, Homo sapiens
ctggctggagagct

SEQ ID NO: 4325081 - DNA, 17 bp, Homo sapiens
ctggctggagagctgct

SEQ ID NO: 4325082 - DNA, 15 bp, Homo sapiens
ctggcttttcgcttg

SEQ ID NO: 4325083 - DNA, 22 bp, Homo sapiens
ctggcttttcgcttgcttctgc

SEQ ID NO: 4325084 - DNA, 15 bp, Homo sapiens
ctgggaagaacaagg

SEQ ID NO: 4325085 - DNA, 19 bp, Homo sapiens
ctgggaagctgagggcaaa

SEQ ID NO: 4325086 - DNA, 18 bp, Homo sapiens
ctgggacctaatgctggc

SEQ ID NO: 4325087 - DNA, 20 bp, Homo sapiens
ctgggcaatgtgataaaacc

SEQ ID NO: 4325088 - DNA, 14 bp, Homo sapiens
ctgggcacccctgc

SEQ ID NO: 4325089 - DNA, 15 bp, Homo sapiens
ctgggcacccctgcc

SEQ ID NO: 4325090 - DNA, 18 bp, Homo sapiens
ctgggcagtgagtgccat

SEQ ID NO: 4325091 - DNA, 21 bp, Homo sapiens
ctgggcagtgagtgccatgct

SEQ ID NO: 4325092 - DNA, 17 bp, Homo sapiens
ctgggcatctgttctgg

SEQ ID NO: 4325093 - DNA, 13 bp, Homo sapiens
ctgggcatgtttg

SEQ ID NO: 4325094 - DNA, 22 bp, Homo sapiens
ctggggcttggggattgccact

SEQ ID NO: 4325095 - DNA, 23 bp, Homo sapiens
ctggggcttggggattgccacta

SEQ ID NO: 4325096 - DNA, 13 bp, Homo sapiens
ctgggtgccaggt

SEQ ID NO: 4325097 - DNA, 22 bp, Homo sapiens
ctgggtggcaccagcagcctgg

SEQ ID NO: 4325098 - DNA, 18 bp, Homo sapiens
ctggtatttatctgcaag

SEQ ID NO: 4325099 - DNA, 13 bp, Homo sapiens
ctggtcacctccc

SEQ ID NO: 4325100 - DNA, 15 bp, Homo sapiens
ctggtcacctcccat

SEQ ID NO: 4325101 - DNA, 17 bp, Homo sapiens
ctggtcacctcccatcc

SEQ ID NO: 4325102 - DNA, 16 bp, Homo sapiens
ctggtggaagtcttgg

SEQ ID NO: 4325103 - DNA, 14 bp, Homo sapiens
ctggtggccttggg

SEQ ID NO: 4325104 - DNA, 21 bp, Homo sapiens
ctggtgggcctcgacgtccct

SEQ ID NO: 4325105 - DNA, 19 bp, Homo sapiens
ctggtgggctattgaagat

SEQ ID NO: 4325106 - DNA, 17 bp, Homo sapiens
ctggttcgtgccatgcc

SEQ ID NO: 4325107 - DNA, 19 bp, Homo sapiens
ctggttgtaccctctccag

SEQ ID NO: 4325108 - DNA, 13 bp, Homo sapiens
ctggttgtcagaa

SEQ ID NO: 4325109 - DNA, 19 bp, Homo sapiens
ctgtaactttttttcagtt

SEQ ID NO: 4325110 - DNA, 17 bp, Homo sapiens
ctgtaataaagctcttt

SEQ ID NO: 4325111 - DNA, 16 bp, Homo sapiens
ctgtacatacaaattc

SEQ ID NO: 4325112 - DNA, 13 bp, Homo sapiens
ctgtactttgtgt

SEQ ID NO: 4325113 - DNA, 18 bp, Homo sapiens
ctgtagcttgttccctgt

SEQ ID NO: 4325114 - DNA, 22 bp, Homo sapiens
ctgtaggagctacccttttcct

SEQ ID NO: 4325115 - DNA, 17 bp, Homo sapiens
ctgtatccccagtgccc

SEQ ID NO: 4325116 - DNA, 20 bp, Homo sapiens
ctgtatttcagtattttcca

SEQ ID NO: 4325117 - DNA, 21 bp, Homo sapiens
ctgtatttcagtattttccag

SEQ ID NO: 4325118 - DNA, 15 bp, Homo sapiens
ctgtatttctgtgga

SEQ ID NO: 4325119 - DNA, 17 bp, Homo sapiens
ctgtatttctgtggaaa

SEQ ID NO: 4325120 - DNA, 18 bp, Homo sapiens
ctgtccaatttctgctgt

SEQ ID NO: 4325121 - DNA, 23 bp, Homo sapiens
ctgtccagccgtgtgtgcatgtg

SEQ ID NO: 4325122 - DNA, 14 bp, Homo sapiens
ctgtccccagggga

SEQ ID NO: 4325123 - DNA, 15 bp, Homo sapiens
ctgtcccctcagctc

SEQ ID NO: 4325124 - DNA, 15 bp, Homo sapiens
ctgtccgagctttga

SEQ ID NO: 4325125 - DNA, 13 bp, Homo sapiens
ctgtccgtcccgc

SEQ ID NO: 4325126 - DNA, 18 bp, Homo sapiens
ctgtctcaaaaaaagaaa

SEQ ID NO: 4325127 - DNA, 20 bp, Homo sapiens
ctgtctcagtacctcccctc

SEQ ID NO: 4325128 - DNA, 22 bp, Homo sapiens
ctgtctccctccccaaatggct

SEQ ID NO: 4325129 - DNA, 12 bp, Homo sapiens
ctgtctcctgtc

SEQ ID NO: 4325130 - DNA, 13 bp, Homo sapiens
ctgtctctgcatc

SEQ ID NO: 4325131 - DNA, 22 bp, Homo sapiens
ctgtgcttccttggttcatgct

SEQ ID NO: 4325132 - DNA, 14 bp, Homo sapiens
ctgtggccaggagc

SEQ ID NO: 4325133 - DNA, 17 bp, Homo sapiens
ctgtggccaggagccct

SEQ ID NO: 4325134 - DNA, 21 bp, Homo sapiens
ctgtgtacataaagtcatcaa

SEQ ID NO: 4325135 - DNA, 17 bp, Homo sapiens
ctgtgtagttccctctg

SEQ ID NO: 4325136 - DNA, 16 bp, Homo sapiens
ctgtgtctgaatcatg

SEQ ID NO: 4325137 - DNA, 17 bp, Homo sapiens
ctgtgtctgaatcatgt

SEQ ID NO: 4325138 - DNA, 21 bp, Homo sapiens
ctgtgtctgaatcatgtctgt

SEQ ID NO: 4325139 - DNA, 14 bp, Homo sapiens
ctgtgtctgctctc

SEQ ID NO: 4325140 - DNA, 13 bp, Homo sapiens
ctgtgtctggcag

SEQ ID NO: 4325141 - DNA, 15 bp, Homo sapiens
ctgtgtctggcaggc

SEQ ID NO: 4325142 - DNA, 13 bp, Homo sapiens
ctgtgtgctgtaa

SEQ ID NO: 4325143 - DNA, 17 bp, Homo sapiens
ctgttactgcttctctt

SEQ ID NO: 4325144 - DNA, 20 bp, Homo sapiens
ctgttactgcttctctttgt

SEQ ID NO: 4325145 - DNA, 17 bp, Homo sapiens
ctgttactgtcttcagt

SEQ ID NO: 4325146 - DNA, 14 bp, Homo sapiens
ctgttcacactgca

SEQ ID NO: 4325147 - DNA, 18 bp, Homo sapiens
ctgttcagttaagttctt

SEQ ID NO: 4325148 - DNA, 13 bp, Homo sapiens
ctgttctgtgtac

SEQ ID NO: 4325149 - DNA, 16 bp, Homo sapiens
ctgttctgtgtacata

SEQ ID NO: 4325150 - DNA, 15 bp, Homo sapiens
ctgttgcccgccctc

SEQ ID NO: 4325151 - DNA, 18 bp, Homo sapiens
ctgttgcccgccctccac

SEQ ID NO: 4325152 - DNA, 23 bp, Homo sapiens
ctgttgcccgccctccacccact

SEQ ID NO: 4325153 - DNA, 12 bp, Homo sapiens
ctgttgtacaag

SEQ ID NO: 4325154 - DNA, 14 bp, Homo sapiens
ctgttgtacaagct

SEQ ID NO: 4325155 - DNA, 18 bp, Homo sapiens
ctgttgtccttaaaattc

SEQ ID NO: 4325156 - DNA, 12 bp, Homo sapiens
ctgttgtttcta

SEQ ID NO: 4325157 - DNA, 16 bp, Homo sapiens
ctgttgtttctataaa

SEQ ID NO: 4325158 - DNA, 20 bp, Homo sapiens
ctgttgtttctataaatgac

SEQ ID NO: 4325159 - DNA, 23 bp, Homo sapiens
ctgttgtttctataaatgactat

SEQ ID NO: 4325160 - DNA, 18 bp, Homo sapiens
ctgtttactcccttctgt

SEQ ID NO: 4325161 - DNA, 13 bp, Homo sapiens
ctgttttctcttg

SEQ ID NO: 4325162 - DNA, 17 bp, Homo sapiens
ctgttttctcttgagag

SEQ ID NO: 4325163 - DNA, 16 bp, Homo sapiens
cttaaaaagtggaaaa

SEQ ID NO: 4325164 - DNA, 15 bp, Homo sapiens
cttaaacttgtgaat

SEQ ID NO: 4325165 - DNA, 14 bp, Homo sapiens
cttaaagcttgatt

SEQ ID NO: 4325166 - DNA, 17 bp, Homo sapiens
cttaaagcttgatttga

SEQ ID NO: 4325167 - DNA, 22 bp, Homo sapiens
cttaaatcatttggttaaatca

SEQ ID NO: 4325168 - DNA, 14 bp, Homo sapiens
cttaaatgaactac

SEQ ID NO: 4325169 - DNA, 20 bp, Homo sapiens
cttaaatgaactactgctat

SEQ ID NO: 4325170 - DNA, 15 bp, Homo sapiens
cttaactgtatttca

SEQ ID NO: 4325171 - DNA, 18 bp, Homo sapiens
cttaactgtatttcagta

SEQ ID NO: 4325172 - DNA, 22 bp, Homo sapiens
cttaaggatcaccccagccccc

SEQ ID NO: 4325173 - DNA, 24 bp, Homo sapiens
cttaatggtaggtcaagtaataaa

SEQ ID NO: 4325174 - DNA, 17 bp, Homo sapiens
cttaatgtctgtcagaa

SEQ ID NO: 4325175 - DNA, 20 bp, Homo sapiens
cttaatgtctgtcagaagac

SEQ ID NO: 4325176 - DNA, 20 bp, Homo sapiens
cttacaagcttaaagcttga

SEQ ID NO: 4325177 - DNA, 23 bp, Homo sapiens
cttaccatttgctactgtacata

SEQ ID NO: 4325178 - DNA, 23 bp, Homo sapiens
cttaccccacacacagtccaact

SEQ ID NO: 4325179 - DNA, 19 bp, Homo sapiens
cttacctcggtgccttcct

SEQ ID NO: 4325180 - DNA, 16 bp, Homo sapiens
cttacctgcttgagct

SEQ ID NO: 4325181 - DNA, 16 bp, Homo sapiens
cttacggttttaaatg

SEQ ID NO: 4325182 - DNA, 13 bp, Homo sapiens
cttactcacctct

SEQ ID NO: 4325183 - DNA, 15 bp, Homo sapiens
cttactcacctctct

SEQ ID NO: 4325184 - DNA, 13 bp, Homo sapiens
cttacttgcactg

SEQ ID NO: 4325185 - DNA, 18 bp, Homo sapiens
ctcattaaactctaaaga

SEQ ID NO: 4325186 - DNA, 19 bp, Homo sapiens
ctcattaaactctaaagat

SEQ ID NO: 4325187 - DNA, 20 bp, Homo sapiens
ctcattaaactctaaagatt

SEQ ID NO: 4325188 - DNA, 15 bp, Homo sapiens
ctccaacccagcagt

SEQ ID NO: 4325189 - DNA, 23 bp, Homo sapiens
ctccaacccgttgggtcccttgc

SEQ ID NO: 4325190 - DNA, 18 bp, Homo sapiens
ctccaattctgaaatact

SEQ ID NO: 4325191 - DNA, 23 bp, Homo sapiens
ctccaattctgaaatacttttga

SEQ ID NO: 4325192 - DNA, 16 bp, Homo sapiens
ctccacaaagagacca

SEQ ID NO: 4325193 - DNA, 19 bp, Homo sapiens
ctccacacggagctcctgg

SEQ ID NO: 4325194 - DNA, 14 bp, Homo sapiens
ctccacccactagg

SEQ ID NO: 4325195 - DNA, 17 bp, Homo sapiens
ctccactggtctgtctt

SEQ ID NO: 4325196 - DNA, 19 bp, Homo sapiens
ctccagacgtaggggaggg

SEQ ID NO: 4325197 - DNA, 20 bp, Homo sapiens
ctccagcctggacccccagc

SEQ ID NO: 4325198 - DNA, 12 bp, Homo sapiens
ctccagcctggg

SEQ ID NO: 4325199 - DNA, 13 bp, Homo sapiens
ctccagctgttca

SEQ ID NO: 4325200 - DNA, 18 bp, Homo sapiens
ctccagggagattttgag

SEQ ID NO: 4325201 - DNA, 18 bp, Homo sapiens
ctccatttttaaccactt

SEQ ID NO: 4325202 - DNA, 21 bp, Homo sapiens
ctcccaaggctgcgtctggag

SEQ ID NO: 4325203 - DNA, 16 bp, Homo sapiens
ctcccacccaaggaga

SEQ ID NO: 4325204 - DNA, 23 bp, Homo sapiens
ctcccacgactgttgtacaagct

SEQ ID NO: 4325205 - DNA, 18 bp, Homo sapiens
ctcccagctctctctcct

SEQ ID NO: 4325206 - DNA, 21 bp, Homo sapiens
ctcccagctctctctcctgga

SEQ ID NO: 4325207 - DNA, 15 bp, Homo sapiens
ctccccaaatggctg

SEQ ID NO: 4325208 - DNA, 16 bp, Homo sapiens
ctccccaaatggctgc

SEQ ID NO: 4325209 - DNA, 17 bp, Homo sapiens
ctccccaaatggctgct

SEQ ID NO: 4325210 - DNA, 14 bp, Homo sapiens
ctccccagaattca

SEQ ID NO: 4325211 - DNA, 19 bp, Homo sapiens
ctccccctgtcccctcagc

SEQ ID NO: 4325212 - DNA, 19 bp, Homo sapiens
ctccccgccccctgaaaca

SEQ ID NO: 4325213 - DNA, 15 bp, Homo sapiens
ctccccgcctgttcc

SEQ ID NO: 4325214 - DNA, 22 bp, Homo sapiens
ctcccctccccgccccctgaaa

SEQ ID NO: 4325215 - DNA, 14 bp, Homo sapiens
ctcccgccaccctg

SEQ ID NO: 4325216 - DNA, 14 bp, Homo sapiens
ctccctaaactgta

SEQ ID NO: 4325217 - DNA, 20 bp, Homo sapiens
ctccctccccaaatggctgc

SEQ ID NO: 4325218 - DNA, 21 bp, Homo sapiens
ctccctccccaaatggctgct

SEQ ID NO: 4325219 - DNA, 21 bp, Homo sapiens
ctccctcctgatgtttttccc

SEQ ID NO: 4325220 - DNA, 14 bp, Homo sapiens
ctccctgaccccct

SEQ ID NO: 4325221 - DNA, 16 bp, Homo sapiens
ctccctgaccccctgt

SEQ ID NO: 4325222 - DNA, 17 bp, Homo sapiens
ctccctgaccccctgtc

SEQ ID NO: 4325223 - DNA, 16 bp, Homo sapiens
ctccctgctcccagct

SEQ ID NO: 4325224 - DNA, 17 bp, Homo sapiens
ctccctgtctctgcatc

SEQ ID NO: 4325225 - DNA, 21 bp, Homo sapiens
ctccctgtttgaagcctgccc

SEQ ID NO: 4325226 - DNA, 13 bp, Homo sapiens
ctcccttctgtag

SEQ ID NO: 4325227 - DNA, 23 bp, Homo sapiens
ctcccttctttgcttctttttct

SEQ ID NO: 4325228 - DNA, 13 bp, Homo sapiens
ctccgtacacttc

SEQ ID NO: 4325229 - DNA, 14 bp, Homo sapiens
ctcctaatggcatg

SEQ ID NO: 4325230 - DNA, 19 bp, Homo sapiens
ctcctaatggcatggagac

SEQ ID NO: 4325231 - DNA, 16 bp, Homo sapiens
ctcctatttttgtaaa

SEQ ID NO: 4325232 - DNA, 15 bp, Homo sapiens
ctcctccagccgcca

SEQ ID NO: 4325233 - DNA, 22 bp, Homo sapiens
ctgaggtgggaggatctcttga

SEQ ID NO: 4325234 - DNA, 23 bp, Homo sapiens
ctgaggttagcccaatggagaaa

SEQ ID NO: 4325235 - DNA, 16 bp, Homo sapiens
ctgagtgagttttact

SEQ ID NO: 4325236 - DNA, 19 bp, Homo sapiens
ctgataaaacaacagctcg

SEQ ID NO: 4325237 - DNA, 17 bp, Homo sapiens
ctgatatgctgagaaat

SEQ ID NO: 4325238 - DNA, 13 bp, Homo sapiens
ctgatctgtactt

SEQ ID NO: 4325239 - DNA, 16 bp, Homo sapiens
ctgatctgtactttgt

SEQ ID NO: 4325240 - DNA, 15 bp, Homo sapiens
ctgatgtttttccca

SEQ ID NO: 4325241 - DNA, 20 bp, Homo sapiens
ctgattataccatgtgtgct

SEQ ID NO: 4325242 - DNA, 17 bp, Homo sapiens
ctgattccctctcccac

SEQ ID NO: 4325243 - DNA, 19 bp, Homo sapiens
ctgattccctctcccaccc

SEQ ID NO: 4325244 - DNA, 12 bp, Homo sapiens
ctgatttccctt

SEQ ID NO: 4325245 - DNA, 19 bp, Homo sapiens
ctgcaaacccatgaagctg

SEQ ID NO: 4325246 - DNA, 16 bp, Homo sapiens
ctgcaaataaagcctt

SEQ ID NO: 4325247 - DNA, 18 bp, Homo sapiens
ctgcaaataaagcctttt

SEQ ID NO: 4325248 - DNA, 18 bp, Homo sapiens
ctgcaagaattgaagcag

SEQ ID NO: 4325249 - DNA, 18 bp, Homo sapiens
ctgcaagtcattgagtga

SEQ ID NO: 4325250 - DNA, 13 bp, Homo sapiens
ctgcacaagctgc

SEQ ID NO: 4325251 - DNA, 16 bp, Homo sapiens
ctgcacaagctgcacc

SEQ ID NO: 4325252 - DNA, 12 bp, Homo sapiens
ctgcacctctgg

SEQ ID NO: 4325253 - DNA, 19 bp, Homo sapiens
ctgcactccagcctgggtg

SEQ ID NO: 4325254 - DNA, 16 bp, Homo sapiens
ctgcagggtgaagcac

SEQ ID NO: 4325255 - DNA, 15 bp, Homo sapiens
ctgccaaagcttgtg

SEQ ID NO: 4325256 - DNA, 22 bp, Homo sapiens
ctgccaacacacgtccactccc

SEQ ID NO: 4325257 - DNA, 19 bp, Homo sapiens
ctgccagaaaaaaataact

SEQ ID NO: 4325258 - DNA, 11 bp, Homo sapiens
ctgccaggcat

SEQ ID NO: 4325259 - DNA, 13 bp, Homo sapiens
ctgccagtggaga

SEQ ID NO: 4325260 - DNA, 15 bp, Homo sapiens
ctgccagtggagacg

SEQ ID NO: 4325261 - DNA, 14 bp, Homo sapiens
ctgccatgccagct

SEQ ID NO: 4325262 - DNA, 21 bp, Homo sapiens
ctgcccagccctctgtggcca

SEQ ID NO: 4325263 - DNA, 23 bp, Homo sapiens
ctgcccagttggaggagactggg

SEQ ID NO: 4325264 - DNA, 19 bp, Homo sapiens
ctgccccagcccaagtcca

SEQ ID NO: 4325265 - DNA, 14 bp, Homo sapiens
ctgcccctgagttc

SEQ ID NO: 4325266 - DNA, 20 bp, Homo sapiens
ctgcccggcagggtcctaga

SEQ ID NO: 4325267 - DNA, 14 bp, Homo sapiens
ctgcctcttctcta

SEQ ID NO: 4325268 - DNA, 9 bp, Homo sapiens
ctgcctggc

SEQ ID NO: 4325269 - DNA, 10 bp, Homo sapiens
ctgcctggca

SEQ ID NO: 4325270 - DNA, 12 bp, Homo sapiens
ctgcctggcaac

SEQ ID NO: 4325271 - DNA, 13 bp, Homo sapiens
ctgcctggcaaca

SEQ ID NO: 4325272 - DNA, 12 bp, Homo sapiens
ctgcctgggatg

SEQ ID NO: 4325273 - DNA, 16 bp, Homo sapiens
ctgcctgggatgccct

SEQ ID NO: 4325274 - DNA, 15 bp, Homo sapiens
ctgcctggttttatt

SEQ ID NO: 4325275 - DNA, 15 bp, Homo sapiens
ctgcctgtaattaaa

SEQ ID NO: 4325276 - DNA, 22 bp, Homo sapiens
ctgcctgtaattaaactagttt

SEQ ID NO: 4325277 - DNA, 16 bp, Homo sapiens
ctgcgtactccactgg

SEQ ID NO: 4325278 - DNA, 21 bp, Homo sapiens
ctgcgtactccactggtctgt

SEQ ID NO: 4325279 - DNA, 16 bp, Homo sapiens
ctgcgtctggaggggc

SEQ ID NO: 4325280 - DNA, 18 bp, Homo sapiens
ctgcgtctggaggggccc

SEQ ID NO: 4325281 - DNA, 23 bp, Homo sapiens
ctgcgtctggaggggcccctgct

SEQ ID NO: 4325282 - DNA, 13 bp, Homo sapiens
ctgctaagctaaa

SEQ ID NO: 4325283 - DNA, 17 bp, Homo sapiens
ctgctatcaaagaggtt

SEQ ID NO: 4325284 - DNA, 22 bp, Homo sapiens
ctgctattttttttaaatcaaa

SEQ ID NO: 4325285 - DNA, 23 bp, Homo sapiens
ctgctattttttttaaatcaaaa

SEQ ID NO: 4325286 - DNA, 20 bp, Homo sapiens
ctgctcattaaactgattcc

SEQ ID NO: 4325287 - DNA, 19 bp, Homo sapiens
ctgctccagctgttcagct

SEQ ID NO: 4325288 - DNA, 20 bp, Homo sapiens
ctgctccagctgttcagctg

SEQ ID NO: 4325289 - DNA, 12 bp, Homo sapiens
ctgctccaggga

SEQ ID NO: 4325290 - DNA, 22 bp, Homo sapiens
ctgctcccagctctctctcctg

SEQ ID NO: 4325291 - DNA, 18 bp, Homo sapiens
ctgctcggcttcttggac

SEQ ID NO: 4325292 - DNA, 21 bp, Homo sapiens
ctgctcggcttcttggacctt

SEQ ID NO: 4325293 - DNA, 19 bp, Homo sapiens
ctgctctagaaagtataga

SEQ ID NO: 4325294 - DNA, 19 bp, Homo sapiens
ctgctgaaagtcctgcttt

SEQ ID NO: 4325295 - DNA, 18 bp, Homo sapiens
ctgctgactgttttctct

SEQ ID NO: 4325296 - DNA, 17 bp, Homo sapiens
ctgctgggtgccaggtg

SEQ ID NO: 4325297 - DNA, 19 bp, Homo sapiens
ctgctgggtgccaggtgct

SEQ ID NO: 4325298 - DNA, 15 bp, Homo sapiens
ctgctgttctgtgta

SEQ ID NO: 4325299 - DNA, 16 bp, Homo sapiens
ctgctgttctgtgtac

SEQ ID NO: 4325300 - DNA, 13 bp, Homo sapiens
ctgcttacagttt

SEQ ID NO: 4325301 - DNA, 17 bp, Homo sapiens
ctgcttggagtgcccca

SEQ ID NO: 4325302 - DNA, 20 bp, Homo sapiens
ctgcttggagtgccccaagg

SEQ ID NO: 4325303 - DNA, 24 bp, Homo sapiens
ctgctttcctatctagcatttatt

SEQ ID NO: 4325304 - DNA, 14 bp, Homo sapiens
ctgctttgtgcata

SEQ ID NO: 4325305 - DNA, 16 bp, Homo sapiens
ctggaaacagcagtgt

SEQ ID NO: 4325306 - DNA, 11 bp, Homo sapiens
ctggaagaaag

SEQ ID NO: 4325307 - DNA, 12 bp, Homo sapiens
ctggaagcctgc

SEQ ID NO: 4325308 - DNA, 18 bp, Homo sapiens
ctggagctgctaagctaa

SEQ ID NO: 4325309 - DNA, 21 bp, Homo sapiens
ccccctgtcccctcagctcca

SEQ ID NO: 4325310 - DNA, 14 bp, Homo sapiens
cccccttctgggca

SEQ ID NO: 4325311 - DNA, 15 bp, Homo sapiens
ccccctttctctgcc

SEQ ID NO: 4325312 - DNA, 13 bp, Homo sapiens
ccccgccccctga

SEQ ID NO: 4325313 - DNA, 14 bp, Homo sapiens
ccccgcctgttccc

SEQ ID NO: 4325314 - DNA, 15 bp, Homo sapiens
ccccgtcccagaggc

SEQ ID NO: 4325315 - DNA, 14 bp, Homo sapiens
ccccgttgtgcctg

SEQ ID NO: 4325316 - DNA, 17 bp, Homo sapiens
cccctcagctccagacg

SEQ ID NO: 4325317 - DNA, 16 bp, Homo sapiens
cccctccctgctccca

SEQ ID NO: 4325318 - DNA, 11 bp, Homo sapiens
cccctctgtag

SEQ ID NO: 4325319 - DNA, 19 bp, Homo sapiens
cccctgaaacatgtgcccc

SEQ ID NO: 4325320 - DNA, 22 bp, Homo sapiens
cccctgaaacatgtgcccctgc

SEQ ID NO: 4325321 - DNA, 15 bp, Homo sapiens
cccctgagcccagag

SEQ ID NO: 4325322 - DNA, 14 bp, Homo sapiens
cccctgccaaggcc

SEQ ID NO: 4325323 - DNA, 14 bp, Homo sapiens
cccctgccccagcc

SEQ ID NO: 4325324 - DNA, 16 bp, Homo sapiens
cccctgccccagccca

SEQ ID NO: 4325325 - DNA, 13 bp, Homo sapiens
cccctgcctcctg

SEQ ID NO: 4325326 - DNA, 18 bp, Homo sapiens
cccctgcttctccagcct

SEQ ID NO: 4325327 - DNA, 20 bp, Homo sapiens
cccctgtcccctcagctcca

SEQ ID NO: 4325328 - DNA, 15 bp, Homo sapiens
cccctttctctgcct

SEQ ID NO: 4325329 - DNA, 17 bp, Homo sapiens
cccctttctctgcctgg

SEQ ID NO: 4325330 - DNA, 19 bp, Homo sapiens
cccctttctctgcctggca

SEQ ID NO: 4325331 - DNA, 20 bp, Homo sapiens
cccctttctctgcctggcaa

SEQ ID NO: 4325332 - DNA, 20 bp, Homo sapiens
cccgaagagggagacagaga

SEQ ID NO: 4325333 - DNA, 13 bp, Homo sapiens
cccgccaccctgt

SEQ ID NO: 4325334 - DNA, 13 bp, Homo sapiens
cccgccccctgaa

SEQ ID NO: 4325335 - DNA, 14 bp, Homo sapiens
cccgccccctgaaa

SEQ ID NO: 4325336 - DNA, 11 bp, Homo sapiens
cccgccctcca

SEQ ID NO: 4325337 - DNA, 13 bp, Homo sapiens
cccgcctgttccc

SEQ ID NO: 4325338 - DNA, 13 bp, Homo sapiens
cccggacactcgc

SEQ ID NO: 4325339 - DNA, 16 bp, Homo sapiens
cccggcagggtcctag

SEQ ID NO: 4325340 - DNA, 19 bp, Homo sapiens
cccggtgcagggcctggca

SEQ ID NO: 4325341 - DNA, 20 bp, Homo sapiens
cccggtgcagggcctggcat

SEQ ID NO: 4325342 - DNA, 14 bp, Homo sapiens
cccggtgcatctgg

SEQ ID NO: 4325343 - DNA, 13 bp, Homo sapiens
cccgttgggtccc

SEQ ID NO: 4325344 - DNA, 19 bp, Homo sapiens
ccctagaggacactaggag

SEQ ID NO: 4325345 - DNA, 15 bp, Homo sapiens
ccctatgtgaaaaga

SEQ ID NO: 4325346 - DNA, 21 bp, Homo sapiens
ccctattggcttactgaaaga

SEQ ID NO: 4325347 - DNA, 23 bp, Homo sapiens
ccctattggcttactgaaagaca

SEQ ID NO: 4325348 - DNA, 12 bp, Homo sapiens
ccctcagctcca

SEQ ID NO: 4325349 - DNA, 15 bp, Homo sapiens
ccctcagctccctga

SEQ ID NO: 4325350 - DNA, 16 bp, Homo sapiens
ccctcagctccctgac

SEQ ID NO: 4325351 - DNA, 23 bp, Homo sapiens
ccctccacaaagagaccaggggc

SEQ ID NO: 4325352 - DNA, 14 bp, Homo sapiens
ccctcccccagagc

SEQ ID NO: 4325353 - DNA, 15 bp, Homo sapiens
ccctcccccagagcc

SEQ ID NO: 4325354 - DNA, 18 bp, Homo sapiens
ccctccccgccccctgaa

SEQ ID NO: 4325355 - DNA, 19 bp, Homo sapiens
ccctccccgccccctgaaa

SEQ ID NO: 4325356 - DNA, 17 bp, Homo sapiens
ccctctcccacccaagg

SEQ ID NO: 4325357 - DNA, 23 bp, Homo sapiens
ccctctcccacccaaggagaacg

SEQ ID NO: 4325358 - DNA, 10 bp, Homo sapiens
ccctctgcct

SEQ ID NO: 4325359 - DNA, 14 bp, Homo sapiens
ccctctgcctggga

SEQ ID NO: 4325360 - DNA, 19 bp, Homo sapiens
ccctctgtggccaggagcc

SEQ ID NO: 4325361 - DNA, 18 bp, Homo sapiens
ccctctgtgtctgctctc

SEQ ID NO: 4325362 - DNA, 20 bp, Homo sapiens
ccctgaaacatgtgcccctg

SEQ ID NO: 4325363 - DNA, 23 bp, Homo sapiens
ccctgaaacgagaagtgccctta

SEQ ID NO: 4325364 - DNA, 15 bp, Homo sapiens
ccctgaaagccctga

SEQ ID NO: 4325365 - DNA, 15 bp, Homo sapiens
ccctgagcccagaga

SEQ ID NO: 4325366 - DNA, 23 bp, Homo sapiens
ccctgagcccagagaagctggaa

SEQ ID NO: 4325367 - DNA, 16 bp, Homo sapiens
ccctgagctttctgct

SEQ ID NO: 4325368 - DNA, 21 bp, Homo sapiens
ccctgagttctgacactgtgt

SEQ ID NO: 4325369 - DNA, 15 bp, Homo sapiens
ccctgccccagccca

SEQ ID NO: 4325370 - DNA, 17 bp, Homo sapiens
ccctgccccagcccaag

SEQ ID NO: 4325371 - DNA, 17 bp, Homo sapiens
ccctgcctcctgcctcc

SEQ ID NO: 4325372 - DNA, 13 bp, Homo sapiens
ccctgctcccagc

SEQ ID NO: 4325373 - DNA, 12 bp, Homo sapiens
ccctgcttctcc

SEQ ID NO: 4325374 - DNA, 15 bp, Homo sapiens
ccctgcttctccagc

SEQ ID NO: 4325375 - DNA, 21 bp, Homo sapiens
ccctgcttctccagcctggac

SEQ ID NO: 4325376 - DNA, 15 bp, Homo sapiens
cctgccaggcatggt

SEQ ID NO: 4325377 - DNA, 12 bp, Homo sapiens
cctgcccagtcc

SEQ ID NO: 4325378 - DNA, 21 bp, Homo sapiens
cctgcccagtcccccaacccc

SEQ ID NO: 4325379 - DNA, 20 bp, Homo sapiens
cctgcccagttggaggagac

SEQ ID NO: 4325380 - DNA, 12 bp, Homo sapiens
cctgccccagcc

SEQ ID NO: 4325381 - DNA, 15 bp, Homo sapiens
cctgccccagcccaa

SEQ ID NO: 4325382 - DNA, 17 bp, Homo sapiens
cctgccccagcccaagt

SEQ ID NO: 4325383 - DNA, 13 bp, Homo sapiens
cctgcccttccct

SEQ ID NO: 4325384 - DNA, 16 bp, Homo sapiens
cctgcccttgtctgag

SEQ ID NO: 4325385 - DNA, 19 bp, Homo sapiens
cctgccgaaaacaggagca

SEQ ID NO: 4325386 - DNA, 21 bp, Homo sapiens
cctgcctcctgcctcccgcct

SEQ ID NO: 4325387 - DNA, 17 bp, Homo sapiens
cctgccttttaagtttg

SEQ ID NO: 4325388 - DNA, 12 bp, Homo sapiens
cctgctccagct

SEQ ID NO: 4325389 - DNA, 21 bp, Homo sapiens
cctgctgaaagtcctgctttc

SEQ ID NO: 4325390 - DNA, 14 bp, Homo sapiens
cctgctgcttggag

SEQ ID NO: 4325391 - DNA, 14 bp, Homo sapiens
cctgctgggtgcca

SEQ ID NO: 4325392 - DNA, 14 bp, Homo sapiens
cctgcttctccagc

SEQ ID NO: 4325393 - DNA, 22 bp, Homo sapiens
cctggaaacagacagggagaag

SEQ ID NO: 4325394 - DNA, 17 bp, Homo sapiens
cctggacccccagcttt

SEQ ID NO: 4325395 - DNA, 13 bp, Homo sapiens
cctggaccctgtg

SEQ ID NO: 4325396 - DNA, 16 bp, Homo sapiens
cctggagtctgaagcc

SEQ ID NO: 4325397 - DNA, 19 bp, Homo sapiens
cctggagtctgaagcctgc

SEQ ID NO: 4325398 - DNA, 23 bp, Homo sapiens
cctggagtctgaagcctgcaggt

SEQ ID NO: 4325399 - DNA, 13 bp, Homo sapiens
cctggcccactgc

SEQ ID NO: 4325400 - DNA, 14 bp, Homo sapiens
cctggcccactgca

SEQ ID NO: 4325401 - DNA, 16 bp, Homo sapiens
cctggcccactgcatc

SEQ ID NO: 4325402 - DNA, 14 bp, Homo sapiens
cctggcggaggtgg

SEQ ID NO: 4325403 - DNA, 18 bp, Homo sapiens
cctggcggaggtggagtg

SEQ ID NO: 4325404 - DNA, 20 bp, Homo sapiens
cctggcggaggtggagtggc

SEQ ID NO: 4325405 - DNA, 13 bp, Homo sapiens
cctggcgggatgg

SEQ ID NO: 4325406 - DNA, 13 bp, Homo sapiens
cctgggatgccct

SEQ ID NO: 4325407 - DNA, 14 bp, Homo sapiens
cctgggatgccctt

SEQ ID NO: 4325408 - DNA, 17 bp, Homo sapiens
cctgggatgcccttccc

SEQ ID NO: 4325409 - DNA, 20 bp, Homo sapiens
cctgggatgcccttccccct

SEQ ID NO: 4325410 - DNA, 22 bp, Homo sapiens
cctgggatggacgctgccggga

SEQ ID NO: 4325411 - DNA, 23 bp, Homo sapiens
cctgggcagtgagtgccatgctt

SEQ ID NO: 4325412 - DNA, 22 bp, Homo sapiens
cctgggcatgtttgtctgtgtg

SEQ ID NO: 4325413 - DNA, 19 bp, Homo sapiens
cctgggcggggccgcagcc

SEQ ID NO: 4325414 - DNA, 22 bp, Homo sapiens
cctgggcggggccgcagccaca

SEQ ID NO: 4325415 - DNA, 19 bp, Homo sapiens
cctggggtttagaacccca

SEQ ID NO: 4325416 - DNA, 24 bp, Homo sapiens
cctggggtttagaaccccaggtga

SEQ ID NO: 4325417 - DNA, 19 bp, Homo sapiens
cctggtgcccttccctgga

SEQ ID NO: 4325418 - DNA, 16 bp, Homo sapiens
cctggttcgtgccatg

SEQ ID NO: 4325419 - DNA, 16 bp, Homo sapiens
cctggttttatttata

SEQ ID NO: 4325420 - DNA, 15 bp, Homo sapiens
cctgtagagtgggag

SEQ ID NO: 4325421 - DNA, 22 bp, Homo sapiens
cctgtagatcagggatagcgct

SEQ ID NO: 4325422 - DNA, 22 bp, Homo sapiens
cctgtatgtctacctctgactt

SEQ ID NO: 4325423 - DNA, 16 bp, Homo sapiens
cctgtcccctcagctc

SEQ ID NO: 4325424 - DNA, 21 bp, Homo sapiens
cctgtcccctcagctccagac

SEQ ID NO: 4325425 - DNA, 15 bp, Homo sapiens
cctgtctctgcatct

SEQ ID NO: 4325426 - DNA, 14 bp, Homo sapiens
cctgtctgtttata

SEQ ID NO: 4325427 - DNA, 18 bp, Homo sapiens
cctgtttgaagcctgccc

SEQ ID NO: 4325428 - DNA, 16 bp, Homo sapiens
cctgttttgagaccag

SEQ ID NO: 4325429 - DNA, 23 bp, Homo sapiens
ccttaaatgaactactgctattt

SEQ ID NO: 4325430 - DNA, 22 bp, Homo sapiens
ccttaaggatcaccccagcccc

SEQ ID NO: 4325431 - DNA, 20 bp, Homo sapiens
ccttacacgtgcgtgtgagt

SEQ ID NO: 4325432 - DNA, 16 bp, Homo sapiens
ccttactcacctctct

SEQ ID NO: 4325433 - DNA, 14 bp, Homo sapiens
ccttacttgcactg

SEQ ID NO: 4325434 - DNA, 20 bp, Homo sapiens
catgatacctattaaaggaa

SEQ ID NO: 4325435 - DNA, 22 bp, Homo sapiens
catgatacctattaaaggaaaa

SEQ ID NO: 4325436 - DNA, 16 bp, Homo sapiens
catgcaaactgcttta

SEQ ID NO: 4325437 - DNA, 15 bp, Homo sapiens
catgccacagtggta

SEQ ID NO: 4325438 - DNA, 20 bp, Homo sapiens
catgccagcttatctcaggg

SEQ ID NO: 4325439 - DNA, 17 bp, Homo sapiens
catgctcctggcccact

SEQ ID NO: 4325440 - DNA, 19 bp, Homo sapiens
catgctgagtctcccaagg

SEQ ID NO: 4325441 - DNA, 17 bp, Homo sapiens
catgctgtccgtgcttg

SEQ ID NO: 4325442 - DNA, 19 bp, Homo sapiens
catgcttctactgtgacac

SEQ ID NO: 4325443 - DNA, 23 bp, Homo sapiens
catgcttctcatcttgtgaaatg

SEQ ID NO: 4325444 - DNA, 23 bp, Homo sapiens
catgctttgagaccagaagaaaa

SEQ ID NO: 4325445 - DNA, 13 bp, Homo sapiens
catggagactctg

SEQ ID NO: 4325446 - DNA, 15 bp, Homo sapiens
catggccaatagtca

SEQ ID NO: 4325447 - DNA, 16 bp, Homo sapiens
catggccagactccct

SEQ ID NO: 4325448 - DNA, 14 bp, Homo sapiens
catggggcccctgg

SEQ ID NO: 4325449 - DNA, 18 bp, Homo sapiens
catggtacccccttctgg

SEQ ID NO: 4325450 - DNA, 20 bp, Homo sapiens
catggttcattttctgatgc

SEQ ID NO: 4325451 - DNA, 23 bp, Homo sapiens
catggttcattttctgatgccca

SEQ ID NO: 4325452 - DNA, 15 bp, Homo sapiens
catgtagctgagttt

SEQ ID NO: 4325453 - DNA, 15 bp, Homo sapiens
catgtagtgctctca

SEQ ID NO: 4325454 - DNA, 13 bp, Homo sapiens
catgtctgtatcc

SEQ ID NO: 4325455 - DNA, 13 bp, Homo sapiens
catgtgcccctgc

SEQ ID NO: 4325456 - DNA, 20 bp, Homo sapiens
catgtgcgtttcatgtgttt

SEQ ID NO: 4325457 - DNA, 18 bp, Homo sapiens
catgtgctgatgtttaca

SEQ ID NO: 4325458 - DNA, 14 bp, Homo sapiens
catgtgttcattct

SEQ ID NO: 4325459 - DNA, 22 bp, Homo sapiens
catgttgggtttgagacagaca

SEQ ID NO: 4325460 - DNA, 22 bp, Homo sapiens
catgtttctcccataggctgtg

SEQ ID NO: 4325461 - DNA, 21 bp, Homo sapiens
catgtttgtctgtgtgctgta

SEQ ID NO: 4325462 - DNA, 18 bp, Homo sapiens
cattaaactctaaagatt

SEQ ID NO: 4325463 - DNA, 15 bp, Homo sapiens
cattaactaaatgct

SEQ ID NO: 4325464 - DNA, 20 bp, Homo sapiens
cattaataactgaataaaaa

SEQ ID NO: 4325465 - DNA, 15 bp, Homo sapiens
cattacgtgcattta

SEQ ID NO: 4325466 - DNA, 17 bp, Homo sapiens
cattacgtgcatttaaa

SEQ ID NO: 4325467 - DNA, 19 bp, Homo sapiens
cattacttctgagccccag

SEQ ID NO: 4325468 - DNA, 18 bp, Homo sapiens
cattagcttgtctattat

SEQ ID NO: 4325469 - DNA, 12 bp, Homo sapiens
cattaggaattg

SEQ ID NO: 4325470 - DNA, 15 bp, Homo sapiens
cattcattctgagcc

SEQ ID NO: 4325471 - DNA, 16 bp, Homo sapiens
cattcattctgagccc

SEQ ID NO: 4325472 - DNA, 21 bp, Homo sapiens
cattccattgcctagctcttt

SEQ ID NO: 4325473 - DNA, 16 bp, Homo sapiens
cattcctacaatttct

SEQ ID NO: 4325474 - DNA, 23 bp, Homo sapiens
cattcctgttctctttgccttga

SEQ ID NO: 4325475 - DNA, 17 bp, Homo sapiens
cattccttacttgcact

SEQ ID NO: 4325476 - DNA, 16 bp, Homo sapiens
cagggaaatgtgtatc

SEQ ID NO: 4325477 - DNA, 13 bp, Homo sapiens
cagggagaggcct

SEQ ID NO: 4325478 - DNA, 23 bp, Homo sapiens
cagggagaggcctcggctgtctc

SEQ ID NO: 4325479 - DNA, 12 bp, Homo sapiens
cagggaggaaga

SEQ ID NO: 4325480 - DNA, 18 bp, Homo sapiens
cagggcactgtctgcgtg

SEQ ID NO: 4325481 - DNA, 15 bp, Homo sapiens
cagggcctggcatag

SEQ ID NO: 4325482 - DNA, 21 bp, Homo sapiens
cagggctggtcacctcccatc

SEQ ID NO: 4325483 - DNA, 18 bp, Homo sapiens
caggggatgtacatctct

SEQ ID NO: 4325484 - DNA, 21 bp, Homo sapiens
caggggatgtacatctctccc

SEQ ID NO: 4325485 - DNA, 21 bp, Homo sapiens
caggggcgcttgggaggggcc

SEQ ID NO: 4325486 - DNA, 20 bp, Homo sapiens
caggggcgggtgatgagacc

SEQ ID NO: 4325487 - DNA, 20 bp, Homo sapiens
cagggtattccagagtgggg

SEQ ID NO: 4325488 - DNA, 17 bp, Homo sapiens
cagggtgaagcaccagg

SEQ ID NO: 4325489 - DNA, 18 bp, Homo sapiens
cagggtgaagcaccaggg

SEQ ID NO: 4325490 - DNA, 20 bp, Homo sapiens
cagggtgaagcaccagggag

SEQ ID NO: 4325491 - DNA, 15 bp, Homo sapiens
cagggtggagggaag

SEQ ID NO: 4325492 - DNA, 21 bp, Homo sapiens
cagggttaagcctgtaattat

SEQ ID NO: 4325493 - DNA, 20 bp, Homo sapiens
cagggttctgctcggcttct

SEQ ID NO: 4325494 - DNA, 14 bp, Homo sapiens
caggtaacactaca

SEQ ID NO: 4325495 - DNA, 14 bp, Homo sapiens
caggtatcaactag

SEQ ID NO: 4325496 - DNA, 16 bp, Homo sapiens
caggtctttgggaagc

SEQ ID NO: 4325497 - DNA, 13 bp, Homo sapiens
caggtgagaagca

SEQ ID NO: 4325498 - DNA, 23 bp, Homo sapiens
caggtgcagcccttcctccctgt

SEQ ID NO: 4325499 - DNA, 22 bp, Homo sapiens
caggtggagagagtggtaaaaa

SEQ ID NO: 4325500 - DNA, 21 bp, Homo sapiens
caggttagagacagtatgtat

SEQ ID NO: 4325501 - DNA, 14 bp, Homo sapiens
caggttggtggggg

SEQ ID NO: 4325502 - DNA, 14 bp, Homo sapiens
cagtaatgtagaaa

SEQ ID NO: 4325503 - DNA, 16 bp, Homo sapiens
cagtaatgtagaaatg

SEQ ID NO: 4325504 - DNA, 13 bp, Homo sapiens
cagtagaaagagt

SEQ ID NO: 4325505 - DNA, 13 bp, Homo sapiens
cagtatctcaggg

SEQ ID NO: 4325506 - DNA, 15 bp, Homo sapiens
cagtatctcagggcc

SEQ ID NO: 4325507 - DNA, 16 bp, Homo sapiens
cagtccaactcttcca

SEQ ID NO: 4325508 - DNA, 14 bp, Homo sapiens
cagtcccagcacat

SEQ ID NO: 4325509 - DNA, 21 bp, Homo sapiens
cagtctgattataccatgtgt

SEQ ID NO: 4325510 - DNA, 18 bp, Homo sapiens
cagtgagtctctggggca

SEQ ID NO: 4325511 - DNA, 17 bp, Homo sapiens
cagtgagtgccatgctt

SEQ ID NO: 4325512 - DNA, 11 bp, Homo sapiens
cagtgccacac

SEQ ID NO: 4325513 - DNA, 19 bp, Homo sapiens
cagtgcccggtgcagggcc

SEQ ID NO: 4325514 - DNA, 16 bp, Homo sapiens
caaataaagcctttta

SEQ ID NO: 4325515 - DNA, 21 bp, Homo sapiens
caaatatatgtatatatattc

SEQ ID NO: 4325516 - DNA, 15 bp, Homo sapiens
caaatgatacagtca

SEQ ID NO: 4325517 - DNA, 21 bp, Homo sapiens
caaattagggcaattggaaca

SEQ ID NO: 4325518 - DNA, 15 bp, Homo sapiens
caaattatttattac

SEQ ID NO: 4325519 - DNA, 19 bp, Homo sapiens
caaattatttattacttgt

SEQ ID NO: 4325520 - DNA, 23 bp, Homo sapiens
caaattatttattacttgtgcac

SEQ ID NO: 4325521 - DNA, 22 bp, Homo sapiens
caaattgctcctaagcttcaaa

SEQ ID NO: 4325522 - DNA, 14 bp, Homo sapiens
caaattgtgcttct

SEQ ID NO: 4325523 - DNA, 20 bp, Homo sapiens
caaatttaattaaagcctta

SEQ ID NO: 4325524 - DNA, 21 bp, Homo sapiens
caaattttgatgccaagaaag

SEQ ID NO: 4325525 - DNA, 15 bp, Homo sapiens
caacaatgattttct

SEQ ID NO: 4325526 - DNA, 14 bp, Homo sapiens
caacaccagcccct

SEQ ID NO: 4325527 - DNA, 22 bp, Homo sapiens
caacacctctgcacaagctgca

SEQ ID NO: 4325528 - DNA, 21 bp, Homo sapiens
caacatcttacttgtcctttg

SEQ ID NO: 4325529 - DNA, 23 bp, Homo sapiens
caacatgaatttttatgatttct

SEQ ID NO: 4325530 - DNA, 12 bp, Homo sapiens
caaccccagccg

SEQ ID NO: 4325531 - DNA, 23 bp, Homo sapiens
caaccccagccgctcggaggccc

SEQ ID NO: 4325532 - DNA, 10 bp, Homo sapiens
caacccctga

SEQ ID NO: 4325533 - DNA, 12 bp, Homo sapiens
caacccctgagg

SEQ ID NO: 4325534 - DNA, 13 bp, Homo sapiens
caacccctgagga

SEQ ID NO: 4325535 - DNA, 21 bp, Homo sapiens
caacccgttgggtcccttgct

SEQ ID NO: 4325536 - DNA, 17 bp, Homo sapiens
caactcaagtgtcacct

SEQ ID NO: 4325537 - DNA, 20 bp, Homo sapiens
caactcaagtgtcacctcct

SEQ ID NO: 4325538 - DNA, 16 bp, Homo sapiens
caactgcattggcttt

SEQ ID NO: 4325539 - DNA, 17 bp, Homo sapiens
caactttgcaaattatt

SEQ ID NO: 4325540 - DNA, 17 bp, Homo sapiens
caagaactcattatttt

SEQ ID NO: 4325541 - DNA, 21 bp, Homo sapiens
caagaagcgtgagacgccacc

SEQ ID NO: 4325542 - DNA, 22 bp, Homo sapiens
caagaagctttaatatttaaat

SEQ ID NO: 4325543 - DNA, 23 bp, Homo sapiens
caagaaggaagatttgacgttgt

SEQ ID NO: 4325544 - DNA, 18 bp, Homo sapiens
caagactctttggacact

SEQ ID NO: 4325545 - DNA, 14 bp, Homo sapiens
caagagcaggaggt

SEQ ID NO: 4325546 - DNA, 16 bp, Homo sapiens
caagagggacagagcc

SEQ ID NO: 4325547 - DNA, 20 bp, Homo sapiens
caagaggtttttctccccgc

SEQ ID NO: 4325548 - DNA, 23 bp, Homo sapiens
caagattttttttttaagtgaca

SEQ ID NO: 4325549 - DNA, 18 bp, Homo sapiens
caagcatttttccatctg

SEQ ID NO: 4325550 - DNA, 23 bp, Homo sapiens
caagccttactcacctctctcta

SEQ ID NO: 4325551 - DNA, 16 bp, Homo sapiens
caagctaatctgcctg

SEQ ID NO: 4325552 - DNA, 22 bp, Homo sapiens
caagctcaggaggcgaataaat

SEQ ID NO: 4325553 - DNA, 20 bp, Homo sapiens
caagctgcaccctcaggcag

SEQ ID NO: 4325554 - DNA, 22 bp, Homo sapiens
caagctgcaccctcaggcaggt

SEQ ID NO: 4325555 - DNA, 19 bp, Homo sapiens
caaggaaattaagaactga

SEQ ID NO: 4325556 - DNA, 22 bp, Homo sapiens
caaggaggtggtgaatttttaa

SEQ ID NO: 4325557 - DNA, 18 bp, Homo sapiens
caaggatatactgcagct

SEQ ID NO: 4325558 - DNA, 22 bp, Homo sapiens
caaggatcttttggacctggct

SEQ ID NO: 4325559 - DNA, 14 bp, Homo sapiens
caaggccagaaaaa

SEQ ID NO: 4325560 - DNA, 20 bp, Homo sapiens
caaggccagaaaaagaagaa

SEQ ID NO: 4325561 - DNA, 20 bp, Homo sapiens
caaggccggagacccacagc

SEQ ID NO: 4325562 - DNA, 22 bp, Homo sapiens
caaggctgcagtgagccgagat

SEQ ID NO: 4325563 - DNA, 18 bp, Homo sapiens
caaggctgcgtctggagg

SEQ ID NO: 4325564 - DNA, 21 bp, Homo sapiens
caaggctgggggaagaagctc

SEQ ID NO: 4325565 - DNA, 20 bp, Homo sapiens
caagggcatcatcctcagca

SEQ ID NO: 4325566 - DNA, 21 bp, Homo sapiens
caagggccgtgcccttgccct

SEQ ID NO: 4325567 - DNA, 16 bp, Homo sapiens
caaggtatacctcagt

SEQ ID NO: 4325568 - DNA, 12 bp, Homo sapiens
caaggtgggagg

SEQ ID NO: 4325569 - DNA, 15 bp, Homo sapiens
caagtaacactttaa

SEQ ID NO: 4325570 - DNA, 15 bp, Homo sapiens
caagtaagaaataat

SEQ ID NO: 4325571 - DNA, 21 bp, Homo sapiens
caagtagcctctgggatctgc

SEQ ID NO: 4325572 - DNA, 14 bp, Homo sapiens
caagtcattcctaa

SEQ ID NO: 4325573 - DNA, 14 bp, Homo sapiens
caagtccaagcccg

SEQ ID NO: 4325574 - DNA, 15 bp, Homo sapiens
caagtttttctctca

SEQ ID NO: 4325575 - DNA, 22 bp, Homo sapiens
caataaagagttagaatgaaaa

SEQ ID NO: 4325576 - DNA, 13 bp, Homo sapiens
caatagaaagcaa

SEQ ID NO: 4325577 - DNA, 14 bp, Homo sapiens
caatagaaagcaaa

SEQ ID NO: 4325578 - DNA, 16 bp, Homo sapiens
caatatgacacagctt

SEQ ID NO: 4325579 - DNA, 17 bp, Homo sapiens
caatattcgctgtgtca

SEQ ID NO: 4325580 - DNA, 22 bp, Homo sapiens
caatatttctgctttctttgat

SEQ ID NO: 4325581 - DNA, 12 bp, Homo sapiens
caatcattgttt

SEQ ID NO: 4325582 - DNA, 13 bp, Homo sapiens
caatcattttgga

SEQ ID NO: 4325583 - DNA, 15 bp, Homo sapiens
caatccatgcttcac

SEQ ID NO: 4325584 - DNA, 13 bp, Homo sapiens
caatctgggaaga

SEQ ID NO: 4325585 - DNA, 12 bp, Homo sapiens
caatgaaaagtc

SEQ ID NO: 4325586 - DNA, 22 bp, Homo sapiens
caatgatacccaacagtttatt

SEQ ID NO: 4325587 - DNA, 21 bp, Homo sapiens
caatgatcacatctaaagctt

SEQ ID NO: 4325588 - DNA, 14 bp, Homo sapiens
caatggagaaaatg

SEQ ID NO: 4325589 - DNA, 16 bp, Homo sapiens
caatggagaaaatgaa

SEQ ID NO: 4325590 - DNA, 14 bp, Homo sapiens
caatgtgtttttct

SEQ ID NO: 4325591 - DNA, 10 bp, Homo sapiens
caattccaat

SEQ ID NO: 4325592 - DNA, 17 bp, Homo sapiens
caattccaatatttctg

SEQ ID NO: 4325593 - DNA, 22 bp, Homo sapiens
caatttgcataatactaattta

SEQ ID NO: 4325594 - DNA, 23 bp, Homo sapiens
caatttgttcttgtattttaata

SEQ ID NO: 4325595 - DNA, 17 bp, Homo sapiens
cacaaacgggctcagca

SEQ ID NO: 4325596 - DNA, 20 bp, Homo sapiens
cacaactttgcaaattattt

SEQ ID NO: 4325597 - DNA, 23 bp, Homo sapiens
cacaagctgcaccctcaggcagg

SEQ ID NO: 4325598 - DNA, 16 bp, Homo sapiens
cacaaggattgaaaat

SEQ ID NO: 4325599 - DNA, 19 bp, Homo sapiens
cacaaggccagaaaaagaa

SEQ ID NO: 4325600 - DNA, 20 bp, Homo sapiens
cacaaggccagaaaaagaag

SEQ ID NO: 4325601 - DNA, 15 bp, Homo sapiens
cacaagtagcctctg

SEQ ID NO: 4325602 - DNA, 19 bp, Homo sapiens
cacaagtctcctagacact

SEQ ID NO: 4325603 - DNA, 20 bp, Homo sapiens
cacagaccaagtccaagccc

SEQ ID NO: 4325604 - DNA, 18 bp, Homo sapiens
cacagagtttgtagtaaa

SEQ ID NO: 4325605 - DNA, 21 bp, Homo sapiens
cacagagtttgtagtaaatat

SEQ ID NO: 4325606 - DNA, 23 bp, Homo sapiens
cacagagtttgtagtaaatatta

SEQ ID NO: 4325607 - DNA, 14 bp, Homo sapiens
cacagccctggaat

SEQ ID NO: 4325608 - DNA, 19 bp, Homo sapiens
cacaggagtcctttctttt

SEQ ID NO: 4325609 - DNA, 17 bp, Homo sapiens
cacaggcagctctgagc

SEQ ID NO: 4325610 - DNA, 18 bp, Homo sapiens
cacaggcagctctgagcc

SEQ ID NO: 4325611 - DNA, 12 bp, Homo sapiens
cacaggcctccc

SEQ ID NO: 4325612 - DNA, 13 bp, Homo sapiens
cacaggcctccct

SEQ ID NO: 4325613 - DNA, 14 bp, Homo sapiens
cacaggcctccctg

SEQ ID NO: 4325614 - DNA, 15 bp, Homo sapiens
cacaggcctccctgt

SEQ ID NO: 4325615 - DNA, 16 bp, Homo sapiens
cacaggcctccctgtt

SEQ ID NO: 4325616 - DNA, 17 bp, Homo sapiens
cacagggaaatgtgtat

SEQ ID NO: 4325617 - DNA, 13 bp, Homo sapiens
cacagtgggaaga

SEQ ID NO: 4325618 - DNA, 16 bp, Homo sapiens
cacataaatgaaagaa

SEQ ID NO: 4325619 - DNA, 21 bp, Homo sapiens
cacataggctggtggccttgg

SEQ ID NO: 4325620 - DNA, 23 bp, Homo sapiens
cacataggctggtggccttgggc

SEQ ID NO: 4325621 - DNA, 14 bp, Homo sapiens
cacatagtttcttt

SEQ ID NO: 4325622 - DNA, 13 bp, Homo sapiens
cacatataaaaac

SEQ ID NO: 4325623 - DNA, 23 bp, Homo sapiens
cacatctaaagctttatctttgt

SEQ ID NO: 4325624 - DNA, 15 bp, Homo sapiens
cacatctttcctgtc

SEQ ID NO: 4325625 - DNA, 14 bp, Homo sapiens
cacatttcctctct

SEQ ID NO: 4325626 - DNA, 20 bp, Homo sapiens
caccaccgaatatattactg

SEQ ID NO: 4325627 - DNA, 23 bp, Homo sapiens
caccaccgaatatattactgatt

SEQ ID NO: 4325628 - DNA, 21 bp, Homo sapiens
caccagggagaggcctcggct

SEQ ID NO: 4325629 - DNA, 16 bp, Homo sapiens
caccagggcactgtct

SEQ ID NO: 4325630 - DNA, 18 bp, Homo sapiens
caccagggcactgtctgc

SEQ ID NO: 4325631 - DNA, 13 bp, Homo sapiens
caccattcctgga

SEQ ID NO: 4325632 - DNA, 14 bp, Homo sapiens
caccattcctggaa

SEQ ID NO: 4325633 - DNA, 22 bp, Homo sapiens
cacccagaggtggccctcccag

SEQ ID NO: 4325634 - DNA, 11 bp, Homo sapiens
caaaagaaaat

SEQ ID NO: 4325635 - DNA, 19 bp, Homo sapiens
caaaagtcagagttaaaat

SEQ ID NO: 4325636 - DNA, 17 bp, Homo sapiens
caaaagttttcctgaga

SEQ ID NO: 4325637 - DNA, 14 bp, Homo sapiens
caaaataaagaata

SEQ ID NO: 4325638 - DNA, 13 bp, Homo sapiens
caaaatagaagaa

SEQ ID NO: 4325639 - DNA, 15 bp, Homo sapiens
caaaatagaagaaga

SEQ ID NO: 4325640 - DNA, 14 bp, Homo sapiens
caaaatttgaataa

SEQ ID NO: 4325641 - DNA, 13 bp, Homo sapiens
caaacaaacaagc

SEQ ID NO: 4325642 - DNA, 15 bp, Homo sapiens
caaacatgtatttat

SEQ ID NO: 4325643 - DNA, 21 bp, Homo sapiens
caaaccttaagataatggata

SEQ ID NO: 4325644 - DNA, 20 bp, Homo sapiens
caaactctataaagaaactt

SEQ ID NO: 4325645 - DNA, 13 bp, Homo sapiens
caaactgctttat

SEQ ID NO: 4325646 - DNA, 20 bp, Homo sapiens
caaacttctcgcaactgaag

SEQ ID NO: 4325647 - DNA, 12 bp, Homo sapiens
caaagaaaatga

SEQ ID NO: 4325648 - DNA, 15 bp, Homo sapiens
caaagaaaatgagaa

SEQ ID NO: 4325649 - DNA, 21 bp, Homo sapiens
caaagaaacaaagcaaatttc

SEQ ID NO: 4325650 - DNA, 15 bp, Homo sapiens
caaagagaaaactta

SEQ ID NO: 4325651 - DNA, 21 bp, Homo sapiens
caaagaggttttaaaaaaatc

SEQ ID NO: 4325652 - DNA, 14 bp, Homo sapiens
caaagatttcagta

SEQ ID NO: 4325653 - DNA, 21 bp, Homo sapiens
caaagatttcagtagaatttt

SEQ ID NO: 4325654 - DNA, 21 bp, Homo sapiens
caaagcaaatttcattatcta

SEQ ID NO: 4325655 - DNA, 23 bp, Homo sapiens
caaagctgatttcccttttttct

SEQ ID NO: 4325656 - DNA, 19 bp, Homo sapiens
caaaggaccgttttgtatt

SEQ ID NO: 4325657 - DNA, 16 bp, Homo sapiens
caaagtgccactcatt

SEQ ID NO: 4325658 - DNA, 22 bp, Homo sapiens
caaagtgccactcattcctgta

SEQ ID NO: 4325659 - DNA, 18 bp, Homo sapiens
caaagtggggtacagtaa

SEQ ID NO: 4325660 - DNA, 14 bp, Homo sapiens
caaataaagccttt

SEQ ID NO: 4325661 - DNA, 18 bp, Homo sapiens
agtgtttgaaaactgaca

SEQ ID NO: 4325662 - DNA, 14 bp, Homo sapiens
agttaaaatatata

SEQ ID NO: 4325663 - DNA, 18 bp, Homo sapiens
agttaaaatcacatttta

SEQ ID NO: 4325664 - DNA, 22 bp, Homo sapiens
agttaaaatcacattttaagtg

SEQ ID NO: 4325665 - DNA, 22 bp, Homo sapiens
agttaaataaatagaaagagtt

SEQ ID NO: 4325666 - DNA, 15 bp, Homo sapiens
agttaagtgtcattt

SEQ ID NO: 4325667 - DNA, 17 bp, Homo sapiens
agttacgtataatgctt

SEQ ID NO: 4325668 - DNA, 17 bp, Homo sapiens
agttagagataattctg

SEQ ID NO: 4325669 - DNA, 18 bp, Homo sapiens
agttagagataattctga

SEQ ID NO: 4325670 - DNA, 19 bp, Homo sapiens
agttataaaactatgtgtt

SEQ ID NO: 4325671 - DNA, 17 bp, Homo sapiens
agttataagcgtattta

SEQ ID NO: 4325672 - DNA, 15 bp, Homo sapiens
agttccattcttggt

SEQ ID NO: 4325673 - DNA, 13 bp, Homo sapiens
agttccctctgcc

SEQ ID NO: 4325674 - DNA, 17 bp, Homo sapiens
agttccctctgcctggg

SEQ ID NO: 4325675 - DNA, 18 bp, Homo sapiens
agttccctctgcctggga

SEQ ID NO: 4325676 - DNA, 23 bp, Homo sapiens
agttcttagtcccacagggaaat

SEQ ID NO: 4325677 - DNA, 17 bp, Homo sapiens
agttgaaaaacagctga

SEQ ID NO: 4325678 - DNA, 16 bp, Homo sapiens
agttgaggaactgtac

SEQ ID NO: 4325679 - DNA, 13 bp, Homo sapiens
agttgattcagct

SEQ ID NO: 4325680 - DNA, 15 bp, Homo sapiens
agttgattcagctct

SEQ ID NO: 4325681 - DNA, 18 bp, Homo sapiens
agttgattcagctctgca

SEQ ID NO: 4325682 - DNA, 15 bp, Homo sapiens
agttgcagaaaatga

SEQ ID NO: 4325683 - DNA, 15 bp, Homo sapiens
agttgctaactggga

SEQ ID NO: 4325684 - DNA, 20 bp, Homo sapiens
agttgctaactgggaagaac

SEQ ID NO: 4325685 - DNA, 21 bp, Homo sapiens
agttgctaactgggaagaaca

SEQ ID NO: 4325686 - DNA, 16 bp, Homo sapiens
agttgctggaaaatca

SEQ ID NO: 4325687 - DNA, 16 bp, Homo sapiens
agttggaaaattccca

SEQ ID NO: 4325688 - DNA, 20 bp, Homo sapiens
agttggaggagactgggcac

SEQ ID NO: 4325689 - DNA, 14 bp, Homo sapiens
agttgtctctcttc

SEQ ID NO: 4325690 - DNA, 21 bp, Homo sapiens
agttgtctgaattgagaaaag

SEQ ID NO: 4325691 - DNA, 13 bp, Homo sapiens
agttgtctgtgct

SEQ ID NO: 4325692 - DNA, 21 bp, Homo sapiens
agttgtctgtgcttccttggt

SEQ ID NO: 4325693 - DNA, 15 bp, Homo sapiens
agttgttaacttcta

SEQ ID NO: 4325694 - DNA, 17 bp, Homo sapiens
agttgttgtttgccaag

SEQ ID NO: 4325695 - DNA, 19 bp, Homo sapiens
agtttatctatcggaagaa

SEQ ID NO: 4325696 - DNA, 20 bp, Homo sapiens
agtttatctatcggaagaac

SEQ ID NO: 4325697 - DNA, 16 bp, Homo sapiens
agtttcatgtatgtat

SEQ ID NO: 4325698 - DNA, 19 bp, Homo sapiens
agtttcatgtatgtatata

SEQ ID NO: 4325699 - DNA, 15 bp, Homo sapiens
agtttccaagaaatt

SEQ ID NO: 4325700 - DNA, 17 bp, Homo sapiens
agtttggaaataaaaat

SEQ ID NO: 4325701 - DNA, 22 bp, Homo sapiens
agtttggaaataaaaatgttct

SEQ ID NO: 4325702 - DNA, 19 bp, Homo sapiens
agtttgtaggtaaaatgta

SEQ ID NO: 4325703 - DNA, 22 bp, Homo sapiens
agtttgtaggtaaaatgtattt

SEQ ID NO: 4325704 - DNA, 19 bp, Homo sapiens
agtttgtgtgtatttgtat

SEQ ID NO: 4325705 - DNA, 21 bp, Homo sapiens
agtttgtgtgtatttgtatta

SEQ ID NO: 4325706 - DNA, 15 bp, Homo sapiens
agttttactcttaaa

SEQ ID NO: 4325707 - DNA, 18 bp, Homo sapiens
agttttactcttaaatca

SEQ ID NO: 4325708 - DNA, 20 bp, Homo sapiens
agttttactcttaaatcatt

SEQ ID NO: 4325709 - DNA, 22 bp, Homo sapiens
agttttactcttaaatcatttg

SEQ ID NO: 4325710 - DNA, 11 bp, Homo sapiens
agttttcctga

SEQ ID NO: 4325711 - DNA, 14 bp, Homo sapiens
ataaaactatgtgt

SEQ ID NO: 4325712 - DNA, 16 bp, Homo sapiens
ataaaagcacactgct

SEQ ID NO: 4325713 - DNA, 13 bp, Homo sapiens
ataaaattctaga

SEQ ID NO: 4325714 - DNA, 13 bp, Homo sapiens
ataaaattgaaaa

SEQ ID NO: 4325715 - DNA, 16 bp, Homo sapiens
ataaaattgaaaacac

SEQ ID NO: 4325716 - DNA, 14 bp, Homo sapiens
ataaacaatgatgc

SEQ ID NO: 4325717 - DNA, 14 bp, Homo sapiens
ataaactgttttca

SEQ ID NO: 4325718 - DNA, 17 bp, Homo sapiens
ataaactttgaataaaa

SEQ ID NO: 4325719 - DNA, 10 bp, Homo sapiens
ataaagaaaa

SEQ ID NO: 4325720 - DNA, 15 bp, Homo sapiens
ataaagaaaattctc

SEQ ID NO: 4325721 - DNA, 19 bp, Homo sapiens
ataaagaaacttttgaaaa

SEQ ID NO: 4325722 - DNA, 11 bp, Homo sapiens
ataaagcattc

SEQ ID NO: 4325723 - DNA, 13 bp, Homo sapiens
ataaagcattctt

SEQ ID NO: 4325724 - DNA, 16 bp, Homo sapiens
ataaagcattctttaa

SEQ ID NO: 4325725 - DNA, 15 bp, Homo sapiens
ataaagccttttaaa

SEQ ID NO: 4325726 - DNA, 20 bp, Homo sapiens
ataaagccttttaaatcatc

SEQ ID NO: 4325727 - DNA, 16 bp, Homo sapiens
ataaaggcaaggaaat

SEQ ID NO: 4325728 - DNA, 20 bp, Homo sapiens
ataaagtatagagagaagtt

SEQ ID NO: 4325729 - DNA, 19 bp, Homo sapiens
ataaatatatataaagaat

SEQ ID NO: 4325730 - DNA, 18 bp, Homo sapiens
ataaatctatgatatatt

SEQ ID NO: 4325731 - DNA, 14 bp, Homo sapiens
ataaatgaaagaaa

SEQ ID NO: 4325732 - DNA, 16 bp, Homo sapiens
ataaatgaaagaaacc

SEQ ID NO: 4325733 - DNA, 11 bp, Homo sapiens
ataaatgttca

SEQ ID NO: 4325734 - DNA, 12 bp, Homo sapiens
ataaatgttcaa

SEQ ID NO: 4325735 - DNA, 13 bp, Homo sapiens
ataaatgttcaaa

SEQ ID NO: 4325736 - DNA, 17 bp, Homo sapiens
ataaatgttcaaactgt

SEQ ID NO: 4325737 - DNA, 19 bp, Homo sapiens
ataaattaaataaactgtt

SEQ ID NO: 4325738 - DNA, 23 bp, Homo sapiens
ataaattaaataaactgttttca

SEQ ID NO: 4325739 - DNA, 22 bp, Homo sapiens
ataaccatttaaagaaagaatg

SEQ ID NO: 4325740 - DNA, 17 bp, Homo sapiens
ataacctttacactcct

SEQ ID NO: 4325741 - DNA, 21 bp, Homo sapiens
ataactattttgttttaatct

SEQ ID NO: 4325742 - DNA, 24 bp, Homo sapiens
ataactattttgttttaatctact

SEQ ID NO: 4325743 - DNA, 15 bp, Homo sapiens
ataagaaagtttcac

SEQ ID NO: 4325744 - DNA, 16 bp, Homo sapiens
ataagaatgagcctgt

SEQ ID NO: 4325745 - DNA, 18 bp, Homo sapiens
ataagacttgtttctttc

SEQ ID NO: 4325746 - DNA, 23 bp, Homo sapiens
ataaggtttgttcctttgaagaa

SEQ ID NO: 4325747 - DNA, 22 bp, Homo sapiens
ataagtatccagtactttataa

SEQ ID NO: 4325748 - DNA, 14 bp, Homo sapiens
ataagtgttcagtg

SEQ ID NO: 4325749 - DNA, 15 bp, Homo sapiens
ataagtgttcagtgt

SEQ ID NO: 4325750 - DNA, 19 bp, Homo sapiens
ataagtgttcagtgttgac

SEQ ID NO: 4325751 - DNA, 21 bp, Homo sapiens
ataagtgttcagtgttgacat

SEQ ID NO: 4325752 - DNA, 19 bp, Homo sapiens
ataatacagtatctcaggg

SEQ ID NO: 4325753 - DNA, 16 bp, Homo sapiens
ataatactaatttatt

SEQ ID NO: 4325754 - DNA, 20 bp, Homo sapiens
ataatactaatttattgccg

SEQ ID NO: 4325755 - DNA, 12 bp, Homo sapiens
ataataggaatt

SEQ ID NO: 4325756 - DNA, 13 bp, Homo sapiens
ataataggaattc

SEQ ID NO: 4325757 - DNA, 20 bp, Homo sapiens
ataatctatattaaatgagg

SEQ ID NO: 4325758 - DNA, 18 bp, Homo sapiens
ataatctcctctgctcat

SEQ ID NO: 4325759 - DNA, 23 bp, Homo sapiens
ataatgctattttaaaaaatata

SEQ ID NO: 4325760 - DNA, 16 bp, Homo sapiens
ataattcctacagcac

SEQ ID NO: 4325761 - DNA, 18 bp, Homo sapiens
ataattcctacagcacta

SEQ ID NO: 4325762 - DNA, 19 bp, Homo sapiens
ataattctgatcaatcatt

SEQ ID NO: 4325763 - DNA, 13 bp, Homo sapiens
atacaaatatatg

SEQ ID NO: 4325764 - DNA, 20 bp, Homo sapiens
atacaacatgtagctgagtt

SEQ ID NO: 4325765 - DNA, 22 bp, Homo sapiens
atacacaagagggactgtattt

SEQ ID NO: 4325766 - DNA, 20 bp, Homo sapiens
atacacaaggccagaaaaag

SEQ ID NO: 4325767 - DNA, 22 bp, Homo sapiens
atacacacatagtttctttttt

SEQ ID NO: 4325768 - DNA, 17 bp, Homo sapiens
atacacagttaaataaa

SEQ ID NO: 4325769 - DNA, 18 bp, Homo sapiens
atacacatataaaaacaa

SEQ ID NO: 4325770 - DNA, 20 bp, Homo sapiens
atcctagccccacccagagg

SEQ ID NO: 4325771 - DNA, 20 bp, Homo sapiens
atcctagttccattcttggt

SEQ ID NO: 4325772 - DNA, 21 bp, Homo sapiens
atcgacatcctagccccaccc

SEQ ID NO: 4325773 - DNA, 20 bp, Homo sapiens
atcgcagcttcctgtctgtt

SEQ ID NO: 4325774 - DNA, 14 bp, Homo sapiens
atctaaagctttat

SEQ ID NO: 4325775 - DNA, 21 bp, Homo sapiens
atctaaagctttatctttgtg

SEQ ID NO: 4325776 - DNA, 22 bp, Homo sapiens
atctaaagctttatctttgtgt

SEQ ID NO: 4325777 - DNA, 15 bp, Homo sapiens
atctaagtatatgtg

SEQ ID NO: 4325778 - DNA, 17 bp, Homo sapiens
atctactttttgtattt

SEQ ID NO: 4325779 - DNA, 19 bp, Homo sapiens
atctactttttgtatttag

SEQ ID NO: 4325780 - DNA, 20 bp, Homo sapiens
atctagtttccctggtgccc

SEQ ID NO: 4325781 - DNA, 18 bp, Homo sapiens
atctatgatatatttata

SEQ ID NO: 4325782 - DNA, 14 bp, Homo sapiens
atctcctctgctca

SEQ ID NO: 4325783 - DNA, 15 bp, Homo sapiens
atctcctctgctcat

SEQ ID NO: 4325784 - DNA, 14 bp, Homo sapiens
agggcgggcaagga

SEQ ID NO: 4325785 - DNA, 18 bp, Homo sapiens
aggggaaaatcagcctgc

SEQ ID NO: 4325786 - DNA, 16 bp, Homo sapiens
aggggaggggggcaca

SEQ ID NO: 4325787 - DNA, 14 bp, Homo sapiens
aggggatgggaaat

SEQ ID NO: 4325788 - DNA, 16 bp, Homo sapiens
aggggatgggaaataa

SEQ ID NO: 4325789 - DNA, 15 bp, Homo sapiens
aggggcacagggtct

SEQ ID NO: 4325790 - DNA, 20 bp, Homo sapiens
aggggcccctgcttctccag

SEQ ID NO: 4325791 - DNA, 21 bp, Homo sapiens
aggggcccctgcttctccagc

SEQ ID NO: 4325792 - DNA, 23 bp, Homo sapiens
aggggggcacatgctgagtctcc

SEQ ID NO: 4325793 - DNA, 19 bp, Homo sapiens
aggggtgattgaaagaaaa

SEQ ID NO: 4325794 - DNA, 22 bp, Homo sapiens
aggggttgccacaggcctccct

SEQ ID NO: 4325795 - DNA, 18 bp, Homo sapiens
aggggtttcttttggaaa

SEQ ID NO: 4325796 - DNA, 11 bp, Homo sapiens
agggtctccag

SEQ ID NO: 4325797 - DNA, 22 bp, Homo sapiens
agggtgtccggtccctgtccca

SEQ ID NO: 4325798 - DNA, 15 bp, Homo sapiens
aggtaaaatgtattt

SEQ ID NO: 4325799 - DNA, 19 bp, Homo sapiens
aggtaaaatgtatttttct

SEQ ID NO: 4325800 - DNA, 18 bp, Homo sapiens
aggtagaggaaaatcaat

SEQ ID NO: 4325801 - DNA, 15 bp, Homo sapiens
aggtatacctcagtt

SEQ ID NO: 4325802 - DNA, 12 bp, Homo sapiens
aggtcatgaagg

SEQ ID NO: 4325803 - DNA, 21 bp, Homo sapiens
aggtcatgaaggacactctgc

SEQ ID NO: 4325804 - DNA, 21 bp, Homo sapiens
aggtccctgtatgtctacctc

SEQ ID NO: 4325805 - DNA, 14 bp, Homo sapiens
aggtcgaggcagga

SEQ ID NO: 4325806 - DNA, 16 bp, Homo sapiens
aggtcgtttatgtgtg

SEQ ID NO: 4325807 - DNA, 23 bp, Homo sapiens
aggtgagaagcagaggaaggaga

SEQ ID NO: 4325808 - DNA, 21 bp, Homo sapiens
aggtgagctatagtgaagaat

SEQ ID NO: 4325809 - DNA, 15 bp, Homo sapiens
aggtggccctcccag

SEQ ID NO: 4325810 - DNA, 16 bp, Homo sapiens
aggtgggtgaggctgg

SEQ ID NO: 4325811 - DNA, 19 bp, Homo sapiens
aggtgggtgaggctgggca

SEQ ID NO: 4325812 - DNA, 15 bp, Homo sapiens
aggtgttgccagtgc

SEQ ID NO: 4325813 - DNA, 13 bp, Homo sapiens
aggttagaatgat

SEQ ID NO: 4325814 - DNA, 23 bp, Homo sapiens
aggttagcccaatggagaaatga

SEQ ID NO: 4325815 - DNA, 17 bp, Homo sapiens
aggttcgggattccctg

SEQ ID NO: 4325816 - DNA, 19 bp, Homo sapiens
aggttcgggattccctggt

SEQ ID NO: 4325817 - DNA, 14 bp, Homo sapiens
aggttctgggcctc

SEQ ID NO: 4325818 - DNA, 18 bp, Homo sapiens
aggttctgggcctctgaa

SEQ ID NO: 4325819 - DNA, 14 bp, Homo sapiens
aggtttaagctgtt

SEQ ID NO: 4325820 - DNA, 21 bp, Homo sapiens
aggtttgttcctttgaagaat

SEQ ID NO: 4325821 - DNA, 15 bp, Homo sapiens
aggtttttctccccg

SEQ ID NO: 4325822 - DNA, 13 bp, Homo sapiens
agtaaaatttatt

SEQ ID NO: 4325823 - DNA, 15 bp, Homo sapiens
agtaaaatttatttc

SEQ ID NO: 4325824 - DNA, 21 bp, Homo sapiens
agtaaagccattaaatgaata

SEQ ID NO: 4325825 - DNA, 23 bp, Homo sapiens
agtaacactttaaaaccagttac

SEQ ID NO: 4325826 - DNA, 20 bp, Homo sapiens
agtaagccgtgattttcatt

SEQ ID NO: 4325827 - DNA, 17 bp, Homo sapiens
agtaatatttaaagatt

SEQ ID NO: 4325828 - DNA, 23 bp, Homo sapiens
agtaatcgggcgcccgaagaggg

SEQ ID NO: 4325829 - DNA, 22 bp, Homo sapiens
agtaatgatgtaacagtgcaag

SEQ ID NO: 4325830 - DNA, 13 bp, Homo sapiens
agtaatgtagaaa

SEQ ID NO: 4325831 - DNA, 16 bp, Homo sapiens
agtaatgtagaaatgt

SEQ ID NO: 4325832 - DNA, 13 bp, Homo sapiens
agtacaatgtgtt

SEQ ID NO: 4325833 - DNA, 17 bp, Homo sapiens
agtacaatgtgtttttc

SEQ ID NO: 4325834 - DNA, 20 bp, Homo sapiens
agtagaaagacatctgcctg

SEQ ID NO: 4325835 - DNA, 14 bp, Homo sapiens
agtagatgcctgtt

SEQ ID NO: 4325836 - DNA, 13 bp, Homo sapiens
agtagcctctggg

SEQ ID NO: 4325837 - DNA, 20 bp, Homo sapiens
agtaggatgtctcttggaaa

SEQ ID NO: 4325838 - DNA, 16 bp, Homo sapiens
agtagtccttggcata

SEQ ID NO: 4325839 - DNA, 19 bp, Homo sapiens
agtatccagtactttataa

SEQ ID NO: 4325840 - DNA, 15 bp, Homo sapiens
agtatctcagggcct

SEQ ID NO: 4325841 - DNA, 14 bp, Homo sapiens
agtatgtccttcag

SEQ ID NO: 4325842 - DNA, 17 bp, Homo sapiens
agtattttccagcctta

SEQ ID NO: 4325843 - DNA, 22 bp, Homo sapiens
agtcaaatttgaaaataattgt

SEQ ID NO: 4325844 - DNA, 18 bp, Homo sapiens
agtcaactggggaaaagg

SEQ ID NO: 4325845 - DNA, 18 bp, Homo sapiens
agtcagtggctttgcata

SEQ ID NO: 4325846 - DNA, 13 bp, Homo sapiens
agtcatttctgat

SEQ ID NO: 4325847 - DNA, 15 bp, Homo sapiens
agtcccccaacccca

SEQ ID NO: 4325848 - DNA, 22 bp, Homo sapiens
agtcccgcgaaacccggtgcat

SEQ ID NO: 4325849 - DNA, 15 bp, Homo sapiens
agtccctatagtata

SEQ ID NO: 4325850 - DNA, 13 bp, Homo sapiens
agtcctgctttcc

SEQ ID NO: 4325851 - DNA, 19 bp, Homo sapiens
agtcctgctttcctatcta

SEQ ID NO: 4325852 - DNA, 13 bp, Homo sapiens
agtcgggcatgag

SEQ ID NO: 4325853 - DNA, 20 bp, Homo sapiens
agtcgggcatgagtctgttt

SEQ ID NO: 4325854 - DNA, 13 bp, Homo sapiens
agtcgttttccaa

SEQ ID NO: 4325855 - DNA, 21 bp, Homo sapiens
agtctgaaccaatagaaagca

SEQ ID NO: 4325856 - DNA, 20 bp, Homo sapiens
agtctgagttctctttctta

SEQ ID NO: 4325857 - DNA, 20 bp, Homo sapiens
agtctggggtgggagggagg

SEQ ID NO: 4325858 - DNA, 15 bp, Homo sapiens
agtctgtttcccaag

SEQ ID NO: 4325859 - DNA, 16 bp, Homo sapiens
agtctgtttcccaagc

SEQ ID NO: 4325860 - DNA, 18 bp, Homo sapiens
agtctgtttcccaagcta

SEQ ID NO: 4325861 - DNA, 18 bp, Homo sapiens
agtcttaactgtatttca

SEQ ID NO: 4325862 - DNA, 20 bp, Homo sapiens
agtctttcttagtgcctgtg

SEQ ID NO: 4325863 - DNA, 14 bp, Homo sapiens
agtctttttttcct

SEQ ID NO: 4325864 - DNA, 23 bp, Homo sapiens
agtgaaaaaggaggaagagaaaa

SEQ ID NO: 4325865 - DNA, 13 bp, Homo sapiens
agtgaaaatacta

SEQ ID NO: 4325866 - DNA, 16 bp, Homo sapiens
agtgacataattgtcc

SEQ ID NO: 4325867 - DNA, 18 bp, Homo sapiens
agtgagtgccatgctttt

SEQ ID NO: 4325868 - DNA, 15 bp, Homo sapiens
agtgatctgttcagt

SEQ ID NO: 4325869 - DNA, 19 bp, Homo sapiens
agtgccactcattcctgta

SEQ ID NO: 4325870 - DNA, 17 bp, Homo sapiens
agtgccataccttctcc

SEQ ID NO: 4325871 - DNA, 18 bp, Homo sapiens
agtgccataccttctccc

SEQ ID NO: 4325872 - DNA, 19 bp, Homo sapiens
agtgccataccttctccca

SEQ ID NO: 4325873 - DNA, 19 bp, Homo sapiens
agtgccccaaggaggtggc

SEQ ID NO: 4325874 - DNA, 20 bp, Homo sapiens
agtgcccggtgcagggcctg

SEQ ID NO: 4325875 - DNA, 21 bp, Homo sapiens
agtgcccggtgcagggcctgg

SEQ ID NO: 4325876 - DNA, 23 bp, Homo sapiens
agtgcccggtgcagggcctggca

SEQ ID NO: 4325877 - DNA, 17 bp, Homo sapiens
agtgcctgctgggtgcc

SEQ ID NO: 4325878 - DNA, 21 bp, Homo sapiens
agtgcctgctgggtgccaggt

SEQ ID NO: 4325879 - DNA, 17 bp, Homo sapiens
agtgctaagctgccctg

SEQ ID NO: 4325880 - DNA, 15 bp, Homo sapiens
agtgctacctgcacc

SEQ ID NO: 4325881 - DNA, 19 bp, Homo sapiens
agtgctacctgcacctctg

SEQ ID NO: 4325882 - DNA, 19 bp, Homo sapiens
agtgctgtccatgcttctc

SEQ ID NO: 4325883 - DNA, 23 bp, Homo sapiens
agtgcttcagagtttgtgtgtat

SEQ ID NO: 4325884 - DNA, 18 bp, Homo sapiens
agtggaaaaatagcctgc

SEQ ID NO: 4325885 - DNA, 18 bp, Homo sapiens
agtggcatagagaataca

SEQ ID NO: 4325886 - DNA, 20 bp, Homo sapiens
agtgggatcaacaatgattt

SEQ ID NO: 4325887 - DNA, 18 bp, Homo sapiens
agtggggagggagtctgg

SEQ ID NO: 4325888 - DNA, 19 bp, Homo sapiens
agtgggtgaataatacagt

SEQ ID NO: 4325889 - DNA, 13 bp, Homo sapiens
agtggtaaaaaag

SEQ ID NO: 4325890 - DNA, 17 bp, Homo sapiens
agtggtaaaaaagaaat

SEQ ID NO: 4325891 - DNA, 16 bp, Homo sapiens
agtggtactctgtgtc

SEQ ID NO: 4325892 - DNA, 17 bp, Homo sapiens
agtgtcaagaaggaaga

SEQ ID NO: 4325893 - DNA, 16 bp, Homo sapiens
agtgtcacctccttcc

SEQ ID NO: 4325894 - DNA, 18 bp, Homo sapiens
agtgtcacctccttcccc

SEQ ID NO: 4325895 - DNA, 16 bp, Homo sapiens
agtgtcatttctttta

SEQ ID NO: 4325896 - DNA, 20 bp, Homo sapiens
agtgtgcctgaagtcccaga

SEQ ID NO: 4325897 - DNA, 17 bp, Homo sapiens
agattagggaaaatgga

SEQ ID NO: 4325898 - DNA, 16 bp, Homo sapiens
agattagtaactgttc

SEQ ID NO: 4325899 - DNA, 21 bp, Homo sapiens
agattatagctcccaaaagaa

SEQ ID NO: 4325900 - DNA, 17 bp, Homo sapiens
agattatcagtagaaag

SEQ ID NO: 4325901 - DNA, 19 bp, Homo sapiens
agattatcagtagaaagag

SEQ ID NO: 4325902 - DNA, 16 bp, Homo sapiens
agattgcaccactgca

SEQ ID NO: 4325903 - DNA, 21 bp, Homo sapiens
agatttactgctctagaaagt

SEQ ID NO: 4325904 - DNA, 22 bp, Homo sapiens
agatttactgctctagaaagta

SEQ ID NO: 4325905 - DNA, 17 bp, Homo sapiens
agatttgaaaaactttt

SEQ ID NO: 4325906 - DNA, 15 bp, Homo sapiens
agatttgaaaacaaa

SEQ ID NO: 4325907 - DNA, 16 bp, Homo sapiens
agatttggaaaattca

SEQ ID NO: 4325908 - DNA, 19 bp, Homo sapiens
agattttgaggtaaagata

SEQ ID NO: 4325909 - DNA, 22 bp, Homo sapiens
agatttttttcatagatttgaa

SEQ ID NO: 4325910 - DNA, 22 bp, Homo sapiens
agattttttttttaagtgacat

SEQ ID NO: 4325911 - DNA, 18 bp, Homo sapiens
agcaaaagatgcttctca

SEQ ID NO: 4325912 - DNA, 16 bp, Homo sapiens
agcaaagatttcagta

SEQ ID NO: 4325913 - DNA, 17 bp, Homo sapiens
agcaaagatttcagtag

SEQ ID NO: 4325914 - DNA, 19 bp, Homo sapiens
agcaaattctgtttttcta

SEQ ID NO: 4325915 - DNA, 14 bp, Homo sapiens
agcaacctttccct

SEQ ID NO: 4325916 - DNA, 14 bp, Homo sapiens
agcaagaagaattg

SEQ ID NO: 4325917 - DNA, 20 bp, Homo sapiens
agcaatgcccgtaatgctta

SEQ ID NO: 4325918 - DNA, 18 bp, Homo sapiens
agcacaagaagcgtgaga

SEQ ID NO: 4325919 - DNA, 14 bp, Homo sapiens
agcacatttcctct

SEQ ID NO: 4325920 - DNA, 16 bp, Homo sapiens
agcacatttcctctct

SEQ ID NO: 4325921 - DNA, 14 bp, Homo sapiens
agcaccagggagag

SEQ ID NO: 4325922 - DNA, 24 bp, Homo sapiens
agcaccagggagaggcctcggctg

SEQ ID NO: 4325923 - DNA, 14 bp, Homo sapiens
agcactactgggtg

SEQ ID NO: 4325924 - DNA, 19 bp, Homo sapiens
agcactactgggtgtcatt

SEQ ID NO: 4325925 - DNA, 15 bp, Homo sapiens
agcactagagaatgc

SEQ ID NO: 4325926 - DNA, 17 bp, Homo sapiens
agcactagagaatgcac

SEQ ID NO: 4325927 - DNA, 22 bp, Homo sapiens
agcactttgggaggccaaggtg

SEQ ID NO: 4325928 - DNA, 23 bp, Homo sapiens
agcactttgggaggccaaggtgg

SEQ ID NO: 4325929 - DNA, 20 bp, Homo sapiens
agcagatcagtctttgtcaa

SEQ ID NO: 4325930 - DNA, 16 bp, Homo sapiens
agcagcagggagggct

SEQ ID NO: 4325931 - DNA, 16 bp, Homo sapiens
agcagcctggaccctg

SEQ ID NO: 4325932 - DNA, 22 bp, Homo sapiens
agcaggaggttctgggcctctg

SEQ ID NO: 4325933 - DNA, 17 bp, Homo sapiens
agcagtaaaataaaaaa

SEQ ID NO: 4325934 - DNA, 19 bp, Homo sapiens
agcagtaaaataaaaaacc

SEQ ID NO: 4325935 - DNA, 23 bp, Homo sapiens
agcagtgttctctctgaatgctg

SEQ ID NO: 4325936 - DNA, 23 bp, Homo sapiens
agcatcagcacagctctcctcct

SEQ ID NO: 4325937 - DNA, 14 bp, Homo sapiens
agcatctctgcctc

SEQ ID NO: 4325938 - DNA, 15 bp, Homo sapiens
agcattaactaaatg

SEQ ID NO: 4325939 - DNA, 17 bp, Homo sapiens
agcattaactaaatgct

SEQ ID NO: 4325940 - DNA, 17 bp, Homo sapiens
agcattactttaacctc

SEQ ID NO: 4325941 - DNA, 17 bp, Homo sapiens
agcattggcccctgagc

SEQ ID NO: 4325942 - DNA, 23 bp, Homo sapiens
agcatttagcttgttccactgca

SEQ ID NO: 4325943 - DNA, 15 bp, Homo sapiens
agcatttatttctct

SEQ ID NO: 4325944 - DNA, 16 bp, Homo sapiens
agcatttatttctctg

SEQ ID NO: 4325945 - DNA, 13 bp, Homo sapiens
agcatttttccat

SEQ ID NO: 4325946 - DNA, 16 bp, Homo sapiens
agccaacaggtaaaca

SEQ ID NO: 4325947 - DNA, 23 bp, Homo sapiens
agccaagtgtggtagagtgtgcc

SEQ ID NO: 4325948 - DNA, 17 bp, Homo sapiens
agccacggaaacataga

SEQ ID NO: 4325949 - DNA, 18 bp, Homo sapiens
agccatgggaaatgagcc

SEQ ID NO: 4325950 - DNA, 18 bp, Homo sapiens
agccattaaatgaatatt

SEQ ID NO: 4325951 - DNA, 14 bp, Homo sapiens
agccattcctgttc

SEQ ID NO: 4325952 - DNA, 23 bp, Homo sapiens
agcccaacagacaccatcttttg

SEQ ID NO: 4325953 - DNA, 10 bp, Homo sapiens
agcccaagtc

SEQ ID NO: 4325954 - DNA, 13 bp, Homo sapiens
agcccatttcaat

SEQ ID NO: 4325955 - DNA, 15 bp, Homo sapiens
agccccaatccagag

SEQ ID NO: 4325956 - DNA, 19 bp, Homo sapiens
agccccaatccagagaagc

SEQ ID NO: 4325957 - DNA, 19 bp, Homo sapiens
agccccacccagaggtggc

SEQ ID NO: 4325958 - DNA, 13 bp, Homo sapiens
agccccagcccca

SEQ ID NO: 4325959 - DNA, 15 bp, Homo sapiens
agccccagccccgtc

SEQ ID NO: 4325960 - DNA, 16 bp, Homo sapiens
agccccgtcccagagg

SEQ ID NO: 4325961 - DNA, 17 bp, Homo sapiens
agccccgtcccagaggc

SEQ ID NO: 4325962 - DNA, 20 bp, Homo sapiens
agcccctctcacaggcagct

SEQ ID NO: 4325963 - DNA, 17 bp, Homo sapiens
agcccctgccccagccc

SEQ ID NO: 4325964 - DNA, 23 bp, Homo sapiens
agcccctgccccagcccaagtcc

SEQ ID NO: 4325965 - DNA, 19 bp, Homo sapiens
agccctctccaaatcaagg

SEQ ID NO: 4325966 - DNA, 17 bp, Homo sapiens
agccctctgtggccagg

SEQ ID NO: 4325967 - DNA, 21 bp, Homo sapiens
agccctctgtggccaggagcc

SEQ ID NO: 4325968 - DNA, 23 bp, Homo sapiens
agccctgaaacgagaagtgccct

SEQ ID NO: 4325969 - DNA, 20 bp, Homo sapiens
agcccttctaccccacctga

SEQ ID NO: 4325970 - DNA, 21 bp, Homo sapiens
agccgccatgctcctggccca

SEQ ID NO: 4325971 - DNA, 20 bp, Homo sapiens
agccgcgctttcccctcctc

SEQ ID NO: 4325972 - DNA, 12 bp, Homo sapiens
agccgctcggag

SEQ ID NO: 4325973 - DNA, 12 bp, Homo sapiens
agcctattgtct

SEQ ID NO: 4325974 - DNA, 14 bp, Homo sapiens
agcctattgtcttt

SEQ ID NO: 4325975 - DNA, 13 bp, Homo sapiens
agcctcctgccca

SEQ ID NO: 4325976 - DNA, 15 bp, Homo sapiens
agcctcctgcccagt

SEQ ID NO: 4325977 - DNA, 23 bp, Homo sapiens
agcctctgaaaaccaatgttctc

SEQ ID NO: 4325978 - DNA, 17 bp, Homo sapiens
agcctctgggatctgcc

SEQ ID NO: 4325979 - DNA, 19 bp, Homo sapiens
agcctctgggatctgccaa

SEQ ID NO: 4325980 - DNA, 21 bp, Homo sapiens
agcctgcaggtccggggagga

SEQ ID NO: 4325981 - DNA, 23 bp, Homo sapiens
agcctgcaggtccggggaggagg

SEQ ID NO: 4325982 - DNA, 20 bp, Homo sapiens
agcctgcccagttggaggag

SEQ ID NO: 4325983 - DNA, 14 bp, Homo sapiens
agcctgcccttgtc

SEQ ID NO: 4325984 - DNA, 14 bp, Homo sapiens
agcctgctccagct

SEQ ID NO: 4325985 - DNA, 12 bp, Homo sapiens
agcctgggaggt

SEQ ID NO: 4325986 - DNA, 14 bp, Homo sapiens
agccttactcacct

SEQ ID NO: 4325987 - DNA, 20 bp, Homo sapiens
agccttagagcatctctgcc

SEQ ID NO: 4325988 - DNA, 21 bp, Homo sapiens
agccttatgtgttacattatt

SEQ ID NO: 4325989 - DNA, 20 bp, Homo sapiens
agcgccaagtggccactggc

SEQ ID NO: 4325990 - DNA, 19 bp, Homo sapiens
agcgctgttgatcccctct

SEQ ID NO: 4325991 - DNA, 23 bp, Homo sapiens
agcggctggcagcccacccctca

SEQ ID NO: 4325992 - DNA, 20 bp, Homo sapiens
agcgtggtttttatgtgtat

SEQ ID NO: 4325993 - DNA, 13 bp, Homo sapiens
agctaaagaaact

SEQ ID NO: 4325994 - DNA, 23 bp, Homo sapiens
agctaagtgacagtcacttaact

SEQ ID NO: 4325995 - DNA, 22 bp, Homo sapiens
agctaatctgcctggttttatt

SEQ ID NO: 4325996 - DNA, 15 bp, Homo sapiens
agctaccctgtgtat

SEQ ID NO: 4325997 - DNA, 22 bp, Homo sapiens
agctacccttttcctttgtggt

SEQ ID NO: 4325998 - DNA, 14 bp, Homo sapiens
agctagaatttctg

SEQ ID NO: 4325999 - DNA, 15 bp, Homo sapiens
agctagactgtgtct

SEQ ID NO: 4326000 - DNA, 14 bp, Homo sapiens
agctaggaaagagg

SEQ ID NO: 4326001 - DNA, 14 bp, Homo sapiens
agctagtgccaaat

SEQ ID NO: 4326002 - DNA, 19 bp, Homo sapiens
agctagtgccaaataattg

SEQ ID NO: 4326003 - DNA, 20 bp, Homo sapiens
agctagtgccaaataattga

SEQ ID NO: 4326004 - DNA, 21 bp, Homo sapiens
agctagtgccaaataattgat

SEQ ID NO: 4326005 - DNA, 17 bp, Homo sapiens
agctatagtgaagaata

SEQ ID NO: 4326006 - DNA, 13 bp, Homo sapiens
agctattaaaatg

SEQ ID NO: 4326007 - DNA, 12 bp, Homo sapiens
agctcaactaaa

SEQ ID NO: 4326008 - DNA, 13 bp, Homo sapiens
agctcaggaggcg

SEQ ID NO: 4326009 - DNA, 20 bp, Homo sapiens
agctcaggaggcgaataaat

SEQ ID NO: 4326010 - DNA, 14 bp, Homo sapiens
agctccatacttct

SEQ ID NO: 4326011 - DNA, 23 bp, Homo sapiens
agctcccacacccacctctgcca

SEQ ID NO: 4326012 - DNA, 10 bp, Homo sapiens
agctccccca

SEQ ID NO: 4326013 - DNA, 13 bp, Homo sapiens
agctcccccaggc

SEQ ID NO: 4326014 - DNA, 14 bp, Homo sapiens
agctcccccaggca

SEQ ID NO: 4326015 - DNA, 18 bp, Homo sapiens
agctcccccaggcagaaa

SEQ ID NO: 4326016 - DNA, 15 bp, Homo sapiens
agctccccctgtccc

SEQ ID NO: 4326017 - DNA, 17 bp, Homo sapiens
agctccctgaccccctg

SEQ ID NO: 4326018 - DNA, 13 bp, Homo sapiens
agctcgatccaaa

SEQ ID NO: 4326019 - DNA, 16 bp, Homo sapiens
agctctctctcctgga

SEQ ID NO: 4326020 - DNA, 23 bp, Homo sapiens
agctcttttttgtttgtttcttt

SEQ ID NO: 4326021 - DNA, 13 bp, Homo sapiens
agctgaagaaatt

SEQ ID NO: 4326022 - DNA, 17 bp, Homo sapiens
agctgacggtttctccc

SEQ ID NO: 4326023 - DNA, 21 bp, Homo sapiens
agctgacggtttctccccgga

SEQ ID NO: 4326024 - DNA, 20 bp, Homo sapiens
agctgaggtttagtaatcta

SEQ ID NO: 4326025 - DNA, 23 bp, Homo sapiens
agctgatttcccttttttcttcc

SEQ ID NO: 4326026 - DNA, 13 bp, Homo sapiens
agctgcaccctca

SEQ ID NO: 4326027 - DNA, 19 bp, Homo sapiens
agctgcaccctcaggcagg

SEQ ID NO: 4326028 - DNA, 22 bp, Homo sapiens
agctgccgtgcctgtgtcctga

SEQ ID NO: 4326029 - DNA, 13 bp, Homo sapiens
agctggaagcctg

SEQ ID NO: 4326030 - DNA, 14 bp, Homo sapiens
agctggccctcagc

SEQ ID NO: 4326031 - DNA, 15 bp, Homo sapiens
agctggccctcagct

SEQ ID NO: 4326032 - DNA, 19 bp, Homo sapiens
agctggccctcagctccct

SEQ ID NO: 4326033 - DNA, 21 bp, Homo sapiens
agctggccctcagctccctga

SEQ ID NO: 4326034 - DNA, 18 bp, Homo sapiens
agctgggacctaatgctg

SEQ ID NO: 4326035 - DNA, 18 bp, Homo sapiens
agctgttactgtcttcag

SEQ ID NO: 4326036 - DNA, 19 bp, Homo sapiens
agctgttactgtcttcagt

SEQ ID NO: 4326037 - DNA, 13 bp, Homo sapiens
agctgttcagctg

SEQ ID NO: 4326038 - DNA, 14 bp, Homo sapiens
agctgttcagctgg

SEQ ID NO: 4326039 - DNA, 13 bp, Homo sapiens
agctgtttatgtt

SEQ ID NO: 4326040 - DNA, 18 bp, Homo sapiens
agctgtttatgtttttat

SEQ ID NO: 4326041 - DNA, 15 bp, Homo sapiens
agcttaaagcttgat

SEQ ID NO: 4326042 - DNA, 14 bp, Homo sapiens
agcttatctcaggg

SEQ ID NO: 4326043 - DNA, 15 bp, Homo sapiens
agcttatctcagggg

SEQ ID NO: 4326044 - DNA, 17 bp, Homo sapiens
agcttattcaatattta

SEQ ID NO: 4326045 - DNA, 14 bp, Homo sapiens
agcttcctgtctgt

SEQ ID NO: 4326046 - DNA, 17 bp, Homo sapiens
agcttcctgtctgttta

SEQ ID NO: 4326047 - DNA, 20 bp, Homo sapiens
agcttctagacactccttga

SEQ ID NO: 4326048 - DNA, 15 bp, Homo sapiens
agcttgatttgatct

SEQ ID NO: 4326049 - DNA, 15 bp, Homo sapiens
agctttatctttgtg

SEQ ID NO: 4326050 - DNA, 19 bp, Homo sapiens
agctttatctttgtgtaat

SEQ ID NO: 4326051 - DNA, 13 bp, Homo sapiens
agctttctgtgca

SEQ ID NO: 4326052 - DNA, 12 bp, Homo sapiens
agctttgaaaat

SEQ ID NO: 4326053 - DNA, 19 bp, Homo sapiens
agctttgaaaattcagtgg

SEQ ID NO: 4326054 - DNA, 15 bp, Homo sapiens
agctttgcccaacac

SEQ ID NO: 4326055 - DNA, 21 bp, Homo sapiens
agctttgtttgttgtcagctg

SEQ ID NO: 4326056 - DNA, 15 bp, Homo sapiens
aggaaaaagcacaag

SEQ ID NO: 4326057 - DNA, 12 bp, Homo sapiens
aggaaaaatgta

SEQ ID NO: 4326058 - DNA, 13 bp, Homo sapiens
aggaaacatagaa

SEQ ID NO: 4326059 - DNA, 22 bp, Homo sapiens
aggaaacatagaaagacatggg

SEQ ID NO: 4326060 - DNA, 13 bp, Homo sapiens
aggaaagaggagg

SEQ ID NO: 4326061 - DNA, 13 bp, Homo sapiens
aggaaattaagaa

SEQ ID NO: 4326062 - DNA, 18 bp, Homo sapiens
aggaaattaagaactgaa

SEQ ID NO: 4326063 - DNA, 20 bp, Homo sapiens
aggaagatgggggcaagaag

SEQ ID NO: 4326064 - DNA, 18 bp, Homo sapiens
aggaattctttgcattcc

SEQ ID NO: 4326065 - DNA, 23 bp, Homo sapiens
aggacaaaaagaccttctcccta

SEQ ID NO: 4326066 - DNA, 21 bp, Homo sapiens
aggacacatcgttcgatttaa

SEQ ID NO: 4326067 - DNA, 21 bp, Homo sapiens
aggacatagaggtatattgga

SEQ ID NO: 4326068 - DNA, 13 bp, Homo sapiens
aggactgaagctg

SEQ ID NO: 4326069 - DNA, 15 bp, Homo sapiens
aggactgaagctggg

SEQ ID NO: 4326070 - DNA, 17 bp, Homo sapiens
aggactgaagctggggc

SEQ ID NO: 4326071 - DNA, 23 bp, Homo sapiens
aggagaaaggggtgattgaaaga

SEQ ID NO: 4326072 - DNA, 20 bp, Homo sapiens
aggagactgggcacccctgc

SEQ ID NO: 4326073 - DNA, 18 bp, Homo sapiens
aggagagagggtctccag

SEQ ID NO: 4326074 - DNA, 15 bp, Homo sapiens
aggagaggagagggg

SEQ ID NO: 4326075 - DNA, 11 bp, Homo sapiens
aggagccccag

SEQ ID NO: 4326076 - DNA, 14 bp, Homo sapiens
aggagccccagccc

SEQ ID NO: 4326077 - DNA, 18 bp, Homo sapiens
aggagccctactgaaggg

SEQ ID NO: 4326078 - DNA, 22 bp, Homo sapiens
aggagctacccttttcctttgt

SEQ ID NO: 4326079 - DNA, 15 bp, Homo sapiens
aggagctcaactaaa

SEQ ID NO: 4326080 - DNA, 17 bp, Homo sapiens
aggagctcaactaaaag

SEQ ID NO: 4326081 - DNA, 15 bp, Homo sapiens
aggaggcagaaagat

SEQ ID NO: 4326082 - DNA, 17 bp, Homo sapiens
aggaggcgaataaatgt

SEQ ID NO: 4326083 - DNA, 18 bp, Homo sapiens
aggaggcgaataaatgtt

SEQ ID NO: 4326084 - DNA, 14 bp, Homo sapiens
aggagggagagccc

SEQ ID NO: 4326085 - DNA, 21 bp, Homo sapiens
aggaggttcgggattccctgg

SEQ ID NO: 4326086 - DNA, 20 bp, Homo sapiens
aggagtgccataccttctcc

SEQ ID NO: 4326087 - DNA, 23 bp, Homo sapiens
aggagtgccataccttctcccag

SEQ ID NO: 4326088 - DNA, 22 bp, Homo sapiens
aggagtttatctatcggaagaa

SEQ ID NO: 4326089 - DNA, 21 bp, Homo sapiens
aggagtttgagaccaacctgg

SEQ ID NO: 4326090 - DNA, 16 bp, Homo sapiens
aggatcaccccagccc

SEQ ID NO: 4326091 - DNA, 15 bp, Homo sapiens
aggatctaggatggg

SEQ ID NO: 4326092 - DNA, 21 bp, Homo sapiens
aggatctcttgagcctgggag

SEQ ID NO: 4326093 - DNA, 19 bp, Homo sapiens
aggatcttttggacctggc

SEQ ID NO: 4326094 - DNA, 16 bp, Homo sapiens
aggatgagcaaaacat

SEQ ID NO: 4326095 - DNA, 15 bp, Homo sapiens
aggatgctaatggaa

SEQ ID NO: 4326096 - DNA, 12 bp, Homo sapiens
aggatgctgaag

SEQ ID NO: 4326097 - DNA, 23 bp, Homo sapiens
aggattgggggatgtgaagaaat

SEQ ID NO: 4326098 - DNA, 21 bp, Homo sapiens
aggcacttattgtaaatttta

SEQ ID NO: 4326099 - DNA, 18 bp, Homo sapiens
aggcagaaatagttgtct

SEQ ID NO: 4326100 - DNA, 17 bp, Homo sapiens
aggcagcaacagcagag

SEQ ID NO: 4326101 - DNA, 21 bp, Homo sapiens
aggccccaaaggaaaaagcac

SEQ ID NO: 4326102 - DNA, 22 bp, Homo sapiens
aggccccaaaggaaaaagcaca

SEQ ID NO: 4326103 - DNA, 21 bp, Homo sapiens
aggccccaactcaagtgtcac

SEQ ID NO: 4326104 - DNA, 15 bp, Homo sapiens
aggccgctgcccctg

SEQ ID NO: 4326105 - DNA, 23 bp, Homo sapiens
aggccggagacccacagccctga

SEQ ID NO: 4326106 - DNA, 23 bp, Homo sapiens
aggcctacctctcgtttctgccc

SEQ ID NO: 4326107 - DNA, 13 bp, Homo sapiens
aggcctccctgtt

SEQ ID NO: 4326108 - DNA, 14 bp, Homo sapiens
aggcctccctgttt

SEQ ID NO: 4326109 - DNA, 16 bp, Homo sapiens
aggcctcggctgtctc

SEQ ID NO: 4326110 - DNA, 19 bp, Homo sapiens
aggcctcggctgtctcctg

SEQ ID NO: 4326111 - DNA, 22 bp, Homo sapiens
aggcctctgccccaagagcagg

SEQ ID NO: 4326112 - DNA, 16 bp, Homo sapiens
aggcgaataaatgttc

SEQ ID NO: 4326113 - DNA, 19 bp, Homo sapiens
aggctatcctgctgaaagt

SEQ ID NO: 4326114 - DNA, 15 bp, Homo sapiens
aggctcaaggctgtg

SEQ ID NO: 4326115 - DNA, 16 bp, Homo sapiens
aggctctctaagaaaa

SEQ ID NO: 4326116 - DNA, 16 bp, Homo sapiens
aggctgggcagggcct

SEQ ID NO: 4326117 - DNA, 21 bp, Homo sapiens
aggctgggcagggcctggcgg

SEQ ID NO: 4326118 - DNA, 15 bp, Homo sapiens
aggcttccaagcatt

SEQ ID NO: 4326119 - DNA, 13 bp, Homo sapiens
aggctttaaaagt

SEQ ID NO: 4326120 - DNA, 16 bp, Homo sapiens
aggcttttgggccaaa

SEQ ID NO: 4326121 - DNA, 13 bp, Homo sapiens
agggacagagccc

SEQ ID NO: 4326122 - DNA, 23 bp, Homo sapiens
agggacagagcccgggagagact

SEQ ID NO: 4326123 - DNA, 16 bp, Homo sapiens
agggactgtatttctg

SEQ ID NO: 4326124 - DNA, 18 bp, Homo sapiens
agggagaagttgagcagg

SEQ ID NO: 4326125 - DNA, 19 bp, Homo sapiens
agggagacagagatgtgca

SEQ ID NO: 4326126 - DNA, 23 bp, Homo sapiens
agggagagccctgtccctgccct

SEQ ID NO: 4326127 - DNA, 12 bp, Homo sapiens
agggagaggcct

SEQ ID NO: 4326128 - DNA, 14 bp, Homo sapiens
agggagcctcctgc

SEQ ID NO: 4326129 - DNA, 24 bp, Homo sapiens
agggagcttattcaatatttactg

SEQ ID NO: 4326130 - DNA, 14 bp, Homo sapiens
agggaggcatctgc

SEQ ID NO: 4326131 - DNA, 19 bp, Homo sapiens
agaagcaaagatttcagta

SEQ ID NO: 4326132 - DNA, 18 bp, Homo sapiens
agaagcgctcatctggct

SEQ ID NO: 4326133 - DNA, 15 bp, Homo sapiens
agaagcggctggcag

SEQ ID NO: 4326134 - DNA, 16 bp, Homo sapiens
agaagcggctggcagc

SEQ ID NO: 4326135 - DNA, 19 bp, Homo sapiens
agaaggagctcaactaaaa

SEQ ID NO: 4326136 - DNA, 20 bp, Homo sapiens
agaaggagtcagaaactgtt

SEQ ID NO: 4326137 - DNA, 16 bp, Homo sapiens
agaaggggatgggaaa

SEQ ID NO: 4326138 - DNA, 17 bp, Homo sapiens
agaaggggatgggaaat

SEQ ID NO: 4326139 - DNA, 22 bp, Homo sapiens
agaaggggatgggaaataaaga

SEQ ID NO: 4326140 - DNA, 23 bp, Homo sapiens
agaaggggatgggaaataaagaa

SEQ ID NO: 4326141 - DNA, 17 bp, Homo sapiens
agaagttttttactttg

SEQ ID NO: 4326142 - DNA, 20 bp, Homo sapiens
agaagttttttactttggtt

SEQ ID NO: 4326143 - DNA, 17 bp, Homo sapiens
agaataattatttcaga

SEQ ID NO: 4326144 - DNA, 20 bp, Homo sapiens
agaatacacatataaaaaca

SEQ ID NO: 4326145 - DNA, 21 bp, Homo sapiens
agaatatactgtcttgtctca

SEQ ID NO: 4326146 - DNA, 15 bp, Homo sapiens
agaatatatatatat

SEQ ID NO: 4326147 - DNA, 13 bp, Homo sapiens
agaatgagcctgt

SEQ ID NO: 4326148 - DNA, 15 bp, Homo sapiens
agaatgatcatctgt

SEQ ID NO: 4326149 - DNA, 23 bp, Homo sapiens
agaatgcacgcgtgcatatgcta

SEQ ID NO: 4326150 - DNA, 21 bp, Homo sapiens
agaatgcattccagaacaaat

SEQ ID NO: 4326151 - DNA, 23 bp, Homo sapiens
agaatgtagtcagactgacacta

SEQ ID NO: 4326152 - DNA, 20 bp, Homo sapiens
agaattataattagttcctc

SEQ ID NO: 4326153 - DNA, 23 bp, Homo sapiens
agaattatccattacgtgcattt

SEQ ID NO: 4326154 - DNA, 17 bp, Homo sapiens
agaatttctggaagaaa

SEQ ID NO: 4326155 - DNA, 19 bp, Homo sapiens
agaatttctggaagaaagg

SEQ ID NO: 4326156 - DNA, 22 bp, Homo sapiens
agaatttctggaagaaaggctg

SEQ ID NO: 4326157 - DNA, 13 bp, Homo sapiens
agaattttagtcc

SEQ ID NO: 4326158 - DNA, 16 bp, Homo sapiens
agacaatcattgtttt

SEQ ID NO: 4326159 - DNA, 22 bp, Homo sapiens
agacaatcattgttttgaatat

SEQ ID NO: 4326160 - DNA, 22 bp, Homo sapiens
agacacacaggagtcctttctt

SEQ ID NO: 4326161 - DNA, 18 bp, Homo sapiens
agacactaattccttaaa

SEQ ID NO: 4326162 - DNA, 20 bp, Homo sapiens
agacactaattccttaaatg

SEQ ID NO: 4326163 - DNA, 21 bp, Homo sapiens
agacactaattccttaaatga

SEQ ID NO: 4326164 - DNA, 16 bp, Homo sapiens
agacactccttgaaat

SEQ ID NO: 4326165 - DNA, 17 bp, Homo sapiens
agacatctgcctgtaat

SEQ ID NO: 4326166 - DNA, 19 bp, Homo sapiens
agacatctgcctgtaatta

SEQ ID NO: 4326167 - DNA, 22 bp, Homo sapiens
agacatgggctatcagggagga

SEQ ID NO: 4326168 - DNA, 11 bp, Homo sapiens
agaccaggagg

SEQ ID NO: 4326169 - DNA, 16 bp, Homo sapiens
agacccacagccctga

SEQ ID NO: 4326170 - DNA, 15 bp, Homo sapiens
agaccctttgttgaa

SEQ ID NO: 4326171 - DNA, 19 bp, Homo sapiens
agaccctttgttgaaaaat

SEQ ID NO: 4326172 - DNA, 22 bp, Homo sapiens
agaccgctctcttttctgtact

SEQ ID NO: 4326173 - DNA, 23 bp, Homo sapiens
agacgtcgtacccagccatgtgt

SEQ ID NO: 4326174 - DNA, 16 bp, Homo sapiens
agactattatgaaatc

SEQ ID NO: 4326175 - DNA, 19 bp, Homo sapiens
agactattatgaaatcata

SEQ ID NO: 4326176 - DNA, 20 bp, Homo sapiens
agactattttctattttccc

SEQ ID NO: 4326177 - DNA, 15 bp, Homo sapiens
agactcctcttccca

SEQ ID NO: 4326178 - DNA, 16 bp, Homo sapiens
agactctttggacact

SEQ ID NO: 4326179 - DNA, 18 bp, Homo sapiens
agactgggcacccctgcc

SEQ ID NO: 4326180 - DNA, 19 bp, Homo sapiens
agactgggcacccctgcct

SEQ ID NO: 4326181 - DNA, 14 bp, Homo sapiens
agactgtaactttt

SEQ ID NO: 4326182 - DNA, 21 bp, Homo sapiens
agactgtaactttttttcagt

SEQ ID NO: 4326183 - DNA, 23 bp, Homo sapiens
agactgtaactttttttcagttc

SEQ ID NO: 4326184 - DNA, 21 bp, Homo sapiens
agactgtgtctgaatcatgtc

SEQ ID NO: 4326185 - DNA, 14 bp, Homo sapiens
agacttactgcatt

SEQ ID NO: 4326186 - DNA, 15 bp, Homo sapiens
agacttactgcattg

SEQ ID NO: 4326187 - DNA, 16 bp, Homo sapiens
agacttactgcattgc

SEQ ID NO: 4326188 - DNA, 14 bp, Homo sapiens
agacttgtttcttt

SEQ ID NO: 4326189 - DNA, 16 bp, Homo sapiens
agacttgtttctttct

SEQ ID NO: 4326190 - DNA, 22 bp, Homo sapiens
agacttgtttctttctgtctct

SEQ ID NO: 4326191 - DNA, 18 bp, Homo sapiens
agactttgctgcatttta

SEQ ID NO: 4326192 - DNA, 13 bp, Homo sapiens
agactttgctgtt

SEQ ID NO: 4326193 - DNA, 22 bp, Homo sapiens
agactttgctgttactgcttct

SEQ ID NO: 4326194 - DNA, 22 bp, Homo sapiens
agagaatacacatataaaaaca

SEQ ID NO: 4326195 - DNA, 22 bp, Homo sapiens
agagagcttattgttttaaaaa

SEQ ID NO: 4326196 - DNA, 13 bp, Homo sapiens
agagaggagaaag

SEQ ID NO: 4326197 - DNA, 16 bp, Homo sapiens
agagagtggtaaaaaa

SEQ ID NO: 4326198 - DNA, 18 bp, Homo sapiens
agagagtggtaaaaaaga

SEQ ID NO: 4326199 - DNA, 19 bp, Homo sapiens
agagagtggtaaaaaagaa

SEQ ID NO: 4326200 - DNA, 20 bp, Homo sapiens
agagagtggtaaaaaagaaa

SEQ ID NO: 4326201 - DNA, 21 bp, Homo sapiens
agagagtggtaaaaaagaaat

SEQ ID NO: 4326202 - DNA, 15 bp, Homo sapiens
agagatgaaataatt

SEQ ID NO: 4326203 - DNA, 16 bp, Homo sapiens
agagatgaaataattt

SEQ ID NO: 4326204 - DNA, 15 bp, Homo sapiens
agagatgtgcagagt

SEQ ID NO: 4326205 - DNA, 16 bp, Homo sapiens
agagattgtggtttca

SEQ ID NO: 4326206 - DNA, 23 bp, Homo sapiens
agagccaccagggcactgtctgc

SEQ ID NO: 4326207 - DNA, 17 bp, Homo sapiens
agagcccgggagagact

SEQ ID NO: 4326208 - DNA, 18 bp, Homo sapiens
agagcccgggagagactc

SEQ ID NO: 4326209 - DNA, 14 bp, Homo sapiens
agagcttttcagaa

SEQ ID NO: 4326210 - DNA, 14 bp, Homo sapiens
agaggaaaatcaat

SEQ ID NO: 4326211 - DNA, 15 bp, Homo sapiens
agaggaaggaaacat

SEQ ID NO: 4326212 - DNA, 13 bp, Homo sapiens
agaggatgctgaa

SEQ ID NO: 4326213 - DNA, 18 bp, Homo sapiens
agaggatggatgaatctg

SEQ ID NO: 4326214 - DNA, 18 bp, Homo sapiens
agaggcaactgcattggc

SEQ ID NO: 4326215 - DNA, 18 bp, Homo sapiens
agaggcttccaagcatta

SEQ ID NO: 4326216 - DNA, 21 bp, Homo sapiens
agaggcttccaagcattactt

SEQ ID NO: 4326217 - DNA, 13 bp, Homo sapiens
agagggacagagc

SEQ ID NO: 4326218 - DNA, 21 bp, Homo sapiens
agagggactgtatttctgtgg

SEQ ID NO: 4326219 - DNA, 14 bp, Homo sapiens
agagggtctccagt

SEQ ID NO: 4326220 - DNA, 21 bp, Homo sapiens
agaggtcatcccttcctcctc

SEQ ID NO: 4326221 - DNA, 14 bp, Homo sapiens
agaggtggccctcc

SEQ ID NO: 4326222 - DNA, 15 bp, Homo sapiens
agaggttagaatgat

SEQ ID NO: 4326223 - DNA, 19 bp, Homo sapiens
agaggtttttctccccgct

SEQ ID NO: 4326224 - DNA, 17 bp, Homo sapiens
agagtacgtgaaatgct

SEQ ID NO: 4326225 - DNA, 17 bp, Homo sapiens
agagtaggtactccata

SEQ ID NO: 4326226 - DNA, 22 bp, Homo sapiens
agagtcacaagtagcctctggg

SEQ ID NO: 4326227 - DNA, 19 bp, Homo sapiens
agagtggggatatgattta

SEQ ID NO: 4326228 - DNA, 19 bp, Homo sapiens
agagtgttatcatattggt

SEQ ID NO: 4326229 - DNA, 16 bp, Homo sapiens
agagtttgtgtgtatt

SEQ ID NO: 4326230 - DNA, 13 bp, Homo sapiens
agataagacttgt

SEQ ID NO: 4326231 - DNA, 18 bp, Homo sapiens
agataatattaaggaaga

SEQ ID NO: 4326232 - DNA, 19 bp, Homo sapiens
agataatggataatcttcg

SEQ ID NO: 4326233 - DNA, 23 bp, Homo sapiens
agatacacaagagggactgtatt

SEQ ID NO: 4326234 - DNA, 17 bp, Homo sapiens
agataccgagaatgatc

SEQ ID NO: 4326235 - DNA, 22 bp, Homo sapiens
agatatccaaacaagactgctc

SEQ ID NO: 4326236 - DNA, 20 bp, Homo sapiens
agatatggagaattgctgaa

SEQ ID NO: 4326237 - DNA, 12 bp, Homo sapiens
agatctgggcat

SEQ ID NO: 4326238 - DNA, 18 bp, Homo sapiens
agatgccaaaaaagatgc

SEQ ID NO: 4326239 - DNA, 17 bp, Homo sapiens
agatgccaacagacact

SEQ ID NO: 4326240 - DNA, 18 bp, Homo sapiens
agatgcctgttttgagac

SEQ ID NO: 4326241 - DNA, 19 bp, Homo sapiens
agatgcctgttttgagacc

SEQ ID NO: 4326242 - DNA, 23 bp, Homo sapiens
acccagaggtggccctcccaggc

SEQ ID NO: 4326243 - DNA, 17 bp, Homo sapiens
acccagcagttctctgc

SEQ ID NO: 4326244 - DNA, 22 bp, Homo sapiens
acccagttgtgctatattttta

SEQ ID NO: 4326245 - DNA, 19 bp, Homo sapiens
acccataagtaatatttaa

SEQ ID NO: 4326246 - DNA, 11 bp, Homo sapiens
acccatgaagc

SEQ ID NO: 4326247 - DNA, 13 bp, Homo sapiens
acccatgaagctg

SEQ ID NO: 4326248 - DNA, 17 bp, Homo sapiens
acccatgaagctggccc

SEQ ID NO: 4326249 - DNA, 18 bp, Homo sapiens
acccatgaagctggccct

SEQ ID NO: 4326250 - DNA, 22 bp, Homo sapiens
acccatgaagctggccctcagc

SEQ ID NO: 4326251 - DNA, 23 bp, Homo sapiens
acccatgaagctggccctcagct

SEQ ID NO: 4326252 - DNA, 14 bp, Homo sapiens
accccacctgacct

SEQ ID NO: 4326253 - DNA, 19 bp, Homo sapiens
accccacctgacctctgca

SEQ ID NO: 4326254 - DNA, 10 bp, Homo sapiens
accccagagt

SEQ ID NO: 4326255 - DNA, 13 bp, Homo sapiens
accccagccccca

SEQ ID NO: 4326256 - DNA, 16 bp, Homo sapiens
accccagcccccacag

SEQ ID NO: 4326257 - DNA, 23 bp, Homo sapiens
accccagccgctcggaggcccca

SEQ ID NO: 4326258 - DNA, 17 bp, Homo sapiens
accccaggtgagacctc

SEQ ID NO: 4326259 - DNA, 22 bp, Homo sapiens
acccccagctttgcccaacacc

SEQ ID NO: 4326260 - DNA, 20 bp, Homo sapiens
accccccaacccctgaggaa

SEQ ID NO: 4326261 - DNA, 14 bp, Homo sapiens
acccccttctgggc

SEQ ID NO: 4326262 - DNA, 17 bp, Homo sapiens
acccccttctgggcatc

SEQ ID NO: 4326263 - DNA, 10 bp, Homo sapiens
acccctgcct

SEQ ID NO: 4326264 - DNA, 15 bp, Homo sapiens
acccctgcctcctgc

SEQ ID NO: 4326265 - DNA, 16 bp, Homo sapiens
acccctgcctcctgcc

SEQ ID NO: 4326266 - DNA, 18 bp, Homo sapiens
acccctgcctcctgcctc

SEQ ID NO: 4326267 - DNA, 22 bp, Homo sapiens
acccctttcccccaccccagag

SEQ ID NO: 4326268 - DNA, 13 bp, Homo sapiens
accctattgctgc

SEQ ID NO: 4326269 - DNA, 13 bp, Homo sapiens
accctctccaggc

SEQ ID NO: 4326270 - DNA, 18 bp, Homo sapiens
accctgaaagccctgagc

SEQ ID NO: 4326271 - DNA, 17 bp, Homo sapiens
accctgggcagtgagtg

SEQ ID NO: 4326272 - DNA, 20 bp, Homo sapiens
accctgtctcagtacctccc

SEQ ID NO: 4326273 - DNA, 19 bp, Homo sapiens
accctttgttgaaaaatgt

SEQ ID NO: 4326274 - DNA, 17 bp, Homo sapiens
accctttgtttcttgtt

SEQ ID NO: 4326275 - DNA, 17 bp, Homo sapiens
acccttttcctttgtgg

SEQ ID NO: 4326276 - DNA, 12 bp, Homo sapiens
accgaggagccc

SEQ ID NO: 4326277 - DNA, 18 bp, Homo sapiens
accgaggtgttgccagtg

SEQ ID NO: 4326278 - DNA, 19 bp, Homo sapiens
accgaggtgttgccagtgc

SEQ ID NO: 4326279 - DNA, 21 bp, Homo sapiens
accgccgactttgtacccccc

SEQ ID NO: 4326280 - DNA, 22 bp, Homo sapiens
accgctctcttttctgtacttc

SEQ ID NO: 4326281 - DNA, 14 bp, Homo sapiens
accgtctttacccc

SEQ ID NO: 4326282 - DNA, 20 bp, Homo sapiens
accgtctttacccctgctga

SEQ ID NO: 4326283 - DNA, 12 bp, Homo sapiens
acctaatgctgg

SEQ ID NO: 4326284 - DNA, 21 bp, Homo sapiens
acctaatgctggcctgactgg

SEQ ID NO: 4326285 - DNA, 13 bp, Homo sapiens
acctatcaaaaac

SEQ ID NO: 4326286 - DNA, 19 bp, Homo sapiens
acctatccgccctgcagca

SEQ ID NO: 4326287 - DNA, 14 bp, Homo sapiens
acctcatttatagc

SEQ ID NO: 4326288 - DNA, 20 bp, Homo sapiens
acctcccacaaaggagagct

SEQ ID NO: 4326289 - DNA, 23 bp, Homo sapiens
acctcccatcccgtaagaccacc

SEQ ID NO: 4326290 - DNA, 22 bp, Homo sapiens
acctcccctccccgccccctga

SEQ ID NO: 4326291 - DNA, 14 bp, Homo sapiens
acctcctgcctccc

SEQ ID NO: 4326292 - DNA, 12 bp, Homo sapiens
acctccttcccc

SEQ ID NO: 4326293 - DNA, 13 bp, Homo sapiens
acctccttcccca

SEQ ID NO: 4326294 - DNA, 14 bp, Homo sapiens
acctccttccccag

SEQ ID NO: 4326295 - DNA, 18 bp, Homo sapiens
acctccttccccagctcc

SEQ ID NO: 4326296 - DNA, 18 bp, Homo sapiens
acctctcgtttctgccca

SEQ ID NO: 4326297 - DNA, 12 bp, Homo sapiens
acctctgcacaa

SEQ ID NO: 4326298 - DNA, 16 bp, Homo sapiens
acctctgcacaagctg

SEQ ID NO: 4326299 - DNA, 18 bp, Homo sapiens
acctctgcacaagctgca

SEQ ID NO: 4326300 - DNA, 16 bp, Homo sapiens
acctgccttttaagtt

SEQ ID NO: 4326301 - DNA, 23 bp, Homo sapiens
acctgcttgagctttctgtgcat

SEQ ID NO: 4326302 - DNA, 18 bp, Homo sapiens
accttatgttagagtcat

SEQ ID NO: 4326303 - DNA, 12 bp, Homo sapiens
accttctcccag

SEQ ID NO: 4326304 - DNA, 13 bp, Homo sapiens
accttctcccagg

SEQ ID NO: 4326305 - DNA, 11 bp, Homo sapiens
accttctccct

SEQ ID NO: 4326306 - DNA, 22 bp, Homo sapiens
accttgtgactcagtgtatttt

SEQ ID NO: 4326307 - DNA, 15 bp, Homo sapiens
acgactgcccggcag

SEQ ID NO: 4326308 - DNA, 14 bp, Homo sapiens
acgagaagtgccct

SEQ ID NO: 4326309 - DNA, 23 bp, Homo sapiens
acgcctctccctaggagaagagt

SEQ ID NO: 4326310 - DNA, 13 bp, Homo sapiens
acggagctcctgg

SEQ ID NO: 4326311 - DNA, 16 bp, Homo sapiens
acggagctcctggcag

SEQ ID NO: 4326312 - DNA, 19 bp, Homo sapiens
acgggagcattggcccctg

SEQ ID NO: 4326313 - DNA, 16 bp, Homo sapiens
acgtataatgctttct

SEQ ID NO: 4326314 - DNA, 18 bp, Homo sapiens
acgtgcatttaaactctg

SEQ ID NO: 4326315 - DNA, 19 bp, Homo sapiens
acgtgcatttaaactctgc

SEQ ID NO: 4326316 - DNA, 20 bp, Homo sapiens
acgtgcatttaaactctgcc

SEQ ID NO: 4326317 - DNA, 15 bp, Homo sapiens
acgtgccattgtctt

SEQ ID NO: 4326318 - DNA, 20 bp, Homo sapiens
acgtgcgtgtgagtgtgtgt

SEQ ID NO: 4326319 - DNA, 15 bp, Homo sapiens
acgttgttgtcattg

SEQ ID NO: 4326320 - DNA, 20 bp, Homo sapiens
actaaaagtggcatagagaa

SEQ ID NO: 4326321 - DNA, 18 bp, Homo sapiens
actaaagttgaaaataca

SEQ ID NO: 4326322 - DNA, 21 bp, Homo sapiens
actaaatgctcatacacagtt

SEQ ID NO: 4326323 - DNA, 20 bp, Homo sapiens
actaacaaaatttgaataat

SEQ ID NO: 4326324 - DNA, 17 bp, Homo sapiens
actaattccttaaatga

SEQ ID NO: 4326325 - DNA, 18 bp, Homo sapiens
actaattccttaaatgaa

SEQ ID NO: 4326326 - DNA, 20 bp, Homo sapiens
actaattccttaaatgaact

SEQ ID NO: 4326327 - DNA, 18 bp, Homo sapiens
actacattagggaagcta

SEQ ID NO: 4326328 - DNA, 15 bp, Homo sapiens
actactcaaatggca

SEQ ID NO: 4326329 - DNA, 16 bp, Homo sapiens
actactgacgaaagag

SEQ ID NO: 4326330 - DNA, 14 bp, Homo sapiens
actactgctatttt

SEQ ID NO: 4326331 - DNA, 14 bp, Homo sapiens
actactgggtgtca

SEQ ID NO: 4326332 - DNA, 17 bp, Homo sapiens
actactgggtgtcattt

SEQ ID NO: 4326333 - DNA, 23 bp, Homo sapiens
actactgggtgtcatttcattcc

SEQ ID NO: 4326334 - DNA, 13 bp, Homo sapiens
actaggagactgg

SEQ ID NO: 4326335 - DNA, 15 bp, Homo sapiens
actattgtaatgcca

SEQ ID NO: 4326336 - DNA, 23 bp, Homo sapiens
actattgtaatgccaatatgaca

SEQ ID NO: 4326337 - DNA, 13 bp, Homo sapiens
actattttttaat

SEQ ID NO: 4326338 - DNA, 17 bp, Homo sapiens
actattttttaataaaa

SEQ ID NO: 4326339 - DNA, 18 bp, Homo sapiens
actcaaacacttattgtt

SEQ ID NO: 4326340 - DNA, 15 bp, Homo sapiens
actcaagtgtcacct

SEQ ID NO: 4326341 - DNA, 19 bp, Homo sapiens
actcaagtgtcacctcctt

SEQ ID NO: 4326342 - DNA, 15 bp, Homo sapiens
actcagtgtatttta

SEQ ID NO: 4326343 - DNA, 17 bp, Homo sapiens
actcatagattgcaaat

SEQ ID NO: 4326344 - DNA, 21 bp, Homo sapiens
actcatagattgcaaatattg

SEQ ID NO: 4326345 - DNA, 19 bp, Homo sapiens
actcatgcaaactgcttta

SEQ ID NO: 4326346 - DNA, 21 bp, Homo sapiens
acacaagagggactgtatttc

SEQ ID NO: 4326347 - DNA, 23 bp, Homo sapiens
acacaagagggactgtatttctg

SEQ ID NO: 4326348 - DNA, 19 bp, Homo sapiens
acacaaggccagaaaaaga

SEQ ID NO: 4326349 - DNA, 24 bp, Homo sapiens
acacacaggagtcctttcttttga

SEQ ID NO: 4326350 - DNA, 19 bp, Homo sapiens
acacagtgctcgaccttga

SEQ ID NO: 4326351 - DNA, 17 bp, Homo sapiens
acacataaatgaaagaa

SEQ ID NO: 4326352 - DNA, 16 bp, Homo sapiens
acacatatgtgcttct

SEQ ID NO: 4326353 - DNA, 17 bp, Homo sapiens
acaccagcccctgcccc

SEQ ID NO: 4326354 - DNA, 21 bp, Homo sapiens
acacctctgcacaagctgcac

SEQ ID NO: 4326355 - DNA, 21 bp, Homo sapiens
acaccttttctatttacctcc

SEQ ID NO: 4326356 - DNA, 16 bp, Homo sapiens
acacggagctcctggc

SEQ ID NO: 4326357 - DNA, 20 bp, Homo sapiens
acacgtccactcccaagcca

SEQ ID NO: 4326358 - DNA, 14 bp, Homo sapiens
acactaattcctta

SEQ ID NO: 4326359 - DNA, 15 bp, Homo sapiens
acactcaaaagctgg

SEQ ID NO: 4326360 - DNA, 16 bp, Homo sapiens
acactccccacgggaa

SEQ ID NO: 4326361 - DNA, 13 bp, Homo sapiens
acactccttgaaa

SEQ ID NO: 4326362 - DNA, 20 bp, Homo sapiens
acacttatctcactgtttta

SEQ ID NO: 4326363 - DNA, 20 bp, Homo sapiens
acactttaaaaccagttacc

SEQ ID NO: 4326364 - DNA, 14 bp, Homo sapiens
acactttacctctt

SEQ ID NO: 4326365 - DNA, 14 bp, Homo sapiens
acagaaggggatgg

SEQ ID NO: 4326366 - DNA, 19 bp, Homo sapiens
acagaaggggatgggaaat

SEQ ID NO: 4326367 - DNA, 15 bp, Homo sapiens
acagacactgttgca

SEQ ID NO: 4326368 - DNA, 18 bp, Homo sapiens
acagagtttgtagtaaat

SEQ ID NO: 4326369 - DNA, 21 bp, Homo sapiens
acagatgtgaaggacatgaga

SEQ ID NO: 4326370 - DNA, 23 bp, Homo sapiens
acagatttgaggactgaagctgg

SEQ ID NO: 4326371 - DNA, 17 bp, Homo sapiens
acagcacagatgtgaag

SEQ ID NO: 4326372 - DNA, 20 bp, Homo sapiens
acagcactactgggtgtcat

SEQ ID NO: 4326373 - DNA, 13 bp, Homo sapiens
acagccctgaaac

SEQ ID NO: 4326374 - DNA, 22 bp, Homo sapiens
acagccctgaaacgagaagtgc

SEQ ID NO: 4326375 - DNA, 17 bp, Homo sapiens
acagctattaaaatgta

SEQ ID NO: 4326376 - DNA, 16 bp, Homo sapiens
acagctccatacttct

SEQ ID NO: 4326377 - DNA, 15 bp, Homo sapiens
acagctcgatccaaa

SEQ ID NO: 4326378 - DNA, 21 bp, Homo sapiens
acagctgacggtttctccccg

SEQ ID NO: 4326379 - DNA, 14 bp, Homo sapiens
acagcttgtgaatg

SEQ ID NO: 4326380 - DNA, 15 bp, Homo sapiens
acagcttgtgaatgt

SEQ ID NO: 4326381 - DNA, 18 bp, Homo sapiens
acagcttgtgaatgttta

SEQ ID NO: 4326382 - DNA, 22 bp, Homo sapiens
acaggagtcctttcttttgaaa

SEQ ID NO: 4326383 - DNA, 13 bp, Homo sapiens
acaggcctccctg

SEQ ID NO: 4326384 - DNA, 15 bp, Homo sapiens
acaggcctgaagata

SEQ ID NO: 4326385 - DNA, 17 bp, Homo sapiens
acagggaaatgtgtatc

SEQ ID NO: 4326386 - DNA, 16 bp, Homo sapiens
acagggagcctcctgc

SEQ ID NO: 4326387 - DNA, 18 bp, Homo sapiens
acagggagcctcctgccc

SEQ ID NO: 4326388 - DNA, 15 bp, Homo sapiens
acagtaatgtagaaa

SEQ ID NO: 4326389 - DNA, 17 bp, Homo sapiens
acagtaatgtagaaatg

SEQ ID NO: 4326390 - DNA, 14 bp, Homo sapiens
acagtgggaagaat

SEQ ID NO: 4326391 - DNA, 17 bp, Homo sapiens
acagtgggaagaatagc

SEQ ID NO: 4326392 - DNA, 15 bp, Homo sapiens
acagtggtactctgt

SEQ ID NO: 4326393 - DNA, 20 bp, Homo sapiens
acagtggtactctgtgtctg

SEQ ID NO: 4326394 - DNA, 16 bp, Homo sapiens
acagttgaaaaacagc

SEQ ID NO: 4326395 - DNA, 23 bp, Homo sapiens
acagttttgtcagtctttcttag

SEQ ID NO: 4326396 - DNA, 16 bp, Homo sapiens
acataaagtcatcaaa

SEQ ID NO: 4326397 - DNA, 18 bp, Homo sapiens
acataaagtcatcaaagt

SEQ ID NO: 4326398 - DNA, 12 bp, Homo sapiens
acataaatgaaa

SEQ ID NO: 4326399 - DNA, 15 bp, Homo sapiens
acataaatgaaagaa

SEQ ID NO: 4326400 - DNA, 16 bp, Homo sapiens
acatacatacatacat

SEQ ID NO: 4326401 - DNA, 17 bp, Homo sapiens
acatagaaacatacaca

SEQ ID NO: 4326402 - DNA, 12 bp, Homo sapiens
acatagaaagac

SEQ ID NO: 4326403 - DNA, 13 bp, Homo sapiens
acatagaaagaca

SEQ ID NO: 4326404 - DNA, 18 bp, Homo sapiens
acatagaggtatattgga

SEQ ID NO: 4326405 - DNA, 21 bp, Homo sapiens
acatagaggtatattggaaga

SEQ ID NO: 4326406 - DNA, 12 bp, Homo sapiens
acatagcctttg

SEQ ID NO: 4326407 - DNA, 14 bp, Homo sapiens
acatataaaaacaa

SEQ ID NO: 4326408 - DNA, 21 bp, Homo sapiens
acatataaaaacaatatattt

SEQ ID NO: 4326409 - DNA, 23 bp, Homo sapiens
acatataaaaacaatatatttgt

SEQ ID NO: 4326410 - DNA, 16 bp, Homo sapiens
acatcaaaaccaccct

SEQ ID NO: 4326411 - DNA, 12 bp, Homo sapiens
acatcagatttc

SEQ ID NO: 4326412 - DNA, 16 bp, Homo sapiens
acatcagatttcttaa

SEQ ID NO: 4326413 - DNA, 21 bp, Homo sapiens
acatcagatttcttaatgtct

SEQ ID NO: 4326414 - DNA, 16 bp, Homo sapiens
acatcctagccccacc

SEQ ID NO: 4326415 - DNA, 17 bp, Homo sapiens
acatcctagccccaccc

SEQ ID NO: 4326416 - DNA, 17 bp, Homo sapiens
acatctgcctgtaatta

SEQ ID NO: 4326417 - DNA, 22 bp, Homo sapiens
acatctgcctgtaattaaacta

SEQ ID NO: 4326418 - DNA, 21 bp, Homo sapiens
acatctgtctttcatctccca

SEQ ID NO: 4326419 - DNA, 15 bp, Homo sapiens
acatcttacttgtcc

SEQ ID NO: 4326420 - DNA, 13 bp, Homo sapiens
acatgaagaatgt

SEQ ID NO: 4326421 - DNA, 18 bp, Homo sapiens
acatgagactaagagaaa

SEQ ID NO: 4326422 - DNA, 16 bp, Homo sapiens
acatggccagactccc

SEQ ID NO: 4326423 - DNA, 21 bp, Homo sapiens
acatggccagactcccttgct

SEQ ID NO: 4326424 - DNA, 18 bp, Homo sapiens
acatgtatttatgtaatg

SEQ ID NO: 4326425 - DNA, 16 bp, Homo sapiens
acatgtccttgtgtgt

SEQ ID NO: 4326426 - DNA, 12 bp, Homo sapiens
acatgtgcccct

SEQ ID NO: 4326427 - DNA, 17 bp, Homo sapiens
acatgtgctgatgttta

SEQ ID NO: 4326428 - DNA, 12 bp, Homo sapiens
acattaggaatt

SEQ ID NO: 4326429 - DNA, 19 bp, Homo sapiens
acattcttaaactagttgt

SEQ ID NO: 4326430 - DNA, 11 bp, Homo sapiens
acatttgaatt

SEQ ID NO: 4326431 - DNA, 13 bp, Homo sapiens
acattttaagtgc

SEQ ID NO: 4326432 - DNA, 22 bp, Homo sapiens
acattttcttttattatcagtt

SEQ ID NO: 4326433 - DNA, 18 bp, Homo sapiens
accaatgcttttatcaaa

SEQ ID NO: 4326434 - DNA, 14 bp, Homo sapiens
accaattattgata

SEQ ID NO: 4326435 - DNA, 16 bp, Homo sapiens
accaccttcccttcct

SEQ ID NO: 4326436 - DNA, 17 bp, Homo sapiens
accactgcactccagcc

SEQ ID NO: 4326437 - DNA, 20 bp, Homo sapiens
accactgcactccagcctgg

SEQ ID NO: 4326438 - DNA, 21 bp, Homo sapiens
accactgcactccagcctggg

SEQ ID NO: 4326439 - DNA, 12 bp, Homo sapiens
accagaagaaaa

SEQ ID NO: 4326440 - DNA, 14 bp, Homo sapiens
accagaagaaaaga

SEQ ID NO: 4326441 - DNA, 12 bp, Homo sapiens
accagaagcaag

SEQ ID NO: 4326442 - DNA, 17 bp, Homo sapiens
accagcagcctggaccc

SEQ ID NO: 4326443 - DNA, 14 bp, Homo sapiens
accagcccacagca

SEQ ID NO: 4326444 - DNA, 18 bp, Homo sapiens
accagcccctgccccagc

SEQ ID NO: 4326445 - DNA, 16 bp, Homo sapiens
accagctaccctgtgt

SEQ ID NO: 4326446 - DNA, 17 bp, Homo sapiens
aatgccaaaatgtactt

SEQ ID NO: 4326447 - DNA, 17 bp, Homo sapiens
aatgccaatatgacaca

SEQ ID NO: 4326448 - DNA, 19 bp, Homo sapiens
aatgccaggcggacaaagt

SEQ ID NO: 4326449 - DNA, 21 bp, Homo sapiens
aatgctgagctgaagaaatta

SEQ ID NO: 4326450 - DNA, 11 bp, Homo sapiens
aatgctttctg

SEQ ID NO: 4326451 - DNA, 17 bp, Homo sapiens
aatggactggtttgaga

SEQ ID NO: 4326452 - DNA, 19 bp, Homo sapiens
aatggactggtttgagatt

SEQ ID NO: 4326453 - DNA, 14 bp, Homo sapiens
aatggagaaaatga

SEQ ID NO: 4326454 - DNA, 15 bp, Homo sapiens
aatggagaaaatgaa

SEQ ID NO: 4326455 - DNA, 18 bp, Homo sapiens
aatggagtgtttgaaaac

SEQ ID NO: 4326456 - DNA, 15 bp, Homo sapiens
aatggctgctttgac

SEQ ID NO: 4326457 - DNA, 19 bp, Homo sapiens
aatgggcacaatcttggtc

SEQ ID NO: 4326458 - DNA, 14 bp, Homo sapiens
aatgtacttaaatg

SEQ ID NO: 4326459 - DNA, 15 bp, Homo sapiens
aatgtacttaaatga

SEQ ID NO: 4326460 - DNA, 23 bp, Homo sapiens
aatgtaggcacttttattttcat

SEQ ID NO: 4326461 - DNA, 17 bp, Homo sapiens
aatgtagggttatattt

SEQ ID NO: 4326462 - DNA, 21 bp, Homo sapiens
aatgtcagactttgctgcatt

SEQ ID NO: 4326463 - DNA, 22 bp, Homo sapiens
aatgtcctaacagagaaataga

SEQ ID NO: 4326464 - DNA, 23 bp, Homo sapiens
aatgtctgtcagaagacactaat

SEQ ID NO: 4326465 - DNA, 19 bp, Homo sapiens
aatgtgaaaagaaaaatga

SEQ ID NO: 4326466 - DNA, 13 bp, Homo sapiens
aatgtgaagccag

SEQ ID NO: 4326467 - DNA, 20 bp, Homo sapiens
aatgtgatcaactgttcagg

SEQ ID NO: 4326468 - DNA, 17 bp, Homo sapiens
aatgtgtctgtgttgct

SEQ ID NO: 4326469 - DNA, 20 bp, Homo sapiens
aatgtgtgtgtgatggaggg

SEQ ID NO: 4326470 - DNA, 13 bp, Homo sapiens
aatgttaagaaag

SEQ ID NO: 4326471 - DNA, 14 bp, Homo sapiens
aatgttaagaaaga

SEQ ID NO: 4326472 - DNA, 16 bp, Homo sapiens
aatgttctaaattcta

SEQ ID NO: 4326473 - DNA, 21 bp, Homo sapiens
aatgttctctcttctccacct

SEQ ID NO: 4326474 - DNA, 17 bp, Homo sapiens
aatgtttagtgtgctgc

SEQ ID NO: 4326475 - DNA, 16 bp, Homo sapiens
aattaaaaactttaaa

SEQ ID NO: 4326476 - DNA, 17 bp, Homo sapiens
aattaaagccttaagca

SEQ ID NO: 4326477 - DNA, 22 bp, Homo sapiens
aattaaagccttaagcacaatt

SEQ ID NO: 4326478 - DNA, 15 bp, Homo sapiens
aattaaataaactgt

SEQ ID NO: 4326479 - DNA, 24 bp, Homo sapiens
aattaaataaactgttttcaagtc

SEQ ID NO: 4326480 - DNA, 12 bp, Homo sapiens
aattaacaagaa

SEQ ID NO: 4326481 - DNA, 20 bp, Homo sapiens
aattaacaagaactcattat

SEQ ID NO: 4326482 - DNA, 14 bp, Homo sapiens
aattaagaactgaa

SEQ ID NO: 4326483 - DNA, 13 bp, Homo sapiens
aattaattaaaag

SEQ ID NO: 4326484 - DNA, 19 bp, Homo sapiens
aattaccatagagtaatga

SEQ ID NO: 4326485 - DNA, 14 bp, Homo sapiens
aattactacattag

SEQ ID NO: 4326486 - DNA, 21 bp, Homo sapiens
aattacttttgaaccatgtat

SEQ ID NO: 4326487 - DNA, 14 bp, Homo sapiens
aattagaagaaaat

SEQ ID NO: 4326488 - DNA, 20 bp, Homo sapiens
aattataaaattgaaaacac

SEQ ID NO: 4326489 - DNA, 19 bp, Homo sapiens
aattatacgtacatacaca

SEQ ID NO: 4326490 - DNA, 14 bp, Homo sapiens
aattatccattacg

SEQ ID NO: 4326491 - DNA, 20 bp, Homo sapiens
aattattgatatatattata

SEQ ID NO: 4326492 - DNA, 16 bp, Homo sapiens
aattattggtatattt

SEQ ID NO: 4326493 - DNA, 15 bp, Homo sapiens
aattatttattactt

SEQ ID NO: 4326494 - DNA, 13 bp, Homo sapiens
aattatttcagat

SEQ ID NO: 4326495 - DNA, 13 bp, Homo sapiens
aattcctacagca

SEQ ID NO: 4326496 - DNA, 14 bp, Homo sapiens
aattcctacagcac

SEQ ID NO: 4326497 - DNA, 19 bp, Homo sapiens
aattcctacagcactactg

SEQ ID NO: 4326498 - DNA, 15 bp, Homo sapiens
aattccttaaatgaa

SEQ ID NO: 4326499 - DNA, 17 bp, Homo sapiens
aattccttaaatgaact

SEQ ID NO: 4326500 - DNA, 15 bp, Homo sapiens
aattcgcccgagctg

SEQ ID NO: 4326501 - DNA, 21 bp, Homo sapiens
aattcgcccgagctgtttatg

SEQ ID NO: 4326502 - DNA, 16 bp, Homo sapiens
aattctcctgataaaa

SEQ ID NO: 4326503 - DNA, 16 bp, Homo sapiens
aattctgaaatacttt

SEQ ID NO: 4326504 - DNA, 19 bp, Homo sapiens
aattctgatcaatcatttt

SEQ ID NO: 4326505 - DNA, 12 bp, Homo sapiens
aattgaaaacac

SEQ ID NO: 4326506 - DNA, 16 bp, Homo sapiens
aattgaaaacactaac

SEQ ID NO: 4326507 - DNA, 22 bp, Homo sapiens
aattgacaagctaggaaagagg

SEQ ID NO: 4326508 - DNA, 14 bp, Homo sapiens
aattgagaaaagag

SEQ ID NO: 4326509 - DNA, 21 bp, Homo sapiens
aattgatcataggtatttcaa

SEQ ID NO: 4326510 - DNA, 17 bp, Homo sapiens
aattgcagatgccaaaa

SEQ ID NO: 4326511 - DNA, 18 bp, Homo sapiens
aattgcagtttcatgtat

SEQ ID NO: 4326512 - DNA, 20 bp, Homo sapiens
aattgcagtttcatgtatgt

SEQ ID NO: 4326513 - DNA, 20 bp, Homo sapiens
aattgctcctaagcttcaaa

SEQ ID NO: 4326514 - DNA, 20 bp, Homo sapiens
aattgcttttgaaaaacaac

SEQ ID NO: 4326515 - DNA, 16 bp, Homo sapiens
aattggaacaaagtga

SEQ ID NO: 4326516 - DNA, 18 bp, Homo sapiens
aattggcataatttgtct

SEQ ID NO: 4326517 - DNA, 21 bp, Homo sapiens
aattgtgcttctccccagaat

SEQ ID NO: 4326518 - DNA, 22 bp, Homo sapiens
aattgtttaccatagaaagatg

SEQ ID NO: 4326519 - DNA, 19 bp, Homo sapiens
aattgtttatacacaactt

SEQ ID NO: 4326520 - DNA, 11 bp, Homo sapiens
aatttaaattg

SEQ ID NO: 4326521 - DNA, 12 bp, Homo sapiens
aatttcacagtt

SEQ ID NO: 4326522 - DNA, 19 bp, Homo sapiens
aatttcacagttctgtaat

SEQ ID NO: 4326523 - DNA, 12 bp, Homo sapiens
aatttcattatc

SEQ ID NO: 4326524 - DNA, 15 bp, Homo sapiens
aatttctggaagaaa

SEQ ID NO: 4326525 - DNA, 22 bp, Homo sapiens
aatttctttttggtaaatatga

SEQ ID NO: 4326526 - DNA, 16 bp, Homo sapiens
aatttgaataataaat

SEQ ID NO: 4326527 - DNA, 17 bp, Homo sapiens
aatttgaataataaatc

SEQ ID NO: 4326528 - DNA, 14 bp, Homo sapiens
aatttggcaaaaca

SEQ ID NO: 4326529 - DNA, 19 bp, Homo sapiens
aatttgttcttgtatttta

SEQ ID NO: 4326530 - DNA, 16 bp, Homo sapiens
acaaaaagcataaaaa

SEQ ID NO: 4326531 - DNA, 15 bp, Homo sapiens
acaaaagggagaaca

SEQ ID NO: 4326532 - DNA, 15 bp, Homo sapiens
acaaaatttcacagt

SEQ ID NO: 4326533 - DNA, 21 bp, Homo sapiens
acaaaatttgaataataaatc

SEQ ID NO: 4326534 - DNA, 17 bp, Homo sapiens
acaaagaaacaaagcaa

SEQ ID NO: 4326535 - DNA, 23 bp, Homo sapiens
acaaagataagacttgtttcttt

SEQ ID NO: 4326536 - DNA, 23 bp, Homo sapiens
acaaagcactagagaatgcacag

SEQ ID NO: 4326537 - DNA, 15 bp, Homo sapiens
acaaagctgatttcc

SEQ ID NO: 4326538 - DNA, 19 bp, Homo sapiens
acaaagctgatttcccttt

SEQ ID NO: 4326539 - DNA, 17 bp, Homo sapiens
acaaattttttaatttc

SEQ ID NO: 4326540 - DNA, 20 bp, Homo sapiens
acaaccccctccacaaagag

SEQ ID NO: 4326541 - DNA, 17 bp, Homo sapiens
aagatatggagaattgc

SEQ ID NO: 4326542 - DNA, 17 bp, Homo sapiens
aagatcacgctccccgc

SEQ ID NO: 4326543 - DNA, 16 bp, Homo sapiens
aagatgcttctcactg

SEQ ID NO: 4326544 - DNA, 17 bp, Homo sapiens
aagatgcttctcactgc

SEQ ID NO: 4326545 - DNA, 16 bp, Homo sapiens
aagatggagaggaaga

SEQ ID NO: 4326546 - DNA, 18 bp, Homo sapiens
aagatggagaggaagaaa

SEQ ID NO: 4326547 - DNA, 20 bp, Homo sapiens
aagatgttcaatagaacatg

SEQ ID NO: 4326548 - DNA, 15 bp, Homo sapiens
aagatttgaaaacaa

SEQ ID NO: 4326549 - DNA, 20 bp, Homo sapiens
aagatttgaaaacaaacttc

SEQ ID NO: 4326550 - DNA, 17 bp, Homo sapiens
aagatttggaaaattca

SEQ ID NO: 4326551 - DNA, 19 bp, Homo sapiens
aagcaaagatttcagtaga

SEQ ID NO: 4326552 - DNA, 17 bp, Homo sapiens
aagcaacctttcccttc

SEQ ID NO: 4326553 - DNA, 13 bp, Homo sapiens
aagcaccagggag

SEQ ID NO: 4326554 - DNA, 19 bp, Homo sapiens
aagcaccagggagaggcct

SEQ ID NO: 4326555 - DNA, 15 bp, Homo sapiens
aagcagaggaaggaa

SEQ ID NO: 4326556 - DNA, 19 bp, Homo sapiens
aagcagaggaaggaaacat

SEQ ID NO: 4326557 - DNA, 22 bp, Homo sapiens
aagcagaggaaggaaacataga

SEQ ID NO: 4326558 - DNA, 16 bp, Homo sapiens
aagcagtaaaataaaa

SEQ ID NO: 4326559 - DNA, 19 bp, Homo sapiens
aagcagtaaaataaaaaac

SEQ ID NO: 4326560 - DNA, 23 bp, Homo sapiens
aagcattactttaacctccctca

SEQ ID NO: 4326561 - DNA, 13 bp, Homo sapiens
aagcattctttaa

SEQ ID NO: 4326562 - DNA, 23 bp, Homo sapiens
aagccaacaggtaaacacataaa

SEQ ID NO: 4326563 - DNA, 18 bp, Homo sapiens
aagccattaaatgaatat

SEQ ID NO: 4326564 - DNA, 15 bp, Homo sapiens
aagccctatgtgaaa

SEQ ID NO: 4326565 - DNA, 15 bp, Homo sapiens
aagcctcctccagcc

SEQ ID NO: 4326566 - DNA, 10 bp, Homo sapiens
aagcctgccc

SEQ ID NO: 4326567 - DNA, 17 bp, Homo sapiens
aagcctgcccttgtctg

SEQ ID NO: 4326568 - DNA, 17 bp, Homo sapiens
aagccttactcacctct

SEQ ID NO: 4326569 - DNA, 19 bp, Homo sapiens
aagccttactcacctctct

SEQ ID NO: 4326570 - DNA, 22 bp, Homo sapiens
aagcgctcatctggcttttcgc

SEQ ID NO: 4326571 - DNA, 14 bp, Homo sapiens
aagctaatctgcct

SEQ ID NO: 4326572 - DNA, 17 bp, Homo sapiens
aagctagactgtgtctg

SEQ ID NO: 4326573 - DNA, 22 bp, Homo sapiens
aagctcccacacccacctctgc

SEQ ID NO: 4326574 - DNA, 16 bp, Homo sapiens
aagctctagtgggaag

SEQ ID NO: 4326575 - DNA, 22 bp, Homo sapiens
aagctcttacactacattagaa

SEQ ID NO: 4326576 - DNA, 13 bp, Homo sapiens
aagctgccctgag

SEQ ID NO: 4326577 - DNA, 20 bp, Homo sapiens
aagctggccctcagctccct

SEQ ID NO: 4326578 - DNA, 17 bp, Homo sapiens
aagcttatttttatgtg

SEQ ID NO: 4326579 - DNA, 18 bp, Homo sapiens
aagcttatttttatgtgg

SEQ ID NO: 4326580 - DNA, 23 bp, Homo sapiens
aagcttcattagcttgtctatta

SEQ ID NO: 4326581 - DNA, 20 bp, Homo sapiens
aagcttgatttgatctttgt

SEQ ID NO: 4326582 - DNA, 21 bp, Homo sapiens
aagcttgtggaggagggagag

SEQ ID NO: 4326583 - DNA, 14 bp, Homo sapiens
aaggaaattaagaa

SEQ ID NO: 4326584 - DNA, 15 bp, Homo sapiens
aaggaaattaagaac

SEQ ID NO: 4326585 - DNA, 17 bp, Homo sapiens
aaggaactgatacatct

SEQ ID NO: 4326586 - DNA, 17 bp, Homo sapiens
aaggaaggctgaaggct

SEQ ID NO: 4326587 - DNA, 20 bp, Homo sapiens
aaggagtgccataccttctc

SEQ ID NO: 4326588 - DNA, 16 bp, Homo sapiens
aaggatcaccccagcc

SEQ ID NO: 4326589 - DNA, 24 bp, Homo sapiens
aaggatcttttggacctggctaat

SEQ ID NO: 4326590 - DNA, 17 bp, Homo sapiens
aaggatgatggaaaaat

SEQ ID NO: 4326591 - DNA, 18 bp, Homo sapiens
aaggatgatggaaaaatc

SEQ ID NO: 4326592 - DNA, 19 bp, Homo sapiens
aaggatgatggaaaaatca

SEQ ID NO: 4326593 - DNA, 13 bp, Homo sapiens
aaggcaaggaaat

SEQ ID NO: 4326594 - DNA, 23 bp, Homo sapiens
aaggcagcctttttctggccttg

SEQ ID NO: 4326595 - DNA, 15 bp, Homo sapiens
aaggccagaaaaaga

SEQ ID NO: 4326596 - DNA, 16 bp, Homo sapiens
aaggccagaaaaagaa

SEQ ID NO: 4326597 - DNA, 19 bp, Homo sapiens
aaggctgcgtctggagggg

SEQ ID NO: 4326598 - DNA, 17 bp, Homo sapiens
aagggccaatggagaaa

SEQ ID NO: 4326599 - DNA, 16 bp, Homo sapiens
aagggccgtgcccttg

SEQ ID NO: 4326600 - DNA, 23 bp, Homo sapiens
aagggccgtgcccttgcccttgg

SEQ ID NO: 4326601 - DNA, 18 bp, Homo sapiens
aaggggtgattgaaagaa

SEQ ID NO: 4326602 - DNA, 19 bp, Homo sapiens
aaggggtgattgaaagaaa

SEQ ID NO: 4326603 - DNA, 18 bp, Homo sapiens
aagggtaacttgttttta

SEQ ID NO: 4326604 - DNA, 15 bp, Homo sapiens
aaggtgggtgaggct

SEQ ID NO: 4326605 - DNA, 22 bp, Homo sapiens
aaggtgggtgaggctgggcagg

SEQ ID NO: 4326606 - DNA, 22 bp, Homo sapiens
aaggtttgttcctttgaagaat

SEQ ID NO: 4326607 - DNA, 14 bp, Homo sapiens
aagtaacagtatgt

SEQ ID NO: 4326608 - DNA, 13 bp, Homo sapiens
aagtaattatgca

SEQ ID NO: 4326609 - DNA, 14 bp, Homo sapiens
aagtactgtttacc

SEQ ID NO: 4326610 - DNA, 21 bp, Homo sapiens
aagtagacaatcattgttttg

SEQ ID NO: 4326611 - DNA, 14 bp, Homo sapiens
aagtagcctctggg

SEQ ID NO: 4326612 - DNA, 22 bp, Homo sapiens
aagtaggactttcctaaatgtt

SEQ ID NO: 4326613 - DNA, 23 bp, Homo sapiens
aagtaggactttcctaaatgttt

SEQ ID NO: 4326614 - DNA, 15 bp, Homo sapiens
aagtataaggtgctc

SEQ ID NO: 4326615 - DNA, 17 bp, Homo sapiens
aagtcattgagtgactt

SEQ ID NO: 4326616 - DNA, 12 bp, Homo sapiens
aagtcctgcttt

SEQ ID NO: 4326617 - DNA, 15 bp, Homo sapiens
aagtctgagttctct

SEQ ID NO: 4326618 - DNA, 21 bp, Homo sapiens
aagtgccactcattcctgtag

SEQ ID NO: 4326619 - DNA, 13 bp, Homo sapiens
aagtgcctgctgg

SEQ ID NO: 4326620 - DNA, 16 bp, Homo sapiens
aagtgcttcacatttg

SEQ ID NO: 4326621 - DNA, 16 bp, Homo sapiens
aagtgtcacctccttc

SEQ ID NO: 4326622 - DNA, 19 bp, Homo sapiens
aagtgtcacctccttcccc

SEQ ID NO: 4326623 - DNA, 17 bp, Homo sapiens
aagtgttcagtgttgac

SEQ ID NO: 4326624 - DNA, 15 bp, Homo sapiens
aataaactgttttca

SEQ ID NO: 4326625 - DNA, 16 bp, Homo sapiens
aataaactttgaataa

SEQ ID NO: 4326626 - DNA, 20 bp, Homo sapiens
aataaactttgaataaaaga

SEQ ID NO: 4326627 - DNA, 10 bp, Homo sapiens
aataaagcat

SEQ ID NO: 4326628 - DNA, 12 bp, Homo sapiens
aataaagcattc

SEQ ID NO: 4326629 - DNA, 12 bp, Homo sapiens
aataaatgttca

SEQ ID NO: 4326630 - DNA, 17 bp, Homo sapiens
aataaatgttcaaactg

SEQ ID NO: 4326631 - DNA, 18 bp, Homo sapiens
aataaatgttcaaactgt

SEQ ID NO: 4326632 - DNA, 19 bp, Homo sapiens
aataactattttgttttaa

SEQ ID NO: 4326633 - DNA, 22 bp, Homo sapiens
aataactattttgttttaatct

SEQ ID NO: 4326634 - DNA, 15 bp, Homo sapiens
aataagaaagtttca

SEQ ID NO: 4326635 - DNA, 12 bp, Homo sapiens
aataatattgtt

SEQ ID NO: 4326636 - DNA, 14 bp, Homo sapiens
aataatctatatta

SEQ ID NO: 4326637 - DNA, 19 bp, Homo sapiens
aataatctatattaaatga

SEQ ID NO: 4326638 - DNA, 22 bp, Homo sapiens
aatacacatataaaaacaatat

SEQ ID NO: 4326639 - DNA, 22 bp, Homo sapiens
aatagaggtgatgctgctaaag

SEQ ID NO: 4326640 - DNA, 15 bp, Homo sapiens
aatagattatagttg

SEQ ID NO: 4326641 - DNA, 12 bp, Homo sapiens
aataggaattca

SEQ ID NO: 4326642 - DNA, 20 bp, Homo sapiens
aatagttgtctgtgcttcct

SEQ ID NO: 4326643 - DNA, 18 bp, Homo sapiens
aatagtttccaagaaatt

SEQ ID NO: 4326644 - DNA, 16 bp, Homo sapiens
aatatactttttttgt

SEQ ID NO: 4326645 - DNA, 23 bp, Homo sapiens
aatatagtttggaaataaaaatg

SEQ ID NO: 4326646 - DNA, 14 bp, Homo sapiens
aatatatatagtta

SEQ ID NO: 4326647 - DNA, 16 bp, Homo sapiens
aatatatatataaaat

SEQ ID NO: 4326648 - DNA, 15 bp, Homo sapiens
aatatatgtatatat

SEQ ID NO: 4326649 - DNA, 21 bp, Homo sapiens
aatatgaaccctttgtttctt

SEQ ID NO: 4326650 - DNA, 21 bp, Homo sapiens
aatatgacacagcttgtgaat

SEQ ID NO: 4326651 - DNA, 11 bp, Homo sapiens
aatattaaagc

SEQ ID NO: 4326652 - DNA, 15 bp, Homo sapiens
aatattcaagtaaca

SEQ ID NO: 4326653 - DNA, 16 bp, Homo sapiens
aatattcaagtaacac

SEQ ID NO: 4326654 - DNA, 17 bp, Homo sapiens
aatattcaagtaacact

SEQ ID NO: 4326655 - DNA, 14 bp, Homo sapiens
aatattggttagta

SEQ ID NO: 4326656 - DNA, 16 bp, Homo sapiens
aatattttgataataa

SEQ ID NO: 4326657 - DNA, 13 bp, Homo sapiens
aatcaaaaacttt

SEQ ID NO: 4326658 - DNA, 12 bp, Homo sapiens
aatcaatgcttt

SEQ ID NO: 4326659 - DNA, 18 bp, Homo sapiens
aatcagcaatattgcctg

SEQ ID NO: 4326660 - DNA, 13 bp, Homo sapiens
aatcagcctgctc

SEQ ID NO: 4326661 - DNA, 18 bp, Homo sapiens
aatcagcctgctccagct

SEQ ID NO: 4326662 - DNA, 21 bp, Homo sapiens
aaatgtttttaacactatact

SEQ ID NO: 4326663 - DNA, 12 bp, Homo sapiens
aaattaaataaa

SEQ ID NO: 4326664 - DNA, 17 bp, Homo sapiens
aaattaaataaactgtt

SEQ ID NO: 4326665 - DNA, 15 bp, Homo sapiens
aaattaagaactgaa

SEQ ID NO: 4326666 - DNA, 12 bp, Homo sapiens
aaattataaaat

SEQ ID NO: 4326667 - DNA, 16 bp, Homo sapiens
aaattataaaattgaa

SEQ ID NO: 4326668 - DNA, 18 bp, Homo sapiens
aaattattggtatatttg

SEQ ID NO: 4326669 - DNA, 11 bp, Homo sapiens
aaattcaaagg

SEQ ID NO: 4326670 - DNA, 18 bp, Homo sapiens
aaattcccaaatattaca

SEQ ID NO: 4326671 - DNA, 19 bp, Homo sapiens
aaattcgcccgagctgttt

SEQ ID NO: 4326672 - DNA, 17 bp, Homo sapiens
aaattctctcaagactt

SEQ ID NO: 4326673 - DNA, 16 bp, Homo sapiens
aaattgaaaacactaa

SEQ ID NO: 4326674 - DNA, 21 bp, Homo sapiens
aaattgacaagctaggaaaga

SEQ ID NO: 4326675 - DNA, 22 bp, Homo sapiens
aaattgtgcttctccccagaat

SEQ ID NO: 4326676 - DNA, 18 bp, Homo sapiens
aaatttcacagttctgta

SEQ ID NO: 4326677 - DNA, 15 bp, Homo sapiens
aaatttgaataataa

SEQ ID NO: 4326678 - DNA, 13 bp, Homo sapiens
aacaaaatttcac

SEQ ID NO: 4326679 - DNA, 13 bp, Homo sapiens
aacaaaatttgaa

SEQ ID NO: 4326680 - DNA, 13 bp, Homo sapiens
aacaaacttctcg

SEQ ID NO: 4326681 - DNA, 22 bp, Homo sapiens
aacaaacttctcgcaactgaag

SEQ ID NO: 4326682 - DNA, 14 bp, Homo sapiens
aacaatatatttgt

SEQ ID NO: 4326683 - DNA, 13 bp, Homo sapiens
aacaccagcccct

SEQ ID NO: 4326684 - DNA, 16 bp, Homo sapiens
aacaccagcccctgcc

SEQ ID NO: 4326685 - DNA, 16 bp, Homo sapiens
aacactaacaaaattt

SEQ ID NO: 4326686 - DNA, 23 bp, Homo sapiens
aacactaacaaaatttgaataat

SEQ ID NO: 4326687 - DNA, 20 bp, Homo sapiens
aacactacagagtacgtgaa

SEQ ID NO: 4326688 - DNA, 14 bp, Homo sapiens
aacagagaaataga

SEQ ID NO: 4326689 - DNA, 18 bp, Homo sapiens
aacagcaggatgccctgt

SEQ ID NO: 4326690 - DNA, 16 bp, Homo sapiens
aacagctcgatccaaa

SEQ ID NO: 4326691 - DNA, 19 bp, Homo sapiens
aacagctcgatccaaattg

SEQ ID NO: 4326692 - DNA, 14 bp, Homo sapiens
aacatagaaagaca

SEQ ID NO: 4326693 - DNA, 14 bp, Homo sapiens
aacatgcaagaatt

SEQ ID NO: 4326694 - DNA, 16 bp, Homo sapiens
aacatggccagactcc

SEQ ID NO: 4326695 - DNA, 18 bp, Homo sapiens
aacatggccagactccct

SEQ ID NO: 4326696 - DNA, 20 bp, Homo sapiens
aacatggccagactcccttg

SEQ ID NO: 4326697 - DNA, 15 bp, Homo sapiens
aaccaagtcaagtga

SEQ ID NO: 4326698 - DNA, 12 bp, Homo sapiens
aaccaatagaaa

SEQ ID NO: 4326699 - DNA, 15 bp, Homo sapiens
aaccacttcagctga

SEQ ID NO: 4326700 - DNA, 16 bp, Homo sapiens
aaccagaagtgcagcc

SEQ ID NO: 4326701 - DNA, 15 bp, Homo sapiens
aaccatctctgtgat

SEQ ID NO: 4326702 - DNA, 15 bp, Homo sapiens
aaccattgtcttgtt

SEQ ID NO: 4326703 - DNA, 24 bp, Homo sapiens
aaccattgtcttgttctgtgatga

SEQ ID NO: 4326704 - DNA, 17 bp, Homo sapiens
aaccatttaaagaaaga

SEQ ID NO: 4326705 - DNA, 13 bp, Homo sapiens
aacccccttttcc

SEQ ID NO: 4326706 - DNA, 18 bp, Homo sapiens
aacccggtgcatctggca

SEQ ID NO: 4326707 - DNA, 16 bp, Homo sapiens
aacctccctcaacaag

SEQ ID NO: 4326708 - DNA, 19 bp, Homo sapiens
aacctccctcaacaaggta

SEQ ID NO: 4326709 - DNA, 13 bp, Homo sapiens
aacctttcccttc

SEQ ID NO: 4326710 - DNA, 19 bp, Homo sapiens
aacgttgacccctttcccc

SEQ ID NO: 4326711 - DNA, 15 bp, Homo sapiens
aactattcagaggaa

SEQ ID NO: 4326712 - DNA, 17 bp, Homo sapiens
aactctataaagaaact

SEQ ID NO: 4326713 - DNA, 14 bp, Homo sapiens
aactgaataaaaaa

SEQ ID NO: 4326714 - DNA, 19 bp, Homo sapiens
aactgaataaaaaataaat

SEQ ID NO: 4326715 - DNA, 13 bp, Homo sapiens
aactgacatcaga

SEQ ID NO: 4326716 - DNA, 16 bp, Homo sapiens
aactgacatcagattt

SEQ ID NO: 4326717 - DNA, 19 bp, Homo sapiens
aactgacatcagatttctt

SEQ ID NO: 4326718 - DNA, 16 bp, Homo sapiens
aactgcattggctttg

SEQ ID NO: 4326719 - DNA, 22 bp, Homo sapiens
aactgcttacagtttattttct

SEQ ID NO: 4326720 - DNA, 17 bp, Homo sapiens
aactgctttattttccc

SEQ ID NO: 4326721 - DNA, 18 bp, Homo sapiens
aactgctttattttccct

SEQ ID NO: 4326722 - DNA, 23 bp, Homo sapiens
aactgctttgggagattatcagt

SEQ ID NO: 4326723 - DNA, 14 bp, Homo sapiens
aactggaattaaaa

SEQ ID NO: 4326724 - DNA, 12 bp, Homo sapiens
aactggagctgc

SEQ ID NO: 4326725 - DNA, 15 bp, Homo sapiens
aactgggaagaacaa

SEQ ID NO: 4326726 - DNA, 19 bp, Homo sapiens
aactggttgtagtgggaag

SEQ ID NO: 4326727 - DNA, 12 bp, Homo sapiens
aactgtatttca

SEQ ID NO: 4326728 - DNA, 17 bp, Homo sapiens
aactgtatttcagtatt

SEQ ID NO: 4326729 - DNA, 16 bp, Homo sapiens
aacttgaaaagaaaac

SEQ ID NO: 4326730 - DNA, 12 bp, Homo sapiens
aacttgtgaatg

SEQ ID NO: 4326731 - DNA, 13 bp, Homo sapiens
aacttgtgaatgc

SEQ ID NO: 4326732 - DNA, 14 bp, Homo sapiens
aacttgtttttatt

SEQ ID NO: 4326733 - DNA, 13 bp, Homo sapiens
aacttttcatttc

SEQ ID NO: 4326734 - DNA, 16 bp, Homo sapiens
aacttttcatttcaga

SEQ ID NO: 4326735 - DNA, 18 bp, Homo sapiens
aacttttcatttcagatt

SEQ ID NO: 4326736 - DNA, 20 bp, Homo sapiens
aacttttcatttcagatttt

SEQ ID NO: 4326737 - DNA, 12 bp, Homo sapiens
aacttttgaaaa

SEQ ID NO: 4326738 - DNA, 14 bp, Homo sapiens
aacttttgaaaaag

SEQ ID NO: 4326739 - DNA, 15 bp, Homo sapiens
aacttttgaaaaagt

SEQ ID NO: 4326740 - DNA, 17 bp, Homo sapiens
aacttttgaaaaagtgt

SEQ ID NO: 4326741 - DNA, 16 bp, Homo sapiens
aactttttttcagttc

SEQ ID NO: 4326742 - DNA, 16 bp, Homo sapiens
aagaaaaaaaaatact

SEQ ID NO: 4326743 - DNA, 13 bp, Homo sapiens
aagaaaaagaaaa

SEQ ID NO: 4326744 - DNA, 12 bp, Homo sapiens
aagaaaagactt

SEQ ID NO: 4326745 - DNA, 12 bp, Homo sapiens
aagaaaagagag

SEQ ID NO: 4326746 - DNA, 14 bp, Homo sapiens
aagaaaatggatga

SEQ ID NO: 4326747 - DNA, 16 bp, Homo sapiens
aagaaaattctctcaa

SEQ ID NO: 4326748 - DNA, 13 bp, Homo sapiens
aagaaaattttcc

SEQ ID NO: 4326749 - DNA, 15 bp, Homo sapiens
aagaaacaaagcaaa

SEQ ID NO: 4326750 - DNA, 18 bp, Homo sapiens
aagaaactgcttacagtt

SEQ ID NO: 4326751 - DNA, 21 bp, Homo sapiens
aagaaattttagatattatca

SEQ ID NO: 4326752 - DNA, 19 bp, Homo sapiens
aagaacaaggccctgaggg

SEQ ID NO: 4326753 - DNA, 14 bp, Homo sapiens
aagaacatgaatct

SEQ ID NO: 4326754 - DNA, 21 bp, Homo sapiens
aagaactgaatccatatttca

SEQ ID NO: 4326755 - DNA, 20 bp, Homo sapiens
aagaagaccctttgttgaaa

SEQ ID NO: 4326756 - DNA, 22 bp, Homo sapiens
aagaagaccctttgttgaaaaa

SEQ ID NO: 4326757 - DNA, 17 bp, Homo sapiens
aagaagatcacgctccc

SEQ ID NO: 4326758 - DNA, 23 bp, Homo sapiens
aagaagttttttactttggttta

SEQ ID NO: 4326759 - DNA, 19 bp, Homo sapiens
aagaatgtagccctctcca

SEQ ID NO: 4326760 - DNA, 19 bp, Homo sapiens
aagacaatgtgaaaagaaa

SEQ ID NO: 4326761 - DNA, 15 bp, Homo sapiens
aagacactaattcct

SEQ ID NO: 4326762 - DNA, 16 bp, Homo sapiens
aagacactaattcctt

SEQ ID NO: 4326763 - DNA, 19 bp, Homo sapiens
aagacatctgcctgtaatt

SEQ ID NO: 4326764 - DNA, 23 bp, Homo sapiens
aagacatgggctatcagggagga

SEQ ID NO: 4326765 - DNA, 15 bp, Homo sapiens
aagaccaccttccct

SEQ ID NO: 4326766 - DNA, 18 bp, Homo sapiens
aagaccaccttcccttcc

SEQ ID NO: 4326767 - DNA, 21 bp, Homo sapiens
aagaccaccttcccttcctca

SEQ ID NO: 4326768 - DNA, 14 bp, Homo sapiens
aagacccaacttgc

SEQ ID NO: 4326769 - DNA, 15 bp, Homo sapiens
aagaccttctcccta

SEQ ID NO: 4326770 - DNA, 21 bp, Homo sapiens
aagacttacctgaataattac

SEQ ID NO: 4326771 - DNA, 17 bp, Homo sapiens
aagacttgtttctttct

SEQ ID NO: 4326772 - DNA, 19 bp, Homo sapiens
aagagaaaccttgcaaact

SEQ ID NO: 4326773 - DNA, 16 bp, Homo sapiens
aagagatctgggcatt

SEQ ID NO: 4326774 - DNA, 15 bp, Homo sapiens
aagaggcttccaagc

SEQ ID NO: 4326775 - DNA, 12 bp, Homo sapiens
aagagggactgt

SEQ ID NO: 4326776 - DNA, 18 bp, Homo sapiens
aagaggttttaaaaaaat

SEQ ID NO: 4326777 - DNA, 12 bp, Homo sapiens
aagaggttttat

SEQ ID NO: 4326778 - DNA, 15 bp, Homo sapiens
aagagtgagaactag

SEQ ID NO: 4326779 - DNA, 17 bp, Homo sapiens
aagagtgttatcatatt

SEQ ID NO: 4326780 - DNA, 20 bp, Homo sapiens
aagagttctatggagacttt

SEQ ID NO: 4326781 - DNA, 19 bp, Homo sapiens
aagataatattaaggaaga

SEQ ID NO: 4326782 - DNA, 20 bp, Homo sapiens
aagataatggataatcttcg

SEQ ID NO: 4326783 - DNA, 18 bp, Homo sapiens
aagatacacaagagggac

SEQ ID NO: 4326784 - DNA, 19 bp, Homo sapiens
aaagcaattaaatgatatt

SEQ ID NO: 4326785 - DNA, 15 bp, Homo sapiens
aaagcattctttaac

SEQ ID NO: 4326786 - DNA, 17 bp, Homo sapiens
aaagccaccttgttaca

SEQ ID NO: 4326787 - DNA, 18 bp, Homo sapiens
aaagccaccttgttacaa

SEQ ID NO: 4326788 - DNA, 20 bp, Homo sapiens
aaagccctatgtgaaaagat

SEQ ID NO: 4326789 - DNA, 18 bp, Homo sapiens
aaagctcaggaatcctac

SEQ ID NO: 4326790 - DNA, 16 bp, Homo sapiens
aaagcttatttttatg

SEQ ID NO: 4326791 - DNA, 22 bp, Homo sapiens
aaagcttatttttatgtggtct

SEQ ID NO: 4326792 - DNA, 20 bp, Homo sapiens
aaagcttgatttgatctttg

SEQ ID NO: 4326793 - DNA, 21 bp, Homo sapiens
aaagcttgatttgatctttgt

SEQ ID NO: 4326794 - DNA, 22 bp, Homo sapiens
aaagcttgatttgatctttgtt

SEQ ID NO: 4326795 - DNA, 16 bp, Homo sapiens
aaagctttatctttgt

SEQ ID NO: 4326796 - DNA, 18 bp, Homo sapiens
aaaggatagtatttttat

SEQ ID NO: 4326797 - DNA, 20 bp, Homo sapiens
aaaggatgatggaaaaatca

SEQ ID NO: 4326798 - DNA, 19 bp, Homo sapiens
aaaggggtgattgaaagaa

SEQ ID NO: 4326799 - DNA, 12 bp, Homo sapiens
aaagtaaacttg

SEQ ID NO: 4326800 - DNA, 13 bp, Homo sapiens
aaagtatagagag

SEQ ID NO: 4326801 - DNA, 16 bp, Homo sapiens
aaagtatgtccttcag

SEQ ID NO: 4326802 - DNA, 18 bp, Homo sapiens
aaagtcgttttccaaact

SEQ ID NO: 4326803 - DNA, 21 bp, Homo sapiens
aaagtgaaacgtaattgtaca

SEQ ID NO: 4326804 - DNA, 15 bp, Homo sapiens
aaagtgccactcatt

SEQ ID NO: 4326805 - DNA, 15 bp, Homo sapiens
aaagtggcatagaga

SEQ ID NO: 4326806 - DNA, 17 bp, Homo sapiens
aaagtggggtacagtaa

SEQ ID NO: 4326807 - DNA, 14 bp, Homo sapiens
aaagtgtacatgaa

SEQ ID NO: 4326808 - DNA, 17 bp, Homo sapiens
aaagttgaaaatacatt

SEQ ID NO: 4326809 - DNA, 20 bp, Homo sapiens
aaagttgctaactgggaaga

SEQ ID NO: 4326810 - DNA, 12 bp, Homo sapiens
aaagttgctttt

SEQ ID NO: 4326811 - DNA, 15 bp, Homo sapiens
aaagttttcctgaga

SEQ ID NO: 4326812 - DNA, 15 bp, Homo sapiens
aaataaactgttttc

SEQ ID NO: 4326813 - DNA, 11 bp, Homo sapiens
aaataaagcct

SEQ ID NO: 4326814 - DNA, 13 bp, Homo sapiens
aaataaagccttt

SEQ ID NO: 4326815 - DNA, 15 bp, Homo sapiens
aaataaatagaaaag

SEQ ID NO: 4326816 - DNA, 21 bp, Homo sapiens
aaataactattttgttttaat

SEQ ID NO: 4326817 - DNA, 13 bp, Homo sapiens
aaataagtatcca

SEQ ID NO: 4326818 - DNA, 18 bp, Homo sapiens
aaatagaaaagtagacaa

SEQ ID NO: 4326819 - DNA, 17 bp, Homo sapiens
aaatagaagaagaggaa

SEQ ID NO: 4326820 - DNA, 17 bp, Homo sapiens
aaatagtttccaagaaa

SEQ ID NO: 4326821 - DNA, 18 bp, Homo sapiens
aaatatatatagttagat

SEQ ID NO: 4326822 - DNA, 19 bp, Homo sapiens
aaatatgaaccctttgttt

SEQ ID NO: 4326823 - DNA, 19 bp, Homo sapiens
aaatattaatatcctgtaa

SEQ ID NO: 4326824 - DNA, 20 bp, Homo sapiens
aaatattcaagtaacacttt

SEQ ID NO: 4326825 - DNA, 16 bp, Homo sapiens
aaatattcatgcttct

SEQ ID NO: 4326826 - DNA, 16 bp, Homo sapiens
aaatattttctgggtt

SEQ ID NO: 4326827 - DNA, 13 bp, Homo sapiens
aaatcaaaaactt

SEQ ID NO: 4326828 - DNA, 14 bp, Homo sapiens
aaatcaaaaacttt

SEQ ID NO: 4326829 - DNA, 22 bp, Homo sapiens
aaatcaaaaacttttcatttca

SEQ ID NO: 4326830 - DNA, 12 bp, Homo sapiens
aaatcaaggatc

SEQ ID NO: 4326831 - DNA, 16 bp, Homo sapiens
aaatcaaggatctttt

SEQ ID NO: 4326832 - DNA, 12 bp, Homo sapiens
aaatcacatttt

SEQ ID NO: 4326833 - DNA, 13 bp, Homo sapiens
aaatcacatttta

SEQ ID NO: 4326834 - DNA, 23 bp, Homo sapiens
aaatcacattttaagtgcttcac

SEQ ID NO: 4326835 - DNA, 19 bp, Homo sapiens
aaatcagccgtgtaaccat

SEQ ID NO: 4326836 - DNA, 23 bp, Homo sapiens
aaatcagcctgctccagctgttc

SEQ ID NO: 4326837 - DNA, 16 bp, Homo sapiens
aaatcatattgagaat

SEQ ID NO: 4326838 - DNA, 18 bp, Homo sapiens
aaatcatattgagaataa

SEQ ID NO: 4326839 - DNA, 21 bp, Homo sapiens
aaatcatttggcttgctgttt

SEQ ID NO: 4326840 - DNA, 15 bp, Homo sapiens
aaatctatgatatat

SEQ ID NO: 4326841 - DNA, 17 bp, Homo sapiens
aaatctatgatatattt

SEQ ID NO: 4326842 - DNA, 16 bp, Homo sapiens
aaatgaactactgcta

SEQ ID NO: 4326843 - DNA, 17 bp, Homo sapiens
aaatgaactactgctat

SEQ ID NO: 4326844 - DNA, 20 bp, Homo sapiens
aaatgaactactgctatttt

SEQ ID NO: 4326845 - DNA, 13 bp, Homo sapiens
aaatgaagcagag

SEQ ID NO: 4326846 - DNA, 19 bp, Homo sapiens
aaatgaatattttgataat

SEQ ID NO: 4326847 - DNA, 18 bp, Homo sapiens
aaatgaatttcatgtgaa

SEQ ID NO: 4326848 - DNA, 15 bp, Homo sapiens
aaatgactattgtaa

SEQ ID NO: 4326849 - DNA, 16 bp, Homo sapiens
aaatgactattgtaat

SEQ ID NO: 4326850 - DNA, 16 bp, Homo sapiens
aaatgagggtttctga

SEQ ID NO: 4326851 - DNA, 13 bp, Homo sapiens
aaatgagttactt

SEQ ID NO: 4326852 - DNA, 16 bp, Homo sapiens
aaatggatagaaaaaa

SEQ ID NO: 4326853 - DNA, 21 bp, Homo sapiens
aaatggatagaaaaaaactaa

SEQ ID NO: 4326854 - DNA, 14 bp, Homo sapiens
aaatggatatagaa

SEQ ID NO: 4326855 - DNA, 14 bp, Homo sapiens
aaatggatgacaaa

SEQ ID NO: 4326856 - DNA, 23 bp, Homo sapiens
aaatggatgacaaagaaaatgag

SEQ ID NO: 4326857 - DNA, 17 bp, Homo sapiens
aaatggatgcaaagtac

SEQ ID NO: 4326858 - DNA, 11 bp, Homo sapiens
aaatggctgct

SEQ ID NO: 4326859 - DNA, 16 bp, Homo sapiens
aaatgggagcaacata

SEQ ID NO: 4326860 - DNA, 21 bp, Homo sapiens
aaatggtatggccaaaagtca

SEQ ID NO: 4326861 - DNA, 16 bp, Homo sapiens
aaatgtaatgtcagac

SEQ ID NO: 4326862 - DNA, 18 bp, Homo sapiens
aaatgtaatgtcagactt

SEQ ID NO: 4326863 - DNA, 17 bp, Homo sapiens
aaatgtagactctgact

SEQ ID NO: 4326864 - DNA, 13 bp, Homo sapiens
aaatgttaagaaa

SEQ ID NO: 4326865 - DNA, 14 bp, Homo sapiens
aaatgttaagaaag

SEQ ID NO: 4326866 - DNA, 19 bp, Homo sapiens
caaggccggagacccacag

SEQ ID NO: 4326867 - DNA, 14 bp, Homo sapiens
caaggctgcgtctg

SEQ ID NO: 4326868 - DNA, 14 bp, Homo sapiens
caaggcttatctct

SEQ ID NO: 4326869 - DNA, 13 bp, Homo sapiens
caagtaacacttt

SEQ ID NO: 4326870 - DNA, 15 bp, Homo sapiens
caagtaaggctttta

SEQ ID NO: 4326871 - DNA, 18 bp, Homo sapiens
caagtctcctagacactc

SEQ ID NO: 4326872 - DNA, 22 bp, Homo sapiens
caagtgaaaaaggaggaagaga

SEQ ID NO: 4326873 - DNA, 23 bp, Homo sapiens
caagtgaaaaaggaggaagagaa

SEQ ID NO: 4326874 - DNA, 15 bp, Homo sapiens
caagtgaacttggga

SEQ ID NO: 4326875 - DNA, 13 bp, Homo sapiens
caagtgtcacctc

SEQ ID NO: 4326876 - DNA, 14 bp, Homo sapiens
caagtgtcacctcc

SEQ ID NO: 4326877 - DNA, 20 bp, Homo sapiens
caagtttttctctcaaatga

SEQ ID NO: 4326878 - DNA, 23 bp, Homo sapiens
caatagaacatgcaagaatttct

SEQ ID NO: 4326879 - DNA, 16 bp, Homo sapiens
caatagtcatatgtga

SEQ ID NO: 4326880 - DNA, 23 bp, Homo sapiens
caatagtcatatgtgaagacaga

SEQ ID NO: 4326881 - DNA, 12 bp, Homo sapiens
caatatatttgt

SEQ ID NO: 4326882 - DNA, 11 bp, Homo sapiens
caatatgctta

SEQ ID NO: 4326883 - DNA, 20 bp, Homo sapiens
caatccagagaagcgctgtt

SEQ ID NO: 4326884 - DNA, 20 bp, Homo sapiens
caatcgacatcctagcccca

SEQ ID NO: 4326885 - DNA, 14 bp, Homo sapiens
caatcttaagagga

SEQ ID NO: 4326886 - DNA, 20 bp, Homo sapiens
caatgaaaagtcgttttcca

SEQ ID NO: 4326887 - DNA, 23 bp, Homo sapiens
caatgatacccaacagtttattt

SEQ ID NO: 4326888 - DNA, 20 bp, Homo sapiens
caatgcccgtaatgcttaga

SEQ ID NO: 4326889 - DNA, 13 bp, Homo sapiens
caatggagaaaat

SEQ ID NO: 4326890 - DNA, 22 bp, Homo sapiens
caatggagaaaatgaatggaca

SEQ ID NO: 4326891 - DNA, 15 bp, Homo sapiens
caatggagaaatgaa

SEQ ID NO: 4326892 - DNA, 22 bp, Homo sapiens
caatgtgaaaagaaaaatgagc

SEQ ID NO: 4326893 - DNA, 16 bp, Homo sapiens
caatgtgtttttctcc

SEQ ID NO: 4326894 - DNA, 17 bp, Homo sapiens
caatgtgtttttctcca

SEQ ID NO: 4326895 - DNA, 14 bp, Homo sapiens
caatgttctctctt

SEQ ID NO: 4326896 - DNA, 21 bp, Homo sapiens
caattccaatatttctgcttt

SEQ ID NO: 4326897 - DNA, 15 bp, Homo sapiens
caattgcagatgcca

SEQ ID NO: 4326898 - DNA, 13 bp, Homo sapiens
caatttatgcaga

SEQ ID NO: 4326899 - DNA, 20 bp, Homo sapiens
caatttggagcattaactaa

SEQ ID NO: 4326900 - DNA, 22 bp, Homo sapiens
caatttggagcattaactaaat

SEQ ID NO: 4326901 - DNA, 13 bp, Homo sapiens
cacaaagagacca

SEQ ID NO: 4326902 - DNA, 13 bp, Homo sapiens
cacaaaggagagc

SEQ ID NO: 4326903 - DNA, 17 bp, Homo sapiens
cacaagccttactcacc

SEQ ID NO: 4326904 - DNA, 20 bp, Homo sapiens
cacaagccttactcacctct

SEQ ID NO: 4326905 - DNA, 21 bp, Homo sapiens
cacaagccttactcacctctc

SEQ ID NO: 4326906 - DNA, 22 bp, Homo sapiens
cacaagccttactcacctctct

SEQ ID NO: 4326907 - DNA, 17 bp, Homo sapiens
cacaagctgcaccctca

SEQ ID NO: 4326908 - DNA, 18 bp, Homo sapiens
cacaaggattgaaaattc

SEQ ID NO: 4326909 - DNA, 16 bp, Homo sapiens
cacaaggccagaaaaa

SEQ ID NO: 4326910 - DNA, 17 bp, Homo sapiens
cacaaggccagaaaaag

SEQ ID NO: 4326911 - DNA, 21 bp, Homo sapiens
cacaaggccagaaaaagaaga

SEQ ID NO: 4326912 - DNA, 17 bp, Homo sapiens
cacaagtagcctctggg

SEQ ID NO: 4326913 - DNA, 20 bp, Homo sapiens
cacacaggagtcctttcttt

SEQ ID NO: 4326914 - DNA, 16 bp, Homo sapiens
cacacccacctctgcc

SEQ ID NO: 4326915 - DNA, 16 bp, Homo sapiens
cacaccgctggctccg

SEQ ID NO: 4326916 - DNA, 13 bp, Homo sapiens
cacactaagaaat

SEQ ID NO: 4326917 - DNA, 17 bp, Homo sapiens
cacagatatactttgtg

SEQ ID NO: 4326918 - DNA, 20 bp, Homo sapiens
cacagatatactttgtggac

SEQ ID NO: 4326919 - DNA, 23 bp, Homo sapiens
cacagatatactttgtggaccaa

SEQ ID NO: 4326920 - DNA, 21 bp, Homo sapiens
cacagcaggatgctaatggaa

SEQ ID NO: 4326921 - DNA, 14 bp, Homo sapiens
cacagccctgaaac

SEQ ID NO: 4326922 - DNA, 11 bp, Homo sapiens
cacagccctgg

SEQ ID NO: 4326923 - DNA, 22 bp, Homo sapiens
cacaggagtcctttcttttgaa

SEQ ID NO: 4326924 - DNA, 15 bp, Homo sapiens
cacaggcagctctga

SEQ ID NO: 4326925 - DNA, 15 bp, Homo sapiens
cacagtaatgtagaa

SEQ ID NO: 4326926 - DNA, 17 bp, Homo sapiens
cacagtaatgtagaaat

SEQ ID NO: 4326927 - DNA, 15 bp, Homo sapiens
cacataaatgaaaga

SEQ ID NO: 4326928 - DNA, 17 bp, Homo sapiens
cacataaatgaaagaaa

SEQ ID NO: 4326929 - DNA, 14 bp, Homo sapiens
cacatctttcctgt

SEQ ID NO: 4326930 - DNA, 17 bp, Homo sapiens
cacatgctgagtctccc

SEQ ID NO: 4326931 - DNA, 22 bp, Homo sapiens
cacatgctgagtctcccaaggc

SEQ ID NO: 4326932 - DNA, 14 bp, Homo sapiens
cacatgtgctgatg

SEQ ID NO: 4326933 - DNA, 20 bp, Homo sapiens
cacattgggtctctggtcct

SEQ ID NO: 4326934 - DNA, 17 bp, Homo sapiens
cacatttcctctctatc

SEQ ID NO: 4326935 - DNA, 13 bp, Homo sapiens
cacattttaagtg

SEQ ID NO: 4326936 - DNA, 15 bp, Homo sapiens
caccagcagcctgga

SEQ ID NO: 4326937 - DNA, 14 bp, Homo sapiens
caccagcccctgcc

SEQ ID NO: 4326938 - DNA, 15 bp, Homo sapiens
caccagcccctgccc

SEQ ID NO: 4326939 - DNA, 17 bp, Homo sapiens
caccagcccctgcccca

SEQ ID NO: 4326940 - DNA, 21 bp, Homo sapiens
caccagcccctgccccagccc

SEQ ID NO: 4326941 - DNA, 14 bp, Homo sapiens
caccagctggtata

SEQ ID NO: 4326942 - DNA, 17 bp, Homo sapiens
caccagctggtatattg

SEQ ID NO: 4326943 - DNA, 16 bp, Homo sapiens
caccagggagaggcct

SEQ ID NO: 4326944 - DNA, 17 bp, Homo sapiens
caccagggagaggcctc

SEQ ID NO: 4326945 - DNA, 17 bp, Homo sapiens
caccagggcactgtctg

SEQ ID NO: 4326946 - DNA, 15 bp, Homo sapiens
cacccacaaagaaac

SEQ ID NO: 4326947 - DNA, 15 bp, Homo sapiens
cacccacctctgcca

SEQ ID NO: 4326948 - DNA, 15 bp, Homo sapiens
cacccagaggtggcc

SEQ ID NO: 4326949 - DNA, 17 bp, Homo sapiens
cacccagaggtggccct

SEQ ID NO: 4326950 - DNA, 18 bp, Homo sapiens
cacccagaggtggccctc

SEQ ID NO: 4326951 - DNA, 15 bp, Homo sapiens
caccccagcatcagc

SEQ ID NO: 4326952 - DNA, 13 bp, Homo sapiens
caccccagccccc

SEQ ID NO: 4326953 - DNA, 14 bp, Homo sapiens
caccccagccccca

SEQ ID NO: 4326954 - DNA, 17 bp, Homo sapiens
caccccagcccccacag

SEQ ID NO: 4326955 - DNA, 18 bp, Homo sapiens
cacccccaattccttgag

SEQ ID NO: 4326956 - DNA, 20 bp, Homo sapiens
cacccctgcctcctgcctcc

SEQ ID NO: 4326957 - DNA, 17 bp, Homo sapiens
cacccgacctctgactg

SEQ ID NO: 4326958 - DNA, 17 bp, Homo sapiens
caccctgaaagccctga

SEQ ID NO: 4326959 - DNA, 20 bp, Homo sapiens
caccctgtctcagtacctcc

SEQ ID NO: 4326960 - DNA, 20 bp, Homo sapiens
cacccttaagctgtagagag

SEQ ID NO: 4326961 - DNA, 12 bp, Homo sapiens
cacctccttccc

SEQ ID NO: 4326962 - DNA, 17 bp, Homo sapiens
cacctccttccccagct

SEQ ID NO: 4326963 - DNA, 19 bp, Homo sapiens
cacctctgcacaagctgca

SEQ ID NO: 4326964 - DNA, 15 bp, Homo sapiens
cacgaactgttcaca

SEQ ID NO: 4326965 - DNA, 20 bp, Homo sapiens
cacgactgttgtacaagctc

SEQ ID NO: 4326966 - DNA, 21 bp, Homo sapiens
cacgactgttgtacaagctca

SEQ ID NO: 4326967 - DNA, 11 bp, Homo sapiens
cacgattttaa

SEQ ID NO: 4326968 - DNA, 16 bp, Homo sapiens
cacgattttaaaatga

SEQ ID NO: 4326969 - DNA, 17 bp, Homo sapiens
cacgcacttcgggaggt

SEQ ID NO: 4326970 - DNA, 15 bp, Homo sapiens
cacgctccccgcctg

SEQ ID NO: 4326971 - DNA, 18 bp, Homo sapiens
cacgctccccgcctgttc

SEQ ID NO: 4326972 - DNA, 18 bp, Homo sapiens
cacggaaacatagaaaca

SEQ ID NO: 4326973 - DNA, 16 bp, Homo sapiens
cacggaagagccttgc

SEQ ID NO: 4326974 - DNA, 22 bp, Homo sapiens
cacggaagagccttgcggaagg

SEQ ID NO: 4326975 - DNA, 21 bp, Homo sapiens
cacggggcaggaccttccttc

SEQ ID NO: 4326976 - DNA, 21 bp, Homo sapiens
cacgtgcgtgtgagtgtgtgt

SEQ ID NO: 4326977 - DNA, 13 bp, Homo sapiens
cacgtggccagga

SEQ ID NO: 4326978 - DNA, 14 bp, Homo sapiens
cactaacaaaattt

SEQ ID NO: 4326979 - DNA, 21 bp, Homo sapiens
cactaacaaaatttgaataat

SEQ ID NO: 4326980 - DNA, 14 bp, Homo sapiens
cactaattccttaa

SEQ ID NO: 4326981 - DNA, 19 bp, Homo sapiens
cactaattccttaaatgaa

SEQ ID NO: 4326982 - DNA, 12 bp, Homo sapiens
cactactgggtg

SEQ ID NO: 4326983 - DNA, 16 bp, Homo sapiens
cactactgggtgtcat

SEQ ID NO: 4326984 - DNA, 23 bp, Homo sapiens
cactagagaatgcacagatatac

SEQ ID NO: 4326985 - DNA, 19 bp, Homo sapiens
caggagggagagcctctgt

SEQ ID NO: 4326986 - DNA, 16 bp, Homo sapiens
caggagtcctttcttt

SEQ ID NO: 4326987 - DNA, 16 bp, Homo sapiens
caggcagctctgagcc

SEQ ID NO: 4326988 - DNA, 15 bp, Homo sapiens
caggcaggtgggatg

SEQ ID NO: 4326989 - DNA, 17 bp, Homo sapiens
caggctactctgcccac

SEQ ID NO: 4326990 - DNA, 22 bp, Homo sapiens
caggctgcttcaatcccagcct

SEQ ID NO: 4326991 - DNA, 19 bp, Homo sapiens
cagggaaggaatcctggtg

SEQ ID NO: 4326992 - DNA, 20 bp, Homo sapiens
cagggaaggaatcctggtgg

SEQ ID NO: 4326993 - DNA, 12 bp, Homo sapiens
cagggagaagtt

SEQ ID NO: 4326994 - DNA, 15 bp, Homo sapiens
cagggagaggcctcg

SEQ ID NO: 4326995 - DNA, 17 bp, Homo sapiens
cagggagaggcctcggc

SEQ ID NO: 4326996 - DNA, 14 bp, Homo sapiens
cagggagcctcctg

SEQ ID NO: 4326997 - DNA, 15 bp, Homo sapiens
cagggcactgtctgc

SEQ ID NO: 4326998 - DNA, 18 bp, Homo sapiens
cagggctggtcacctccc

SEQ ID NO: 4326999 - DNA, 21 bp, Homo sapiens
cagggtgaagcaccagggaga

SEQ ID NO: 4327000 - DNA, 22 bp, Homo sapiens
cagggtgaagcaccagggagag

SEQ ID NO: 4327001 - DNA, 15 bp, Homo sapiens
caggtccggggagga

SEQ ID NO: 4327002 - DNA, 18 bp, Homo sapiens
caggtccggggaggaggt

SEQ ID NO: 4327003 - DNA, 13 bp, Homo sapiens
caggtctctgtgg

SEQ ID NO: 4327004 - DNA, 20 bp, Homo sapiens
caggtgagaagcagaggaag

SEQ ID NO: 4327005 - DNA, 21 bp, Homo sapiens
caggtgagaagcagaggaagg

SEQ ID NO: 4327006 - DNA, 18 bp, Homo sapiens
caggtggttatggagagg

SEQ ID NO: 4327007 - DNA, 17 bp, Homo sapiens
cagtaaagaggcttcca

SEQ ID NO: 4327008 - DNA, 23 bp, Homo sapiens
cagtaaagaggcttccaagcatt

SEQ ID NO: 4327009 - DNA, 13 bp, Homo sapiens
cagtaatgtagaa

SEQ ID NO: 4327010 - DNA, 15 bp, Homo sapiens
cagtaatgtagaaat

SEQ ID NO: 4327011 - DNA, 17 bp, Homo sapiens
cagtaatgtagaaatgt

SEQ ID NO: 4327012 - DNA, 15 bp, Homo sapiens
cagtacaatcagcag

SEQ ID NO: 4327013 - DNA, 16 bp, Homo sapiens
cagtagaattttagtc

SEQ ID NO: 4327014 - DNA, 22 bp, Homo sapiens
cagtataatctcctctgctcat

SEQ ID NO: 4327015 - DNA, 11 bp, Homo sapiens
cagtattttcc

SEQ ID NO: 4327016 - DNA, 18 bp, Homo sapiens
cagtattttccagcctta

SEQ ID NO: 4327017 - DNA, 12 bp, Homo sapiens
cagtcatgcact

SEQ ID NO: 4327018 - DNA, 16 bp, Homo sapiens
cagtcatgcactcaca

SEQ ID NO: 4327019 - DNA, 18 bp, Homo sapiens
cagtcccccaaccccagc

SEQ ID NO: 4327020 - DNA, 13 bp, Homo sapiens
cagtgagtgccat

SEQ ID NO: 4327021 - DNA, 21 bp, Homo sapiens
cagtgagtgccatgctttttg

SEQ ID NO: 4327022 - DNA, 18 bp, Homo sapiens
cagtgccgagaaggaagc

SEQ ID NO: 4327023 - DNA, 16 bp, Homo sapiens
cagtgctcctggccct

SEQ ID NO: 4327024 - DNA, 22 bp, Homo sapiens
cagtgctgtccatgcttctcat

SEQ ID NO: 4327025 - DNA, 15 bp, Homo sapiens
cagtgggttaattat

SEQ ID NO: 4327026 - DNA, 19 bp, Homo sapiens
cagtgtcgggaattttccc

SEQ ID NO: 4327027 - DNA, 14 bp, Homo sapiens
cagtgttgacatag

SEQ ID NO: 4327028 - DNA, 15 bp, Homo sapiens
cagtgttgacatagc

SEQ ID NO: 4327029 - DNA, 21 bp, Homo sapiens
cagtgttgacatagcctttgt

SEQ ID NO: 4327030 - DNA, 19 bp, Homo sapiens
cagttaaaatcacatttta

SEQ ID NO: 4327031 - DNA, 20 bp, Homo sapiens
cagttaaataaatagaaaga

SEQ ID NO: 4327032 - DNA, 17 bp, Homo sapiens
cagttataagcgtattt

SEQ ID NO: 4327033 - DNA, 17 bp, Homo sapiens
cagttctctgccaaagc

SEQ ID NO: 4327034 - DNA, 15 bp, Homo sapiens
cagttggcccttctg

SEQ ID NO: 4327035 - DNA, 13 bp, Homo sapiens
cagtttattttct

SEQ ID NO: 4327036 - DNA, 19 bp, Homo sapiens
cagtttattttctgtgtaa

SEQ ID NO: 4327037 - DNA, 15 bp, Homo sapiens
cagtttcatgtatgt

SEQ ID NO: 4327038 - DNA, 14 bp, Homo sapiens
cataaaattctaga

SEQ ID NO: 4327039 - DNA, 17 bp, Homo sapiens
cataaagtcatcaaagt

SEQ ID NO: 4327040 - DNA, 16 bp, Homo sapiens
cataagtttaactgta

SEQ ID NO: 4327041 - DNA, 18 bp, Homo sapiens
cataattcctacagcact

SEQ ID NO: 4327042 - DNA, 19 bp, Homo sapiens
cataattcctacagcacta

SEQ ID NO: 4327043 - DNA, 21 bp, Homo sapiens
cataatttgtcttagttgata

SEQ ID NO: 4327044 - DNA, 21 bp, Homo sapiens
catacacaaggccagaaaaag

SEQ ID NO: 4327045 - DNA, 22 bp, Homo sapiens
catacacaaggccagaaaaaga

SEQ ID NO: 4327046 - DNA, 17 bp, Homo sapiens
catacacacatacatac

SEQ ID NO: 4327047 - DNA, 14 bp, Homo sapiens
catacatacataca

SEQ ID NO: 4327048 - DNA, 15 bp, Homo sapiens
cataccttctcccag

SEQ ID NO: 4327049 - DNA, 17 bp, Homo sapiens
cataggctggtggcctt

SEQ ID NO: 4327050 - DNA, 20 bp, Homo sapiens
cataggctggtggccttggg

SEQ ID NO: 4327051 - DNA, 19 bp, Homo sapiens
cataggctgtgtttacatg

SEQ ID NO: 4327052 - DNA, 18 bp, Homo sapiens
catagtgtcaagaaggaa

SEQ ID NO: 4327053 - DNA, 13 bp, Homo sapiens
catataaaaacaa

SEQ ID NO: 4327054 - DNA, 15 bp, Homo sapiens
catataaaaacaata

SEQ ID NO: 4327055 - DNA, 17 bp, Homo sapiens
catatatgctgtatttc

SEQ ID NO: 4327056 - DNA, 18 bp, Homo sapiens
catatatgctgtatttct

SEQ ID NO: 4327057 - DNA, 16 bp, Homo sapiens
catatatgcttccaga

SEQ ID NO: 4327058 - DNA, 23 bp, Homo sapiens
catatcaaaaagtattaaaacta

SEQ ID NO: 4327059 - DNA, 17 bp, Homo sapiens
catatgaccattgaaaa

SEQ ID NO: 4327060 - DNA, 21 bp, Homo sapiens
catatgcagaacgtatttagc

SEQ ID NO: 4327061 - DNA, 19 bp, Homo sapiens
catatgctcctagagagga

SEQ ID NO: 4327062 - DNA, 23 bp, Homo sapiens
catatgctcctagagaggagaaa

SEQ ID NO: 4327063 - DNA, 15 bp, Homo sapiens
catatggaggcctga

SEQ ID NO: 4327064 - DNA, 15 bp, Homo sapiens
catatgttaaagctt

SEQ ID NO: 4327065 - DNA, 23 bp, Homo sapiens
catatgttaaagcttatttttat

SEQ ID NO: 4327066 - DNA, 16 bp, Homo sapiens
catattgaatgtttcc

SEQ ID NO: 4327067 - DNA, 24 bp, Homo sapiens
catcaaagtggggtacagtaaaga

SEQ ID NO: 4327068 - DNA, 21 bp, Homo sapiens
catcaacaaaagggagaacat

SEQ ID NO: 4327069 - DNA, 19 bp, Homo sapiens
catcacagtgggaagaata

SEQ ID NO: 4327070 - DNA, 13 bp, Homo sapiens
catcagatttctt

SEQ ID NO: 4327071 - DNA, 22 bp, Homo sapiens
catcagatttcttaatgtctgt

SEQ ID NO: 4327072 - DNA, 16 bp, Homo sapiens
catcagcttaatttaa

SEQ ID NO: 4327073 - DNA, 17 bp, Homo sapiens
catcatcctcagcagca

SEQ ID NO: 4327074 - DNA, 20 bp, Homo sapiens
catcccgtaagaccaccttc

SEQ ID NO: 4327075 - DNA, 12 bp, Homo sapiens
catcctagcccc

SEQ ID NO: 4327076 - DNA, 13 bp, Homo sapiens
catcctagcccca

SEQ ID NO: 4327077 - DNA, 19 bp, Homo sapiens
catcctagccccacccaga

SEQ ID NO: 4327078 - DNA, 14 bp, Homo sapiens
catcctcagcagca

SEQ ID NO: 4327079 - DNA, 12 bp, Homo sapiens
catctaaagctt

SEQ ID NO: 4327080 - DNA, 13 bp, Homo sapiens
catctaaagcttt

SEQ ID NO: 4327081 - DNA, 17 bp, Homo sapiens
catctaaagctttatct

SEQ ID NO: 4327082 - DNA, 23 bp, Homo sapiens
catctagtttccctggtgccctt

SEQ ID NO: 4327083 - DNA, 18 bp, Homo sapiens
aagaggatggatgaatct

SEQ ID NO: 4327084 - DNA, 13 bp, Homo sapiens
aagagggactgta

SEQ ID NO: 4327085 - DNA, 21 bp, Homo sapiens
aagataatattaaggaagaca

SEQ ID NO: 4327086 - DNA, 19 bp, Homo sapiens
aagatgccaacagacacta

SEQ ID NO: 4327087 - DNA, 15 bp, Homo sapiens
aagatggagaggaag

SEQ ID NO: 4327088 - DNA, 17 bp, Homo sapiens
aagatggagaggaagaa

SEQ ID NO: 4327089 - DNA, 23 bp, Homo sapiens
aagatggagaggaagaaacgcta

SEQ ID NO: 4327090 - DNA, 17 bp, Homo sapiens
aagatgggggcaagaag

SEQ ID NO: 4327091 - DNA, 21 bp, Homo sapiens
aagcaaagatttcagtagaat

SEQ ID NO: 4327092 - DNA, 19 bp, Homo sapiens
aagcaaatttcattatcta

SEQ ID NO: 4327093 - DNA, 23 bp, Homo sapiens
aagcaaatttcattatctaatga

SEQ ID NO: 4327094 - DNA, 14 bp, Homo sapiens
aagcaacctttccc

SEQ ID NO: 4327095 - DNA, 16 bp, Homo sapiens
aagcaattaaatgata

SEQ ID NO: 4327096 - DNA, 13 bp, Homo sapiens
aagcacaagaagc

SEQ ID NO: 4327097 - DNA, 13 bp, Homo sapiens
aagcagaggaagg

SEQ ID NO: 4327098 - DNA, 23 bp, Homo sapiens
aagcagaggaaggaaacatagaa

SEQ ID NO: 4327099 - DNA, 21 bp, Homo sapiens
aagcagaggaaggagaggaga

SEQ ID NO: 4327100 - DNA, 15 bp, Homo sapiens
aagcagtaaaataaa

SEQ ID NO: 4327101 - DNA, 17 bp, Homo sapiens
aagcagtaaaataaaaa

SEQ ID NO: 4327102 - DNA, 19 bp, Homo sapiens
aagccctgagctttctgct

SEQ ID NO: 4327103 - DNA, 21 bp, Homo sapiens
aagccgtgattttcattgctg

SEQ ID NO: 4327104 - DNA, 16 bp, Homo sapiens
aagcctcccacgactg

SEQ ID NO: 4327105 - DNA, 19 bp, Homo sapiens
aagcctcctccagccgcca

SEQ ID NO: 4327106 - DNA, 23 bp, Homo sapiens
aagcctgcaggtccggggaggag

SEQ ID NO: 4327107 - DNA, 11 bp, Homo sapiens
aagcctgccct

SEQ ID NO: 4327108 - DNA, 15 bp, Homo sapiens
aagcctgtaattatg

SEQ ID NO: 4327109 - DNA, 14 bp, Homo sapiens
aagccttttaaatc

SEQ ID NO: 4327110 - DNA, 17 bp, Homo sapiens
aagccttttaaatcatc

SEQ ID NO: 4327111 - DNA, 20 bp, Homo sapiens
aagcgctgttgcccgccctc

SEQ ID NO: 4327112 - DNA, 21 bp, Homo sapiens
aagcgtgcacaaggattgaaa

SEQ ID NO: 4327113 - DNA, 23 bp, Homo sapiens
aagcgtgcacaaggattgaaaat

SEQ ID NO: 4327114 - DNA, 12 bp, Homo sapiens
aagctaaagaaa

SEQ ID NO: 4327115 - DNA, 14 bp, Homo sapiens
aagctaaagaaact

SEQ ID NO: 4327116 - DNA, 16 bp, Homo sapiens
aagctaggaaagagga

SEQ ID NO: 4327117 - DNA, 19 bp, Homo sapiens
aagctcccacacccacctc

SEQ ID NO: 4327118 - DNA, 20 bp, Homo sapiens
aagctgatttcccttttttc

SEQ ID NO: 4327119 - DNA, 13 bp, Homo sapiens
aagctgcaccctc

SEQ ID NO: 4327120 - DNA, 21 bp, Homo sapiens
aagctgcaccctcaggcaggt

SEQ ID NO: 4327121 - DNA, 22 bp, Homo sapiens
aagctgcaccctcaggcaggtg

SEQ ID NO: 4327122 - DNA, 17 bp, Homo sapiens
aagcttctagacactcc

SEQ ID NO: 4327123 - DNA, 22 bp, Homo sapiens
aagcttgatttgatctttgttt

SEQ ID NO: 4327124 - DNA, 14 bp, Homo sapiens
aagctttatctttg

SEQ ID NO: 4327125 - DNA, 17 bp, Homo sapiens
aagctttatctttgtgt

SEQ ID NO: 4327126 - DNA, 14 bp, Homo sapiens
aagcttttcctttc

SEQ ID NO: 4327127 - DNA, 15 bp, Homo sapiens
aaggaaacatagaaa

SEQ ID NO: 4327128 - DNA, 17 bp, Homo sapiens
aaggaaacatagaaaga

SEQ ID NO: 4327129 - DNA, 20 bp, Homo sapiens
aaggaaattaagaactgaat

SEQ ID NO: 4327130 - DNA, 13 bp, Homo sapiens
aaggaagatttga

SEQ ID NO: 4327131 - DNA, 21 bp, Homo sapiens
aaggacatgagactaagagaa

SEQ ID NO: 4327132 - DNA, 17 bp, Homo sapiens
aaggagaaggagtgcca

SEQ ID NO: 4327133 - DNA, 18 bp, Homo sapiens
aaggaggaagagaaaaaa

SEQ ID NO: 4327134 - DNA, 14 bp, Homo sapiens
aaggaggtggctgt

SEQ ID NO: 4327135 - DNA, 12 bp, Homo sapiens
aaggagtgccat

SEQ ID NO: 4327136 - DNA, 14 bp, Homo sapiens
aaggatatactgca

SEQ ID NO: 4327137 - DNA, 21 bp, Homo sapiens
aaggccaataaagagttagaa

SEQ ID NO: 4327138 - DNA, 14 bp, Homo sapiens
aaggctgcgtctgg

SEQ ID NO: 4327139 - DNA, 16 bp, Homo sapiens
aaggctgcgtctggag

SEQ ID NO: 4327140 - DNA, 16 bp, Homo sapiens
aaggctgggggaagaa

SEQ ID NO: 4327141 - DNA, 21 bp, Homo sapiens
aaggctttaaaagtcattatt

SEQ ID NO: 4327142 - DNA, 20 bp, Homo sapiens
aagggcatcatcctcagcag

SEQ ID NO: 4327143 - DNA, 22 bp, Homo sapiens
aagggcatcatcctcagcagca

SEQ ID NO: 4327144 - DNA, 21 bp, Homo sapiens
aagggcgggcaaggagtgggg

SEQ ID NO: 4327145 - DNA, 20 bp, Homo sapiens
aaggggatgggaaataaaga

SEQ ID NO: 4327146 - DNA, 13 bp, Homo sapiens
aaggggtgattga

SEQ ID NO: 4327147 - DNA, 14 bp, Homo sapiens
aaggtacaatcaaa

SEQ ID NO: 4327148 - DNA, 16 bp, Homo sapiens
aagtaaacttgtgtat

SEQ ID NO: 4327149 - DNA, 12 bp, Homo sapiens
aagtaacacttt

SEQ ID NO: 4327150 - DNA, 21 bp, Homo sapiens
aagtaacactttaaaaccagt

SEQ ID NO: 4327151 - DNA, 14 bp, Homo sapiens
aagtaataaaaaga

SEQ ID NO: 4327152 - DNA, 16 bp, Homo sapiens
aagtaatatttaaaga

SEQ ID NO: 4327153 - DNA, 19 bp, Homo sapiens
aagtactgtttaccatttt

SEQ ID NO: 4327154 - DNA, 19 bp, Homo sapiens
aagtagacaatcattgttt

SEQ ID NO: 4327155 - DNA, 22 bp, Homo sapiens
aagtagcctctgggatctgcca

SEQ ID NO: 4327156 - DNA, 13 bp, Homo sapiens
aagtataaggtgc

SEQ ID NO: 4327157 - DNA, 13 bp, Homo sapiens
aagtatagagaga

SEQ ID NO: 4327158 - DNA, 14 bp, Homo sapiens
aagtatagagagaa

SEQ ID NO: 4327159 - DNA, 23 bp, Homo sapiens
aagtatagagagaagttcataca

SEQ ID NO: 4327160 - DNA, 15 bp, Homo sapiens
aagtatatgtgagaa

SEQ ID NO: 4327161 - DNA, 21 bp, Homo sapiens
aagtcaagtgaaaaaggagga

SEQ ID NO: 4327162 - DNA, 17 bp, Homo sapiens
aagtcagagttaaaata

SEQ ID NO: 4327163 - DNA, 18 bp, Homo sapiens
aagtcagagttaaaatat

SEQ ID NO: 4327164 - DNA, 13 bp, Homo sapiens
aagtcatcaaagt

SEQ ID NO: 4327165 - DNA, 21 bp, Homo sapiens
aagtccaaatgtttacaggga

SEQ ID NO: 4327166 - DNA, 15 bp, Homo sapiens
aagtcgttttccaaa

SEQ ID NO: 4327167 - DNA, 23 bp, Homo sapiens
aagtctgagttctctttcttagt

SEQ ID NO: 4327168 - DNA, 21 bp, Homo sapiens
aagtgaaaaaggaggaagaga

SEQ ID NO: 4327169 - DNA, 17 bp, Homo sapiens
aagtgaacttgggaggg

SEQ ID NO: 4327170 - DNA, 14 bp, Homo sapiens
aagtgaatccttaa

SEQ ID NO: 4327171 - DNA, 16 bp, Homo sapiens
aagtgaatttatgaga

SEQ ID NO: 4327172 - DNA, 12 bp, Homo sapiens
aagtgacataat

SEQ ID NO: 4327173 - DNA, 17 bp, Homo sapiens
aagtgagagttggggag

SEQ ID NO: 4327174 - DNA, 20 bp, Homo sapiens
aagtgccactcattcctgta

SEQ ID NO: 4327175 - DNA, 23 bp, Homo sapiens
aagtgctgtcttgatgactgctg

SEQ ID NO: 4327176 - DNA, 17 bp, Homo sapiens
aagtgcttcacatttgt

SEQ ID NO: 4327177 - DNA, 21 bp, Homo sapiens
aagtggcatagagaatacaca

SEQ ID NO: 4327178 - DNA, 23 bp, Homo sapiens
aagtggggtacagtaaagaggct

SEQ ID NO: 4327179 - DNA, 16 bp, Homo sapiens
aagtgtaatagattat

SEQ ID NO: 4327180 - DNA, 16 bp, Homo sapiens
aagtgtacatgaagaa

SEQ ID NO: 4327181 - DNA, 18 bp, Homo sapiens
aagtgtcacctccttccc

SEQ ID NO: 4327182 - DNA, 22 bp, Homo sapiens
aagtgtcacctccttccccagc

SEQ ID NO: 4327183 - DNA, 14 bp, Homo sapiens
aagtgtcatttctt

SEQ ID NO: 4327184 - DNA, 15 bp, Homo sapiens
aagtgtcatttcttt

SEQ ID NO: 4327185 - DNA, 20 bp, Homo sapiens
aagtgttcagtgttgacata

SEQ ID NO: 4327186 - DNA, 15 bp, Homo sapiens
aagttaagtgtcatt

SEQ ID NO: 4327187 - DNA, 20 bp, Homo sapiens
aagttgaaaatacattctta

SEQ ID NO: 4327188 - DNA, 23 bp, Homo sapiens
aagtttgtagtttttgctgaagg

SEQ ID NO: 4327189 - DNA, 13 bp, Homo sapiens
aagttttcctgag

SEQ ID NO: 4327190 - DNA, 13 bp, Homo sapiens
aataaaaaataaa

SEQ ID NO: 4327191 - DNA, 14 bp, Homo sapiens
aataaaaattatga

SEQ ID NO: 4327192 - DNA, 18 bp, Homo sapiens
aataaactgttttcaagt

SEQ ID NO: 4327193 - DNA, 14 bp, Homo sapiens
aataaagaaaattc

SEQ ID NO: 4327194 - DNA, 18 bp, Homo sapiens
aataaagagttagaatga

SEQ ID NO: 4327195 - DNA, 12 bp, Homo sapiens
aataaagccttt

SEQ ID NO: 4327196 - DNA, 11 bp, Homo sapiens
aataaatgttc

SEQ ID NO: 4327197 - DNA, 14 bp, Homo sapiens
aataactattttgt

SEQ ID NO: 4327198 - DNA, 11 bp, Homo sapiens
aataactgaat

SEQ ID NO: 4327199 - DNA, 16 bp, Homo sapiens
aataactgaataaaaa

SEQ ID NO: 4327200 - DNA, 21 bp, Homo sapiens
aataatattgtttttctttct

SEQ ID NO: 4327201 - DNA, 14 bp, Homo sapiens
acatctaaagcttt

SEQ ID NO: 4327202 - DNA, 17 bp, Homo sapiens
acatgagactaagagaa

SEQ ID NO: 4327203 - DNA, 16 bp, Homo sapiens
acatgcaagaatttct

SEQ ID NO: 4327204 - DNA, 14 bp, Homo sapiens
acatgctgagtctc

SEQ ID NO: 4327205 - DNA, 17 bp, Homo sapiens
acatggccaatagtcat

SEQ ID NO: 4327206 - DNA, 23 bp, Homo sapiens
acatggccaatagtcatatgtga

SEQ ID NO: 4327207 - DNA, 14 bp, Homo sapiens
acatgtatttatgt

SEQ ID NO: 4327208 - DNA, 22 bp, Homo sapiens
acatgtgcagatatccaaacaa

SEQ ID NO: 4327209 - DNA, 13 bp, Homo sapiens
acatgtgcccctg

SEQ ID NO: 4327210 - DNA, 15 bp, Homo sapiens
acatgtgcccctgcc

SEQ ID NO: 4327211 - DNA, 16 bp, Homo sapiens
acatgtgctgatgttt

SEQ ID NO: 4327212 - DNA, 20 bp, Homo sapiens
acattaccctaatggctgct

SEQ ID NO: 4327213 - DNA, 18 bp, Homo sapiens
acattagaacactgcatt

SEQ ID NO: 4327214 - DNA, 16 bp, Homo sapiens
acattaggaattgttt

SEQ ID NO: 4327215 - DNA, 20 bp, Homo sapiens
acattaggaattgtttatac

SEQ ID NO: 4327216 - DNA, 13 bp, Homo sapiens
acattatcttagt

SEQ ID NO: 4327217 - DNA, 22 bp, Homo sapiens
acattcttggttgttaatttag

SEQ ID NO: 4327218 - DNA, 19 bp, Homo sapiens
accaatgcttttatcaaac

SEQ ID NO: 4327219 - DNA, 17 bp, Homo sapiens
accaattattgatatat

SEQ ID NO: 4327220 - DNA, 15 bp, Homo sapiens
accacccacaaagaa

SEQ ID NO: 4327221 - DNA, 13 bp, Homo sapiens
accaccttccctt

SEQ ID NO: 4327222 - DNA, 15 bp, Homo sapiens
accagaagaaaagac

SEQ ID NO: 4327223 - DNA, 20 bp, Homo sapiens
accagaagtgcagcccctct

SEQ ID NO: 4327224 - DNA, 14 bp, Homo sapiens
accagcagcctgga

SEQ ID NO: 4327225 - DNA, 23 bp, Homo sapiens
accagcaggaggttctgggcctc

SEQ ID NO: 4327226 - DNA, 15 bp, Homo sapiens
accagcccctgcccc

SEQ ID NO: 4327227 - DNA, 22 bp, Homo sapiens
accagcgtgtgactactccccc

SEQ ID NO: 4327228 - DNA, 21 bp, Homo sapiens
accaggagggagagcctctgt

SEQ ID NO: 4327229 - DNA, 20 bp, Homo sapiens
accagggagaggcctcggct

SEQ ID NO: 4327230 - DNA, 21 bp, Homo sapiens
accagggcactgtctgcgtga

SEQ ID NO: 4327231 - DNA, 20 bp, Homo sapiens
accataccactttgacacgc

SEQ ID NO: 4327232 - DNA, 23 bp, Homo sapiens
accatgattaaccacttcagctg

SEQ ID NO: 4327233 - DNA, 20 bp, Homo sapiens
accatggccattcagcacag

SEQ ID NO: 4327234 - DNA, 17 bp, Homo sapiens
accattgtcttgttctg

SEQ ID NO: 4327235 - DNA, 18 bp, Homo sapiens
accatttgctactgtaca

SEQ ID NO: 4327236 - DNA, 11 bp, Homo sapiens
accatttttca

SEQ ID NO: 4327237 - DNA, 16 bp, Homo sapiens
acccacaaagaaacaa

SEQ ID NO: 4327238 - DNA, 12 bp, Homo sapiens
acccacctctgc

SEQ ID NO: 4327239 - DNA, 14 bp, Homo sapiens
acccacctctgcca

SEQ ID NO: 4327240 - DNA, 18 bp, Homo sapiens
acccactaggtgaacagc

SEQ ID NO: 4327241 - DNA, 19 bp, Homo sapiens
acccagaacctttttatag

SEQ ID NO: 4327242 - DNA, 14 bp, Homo sapiens
acccagaggtggcc

SEQ ID NO: 4327243 - DNA, 23 bp, Homo sapiens
acccataagtaatatttaaagat

SEQ ID NO: 4327244 - DNA, 16 bp, Homo sapiens
acccatgaagctggcc

SEQ ID NO: 4327245 - DNA, 19 bp, Homo sapiens
acccatgaagctggccctc

SEQ ID NO: 4327246 - DNA, 14 bp, Homo sapiens
accccagagttggg

SEQ ID NO: 4327247 - DNA, 18 bp, Homo sapiens
accccagcatcagcacag

SEQ ID NO: 4327248 - DNA, 14 bp, Homo sapiens
accccagcccccac

SEQ ID NO: 4327249 - DNA, 22 bp, Homo sapiens
accccagcccccacagccctgg

SEQ ID NO: 4327250 - DNA, 14 bp, Homo sapiens
acccccaaatttaa

SEQ ID NO: 4327251 - DNA, 13 bp, Homo sapiens
acccccttctggg

SEQ ID NO: 4327252 - DNA, 12 bp, Homo sapiens
acccctgcctcc

SEQ ID NO: 4327253 - DNA, 13 bp, Homo sapiens
acccctgcctcct

SEQ ID NO: 4327254 - DNA, 20 bp, Homo sapiens
acccctgcctcctgcctccc

SEQ ID NO: 4327255 - DNA, 12 bp, Homo sapiens
acccctttcccc

SEQ ID NO: 4327256 - DNA, 13 bp, Homo sapiens
acccctttccccc

SEQ ID NO: 4327257 - DNA, 16 bp, Homo sapiens
acccctttcccccacc

SEQ ID NO: 4327258 - DNA, 23 bp, Homo sapiens
acccgccccgccccctccctgct

SEQ ID NO: 4327259 - DNA, 19 bp, Homo sapiens
accctattgctgcttgagg

SEQ ID NO: 4327260 - DNA, 16 bp, Homo sapiens
accctcaggcaggtgg

SEQ ID NO: 4327261 - DNA, 20 bp, Homo sapiens
accctgtgtatacagccctg

SEQ ID NO: 4327262 - DNA, 18 bp, Homo sapiens
acccttaagctgtagaga

SEQ ID NO: 4327263 - DNA, 21 bp, Homo sapiens
accgaatatattactgattta

SEQ ID NO: 4327264 - DNA, 15 bp, Homo sapiens
accgaggagccccag

SEQ ID NO: 4327265 - DNA, 13 bp, Homo sapiens
accgctggctccg

SEQ ID NO: 4327266 - DNA, 14 bp, Homo sapiens
accgctggctccgc

SEQ ID NO: 4327267 - DNA, 14 bp, Homo sapiens
acctatcaaaaact

SEQ ID NO: 4327268 - DNA, 17 bp, Homo sapiens
acctatcaaaaactgac

SEQ ID NO: 4327269 - DNA, 16 bp, Homo sapiens
acctattgaattacca

SEQ ID NO: 4327270 - DNA, 16 bp, Homo sapiens
acctcagttccacggt

SEQ ID NO: 4327271 - DNA, 23 bp, Homo sapiens
acctcccctccccgccccctgaa

SEQ ID NO: 4327272 - DNA, 19 bp, Homo sapiens
acctccctcctgatgtttt

SEQ ID NO: 4327273 - DNA, 16 bp, Homo sapiens
acctcctaatggcatg

SEQ ID NO: 4327274 - DNA, 19 bp, Homo sapiens
acctcctaatggcatggag

SEQ ID NO: 4327275 - DNA, 17 bp, Homo sapiens
acctcggtgccttcctc

SEQ ID NO: 4327276 - DNA, 19 bp, Homo sapiens
acctctcgtttctgcccag

SEQ ID NO: 4327277 - DNA, 22 bp, Homo sapiens
acctctgcaagagggggcattg

SEQ ID NO: 4327278 - DNA, 21 bp, Homo sapiens
acctctgcacaagctgcaccc

SEQ ID NO: 4327279 - DNA, 13 bp, Homo sapiens
acctctgccactc

SEQ ID NO: 4327280 - DNA, 15 bp, Homo sapiens
acctgaagtcaaacc

SEQ ID NO: 4327281 - DNA, 16 bp, Homo sapiens
acctgacctctgcaag

SEQ ID NO: 4327282 - DNA, 18 bp, Homo sapiens
acctgccttttaagtttg

SEQ ID NO: 4327283 - DNA, 24 bp, Homo sapiens
acctgcttgagctttctgtgcatg

SEQ ID NO: 4327284 - DNA, 21 bp, Homo sapiens
acctgggtaactagggaagat

SEQ ID NO: 4327285 - DNA, 21 bp, Homo sapiens
accttctcccaggcctctgcc

SEQ ID NO: 4327286 - DNA, 22 bp, Homo sapiens
accttctcccaggcctctgccc

SEQ ID NO: 4327287 - DNA, 19 bp, Homo sapiens
accttctggcttccttctc

SEQ ID NO: 4327288 - DNA, 21 bp, Homo sapiens
accttgtgactcagtgtattt

SEQ ID NO: 4327289 - DNA, 23 bp, Homo sapiens
accttgtgactcagtgtatttta

SEQ ID NO: 4327290 - DNA, 15 bp, Homo sapiens
acctttttatattta

SEQ ID NO: 4327291 - DNA, 23 bp, Homo sapiens
acctttttatatttaaaaaatta

SEQ ID NO: 4327292 - DNA, 13 bp, Homo sapiens
acgccaccattcc

SEQ ID NO: 4327293 - DNA, 23 bp, Homo sapiens
acgccaggggaaaatcagcctgc

SEQ ID NO: 4327294 - DNA, 13 bp, Homo sapiens
acgctacggggaa

SEQ ID NO: 4327295 - DNA, 23 bp, Homo sapiens
acgctacggggaaaatgcatttt

SEQ ID NO: 4327296 - DNA, 17 bp, Homo sapiens
acgctatgtagaatgtc

SEQ ID NO: 4327297 - DNA, 19 bp, Homo sapiens
acgctatgtagaatgtctt

SEQ ID NO: 4327298 - DNA, 17 bp, Homo sapiens
acgctccccgcctgttc

SEQ ID NO: 4327299 - DNA, 18 bp, Homo sapiens
acgctccccgcctgttcc

SEQ ID NO: 4327300 - DNA, 19 bp, Homo sapiens
acgctccccgcctgttccc

SEQ ID NO: 4327301 - DNA, 20 bp, Homo sapiens
acgctccccgcctgttcccc

SEQ ID NO: 4327302 - DNA, 22 bp, Homo sapiens
acgctccccgcctgttcccccg

SEQ ID NO: 4327303 - DNA, 15 bp, Homo sapiens
acggaaacatagaaa

SEQ ID NO: 4327304 - DNA, 17 bp, Homo sapiens
acggaaacatagaaaca

SEQ ID NO: 4327305 - DNA, 18 bp, Homo sapiens
acgggagcattggcccct

SEQ ID NO: 4327306 - DNA, 15 bp, Homo sapiens
acggggaaaatgcat

SEQ ID NO: 4327307 - DNA, 22 bp, Homo sapiens
acggttgctaaattataaaatt

SEQ ID NO: 4327308 - DNA, 13 bp, Homo sapiens
acggttttaaatg

SEQ ID NO: 4327309 - DNA, 18 bp, Homo sapiens
acggttttaaatgtgttg

SEQ ID NO: 4327310 - DNA, 15 bp, Homo sapiens
acggttttactgcag

SEQ ID NO: 4327311 - DNA, 17 bp, Homo sapiens
acggttttactgcagct

SEQ ID NO: 4327312 - DNA, 15 bp, Homo sapiens
acgtacatacacaca

SEQ ID NO: 4327313 - DNA, 18 bp, Homo sapiens
acgtatttagccattacc

SEQ ID NO: 4327314 - DNA, 17 bp, Homo sapiens
acgtccactcccaagcc

SEQ ID NO: 4327315 - DNA, 19 bp, Homo sapiens
acgtcgccataaaggcccc

SEQ ID NO: 4327316 - DNA, 14 bp, Homo sapiens
acgtggccaggagc

SEQ ID NO: 4327317 - DNA, 15 bp, Homo sapiens
acgtggccaggagcc

SEQ ID NO: 4327318 - DNA, 19 bp, Homo sapiens
acgttcttacaagcttaaa

SEQ ID NO: 4327319 - DNA, 14 bp, Homo sapiens
agaggaaggaaaca

SEQ ID NO: 4327320 - DNA, 22 bp, Homo sapiens
agaggaaggaaacatagaaaga

SEQ ID NO: 4327321 - DNA, 16 bp, Homo sapiens
agaggaaggagaggag

SEQ ID NO: 4327322 - DNA, 21 bp, Homo sapiens
agaggcctcggctgtctcctg

SEQ ID NO: 4327323 - DNA, 16 bp, Homo sapiens
agaggcttttgggcca

SEQ ID NO: 4327324 - DNA, 15 bp, Homo sapiens
agagggacagagccc

SEQ ID NO: 4327325 - DNA, 11 bp, Homo sapiens
agaggtggccc

SEQ ID NO: 4327326 - DNA, 19 bp, Homo sapiens
agaggtggccctcccaggc

SEQ ID NO: 4327327 - DNA, 22 bp, Homo sapiens
agaggtggccctcccaggctgg

SEQ ID NO: 4327328 - DNA, 17 bp, Homo sapiens
agaggttttatttacat

SEQ ID NO: 4327329 - DNA, 16 bp, Homo sapiens
agaggtttttctcccc

SEQ ID NO: 4327330 - DNA, 17 bp, Homo sapiens
agagtggtaaaaaagaa

SEQ ID NO: 4327331 - DNA, 21 bp, Homo sapiens
agagtggtaaaaaagaaatga

SEQ ID NO: 4327332 - DNA, 23 bp, Homo sapiens
agagtggtaaaaaagaaatgaaa

SEQ ID NO: 4327333 - DNA, 15 bp, Homo sapiens
agagtgttatcatat

SEQ ID NO: 4327334 - DNA, 12 bp, Homo sapiens
agagttaaaata

SEQ ID NO: 4327335 - DNA, 22 bp, Homo sapiens
agagttcctctttgccctgagg

SEQ ID NO: 4327336 - DNA, 19 bp, Homo sapiens
agagttgaggaactgtaca

SEQ ID NO: 4327337 - DNA, 14 bp, Homo sapiens
agagtttgtagtaa

SEQ ID NO: 4327338 - DNA, 14 bp, Homo sapiens
agagtttgtgtgta

SEQ ID NO: 4327339 - DNA, 22 bp, Homo sapiens
agataatattaaggaagacaat

SEQ ID NO: 4327340 - DNA, 18 bp, Homo sapiens
agataatggataatcttc

SEQ ID NO: 4327341 - DNA, 16 bp, Homo sapiens
agataccgagaatgat

SEQ ID NO: 4327342 - DNA, 15 bp, Homo sapiens
agatatactttgtgg

SEQ ID NO: 4327343 - DNA, 23 bp, Homo sapiens
agatatactttgtggaccaatta

SEQ ID NO: 4327344 - DNA, 18 bp, Homo sapiens
agatatccaaacaagact

SEQ ID NO: 4327345 - DNA, 18 bp, Homo sapiens
agatattatcataacatc

SEQ ID NO: 4327346 - DNA, 21 bp, Homo sapiens
agatcagggatagcgctgttg

SEQ ID NO: 4327347 - DNA, 11 bp, Homo sapiens
agatcctggaa

SEQ ID NO: 4327348 - DNA, 22 bp, Homo sapiens
agatcttcccctaacctttggg

SEQ ID NO: 4327349 - DNA, 19 bp, Homo sapiens
agatgacaaaagaaaattt

SEQ ID NO: 4327350 - DNA, 13 bp, Homo sapiens
agatggagaggaa

SEQ ID NO: 4327351 - DNA, 16 bp, Homo sapiens
agatggagaggaagaa

SEQ ID NO: 4327352 - DNA, 18 bp, Homo sapiens
agatggagaggaagaaac

SEQ ID NO: 4327353 - DNA, 23 bp, Homo sapiens
agatggagcaggtctttgggaag

SEQ ID NO: 4327354 - DNA, 15 bp, Homo sapiens
agatgggggcaagaa

SEQ ID NO: 4327355 - DNA, 18 bp, Homo sapiens
agatgggggcaagaagat

SEQ ID NO: 4327356 - DNA, 14 bp, Homo sapiens
agatgtttaccttc

SEQ ID NO: 4327357 - DNA, 22 bp, Homo sapiens
agattatagctcccaaaagaat

SEQ ID NO: 4327358 - DNA, 20 bp, Homo sapiens
agattatcagtagaaagagt

SEQ ID NO: 4327359 - DNA, 16 bp, Homo sapiens
agattgccccaggtct

SEQ ID NO: 4327360 - DNA, 17 bp, Homo sapiens
agattggatttgctgtg

SEQ ID NO: 4327361 - DNA, 12 bp, Homo sapiens
agatttcagtag

SEQ ID NO: 4327362 - DNA, 14 bp, Homo sapiens
agatttcagtagaa

SEQ ID NO: 4327363 - DNA, 23 bp, Homo sapiens
agatttcttaatgtctgtcagaa

SEQ ID NO: 4327364 - DNA, 12 bp, Homo sapiens
agattttaaaaa

SEQ ID NO: 4327365 - DNA, 21 bp, Homo sapiens
agatttttttcatagatttga

SEQ ID NO: 4327366 - DNA, 15 bp, Homo sapiens
agcaaagatttcagt

SEQ ID NO: 4327367 - DNA, 12 bp, Homo sapiens
agcaactcccac

SEQ ID NO: 4327368 - DNA, 14 bp, Homo sapiens
agcaactcccacga

SEQ ID NO: 4327369 - DNA, 15 bp, Homo sapiens
agcaaggtctcagac

SEQ ID NO: 4327370 - DNA, 20 bp, Homo sapiens
agcaagtgagaccctgtctc

SEQ ID NO: 4327371 - DNA, 21 bp, Homo sapiens
agcaatgcccgtaatgcttag

SEQ ID NO: 4327372 - DNA, 16 bp, Homo sapiens
agcacaattaattaaa

SEQ ID NO: 4327373 - DNA, 15 bp, Homo sapiens
agcacagctctcctc

SEQ ID NO: 4327374 - DNA, 20 bp, Homo sapiens
agcaccagggagaggcctcg

SEQ ID NO: 4327375 - DNA, 16 bp, Homo sapiens
agcactactgggtgtc

SEQ ID NO: 4327376 - DNA, 18 bp, Homo sapiens
agcactactgggtgtcat

SEQ ID NO: 4327377 - DNA, 13 bp, Homo sapiens
agcactagagaat

SEQ ID NO: 4327378 - DNA, 11 bp, Homo sapiens
agcagaggaag

SEQ ID NO: 4327379 - DNA, 14 bp, Homo sapiens
agcagaggaaggaa

SEQ ID NO: 4327380 - DNA, 17 bp, Homo sapiens
agcagaggaaggagagg

SEQ ID NO: 4327381 - DNA, 13 bp, Homo sapiens
agcagatgtttaa

SEQ ID NO: 4327382 - DNA, 16 bp, Homo sapiens
agcaggaggtgcctga

SEQ ID NO: 4327383 - DNA, 20 bp, Homo sapiens
agcaggcacttgattccttg

SEQ ID NO: 4327384 - DNA, 19 bp, Homo sapiens
agcaggccaaacatggcca

SEQ ID NO: 4327385 - DNA, 20 bp, Homo sapiens
agcagggagggcttctgcca

SEQ ID NO: 4327386 - DNA, 16 bp, Homo sapiens
agcagggctggtcacc

SEQ ID NO: 4327387 - DNA, 20 bp, Homo sapiens
agcagggctggtcacctccc

SEQ ID NO: 4327388 - DNA, 23 bp, Homo sapiens
agcagggctggtcacctcccatc

SEQ ID NO: 4327389 - DNA, 13 bp, Homo sapiens
agcagtaaaataa

SEQ ID NO: 4327390 - DNA, 23 bp, Homo sapiens
agcagttaatcacccaccatagg

SEQ ID NO: 4327391 - DNA, 15 bp, Homo sapiens
agcagttctctgcca

SEQ ID NO: 4327392 - DNA, 19 bp, Homo sapiens
agcataaaaattagccaag

SEQ ID NO: 4327393 - DNA, 22 bp, Homo sapiens
agcatctagtttccctggtgcc

SEQ ID NO: 4327394 - DNA, 16 bp, Homo sapiens
agcatggggcccctgg

SEQ ID NO: 4327395 - DNA, 13 bp, Homo sapiens
agcattactttaa

SEQ ID NO: 4327396 - DNA, 15 bp, Homo sapiens
agcattggcccctga

SEQ ID NO: 4327397 - DNA, 19 bp, Homo sapiens
agccaacaggtaaacacat

SEQ ID NO: 4327398 - DNA, 19 bp, Homo sapiens
agccacaaaataaatgttg

SEQ ID NO: 4327399 - DNA, 17 bp, Homo sapiens
agccacaccgctggctc

SEQ ID NO: 4327400 - DNA, 13 bp, Homo sapiens
agccacggaaaca

SEQ ID NO: 4327401 - DNA, 20 bp, Homo sapiens
agccagatctcgggactcag

SEQ ID NO: 4327402 - DNA, 14 bp, Homo sapiens
agccattaaatgaa

SEQ ID NO: 4327403 - DNA, 22 bp, Homo sapiens
agccattaaatgaatattttga

SEQ ID NO: 4327404 - DNA, 17 bp, Homo sapiens
agccattcctgttctct

SEQ ID NO: 4327405 - DNA, 14 bp, Homo sapiens
agcccaagtccaaa

SEQ ID NO: 4327406 - DNA, 15 bp, Homo sapiens
agcccaatggagaaa

SEQ ID NO: 4327407 - DNA, 17 bp, Homo sapiens
agcccaatggagaaatg

SEQ ID NO: 4327408 - DNA, 18 bp, Homo sapiens
agcccaatggagaaatga

SEQ ID NO: 4327409 - DNA, 23 bp, Homo sapiens
agcccacccctcaacacctctgc

SEQ ID NO: 4327410 - DNA, 12 bp, Homo sapiens
agcccactcccc

SEQ ID NO: 4327411 - DNA, 12 bp, Homo sapiens
agcccagaagaa

SEQ ID NO: 4327412 - DNA, 15 bp, Homo sapiens
agccccacccagagg

SEQ ID NO: 4327413 - DNA, 14 bp, Homo sapiens
agccccagccccgt

SEQ ID NO: 4327414 - DNA, 13 bp, Homo sapiens
agcccccacagcc

SEQ ID NO: 4327415 - DNA, 14 bp, Homo sapiens
agcccccacagccc

SEQ ID NO: 4327416 - DNA, 15 bp, Homo sapiens
agcccccacagccct

SEQ ID NO: 4327417 - DNA, 17 bp, Homo sapiens
agcccccacagccctgg

SEQ ID NO: 4327418 - DNA, 19 bp, Homo sapiens
agcccccacagccctggaa

SEQ ID NO: 4327419 - DNA, 20 bp, Homo sapiens
agcccccacagccctggaat

SEQ ID NO: 4327420 - DNA, 13 bp, Homo sapiens
agcccctgcccca

SEQ ID NO: 4327421 - DNA, 18 bp, Homo sapiens
agcccctgccccagccca

SEQ ID NO: 4327422 - DNA, 20 bp, Homo sapiens
agccctctccaaatcaagga

SEQ ID NO: 4327423 - DNA, 19 bp, Homo sapiens
agccctctgtggccaggag

SEQ ID NO: 4327424 - DNA, 19 bp, Homo sapiens
agccctgacgcaatgaaaa

SEQ ID NO: 4327425 - DNA, 15 bp, Homo sapiens
agccctgagctttct

SEQ ID NO: 4327426 - DNA, 12 bp, Homo sapiens
agccctgtccct

SEQ ID NO: 4327427 - DNA, 14 bp, Homo sapiens
agccgtgtgtgcat

SEQ ID NO: 4327428 - DNA, 21 bp, Homo sapiens
agccgtgtgtgcatgtgccga

SEQ ID NO: 4327429 - DNA, 23 bp, Homo sapiens
agccgtgtgtgcatgtgccgagg

SEQ ID NO: 4327430 - DNA, 15 bp, Homo sapiens
agcctaatacaacat

SEQ ID NO: 4327431 - DNA, 11 bp, Homo sapiens
agcctcctgcc

SEQ ID NO: 4327432 - DNA, 14 bp, Homo sapiens
agcctcctgcccag

SEQ ID NO: 4327433 - DNA, 16 bp, Homo sapiens
agcctcctgcccagtc

SEQ ID NO: 4327434 - DNA, 18 bp, Homo sapiens
agcctcctgcccagtccc

SEQ ID NO: 4327435 - DNA, 20 bp, Homo sapiens
agcctgcaggtccggggagg

SEQ ID NO: 4327436 - DNA, 11 bp, Homo sapiens
agcctgcccag

SEQ ID NO: 4327437 - DNA, 21 bp, Homo sapiens
agcctgcccagttggaggaga

SEQ ID NO: 4327438 - DNA, 13 bp, Homo sapiens
agtgggtgaataa

SEQ ID NO: 4327439 - DNA, 15 bp, Homo sapiens
agtggtactctgtgt

SEQ ID NO: 4327440 - DNA, 16 bp, Homo sapiens
agtggttggatgtagt

SEQ ID NO: 4327441 - DNA, 18 bp, Homo sapiens
agtggttggatgtagtca

SEQ ID NO: 4327442 - DNA, 21 bp, Homo sapiens
agtggttggatgtagtcacat

SEQ ID NO: 4327443 - DNA, 15 bp, Homo sapiens
agtgtattttaaatt

SEQ ID NO: 4327444 - DNA, 23 bp, Homo sapiens
agtgtattttaaattctcagtca

SEQ ID NO: 4327445 - DNA, 17 bp, Homo sapiens
agtgtattttactattt

SEQ ID NO: 4327446 - DNA, 20 bp, Homo sapiens
agtgtgcggatgataactac

SEQ ID NO: 4327447 - DNA, 23 bp, Homo sapiens
agtgtgcggatgataactactga

SEQ ID NO: 4327448 - DNA, 14 bp, Homo sapiens
agtgtgctgctgtt

SEQ ID NO: 4327449 - DNA, 15 bp, Homo sapiens
agtgtgctgctgttc

SEQ ID NO: 4327450 - DNA, 16 bp, Homo sapiens
agtgtgtgtgtgtgtc

SEQ ID NO: 4327451 - DNA, 19 bp, Homo sapiens
agtgtgtgtgtgtgtctgt

SEQ ID NO: 4327452 - DNA, 12 bp, Homo sapiens
agtgttcagtgt

SEQ ID NO: 4327453 - DNA, 13 bp, Homo sapiens
agtgttcagtgtt

SEQ ID NO: 4327454 - DNA, 14 bp, Homo sapiens
agtgttcagtgttg

SEQ ID NO: 4327455 - DNA, 18 bp, Homo sapiens
agtgttcagtgttgacat

SEQ ID NO: 4327456 - DNA, 13 bp, Homo sapiens
agtgttgacatag

SEQ ID NO: 4327457 - DNA, 15 bp, Homo sapiens
agtgttgacatagcc

SEQ ID NO: 4327458 - DNA, 18 bp, Homo sapiens
agtgttgacatagccttt

SEQ ID NO: 4327459 - DNA, 23 bp, Homo sapiens
agtgtttgaaaactgacatcaga

SEQ ID NO: 4327460 - DNA, 19 bp, Homo sapiens
agttaaaatatatatagtt

SEQ ID NO: 4327461 - DNA, 23 bp, Homo sapiens
agttacccaaaatctgattagaa

SEQ ID NO: 4327462 - DNA, 22 bp, Homo sapiens
agttacgtataatgctttctga

SEQ ID NO: 4327463 - DNA, 14 bp, Homo sapiens
agttagagataatt

SEQ ID NO: 4327464 - DNA, 18 bp, Homo sapiens
agttataagcgtatttag

SEQ ID NO: 4327465 - DNA, 16 bp, Homo sapiens
agttcatatgcagaac

SEQ ID NO: 4327466 - DNA, 19 bp, Homo sapiens
agttccacggttgctaaat

SEQ ID NO: 4327467 - DNA, 18 bp, Homo sapiens
agttccattcttggtcaa

SEQ ID NO: 4327468 - DNA, 15 bp, Homo sapiens
agttccctctgcctg

SEQ ID NO: 4327469 - DNA, 20 bp, Homo sapiens
agttcctctttgccctgagg

SEQ ID NO: 4327470 - DNA, 21 bp, Homo sapiens
agttctatggagactttgctg

SEQ ID NO: 4327471 - DNA, 22 bp, Homo sapiens
agttctatggagactttgctgt

SEQ ID NO: 4327472 - DNA, 13 bp, Homo sapiens
agttcttctccaa

SEQ ID NO: 4327473 - DNA, 18 bp, Homo sapiens
agttgaaaaacagctgag

SEQ ID NO: 4327474 - DNA, 15 bp, Homo sapiens
agttgaaaatacatt

SEQ ID NO: 4327475 - DNA, 17 bp, Homo sapiens
agttgatattcaaggct

SEQ ID NO: 4327476 - DNA, 14 bp, Homo sapiens
agttgattcagctc

SEQ ID NO: 4327477 - DNA, 17 bp, Homo sapiens
agttgattcagctctgc

SEQ ID NO: 4327478 - DNA, 23 bp, Homo sapiens
agttgattcagctctgcaagaat

SEQ ID NO: 4327479 - DNA, 16 bp, Homo sapiens
agttgcagaaaatgaa

SEQ ID NO: 4327480 - DNA, 22 bp, Homo sapiens
agttgggatgcggggcagagcc

SEQ ID NO: 4327481 - DNA, 21 bp, Homo sapiens
agttgtctctcttcagactct

SEQ ID NO: 4327482 - DNA, 17 bp, Homo sapiens
agttgtgggtgggagag

SEQ ID NO: 4327483 - DNA, 14 bp, Homo sapiens
agttgttgtttgcc

SEQ ID NO: 4327484 - DNA, 22 bp, Homo sapiens
agttgttgtttgccaagctaat

SEQ ID NO: 4327485 - DNA, 21 bp, Homo sapiens
agtttaagggtggaaaaatgc

SEQ ID NO: 4327486 - DNA, 23 bp, Homo sapiens
agtttaagggtggaaaaatgccc

SEQ ID NO: 4327487 - DNA, 21 bp, Homo sapiens
agtttagaagcgctcatctgg

SEQ ID NO: 4327488 - DNA, 18 bp, Homo sapiens
agtttcatgtatgtatat

SEQ ID NO: 4327489 - DNA, 15 bp, Homo sapiens
agtttccctggtgcc

SEQ ID NO: 4327490 - DNA, 18 bp, Homo sapiens
agtttgagatcagcctgg

SEQ ID NO: 4327491 - DNA, 20 bp, Homo sapiens
agtttgagatcagcctgggc

SEQ ID NO: 4327492 - DNA, 23 bp, Homo sapiens
agtttgctaaattgagaggggct

SEQ ID NO: 4327493 - DNA, 14 bp, Homo sapiens
agtttggaaataaa

SEQ ID NO: 4327494 - DNA, 17 bp, Homo sapiens
agtttgtaggtaaaatg

SEQ ID NO: 4327495 - DNA, 20 bp, Homo sapiens
agtttgtaggtaaaatgtat

SEQ ID NO: 4327496 - DNA, 21 bp, Homo sapiens
agtttgtaggtaaaatgtatt

SEQ ID NO: 4327497 - DNA, 21 bp, Homo sapiens
agtttttaattaaaaacttta

SEQ ID NO: 4327498 - DNA, 18 bp, Homo sapiens
agtttttacaaaactgct

SEQ ID NO: 4327499 - DNA, 14 bp, Homo sapiens
agtttttctctcaa

SEQ ID NO: 4327500 - DNA, 15 bp, Homo sapiens
agttttttactttgg

SEQ ID NO: 4327501 - DNA, 16 bp, Homo sapiens
agtttttttttttcca

SEQ ID NO: 4327502 - DNA, 16 bp, Homo sapiens
ataaaaattaaatgtg

SEQ ID NO: 4327503 - DNA, 12 bp, Homo sapiens
ataaaatgaata

SEQ ID NO: 4327504 - DNA, 14 bp, Homo sapiens
ataaaattgaaaac

SEQ ID NO: 4327505 - DNA, 15 bp, Homo sapiens
ataaaattgaaaaca

SEQ ID NO: 4327506 - DNA, 19 bp, Homo sapiens
ataaaattgaaaacactaa

SEQ ID NO: 4327507 - DNA, 22 bp, Homo sapiens
ataaaattgcagtttcatgtat

SEQ ID NO: 4327508 - DNA, 15 bp, Homo sapiens
ataaactttgaataa

SEQ ID NO: 4327509 - DNA, 18 bp, Homo sapiens
ataaactttgaataaaag

SEQ ID NO: 4327510 - DNA, 20 bp, Homo sapiens
ataaactttgaataaaagaa

SEQ ID NO: 4327511 - DNA, 13 bp, Homo sapiens
ataaagaaaattc

SEQ ID NO: 4327512 - DNA, 14 bp, Homo sapiens
ataaagaaaattct

SEQ ID NO: 4327513 - DNA, 18 bp, Homo sapiens
ataaagaaaattctctca

SEQ ID NO: 4327514 - DNA, 15 bp, Homo sapiens
ataaagaatatatat

SEQ ID NO: 4327515 - DNA, 17 bp, Homo sapiens
ataaagccttttaaatc

SEQ ID NO: 4327516 - DNA, 14 bp, Homo sapiens
ataaaggcaaggaa

SEQ ID NO: 4327517 - DNA, 22 bp, Homo sapiens
ataaaggcaaggaaattaagaa

SEQ ID NO: 4327518 - DNA, 14 bp, Homo sapiens
ataaagtcatcaaa

SEQ ID NO: 4327519 - DNA, 13 bp, Homo sapiens
ataaagtgtaata

SEQ ID NO: 4327520 - DNA, 15 bp, Homo sapiens
ataaatagaaaagta

SEQ ID NO: 4327521 - DNA, 15 bp, Homo sapiens
ataaatgaaagaaac

SEQ ID NO: 4327522 - DNA, 13 bp, Homo sapiens
ataaatgactatt

SEQ ID NO: 4327523 - DNA, 17 bp, Homo sapiens
ataaatgactattgtaa

SEQ ID NO: 4327524 - DNA, 18 bp, Homo sapiens
ataaatgactattgtaat

SEQ ID NO: 4327525 - DNA, 19 bp, Homo sapiens
ataaatgactattgtaatg

SEQ ID NO: 4327526 - DNA, 16 bp, Homo sapiens
ataaattaaataaact

SEQ ID NO: 4327527 - DNA, 17 bp, Homo sapiens
ataactactgacgaaag

SEQ ID NO: 4327528 - DNA, 12 bp, Homo sapiens
ataactgaataa

SEQ ID NO: 4327529 - DNA, 14 bp, Homo sapiens
ataactgaataaaa

SEQ ID NO: 4327530 - DNA, 17 bp, Homo sapiens
ataactgaataaaaaat

SEQ ID NO: 4327531 - DNA, 16 bp, Homo sapiens
ataagacttgtttctt

SEQ ID NO: 4327532 - DNA, 18 bp, Homo sapiens
ataagcgtatttagactg

SEQ ID NO: 4327533 - DNA, 14 bp, Homo sapiens
ataaggtaatgtag

SEQ ID NO: 4327534 - DNA, 13 bp, Homo sapiens
ataagtgttcagt

SEQ ID NO: 4327535 - DNA, 16 bp, Homo sapiens
ataagtgttcagtgtt

SEQ ID NO: 4327536 - DNA, 18 bp, Homo sapiens
ataataatattgtttttc

SEQ ID NO: 4327537 - DNA, 14 bp, Homo sapiens
ataatactaattta

SEQ ID NO: 4327538 - DNA, 13 bp, Homo sapiens
ataatctatatta

SEQ ID NO: 4327539 - DNA, 16 bp, Homo sapiens
ataatgctattttaaa

SEQ ID NO: 4327540 - DNA, 12 bp, Homo sapiens
ataatgctttct

SEQ ID NO: 4327541 - DNA, 20 bp, Homo sapiens
ataatgtgtctgtgttgctt

SEQ ID NO: 4327542 - DNA, 22 bp, Homo sapiens
ataatgtgtctgtgttgcttca

SEQ ID NO: 4327543 - DNA, 14 bp, Homo sapiens
ataattatttcaga

SEQ ID NO: 4327544 - DNA, 19 bp, Homo sapiens
ataattatttcagattcct

SEQ ID NO: 4327545 - DNA, 19 bp, Homo sapiens
ataattcctacagcactac

SEQ ID NO: 4327546 - DNA, 17 bp, Homo sapiens
atacacaactttgcaaa

SEQ ID NO: 4327547 - DNA, 18 bp, Homo sapiens
atacacaagagggactgt

SEQ ID NO: 4327548 - DNA, 21 bp, Homo sapiens
atacacaagagggactgtatt

SEQ ID NO: 4327549 - DNA, 23 bp, Homo sapiens
atacacaaggccagaaaaagaag

SEQ ID NO: 4327550 - DNA, 15 bp, Homo sapiens
atacacatataaaaa

SEQ ID NO: 4327551 - DNA, 15 bp, Homo sapiens
atacagctattaaaa

SEQ ID NO: 4327552 - DNA, 19 bp, Homo sapiens
atacagctattaaaatgta

SEQ ID NO: 4327553 - DNA, 13 bp, Homo sapiens
atacatacataca

SEQ ID NO: 4327554 - DNA, 17 bp, Homo sapiens
atacatacatacaaata

SEQ ID NO: 4327555 - DNA, 18 bp, Homo sapiens
atacatacatacaaatat

SEQ ID NO: 4327556 - DNA, 20 bp, Homo sapiens
ataccactttgacacgcttc

SEQ ID NO: 4327557 - DNA, 20 bp, Homo sapiens
catctctgtgattacctctc

SEQ ID NO: 4327558 - DNA, 16 bp, Homo sapiens
catctgcatgggtctt

SEQ ID NO: 4327559 - DNA, 20 bp, Homo sapiens
catctggcacgtggccagga

SEQ ID NO: 4327560 - DNA, 22 bp, Homo sapiens
catctggcacgtggccaggagc

SEQ ID NO: 4327561 - DNA, 24 bp, Homo sapiens
catctggcacgtggccaggagcca

SEQ ID NO: 4327562 - DNA, 17 bp, Homo sapiens
catctgtgcacactaag

SEQ ID NO: 4327563 - DNA, 13 bp, Homo sapiens
catcttgtgaaat

SEQ ID NO: 4327564 - DNA, 21 bp, Homo sapiens
catcttttgtgagatgtaatt

SEQ ID NO: 4327565 - DNA, 17 bp, Homo sapiens
catgaaggacactctgc

SEQ ID NO: 4327566 - DNA, 18 bp, Homo sapiens
catgaattcttatgctta

SEQ ID NO: 4327567 - DNA, 21 bp, Homo sapiens
catgatacctattaaaggaaa

SEQ ID NO: 4327568 - DNA, 23 bp, Homo sapiens
catgattaaccacttcagctgac

SEQ ID NO: 4327569 - DNA, 24 bp, Homo sapiens
catgattaaccacttcagctgact

SEQ ID NO: 4327570 - DNA, 22 bp, Homo sapiens
catgcaaactgctttattttcc

SEQ ID NO: 4327571 - DNA, 13 bp, Homo sapiens
catgcaagaattt

SEQ ID NO: 4327572 - DNA, 23 bp, Homo sapiens
catgcaagaatttctggaagaaa

SEQ ID NO: 4327573 - DNA, 17 bp, Homo sapiens
catgctcatgtatattt

SEQ ID NO: 4327574 - DNA, 13 bp, Homo sapiens
catgctcctggcc

SEQ ID NO: 4327575 - DNA, 14 bp, Homo sapiens
catgctcctggccc

SEQ ID NO: 4327576 - DNA, 20 bp, Homo sapiens
catgctgtccgtgcttgctg

SEQ ID NO: 4327577 - DNA, 22 bp, Homo sapiens
catgcttctcatcttgtgaaat

SEQ ID NO: 4327578 - DNA, 22 bp, Homo sapiens
catggccaatagtcatatgtga

SEQ ID NO: 4327579 - DNA, 16 bp, Homo sapiens
catgggaaatgagcca

SEQ ID NO: 4327580 - DNA, 18 bp, Homo sapiens
catgggaaatgagccagc

SEQ ID NO: 4327581 - DNA, 24 bp, Homo sapiens
catgggctatcagggaggaagatg

SEQ ID NO: 4327582 - DNA, 21 bp, Homo sapiens
catggtagatttttttcatag

SEQ ID NO: 4327583 - DNA, 15 bp, Homo sapiens
catgtatttatgtaa

SEQ ID NO: 4327584 - DNA, 19 bp, Homo sapiens
catgtccttgtgtgttttg

SEQ ID NO: 4327585 - DNA, 22 bp, Homo sapiens
catgtccttgtgtgttttgaga

SEQ ID NO: 4327586 - DNA, 17 bp, Homo sapiens
catgtctgtatccccag

SEQ ID NO: 4327587 - DNA, 19 bp, Homo sapiens
catgtctgtatccccagtg

SEQ ID NO: 4327588 - DNA, 20 bp, Homo sapiens
catgtctgtatccccagtgc

SEQ ID NO: 4327589 - DNA, 21 bp, Homo sapiens
catgtctgtatccccagtgcc

SEQ ID NO: 4327590 - DNA, 17 bp, Homo sapiens
catgtgcccctgccaag

SEQ ID NO: 4327591 - DNA, 15 bp, Homo sapiens
catgtgttttataag

SEQ ID NO: 4327592 - DNA, 19 bp, Homo sapiens
catgttatttaacctgagt

SEQ ID NO: 4327593 - DNA, 20 bp, Homo sapiens
catgtttgtctgtgtgctgt

SEQ ID NO: 4327594 - DNA, 22 bp, Homo sapiens
cattaaatgaatattttgataa

SEQ ID NO: 4327595 - DNA, 17 bp, Homo sapiens
cattaactaaatgctca

SEQ ID NO: 4327596 - DNA, 18 bp, Homo sapiens
cattaactaaatgctcat

SEQ ID NO: 4327597 - DNA, 17 bp, Homo sapiens
cattaagtcagtggctt

SEQ ID NO: 4327598 - DNA, 19 bp, Homo sapiens
cattacccacgtgacacca

SEQ ID NO: 4327599 - DNA, 14 bp, Homo sapiens
cattacgtgcattt

SEQ ID NO: 4327600 - DNA, 18 bp, Homo sapiens
cattacgtgcatttaaac

SEQ ID NO: 4327601 - DNA, 22 bp, Homo sapiens
cattacgtgcatttaaactctg

SEQ ID NO: 4327602 - DNA, 19 bp, Homo sapiens
cattagagcccatttcaat

SEQ ID NO: 4327603 - DNA, 23 bp, Homo sapiens
cattaggaattgtttatacacaa

SEQ ID NO: 4327604 - DNA, 13 bp, Homo sapiens
cattccattgcct

SEQ ID NO: 4327605 - DNA, 16 bp, Homo sapiens
cattccttacttgcac

SEQ ID NO: 4327606 - DNA, 17 bp, Homo sapiens
cattctcataattccta

SEQ ID NO: 4327607 - DNA, 12 bp, Homo sapiens
cattctgagccc

SEQ ID NO: 4327608 - DNA, 16 bp, Homo sapiens
cattctgcattgagaa

SEQ ID NO: 4327609 - DNA, 13 bp, Homo sapiens
cattctttcccag

SEQ ID NO: 4327610 - DNA, 12 bp, Homo sapiens
cattgaaaaagg

SEQ ID NO: 4327611 - DNA, 15 bp, Homo sapiens
cattgacatttgaat

SEQ ID NO: 4327612 - DNA, 13 bp, Homo sapiens
cattgagaaggaa

SEQ ID NO: 4327613 - DNA, 22 bp, Homo sapiens
cattgatttttaacctcaaaat

SEQ ID NO: 4327614 - DNA, 17 bp, Homo sapiens
cattgcaaaatagaaga

SEQ ID NO: 4327615 - DNA, 20 bp, Homo sapiens
cattgcaaaatagaagaaga

SEQ ID NO: 4327616 - DNA, 16 bp, Homo sapiens
cattggcccctgagcc

SEQ ID NO: 4327617 - DNA, 14 bp, Homo sapiens
cattgtccagctgg

SEQ ID NO: 4327618 - DNA, 19 bp, Homo sapiens
cattgtctttcctcccttc

SEQ ID NO: 4327619 - DNA, 15 bp, Homo sapiens
catttaaactctgcc

SEQ ID NO: 4327620 - DNA, 12 bp, Homo sapiens
catttcagattt

SEQ ID NO: 4327621 - DNA, 16 bp, Homo sapiens
catttcagattttaaa

SEQ ID NO: 4327622 - DNA, 20 bp, Homo sapiens
catttcagattttaaaaagg

SEQ ID NO: 4327623 - DNA, 12 bp, Homo sapiens
catttcattcca

SEQ ID NO: 4327624 - DNA, 15 bp, Homo sapiens
catttcctctctatc

SEQ ID NO: 4327625 - DNA, 12 bp, Homo sapiens
catttgctgttg

SEQ ID NO: 4327626 - DNA, 18 bp, Homo sapiens
catttgctgttgtttcta

SEQ ID NO: 4327627 - DNA, 21 bp, Homo sapiens
catttgctgttgtttctataa

SEQ ID NO: 4327628 - DNA, 23 bp, Homo sapiens
catttgctgttgtttctataaat

SEQ ID NO: 4327629 - DNA, 15 bp, Homo sapiens
catttggaatgaata

SEQ ID NO: 4327630 - DNA, 20 bp, Homo sapiens
cattttaagtgcttcacatt

SEQ ID NO: 4327631 - DNA, 16 bp, Homo sapiens
cattttcttcagaatt

SEQ ID NO: 4327632 - DNA, 24 bp, Homo sapiens
cattttgctaaatgtgaatgatga

SEQ ID NO: 4327633 - DNA, 21 bp, Homo sapiens
catttttcattcacttctctt

SEQ ID NO: 4327634 - DNA, 17 bp, Homo sapiens
ccaaaatgttggctgcg

SEQ ID NO: 4327635 - DNA, 17 bp, Homo sapiens
ccaaacatgtatttatg

SEQ ID NO: 4327636 - DNA, 21 bp, Homo sapiens
ccaaactgactcaacagtcat

SEQ ID NO: 4327637 - DNA, 22 bp, Homo sapiens
ccaaagcctcctccagccgcca

SEQ ID NO: 4327638 - DNA, 22 bp, Homo sapiens
ccaaaggaaaaagcacaagaag

SEQ ID NO: 4327639 - DNA, 23 bp, Homo sapiens
ccaaaggaaaaagcacaagaagc

SEQ ID NO: 4327640 - DNA, 23 bp, Homo sapiens
ccaaagtgccactcattcctgta

SEQ ID NO: 4327641 - DNA, 13 bp, Homo sapiens
ccaaatcaaggat

SEQ ID NO: 4327642 - DNA, 15 bp, Homo sapiens
ccaaatcaaggatct

SEQ ID NO: 4327643 - DNA, 18 bp, Homo sapiens
ccaaatggctgctttgac

SEQ ID NO: 4327644 - DNA, 17 bp, Homo sapiens
ccaaattgtgcttctcc

SEQ ID NO: 4327645 - DNA, 23 bp, Homo sapiens
ccaaattgtgcttctccccagaa

SEQ ID NO: 4327646 - DNA, 15 bp, Homo sapiens
ccaacaccagcccct

SEQ ID NO: 4327647 - DNA, 13 bp, Homo sapiens
ccaacccagcagt

SEQ ID NO: 4327648 - DNA, 21 bp, Homo sapiens
ccaactcaagtgtcacctcct

SEQ ID NO: 4327649 - DNA, 23 bp, Homo sapiens
ccaactcaagtgtcacctccttc

SEQ ID NO: 4327650 - DNA, 14 bp, Homo sapiens
ccaagaacattatc

SEQ ID NO: 4327651 - DNA, 15 bp, Homo sapiens
ccaagagcaggaggt

SEQ ID NO: 4327652 - DNA, 21 bp, Homo sapiens
ccaagagcaggaggtgcctga

SEQ ID NO: 4327653 - DNA, 21 bp, Homo sapiens
ccaagatggagaggaagaaac

SEQ ID NO: 4327654 - DNA, 18 bp, Homo sapiens
ccaagctctagtgggaag

SEQ ID NO: 4327655 - DNA, 13 bp, Homo sapiens
ccaaggaggtggc

SEQ ID NO: 4327656 - DNA, 20 bp, Homo sapiens
ccaaggctgcgtctggaggg

SEQ ID NO: 4327657 - DNA, 13 bp, Homo sapiens
ccaagggccgtgc

SEQ ID NO: 4327658 - DNA, 22 bp, Homo sapiens
ccaaggtggcccggaagaacca

SEQ ID NO: 4327659 - DNA, 13 bp, Homo sapiens
ccaaggtgggagg

SEQ ID NO: 4327660 - DNA, 12 bp, Homo sapiens
ccaatatttctg

SEQ ID NO: 4327661 - DNA, 21 bp, Homo sapiens
ccaatccagagaagcgctgtt

SEQ ID NO: 4327662 - DNA, 14 bp, Homo sapiens
ccaatggagaaaat

SEQ ID NO: 4327663 - DNA, 17 bp, Homo sapiens
ccaatggagaaatgaag

SEQ ID NO: 4327664 - DNA, 20 bp, Homo sapiens
ccaattattgatatatatta

SEQ ID NO: 4327665 - DNA, 14 bp, Homo sapiens
ccacaaagagacca

SEQ ID NO: 4327666 - DNA, 18 bp, Homo sapiens
ccacaaagagaccagggg

SEQ ID NO: 4327667 - DNA, 20 bp, Homo sapiens
ccacaagccttactcacctc

SEQ ID NO: 4327668 - DNA, 21 bp, Homo sapiens
ccacaagccttactcacctct

SEQ ID NO: 4327669 - DNA, 18 bp, Homo sapiens
ccacacccacctctgcca

SEQ ID NO: 4327670 - DNA, 16 bp, Homo sapiens
ccacaccgctggctcc

SEQ ID NO: 4327671 - DNA, 20 bp, Homo sapiens
ccacacggagctcctggcag

SEQ ID NO: 4327672 - DNA, 11 bp, Homo sapiens
ccacagccctg

SEQ ID NO: 4327673 - DNA, 12 bp, Homo sapiens
ccacagccctga

SEQ ID NO: 4327674 - DNA, 22 bp, Homo sapiens
cctgagaataagaaagtttcac

SEQ ID NO: 4327675 - DNA, 14 bp, Homo sapiens
cctgagctttctgc

SEQ ID NO: 4327676 - DNA, 18 bp, Homo sapiens
cctgaggaagatgggggc

SEQ ID NO: 4327677 - DNA, 21 bp, Homo sapiens
cctgagtggccagggaatcta

SEQ ID NO: 4327678 - DNA, 15 bp, Homo sapiens
cctgagttctgacac

SEQ ID NO: 4327679 - DNA, 13 bp, Homo sapiens
cctgatggcccaa

SEQ ID NO: 4327680 - DNA, 14 bp, Homo sapiens
cctgcacctctgga

SEQ ID NO: 4327681 - DNA, 15 bp, Homo sapiens
cctgcagcagaacct

SEQ ID NO: 4327682 - DNA, 12 bp, Homo sapiens
cctgccaaggcc

SEQ ID NO: 4327683 - DNA, 15 bp, Homo sapiens
cctgcccagtccccc

SEQ ID NO: 4327684 - DNA, 19 bp, Homo sapiens
cctgcccagttggaggaga

SEQ ID NO: 4327685 - DNA, 22 bp, Homo sapiens
cctgccctcaggctccccagtg

SEQ ID NO: 4327686 - DNA, 17 bp, Homo sapiens
cctgcccttgtctgaga

SEQ ID NO: 4327687 - DNA, 15 bp, Homo sapiens
cctgcctcttctcta

SEQ ID NO: 4327688 - DNA, 23 bp, Homo sapiens
cctgctgcttggagtgccccaag

SEQ ID NO: 4327689 - DNA, 15 bp, Homo sapiens
cctgctgggtgccag

SEQ ID NO: 4327690 - DNA, 16 bp, Homo sapiens
cctgctgggtgccagg

SEQ ID NO: 4327691 - DNA, 20 bp, Homo sapiens
cctgctgggtgccaggtgct

SEQ ID NO: 4327692 - DNA, 17 bp, Homo sapiens
cctgctgtccgtcccgc

SEQ ID NO: 4327693 - DNA, 23 bp, Homo sapiens
cctggaaacagacagggagaagt

SEQ ID NO: 4327694 - DNA, 12 bp, Homo sapiens
cctggaaaccac

SEQ ID NO: 4327695 - DNA, 15 bp, Homo sapiens
cctggaaaccacagt

SEQ ID NO: 4327696 - DNA, 17 bp, Homo sapiens
cctggaaaccacagtcc

SEQ ID NO: 4327697 - DNA, 14 bp, Homo sapiens
cctggaccctgtgg

SEQ ID NO: 4327698 - DNA, 15 bp, Homo sapiens
cctggagtataatat

SEQ ID NO: 4327699 - DNA, 21 bp, Homo sapiens
cctggcaacatcttacttgtc

SEQ ID NO: 4327700 - DNA, 12 bp, Homo sapiens
cctggcatagag

SEQ ID NO: 4327701 - DNA, 15 bp, Homo sapiens
cctggcggaggtgga

SEQ ID NO: 4327702 - DNA, 17 bp, Homo sapiens
cctggcgggatgggcca

SEQ ID NO: 4327703 - DNA, 18 bp, Homo sapiens
cctggctggagagctgct

SEQ ID NO: 4327704 - DNA, 16 bp, Homo sapiens
cctgggatgcccttcc

SEQ ID NO: 4327705 - DNA, 22 bp, Homo sapiens
cctgggatgcccttcccccttt

SEQ ID NO: 4327706 - DNA, 15 bp, Homo sapiens
cctgggcagtgagtg

SEQ ID NO: 4327707 - DNA, 17 bp, Homo sapiens
cctgggcagtgagtgcc

SEQ ID NO: 4327708 - DNA, 20 bp, Homo sapiens
cctgggcttggtaagtgaat

SEQ ID NO: 4327709 - DNA, 17 bp, Homo sapiens
cctggggtttagaaccc

SEQ ID NO: 4327710 - DNA, 16 bp, Homo sapiens
cctggtctttcctctg

SEQ ID NO: 4327711 - DNA, 21 bp, Homo sapiens
cctggtgcccttccctggagg

SEQ ID NO: 4327712 - DNA, 13 bp, Homo sapiens
cctggtgggcctc

SEQ ID NO: 4327713 - DNA, 15 bp, Homo sapiens
cctggtgggcctcga

SEQ ID NO: 4327714 - DNA, 14 bp, Homo sapiens
cctggttcgtgcca

SEQ ID NO: 4327715 - DNA, 19 bp, Homo sapiens
cctggttcgtgccatgccc

SEQ ID NO: 4327716 - DNA, 13 bp, Homo sapiens
cctggttttattt

SEQ ID NO: 4327717 - DNA, 23 bp, Homo sapiens
cctgtagagtgggagctgagtgg

SEQ ID NO: 4327718 - DNA, 15 bp, Homo sapiens
cctgtcccctcagct

SEQ ID NO: 4327719 - DNA, 17 bp, Homo sapiens
cctgtcccctcagctcc

SEQ ID NO: 4327720 - DNA, 16 bp, Homo sapiens
cctgtctctgcatctg

SEQ ID NO: 4327721 - DNA, 18 bp, Homo sapiens
cctgtgcctcccttttct

SEQ ID NO: 4327722 - DNA, 20 bp, Homo sapiens
cctgtggatgataaaacaca

SEQ ID NO: 4327723 - DNA, 17 bp, Homo sapiens
cctgtgtatacagccct

SEQ ID NO: 4327724 - DNA, 17 bp, Homo sapiens
cctgttttgagaccaga

SEQ ID NO: 4327725 - DNA, 14 bp, Homo sapiens
ccttaaatgaacta

SEQ ID NO: 4327726 - DNA, 14 bp, Homo sapiens
ccttactcacctct

SEQ ID NO: 4327727 - DNA, 21 bp, Homo sapiens
ccttactcacctctctctaag

SEQ ID NO: 4327728 - DNA, 16 bp, Homo sapiens
ccttacttgcactgtt

SEQ ID NO: 4327729 - DNA, 17 bp, Homo sapiens
ccttacttgcactgtta

SEQ ID NO: 4327730 - DNA, 14 bp, Homo sapiens
ccttagtctttcct

SEQ ID NO: 4327731 - DNA, 19 bp, Homo sapiens
ccttatgtgttacattatt

SEQ ID NO: 4327732 - DNA, 12 bp, Homo sapiens
ccttccccagct

SEQ ID NO: 4327733 - DNA, 15 bp, Homo sapiens
ccttccccagctccc

SEQ ID NO: 4327734 - DNA, 21 bp, Homo sapiens
ccttccccagctcccccaggc

SEQ ID NO: 4327735 - DNA, 22 bp, Homo sapiens
ccttccccctttctctgcctgg

SEQ ID NO: 4327736 - DNA, 24 bp, Homo sapiens
ccttccccctttctctgcctggca

SEQ ID NO: 4327737 - DNA, 14 bp, Homo sapiens
ccttccctggaggt

SEQ ID NO: 4327738 - DNA, 15 bp, Homo sapiens
ccttcccttcctcag

SEQ ID NO: 4327739 - DNA, 17 bp, Homo sapiens
ccttcccttcctcagca

SEQ ID NO: 4327740 - DNA, 18 bp, Homo sapiens
ccttcctaccctcctgca

SEQ ID NO: 4327741 - DNA, 18 bp, Homo sapiens
ccttcctcagcaggccaa

SEQ ID NO: 4327742 - DNA, 15 bp, Homo sapiens
ccttcctgtccccag

SEQ ID NO: 4327743 - DNA, 18 bp, Homo sapiens
ccttcctgtccccagggg

SEQ ID NO: 4327744 - DNA, 15 bp, Homo sapiens
ccttccttccacgga

SEQ ID NO: 4327745 - DNA, 22 bp, Homo sapiens
ccttcctttttattcagctaga

SEQ ID NO: 4327746 - DNA, 15 bp, Homo sapiens
ccttctcccaggcct

SEQ ID NO: 4327747 - DNA, 16 bp, Homo sapiens
ccttctcccaggcctc

SEQ ID NO: 4327748 - DNA, 14 bp, Homo sapiens
ccttctccctagcc

SEQ ID NO: 4327749 - DNA, 17 bp, Homo sapiens
ccttctccctagccctt

SEQ ID NO: 4327750 - DNA, 14 bp, Homo sapiens
ccttgacttatggc

SEQ ID NO: 4327751 - DNA, 20 bp, Homo sapiens
ccttgagttgattcagctct

SEQ ID NO: 4327752 - DNA, 16 bp, Homo sapiens
ccttgcacctgagcct

SEQ ID NO: 4327753 - DNA, 18 bp, Homo sapiens
ccttgcacctgagcctgt

SEQ ID NO: 4327754 - DNA, 19 bp, Homo sapiens
ccttgcccttggagctgcc

SEQ ID NO: 4327755 - DNA, 23 bp, Homo sapiens
ccttgctttttgctgtgtagttc

SEQ ID NO: 4327756 - DNA, 13 bp, Homo sapiens
ccttggagctgcc

SEQ ID NO: 4327757 - DNA, 16 bp, Homo sapiens
ccttggcatagacatg

SEQ ID NO: 4327758 - DNA, 22 bp, Homo sapiens
ccttggggctcagccacagcct

SEQ ID NO: 4327759 - DNA, 19 bp, Homo sapiens
ccttggttcatgcttctac

SEQ ID NO: 4327760 - DNA, 22 bp, Homo sapiens
cctttatcctagttccattctt

SEQ ID NO: 4327761 - DNA, 14 bp, Homo sapiens
cctttcccccaccc

SEQ ID NO: 4327762 - DNA, 20 bp, Homo sapiens
cctttcccccaccccagagt

SEQ ID NO: 4327763 - DNA, 21 bp, Homo sapiens
cctttcccccaccccagagtt

SEQ ID NO: 4327764 - DNA, 22 bp, Homo sapiens
cctttcccccaccccagagttg

SEQ ID NO: 4327765 - DNA, 14 bp, Homo sapiens
cctttctctgcctg

SEQ ID NO: 4327766 - DNA, 17 bp, Homo sapiens
cctttctctgcctggca

SEQ ID NO: 4327767 - DNA, 18 bp, Homo sapiens
cctttctctgcctggcaa

SEQ ID NO: 4327768 - DNA, 15 bp, Homo sapiens
cctttcttgcactgt

SEQ ID NO: 4327769 - DNA, 20 bp, Homo sapiens
cctttcttttttttcttggt

SEQ ID NO: 4327770 - DNA, 17 bp, Homo sapiens
cctttgaggccccaact

SEQ ID NO: 4327771 - DNA, 23 bp, Homo sapiens
cctttgggccaatttactggcca

SEQ ID NO: 4327772 - DNA, 15 bp, Homo sapiens
ccttttgagcctaga

SEQ ID NO: 4327773 - DNA, 19 bp, Homo sapiens
cctttttctggccttgact

SEQ ID NO: 4327774 - DNA, 21 bp, Homo sapiens
cgaaaacgttgacccctttcc

SEQ ID NO: 4327775 - DNA, 21 bp, Homo sapiens
cgaagacccagcagatgttta

SEQ ID NO: 4327776 - DNA, 14 bp, Homo sapiens
cgaagcaagaagaa

SEQ ID NO: 4327777 - DNA, 15 bp, Homo sapiens
cgaagcaagaagaat

SEQ ID NO: 4327778 - DNA, 16 bp, Homo sapiens
cgaagcctagaagcac

SEQ ID NO: 4327779 - DNA, 21 bp, Homo sapiens
cgaatatattactgatttaga

SEQ ID NO: 4327780 - DNA, 19 bp, Homo sapiens
cgacatcctagccccaccc

SEQ ID NO: 4327781 - DNA, 20 bp, Homo sapiens
cgacatcctagccccaccca

SEQ ID NO: 4327782 - DNA, 18 bp, Homo sapiens
cgaggagccccagccccg

SEQ ID NO: 4327783 - DNA, 13 bp, Homo sapiens
cgataaagtaaca

SEQ ID NO: 4327784 - DNA, 19 bp, Homo sapiens
cgatggaggcctacctctc

SEQ ID NO: 4327785 - DNA, 17 bp, Homo sapiens
cgatggggaaggagaag

SEQ ID NO: 4327786 - DNA, 13 bp, Homo sapiens
cgattttgcctgt

SEQ ID NO: 4327787 - DNA, 17 bp, Homo sapiens
cgcaagagggacagagc

SEQ ID NO: 4327788 - DNA, 20 bp, Homo sapiens
cgcagccacaccgctggctc

SEQ ID NO: 4327789 - DNA, 23 bp, Homo sapiens
cgccaaggctgggggaagaagct

SEQ ID NO: 4327790 - DNA, 11 bp, Homo sapiens
cgccaccattc

SEQ ID NO: 4327791 - DNA, 16 bp, Homo sapiens
cgccaccattcctgga

SEQ ID NO: 4327792 - DNA, 21 bp, Homo sapiens
ctcggctgtctcctgtccccg

SEQ ID NO: 4327793 - DNA, 17 bp, Homo sapiens
ctcggtgtggagaagcg

SEQ ID NO: 4327794 - DNA, 14 bp, Homo sapiens
ctcgtttctgccca

SEQ ID NO: 4327795 - DNA, 15 bp, Homo sapiens
ctctaagaaaagaga

SEQ ID NO: 4327796 - DNA, 15 bp, Homo sapiens
ctctaagtttagaag

SEQ ID NO: 4327797 - DNA, 13 bp, Homo sapiens
ctctacaaaaagc

SEQ ID NO: 4327798 - DNA, 18 bp, Homo sapiens
ctctataagtgttcagtg

SEQ ID NO: 4327799 - DNA, 15 bp, Homo sapiens
ctctcaatatgctta

SEQ ID NO: 4327800 - DNA, 15 bp, Homo sapiens
ctctcacaggcagct

SEQ ID NO: 4327801 - DNA, 17 bp, Homo sapiens
ctctcacaggcagctct

SEQ ID NO: 4327802 - DNA, 20 bp, Homo sapiens
ctctcacaggcagctctgag

SEQ ID NO: 4327803 - DNA, 22 bp, Homo sapiens
ctctcacaggcagctctgagcc

SEQ ID NO: 4327804 - DNA, 23 bp, Homo sapiens
ctctcacaggcagctctgagccg

SEQ ID NO: 4327805 - DNA, 20 bp, Homo sapiens
ctctccaaatcaaggatctt

SEQ ID NO: 4327806 - DNA, 18 bp, Homo sapiens
ctctccccaatccatgct

SEQ ID NO: 4327807 - DNA, 22 bp, Homo sapiens
ctctccccaatccatgcttcac

SEQ ID NO: 4327808 - DNA, 18 bp, Homo sapiens
ctctccctcccccagagc

SEQ ID NO: 4327809 - DNA, 19 bp, Homo sapiens
ctctccctcccccagagcc

SEQ ID NO: 4327810 - DNA, 21 bp, Homo sapiens
ctctccctcccccagagcccc

SEQ ID NO: 4327811 - DNA, 19 bp, Homo sapiens
ctctcctggagtctgaagc

SEQ ID NO: 4327812 - DNA, 20 bp, Homo sapiens
ctctcctggagtctgaagcc

SEQ ID NO: 4327813 - DNA, 16 bp, Homo sapiens
ctctcgtttctgccca

SEQ ID NO: 4327814 - DNA, 13 bp, Homo sapiens
ctctctatctttt

SEQ ID NO: 4327815 - DNA, 22 bp, Homo sapiens
ctctctccacacggagctcctg

SEQ ID NO: 4327816 - DNA, 14 bp, Homo sapiens
ctctctctcctgga

SEQ ID NO: 4327817 - DNA, 13 bp, Homo sapiens
ctctctctctttt

SEQ ID NO: 4327818 - DNA, 16 bp, Homo sapiens
ctctctgtggctccaa

SEQ ID NO: 4327819 - DNA, 15 bp, Homo sapiens
ctctcttcagactct

SEQ ID NO: 4327820 - DNA, 15 bp, Homo sapiens
ctctctttgttctca

SEQ ID NO: 4327821 - DNA, 19 bp, Homo sapiens
ctctcttttctgtacttcc

SEQ ID NO: 4327822 - DNA, 22 bp, Homo sapiens
ctctcttttctgtacttcctga

SEQ ID NO: 4327823 - DNA, 21 bp, Homo sapiens
ctctcttttgaggtccctgta

SEQ ID NO: 4327824 - DNA, 22 bp, Homo sapiens
ctctcttttgaggtccctgtat

SEQ ID NO: 4327825 - DNA, 23 bp, Homo sapiens
ctctgaatgctgagctgaagaaa

SEQ ID NO: 4327826 - DNA, 22 bp, Homo sapiens
ctctgcaagaattgaagcagga

SEQ ID NO: 4327827 - DNA, 13 bp, Homo sapiens
ctctgcacaagct

SEQ ID NO: 4327828 - DNA, 16 bp, Homo sapiens
ctctgcacaagctgca

SEQ ID NO: 4327829 - DNA, 21 bp, Homo sapiens
ctctgcacaagctgcaccctc

SEQ ID NO: 4327830 - DNA, 21 bp, Homo sapiens
ctctgcagggtgaagcaccag

SEQ ID NO: 4327831 - DNA, 22 bp, Homo sapiens
ctctgcagggtgaagcaccagg

SEQ ID NO: 4327832 - DNA, 11 bp, Homo sapiens
ctctgcctggc

SEQ ID NO: 4327833 - DNA, 22 bp, Homo sapiens
ctctgcctgggatgcccttccc

SEQ ID NO: 4327834 - DNA, 14 bp, Homo sapiens
ctctgtggccagga

SEQ ID NO: 4327835 - DNA, 17 bp, Homo sapiens
ctctgtggccaggagcc

SEQ ID NO: 4327836 - DNA, 18 bp, Homo sapiens
ctctgtggccaggagccc

SEQ ID NO: 4327837 - DNA, 22 bp, Homo sapiens
ctctgtgtgagcgtgtccacag

SEQ ID NO: 4327838 - DNA, 17 bp, Homo sapiens
ctcttaaacttgtgaat

SEQ ID NO: 4327839 - DNA, 15 bp, Homo sapiens
ctcttaaatcatttg

SEQ ID NO: 4327840 - DNA, 20 bp, Homo sapiens
ctcttaattttaaagaccca

SEQ ID NO: 4327841 - DNA, 13 bp, Homo sapiens
ctcttagaaaaac

SEQ ID NO: 4327842 - DNA, 20 bp, Homo sapiens
ctcttcagactctcagccca

SEQ ID NO: 4327843 - DNA, 14 bp, Homo sapiens
ctcttccacctctg

SEQ ID NO: 4327844 - DNA, 13 bp, Homo sapiens
ctcttcccagagt

SEQ ID NO: 4327845 - DNA, 15 bp, Homo sapiens
ctcttctttattgca

SEQ ID NO: 4327846 - DNA, 17 bp, Homo sapiens
ctcttctttattgcact

SEQ ID NO: 4327847 - DNA, 20 bp, Homo sapiens
ctcttggaaatgttaagaaa

SEQ ID NO: 4327848 - DNA, 22 bp, Homo sapiens
ctcttggaaatgttaagaaaga

SEQ ID NO: 4327849 - DNA, 21 bp, Homo sapiens
ctctttcaattgcagatgcca

SEQ ID NO: 4327850 - DNA, 17 bp, Homo sapiens
ctctttgttctcagctc

SEQ ID NO: 4327851 - DNA, 14 bp, Homo sapiens
ctctttttcttttc

SEQ ID NO: 4327852 - DNA, 18 bp, Homo sapiens
ctgaaacatgtgcccctg

SEQ ID NO: 4327853 - DNA, 21 bp, Homo sapiens
ctgaaacatgtgcccctgcca

SEQ ID NO: 4327854 - DNA, 20 bp, Homo sapiens
ctgaaagacagtatgagaaa

SEQ ID NO: 4327855 - DNA, 16 bp, Homo sapiens
ctgaaagccctgagct

SEQ ID NO: 4327856 - DNA, 18 bp, Homo sapiens
ctgaaagtcctgctttcc

SEQ ID NO: 4327857 - DNA, 19 bp, Homo sapiens
ctgaaccaatagaaagcaa

SEQ ID NO: 4327858 - DNA, 13 bp, Homo sapiens
ctgaaggaaggct

SEQ ID NO: 4327859 - DNA, 14 bp, Homo sapiens
ctgaagggaacagc

SEQ ID NO: 4327860 - DNA, 22 bp, Homo sapiens
ctgaagggaacagcctgagccg

SEQ ID NO: 4327861 - DNA, 18 bp, Homo sapiens
ctgaagggcattctttcc

SEQ ID NO: 4327862 - DNA, 22 bp, Homo sapiens
ctgaatccatatttcaacagag

SEQ ID NO: 4327863 - DNA, 22 bp, Homo sapiens
ctgaatgctgagctgaagaaat

SEQ ID NO: 4327864 - DNA, 16 bp, Homo sapiens
ctgaatgtttattcct

SEQ ID NO: 4327865 - DNA, 19 bp, Homo sapiens
ctgaatgtttattccttga

SEQ ID NO: 4327866 - DNA, 14 bp, Homo sapiens
ctgacatcagattt

SEQ ID NO: 4327867 - DNA, 15 bp, Homo sapiens
ctgacatcagatttc

SEQ ID NO: 4327868 - DNA, 15 bp, Homo sapiens
ctgacctctgcaaga

SEQ ID NO: 4327869 - DNA, 19 bp, Homo sapiens
ctgacggtttctccccgga

SEQ ID NO: 4327870 - DNA, 14 bp, Homo sapiens
ctgactctgttatt

SEQ ID NO: 4327871 - DNA, 21 bp, Homo sapiens
ctgactgatggtttggaaaat

SEQ ID NO: 4327872 - DNA, 20 bp, Homo sapiens
ctgactggattcattctcat

SEQ ID NO: 4327873 - DNA, 14 bp, Homo sapiens
ctgactggttgtca

SEQ ID NO: 4327874 - DNA, 16 bp, Homo sapiens
ctgactggttgtcaga

SEQ ID NO: 4327875 - DNA, 17 bp, Homo sapiens
ctgagcccagagaagct

SEQ ID NO: 4327876 - DNA, 11 bp, Homo sapiens
ctgagccccag

SEQ ID NO: 4327877 - DNA, 13 bp, Homo sapiens
ctgagccccagcc

SEQ ID NO: 4327878 - DNA, 14 bp, Homo sapiens
ctgagccccagccc

SEQ ID NO: 4327879 - DNA, 18 bp, Homo sapiens
ctgagcccccttcctgtc

SEQ ID NO: 4327880 - DNA, 17 bp, Homo sapiens
ctgagcctggctggaga

SEQ ID NO: 4327881 - DNA, 15 bp, Homo sapiens
ctgagctgaagaaat

SEQ ID NO: 4327882 - DNA, 15 bp, Homo sapiens
ctgagctttctgcta

SEQ ID NO: 4327883 - DNA, 23 bp, Homo sapiens
ctgaggaagatgggggcaagaag

SEQ ID NO: 4327884 - DNA, 17 bp, Homo sapiens
ctgaggctctctaagaa

SEQ ID NO: 4327885 - DNA, 13 bp, Homo sapiens
ctgaggtgggagg

SEQ ID NO: 4327886 - DNA, 17 bp, Homo sapiens
ctgagtctcccaaggct

SEQ ID NO: 4327887 - DNA, 15 bp, Homo sapiens
ctgagtgctatgtgt

SEQ ID NO: 4327888 - DNA, 22 bp, Homo sapiens
ctgagtgggggatcacagcctc

SEQ ID NO: 4327889 - DNA, 18 bp, Homo sapiens
ctgagttctgacactgtg

SEQ ID NO: 4327890 - DNA, 17 bp, Homo sapiens
ctgatctgtactttgtg

SEQ ID NO: 4327891 - DNA, 22 bp, Homo sapiens
ctgatgcatgctttgagaccag

SEQ ID NO: 4327892 - DNA, 18 bp, Homo sapiens
ctgatgcccaccgaggag

SEQ ID NO: 4327893 - DNA, 17 bp, Homo sapiens
ctgatggtttggaaaat

SEQ ID NO: 4327894 - DNA, 19 bp, Homo sapiens
ctgatgtttacaatgatgc

SEQ ID NO: 4327895 - DNA, 21 bp, Homo sapiens
ctgattagaagtataaggtgc

SEQ ID NO: 4327896 - DNA, 19 bp, Homo sapiens
ctgattataccatgtgtgc

SEQ ID NO: 4327897 - DNA, 20 bp, Homo sapiens
ctgattccctctcccaccca

SEQ ID NO: 4327898 - DNA, 23 bp, Homo sapiens
ctgatttagaagcaaagatttca

SEQ ID NO: 4327899 - DNA, 15 bp, Homo sapiens
ctgcaaataaagcct

SEQ ID NO: 4327900 - DNA, 20 bp, Homo sapiens
ctgcaagaattgaagcagga

SEQ ID NO: 4327901 - DNA, 14 bp, Homo sapiens
ctgcacaagctgca

SEQ ID NO: 4327902 - DNA, 15 bp, Homo sapiens
ctgcacaagctgcac

SEQ ID NO: 4327903 - DNA, 14 bp, Homo sapiens
ctgcaccctcaggc

SEQ ID NO: 4327904 - DNA, 18 bp, Homo sapiens
ctgcaccctcaggcaggt

SEQ ID NO: 4327905 - DNA, 13 bp, Homo sapiens
ctgcacctctgga

SEQ ID NO: 4327906 - DNA, 16 bp, Homo sapiens
ctgcactccagcctgg

SEQ ID NO: 4327907 - DNA, 12 bp, Homo sapiens
ctgcagcaactc

SEQ ID NO: 4327908 - DNA, 18 bp, Homo sapiens
ctgcagcaactcccacga

SEQ ID NO: 4327909 - DNA, 12 bp, Homo sapiens
ctgcagctttgt

SEQ ID NO: 4327910 - DNA, 19 bp, Homo sapiens
cttgtttattgagtttgta

SEQ ID NO: 4327911 - DNA, 20 bp, Homo sapiens
ctttaaaagtcattattcct

SEQ ID NO: 4327912 - DNA, 21 bp, Homo sapiens
ctttaaaagtcattattcctg

SEQ ID NO: 4327913 - DNA, 14 bp, Homo sapiens
ctttaaagataagt

SEQ ID NO: 4327914 - DNA, 15 bp, Homo sapiens
ctttacccctgctga

SEQ ID NO: 4327915 - DNA, 12 bp, Homo sapiens
ctttcaattgca

SEQ ID NO: 4327916 - DNA, 19 bp, Homo sapiens
ctttcatctcccagatcct

SEQ ID NO: 4327917 - DNA, 16 bp, Homo sapiens
ctttccaaatgcccag

SEQ ID NO: 4327918 - DNA, 22 bp, Homo sapiens
ctttcccaggtaatttaaattg

SEQ ID NO: 4327919 - DNA, 20 bp, Homo sapiens
ctttcccagtgagtctctgg

SEQ ID NO: 4327920 - DNA, 20 bp, Homo sapiens
ctttcccccaccccagagtt

SEQ ID NO: 4327921 - DNA, 21 bp, Homo sapiens
ctttcccccaccccagagttg

SEQ ID NO: 4327922 - DNA, 18 bp, Homo sapiens
ctttcccctcctccctgg

SEQ ID NO: 4327923 - DNA, 13 bp, Homo sapiens
ctttctctgcctg

SEQ ID NO: 4327924 - DNA, 20 bp, Homo sapiens
ctttctgagtgagttttact

SEQ ID NO: 4327925 - DNA, 16 bp, Homo sapiens
ctttctgtctctctct

SEQ ID NO: 4327926 - DNA, 13 bp, Homo sapiens
ctttcttgcactg

SEQ ID NO: 4327927 - DNA, 18 bp, Homo sapiens
ctttcttgcactgtccag

SEQ ID NO: 4327928 - DNA, 12 bp, Homo sapiens
ctttctttgatt

SEQ ID NO: 4327929 - DNA, 18 bp, Homo sapiens
ctttcttttgattcttcc

SEQ ID NO: 4327930 - DNA, 20 bp, Homo sapiens
ctttgaaacctgctctgtag

SEQ ID NO: 4327931 - DNA, 14 bp, Homo sapiens
ctttgaataaaaga

SEQ ID NO: 4327932 - DNA, 15 bp, Homo sapiens
ctttgaataaaagaa

SEQ ID NO: 4327933 - DNA, 19 bp, Homo sapiens
ctttgagaccagaagaaaa

SEQ ID NO: 4327934 - DNA, 18 bp, Homo sapiens
ctttgaggccccaactca

SEQ ID NO: 4327935 - DNA, 19 bp, Homo sapiens
ctttgcaaattatttatta

SEQ ID NO: 4327936 - DNA, 22 bp, Homo sapiens
ctttgcaaattatttattactt

SEQ ID NO: 4327937 - DNA, 18 bp, Homo sapiens
ctttgcatagctttcaca

SEQ ID NO: 4327938 - DNA, 20 bp, Homo sapiens
ctttgcattccttacttgca

SEQ ID NO: 4327939 - DNA, 22 bp, Homo sapiens
ctttgcattccttacttgcact

SEQ ID NO: 4327940 - DNA, 19 bp, Homo sapiens
ctttgcccaacaccagccc

SEQ ID NO: 4327941 - DNA, 22 bp, Homo sapiens
ctttgcccaacaccagcccctg

SEQ ID NO: 4327942 - DNA, 11 bp, Homo sapiens
ctttgcctggt

SEQ ID NO: 4327943 - DNA, 18 bp, Homo sapiens
ctttgccttgatgttgtg

SEQ ID NO: 4327944 - DNA, 14 bp, Homo sapiens
ctttgctgcatttt

SEQ ID NO: 4327945 - DNA, 19 bp, Homo sapiens
ctttgctgcattttacaca

SEQ ID NO: 4327946 - DNA, 13 bp, Homo sapiens
ctttgctgttact

SEQ ID NO: 4327947 - DNA, 17 bp, Homo sapiens
ctttggataataggaat

SEQ ID NO: 4327948 - DNA, 22 bp, Homo sapiens
ctttgggccaatttactggcca

SEQ ID NO: 4327949 - DNA, 14 bp, Homo sapiens
ctttgtacccccca

SEQ ID NO: 4327950 - DNA, 14 bp, Homo sapiens
ctttgtctgtccag

SEQ ID NO: 4327951 - DNA, 19 bp, Homo sapiens
ctttgtggaccaattattg

SEQ ID NO: 4327952 - DNA, 16 bp, Homo sapiens
ctttgtggttttatgg

SEQ ID NO: 4327953 - DNA, 18 bp, Homo sapiens
ctttgtgtaatctaagta

SEQ ID NO: 4327954 - DNA, 16 bp, Homo sapiens
ctttgtttaaatgcca

SEQ ID NO: 4327955 - DNA, 17 bp, Homo sapiens
ctttgtttaaatgccaa

SEQ ID NO: 4327956 - DNA, 18 bp, Homo sapiens
ctttgtttgttgtcagct

SEQ ID NO: 4327957 - DNA, 22 bp, Homo sapiens
cttttactggactgtctgatca

SEQ ID NO: 4327958 - DNA, 23 bp, Homo sapiens
cttttctgtccgagctttgaaaa

SEQ ID NO: 4327959 - DNA, 14 bp, Homo sapiens
cttttctttctttt

SEQ ID NO: 4327960 - DNA, 21 bp, Homo sapiens
cttttgagtatggctatctat

SEQ ID NO: 4327961 - DNA, 23 bp, Homo sapiens
cttttggacctggctaatggagt

SEQ ID NO: 4327962 - DNA, 15 bp, Homo sapiens
ctttttaaaatagac

SEQ ID NO: 4327963 - DNA, 18 bp, Homo sapiens
ctttttcttaccctctct

SEQ ID NO: 4327964 - DNA, 14 bp, Homo sapiens
ctttttcttttcta

SEQ ID NO: 4327965 - DNA, 13 bp, Homo sapiens
ctttttttcagtt

SEQ ID NO: 4327966 - DNA, 11 bp, Homo sapiens
ctttttttcct

SEQ ID NO: 4327967 - DNA, 12 bp, Homo sapiens
ctttttttgtta

SEQ ID NO: 4327968 - DNA, 16 bp, Homo sapiens
gaaaaaaataactatt

SEQ ID NO: 4327969 - DNA, 18 bp, Homo sapiens
gaaaaaaataactatttt

SEQ ID NO: 4327970 - DNA, 19 bp, Homo sapiens
gaaaaaatattttcctgcc

SEQ ID NO: 4327971 - DNA, 22 bp, Homo sapiens
gaaaaacagaggatgctgaagt

SEQ ID NO: 4327972 - DNA, 16 bp, Homo sapiens
gaaaaagaaaaaatat

SEQ ID NO: 4327973 - DNA, 12 bp, Homo sapiens
gaaaaagaagaa

SEQ ID NO: 4327974 - DNA, 19 bp, Homo sapiens
gaaaaagaagaaggagctc

SEQ ID NO: 4327975 - DNA, 17 bp, Homo sapiens
gaaaaagcacaagaagc

SEQ ID NO: 4327976 - DNA, 21 bp, Homo sapiens
gaaaaagtgtacatgaagaat

SEQ ID NO: 4327977 - DNA, 19 bp, Homo sapiens
gaaaaatattcaagtaaca

SEQ ID NO: 4327978 - DNA, 21 bp, Homo sapiens
gaaaaatattcaagtaacact

SEQ ID NO: 4327979 - DNA, 16 bp, Homo sapiens
gaaaaatgagcctggc

SEQ ID NO: 4327980 - DNA, 20 bp, Homo sapiens
gaaaaatgcccatttttgct

SEQ ID NO: 4327981 - DNA, 18 bp, Homo sapiens
gaaaaccatctctgtgat

SEQ ID NO: 4327982 - DNA, 16 bp, Homo sapiens
gaaaactgacatcaga

SEQ ID NO: 4327983 - DNA, 19 bp, Homo sapiens
gaaaactgacatcagattt

SEQ ID NO: 4327984 - DNA, 18 bp, Homo sapiens
gaaaagaaaaatgagcct

SEQ ID NO: 4327985 - DNA, 19 bp, Homo sapiens
gaaaagatcccaagatgga

SEQ ID NO: 4327986 - DNA, 22 bp, Homo sapiens
gaaaaggatgatggaaaaatca

SEQ ID NO: 4327987 - DNA, 16 bp, Homo sapiens
gaaaagtcgttttcca

SEQ ID NO: 4327988 - DNA, 17 bp, Homo sapiens
gaaaataattgttccaa

SEQ ID NO: 4327989 - DNA, 14 bp, Homo sapiens
gaaaatcagcctgc

SEQ ID NO: 4327990 - DNA, 16 bp, Homo sapiens
gaaaatcagcctgctc

SEQ ID NO: 4327991 - DNA, 22 bp, Homo sapiens
gaaaatcttagtatagtagaaa

SEQ ID NO: 4327992 - DNA, 16 bp, Homo sapiens
gaaaatgaactgcttt

SEQ ID NO: 4327993 - DNA, 13 bp, Homo sapiens
gaaaatgaatgga

SEQ ID NO: 4327994 - DNA, 16 bp, Homo sapiens
gaaaatgagaatctgt

SEQ ID NO: 4327995 - DNA, 18 bp, Homo sapiens
gaaaatgcattttcttca

SEQ ID NO: 4327996 - DNA, 22 bp, Homo sapiens
gaaaatggatgacaaagaaaat

SEQ ID NO: 4327997 - DNA, 16 bp, Homo sapiens
gaaaattacgttctta

SEQ ID NO: 4327998 - DNA, 23 bp, Homo sapiens
gaaaattctctcaagacttctcc

SEQ ID NO: 4327999 - DNA, 16 bp, Homo sapiens
gaaacagacagggaga

SEQ ID NO: 4328000 - DNA, 14 bp, Homo sapiens
gaaacatagaaaca

SEQ ID NO: 4328001 - DNA, 19 bp, Homo sapiens
gaaacatagaaacatacac

SEQ ID NO: 4328002 - DNA, 15 bp, Homo sapiens
gaaacatagaaagac

SEQ ID NO: 4328003 - DNA, 19 bp, Homo sapiens
gaaacatgtgcccctgcca

SEQ ID NO: 4328004 - DNA, 17 bp, Homo sapiens
gaaacgagaagtgccct

SEQ ID NO: 4328005 - DNA, 10 bp, Homo sapiens
gaaacttttg

SEQ ID NO: 4328006 - DNA, 16 bp, Homo sapiens
gaaagaaaaaaaaata

SEQ ID NO: 4328007 - DNA, 18 bp, Homo sapiens
gaaagacagtatgagaaa

SEQ ID NO: 4328008 - DNA, 13 bp, Homo sapiens
gaaagatgacaaa

SEQ ID NO: 4328009 - DNA, 16 bp, Homo sapiens
gaaagatttggaaaat

SEQ ID NO: 4328010 - DNA, 20 bp, Homo sapiens
gaaagatttggaaaattcac

SEQ ID NO: 4328011 - DNA, 21 bp, Homo sapiens
gaaagccctgagctttctgct

SEQ ID NO: 4328012 - DNA, 22 bp, Homo sapiens
gaaagccctgagctttctgcta

SEQ ID NO: 4328013 - DNA, 18 bp, Homo sapiens
gaaagctgggagcgtggg

SEQ ID NO: 4328014 - DNA, 16 bp, Homo sapiens
gaaataattacttttg

SEQ ID NO: 4328015 - DNA, 22 bp, Homo sapiens
gaaatcatagtatatgattgta

SEQ ID NO: 4328016 - DNA, 17 bp, Homo sapiens
gaaattaacaagaactc

SEQ ID NO: 4328017 - DNA, 19 bp, Homo sapiens
gaaattaacaagaactcat

SEQ ID NO: 4328018 - DNA, 15 bp, Homo sapiens
gaaattaagaactga

SEQ ID NO: 4328019 - DNA, 16 bp, Homo sapiens
gaaattaagaactgaa

SEQ ID NO: 4328020 - DNA, 18 bp, Homo sapiens
gaaattattggtatattt

SEQ ID NO: 4328021 - DNA, 17 bp, Homo sapiens
gaacagcaggatgccct

SEQ ID NO: 4328022 - DNA, 14 bp, Homo sapiens
gaacagcctgagcc

SEQ ID NO: 4328023 - DNA, 19 bp, Homo sapiens
gaacatgcaagaatttctg

SEQ ID NO: 4328024 - DNA, 13 bp, Homo sapiens
gaaccaatagaaa

SEQ ID NO: 4328025 - DNA, 16 bp, Homo sapiens
gaaccaatagaaagca

SEQ ID NO: 4328026 - DNA, 15 bp, Homo sapiens
gaacgcacatagctc

SEQ ID NO: 4328027 - DNA, 20 bp, Homo sapiens
gaacgtatttagccattacc

SEQ ID NO: 4328028 - DNA, 14 bp, Homo sapiens
gacttttattatgg

SEQ ID NO: 4328029 - DNA, 21 bp, Homo sapiens
gacttttctgtccgagctttg

SEQ ID NO: 4328030 - DNA, 21 bp, Homo sapiens
gagaaaaatattcaagtaaca

SEQ ID NO: 4328031 - DNA, 18 bp, Homo sapiens
gagaaaatgaatggacaa

SEQ ID NO: 4328032 - DNA, 17 bp, Homo sapiens
gagaaatgaagcagagg

SEQ ID NO: 4328033 - DNA, 15 bp, Homo sapiens
gagaaggagtgccat

SEQ ID NO: 4328034 - DNA, 15 bp, Homo sapiens
gagaagttgagcagg

SEQ ID NO: 4328035 - DNA, 16 bp, Homo sapiens
gagaatgcacagatat

SEQ ID NO: 4328036 - DNA, 13 bp, Homo sapiens
gagacccacagcc

SEQ ID NO: 4328037 - DNA, 15 bp, Homo sapiens
gagacccacagccct

SEQ ID NO: 4328038 - DNA, 18 bp, Homo sapiens
gagactcgctcactccca

SEQ ID NO: 4328039 - DNA, 20 bp, Homo sapiens
gagactgcaagtaaggcttt

SEQ ID NO: 4328040 - DNA, 17 bp, Homo sapiens
gagactgggcacccctg

SEQ ID NO: 4328041 - DNA, 22 bp, Homo sapiens
gagactgggcacccctgcctcc

SEQ ID NO: 4328042 - DNA, 23 bp, Homo sapiens
gagacttcgaagacccagcagat

SEQ ID NO: 4328043 - DNA, 22 bp, Homo sapiens
gagagagtggtaaaaaagaaat

SEQ ID NO: 4328044 - DNA, 20 bp, Homo sapiens
gagagcctctgttttgtaaa

SEQ ID NO: 4328045 - DNA, 21 bp, Homo sapiens
gagagctagcagcagggaggg

SEQ ID NO: 4328046 - DNA, 13 bp, Homo sapiens
gagaggaagaaac

SEQ ID NO: 4328047 - DNA, 19 bp, Homo sapiens
gagaggcctcggctgtctc

SEQ ID NO: 4328048 - DNA, 23 bp, Homo sapiens
gagaggcctcggctgtctcctgt

SEQ ID NO: 4328049 - DNA, 21 bp, Homo sapiens
gagagggtctccagtgttccc

SEQ ID NO: 4328050 - DNA, 18 bp, Homo sapiens
gagagtggtaaaaaagaa

SEQ ID NO: 4328051 - DNA, 14 bp, Homo sapiens
gagatcagcctggg

SEQ ID NO: 4328052 - DNA, 16 bp, Homo sapiens
gagatcagcctgggca

SEQ ID NO: 4328053 - DNA, 21 bp, Homo sapiens
gagatcttcccctaacctttg

SEQ ID NO: 4328054 - DNA, 18 bp, Homo sapiens
gagattggatttgctgtg

SEQ ID NO: 4328055 - DNA, 14 bp, Homo sapiens
gagcatctctgcct

SEQ ID NO: 4328056 - DNA, 21 bp, Homo sapiens
gagcattaactaaatgctcat

SEQ ID NO: 4328057 - DNA, 15 bp, Homo sapiens
gagcattggcccctg

SEQ ID NO: 4328058 - DNA, 17 bp, Homo sapiens
gagcccagttggaaaat

SEQ ID NO: 4328059 - DNA, 16 bp, Homo sapiens
gagccccagccccaat

SEQ ID NO: 4328060 - DNA, 23 bp, Homo sapiens
gagccccagccccaatccagaga

SEQ ID NO: 4328061 - DNA, 22 bp, Homo sapiens
gagccccagccccgtcccagag

SEQ ID NO: 4328062 - DNA, 23 bp, Homo sapiens
gagccccagccccgtcccagagg

SEQ ID NO: 4328063 - DNA, 14 bp, Homo sapiens
gagcctcctgccca

SEQ ID NO: 4328064 - DNA, 22 bp, Homo sapiens
gagcctgtccaatttctgctgt

SEQ ID NO: 4328065 - DNA, 23 bp, Homo sapiens
gagcgtgggctcagcagggctgg

SEQ ID NO: 4328066 - DNA, 14 bp, Homo sapiens
gagcgtgtccacag

SEQ ID NO: 4328067 - DNA, 20 bp, Homo sapiens
gagctatagtgaagaatagg

SEQ ID NO: 4328068 - DNA, 13 bp, Homo sapiens
gagctgaagaaat

SEQ ID NO: 4328069 - DNA, 18 bp, Homo sapiens
gagctgctaagctaaaga

SEQ ID NO: 4328070 - DNA, 22 bp, Homo sapiens
gagcttattcaatatttactga

SEQ ID NO: 4328071 - DNA, 13 bp, Homo sapiens
gagcttattgttt

SEQ ID NO: 4328072 - DNA, 21 bp, Homo sapiens
gagcttattgttttaaaaagt

SEQ ID NO: 4328073 - DNA, 22 bp, Homo sapiens
gagctttctgctatcaaagagg

SEQ ID NO: 4328074 - DNA, 19 bp, Homo sapiens
gagctttctgtgcatgtgc

SEQ ID NO: 4328075 - DNA, 21 bp, Homo sapiens
gaggaaccgaggtgttgccag

SEQ ID NO: 4328076 - DNA, 16 bp, Homo sapiens
gaggaactgtacagaa

SEQ ID NO: 4328077 - DNA, 21 bp, Homo sapiens
gaggaagatgggggcaagaag

SEQ ID NO: 4328078 - DNA, 20 bp, Homo sapiens
gaggaagatgttcaatagaa

SEQ ID NO: 4328079 - DNA, 20 bp, Homo sapiens
gaggacactaggagactggt

SEQ ID NO: 4328080 - DNA, 15 bp, Homo sapiens
gaggactgaagctgg

SEQ ID NO: 4328081 - DNA, 17 bp, Homo sapiens
gaggactgaagctgggg

SEQ ID NO: 4328082 - DNA, 13 bp, Homo sapiens
gaggagactgggc

SEQ ID NO: 4328083 - DNA, 23 bp, Homo sapiens
gaggagactgggcacccctgcct

SEQ ID NO: 4328084 - DNA, 15 bp, Homo sapiens
gaggaggcagaaaga

SEQ ID NO: 4328085 - DNA, 17 bp, Homo sapiens
gaggaggcagaaagatt

SEQ ID NO: 4328086 - DNA, 13 bp, Homo sapiens
gaggatctcttga

SEQ ID NO: 4328087 - DNA, 16 bp, Homo sapiens
gaggatctcttgagcc

SEQ ID NO: 4328088 - DNA, 19 bp, Homo sapiens
gaggatctcttgagcctgg

SEQ ID NO: 4328089 - DNA, 16 bp, Homo sapiens
gaggattgcttgagct

SEQ ID NO: 4328090 - DNA, 15 bp, Homo sapiens
gaggcatctgcatgg

SEQ ID NO: 4328091 - DNA, 13 bp, Homo sapiens
gaggcctacctct

SEQ ID NO: 4328092 - DNA, 21 bp, Homo sapiens
gaggcctcggctgtctcctgt

SEQ ID NO: 4328093 - DNA, 13 bp, Homo sapiens
gaggcgaataaat

SEQ ID NO: 4328094 - DNA, 17 bp, Homo sapiens
gaggcgaataaatgttc

SEQ ID NO: 4328095 - DNA, 13 bp, Homo sapiens
gaggctgggcagg

SEQ ID NO: 4328096 - DNA, 20 bp, Homo sapiens
gaggcttccaagcattactt

SEQ ID NO: 4328097 - DNA, 10 bp, Homo sapiens
gagggaaaag

SEQ ID NO: 4328098 - DNA, 16 bp, Homo sapiens
gagggaaaagggaagt

SEQ ID NO: 4328099 - DNA, 14 bp, Homo sapiens
gagggacagagccc

SEQ ID NO: 4328100 - DNA, 16 bp, Homo sapiens
gagggacagagcccgg

SEQ ID NO: 4328101 - DNA, 19 bp, Homo sapiens
gagggacagagcccgggag

SEQ ID NO: 4328102 - DNA, 14 bp, Homo sapiens
gaggggcccctgct

SEQ ID NO: 4328103 - DNA, 12 bp, Homo sapiens
gagggtggaata

SEQ ID NO: 4328104 - DNA, 15 bp, Homo sapiens
gagggtggtgggtgg

SEQ ID NO: 4328105 - DNA, 15 bp, Homo sapiens
gaggtaaagatatgg

SEQ ID NO: 4328106 - DNA, 17 bp, Homo sapiens
gaggtagaggaaaatca

SEQ ID NO: 4328107 - DNA, 10 bp, Homo sapiens
gaggtccctg

SEQ ID NO: 4328108 - DNA, 16 bp, Homo sapiens
gaggtctctccctccc

SEQ ID NO: 4328109 - DNA, 15 bp, Homo sapiens
gaggtggagtggcca

SEQ ID NO: 4328110 - DNA, 20 bp, Homo sapiens
gaggtggccctcccaggctg

SEQ ID NO: 4328111 - DNA, 20 bp, Homo sapiens
gaggttcgggattccctggt

SEQ ID NO: 4328112 - DNA, 16 bp, Homo sapiens
gaggtttcaaacctcc

SEQ ID NO: 4328113 - DNA, 13 bp, Homo sapiens
gagtcatttctga

SEQ ID NO: 4328114 - DNA, 15 bp, Homo sapiens
gagtccacacttgaa

SEQ ID NO: 4328115 - DNA, 14 bp, Homo sapiens
gagtcctttctttt

SEQ ID NO: 4328116 - DNA, 23 bp, Homo sapiens
gagtcctttcttttgaaatgcca

SEQ ID NO: 4328117 - DNA, 13 bp, Homo sapiens
gagtctcccaagg

SEQ ID NO: 4328118 - DNA, 12 bp, Homo sapiens
gagtctgaagcc

SEQ ID NO: 4328119 - DNA, 15 bp, Homo sapiens
gagtctgaagcctgc

SEQ ID NO: 4328120 - DNA, 17 bp, Homo sapiens
gagtctggggtgggagg

SEQ ID NO: 4328121 - DNA, 17 bp, Homo sapiens
gagtgctatgtgtgctt

SEQ ID NO: 4328122 - DNA, 13 bp, Homo sapiens
gagtggccactgg

SEQ ID NO: 4328123 - DNA, 18 bp, Homo sapiens
gagtggtaaaaaagaaat

SEQ ID NO: 4328124 - DNA, 20 bp, Homo sapiens
gagtggtaaaaaagaaatga

SEQ ID NO: 4328125 - DNA, 19 bp, Homo sapiens
gagtggtttttgctctagg

SEQ ID NO: 4328126 - DNA, 12 bp, Homo sapiens
gagtgtatttta

SEQ ID NO: 4328127 - DNA, 17 bp, Homo sapiens
gagtgtgtgtgtgtgtc

SEQ ID NO: 4328128 - DNA, 19 bp, Homo sapiens
gagttcctctttgccctga

SEQ ID NO: 4328129 - DNA, 14 bp, Homo sapiens
gagttgctgtgccg

SEQ ID NO: 4328130 - DNA, 21 bp, Homo sapiens
gagtttgctaaattgagaggg

SEQ ID NO: 4328131 - DNA, 11 bp, Homo sapiens
gagtttgtagg

SEQ ID NO: 4328132 - DNA, 22 bp, Homo sapiens
gataaagtaacagtatgtcaga

SEQ ID NO: 4328133 - DNA, 22 bp, Homo sapiens
gataactactgacgaaagagtc

SEQ ID NO: 4328134 - DNA, 21 bp, Homo sapiens
gataagacttgtttctttctg

SEQ ID NO: 4328135 - DNA, 17 bp, Homo sapiens
gataataatattgtttt

SEQ ID NO: 4328136 - DNA, 18 bp, Homo sapiens
gataataatattgttttt

SEQ ID NO: 4328137 - DNA, 19 bp, Homo sapiens
gataataatattgtttttc

SEQ ID NO: 4328138 - DNA, 14 bp, Homo sapiens
gataataggaattc

SEQ ID NO: 4328139 - DNA, 15 bp, Homo sapiens
gataatcttcggcca

SEQ ID NO: 4328140 - DNA, 18 bp, Homo sapiens
gataatcttcggccaatt

SEQ ID NO: 4328141 - DNA, 18 bp, Homo sapiens
gatacctattaaaggaaa

SEQ ID NO: 4328142 - DNA, 19 bp, Homo sapiens
gatacctattaaaggaaaa

SEQ ID NO: 4328143 - DNA, 22 bp, Homo sapiens
gatacctattaaaggaaaacca

SEQ ID NO: 4328144 - DNA, 14 bp, Homo sapiens
gatagaaaaaaact

SEQ ID NO: 4328145 - DNA, 17 bp, Homo sapiens
gatagaaaaaaactaaa

SEQ ID NO: 4328146 - DNA, 17 bp, Homo sapiens
gctgggacctaatgctg

SEQ ID NO: 4328147 - DNA, 15 bp, Homo sapiens
gctgggcagggcctg

SEQ ID NO: 4328148 - DNA, 19 bp, Homo sapiens
gctgggcagggcctggcgg

SEQ ID NO: 4328149 - DNA, 14 bp, Homo sapiens
gctgggtgccaggt

SEQ ID NO: 4328150 - DNA, 21 bp, Homo sapiens
gctgggtggcaccagcagcct

SEQ ID NO: 4328151 - DNA, 18 bp, Homo sapiens
gctggtatattgtgtaaa

SEQ ID NO: 4328152 - DNA, 23 bp, Homo sapiens
gctggtgcctcttttcagtagtg

SEQ ID NO: 4328153 - DNA, 13 bp, Homo sapiens
gctggtggccttg

SEQ ID NO: 4328154 - DNA, 14 bp, Homo sapiens
gctggtggccttgg

SEQ ID NO: 4328155 - DNA, 21 bp, Homo sapiens
gctggttgtaccctctccagg

SEQ ID NO: 4328156 - DNA, 16 bp, Homo sapiens
gctgtccatgcttctc

SEQ ID NO: 4328157 - DNA, 17 bp, Homo sapiens
gctgtccgtgcttgctg

SEQ ID NO: 4328158 - DNA, 13 bp, Homo sapiens
gctgtctcctgtc

SEQ ID NO: 4328159 - DNA, 19 bp, Homo sapiens
gctgtcttgatgactgctg

SEQ ID NO: 4328160 - DNA, 13 bp, Homo sapiens
gctgttcagctgg

SEQ ID NO: 4328161 - DNA, 16 bp, Homo sapiens
gctgttgatcccctct

SEQ ID NO: 4328162 - DNA, 21 bp, Homo sapiens
gctgtttactcccttctgtag

SEQ ID NO: 4328163 - DNA, 20 bp, Homo sapiens
gcttacagtttattttctgt

SEQ ID NO: 4328164 - DNA, 16 bp, Homo sapiens
gcttagagaatgttct

SEQ ID NO: 4328165 - DNA, 15 bp, Homo sapiens
gcttagatgttccaa

SEQ ID NO: 4328166 - DNA, 15 bp, Homo sapiens
gcttagtaaaattta

SEQ ID NO: 4328167 - DNA, 21 bp, Homo sapiens
gcttcaaattggtctgaaagg

SEQ ID NO: 4328168 - DNA, 23 bp, Homo sapiens
gcttcactcatgcaaactgcttt

SEQ ID NO: 4328169 - DNA, 17 bp, Homo sapiens
gcttcagagtttgtgtg

SEQ ID NO: 4328170 - DNA, 15 bp, Homo sapiens
gcttcctgtctgttt

SEQ ID NO: 4328171 - DNA, 19 bp, Homo sapiens
gcttcctgtctgtttatat

SEQ ID NO: 4328172 - DNA, 22 bp, Homo sapiens
gcttctagacactccttgaaat

SEQ ID NO: 4328173 - DNA, 20 bp, Homo sapiens
gcttctagccatgtagtgct

SEQ ID NO: 4328174 - DNA, 19 bp, Homo sapiens
gcttctcagttgcagaaaa

SEQ ID NO: 4328175 - DNA, 16 bp, Homo sapiens
gcttctcatcttgtga

SEQ ID NO: 4328176 - DNA, 14 bp, Homo sapiens
gcttctccccagaa

SEQ ID NO: 4328177 - DNA, 22 bp, Homo sapiens
gcttctcttctttattgcacta

SEQ ID NO: 4328178 - DNA, 21 bp, Homo sapiens
gcttctctttgtgcagtgtta

SEQ ID NO: 4328179 - DNA, 18 bp, Homo sapiens
gcttctgcagcaactccc

SEQ ID NO: 4328180 - DNA, 23 bp, Homo sapiens
gcttctgcagcaactcccacgac

SEQ ID NO: 4328181 - DNA, 14 bp, Homo sapiens
gcttcttggacctt

SEQ ID NO: 4328182 - DNA, 18 bp, Homo sapiens
gcttgagctttctgtgca

SEQ ID NO: 4328183 - DNA, 18 bp, Homo sapiens
gcttgatttgatctttgt

SEQ ID NO: 4328184 - DNA, 12 bp, Homo sapiens
gcttgcttctgc

SEQ ID NO: 4328185 - DNA, 20 bp, Homo sapiens
gcttgggaggggccggagga

SEQ ID NO: 4328186 - DNA, 22 bp, Homo sapiens
gcttgggtcctactcctggagc

SEQ ID NO: 4328187 - DNA, 13 bp, Homo sapiens
gctttatctttgt

SEQ ID NO: 4328188 - DNA, 15 bp, Homo sapiens
gctttctgtgcatgt

SEQ ID NO: 4328189 - DNA, 16 bp, Homo sapiens
gctttctgtgcatgtg

SEQ ID NO: 4328190 - DNA, 21 bp, Homo sapiens
gctttgagaccagaagaaaag

SEQ ID NO: 4328191 - DNA, 20 bp, Homo sapiens
gctttgcccaacaccagccc

SEQ ID NO: 4328192 - DNA, 23 bp, Homo sapiens
gctttgcccaacaccagcccctg

SEQ ID NO: 4328193 - DNA, 14 bp, Homo sapiens
gctttgtctgtcca

SEQ ID NO: 4328194 - DNA, 17 bp, Homo sapiens
gctttgtctgtccagcc

SEQ ID NO: 4328195 - DNA, 15 bp, Homo sapiens
gctttgtgcatatgt

SEQ ID NO: 4328196 - DNA, 17 bp, Homo sapiens
gctttgtgcatatgtta

SEQ ID NO: 4328197 - DNA, 17 bp, Homo sapiens
gcttttcctttcttttt

SEQ ID NO: 4328198 - DNA, 17 bp, Homo sapiens
gcttttctcctctttcc

SEQ ID NO: 4328199 - DNA, 21 bp, Homo sapiens
ggaaaaaactttgctccaggc

SEQ ID NO: 4328200 - DNA, 22 bp, Homo sapiens
ggaaaaacagaggatgctgaag

SEQ ID NO: 4328201 - DNA, 14 bp, Homo sapiens
ggaaaaatgtagac

SEQ ID NO: 4328202 - DNA, 15 bp, Homo sapiens
ggaaaacaatttgca

SEQ ID NO: 4328203 - DNA, 18 bp, Homo sapiens
ggaaaacaatttgcataa

SEQ ID NO: 4328204 - DNA, 20 bp, Homo sapiens
ggaaaaggatgatggaaaaa

SEQ ID NO: 4328205 - DNA, 15 bp, Homo sapiens
ggaaaatcagcctgc

SEQ ID NO: 4328206 - DNA, 18 bp, Homo sapiens
ggaaaatcatattgagaa

SEQ ID NO: 4328207 - DNA, 14 bp, Homo sapiens
ggaaaatgcatttt

SEQ ID NO: 4328208 - DNA, 18 bp, Homo sapiens
ggaaaattcaaaggtgga

SEQ ID NO: 4328209 - DNA, 15 bp, Homo sapiens
ggaaataaaaatgtt

SEQ ID NO: 4328210 - DNA, 13 bp, Homo sapiens
ggaaataaagaaa

SEQ ID NO: 4328211 - DNA, 14 bp, Homo sapiens
ggaaataaagaaaa

SEQ ID NO: 4328212 - DNA, 17 bp, Homo sapiens
ggaaccctaaagcagta

SEQ ID NO: 4328213 - DNA, 23 bp, Homo sapiens
ggaaccctaaagcagtaaaataa

SEQ ID NO: 4328214 - DNA, 19 bp, Homo sapiens
ggaagaagttttttacttt

SEQ ID NO: 4328215 - DNA, 15 bp, Homo sapiens
ggaagaggttttatt

SEQ ID NO: 4328216 - DNA, 20 bp, Homo sapiens
ggaagatgttcaatagaaca

SEQ ID NO: 4328217 - DNA, 20 bp, Homo sapiens
ggaaggaaacatagaaagac

SEQ ID NO: 4328218 - DNA, 19 bp, Homo sapiens
ggaagggccaatggagaaa

SEQ ID NO: 4328219 - DNA, 21 bp, Homo sapiens
ggaaggtgggtgaggctgggc

SEQ ID NO: 4328220 - DNA, 16 bp, Homo sapiens
ggaagtagtccttggc

SEQ ID NO: 4328221 - DNA, 21 bp, Homo sapiens
ggaagtcttgggtgttagtgt

SEQ ID NO: 4328222 - DNA, 22 bp, Homo sapiens
ggaatctaatatccccaaatta

SEQ ID NO: 4328223 - DNA, 16 bp, Homo sapiens
ggacactaggagactg

SEQ ID NO: 4328224 - DNA, 17 bp, Homo sapiens
ggacactcaaaagctgg

SEQ ID NO: 4328225 - DNA, 14 bp, Homo sapiens
ggacagagcccggg

SEQ ID NO: 4328226 - DNA, 17 bp, Homo sapiens
ggacagagcccgggaga

SEQ ID NO: 4328227 - DNA, 17 bp, Homo sapiens
ggacagatttgaggact

SEQ ID NO: 4328228 - DNA, 19 bp, Homo sapiens
ggacatgagactaagagaa

SEQ ID NO: 4328229 - DNA, 21 bp, Homo sapiens
ggaccgtctttacccctgctg

SEQ ID NO: 4328230 - DNA, 22 bp, Homo sapiens
ggaccgtctttacccctgctga

SEQ ID NO: 4328231 - DNA, 19 bp, Homo sapiens
ggacctaatgctggcctga

SEQ ID NO: 4328232 - DNA, 21 bp, Homo sapiens
ggacctaatgctggcctgact

SEQ ID NO: 4328233 - DNA, 19 bp, Homo sapiens
ggacctcaggtgagaagca

SEQ ID NO: 4328234 - DNA, 14 bp, Homo sapiens
ggaccttggcgctt

SEQ ID NO: 4328235 - DNA, 16 bp, Homo sapiens
ggactgaagctggggc

SEQ ID NO: 4328236 - DNA, 18 bp, Homo sapiens
ggactgggggcgggactg

SEQ ID NO: 4328237 - DNA, 12 bp, Homo sapiens
ggagaaggagtg

SEQ ID NO: 4328238 - DNA, 21 bp, Homo sapiens
ggagacctctccttcctaccc

SEQ ID NO: 4328239 - DNA, 13 bp, Homo sapiens
ggagactgccagt

SEQ ID NO: 4328240 - DNA, 20 bp, Homo sapiens
ggagactgggcacccctgcc

SEQ ID NO: 4328241 - DNA, 22 bp, Homo sapiens
ggagactgggcacccctgcctc

SEQ ID NO: 4328242 - DNA, 19 bp, Homo sapiens
ggagagactcgctcactcc

SEQ ID NO: 4328243 - DNA, 21 bp, Homo sapiens
ggagagagggtctccagtgtt

SEQ ID NO: 4328244 - DNA, 21 bp, Homo sapiens
ggagagccctgtccctgccct

SEQ ID NO: 4328245 - DNA, 14 bp, Homo sapiens
ggagagcctctgtt

SEQ ID NO: 4328246 - DNA, 16 bp, Homo sapiens
ggagagctagaaagtt

SEQ ID NO: 4328247 - DNA, 15 bp, Homo sapiens
ggagaggggcacagg

SEQ ID NO: 4328248 - DNA, 20 bp, Homo sapiens
ggagattatcagtagaaaga

SEQ ID NO: 4328249 - DNA, 18 bp, Homo sapiens
ggagcccagttggaaaat

SEQ ID NO: 4328250 - DNA, 13 bp, Homo sapiens
ggagcctcctgcc

SEQ ID NO: 4328251 - DNA, 12 bp, Homo sapiens
ggagctcctggc

SEQ ID NO: 4328252 - DNA, 18 bp, Homo sapiens
ggagctgccgtgcctgtg

SEQ ID NO: 4328253 - DNA, 21 bp, Homo sapiens
ggagctgccgtgcctgtgtcc

SEQ ID NO: 4328254 - DNA, 20 bp, Homo sapiens
ggaggaggaccctggaaatg

SEQ ID NO: 4328255 - DNA, 13 bp, Homo sapiens
ggaggagggagag

SEQ ID NO: 4328256 - DNA, 14 bp, Homo sapiens
ggaggcagaaagat

SEQ ID NO: 4328257 - DNA, 23 bp, Homo sapiens
ggaggcagaaagatttggaaaat

SEQ ID NO: 4328258 - DNA, 15 bp, Homo sapiens
ggaggccccaaagga

SEQ ID NO: 4328259 - DNA, 12 bp, Homo sapiens
ggaggggccgga

SEQ ID NO: 4328260 - DNA, 14 bp, Homo sapiens
ggaggggttgccac

SEQ ID NO: 4328261 - DNA, 20 bp, Homo sapiens
ggaggtcaaggctgcagtga

SEQ ID NO: 4328262 - DNA, 15 bp, Homo sapiens
ggaggtcgaggcagg

SEQ ID NO: 4328263 - DNA, 16 bp, Homo sapiens
ggaggtcgaggcagga

SEQ ID NO: 4328264 - DNA, 16 bp, Homo sapiens
gtccactcccaagcca

SEQ ID NO: 4328265 - DNA, 13 bp, Homo sapiens
gtccagctgggac

SEQ ID NO: 4328266 - DNA, 19 bp, Homo sapiens
gtccatgtggttcttcaaa

SEQ ID NO: 4328267 - DNA, 20 bp, Homo sapiens
gtcccaatggtcctgacttt

SEQ ID NO: 4328268 - DNA, 17 bp, Homo sapiens
gtcccagatacttgggg

SEQ ID NO: 4328269 - DNA, 22 bp, Homo sapiens
gtcccagcacatttcctctcta

SEQ ID NO: 4328270 - DNA, 12 bp, Homo sapiens
gtcccagtgccg

SEQ ID NO: 4328271 - DNA, 19 bp, Homo sapiens
gtccccatggcaccctgct

SEQ ID NO: 4328272 - DNA, 17 bp, Homo sapiens
gtcccccgttgtgcctg

SEQ ID NO: 4328273 - DNA, 23 bp, Homo sapiens
gtccccggcggggtgcctgctgt

SEQ ID NO: 4328274 - DNA, 13 bp, Homo sapiens
gtcccctcagctc

SEQ ID NO: 4328275 - DNA, 24 bp, Homo sapiens
gtcccgcgaaacccggtgcatctg

SEQ ID NO: 4328276 - DNA, 18 bp, Homo sapiens
gtcccttggatcagaggt

SEQ ID NO: 4328277 - DNA, 20 bp, Homo sapiens
gtcccttggatcagaggtca

SEQ ID NO: 4328278 - DNA, 14 bp, Homo sapiens
gtcctactcctgga

SEQ ID NO: 4328279 - DNA, 16 bp, Homo sapiens
gtcctactcctggagc

SEQ ID NO: 4328280 - DNA, 23 bp, Homo sapiens
gtcctagaaattccccaccctga

SEQ ID NO: 4328281 - DNA, 13 bp, Homo sapiens
gtcctaggtcatg

SEQ ID NO: 4328282 - DNA, 21 bp, Homo sapiens
gtcctgggtaaatgtggtgag

SEQ ID NO: 4328283 - DNA, 17 bp, Homo sapiens
gtccttgcacctgagcc

SEQ ID NO: 4328284 - DNA, 21 bp, Homo sapiens
gtcctttcttttgaaatgcca

SEQ ID NO: 4328285 - DNA, 15 bp, Homo sapiens
gtctacattaaacaa

SEQ ID NO: 4328286 - DNA, 17 bp, Homo sapiens
gtctcaaaaaaagaaaa

SEQ ID NO: 4328287 - DNA, 19 bp, Homo sapiens
gtctcaaaaaaagaaaaag

SEQ ID NO: 4328288 - DNA, 15 bp, Homo sapiens
gtctcctgtccccgg

SEQ ID NO: 4328289 - DNA, 16 bp, Homo sapiens
gtctcctgtccccggc

SEQ ID NO: 4328290 - DNA, 21 bp, Homo sapiens
gtctctccctcccccagagcc

SEQ ID NO: 4328291 - DNA, 23 bp, Homo sapiens
gtctctccctcccccagagcccc

SEQ ID NO: 4328292 - DNA, 12 bp, Homo sapiens
gtctctgcatct

SEQ ID NO: 4328293 - DNA, 19 bp, Homo sapiens
gtctctggggcaggctgct

SEQ ID NO: 4328294 - DNA, 19 bp, Homo sapiens
gtctctgtgggtgggaatg

SEQ ID NO: 4328295 - DNA, 22 bp, Homo sapiens
gtctgaaaggctatcctgctga

SEQ ID NO: 4328296 - DNA, 16 bp, Homo sapiens
gtctgaagtggttgtt

SEQ ID NO: 4328297 - DNA, 18 bp, Homo sapiens
gtctgaatcatgtctgta

SEQ ID NO: 4328298 - DNA, 19 bp, Homo sapiens
gtctgaattgagaaaagag

SEQ ID NO: 4328299 - DNA, 14 bp, Homo sapiens
gtctgccatgctct

SEQ ID NO: 4328300 - DNA, 23 bp, Homo sapiens
gtctggaggggcccctgcttctc

SEQ ID NO: 4328301 - DNA, 15 bp, Homo sapiens
gtctgtgttgcttca

SEQ ID NO: 4328302 - DNA, 20 bp, Homo sapiens
gtcttcataccccagaaatt

SEQ ID NO: 4328303 - DNA, 21 bp, Homo sapiens
gtctttggataataggaattc

SEQ ID NO: 4328304 - DNA, 21 bp, Homo sapiens
gtgaacagcaggatgccctgt

SEQ ID NO: 4328305 - DNA, 18 bp, Homo sapiens
gtgaacttgggagggggc

SEQ ID NO: 4328306 - DNA, 22 bp, Homo sapiens
gtgaagcaccagggagaggcct

SEQ ID NO: 4328307 - DNA, 14 bp, Homo sapiens
gtgaaggacatgag

SEQ ID NO: 4328308 - DNA, 14 bp, Homo sapiens
gtgaatttatgaga

SEQ ID NO: 4328309 - DNA, 20 bp, Homo sapiens
gtgaatttttaatcagcaat

SEQ ID NO: 4328310 - DNA, 18 bp, Homo sapiens
gtgacataattgtccagt

SEQ ID NO: 4328311 - DNA, 13 bp, Homo sapiens
gtgacattcactg

SEQ ID NO: 4328312 - DNA, 22 bp, Homo sapiens
gtgagaccctgtctcaaaaaaa

SEQ ID NO: 4328313 - DNA, 19 bp, Homo sapiens
gtgagacgccaccattcct

SEQ ID NO: 4328314 - DNA, 15 bp, Homo sapiens
gtgagatgtaattgt

SEQ ID NO: 4328315 - DNA, 20 bp, Homo sapiens
gtgaggggtttcttttggaa

SEQ ID NO: 4328316 - DNA, 14 bp, Homo sapiens
gtgagggtggtggg

SEQ ID NO: 4328317 - DNA, 20 bp, Homo sapiens
gtgagtctgaaccaatagaa

SEQ ID NO: 4328318 - DNA, 21 bp, Homo sapiens
gtgagtctgaaccaatagaaa

SEQ ID NO: 4328319 - DNA, 15 bp, Homo sapiens
gtgagtgccatgctt

SEQ ID NO: 4328320 - DNA, 20 bp, Homo sapiens
gtgagtgccatgctttttgg

SEQ ID NO: 4328321 - DNA, 21 bp, Homo sapiens
gtgagtgtgtgtgtgtgtctg

SEQ ID NO: 4328322 - DNA, 13 bp, Homo sapiens
gtgattgaaagaa

SEQ ID NO: 4328323 - DNA, 13 bp, Homo sapiens
gtgcaaacaaaca

SEQ ID NO: 4328324 - DNA, 22 bp, Homo sapiens
gtgcacttagtagtttttacaa

SEQ ID NO: 4328325 - DNA, 22 bp, Homo sapiens
gtgcagcccctctcacaggcag

SEQ ID NO: 4328326 - DNA, 15 bp, Homo sapiens
gtgcagggcctggca

SEQ ID NO: 4328327 - DNA, 16 bp, Homo sapiens
gtgcagggcctggcat

SEQ ID NO: 4328328 - DNA, 12 bp, Homo sapiens
gtgcatgtgcag

SEQ ID NO: 4328329 - DNA, 14 bp, Homo sapiens
gtgcatgtgcaggt

SEQ ID NO: 4328330 - DNA, 16 bp, Homo sapiens
gtgcatgtgccgaggt

SEQ ID NO: 4328331 - DNA, 20 bp, Homo sapiens
gtgccataccttctcccagg

SEQ ID NO: 4328332 - DNA, 23 bp, Homo sapiens
gtgccataccttctcccaggcct

SEQ ID NO: 4328333 - DNA, 11 bp, Homo sapiens
gtgcccctgcc

SEQ ID NO: 4328334 - DNA, 20 bp, Homo sapiens
gtgcccggtgcagggcctgg

SEQ ID NO: 4328335 - DNA, 20 bp, Homo sapiens
gtgcccttaaggatcacccc

SEQ ID NO: 4328336 - DNA, 22 bp, Homo sapiens
gtgcccttaaggatcaccccag

SEQ ID NO: 4328337 - DNA, 17 bp, Homo sapiens
gtgcccttgcccttgga

SEQ ID NO: 4328338 - DNA, 19 bp, Homo sapiens
gtgcctgctgggtgccagg

SEQ ID NO: 4328339 - DNA, 19 bp, Homo sapiens
gtgcctggttcgtgccatg

SEQ ID NO: 4328340 - DNA, 18 bp, Homo sapiens
gtgcgaagcaagaagaat

SEQ ID NO: 4328341 - DNA, 14 bp, Homo sapiens
gtgctaagctgccc

SEQ ID NO: 4328342 - DNA, 14 bp, Homo sapiens
gtgctaatatactt

SEQ ID NO: 4328343 - DNA, 20 bp, Homo sapiens
gtgctatatttttaaagaag

SEQ ID NO: 4328344 - DNA, 15 bp, Homo sapiens
gtgctgatgtttaca

SEQ ID NO: 4328345 - DNA, 15 bp, Homo sapiens
gtgctgctgttctgt

SEQ ID NO: 4328346 - DNA, 18 bp, Homo sapiens
gtgctgctgttctgtgta

SEQ ID NO: 4328347 - DNA, 14 bp, Homo sapiens
gtgcttatacaatt

SEQ ID NO: 4328348 - DNA, 21 bp, Homo sapiens
gtgcttcagagtttgtgtgta

SEQ ID NO: 4328349 - DNA, 17 bp, Homo sapiens
gtgcttctccccagaat

SEQ ID NO: 4328350 - DNA, 23 bp, Homo sapiens
gtggaaaaatgcccatttttgct

SEQ ID NO: 4328351 - DNA, 20 bp, Homo sapiens
gtggacaagacatgcttggg

SEQ ID NO: 4328352 - DNA, 20 bp, Homo sapiens
gtggaccaattattgatata

SEQ ID NO: 4328353 - DNA, 20 bp, Homo sapiens
gtggagaagcggctggcagc

SEQ ID NO: 4328354 - DNA, 18 bp, Homo sapiens
gtggcaccagcagcctgg

SEQ ID NO: 4328355 - DNA, 16 bp, Homo sapiens
gtggccaggagccatg

SEQ ID NO: 4328356 - DNA, 17 bp, Homo sapiens
gtggccaggagccctgg

SEQ ID NO: 4328357 - DNA, 21 bp, Homo sapiens
gtggccatatatgctgtattt

SEQ ID NO: 4328358 - DNA, 18 bp, Homo sapiens
gtggccctcccaggctgg

SEQ ID NO: 4328359 - DNA, 23 bp, Homo sapiens
gtgggaggatctcttgagcctgg

SEQ ID NO: 4328360 - DNA, 21 bp, Homo sapiens
gtgggcctcgacgtcccttgg

SEQ ID NO: 4328361 - DNA, 14 bp, Homo sapiens
gtgggtgggaatgc

SEQ ID NO: 4328362 - DNA, 15 bp, Homo sapiens
gtggtaaaaaagaaa

SEQ ID NO: 4328363 - DNA, 20 bp, Homo sapiens
gtggtaaaaaagaaatgaaa

SEQ ID NO: 4328364 - DNA, 17 bp, Homo sapiens
gtggtagagtgtgcctg

SEQ ID NO: 4328365 - DNA, 18 bp, Homo sapiens
gtggttatggagagggtg

SEQ ID NO: 4328366 - DNA, 13 bp, Homo sapiens
gtgtaaaatgagt

SEQ ID NO: 4328367 - DNA, 18 bp, Homo sapiens
gtgtacatgaagaatgta

SEQ ID NO: 4328368 - DNA, 16 bp, Homo sapiens
gtgtatttgtattaat

SEQ ID NO: 4328369 - DNA, 16 bp, Homo sapiens
gtgtcaagaaggaaga

SEQ ID NO: 4328370 - DNA, 12 bp, Homo sapiens
gtgtcacctcct

SEQ ID NO: 4328371 - DNA, 15 bp, Homo sapiens
gtgtcacctccttcc

SEQ ID NO: 4328372 - DNA, 19 bp, Homo sapiens
gtgtcacctccttccccag

SEQ ID NO: 4328373 - DNA, 21 bp, Homo sapiens
gtgtcacctccttccccagct

SEQ ID NO: 4328374 - DNA, 15 bp, Homo sapiens
gtgtgagtgtgtgtg

SEQ ID NO: 4328375 - DNA, 23 bp, Homo sapiens
gtgtgcaactaactgactctgtt

SEQ ID NO: 4328376 - DNA, 11 bp, Homo sapiens
gtgtgctgtaa

SEQ ID NO: 4328377 - DNA, 21 bp, Homo sapiens
gtgtggagaagcggctggcag

SEQ ID NO: 4328378 - DNA, 13 bp, Homo sapiens
gtgtgtgcatgtg

SEQ ID NO: 4328379 - DNA, 19 bp, Homo sapiens
gtgtgtgcatgtgccgagg

SEQ ID NO: 4328380 - DNA, 17 bp, Homo sapiens
gtgttcagtgttgacat

SEQ ID NO: 4328381 - DNA, 17 bp, Homo sapiens
tagtcgggcatgagtct

SEQ ID NO: 4328382 - DNA, 14 bp, Homo sapiens
tagtgtgctgctgt

SEQ ID NO: 4328383 - DNA, 15 bp, Homo sapiens
tagtgtgctgctgtt

SEQ ID NO: 4328384 - DNA, 19 bp, Homo sapiens
tagtgtgctgctgttctgt

SEQ ID NO: 4328385 - DNA, 21 bp, Homo sapiens
tagtgtgctgctgttctgtgt

SEQ ID NO: 4328386 - DNA, 13 bp, Homo sapiens
tagttatttgtat

SEQ ID NO: 4328387 - DNA, 16 bp, Homo sapiens
tagttccattcttggt

SEQ ID NO: 4328388 - DNA, 13 bp, Homo sapiens
tagttccctctgc

SEQ ID NO: 4328389 - DNA, 17 bp, Homo sapiens
tagttccctctgcctgg

SEQ ID NO: 4328390 - DNA, 21 bp, Homo sapiens
tagttccctctgcctgggatg

SEQ ID NO: 4328391 - DNA, 17 bp, Homo sapiens
tagttgtctctcttcag

SEQ ID NO: 4328392 - DNA, 18 bp, Homo sapiens
tagttgtctgaattgaga

SEQ ID NO: 4328393 - DNA, 17 bp, Homo sapiens
tagtttccctggtgccc

SEQ ID NO: 4328394 - DNA, 17 bp, Homo sapiens
tagtttggaaataaaaa

SEQ ID NO: 4328395 - DNA, 16 bp, Homo sapiens
tagtttttgctgaagg

SEQ ID NO: 4328396 - DNA, 13 bp, Homo sapiens
tataaagaaactt

SEQ ID NO: 4328397 - DNA, 15 bp, Homo sapiens
tataaagaaactttt

SEQ ID NO: 4328398 - DNA, 19 bp, Homo sapiens
tataaagaaacttttgaaa

SEQ ID NO: 4328399 - DNA, 15 bp, Homo sapiens
tataaagaatatata

SEQ ID NO: 4328400 - DNA, 17 bp, Homo sapiens
tataaaggcaaggaaat

SEQ ID NO: 4328401 - DNA, 15 bp, Homo sapiens
tataaagtatagaga

SEQ ID NO: 4328402 - DNA, 22 bp, Homo sapiens
tataaatctggggaagaggttt

SEQ ID NO: 4328403 - DNA, 13 bp, Homo sapiens
tataaatgactat

SEQ ID NO: 4328404 - DNA, 17 bp, Homo sapiens
tataaatgactattgta

SEQ ID NO: 4328405 - DNA, 17 bp, Homo sapiens
tataagaatgagcctgt

SEQ ID NO: 4328406 - DNA, 14 bp, Homo sapiens
tataagcgtattta

SEQ ID NO: 4328407 - DNA, 18 bp, Homo sapiens
tataagtgttcagtgttg

SEQ ID NO: 4328408 - DNA, 20 bp, Homo sapiens
tataagtgttcagtgttgac

SEQ ID NO: 4328409 - DNA, 21 bp, Homo sapiens
tataagtgttcagtgttgaca

SEQ ID NO: 4328410 - DNA, 22 bp, Homo sapiens
tataagtgttcagtgttgacat

SEQ ID NO: 4328411 - DNA, 15 bp, Homo sapiens
tataatatcctttgt

SEQ ID NO: 4328412 - DNA, 15 bp, Homo sapiens
tataatcatgctcat

SEQ ID NO: 4328413 - DNA, 17 bp, Homo sapiens
tataatcatgctcatgt

SEQ ID NO: 4328414 - DNA, 19 bp, Homo sapiens
tataatctcctctgctcat

SEQ ID NO: 4328415 - DNA, 16 bp, Homo sapiens
tataatgctttctgag

SEQ ID NO: 4328416 - DNA, 14 bp, Homo sapiens
tataatgtgtctgt

SEQ ID NO: 4328417 - DNA, 20 bp, Homo sapiens
tataattagtcgggcatgag

SEQ ID NO: 4328418 - DNA, 17 bp, Homo sapiens
tatacacaactttgcaa

SEQ ID NO: 4328419 - DNA, 18 bp, Homo sapiens
tatacacaactttgcaaa

SEQ ID NO: 4328420 - DNA, 21 bp, Homo sapiens
tataccatgtgtgctaatata

SEQ ID NO: 4328421 - DNA, 11 bp, Homo sapiens
tatacctcagt

SEQ ID NO: 4328422 - DNA, 19 bp, Homo sapiens
tatacctgccttttaagtt

SEQ ID NO: 4328423 - DNA, 15 bp, Homo sapiens
tatacgtacatacac

SEQ ID NO: 4328424 - DNA, 15 bp, Homo sapiens
tatactgtcttgtct

SEQ ID NO: 4328425 - DNA, 20 bp, Homo sapiens
tatactttttttgttataga

SEQ ID NO: 4328426 - DNA, 22 bp, Homo sapiens
tatactttttttgttatagatt

SEQ ID NO: 4328427 - DNA, 13 bp, Homo sapiens
tatagaaaatctt

SEQ ID NO: 4328428 - DNA, 17 bp, Homo sapiens
tatagctcccaaaagaa

SEQ ID NO: 4328429 - DNA, 20 bp, Homo sapiens
tataggttgttcttaatttt

SEQ ID NO: 4328430 - DNA, 20 bp, Homo sapiens
tatagtaccagaagcaaggt

SEQ ID NO: 4328431 - DNA, 21 bp, Homo sapiens
tatagtagaaagacatctgcc

SEQ ID NO: 4328432 - DNA, 14 bp, Homo sapiens
tatagtgaagaata

SEQ ID NO: 4328433 - DNA, 15 bp, Homo sapiens
tatataaagaatata

SEQ ID NO: 4328434 - DNA, 14 bp, Homo sapiens
tatataaaggcaag

SEQ ID NO: 4328435 - DNA, 14 bp, Homo sapiens
tatataaagtatag

SEQ ID NO: 4328436 - DNA, 17 bp, Homo sapiens
tatataatcatgctcat

SEQ ID NO: 4328437 - DNA, 14 bp, Homo sapiens
tatatataaagaat

SEQ ID NO: 4328438 - DNA, 11 bp, Homo sapiens
tatatatatat

SEQ ID NO: 4328439 - DNA, 13 bp, Homo sapiens
tatatatatataa

SEQ ID NO: 4328440 - DNA, 15 bp, Homo sapiens
tatatatatataaag

SEQ ID NO: 4328441 - DNA, 14 bp, Homo sapiens
tatatatatatata

SEQ ID NO: 4328442 - DNA, 21 bp, Homo sapiens
tatatattgaaagttgctttt

SEQ ID NO: 4328443 - DNA, 23 bp, Homo sapiens
tatatgctgtatttctttgtaga

SEQ ID NO: 4328444 - DNA, 19 bp, Homo sapiens
tatatgcttccagaatggg

SEQ ID NO: 4328445 - DNA, 13 bp, Homo sapiens
tatatgtgagaaa

SEQ ID NO: 4328446 - DNA, 14 bp, Homo sapiens
tatattactgattt

SEQ ID NO: 4328447 - DNA, 15 bp, Homo sapiens
tatattactgattta

SEQ ID NO: 4328448 - DNA, 18 bp, Homo sapiens
tatattactgatttagaa

SEQ ID NO: 4328449 - DNA, 22 bp, Homo sapiens
tatattataaatatatataaag

SEQ ID NO: 4328450 - DNA, 19 bp, Homo sapiens
tatatttaaaaaattaaaa

SEQ ID NO: 4328451 - DNA, 14 bp, Homo sapiens
tatcagtagaaaga

SEQ ID NO: 4328452 - DNA, 16 bp, Homo sapiens
tatcagtagaaagagt

SEQ ID NO: 4328453 - DNA, 17 bp, Homo sapiens
tatcagtagaaagagtg

SEQ ID NO: 4328454 - DNA, 15 bp, Homo sapiens
tatcataacatctgg

SEQ ID NO: 4328455 - DNA, 15 bp, Homo sapiens
tatcatggaatttcc

SEQ ID NO: 4328456 - DNA, 22 bp, Homo sapiens
tatccatgacaggcctgaagat

SEQ ID NO: 4328457 - DNA, 22 bp, Homo sapiens
tatccgccctgcagcagaacct

SEQ ID NO: 4328458 - DNA, 17 bp, Homo sapiens
tatcctagttccattct

SEQ ID NO: 4328459 - DNA, 19 bp, Homo sapiens
tatcctagttccattcttg

SEQ ID NO: 4328460 - DNA, 23 bp, Homo sapiens
tatcgcaacatgaatttttatga

SEQ ID NO: 4328461 - DNA, 21 bp, Homo sapiens
tatctagcatttatttctctg

SEQ ID NO: 4328462 - DNA, 16 bp, Homo sapiens
tatctatacctgcctt

SEQ ID NO: 4328463 - DNA, 23 bp, Homo sapiens
tatctatacctgccttttaagtt

SEQ ID NO: 4328464 - DNA, 17 bp, Homo sapiens
tatcttgttattaatgt

SEQ ID NO: 4328465 - DNA, 18 bp, Homo sapiens
tatctttgtgtaatctaa

SEQ ID NO: 4328466 - DNA, 16 bp, Homo sapiens
tatgaaccctttgttt

SEQ ID NO: 4328467 - DNA, 18 bp, Homo sapiens
tatgaaccctttgtttct

SEQ ID NO: 4328468 - DNA, 21 bp, Homo sapiens
tatgaaccctttgtttcttgt

SEQ ID NO: 4328469 - DNA, 16 bp, Homo sapiens
tatgaccattgaaaaa

SEQ ID NO: 4328470 - DNA, 15 bp, Homo sapiens
tatgagaaaaatatt

SEQ ID NO: 4328471 - DNA, 14 bp, Homo sapiens
tatgagatttactg

SEQ ID NO: 4328472 - DNA, 12 bp, Homo sapiens
tatgatatattt

SEQ ID NO: 4328473 - DNA, 14 bp, Homo sapiens
tatgcagaatgttt

SEQ ID NO: 4328474 - DNA, 17 bp, Homo sapiens
tatgctgagaaattatt

SEQ ID NO: 4328475 - DNA, 19 bp, Homo sapiens
tatgctgtatttctttgta

SEQ ID NO: 4328476 - DNA, 15 bp, Homo sapiens
tatggagactttgct

SEQ ID NO: 4328477 - DNA, 16 bp, Homo sapiens
tatgtaatgaagtaaa

SEQ ID NO: 4328478 - DNA, 14 bp, Homo sapiens
tatgtagaatgtct

SEQ ID NO: 4328479 - DNA, 16 bp, Homo sapiens
tatgtcaatcttaaga

SEQ ID NO: 4328480 - DNA, 19 bp, Homo sapiens
tatgtgagaaatcagaatt

SEQ ID NO: 4328481 - DNA, 16 bp, Homo sapiens
tatgtgttacattatt

SEQ ID NO: 4328482 - DNA, 19 bp, Homo sapiens
tatgttagagtcatttctg

SEQ ID NO: 4328483 - DNA, 20 bp, Homo sapiens
tatgttagagtcatttctga

SEQ ID NO: 4328484 - DNA, 14 bp, Homo sapiens
tattaaaatgtaac

SEQ ID NO: 4328485 - DNA, 16 bp, Homo sapiens
tattaaatgagggttt

SEQ ID NO: 4328486 - DNA, 19 bp, Homo sapiens
tattaataaagcattcttt

SEQ ID NO: 4328487 - DNA, 15 bp, Homo sapiens
tattactgatttaga

SEQ ID NO: 4328488 - DNA, 15 bp, Homo sapiens
tattacttgtgcact

SEQ ID NO: 4328489 - DNA, 17 bp, Homo sapiens
tattacttgtgcactta

SEQ ID NO: 4328490 - DNA, 12 bp, Homo sapiens
tattagagaaga

SEQ ID NO: 4328491 - DNA, 15 bp, Homo sapiens
tattataaatatata

SEQ ID NO: 4328492 - DNA, 22 bp, Homo sapiens
tattataaatatatataaagaa

SEQ ID NO: 4328493 - DNA, 23 bp, Homo sapiens
tattatcagttaaaatcacattt

SEQ ID NO: 4328494 - DNA, 18 bp, Homo sapiens
tattatttttttaaacaa

SEQ ID NO: 4328495 - DNA, 21 bp, Homo sapiens
tattcaaggctttaaaagtca

SEQ ID NO: 4328496 - DNA, 14 bp, Homo sapiens
tattcatgcttctt

SEQ ID NO: 4328497 - DNA, 22 bp, Homo sapiens
tattccttgatactaaaagttc

SEQ ID NO: 4328498 - DNA, 11 bp, Homo sapiens
tattctctcat

SEQ ID NO: 4328499 - DNA, 22 bp, Homo sapiens
tattcttaagggaacttccaca

SEQ ID NO: 4328500 - DNA, 18 bp, Homo sapiens
tcctagttccattcttgg

SEQ ID NO: 4328501 - DNA, 14 bp, Homo sapiens
tcctatttttgtaa

SEQ ID NO: 4328502 - DNA, 15 bp, Homo sapiens
tcctccccattccta

SEQ ID NO: 4328503 - DNA, 18 bp, Homo sapiens
tcctccctgggatggacg

SEQ ID NO: 4328504 - DNA, 13 bp, Homo sapiens
tcctccctgtctc

SEQ ID NO: 4328505 - DNA, 15 bp, Homo sapiens
tcctcctctcctgga

SEQ ID NO: 4328506 - DNA, 17 bp, Homo sapiens
tcctctctatctttttt

SEQ ID NO: 4328507 - DNA, 17 bp, Homo sapiens
tcctctctttgttctca

SEQ ID NO: 4328508 - DNA, 14 bp, Homo sapiens
tcctcttcccagag

SEQ ID NO: 4328509 - DNA, 15 bp, Homo sapiens
tcctctttgccctga

SEQ ID NO: 4328510 - DNA, 23 bp, Homo sapiens
tcctgagaataagaaagtttcac

SEQ ID NO: 4328511 - DNA, 22 bp, Homo sapiens
tcctgaggctctctaagaaaag

SEQ ID NO: 4328512 - DNA, 13 bp, Homo sapiens
tcctgatgttttt

SEQ ID NO: 4328513 - DNA, 20 bp, Homo sapiens
tcctggagtctgaagcctgc

SEQ ID NO: 4328514 - DNA, 19 bp, Homo sapiens
tcctgggcttggtaagtga

SEQ ID NO: 4328515 - DNA, 13 bp, Homo sapiens
tcctgtccccagg

SEQ ID NO: 4328516 - DNA, 15 bp, Homo sapiens
tcctgtccccagggg

SEQ ID NO: 4328517 - DNA, 17 bp, Homo sapiens
tccttaaatgaactact

SEQ ID NO: 4328518 - DNA, 15 bp, Homo sapiens
tccttacttgcactg

SEQ ID NO: 4328519 - DNA, 16 bp, Homo sapiens
tccttacttgcactgt

SEQ ID NO: 4328520 - DNA, 19 bp, Homo sapiens
tccttatcctacagtacaa

SEQ ID NO: 4328521 - DNA, 23 bp, Homo sapiens
tccttatcctacagtacaatcag

SEQ ID NO: 4328522 - DNA, 22 bp, Homo sapiens
tccttccccagctcccccaggc

SEQ ID NO: 4328523 - DNA, 23 bp, Homo sapiens
tccttccccagctcccccaggca

SEQ ID NO: 4328524 - DNA, 24 bp, Homo sapiens
tccttccccagctcccccaggcag

SEQ ID NO: 4328525 - DNA, 16 bp, Homo sapiens
tccttcctttttattc

SEQ ID NO: 4328526 - DNA, 17 bp, Homo sapiens
tccttgatttttggtag

SEQ ID NO: 4328527 - DNA, 16 bp, Homo sapiens
tccttgcacctgagcc

SEQ ID NO: 4328528 - DNA, 20 bp, Homo sapiens
tcctttcttttttttcttgg

SEQ ID NO: 4328529 - DNA, 12 bp, Homo sapiens
tcctttgaagaa

SEQ ID NO: 4328530 - DNA, 13 bp, Homo sapiens
tcctttgaagaat

SEQ ID NO: 4328531 - DNA, 24 bp, Homo sapiens
tcctttgaagaattgtagttctta

SEQ ID NO: 4328532 - DNA, 14 bp, Homo sapiens
tcgacatcctagcc

SEQ ID NO: 4328533 - DNA, 17 bp, Homo sapiens
tcgacatcctagcccca

SEQ ID NO: 4328534 - DNA, 20 bp, Homo sapiens
tcgacatcctagccccaccc

SEQ ID NO: 4328535 - DNA, 21 bp, Homo sapiens
tcgatccaaattgtgcttctc

SEQ ID NO: 4328536 - DNA, 20 bp, Homo sapiens
tcgcccacaagccttactca

SEQ ID NO: 4328537 - DNA, 22 bp, Homo sapiens
tcgcccacaagccttactcacc

SEQ ID NO: 4328538 - DNA, 22 bp, Homo sapiens
tcgcctactaagtacccttggg

SEQ ID NO: 4328539 - DNA, 15 bp, Homo sapiens
tcgcttgcttctgca

SEQ ID NO: 4328540 - DNA, 12 bp, Homo sapiens
tcggaggcccca

SEQ ID NO: 4328541 - DNA, 12 bp, Homo sapiens
tcgggattccct

SEQ ID NO: 4328542 - DNA, 19 bp, Homo sapiens
tcgggattccctggtgggc

SEQ ID NO: 4328543 - DNA, 14 bp, Homo sapiens
tcgtttctgcccag

SEQ ID NO: 4328544 - DNA, 13 bp, Homo sapiens
tcgttttccaaac

SEQ ID NO: 4328545 - DNA, 19 bp, Homo sapiens
tctaaaatggacattttct

SEQ ID NO: 4328546 - DNA, 12 bp, Homo sapiens
tctaagaaaaga

SEQ ID NO: 4328547 - DNA, 15 bp, Homo sapiens
tctaagtatatgtga

SEQ ID NO: 4328548 - DNA, 21 bp, Homo sapiens
tctaagtttagaagcgctcat

SEQ ID NO: 4328549 - DNA, 21 bp, Homo sapiens
tctaatgagttgctggaaaat

SEQ ID NO: 4328550 - DNA, 23 bp, Homo sapiens
tctacaaagcactagagaatgca

SEQ ID NO: 4328551 - DNA, 14 bp, Homo sapiens
tctacattaaacaa

SEQ ID NO: 4328552 - DNA, 13 bp, Homo sapiens
tctaccccacctg

SEQ ID NO: 4328553 - DNA, 15 bp, Homo sapiens
tctacgttaagataa

SEQ ID NO: 4328554 - DNA, 18 bp, Homo sapiens
tctactctagggaaaaac

SEQ ID NO: 4328555 - DNA, 19 bp, Homo sapiens
tctagcatttatttctctg

SEQ ID NO: 4328556 - DNA, 22 bp, Homo sapiens
tctagggaaaaaccagcgtgtg

SEQ ID NO: 4328557 - DNA, 16 bp, Homo sapiens
tctagtttccctggtg

SEQ ID NO: 4328558 - DNA, 13 bp, Homo sapiens
tctataaaaacca

SEQ ID NO: 4328559 - DNA, 14 bp, Homo sapiens
tctataaaaaccac

SEQ ID NO: 4328560 - DNA, 23 bp, Homo sapiens
tctataaaaaccacccacaaaga

SEQ ID NO: 4328561 - DNA, 17 bp, Homo sapiens
tctataaagaaactttt

SEQ ID NO: 4328562 - DNA, 22 bp, Homo sapiens
tctataaagaaacttttgaaaa

SEQ ID NO: 4328563 - DNA, 17 bp, Homo sapiens
tctataaatgactattg

SEQ ID NO: 4328564 - DNA, 19 bp, Homo sapiens
tctataaatgactattgta

SEQ ID NO: 4328565 - DNA, 20 bp, Homo sapiens
tctataagtgttcagtgttg

SEQ ID NO: 4328566 - DNA, 24 bp, Homo sapiens
tctataagtgttcagtgttgacat

SEQ ID NO: 4328567 - DNA, 19 bp, Homo sapiens
tctatcggaagaacatgaa

SEQ ID NO: 4328568 - DNA, 17 bp, Homo sapiens
tctatggagactttgct

SEQ ID NO: 4328569 - DNA, 15 bp, Homo sapiens
tctatgtacgataaa

SEQ ID NO: 4328570 - DNA, 16 bp, Homo sapiens
tctcaaatgatacagt

SEQ ID NO: 4328571 - DNA, 20 bp, Homo sapiens
tctcacaggcagctctgagc

SEQ ID NO: 4328572 - DNA, 15 bp, Homo sapiens
tctcagcccagaaga

SEQ ID NO: 4328573 - DNA, 17 bp, Homo sapiens
tctcagctccccctgtc

SEQ ID NO: 4328574 - DNA, 13 bp, Homo sapiens
tctcagggcctgg

SEQ ID NO: 4328575 - DNA, 19 bp, Homo sapiens
tctcagggcctggtcgttt

SEQ ID NO: 4328576 - DNA, 15 bp, Homo sapiens
tctcagttgcagaaa

SEQ ID NO: 4328577 - DNA, 18 bp, Homo sapiens
tctcagttgcagaaaatg

SEQ ID NO: 4328578 - DNA, 21 bp, Homo sapiens
tctcatcacagtgggaagaat

SEQ ID NO: 4328579 - DNA, 16 bp, Homo sapiens
tctccaattctgaaat

SEQ ID NO: 4328580 - DNA, 20 bp, Homo sapiens
tctccacacggagctcctgg

SEQ ID NO: 4328581 - DNA, 14 bp, Homo sapiens
tctccagcctggac

SEQ ID NO: 4328582 - DNA, 19 bp, Homo sapiens
tctccagcctggaccccca

SEQ ID NO: 4328583 - DNA, 23 bp, Homo sapiens
tctcccagatcctggaaacagca

SEQ ID NO: 4328584 - DNA, 15 bp, Homo sapiens
tctccctagcccttc

SEQ ID NO: 4328585 - DNA, 21 bp, Homo sapiens
tctcctctgctcattaaactg

SEQ ID NO: 4328586 - DNA, 18 bp, Homo sapiens
tctcctgccctttcccag

SEQ ID NO: 4328587 - DNA, 14 bp, Homo sapiens
tctcgtttctgccc

SEQ ID NO: 4328588 - DNA, 16 bp, Homo sapiens
tctcgtttctgcccag

SEQ ID NO: 4328589 - DNA, 15 bp, Homo sapiens
tctctaagaaaagag

SEQ ID NO: 4328590 - DNA, 15 bp, Homo sapiens
tctctacaaaaagca

SEQ ID NO: 4328591 - DNA, 21 bp, Homo sapiens
tctctataagtgttcagtgtt

SEQ ID NO: 4328592 - DNA, 23 bp, Homo sapiens
tctctataagtgttcagtgttga

SEQ ID NO: 4328593 - DNA, 23 bp, Homo sapiens
tctctatgtacgataaagtaaca

SEQ ID NO: 4328594 - DNA, 18 bp, Homo sapiens
tctctcaagacttctcca

SEQ ID NO: 4328595 - DNA, 16 bp, Homo sapiens
tctctcaatatgctta

SEQ ID NO: 4328596 - DNA, 20 bp, Homo sapiens
tctctcaatatgcttacaaa

SEQ ID NO: 4328597 - DNA, 21 bp, Homo sapiens
tctctccctcccccagagccc

SEQ ID NO: 4328598 - DNA, 22 bp, Homo sapiens
tctctccctcccccagagcccc

SEQ ID NO: 4328599 - DNA, 13 bp, Homo sapiens
tctctctcctgga

SEQ ID NO: 4328600 - DNA, 14 bp, Homo sapiens
tctctctttttctt

SEQ ID NO: 4328601 - DNA, 15 bp, Homo sapiens
tctctgaatgctgag

SEQ ID NO: 4328602 - DNA, 12 bp, Homo sapiens
tctctgccaaag

SEQ ID NO: 4328603 - DNA, 13 bp, Homo sapiens
tctctgcctggca

SEQ ID NO: 4328604 - DNA, 18 bp, Homo sapiens
tctctggcaaacttttct

SEQ ID NO: 4328605 - DNA, 14 bp, Homo sapiens
tctctgtggctcca

SEQ ID NO: 4328606 - DNA, 17 bp, Homo sapiens
tctcttcagactctcag

SEQ ID NO: 4328607 - DNA, 19 bp, Homo sapiens
tctcttcagactctcagcc

SEQ ID NO: 4328608 - DNA, 18 bp, Homo sapiens
tctcttctttattgcact

SEQ ID NO: 4328609 - DNA, 23 bp, Homo sapiens
tctcttctttattgcactaggaa

SEQ ID NO: 4328610 - DNA, 15 bp, Homo sapiens
tctcttgagcctggg

SEQ ID NO: 4328611 - DNA, 23 bp, Homo sapiens
tctcttggaaatgttaagaaaga

SEQ ID NO: 4328612 - DNA, 22 bp, Homo sapiens
tctctttcaattgcagatgcca

SEQ ID NO: 4328613 - DNA, 15 bp, Homo sapiens
tctctttgtgcagtg

SEQ ID NO: 4328614 - DNA, 13 bp, Homo sapiens
tctctttgttctc

SEQ ID NO: 4328615 - DNA, 14 bp, Homo sapiens
tctctttgttctca

SEQ ID NO: 4328616 - DNA, 21 bp, Homo sapiens
tctctttgttctcagctcccc

SEQ ID NO: 4328617 - DNA, 17 bp, Homo sapiens
tctcttttctgtacttc

SEQ ID NO: 4328618 - DNA, 16 bp, Homo sapiens
tgatcccctctctgtg

SEQ ID NO: 4328619 - DNA, 17 bp, Homo sapiens
tgatcccctctctgtgg

SEQ ID NO: 4328620 - DNA, 14 bp, Homo sapiens
tgatctttgtttaa

SEQ ID NO: 4328621 - DNA, 17 bp, Homo sapiens
tgatctttgtttaaatg

SEQ ID NO: 4328622 - DNA, 20 bp, Homo sapiens
tgatctttgtttaaatgcca

SEQ ID NO: 4328623 - DNA, 23 bp, Homo sapiens
tgatctttgtttaaatgccaaaa

SEQ ID NO: 4328624 - DNA, 13 bp, Homo sapiens
tgatgagacctgg

SEQ ID NO: 4328625 - DNA, 17 bp, Homo sapiens
tgatgcatgctttgaga

SEQ ID NO: 4328626 - DNA, 22 bp, Homo sapiens
tgatgcccaccgaggagcccca

SEQ ID NO: 4328627 - DNA, 19 bp, Homo sapiens
tgatgccctgctccaggga

SEQ ID NO: 4328628 - DNA, 22 bp, Homo sapiens
tgatgccgaacattaggaattg

SEQ ID NO: 4328629 - DNA, 12 bp, Homo sapiens
tgatggaaaaat

SEQ ID NO: 4328630 - DNA, 16 bp, Homo sapiens
tgatggagggaagggg

SEQ ID NO: 4328631 - DNA, 14 bp, Homo sapiens
tgatggtttggaaa

SEQ ID NO: 4328632 - DNA, 13 bp, Homo sapiens
tgatgtttacaat

SEQ ID NO: 4328633 - DNA, 19 bp, Homo sapiens
tgattaaccacttcagctg

SEQ ID NO: 4328634 - DNA, 12 bp, Homo sapiens
tgattacctctc

SEQ ID NO: 4328635 - DNA, 15 bp, Homo sapiens
tgattataccatgtg

SEQ ID NO: 4328636 - DNA, 23 bp, Homo sapiens
tgattcaagtaagtagatgcctg

SEQ ID NO: 4328637 - DNA, 13 bp, Homo sapiens
tgattcagctctg

SEQ ID NO: 4328638 - DNA, 11 bp, Homo sapiens
tgattgaaaga

SEQ ID NO: 4328639 - DNA, 16 bp, Homo sapiens
tgattttattacagaa

SEQ ID NO: 4328640 - DNA, 20 bp, Homo sapiens
tgattttatttaaactattc

SEQ ID NO: 4328641 - DNA, 13 bp, Homo sapiens
tgattttcattgc

SEQ ID NO: 4328642 - DNA, 14 bp, Homo sapiens
tgcaaaatagaaga

SEQ ID NO: 4328643 - DNA, 18 bp, Homo sapiens
tgcaaaatagaagaagag

SEQ ID NO: 4328644 - DNA, 20 bp, Homo sapiens
tgcaaaggtagggactggag

SEQ ID NO: 4328645 - DNA, 18 bp, Homo sapiens
tgcaaagtacaatgtgtt

SEQ ID NO: 4328646 - DNA, 19 bp, Homo sapiens
tgcaaataaagccttttaa

SEQ ID NO: 4328647 - DNA, 19 bp, Homo sapiens
tgcaactaactgactctgt

SEQ ID NO: 4328648 - DNA, 20 bp, Homo sapiens
tgcaactaactgactctgtt

SEQ ID NO: 4328649 - DNA, 23 bp, Homo sapiens
tgcaactaactgactctgttatt

SEQ ID NO: 4328650 - DNA, 24 bp, Homo sapiens
tgcaactaactgactctgttattg

SEQ ID NO: 4328651 - DNA, 23 bp, Homo sapiens
tgcaagaaccaaacgtattttat

SEQ ID NO: 4328652 - DNA, 17 bp, Homo sapiens
tgcaagtgaacttggga

SEQ ID NO: 4328653 - DNA, 12 bp, Homo sapiens
tgcacaaggatt

SEQ ID NO: 4328654 - DNA, 15 bp, Homo sapiens
tgcacactaagaaat

SEQ ID NO: 4328655 - DNA, 14 bp, Homo sapiens
tgcaccattttcaa

SEQ ID NO: 4328656 - DNA, 15 bp, Homo sapiens
tgcaccattttcaat

SEQ ID NO: 4328657 - DNA, 13 bp, Homo sapiens
tgcacctgagcct

SEQ ID NO: 4328658 - DNA, 18 bp, Homo sapiens
tgcacctgagcctgttcc

SEQ ID NO: 4328659 - DNA, 13 bp, Homo sapiens
tgcactaaatatg

SEQ ID NO: 4328660 - DNA, 20 bp, Homo sapiens
tgcactaggaattctttgca

SEQ ID NO: 4328661 - DNA, 12 bp, Homo sapiens
tgcagaaaatga

SEQ ID NO: 4328662 - DNA, 22 bp, Homo sapiens
tgcagaacgtatttagccatta

SEQ ID NO: 4328663 - DNA, 13 bp, Homo sapiens
tgcagcaactccc

SEQ ID NO: 4328664 - DNA, 15 bp, Homo sapiens
tgcagcaactcccac

SEQ ID NO: 4328665 - DNA, 16 bp, Homo sapiens
tgcagcaactcccacg

SEQ ID NO: 4328666 - DNA, 18 bp, Homo sapiens
tgcagcttgtgctgagcc

SEQ ID NO: 4328667 - DNA, 14 bp, Homo sapiens
tgcaggacctcagg

SEQ ID NO: 4328668 - DNA, 16 bp, Homo sapiens
tgcaggacctcaggtg

SEQ ID NO: 4328669 - DNA, 20 bp, Homo sapiens
tgcaggcacttattgtaaat

SEQ ID NO: 4328670 - DNA, 14 bp, Homo sapiens
tgcagggcctggca

SEQ ID NO: 4328671 - DNA, 20 bp, Homo sapiens
tgcaggtccggggaggaggt

SEQ ID NO: 4328672 - DNA, 18 bp, Homo sapiens
tgcagtcatcaacaaaag

SEQ ID NO: 4328673 - DNA, 15 bp, Homo sapiens
tgcagtgttagtatt

SEQ ID NO: 4328674 - DNA, 17 bp, Homo sapiens
tgcagtttcatgtatgt

SEQ ID NO: 4328675 - DNA, 17 bp, Homo sapiens
tgcataaaattctagag

SEQ ID NO: 4328676 - DNA, 20 bp, Homo sapiens
tgcataatactaatttattg

SEQ ID NO: 4328677 - DNA, 18 bp, Homo sapiens
tgcatatgctacacatat

SEQ ID NO: 4328678 - DNA, 20 bp, Homo sapiens
tgcatctggcacgtggccag

SEQ ID NO: 4328679 - DNA, 16 bp, Homo sapiens
tgcatgtgccgaggtg

SEQ ID NO: 4328680 - DNA, 17 bp, Homo sapiens
tgcatgtgccgaggtgc

SEQ ID NO: 4328681 - DNA, 21 bp, Homo sapiens
tgcattaaaggagatcttccc

SEQ ID NO: 4328682 - DNA, 21 bp, Homo sapiens
tgcattagagcccatttcaat

SEQ ID NO: 4328683 - DNA, 13 bp, Homo sapiens
tgcattccttact

SEQ ID NO: 4328684 - DNA, 18 bp, Homo sapiens
tgcattccttacttgcac

SEQ ID NO: 4328685 - DNA, 19 bp, Homo sapiens
tgcattccttacttgcact

SEQ ID NO: 4328686 - DNA, 13 bp, Homo sapiens
tgcatttaaactc

SEQ ID NO: 4328687 - DNA, 14 bp, Homo sapiens
tgcatttaaactct

SEQ ID NO: 4328688 - DNA, 23 bp, Homo sapiens
tgcatttgctgttgtttctataa

SEQ ID NO: 4328689 - DNA, 17 bp, Homo sapiens
tgcattttcttcagaat

SEQ ID NO: 4328690 - DNA, 19 bp, Homo sapiens
tgcattttcttcagaatta

SEQ ID NO: 4328691 - DNA, 11 bp, Homo sapiens
tgccaaagctg

SEQ ID NO: 4328692 - DNA, 19 bp, Homo sapiens
tgccaaagctggctttttg

SEQ ID NO: 4328693 - DNA, 24 bp, Homo sapiens
tgccaacagacactacattaccct

SEQ ID NO: 4328694 - DNA, 20 bp, Homo sapiens
tgccaaggccggagacccac

SEQ ID NO: 4328695 - DNA, 11 bp, Homo sapiens
tgccacaggcc

SEQ ID NO: 4328696 - DNA, 12 bp, Homo sapiens
tgccacaggcct

SEQ ID NO: 4328697 - DNA, 15 bp, Homo sapiens
tgccacaggcctccc

SEQ ID NO: 4328698 - DNA, 21 bp, Homo sapiens
tgccacagtggtactctgtgt

SEQ ID NO: 4328699 - DNA, 20 bp, Homo sapiens
tgccactaagtacagctgac

SEQ ID NO: 4328700 - DNA, 18 bp, Homo sapiens
tgccagaaaaaaataact

SEQ ID NO: 4328701 - DNA, 19 bp, Homo sapiens
tgccagaaaaaaataacta

SEQ ID NO: 4328702 - DNA, 13 bp, Homo sapiens
tgccagtggagac

SEQ ID NO: 4328703 - DNA, 16 bp, Homo sapiens
tgccagtggagacgga

SEQ ID NO: 4328704 - DNA, 17 bp, Homo sapiens
tgccataaaattgcagt

SEQ ID NO: 4328705 - DNA, 15 bp, Homo sapiens
tgccataccttctcc

SEQ ID NO: 4328706 - DNA, 21 bp, Homo sapiens
tgccataccttctcccaggcc

SEQ ID NO: 4328707 - DNA, 17 bp, Homo sapiens
tgccattgtctttcctc

SEQ ID NO: 4328708 - DNA, 15 bp, Homo sapiens
tgcccaacaccagcc

SEQ ID NO: 4328709 - DNA, 17 bp, Homo sapiens
tgcccaacaccagcccc

SEQ ID NO: 4328710 - DNA, 17 bp, Homo sapiens
tgcccaccccagcatca

SEQ ID NO: 4328711 - DNA, 19 bp, Homo sapiens
tgcccaccgaggagcccca

SEQ ID NO: 4328712 - DNA, 14 bp, Homo sapiens
tgcccagccctctg

SEQ ID NO: 4328713 - DNA, 16 bp, Homo sapiens
tgcccagtcccccaac

SEQ ID NO: 4328714 - DNA, 18 bp, Homo sapiens
tgcccagtcccccaaccc

SEQ ID NO: 4328715 - DNA, 17 bp, Homo sapiens
tgcccatttttgctaat

SEQ ID NO: 4328716 - DNA, 18 bp, Homo sapiens
tgccccaagagcaggagg

SEQ ID NO: 4328717 - DNA, 16 bp, Homo sapiens
tgccccaaggaggtgg

SEQ ID NO: 4328718 - DNA, 13 bp, Homo sapiens
tgccccagcccaa

SEQ ID NO: 4328719 - DNA, 17 bp, Homo sapiens
tgccccagcccaagtcc

SEQ ID NO: 4328720 - DNA, 15 bp, Homo sapiens
tgcccctgccaaggc

SEQ ID NO: 4328721 - DNA, 21 bp, Homo sapiens
tgcccctgccaaggccggaga

SEQ ID NO: 4328722 - DNA, 17 bp, Homo sapiens
tgcccggtgcagggcct

SEQ ID NO: 4328723 - DNA, 18 bp, Homo sapiens
tgcccggtgcagggcctg

SEQ ID NO: 4328724 - DNA, 19 bp, Homo sapiens
tgcccggtgcagggcctgg

SEQ ID NO: 4328725 - DNA, 21 bp, Homo sapiens
tgcccggtgcagggcctggca

SEQ ID NO: 4328726 - DNA, 21 bp, Homo sapiens
tgcccttacacgtgcgtgtga

SEQ ID NO: 4328727 - DNA, 11 bp, Homo sapiens
tgcccttcccc

SEQ ID NO: 4328728 - DNA, 12 bp, Homo sapiens
tgcccttccccc

SEQ ID NO: 4328729 - DNA, 15 bp, Homo sapiens
tgcccttgtctgaga

SEQ ID NO: 4328730 - DNA, 20 bp, Homo sapiens
tgccgaggtgcgtcccccgt

SEQ ID NO: 4328731 - DNA, 24 bp, Homo sapiens
tgcctcccgcctcccgccaccctg

SEQ ID NO: 4328732 - DNA, 21 bp, Homo sapiens
tgcctcctagacacccgccct

SEQ ID NO: 4328733 - DNA, 15 bp, Homo sapiens
tgcctcctgcctccc

SEQ ID NO: 4328734 - DNA, 17 bp, Homo sapiens
tgcctcctgtgcctccc

SEQ ID NO: 4328735 - DNA, 16 bp, Homo sapiens
tgcctcggctcacaaa

SEQ ID NO: 4328736 - DNA, 21 bp, Homo sapiens
tgcctcttctctactctaggg

SEQ ID NO: 4328737 - DNA, 13 bp, Homo sapiens
tgttgtacaagct

SEQ ID NO: 4328738 - DNA, 15 bp, Homo sapiens
tgttgtacaagctca

SEQ ID NO: 4328739 - DNA, 13 bp, Homo sapiens
tgttgtcagctga

SEQ ID NO: 4328740 - DNA, 14 bp, Homo sapiens
tgttgtcagctgaa

SEQ ID NO: 4328741 - DNA, 11 bp, Homo sapiens
tgttgtcattg

SEQ ID NO: 4328742 - DNA, 13 bp, Homo sapiens
tgttgtcattgtc

SEQ ID NO: 4328743 - DNA, 15 bp, Homo sapiens
tgttgtcattgtcca

SEQ ID NO: 4328744 - DNA, 21 bp, Homo sapiens
tgttgtcattgtccagctggg

SEQ ID NO: 4328745 - DNA, 20 bp, Homo sapiens
tgtttagctacctttttata

SEQ ID NO: 4328746 - DNA, 16 bp, Homo sapiens
tgtttatatattgaaa

SEQ ID NO: 4328747 - DNA, 14 bp, Homo sapiens
tgtttatgttttta

SEQ ID NO: 4328748 - DNA, 13 bp, Homo sapiens
tgtttattccttg

SEQ ID NO: 4328749 - DNA, 14 bp, Homo sapiens
tgtttattgagttt

SEQ ID NO: 4328750 - DNA, 15 bp, Homo sapiens
tgtttctataaatga

SEQ ID NO: 4328751 - DNA, 12 bp, Homo sapiens
tgtttcttctcc

SEQ ID NO: 4328752 - DNA, 14 bp, Homo sapiens
tgtttcttgtttat

SEQ ID NO: 4328753 - DNA, 21 bp, Homo sapiens
tgtttctttctgtctctctct

SEQ ID NO: 4328754 - DNA, 17 bp, Homo sapiens
tgtttgaagcctgccct

SEQ ID NO: 4328755 - DNA, 23 bp, Homo sapiens
tgtttgtccttgcacctgagcct

SEQ ID NO: 4328756 - DNA, 17 bp, Homo sapiens
tgtttgttgtcagctga

SEQ ID NO: 4328757 - DNA, 15 bp, Homo sapiens
tgttttaatctactt

SEQ ID NO: 4328758 - DNA, 16 bp, Homo sapiens
tgttttataattagtc

SEQ ID NO: 4328759 - DNA, 15 bp, Homo sapiens
tgttttctcttgaga

SEQ ID NO: 4328760 - DNA, 13 bp, Homo sapiens
ttaaaaaaaatcc

SEQ ID NO: 4328761 - DNA, 14 bp, Homo sapiens
ttaaaaaattaaaa

SEQ ID NO: 4328762 - DNA, 18 bp, Homo sapiens
ttaaaaagtggaaaaata

SEQ ID NO: 4328763 - DNA, 13 bp, Homo sapiens
ttaaaatatatat

SEQ ID NO: 4328764 - DNA, 23 bp, Homo sapiens
ttaaaatcacattttaagtgctt

SEQ ID NO: 4328765 - DNA, 12 bp, Homo sapiens
ttaaaatgtgat

SEQ ID NO: 4328766 - DNA, 18 bp, Homo sapiens
ttaaacaaaatttcacag

SEQ ID NO: 4328767 - DNA, 14 bp, Homo sapiens
ttaaactagtttaa

SEQ ID NO: 4328768 - DNA, 17 bp, Homo sapiens
ttaaagacccaacttgc

SEQ ID NO: 4328769 - DNA, 14 bp, Homo sapiens
ttaaagccttaagc

SEQ ID NO: 4328770 - DNA, 17 bp, Homo sapiens
ttaaagcttatttttat

SEQ ID NO: 4328771 - DNA, 19 bp, Homo sapiens
ttaaagcttgatttgatct

SEQ ID NO: 4328772 - DNA, 20 bp, Homo sapiens
ttaaagcttgatttgatctt

SEQ ID NO: 4328773 - DNA, 19 bp, Homo sapiens
ttaaagtaaacttgtgtat

SEQ ID NO: 4328774 - DNA, 14 bp, Homo sapiens
ttaaataaactgtt

SEQ ID NO: 4328775 - DNA, 21 bp, Homo sapiens
ttaaatgagggtttctgatct

SEQ ID NO: 4328776 - DNA, 12 bp, Homo sapiens
ttaaatgccaaa

SEQ ID NO: 4328777 - DNA, 18 bp, Homo sapiens
ttaaatgccaaaatgtac

SEQ ID NO: 4328778 - DNA, 15 bp, Homo sapiens
ttaaatgtgagcaaa

SEQ ID NO: 4328779 - DNA, 17 bp, Homo sapiens
ttaaccacttcagctga

SEQ ID NO: 4328780 - DNA, 13 bp, Homo sapiens
ttaaccattgtct

SEQ ID NO: 4328781 - DNA, 13 bp, Homo sapiens
ttaactaaatgct

SEQ ID NO: 4328782 - DNA, 14 bp, Homo sapiens
ttaactaaatgctc

SEQ ID NO: 4328783 - DNA, 19 bp, Homo sapiens
ttaactgtatttcagtatt

SEQ ID NO: 4328784 - DNA, 15 bp, Homo sapiens
ttaagtgtcatttct

SEQ ID NO: 4328785 - DNA, 18 bp, Homo sapiens
ttaataaactttgaataa

SEQ ID NO: 4328786 - DNA, 15 bp, Homo sapiens
ttaatctactttttg

SEQ ID NO: 4328787 - DNA, 21 bp, Homo sapiens
ttacaatgatgccgaacatta

SEQ ID NO: 4328788 - DNA, 22 bp, Homo sapiens
ttacaatgatgccgaacattag

SEQ ID NO: 4328789 - DNA, 15 bp, Homo sapiens
ttacaggacttctct

SEQ ID NO: 4328790 - DNA, 15 bp, Homo sapiens
ttacagggagcctcc

SEQ ID NO: 4328791 - DNA, 16 bp, Homo sapiens
ttacagggagcctcct

SEQ ID NO: 4328792 - DNA, 20 bp, Homo sapiens
ttacagtttattttctgtgt

SEQ ID NO: 4328793 - DNA, 12 bp, Homo sapiens
ttacatgacttt

SEQ ID NO: 4328794 - DNA, 14 bp, Homo sapiens
ttaccagtctgatt

SEQ ID NO: 4328795 - DNA, 23 bp, Homo sapiens
ttacctcctaatggcatggagac

SEQ ID NO: 4328796 - DNA, 20 bp, Homo sapiens
ttacggttttccaggtttaa

SEQ ID NO: 4328797 - DNA, 16 bp, Homo sapiens
ttacgtataatgcttt

SEQ ID NO: 4328798 - DNA, 19 bp, Homo sapiens
ttacgtgcatttaaactct

SEQ ID NO: 4328799 - DNA, 20 bp, Homo sapiens
ttactcccttctgtagtttt

SEQ ID NO: 4328800 - DNA, 22 bp, Homo sapiens
ttactcttaaatcatttggtta

SEQ ID NO: 4328801 - DNA, 13 bp, Homo sapiens
ttactgaaagaca

SEQ ID NO: 4328802 - DNA, 18 bp, Homo sapiens
ttactgatttagaagcaa

SEQ ID NO: 4328803 - DNA, 14 bp, Homo sapiens
ttacttagaatgcc

SEQ ID NO: 4328804 - DNA, 17 bp, Homo sapiens
ttacttccattgcaaaa

SEQ ID NO: 4328805 - DNA, 21 bp, Homo sapiens
ttacttgcactgttactctta

SEQ ID NO: 4328806 - DNA, 23 bp, Homo sapiens
ttactttaacctccctcaacaag

SEQ ID NO: 4328807 - DNA, 13 bp, Homo sapiens
ttactttggttta

SEQ ID NO: 4328808 - DNA, 18 bp, Homo sapiens
ttactttggtttagtctt

SEQ ID NO: 4328809 - DNA, 15 bp, Homo sapiens
ttactttttgctgtt

SEQ ID NO: 4328810 - DNA, 21 bp, Homo sapiens
ttagaagcaaagatttcagta

SEQ ID NO: 4328811 - DNA, 15 bp, Homo sapiens
ttagaccgctctctt

SEQ ID NO: 4328812 - DNA, 16 bp, Homo sapiens
ttagaccgctctcttt

SEQ ID NO: 4328813 - DNA, 16 bp, Homo sapiens
ttagagcatctctgcc

SEQ ID NO: 4328814 - DNA, 18 bp, Homo sapiens
ttagagcatctctgcctc

SEQ ID NO: 4328815 - DNA, 20 bp, Homo sapiens
ttagagcttttcagaacatc

SEQ ID NO: 4328816 - DNA, 16 bp, Homo sapiens
ttagatgtttaccttc

SEQ ID NO: 4328817 - DNA, 19 bp, Homo sapiens
ttagccacggaaacataga

SEQ ID NO: 4328818 - DNA, 17 bp, Homo sapiens
ttaggaattgtttatac

SEQ ID NO: 4328819 - DNA, 15 bp, Homo sapiens
ttaggatgagcaaaa

SEQ ID NO: 4328820 - DNA, 22 bp, Homo sapiens
ttagggaaaatggatatagaaa

SEQ ID NO: 4328821 - DNA, 19 bp, Homo sapiens
ttagtcgggcatgagtctg

SEQ ID NO: 4328822 - DNA, 22 bp, Homo sapiens
ttagtcgggcatgagtctgttt

SEQ ID NO: 4328823 - DNA, 20 bp, Homo sapiens
ttataaaaataaatagaaaa

SEQ ID NO: 4328824 - DNA, 17 bp, Homo sapiens
ttataaaattgaaaaca

SEQ ID NO: 4328825 - DNA, 13 bp, Homo sapiens
ttataatgggtaa

SEQ ID NO: 4328826 - DNA, 17 bp, Homo sapiens
ttatagattgtcttaat

SEQ ID NO: 4328827 - DNA, 18 bp, Homo sapiens
ttatatataaggtaatgt

SEQ ID NO: 4328828 - DNA, 21 bp, Homo sapiens
ttatatattgaaagttgcttt

SEQ ID NO: 4328829 - DNA, 21 bp, Homo sapiens
ttatcagtagaaagagtgtta

SEQ ID NO: 4328830 - DNA, 21 bp, Homo sapiens
ttatccattacgtgcatttaa

SEQ ID NO: 4328831 - DNA, 22 bp, Homo sapiens
ttatccattacgtgcatttaaa

SEQ ID NO: 4328832 - DNA, 18 bp, Homo sapiens
ttatcctacagtacaatc

SEQ ID NO: 4328833 - DNA, 21 bp, Homo sapiens
ttatcctagttccattcttgg

SEQ ID NO: 4328834 - DNA, 22 bp, Homo sapiens
ttatctatcggaagaacatgaa

SEQ ID NO: 4328835 - DNA, 19 bp, Homo sapiens
ttatctgatatgctgagaa

SEQ ID NO: 4328836 - DNA, 23 bp, Homo sapiens
ttatctgatatgctgagaaatta

SEQ ID NO: 4328837 - DNA, 14 bp, Homo sapiens
ttatgaaatatggt

SEQ ID NO: 4328838 - DNA, 14 bp, Homo sapiens
ttatgagatttact

SEQ ID NO: 4328839 - DNA, 19 bp, Homo sapiens
ttatgcactaaatatgaac

SEQ ID NO: 4328840 - DNA, 22 bp, Homo sapiens
ttatgtgtagttgtctctcttc

SEQ ID NO: 4328841 - DNA, 17 bp, Homo sapiens
ttattcagctagaattt

SEQ ID NO: 4328842 - DNA, 19 bp, Homo sapiens
ttattcagctagaatttct

SEQ ID NO: 4328843 - DNA, 21 bp, Homo sapiens
ttattcagctagaatttctgg

SEQ ID NO: 4328844 - DNA, 19 bp, Homo sapiens
ttattgcatttgctgttgt

SEQ ID NO: 4328845 - DNA, 20 bp, Homo sapiens
ttattgcttattgcttagta

SEQ ID NO: 4328846 - DNA, 17 bp, Homo sapiens
ttatttaaactattcag

SEQ ID NO: 4328847 - DNA, 21 bp, Homo sapiens
ttatttctctggcaaactttt

SEQ ID NO: 4328848 - DNA, 15 bp, Homo sapiens
ttattttcattgtga

SEQ ID NO: 4328849 - DNA, 21 bp, Homo sapiens
ttcaaattggtctgaaaggct

SEQ ID NO: 4328850 - DNA, 18 bp, Homo sapiens
ttcaagcttttcctttct

SEQ ID NO: 4328851 - DNA, 19 bp, Homo sapiens
ttcaagcttttcctttctt

SEQ ID NO: 4328852 - DNA, 14 bp, Homo sapiens
ttcaatagaacatg

SEQ ID NO: 4328853 - DNA, 15 bp, Homo sapiens
ttcacgaactgttca

SEQ ID NO: 4328854 - DNA, 17 bp, Homo sapiens
ttcacggaagagccttg

SEQ ID NO: 4328855 - DNA, 17 bp, Homo sapiens
tttaactacatctgcct

SEQ ID NO: 4328856 - DNA, 21 bp, Homo sapiens
tttaagctgttactgtcttca

SEQ ID NO: 4328857 - DNA, 23 bp, Homo sapiens
tttaagtgacataattgtccagt

SEQ ID NO: 4328858 - DNA, 19 bp, Homo sapiens
tttaagtgcttcacatttg

SEQ ID NO: 4328859 - DNA, 22 bp, Homo sapiens
tttaataaaagtactgaagacc

SEQ ID NO: 4328860 - DNA, 16 bp, Homo sapiens
tttactgagacttcga

SEQ ID NO: 4328861 - DNA, 22 bp, Homo sapiens
tttagaccctattgctgcttga

SEQ ID NO: 4328862 - DNA, 15 bp, Homo sapiens
tttaggttgttacca

SEQ ID NO: 4328863 - DNA, 15 bp, Homo sapiens
tttagtgtgctgctg

SEQ ID NO: 4328864 - DNA, 16 bp, Homo sapiens
tttagtgtgctgctgt

SEQ ID NO: 4328865 - DNA, 17 bp, Homo sapiens
tttagtgtgctgctgtt

SEQ ID NO: 4328866 - DNA, 23 bp, Homo sapiens
tttagtgtgctgctgttctgtgt

SEQ ID NO: 4328867 - DNA, 19 bp, Homo sapiens
tttagttacgtataatgct

SEQ ID NO: 4328868 - DNA, 23 bp, Homo sapiens
tttataaaaataaatagaaaagt

SEQ ID NO: 4328869 - DNA, 13 bp, Homo sapiens
tttatatcttgtt

SEQ ID NO: 4328870 - DNA, 12 bp, Homo sapiens
tttatgatttct

SEQ ID NO: 4328871 - DNA, 19 bp, Homo sapiens
tttatgtaatgaagtaaag

SEQ ID NO: 4328872 - DNA, 15 bp, Homo sapiens
tttattacttgtgca

SEQ ID NO: 4328873 - DNA, 18 bp, Homo sapiens
tttattcagctagaattt

SEQ ID NO: 4328874 - DNA, 12 bp, Homo sapiens
tttattgcacta

SEQ ID NO: 4328875 - DNA, 14 bp, Homo sapiens
tttatttattgctt

SEQ ID NO: 4328876 - DNA, 15 bp, Homo sapiens
tttattttctgtgta

SEQ ID NO: 4328877 - DNA, 14 bp, Homo sapiens
tttcaattctcaaa

SEQ ID NO: 4328878 - DNA, 15 bp, Homo sapiens
tttcaattctcaaaa

SEQ ID NO: 4328879 - DNA, 19 bp, Homo sapiens
tttcacagttctgtaatgt

SEQ ID NO: 4328880 - DNA, 16 bp, Homo sapiens
tttcagattttaaaaa

SEQ ID NO: 4328881 - DNA, 14 bp, Homo sapiens
tttcagtagaattt

SEQ ID NO: 4328882 - DNA, 15 bp, Homo sapiens
tttcagtattttcca

SEQ ID NO: 4328883 - DNA, 20 bp, Homo sapiens
tttcatagatttgaaaaact

SEQ ID NO: 4328884 - DNA, 21 bp, Homo sapiens
tttcatagtgtcaagaaggaa

SEQ ID NO: 4328885 - DNA, 14 bp, Homo sapiens
tttcatgtatgtat

SEQ ID NO: 4328886 - DNA, 11 bp, Homo sapiens
tttcattccat

SEQ ID NO: 4328887 - DNA, 22 bp, Homo sapiens
tttcatttcagattttaaaaag

SEQ ID NO: 4328888 - DNA, 22 bp, Homo sapiens
tttcccaagctagactgtgtct

SEQ ID NO: 4328889 - DNA, 12 bp, Homo sapiens
tttcccccaccc

SEQ ID NO: 4328890 - DNA, 18 bp, Homo sapiens
tttcccccaccccagagt

SEQ ID NO: 4328891 - DNA, 20 bp, Homo sapiens
tttcccccaccccagagttg

SEQ ID NO: 4328892 - DNA, 13 bp, Homo sapiens
tttcctcccttct

SEQ ID NO: 4328893 - DNA, 22 bp, Homo sapiens
tttcctttcttttttttcttgg

SEQ ID NO: 4328894 - DNA, 18 bp, Homo sapiens
tttcgcttgcttctgcag

SEQ ID NO: 4328895 - DNA, 17 bp, Homo sapiens
tttctacattattgctt

SEQ ID NO: 4328896 - DNA, 14 bp, Homo sapiens
tttctataaatgac

SEQ ID NO: 4328897 - DNA, 13 bp, Homo sapiens
tttctattccaaa

SEQ ID NO: 4328898 - DNA, 14 bp, Homo sapiens
tttctattccaaag

SEQ ID NO: 4328899 - DNA, 15 bp, Homo sapiens
tttctatttacctcc

SEQ ID NO: 4328900 - DNA, 15 bp, Homo sapiens
tttctccagtgctgt

SEQ ID NO: 4328901 - DNA, 22 bp, Homo sapiens
tttctctcaaatgatacagtca

SEQ ID NO: 4328902 - DNA, 12 bp, Homo sapiens
tttctctgcctg

SEQ ID NO: 4328903 - DNA, 11 bp, Homo sapiens
tttctgatctg

SEQ ID NO: 4328904 - DNA, 13 bp, Homo sapiens
tttctgtgtaaaa

SEQ ID NO: 4328905 - DNA, 17 bp, Homo sapiens
tttctgtgtaaaatgag

SEQ ID NO: 4328906 - DNA, 18 bp, Homo sapiens
tttctgtgtaaaatgagt

SEQ ID NO: 4328907 - DNA, 23 bp, Homo sapiens
tttcttagtgcttcagagtttgt

SEQ ID NO: 4328908 - DNA, 18 bp, Homo sapiens
tttctttgtagaataaat

SEQ ID NO: 4328909 - DNA, 21 bp, Homo sapiens
tttgaaactaactcatagatt

SEQ ID NO: 4328910 - DNA, 16 bp, Homo sapiens
tttgaatattactcct

SEQ ID NO: 4328911 - DNA, 17 bp, Homo sapiens
tttgagaccagaagaaa

SEQ ID NO: 4328912 - DNA, 18 bp, Homo sapiens
tttgaggtagaggaaaat

SEQ ID NO: 4328913 - DNA, 17 bp, Homo sapiens
tttgagtatggctatct

SEQ ID NO: 4328914 - DNA, 16 bp, Homo sapiens
tttgatctttgtttaa

SEQ ID NO: 4328915 - DNA, 16 bp, Homo sapiens
tttgatgccaagaaag

SEQ ID NO: 4328916 - DNA, 16 bp, Homo sapiens
tttgcataatactaat

SEQ ID NO: 4328917 - DNA, 21 bp, Homo sapiens
tttgcccaacaccagcccctg

SEQ ID NO: 4328918 - DNA, 19 bp, Homo sapiens
tttgctgaaggattatatg

SEQ ID NO: 4328919 - DNA, 22 bp, Homo sapiens
tttgctgtgtagttccctctgc

SEQ ID NO: 4328920 - DNA, 23 bp, Homo sapiens
tttgctgtgtagttccctctgcc

SEQ ID NO: 4328921 - DNA, 13 bp, Homo sapiens
tttgctgttactg

SEQ ID NO: 4328922 - DNA, 17 bp, Homo sapiens
tttgctgttactgcttc

SEQ ID NO: 4328923 - DNA, 12 bp, Homo sapiens
tttggaaaataa

SEQ ID NO: 4328924 - DNA, 16 bp, Homo sapiens
tttggaaaataacttt

SEQ ID NO: 4328925 - DNA, 22 bp, Homo sapiens
tttgggaggccaaggtgggagg

SEQ ID NO: 4328926 - DNA, 23 bp, Homo sapiens
tttgggccaatttactggccact

SEQ ID NO: 4328927 - DNA, 18 bp, Homo sapiens
tttgtaccccccaacccc

SEQ ID NO: 4328928 - DNA, 17 bp, Homo sapiens
tttgtaggtaaaatgta

SEQ ID NO: 4328929 - DNA, 14 bp, Homo sapiens
tttgtagtaaatat

SEQ ID NO: 4328930 - DNA, 12 bp, Homo sapiens
tttgtattaata

SEQ ID NO: 4328931 - DNA, 22 bp, Homo sapiens
tttgtatttagtagttatttgt

SEQ ID NO: 4328932 - DNA, 21 bp, Homo sapiens
tttgtccttgcacctgagcct

SEQ ID NO: 4328933 - DNA, 23 bp, Homo sapiens
tttgtgctatcagactgtaggat

SEQ ID NO: 4328934 - DNA, 16 bp, Homo sapiens
tttgttcctttgaaga

SEQ ID NO: 4328935 - DNA, 19 bp, Homo sapiens
tttgttctcagctccccct

SEQ ID NO: 4328936 - DNA, 19 bp, Homo sapiens
tttgttgaaaaatgttgct

SEQ ID NO: 4328937 - DNA, 16 bp, Homo sapiens
tttgttgtcagctgaa

SEQ ID NO: 4328938 - DNA, 22 bp, Homo sapiens
tttgtttttttccaactgtgtt

SEQ ID NO: 4328939 - DNA, 21 bp, Homo sapiens
ttttaaaaaactgctgactgt

SEQ ID NO: 4328940 - DNA, 15 bp, Homo sapiens
ttttaaaaaatatat

SEQ ID NO: 4328941 - DNA, 20 bp, Homo sapiens
ttttaaaaagggtaacttgt

SEQ ID NO: 4328942 - DNA, 21 bp, Homo sapiens
ttttaaacaaaatttcacagt

SEQ ID NO: 4328943 - DNA, 21 bp, Homo sapiens
ttttaaatcaaaaacttttca

SEQ ID NO: 4328944 - DNA, 21 bp, Homo sapiens
ttttaaatgggagcaacatat

SEQ ID NO: 4328945 - DNA, 13 bp, Homo sapiens
ttttaaatgtgtt

SEQ ID NO: 4328946 - DNA, 17 bp, Homo sapiens
ttttaaattctcagtca

SEQ ID NO: 4328947 - DNA, 18 bp, Homo sapiens
ttttaaattctcagtcat

SEQ ID NO: 4328948 - DNA, 16 bp, Homo sapiens
ttttaagtttgaaact

SEQ ID NO: 4328949 - DNA, 17 bp, Homo sapiens
ttttaattaaaaacttt

SEQ ID NO: 4328950 - DNA, 19 bp, Homo sapiens
ttttaattaaaaactttaa

SEQ ID NO: 4328951 - DNA, 20 bp, Homo sapiens
ttttacacatgtgctgatgt

SEQ ID NO: 4328952 - DNA, 21 bp, Homo sapiens
ttttacccataagtaatattt

SEQ ID NO: 4328953 - DNA, 15 bp, Homo sapiens
ttttactttggttta

SEQ ID NO: 4328954 - DNA, 15 bp, Homo sapiens
ttttaggttgttacc

SEQ ID NO: 4328955 - DNA, 16 bp, Homo sapiens
ttttatttaaactatt

SEQ ID NO: 4328956 - DNA, 22 bp, Homo sapiens
ttttcatagatttgaaaaactt

SEQ ID NO: 4328957 - DNA, 13 bp, Homo sapiens
ttttccaaactga

SEQ ID NO: 4328958 - DNA, 22 bp, Homo sapiens
ttttccccgtgacattcactgg

SEQ ID NO: 4328959 - DNA, 13 bp, Homo sapiens
ttttcctttgtgg

SEQ ID NO: 4328960 - DNA, 16 bp, Homo sapiens
ttttctacattattgc

SEQ ID NO: 4328961 - DNA, 17 bp, Homo sapiens
ttttctctatgtacgat

SEQ ID NO: 4328962 - DNA, 11 bp, Homo sapiens
ttttctgtact

SEQ ID NO: 4328963 - DNA, 12 bp, Homo sapiens
ttttctgtgtaa

SEQ ID NO: 4328964 - DNA, 17 bp, Homo sapiens
ttttcttttattatcag

SEQ ID NO: 4328965 - DNA, 16 bp, Homo sapiens
ttttcttttctatgga

SEQ ID NO: 4328966 - DNA, 15 bp, Homo sapiens
ttttgaaaaagtgta

SEQ ID NO: 4328967 - DNA, 23 bp, Homo sapiens
ttttgaaaaagtgtacatgaaga

SEQ ID NO: 4328968 - DNA, 17 bp, Homo sapiens
ttttgctctagggccct

SEQ ID NO: 4328969 - DNA, 22 bp, Homo sapiens
ttttggaagaagttttttactt

SEQ ID NO: 4328970 - DNA, 21 bp, Homo sapiens
ttttgtaaactggaattaaaa

SEQ ID NO: 4328971 - DNA, 12 bp, Homo sapiens
ttttgtatttag

SEQ ID NO: 4328972 - DNA, 20 bp, Homo sapiens
ttttgtttgatgcaggcact

SEQ ID NO: 4328973 - DNA, 12 bp, Homo sapiens
caccccagagtt

SEQ ID NO: 4328974 - DNA, 19 bp, Homo sapiens
caccccagcatcagcacag

SEQ ID NO: 4328975 - DNA, 19 bp, Homo sapiens
caccccagcccccacagcc

SEQ ID NO: 4328976 - DNA, 22 bp, Homo sapiens
caccccagcccccacagccctg

SEQ ID NO: 4328977 - DNA, 23 bp, Homo sapiens
caccccagcccccacagccctgg

SEQ ID NO: 4328978 - DNA, 20 bp, Homo sapiens
cacccctcaacacctctgca

SEQ ID NO: 4328979 - DNA, 11 bp, Homo sapiens
cacccctgcct

SEQ ID NO: 4328980 - DNA, 15 bp, Homo sapiens
cacccctgcctcctg

SEQ ID NO: 4328981 - DNA, 20 bp, Homo sapiens
cacccgccctgcccttccct

SEQ ID NO: 4328982 - DNA, 17 bp, Homo sapiens
caccgaatatattactg

SEQ ID NO: 4328983 - DNA, 13 bp, Homo sapiens
caccgaggagccc

SEQ ID NO: 4328984 - DNA, 20 bp, Homo sapiens
caccgaggagccccagcccc

SEQ ID NO: 4328985 - DNA, 22 bp, Homo sapiens
caccgaggagccccagccccgt

SEQ ID NO: 4328986 - DNA, 19 bp, Homo sapiens
caccgccgactttgtaccc

SEQ ID NO: 4328987 - DNA, 13 bp, Homo sapiens
caccgctggctcc

SEQ ID NO: 4328988 - DNA, 24 bp, Homo sapiens
cacctccccctgctgctgctgccc

SEQ ID NO: 4328989 - DNA, 16 bp, Homo sapiens
cacctccttccccagc

SEQ ID NO: 4328990 - DNA, 20 bp, Homo sapiens
cacctccttccccagctccc

SEQ ID NO: 4328991 - DNA, 15 bp, Homo sapiens
cacctctgccactct

SEQ ID NO: 4328992 - DNA, 22 bp, Homo sapiens
cacctctggggaagatggagca

SEQ ID NO: 4328993 - DNA, 12 bp, Homo sapiens
cacctgacctct

SEQ ID NO: 4328994 - DNA, 15 bp, Homo sapiens
cacctgacctctgca

SEQ ID NO: 4328995 - DNA, 18 bp, Homo sapiens
cacctgacctctgcaaga

SEQ ID NO: 4328996 - DNA, 11 bp, Homo sapiens
cacctgagcct

SEQ ID NO: 4328997 - DNA, 16 bp, Homo sapiens
caccttagtctttcct

SEQ ID NO: 4328998 - DNA, 13 bp, Homo sapiens
caccttcccttcc

SEQ ID NO: 4328999 - DNA, 14 bp, Homo sapiens
caccttcccttcct

SEQ ID NO: 4329000 - DNA, 17 bp, Homo sapiens
caccttcccttcctcag

SEQ ID NO: 4329001 - DNA, 18 bp, Homo sapiens
caccttcccttcctcagc

SEQ ID NO: 4329002 - DNA, 21 bp, Homo sapiens
caccttcccttcctcagcagg

SEQ ID NO: 4329003 - DNA, 13 bp, Homo sapiens
caccttgttacaa

SEQ ID NO: 4329004 - DNA, 16 bp, Homo sapiens
cacgaactgttcacac

SEQ ID NO: 4329005 - DNA, 16 bp, Homo sapiens
cacgactgcccggcag

SEQ ID NO: 4329006 - DNA, 19 bp, Homo sapiens
cacgctccccgcctgttcc

SEQ ID NO: 4329007 - DNA, 22 bp, Homo sapiens
cacgcttcaaggatatactgca

SEQ ID NO: 4329008 - DNA, 19 bp, Homo sapiens
cacgtccactcccaagcca

SEQ ID NO: 4329009 - DNA, 13 bp, Homo sapiens
cactaacaaaatt

SEQ ID NO: 4329010 - DNA, 18 bp, Homo sapiens
cactaacaaaatttgaat

SEQ ID NO: 4329011 - DNA, 21 bp, Homo sapiens
cactaagaaatgggactctga

SEQ ID NO: 4329012 - DNA, 13 bp, Homo sapiens
cactaattcctta

SEQ ID NO: 4329013 - DNA, 11 bp, Homo sapiens
cactaggaatt

SEQ ID NO: 4329014 - DNA, 14 bp, Homo sapiens
cactaggagactgg

SEQ ID NO: 4329015 - DNA, 19 bp, Homo sapiens
cactaggtgaacagcagga

SEQ ID NO: 4329016 - DNA, 15 bp, Homo sapiens
cactcaaaagctggg

SEQ ID NO: 4329017 - DNA, 19 bp, Homo sapiens
cactcaaaagctgggcagg

SEQ ID NO: 4329018 - DNA, 20 bp, Homo sapiens
cactcaaaagctgggcaggt

SEQ ID NO: 4329019 - DNA, 14 bp, Homo sapiens
cactccagcctggg

SEQ ID NO: 4329020 - DNA, 19 bp, Homo sapiens
cactgaaggattaatgaaa

SEQ ID NO: 4329021 - DNA, 21 bp, Homo sapiens
cactgaaggattaatgaaaac

SEQ ID NO: 4329022 - DNA, 20 bp, Homo sapiens
cactgattccctctcccacc

SEQ ID NO: 4329023 - DNA, 17 bp, Homo sapiens
cactgcaaataaagcct

SEQ ID NO: 4329024 - DNA, 19 bp, Homo sapiens
cactgcaaataaagccttt

SEQ ID NO: 4329025 - DNA, 16 bp, Homo sapiens
cactgcactccagcct

SEQ ID NO: 4329026 - DNA, 19 bp, Homo sapiens
cactgcactccagcctggg

SEQ ID NO: 4329027 - DNA, 19 bp, Homo sapiens
cactgcattcattctgagc

SEQ ID NO: 4329028 - DNA, 20 bp, Homo sapiens
cactgcattcattctgagcc

SEQ ID NO: 4329029 - DNA, 18 bp, Homo sapiens
cactggcacttgcctgct

SEQ ID NO: 4329030 - DNA, 21 bp, Homo sapiens
cactggcacttgcctgctgct

SEQ ID NO: 4329031 - DNA, 17 bp, Homo sapiens
cactggcatcgcagctt

SEQ ID NO: 4329032 - DNA, 15 bp, Homo sapiens
cactggtctgtcttt

SEQ ID NO: 4329033 - DNA, 16 bp, Homo sapiens
cactggtctgtctttg

SEQ ID NO: 4329034 - DNA, 15 bp, Homo sapiens
cactgtcatgtgtct

SEQ ID NO: 4329035 - DNA, 12 bp, Homo sapiens
cactgtctgcgt

SEQ ID NO: 4329036 - DNA, 21 bp, Homo sapiens
cactgtttaagtactgtttac

SEQ ID NO: 4329037 - DNA, 15 bp, Homo sapiens
cacttacctgcttga

SEQ ID NO: 4329038 - DNA, 16 bp, Homo sapiens
cacttacctgcttgag

SEQ ID NO: 4329039 - DNA, 21 bp, Homo sapiens
cacttagacactttacctctt

SEQ ID NO: 4329040 - DNA, 19 bp, Homo sapiens
cacttagtagtttttacaa

SEQ ID NO: 4329041 - DNA, 14 bp, Homo sapiens
cacttatctcactg

SEQ ID NO: 4329042 - DNA, 13 bp, Homo sapiens
cacttcaggagcc

SEQ ID NO: 4329043 - DNA, 15 bp, Homo sapiens
cagaaaaaaataact

SEQ ID NO: 4329044 - DNA, 20 bp, Homo sapiens
cagaaaaaaataactatttt

SEQ ID NO: 4329045 - DNA, 17 bp, Homo sapiens
cagaaagatttggaaaa

SEQ ID NO: 4329046 - DNA, 18 bp, Homo sapiens
cagaaagatttggaaaat

SEQ ID NO: 4329047 - DNA, 16 bp, Homo sapiens
cagaaatagttgtctg

SEQ ID NO: 4329048 - DNA, 17 bp, Homo sapiens
cagaaatagttgtctgt

SEQ ID NO: 4329049 - DNA, 18 bp, Homo sapiens
cagaaatagttgtctgtg

SEQ ID NO: 4329050 - DNA, 12 bp, Homo sapiens
cagaacaaattg

SEQ ID NO: 4329051 - DNA, 13 bp, Homo sapiens
cagaagaaaagac

SEQ ID NO: 4329052 - DNA, 23 bp, Homo sapiens
cagaagaaaagacttacctgaat

SEQ ID NO: 4329053 - DNA, 13 bp, Homo sapiens
cagaagacactaa

SEQ ID NO: 4329054 - DNA, 20 bp, Homo sapiens
cagaagacactaattcctta

SEQ ID NO: 4329055 - DNA, 18 bp, Homo sapiens
cagaagcaaggtctcaga

SEQ ID NO: 4329056 - DNA, 22 bp, Homo sapiens
cagaaggccgatggggaaggag

SEQ ID NO: 4329057 - DNA, 17 bp, Homo sapiens
cagaatggaatccatct

SEQ ID NO: 4329058 - DNA, 13 bp, Homo sapiens
cagaattatccat

SEQ ID NO: 4329059 - DNA, 23 bp, Homo sapiens
cagaattggcataatttgtctta

SEQ ID NO: 4329060 - DNA, 15 bp, Homo sapiens
cagacaattctccct

SEQ ID NO: 4329061 - DNA, 16 bp, Homo sapiens
cagacactacattacc

SEQ ID NO: 4329062 - DNA, 16 bp, Homo sapiens
cagaccaagtccaagc

SEQ ID NO: 4329063 - DNA, 14 bp, Homo sapiens
cagaccacaaaact

SEQ ID NO: 4329064 - DNA, 14 bp, Homo sapiens
cagactcccttgct

SEQ ID NO: 4329065 - DNA, 17 bp, Homo sapiens
cagactctcagcccaga

SEQ ID NO: 4329066 - DNA, 19 bp, Homo sapiens
cagactctcagcccagaag

SEQ ID NO: 4329067 - DNA, 21 bp, Homo sapiens
cagactctcagcccagaagaa

SEQ ID NO: 4329068 - DNA, 19 bp, Homo sapiens
cagagaaatatgcagaagg

SEQ ID NO: 4329069 - DNA, 22 bp, Homo sapiens
cagagaagcgctgttgcccgcc

SEQ ID NO: 4329070 - DNA, 21 bp, Homo sapiens
cagagaagctggaagcctgcc

SEQ ID NO: 4329071 - DNA, 14 bp, Homo sapiens
cagagaattcttag

SEQ ID NO: 4329072 - DNA, 16 bp, Homo sapiens
cagagactaatgttgg

SEQ ID NO: 4329073 - DNA, 16 bp, Homo sapiens
cagagccaccagggca

SEQ ID NO: 4329074 - DNA, 20 bp, Homo sapiens
cagagcccctcatgccacag

SEQ ID NO: 4329075 - DNA, 17 bp, Homo sapiens
cagagcccgggagagac

SEQ ID NO: 4329076 - DNA, 13 bp, Homo sapiens
cagaggaaggaaa

SEQ ID NO: 4329077 - DNA, 14 bp, Homo sapiens
cagaggaaggaaac

SEQ ID NO: 4329078 - DNA, 15 bp, Homo sapiens
cagaggaaggaaaca

SEQ ID NO: 4329079 - DNA, 16 bp, Homo sapiens
cagaggatgctgaagt

SEQ ID NO: 4329080 - DNA, 15 bp, Homo sapiens
cagagtttgtagtaa

SEQ ID NO: 4329081 - DNA, 19 bp, Homo sapiens
cagatacttggggggctga

SEQ ID NO: 4329082 - DNA, 12 bp, Homo sapiens
cagatgccaaaa

SEQ ID NO: 4329083 - DNA, 12 bp, Homo sapiens
cagatgctgaat

SEQ ID NO: 4329084 - DNA, 11 bp, Homo sapiens
cagatgtgaag

SEQ ID NO: 4329085 - DNA, 17 bp, Homo sapiens
cagatttcttaatgtct

SEQ ID NO: 4329086 - DNA, 18 bp, Homo sapiens
cagatttcttaatgtctg

SEQ ID NO: 4329087 - DNA, 21 bp, Homo sapiens
cagatttgaggactgaagctg

SEQ ID NO: 4329088 - DNA, 14 bp, Homo sapiens
cagattttaaaaag

SEQ ID NO: 4329089 - DNA, 15 bp, Homo sapiens
cagattttaaaaagg

SEQ ID NO: 4329090 - DNA, 19 bp, Homo sapiens
cagattttaaaaagggtaa

SEQ ID NO: 4329091 - DNA, 10 bp, Homo sapiens
cagcaactcc

SEQ ID NO: 4329092 - DNA, 11 bp, Homo sapiens
cagcaactccc

SEQ ID NO: 4329093 - DNA, 12 bp, Homo sapiens
cagcaactccca

SEQ ID NO: 4329094 - DNA, 13 bp, Homo sapiens
cagcacagatgtg

SEQ ID NO: 4329095 - DNA, 16 bp, Homo sapiens
cagcacagatgtgaag

SEQ ID NO: 4329096 - DNA, 12 bp, Homo sapiens
cagcacatttcc

SEQ ID NO: 4329097 - DNA, 15 bp, Homo sapiens
cagcactactgggtg

SEQ ID NO: 4329098 - DNA, 18 bp, Homo sapiens
cagcagatgtttaatgaa

SEQ ID NO: 4329099 - DNA, 22 bp, Homo sapiens
cagcagcctggaccctgtggat

SEQ ID NO: 4329100 - DNA, 16 bp, Homo sapiens
cagcaggatgccctgt

SEQ ID NO: 4329101 - DNA, 11 bp, Homo sapiens
cagcaggccaa

SEQ ID NO: 4329102 - DNA, 15 bp, Homo sapiens
cagcaggccaaacat

SEQ ID NO: 4329103 - DNA, 19 bp, Homo sapiens
cagcaggccaaacatggcc

SEQ ID NO: 4329104 - DNA, 20 bp, Homo sapiens
cagcagggagggcttctgcc

SEQ ID NO: 4329105 - DNA, 21 bp, Homo sapiens
cagcagggctggtcacctccc

SEQ ID NO: 4329106 - DNA, 15 bp, Homo sapiens
cagcatcgaggaagg

SEQ ID NO: 4329107 - DNA, 16 bp, Homo sapiens
cagccaaagcctcctc

SEQ ID NO: 4329108 - DNA, 14 bp, Homo sapiens
cagccacaccgctg

SEQ ID NO: 4329109 - DNA, 16 bp, Homo sapiens
cagccacaccgctggc

SEQ ID NO: 4329110 - DNA, 18 bp, Homo sapiens
cagccacaccgctggctc

SEQ ID NO: 4329111 - DNA, 20 bp, Homo sapiens
cagccacaccgctggctccg

SEQ ID NO: 4329112 - DNA, 21 bp, Homo sapiens
cagccatagcttgattgctca

SEQ ID NO: 4329113 - DNA, 16 bp, Homo sapiens
cagccccaatccagag

SEQ ID NO: 4329114 - DNA, 12 bp, Homo sapiens
cagcccccacag

SEQ ID NO: 4329115 - DNA, 18 bp, Homo sapiens
cagcccccacagccctgg

SEQ ID NO: 4329116 - DNA, 19 bp, Homo sapiens
cagccccgtcccagaggcc

SEQ ID NO: 4329117 - DNA, 19 bp, Homo sapiens
cagcccctgccccagccca

SEQ ID NO: 4329118 - DNA, 23 bp, Homo sapiens
cagcccctgccccagcccaagtc

SEQ ID NO: 4329119 - DNA, 23 bp, Homo sapiens
cagccctgaaacgagaagtgccc

SEQ ID NO: 4329120 - DNA, 19 bp, Homo sapiens
cagccgctcggaggcccca

SEQ ID NO: 4329121 - DNA, 20 bp, Homo sapiens
cagccgctcggaggccccaa

SEQ ID NO: 4329122 - DNA, 21 bp, Homo sapiens
cagccgctcggaggccccaaa

SEQ ID NO: 4329123 - DNA, 12 bp, Homo sapiens
cagcctgagccg

SEQ ID NO: 4329124 - DNA, 12 bp, Homo sapiens
cagcctgctcca

SEQ ID NO: 4329125 - DNA, 20 bp, Homo sapiens
cagcctgctccagctgttca

SEQ ID NO: 4329126 - DNA, 17 bp, Homo sapiens
cagcctggacccccagc

SEQ ID NO: 4329127 - DNA, 19 bp, Homo sapiens
cagcctggaccctgtggat

SEQ ID NO: 4329128 - DNA, 18 bp, Homo sapiens
cagccttatgtgttacat

SEQ ID NO: 4329129 - DNA, 20 bp, Homo sapiens
cagccttatgtgttacatta

SEQ ID NO: 4329130 - DNA, 20 bp, Homo sapiens
cagcctttttctggccttga

SEQ ID NO: 4329131 - DNA, 23 bp, Homo sapiens
cagcctttttctggccttgactt

SEQ ID NO: 4329132 - DNA, 21 bp, Homo sapiens
cagctaccacgggtctgccat

SEQ ID NO: 4329133 - DNA, 15 bp, Homo sapiens
cagctagtgccaaat

SEQ ID NO: 4329134 - DNA, 17 bp, Homo sapiens
cagctccccctgtcccc

SEQ ID NO: 4329135 - DNA, 18 bp, Homo sapiens
cagctccccctgtcccct

SEQ ID NO: 4329136 - DNA, 19 bp, Homo sapiens
cagctccccctgtcccctc

SEQ ID NO: 4329137 - DNA, 21 bp, Homo sapiens
cagctccccctgtcccctcag

SEQ ID NO: 4329138 - DNA, 16 bp, Homo sapiens
cagctccctgaccccc

SEQ ID NO: 4329139 - DNA, 21 bp, Homo sapiens
cagctccctgaccccctgtcc

SEQ ID NO: 4329140 - DNA, 22 bp, Homo sapiens
cagctcgatccaaattgtgctt

SEQ ID NO: 4329141 - DNA, 15 bp, Homo sapiens
cagctctcctcctcc

SEQ ID NO: 4329142 - DNA, 16 bp, Homo sapiens
cagctctgcaagaatt

SEQ ID NO: 4329143 - DNA, 19 bp, Homo sapiens
cagctgacggtttctcccc

SEQ ID NO: 4329144 - DNA, 19 bp, Homo sapiens
cagctgagggtgagtgggt

SEQ ID NO: 4329145 - DNA, 20 bp, Homo sapiens
cagctgggacctaatgctgg

SEQ ID NO: 4329146 - DNA, 18 bp, Homo sapiens
cagctggtatattgtgta

SEQ ID NO: 4329147 - DNA, 20 bp, Homo sapiens
cagcttcctgtctgtttata

SEQ ID NO: 4329148 - DNA, 13 bp, Homo sapiens
cagcttgtgaatg

SEQ ID NO: 4329149 - DNA, 19 bp, Homo sapiens
cagcttgtgctgagcctgc

SEQ ID NO: 4329150 - DNA, 22 bp, Homo sapiens
cagcttgtgctgagcctgccca

SEQ ID NO: 4329151 - DNA, 15 bp, Homo sapiens
cagctttctaatgtt

SEQ ID NO: 4329152 - DNA, 17 bp, Homo sapiens
caggaagtgcttattct

SEQ ID NO: 4329153 - DNA, 21 bp, Homo sapiens
caggaatcctacgctatgtag

SEQ ID NO: 4329154 - DNA, 14 bp, Homo sapiens
caggaccttccttc

SEQ ID NO: 4329155 - DNA, 21 bp, Homo sapiens
caggagattggatttgctgtg

SEQ ID NO: 4329156 - DNA, 17 bp, Homo sapiens
caggagcaaatggcgtt

SEQ ID NO: 4329157 - DNA, 18 bp, Homo sapiens
caggagccctactgaagg

SEQ ID NO: 4329158 - DNA, 13 bp, Homo sapiens
caggagccctggc

SEQ ID NO: 4329159 - DNA, 15 bp, Homo sapiens
caggagccctggccc

SEQ ID NO: 4329160 - DNA, 17 bp, Homo sapiens
caggaggcgaataaatg

SEQ ID NO: 4329161 - DNA, 20 bp, Homo sapiens
caggaggcgaataaatgttc

SEQ ID NO: 4329162 - DNA, 15 bp, Homo sapiens
caggagtcctttctt

SEQ ID NO: 4329163 - DNA, 21 bp, Homo sapiens
caggagtttgagaccaacctg

SEQ ID NO: 4329164 - DNA, 21 bp, Homo sapiens
caggatgccctgttgggggct

SEQ ID NO: 4329165 - DNA, 20 bp, Homo sapiens
caggcagaaatagttgtctg

SEQ ID NO: 4329166 - DNA, 15 bp, Homo sapiens
caggcagctctgagc

SEQ ID NO: 4329167 - DNA, 19 bp, Homo sapiens
caggcatcactgattccct

SEQ ID NO: 4329168 - DNA, 19 bp, Homo sapiens
caggccaaacatggccaga

SEQ ID NO: 4329169 - DNA, 13 bp, Homo sapiens
caggcctccctgt

SEQ ID NO: 4329170 - DNA, 12 bp, Homo sapiens
caggcctctgcc

SEQ ID NO: 4329171 - DNA, 14 bp, Homo sapiens
caggcctctgcccc

SEQ ID NO: 4329172 - DNA, 16 bp, Homo sapiens
caggcctctgccccaa

SEQ ID NO: 4329173 - DNA, 17 bp, Homo sapiens
caggcctctgccccaag

SEQ ID NO: 4329174 - DNA, 23 bp, Homo sapiens
caggctggtatttatctgcaagg

SEQ ID NO: 4329175 - DNA, 14 bp, Homo sapiens
cagggaaatgtgta

SEQ ID NO: 4329176 - DNA, 15 bp, Homo sapiens
cagggaaatgtgtat

SEQ ID NO: 4329177 - DNA, 16 bp, Homo sapiens
ccttagcaaattctgt

SEQ ID NO: 4329178 - DNA, 19 bp, Homo sapiens
ccttatcctacagtacaat

SEQ ID NO: 4329179 - DNA, 11 bp, Homo sapiens
ccttccccagc

SEQ ID NO: 4329180 - DNA, 13 bp, Homo sapiens
ccttccccagctc

SEQ ID NO: 4329181 - DNA, 14 bp, Homo sapiens
ccttccccagctcc

SEQ ID NO: 4329182 - DNA, 20 bp, Homo sapiens
ccttcctcctctcctggaaa

SEQ ID NO: 4329183 - DNA, 13 bp, Homo sapiens
ccttcctgtcccc

SEQ ID NO: 4329184 - DNA, 19 bp, Homo sapiens
ccttctcccaggcctctgc

SEQ ID NO: 4329185 - DNA, 20 bp, Homo sapiens
ccttctcccaggcctctgcc

SEQ ID NO: 4329186 - DNA, 16 bp, Homo sapiens
ccttctcctgcccttt

SEQ ID NO: 4329187 - DNA, 18 bp, Homo sapiens
ccttctgggcatctgttc

SEQ ID NO: 4329188 - DNA, 19 bp, Homo sapiens
ccttctgggcatctgttct

SEQ ID NO: 4329189 - DNA, 22 bp, Homo sapiens
ccttctgggcatctgttctggt

SEQ ID NO: 4329190 - DNA, 22 bp, Homo sapiens
ccttgagttgattcagctctgc

SEQ ID NO: 4329191 - DNA, 13 bp, Homo sapiens
ccttgcaaactct

SEQ ID NO: 4329192 - DNA, 20 bp, Homo sapiens
ccttgcaaactctataaaga

SEQ ID NO: 4329193 - DNA, 13 bp, Homo sapiens
ccttgcccttgga

SEQ ID NO: 4329194 - DNA, 15 bp, Homo sapiens
ccttggaagtttcat

SEQ ID NO: 4329195 - DNA, 17 bp, Homo sapiens
ccttggatcagaggtca

SEQ ID NO: 4329196 - DNA, 11 bp, Homo sapiens
ccttgggcctt

SEQ ID NO: 4329197 - DNA, 16 bp, Homo sapiens
ccttgtgactcagtgt

SEQ ID NO: 4329198 - DNA, 11 bp, Homo sapiens
cctttatccta

SEQ ID NO: 4329199 - DNA, 12 bp, Homo sapiens
cctttctctgcc

SEQ ID NO: 4329200 - DNA, 13 bp, Homo sapiens
cctttctctgcct

SEQ ID NO: 4329201 - DNA, 19 bp, Homo sapiens
cctttcttgcactgtccag

SEQ ID NO: 4329202 - DNA, 19 bp, Homo sapiens
cctttcttttgaaatgcca

SEQ ID NO: 4329203 - DNA, 11 bp, Homo sapiens
cctttggcttc

SEQ ID NO: 4329204 - DNA, 14 bp, Homo sapiens
cctttgttgaaaaa

SEQ ID NO: 4329205 - DNA, 13 bp, Homo sapiens
cctttgtttcttg

SEQ ID NO: 4329206 - DNA, 14 bp, Homo sapiens
ccttttgagcctag

SEQ ID NO: 4329207 - DNA, 22 bp, Homo sapiens
ccttttgtcaacggcaaaggca

SEQ ID NO: 4329208 - DNA, 17 bp, Homo sapiens
cctttttctggccttga

SEQ ID NO: 4329209 - DNA, 13 bp, Homo sapiens
ccttttttcttcc

SEQ ID NO: 4329210 - DNA, 23 bp, Homo sapiens
cgaaaacgttgacccctttcccc

SEQ ID NO: 4329211 - DNA, 24 bp, Homo sapiens
cgaaacccggtgcatctggcacgt

SEQ ID NO: 4329212 - DNA, 13 bp, Homo sapiens
cgaagcaagaaga

SEQ ID NO: 4329213 - DNA, 12 bp, Homo sapiens
cgaataaatgtt

SEQ ID NO: 4329214 - DNA, 13 bp, Homo sapiens
cgaataaatgttc

SEQ ID NO: 4329215 - DNA, 14 bp, Homo sapiens
cgaataaatgttca

SEQ ID NO: 4329216 - DNA, 15 bp, Homo sapiens
cgaatatattactga

SEQ ID NO: 4329217 - DNA, 17 bp, Homo sapiens
cgacatcctagccccac

SEQ ID NO: 4329218 - DNA, 18 bp, Homo sapiens
cgacatcctagccccacc

SEQ ID NO: 4329219 - DNA, 17 bp, Homo sapiens
cgacccttttgagccta

SEQ ID NO: 4329220 - DNA, 17 bp, Homo sapiens
cgactgcccggcagggt

SEQ ID NO: 4329221 - DNA, 21 bp, Homo sapiens
cgactgttgtacaagctcagg

SEQ ID NO: 4329222 - DNA, 17 bp, Homo sapiens
cgactttgtacccccca

SEQ ID NO: 4329223 - DNA, 17 bp, Homo sapiens
cgagaactacgcacagc

SEQ ID NO: 4329224 - DNA, 13 bp, Homo sapiens
cgagaagtgccct

SEQ ID NO: 4329225 - DNA, 20 bp, Homo sapiens
cgagattgcaccactgcact

SEQ ID NO: 4329226 - DNA, 16 bp, Homo sapiens
cgaggaagggccgagg

SEQ ID NO: 4329227 - DNA, 15 bp, Homo sapiens
cgaggctaaccctga

SEQ ID NO: 4329228 - DNA, 24 bp, Homo sapiens
cgataaagtaacagtatgtcagat

SEQ ID NO: 4329229 - DNA, 18 bp, Homo sapiens
cgatggaggcctacctct

SEQ ID NO: 4329230 - DNA, 17 bp, Homo sapiens
cgcaacatgaattttta

SEQ ID NO: 4329231 - DNA, 23 bp, Homo sapiens
cgcacttcgggaggtcgaggcag

SEQ ID NO: 4329232 - DNA, 16 bp, Homo sapiens
cgcagccacaccgctg

SEQ ID NO: 4329233 - DNA, 21 bp, Homo sapiens
cgcagccacaccgctggctcc

SEQ ID NO: 4329234 - DNA, 13 bp, Homo sapiens
cgccaaggctggg

SEQ ID NO: 4329235 - DNA, 15 bp, Homo sapiens
cgccatgctcctggc

SEQ ID NO: 4329236 - DNA, 14 bp, Homo sapiens
cgccccctgaaaca

SEQ ID NO: 4329237 - DNA, 22 bp, Homo sapiens
cgccccctgaaacatgtgcccc

SEQ ID NO: 4329238 - DNA, 19 bp, Homo sapiens
cgcctgttcccccgccgct

SEQ ID NO: 4329239 - DNA, 22 bp, Homo sapiens
cgcgaaacccggtgcatctggc

SEQ ID NO: 4329240 - DNA, 21 bp, Homo sapiens
cgctacggggaaaatgcattt

SEQ ID NO: 4329241 - DNA, 24 bp, Homo sapiens
cgctcatctggcttttcgcttgct

SEQ ID NO: 4329242 - DNA, 14 bp, Homo sapiens
cgctccccgcctgt

SEQ ID NO: 4329243 - DNA, 16 bp, Homo sapiens
cgctccccgcctgttc

SEQ ID NO: 4329244 - DNA, 17 bp, Homo sapiens
cgctccccgcctgttcc

SEQ ID NO: 4329245 - DNA, 18 bp, Homo sapiens
cgctccccgcctgttccc

SEQ ID NO: 4329246 - DNA, 12 bp, Homo sapiens
cgctcggaggcc

SEQ ID NO: 4329247 - DNA, 13 bp, Homo sapiens
cgctgccgggaga

SEQ ID NO: 4329248 - DNA, 20 bp, Homo sapiens
cgctgttgatcccctctctg

SEQ ID NO: 4329249 - DNA, 13 bp, Homo sapiens
cgcttgcttctgc

SEQ ID NO: 4329250 - DNA, 16 bp, Homo sapiens
cgcttgcttctgcagc

SEQ ID NO: 4329251 - DNA, 15 bp, Homo sapiens
cgctttcccctcctc

SEQ ID NO: 4329252 - DNA, 15 bp, Homo sapiens
cggagacccacagcc

SEQ ID NO: 4329253 - DNA, 16 bp, Homo sapiens
cggagacccacagccc

SEQ ID NO: 4329254 - DNA, 17 bp, Homo sapiens
cggaggtggagtggcca

SEQ ID NO: 4329255 - DNA, 21 bp, Homo sapiens
cggaggtggagtggccactgg

SEQ ID NO: 4329256 - DNA, 15 bp, Homo sapiens
cggcctttggcttca

SEQ ID NO: 4329257 - DNA, 17 bp, Homo sapiens
cggcggggtgcctgctg

SEQ ID NO: 4329258 - DNA, 18 bp, Homo sapiens
cggcggggtgcctgctgt

SEQ ID NO: 4329259 - DNA, 14 bp, Homo sapiens
cggctggcagccca

SEQ ID NO: 4329260 - DNA, 23 bp, Homo sapiens
cggctggcagcccacccctcaac

SEQ ID NO: 4329261 - DNA, 13 bp, Homo sapiens
cggctgtgggtgg

SEQ ID NO: 4329262 - DNA, 22 bp, Homo sapiens
cgggaaaaaactttgctccagg

SEQ ID NO: 4329263 - DNA, 21 bp, Homo sapiens
cgggactgggggcggggcctg

SEQ ID NO: 4329264 - DNA, 14 bp, Homo sapiens
cgggagactgccag

SEQ ID NO: 4329265 - DNA, 20 bp, Homo sapiens
cgggagcattggcccctgag

SEQ ID NO: 4329266 - DNA, 16 bp, Homo sapiens
cgggaggtcgaggcag

SEQ ID NO: 4329267 - DNA, 23 bp, Homo sapiens
cgggatggagacacggggcagga

SEQ ID NO: 4329268 - DNA, 16 bp, Homo sapiens
cggggccgcagccaca

SEQ ID NO: 4329269 - DNA, 17 bp, Homo sapiens
cggggccgcagccacac

SEQ ID NO: 4329270 - DNA, 15 bp, Homo sapiens
cggggtgcctgctgt

SEQ ID NO: 4329271 - DNA, 15 bp, Homo sapiens
cgggtgatgagacct

SEQ ID NO: 4329272 - DNA, 17 bp, Homo sapiens
cgggtgatgagacctgg

SEQ ID NO: 4329273 - DNA, 18 bp, Homo sapiens
cggtgcagggcctggcat

SEQ ID NO: 4329274 - DNA, 14 bp, Homo sapiens
cggtgcatctggca

SEQ ID NO: 4329275 - DNA, 15 bp, Homo sapiens
cggtgcatctggcac

SEQ ID NO: 4329276 - DNA, 13 bp, Homo sapiens
cggtgtggagaag

SEQ ID NO: 4329277 - DNA, 18 bp, Homo sapiens
cggtgtggagaagcggct

SEQ ID NO: 4329278 - DNA, 21 bp, Homo sapiens
cgtaatgcttagagaatgttc

SEQ ID NO: 4329279 - DNA, 13 bp, Homo sapiens
cgtactccactgg

SEQ ID NO: 4329280 - DNA, 14 bp, Homo sapiens
cgtaggggaggggt

SEQ ID NO: 4329281 - DNA, 13 bp, Homo sapiens
cgtataatgcttt

SEQ ID NO: 4329282 - DNA, 16 bp, Homo sapiens
cgtataatgctttctg

SEQ ID NO: 4329283 - DNA, 18 bp, Homo sapiens
cgtcatgctgtccgtgct

SEQ ID NO: 4329284 - DNA, 22 bp, Homo sapiens
cgtcatgctgtccgtgcttgct

SEQ ID NO: 4329285 - DNA, 18 bp, Homo sapiens
cgtctggaggggcccctg

SEQ ID NO: 4329286 - DNA, 21 bp, Homo sapiens
cgtgagacgccaccattcctg

SEQ ID NO: 4329287 - DNA, 23 bp, Homo sapiens
cgtgcatttaaactctgccagaa

SEQ ID NO: 4329288 - DNA, 15 bp, Homo sapiens
cgtgcgtgtgagtgt

SEQ ID NO: 4329289 - DNA, 17 bp, Homo sapiens
cgtggtttttatgtgta

SEQ ID NO: 4329290 - DNA, 20 bp, Homo sapiens
cgtgtaaccatggacccaat

SEQ ID NO: 4329291 - DNA, 15 bp, Homo sapiens
cgttgacccctttcc

SEQ ID NO: 4329292 - DNA, 11 bp, Homo sapiens
cgttgttgtca

SEQ ID NO: 4329293 - DNA, 14 bp, Homo sapiens
cgttgttgtcattg

SEQ ID NO: 4329294 - DNA, 14 bp, Homo sapiens
cgtttcatgtgttt

SEQ ID NO: 4329295 - DNA, 13 bp, Homo sapiens
cgtttctgcccag

SEQ ID NO: 4329296 - DNA, 15 bp, Homo sapiens
cgtttggttaaagta

SEQ ID NO: 4329297 - DNA, 14 bp, Homo sapiens
cgttttgtattgct

SEQ ID NO: 4329298 - DNA, 18 bp, Homo sapiens
ctaaagaaactgcttaca

SEQ ID NO: 4329299 - DNA, 23 bp, Homo sapiens
ccaggaagtgcttattctctcat

SEQ ID NO: 4329300 - DNA, 22 bp, Homo sapiens
ccaggagattggatttgctgtg

SEQ ID NO: 4329301 - DNA, 12 bp, Homo sapiens
ccaggagccctg

SEQ ID NO: 4329302 - DNA, 13 bp, Homo sapiens
ccaggagccctgg

SEQ ID NO: 4329303 - DNA, 17 bp, Homo sapiens
ccaggagccctggcccg

SEQ ID NO: 4329304 - DNA, 20 bp, Homo sapiens
ccaggcagaaatagttgtct

SEQ ID NO: 4329305 - DNA, 23 bp, Homo sapiens
ccaggcagaaatagttgtctgtg

SEQ ID NO: 4329306 - DNA, 22 bp, Homo sapiens
ccaggcatcactgattccctct

SEQ ID NO: 4329307 - DNA, 13 bp, Homo sapiens
ccaggcctctgcc

SEQ ID NO: 4329308 - DNA, 21 bp, Homo sapiens
ccaggcctctgccccaagagc

SEQ ID NO: 4329309 - DNA, 14 bp, Homo sapiens
ccagggagaggcct

SEQ ID NO: 4329310 - DNA, 15 bp, Homo sapiens
ccagggagattttga

SEQ ID NO: 4329311 - DNA, 11 bp, Homo sapiens
ccagggcactg

SEQ ID NO: 4329312 - DNA, 17 bp, Homo sapiens
ccaggggaggtgtattg

SEQ ID NO: 4329313 - DNA, 22 bp, Homo sapiens
ccagtcccaatggtcctgactt

SEQ ID NO: 4329314 - DNA, 15 bp, Homo sapiens
ccagtcccccaaccc

SEQ ID NO: 4329315 - DNA, 21 bp, Homo sapiens
ccagtgcccggtgcagggcct

SEQ ID NO: 4329316 - DNA, 19 bp, Homo sapiens
ccagtgctaagctgccctg

SEQ ID NO: 4329317 - DNA, 14 bp, Homo sapiens
ccagtgctcctggc

SEQ ID NO: 4329318 - DNA, 17 bp, Homo sapiens
ccagtgctcctggccct

SEQ ID NO: 4329319 - DNA, 21 bp, Homo sapiens
ccagtgctgtccatgcttctc

SEQ ID NO: 4329320 - DNA, 15 bp, Homo sapiens
ccagttttgtttagt

SEQ ID NO: 4329321 - DNA, 15 bp, Homo sapiens
ccataccttctccca

SEQ ID NO: 4329322 - DNA, 20 bp, Homo sapiens
ccataccttctcccaggcct

SEQ ID NO: 4329323 - DNA, 15 bp, Homo sapiens
ccatatatgctgtat

SEQ ID NO: 4329324 - DNA, 18 bp, Homo sapiens
ccatatatgctgtatttc

SEQ ID NO: 4329325 - DNA, 21 bp, Homo sapiens
ccatatatgctgtatttcttt

SEQ ID NO: 4329326 - DNA, 23 bp, Homo sapiens
ccatatatgctgtatttctttgt

SEQ ID NO: 4329327 - DNA, 22 bp, Homo sapiens
ccatcccctgtagagtgggagc

SEQ ID NO: 4329328 - DNA, 22 bp, Homo sapiens
ccatgaagctggccctcagctc

SEQ ID NO: 4329329 - DNA, 23 bp, Homo sapiens
ccatgatacctattaaaggaaaa

SEQ ID NO: 4329330 - DNA, 15 bp, Homo sapiens
ccatgctcctggccc

SEQ ID NO: 4329331 - DNA, 22 bp, Homo sapiens
ccatgcttctcatcttgtgaaa

SEQ ID NO: 4329332 - DNA, 20 bp, Homo sapiens
ccatggtacccccttctggg

SEQ ID NO: 4329333 - DNA, 20 bp, Homo sapiens
ccatgtatgtggtatgtata

SEQ ID NO: 4329334 - DNA, 15 bp, Homo sapiens
ccattaaatgaatat

SEQ ID NO: 4329335 - DNA, 16 bp, Homo sapiens
ccattaaatgaatatt

SEQ ID NO: 4329336 - DNA, 17 bp, Homo sapiens
ccattaaatgaatattt

SEQ ID NO: 4329337 - DNA, 16 bp, Homo sapiens
ccattacgtgcattta

SEQ ID NO: 4329338 - DNA, 22 bp, Homo sapiens
ccattcttggtcaagtttttct

SEQ ID NO: 4329339 - DNA, 14 bp, Homo sapiens
ccattgacatttga

SEQ ID NO: 4329340 - DNA, 15 bp, Homo sapiens
ccattgatttttaac

SEQ ID NO: 4329341 - DNA, 15 bp, Homo sapiens
ccattgtcttgttct

SEQ ID NO: 4329342 - DNA, 20 bp, Homo sapiens
cccaaaatctgattagaagt

SEQ ID NO: 4329343 - DNA, 17 bp, Homo sapiens
cccaaaggaaaaagcac

SEQ ID NO: 4329344 - DNA, 20 bp, Homo sapiens
cccaacaccagcccctgccc

SEQ ID NO: 4329345 - DNA, 17 bp, Homo sapiens
cccaacagtttattttt

SEQ ID NO: 4329346 - DNA, 16 bp, Homo sapiens
cccaacccctgaggaa

SEQ ID NO: 4329347 - DNA, 21 bp, Homo sapiens
cccaactcaagtgtcacctcc

SEQ ID NO: 4329348 - DNA, 22 bp, Homo sapiens
cccaactcaagtgtcacctcct

SEQ ID NO: 4329349 - DNA, 19 bp, Homo sapiens
cccaacttgccaaaatgtt

SEQ ID NO: 4329350 - DNA, 19 bp, Homo sapiens
cccaagatggagaggaaga

SEQ ID NO: 4329351 - DNA, 16 bp, Homo sapiens
cccaagctagactgtg

SEQ ID NO: 4329352 - DNA, 19 bp, Homo sapiens
cccaaggctgcgtctggag

SEQ ID NO: 4329353 - DNA, 17 bp, Homo sapiens
cccaagtcattcctaat

SEQ ID NO: 4329354 - DNA, 20 bp, Homo sapiens
cccaagtccaaatgtttaca

SEQ ID NO: 4329355 - DNA, 18 bp, Homo sapiens
cccaatggagaaatgaag

SEQ ID NO: 4329356 - DNA, 22 bp, Homo sapiens
cccacaagccttactcacctct

SEQ ID NO: 4329357 - DNA, 13 bp, Homo sapiens
cccacagccctga

SEQ ID NO: 4329358 - DNA, 15 bp, Homo sapiens
cccacagccctgaaa

SEQ ID NO: 4329359 - DNA, 15 bp, Homo sapiens
cccacagccctggaa

SEQ ID NO: 4329360 - DNA, 18 bp, Homo sapiens
cccaccctgaaagccctg

SEQ ID NO: 4329361 - DNA, 16 bp, Homo sapiens
cccactcagcagtgag

SEQ ID NO: 4329362 - DNA, 20 bp, Homo sapiens
cccagaaaaaaaaaaactta

SEQ ID NO: 4329363 - DNA, 21 bp, Homo sapiens
cccagagcccctcatgccaca

SEQ ID NO: 4329364 - DNA, 21 bp, Homo sapiens
cccagaggccgctgcccctga

SEQ ID NO: 4329365 - DNA, 14 bp, Homo sapiens
cccagaggtggccc

SEQ ID NO: 4329366 - DNA, 18 bp, Homo sapiens
cccagaggtggccctccc

SEQ ID NO: 4329367 - DNA, 20 bp, Homo sapiens
cccagaggtggccctcccag

SEQ ID NO: 4329368 - DNA, 23 bp, Homo sapiens
ccctgcttctccagcctggaccc

SEQ ID NO: 4329369 - DNA, 23 bp, Homo sapiens
ccctggcccgcaagagggacaga

SEQ ID NO: 4329370 - DNA, 23 bp, Homo sapiens
ccctgggatggacgctgccggga

SEQ ID NO: 4329371 - DNA, 15 bp, Homo sapiens
ccctggtgcccttcc

SEQ ID NO: 4329372 - DNA, 21 bp, Homo sapiens
ccctgtagagtgggagctgag

SEQ ID NO: 4329373 - DNA, 13 bp, Homo sapiens
ccctgtcccctca

SEQ ID NO: 4329374 - DNA, 15 bp, Homo sapiens
ccctgtctctgcatc

SEQ ID NO: 4329375 - DNA, 17 bp, Homo sapiens
ccctgtctctgcatctg

SEQ ID NO: 4329376 - DNA, 19 bp, Homo sapiens
ccctgtgtatacagccctg

SEQ ID NO: 4329377 - DNA, 19 bp, Homo sapiens
ccctgttgggggcttcagg

SEQ ID NO: 4329378 - DNA, 21 bp, Homo sapiens
cccttaaggatcaccccagcc

SEQ ID NO: 4329379 - DNA, 16 bp, Homo sapiens
cccttccccctttctc

SEQ ID NO: 4329380 - DNA, 12 bp, Homo sapiens
cccttctgccct

SEQ ID NO: 4329381 - DNA, 15 bp, Homo sapiens
cccttggatcagagg

SEQ ID NO: 4329382 - DNA, 19 bp, Homo sapiens
ccctttaggatgttttcct

SEQ ID NO: 4329383 - DNA, 13 bp, Homo sapiens
ccctttctctgcc

SEQ ID NO: 4329384 - DNA, 17 bp, Homo sapiens
ccctttctctgcctggc

SEQ ID NO: 4329385 - DNA, 19 bp, Homo sapiens
ccctttcttgcactgtcca

SEQ ID NO: 4329386 - DNA, 19 bp, Homo sapiens
ccctttgtttcttgtttat

SEQ ID NO: 4329387 - DNA, 22 bp, Homo sapiens
ccgactttgtaccccccaaccc

SEQ ID NO: 4329388 - DNA, 19 bp, Homo sapiens
ccgaggaatgtgaagccag

SEQ ID NO: 4329389 - DNA, 14 bp, Homo sapiens
ccgaggagccccag

SEQ ID NO: 4329390 - DNA, 19 bp, Homo sapiens
ccgcaagagggacagagcc

SEQ ID NO: 4329391 - DNA, 20 bp, Homo sapiens
ccgcaagagggacagagccc

SEQ ID NO: 4329392 - DNA, 21 bp, Homo sapiens
ccgcaagagggacagagcccg

SEQ ID NO: 4329393 - DNA, 17 bp, Homo sapiens
ccgccaaggctggggga

SEQ ID NO: 4329394 - DNA, 14 bp, Homo sapiens
ccgccaccctgtct

SEQ ID NO: 4329395 - DNA, 16 bp, Homo sapiens
ccgccctccacccact

SEQ ID NO: 4329396 - DNA, 19 bp, Homo sapiens
ccgccgactttgtaccccc

SEQ ID NO: 4329397 - DNA, 18 bp, Homo sapiens
ccgccgcttttctcctct

SEQ ID NO: 4329398 - DNA, 17 bp, Homo sapiens
ccgcctcccgccaccct

SEQ ID NO: 4329399 - DNA, 23 bp, Homo sapiens
ccgctcggaggccccaaaggaaa

SEQ ID NO: 4329400 - DNA, 12 bp, Homo sapiens
ccgctgcccctg

SEQ ID NO: 4329401 - DNA, 13 bp, Homo sapiens
ccgctgcccctga

SEQ ID NO: 4329402 - DNA, 15 bp, Homo sapiens
ccgctgcccctgagt

SEQ ID NO: 4329403 - DNA, 21 bp, Homo sapiens
ccggaagaaccagaagtgcag

SEQ ID NO: 4329404 - DNA, 18 bp, Homo sapiens
ccggcagggtcctagaaa

SEQ ID NO: 4329405 - DNA, 12 bp, Homo sapiens
ccgggactgggg

SEQ ID NO: 4329406 - DNA, 20 bp, Homo sapiens
ccgggagactgccagtggag

SEQ ID NO: 4329407 - DNA, 17 bp, Homo sapiens
ccgggtttggctgagcc

SEQ ID NO: 4329408 - DNA, 16 bp, Homo sapiens
ccggtgcatctggcac

SEQ ID NO: 4329409 - DNA, 20 bp, Homo sapiens
ccgtaagaccaccttccctt

SEQ ID NO: 4329410 - DNA, 22 bp, Homo sapiens
ccgtaagaccaccttcccttcc

SEQ ID NO: 4329411 - DNA, 23 bp, Homo sapiens
ccgtcccagaggccgctgcccct

SEQ ID NO: 4329412 - DNA, 12 bp, Homo sapiens
ccgtgcttgctg

SEQ ID NO: 4329413 - DNA, 18 bp, Homo sapiens
ccgtgcttgctggtgcct

SEQ ID NO: 4329414 - DNA, 14 bp, Homo sapiens
ccgtgtgtgcatgt

SEQ ID NO: 4329415 - DNA, 16 bp, Homo sapiens
ccgttgggtcccttgc

SEQ ID NO: 4329416 - DNA, 13 bp, Homo sapiens
ccgttgtgcctgg

SEQ ID NO: 4329417 - DNA, 11 bp, Homo sapiens
cctaaactgta

SEQ ID NO: 4329418 - DNA, 21 bp, Homo sapiens
cctaaagcagtaaaataaaaa

SEQ ID NO: 4329419 - DNA, 15 bp, Homo sapiens
cctaatcatgtttct

SEQ ID NO: 4329420 - DNA, 21 bp, Homo sapiens
cctacagttgaaaaacagctg

SEQ ID NO: 4329421 - DNA, 23 bp, Homo sapiens
cctagaggacactaggagactgg

SEQ ID NO: 4329422 - DNA, 22 bp, Homo sapiens
gccgcagccacaccgctggctc

SEQ ID NO: 4329423 - DNA, 16 bp, Homo sapiens
gccgccatgctcctgg

SEQ ID NO: 4329424 - DNA, 15 bp, Homo sapiens
gccgctcggaggccc

SEQ ID NO: 4329425 - DNA, 22 bp, Homo sapiens
gccgctcggaggccccaaagga

SEQ ID NO: 4329426 - DNA, 18 bp, Homo sapiens
gccgctgcccctgagttc

SEQ ID NO: 4329427 - DNA, 17 bp, Homo sapiens
gccgctttgtctgtcca

SEQ ID NO: 4329428 - DNA, 16 bp, Homo sapiens
gccgcttttctcctct

SEQ ID NO: 4329429 - DNA, 16 bp, Homo sapiens
gccggagacccacagc

SEQ ID NO: 4329430 - DNA, 16 bp, Homo sapiens
gccgtcctggactctg

SEQ ID NO: 4329431 - DNA, 13 bp, Homo sapiens
gccgtgcccttgc

SEQ ID NO: 4329432 - DNA, 17 bp, Homo sapiens
gccgtgtgtgcatgtgc

SEQ ID NO: 4329433 - DNA, 20 bp, Homo sapiens
gcctatgtgcgaagcaagaa

SEQ ID NO: 4329434 - DNA, 17 bp, Homo sapiens
gcctccaacccagcagt

SEQ ID NO: 4329435 - DNA, 14 bp, Homo sapiens
gcctcccacgactg

SEQ ID NO: 4329436 - DNA, 13 bp, Homo sapiens
gcctcccgccacc

SEQ ID NO: 4329437 - DNA, 19 bp, Homo sapiens
gcctcccgccaccctgtct

SEQ ID NO: 4329438 - DNA, 20 bp, Homo sapiens
gcctcctgcccagtccccca

SEQ ID NO: 4329439 - DNA, 19 bp, Homo sapiens
gcctcggctgtctcctgtc

SEQ ID NO: 4329440 - DNA, 22 bp, Homo sapiens
gcctctgttttgtaaactaagg

SEQ ID NO: 4329441 - DNA, 16 bp, Homo sapiens
gcctgaaagctgggag

SEQ ID NO: 4329442 - DNA, 21 bp, Homo sapiens
gcctgaaagctgggagcgtgg

SEQ ID NO: 4329443 - DNA, 19 bp, Homo sapiens
gcctgactggttgtcagaa

SEQ ID NO: 4329444 - DNA, 22 bp, Homo sapiens
gcctgcaggtccggggaggagg

SEQ ID NO: 4329445 - DNA, 23 bp, Homo sapiens
gcctgcaggtccggggaggaggt

SEQ ID NO: 4329446 - DNA, 16 bp, Homo sapiens
gcctgcctcttctcta

SEQ ID NO: 4329447 - DNA, 21 bp, Homo sapiens
gcctgctgcttggagtgcccc

SEQ ID NO: 4329448 - DNA, 17 bp, Homo sapiens
gcctgctgggtgccagg

SEQ ID NO: 4329449 - DNA, 20 bp, Homo sapiens
gcctgctgggtgccaggtgc

SEQ ID NO: 4329450 - DNA, 15 bp, Homo sapiens
gcctggacccccagc

SEQ ID NO: 4329451 - DNA, 22 bp, Homo sapiens
gcctggcaacatcttacttgtc

SEQ ID NO: 4329452 - DNA, 15 bp, Homo sapiens
gcctggcgggatggg

SEQ ID NO: 4329453 - DNA, 22 bp, Homo sapiens
gcctggcgggatgggccaccgc

SEQ ID NO: 4329454 - DNA, 21 bp, Homo sapiens
gcctgggaggtcaaggctgca

SEQ ID NO: 4329455 - DNA, 17 bp, Homo sapiens
gcctggttcgtgccatg

SEQ ID NO: 4329456 - DNA, 19 bp, Homo sapiens
gcctgtagatcagggatag

SEQ ID NO: 4329457 - DNA, 14 bp, Homo sapiens
gcctgttcccccgc

SEQ ID NO: 4329458 - DNA, 16 bp, Homo sapiens
gccttatgtgttacat

SEQ ID NO: 4329459 - DNA, 19 bp, Homo sapiens
gccttatgtgttacattat

SEQ ID NO: 4329460 - DNA, 17 bp, Homo sapiens
gccttgctgcataaaat

SEQ ID NO: 4329461 - DNA, 13 bp, Homo sapiens
gcctttggcttca

SEQ ID NO: 4329462 - DNA, 14 bp, Homo sapiens
gccttttaagtttg

SEQ ID NO: 4329463 - DNA, 16 bp, Homo sapiens
gcctttttctggcctt

SEQ ID NO: 4329464 - DNA, 19 bp, Homo sapiens
gcgaagcaagaagaattga

SEQ ID NO: 4329465 - DNA, 17 bp, Homo sapiens
gcgaataaatgttcaaa

SEQ ID NO: 4329466 - DNA, 20 bp, Homo sapiens
gcgcacttacctgcttgagc

SEQ ID NO: 4329467 - DNA, 17 bp, Homo sapiens
gcgctgggtattggaaa

SEQ ID NO: 4329468 - DNA, 18 bp, Homo sapiens
gcgctgttgcccgccctc

SEQ ID NO: 4329469 - DNA, 13 bp, Homo sapiens
gcggctgccgggc

SEQ ID NO: 4329470 - DNA, 16 bp, Homo sapiens
gcgggacatgatgcta

SEQ ID NO: 4329471 - DNA, 14 bp, Homo sapiens
gcgggactgggggc

SEQ ID NO: 4329472 - DNA, 13 bp, Homo sapiens
gcggggcagagcc

SEQ ID NO: 4329473 - DNA, 14 bp, Homo sapiens
gcggggcagagcca

SEQ ID NO: 4329474 - DNA, 15 bp, Homo sapiens
gcgggtgatgagacc

SEQ ID NO: 4329475 - DNA, 19 bp, Homo sapiens
gcgtcccccgttgtgcctg

SEQ ID NO: 4329476 - DNA, 17 bp, Homo sapiens
gcgtctggaggggcccc

SEQ ID NO: 4329477 - DNA, 18 bp, Homo sapiens
gcgtctggaggggcccct

SEQ ID NO: 4329478 - DNA, 20 bp, Homo sapiens
gcgtctggaggggcccctgc

SEQ ID NO: 4329479 - DNA, 21 bp, Homo sapiens
gcgtctggaggggcccctgct

SEQ ID NO: 4329480 - DNA, 19 bp, Homo sapiens
gcgtgactattttttaata

SEQ ID NO: 4329481 - DNA, 15 bp, Homo sapiens
gcgtgagacgccacc

SEQ ID NO: 4329482 - DNA, 19 bp, Homo sapiens
gctaaagaaactgcttaca

SEQ ID NO: 4329483 - DNA, 13 bp, Homo sapiens
gctaaatgtgaat

SEQ ID NO: 4329484 - DNA, 20 bp, Homo sapiens
gctaccacgggtctgccatg

SEQ ID NO: 4329485 - DNA, 20 bp, Homo sapiens
gctacccttttcctttgtgg

SEQ ID NO: 4329486 - DNA, 13 bp, Homo sapiens
gctacctttttat

SEQ ID NO: 4329487 - DNA, 15 bp, Homo sapiens
gctacctttttatat

SEQ ID NO: 4329488 - DNA, 22 bp, Homo sapiens
gctacggggaaaatgcattttc

SEQ ID NO: 4329489 - DNA, 22 bp, Homo sapiens
gctactgtctacgttaagataa

SEQ ID NO: 4329490 - DNA, 13 bp, Homo sapiens
gctaggaaagagg

SEQ ID NO: 4329491 - DNA, 13 bp, Homo sapiens
gctagtgccaaat

SEQ ID NO: 4329492 - DNA, 17 bp, Homo sapiens
gctatatttttaaagaa

SEQ ID NO: 4329493 - DNA, 21 bp, Homo sapiens
gctatatttttaaagaaggag

SEQ ID NO: 4329494 - DNA, 17 bp, Homo sapiens
gctatcagggaggaaga

SEQ ID NO: 4329495 - DNA, 18 bp, Homo sapiens
gctatcagggaggaagat

SEQ ID NO: 4329496 - DNA, 13 bp, Homo sapiens
gctatcctgctga

SEQ ID NO: 4329497 - DNA, 15 bp, Homo sapiens
gctatcctgctgaaa

SEQ ID NO: 4329498 - DNA, 17 bp, Homo sapiens
gctatcctgctgaaagt

SEQ ID NO: 4329499 - DNA, 17 bp, Homo sapiens
gctatctatacctgcct

SEQ ID NO: 4329500 - DNA, 18 bp, Homo sapiens
gctatgctaaacctcctg

SEQ ID NO: 4329501 - DNA, 12 bp, Homo sapiens
gctatgtagaat

SEQ ID NO: 4329502 - DNA, 16 bp, Homo sapiens
gctattaaaatgtaac

SEQ ID NO: 4329503 - DNA, 17 bp, Homo sapiens
gctattttttttaaatc

SEQ ID NO: 4329504 - DNA, 20 bp, Homo sapiens
gctcagcaaaagatgcttct

SEQ ID NO: 4329505 - DNA, 12 bp, Homo sapiens
gctcagcagggc

SEQ ID NO: 4329506 - DNA, 17 bp, Homo sapiens
gctcagccacagcctga

SEQ ID NO: 4329507 - DNA, 18 bp, Homo sapiens
gctcagccacagcctgac

SEQ ID NO: 4329508 - DNA, 19 bp, Homo sapiens
gctcaggaggcgaataaat

SEQ ID NO: 4329509 - DNA, 20 bp, Homo sapiens
gctcaggaggcgaataaatg

SEQ ID NO: 4329510 - DNA, 21 bp, Homo sapiens
gctcaggaggcgaataaatgt

SEQ ID NO: 4329511 - DNA, 13 bp, Homo sapiens
gctcaggagtttg

SEQ ID NO: 4329512 - DNA, 21 bp, Homo sapiens
gctccaacccgttgggtccct

SEQ ID NO: 4329513 - DNA, 11 bp, Homo sapiens
gctccagctgt

SEQ ID NO: 4329514 - DNA, 17 bp, Homo sapiens
gctccaggcatcactga

SEQ ID NO: 4329515 - DNA, 18 bp, Homo sapiens
gctccagggagattttga

SEQ ID NO: 4329516 - DNA, 14 bp, Homo sapiens
gctcccaaaagaat

SEQ ID NO: 4329517 - DNA, 20 bp, Homo sapiens
gctcccacacccacctctgc

SEQ ID NO: 4329518 - DNA, 13 bp, Homo sapiens
gctcccccaggca

SEQ ID NO: 4329519 - DNA, 18 bp, Homo sapiens
gctccccctgtcccctca

SEQ ID NO: 4329520 - DNA, 17 bp, Homo sapiens
gctccccgcctgttccc

SEQ ID NO: 4329521 - DNA, 13 bp, Homo sapiens
gctccctgacccc

SEQ ID NO: 4329522 - DNA, 14 bp, Homo sapiens
gctccctgaccccc

SEQ ID NO: 4329523 - DNA, 14 bp, Homo sapiens
gctcctagagagga

SEQ ID NO: 4329524 - DNA, 20 bp, Homo sapiens
gctcctggcccactgcatcg

SEQ ID NO: 4329525 - DNA, 14 bp, Homo sapiens
gctcggaggcccca

SEQ ID NO: 4329526 - DNA, 21 bp, Homo sapiens
cagtgctaagctgccctgagg

SEQ ID NO: 4329527 - DNA, 22 bp, Homo sapiens
cagtgtatatttttggtggtgg

SEQ ID NO: 4329528 - DNA, 17 bp, Homo sapiens
cagtgttgacatagcct

SEQ ID NO: 4329529 - DNA, 20 bp, Homo sapiens
cagtgttgacatagcctttg

SEQ ID NO: 4329530 - DNA, 23 bp, Homo sapiens
cagtgttgacatagcctttgtgc

SEQ ID NO: 4329531 - DNA, 21 bp, Homo sapiens
cagttccacggttgctaaatt

SEQ ID NO: 4329532 - DNA, 19 bp, Homo sapiens
cagttgaaaaacagctgag

SEQ ID NO: 4329533 - DNA, 16 bp, Homo sapiens
cagttgcagaaaatga

SEQ ID NO: 4329534 - DNA, 19 bp, Homo sapiens
cagttggcccttctgccct

SEQ ID NO: 4329535 - DNA, 18 bp, Homo sapiens
cagtttattttctgtgta

SEQ ID NO: 4329536 - DNA, 22 bp, Homo sapiens
cagtttattttctgtgtaaaat

SEQ ID NO: 4329537 - DNA, 23 bp, Homo sapiens
cataaaattgcagtttcatgtat

SEQ ID NO: 4329538 - DNA, 18 bp, Homo sapiens
cataaacaatgatgccct

SEQ ID NO: 4329539 - DNA, 14 bp, Homo sapiens
cataaatgaaagaa

SEQ ID NO: 4329540 - DNA, 15 bp, Homo sapiens
cataaatgaaagaaa

SEQ ID NO: 4329541 - DNA, 14 bp, Homo sapiens
cataatactaattt

SEQ ID NO: 4329542 - DNA, 18 bp, Homo sapiens
cataatactaatttattg

SEQ ID NO: 4329543 - DNA, 23 bp, Homo sapiens
catacacaaggccagaaaaagaa

SEQ ID NO: 4329544 - DNA, 21 bp, Homo sapiens
catacagctattaaaatgtaa

SEQ ID NO: 4329545 - DNA, 15 bp, Homo sapiens
catacatacatacaa

SEQ ID NO: 4329546 - DNA, 22 bp, Homo sapiens
cataccactttgacacgcttca

SEQ ID NO: 4329547 - DNA, 16 bp, Homo sapiens
cataccccagaaatta

SEQ ID NO: 4329548 - DNA, 12 bp, Homo sapiens
cataccttctcc

SEQ ID NO: 4329549 - DNA, 13 bp, Homo sapiens
cataccttctccc

SEQ ID NO: 4329550 - DNA, 17 bp, Homo sapiens
cataccttctcccaggc

SEQ ID NO: 4329551 - DNA, 18 bp, Homo sapiens
cataccttctcccaggcc

SEQ ID NO: 4329552 - DNA, 13 bp, Homo sapiens
catacttctttca

SEQ ID NO: 4329553 - DNA, 15 bp, Homo sapiens
catagaaacatacac

SEQ ID NO: 4329554 - DNA, 22 bp, Homo sapiens
catagagaatacacatataaaa

SEQ ID NO: 4329555 - DNA, 19 bp, Homo sapiens
catagtataaatctatgat

SEQ ID NO: 4329556 - DNA, 22 bp, Homo sapiens
catagtgctacctgcacctctg

SEQ ID NO: 4329557 - DNA, 20 bp, Homo sapiens
catataaaaacaatatattt

SEQ ID NO: 4329558 - DNA, 14 bp, Homo sapiens
catatatgctgtat

SEQ ID NO: 4329559 - DNA, 20 bp, Homo sapiens
catatatgctgtatttcttt

SEQ ID NO: 4329560 - DNA, 17 bp, Homo sapiens
catatatgcttccagaa

SEQ ID NO: 4329561 - DNA, 19 bp, Homo sapiens
catatgaccattgaaaaag

SEQ ID NO: 4329562 - DNA, 22 bp, Homo sapiens
catatgaccattgaaaaaggaa

SEQ ID NO: 4329563 - DNA, 14 bp, Homo sapiens
catatgtgaagaca

SEQ ID NO: 4329564 - DNA, 21 bp, Homo sapiens
catatgtgaagacagagcaga

SEQ ID NO: 4329565 - DNA, 18 bp, Homo sapiens
catatgttaaagcttatt

SEQ ID NO: 4329566 - DNA, 19 bp, Homo sapiens
catattgagaataattatt

SEQ ID NO: 4329567 - DNA, 18 bp, Homo sapiens
catcacagtgggaagaat

SEQ ID NO: 4329568 - DNA, 17 bp, Homo sapiens
catcactgattccctct

SEQ ID NO: 4329569 - DNA, 20 bp, Homo sapiens
catcactgattccctctccc

SEQ ID NO: 4329570 - DNA, 21 bp, Homo sapiens
catcactgattccctctccca

SEQ ID NO: 4329571 - DNA, 15 bp, Homo sapiens
catcagcttaattta

SEQ ID NO: 4329572 - DNA, 16 bp, Homo sapiens
catccacttcaggagc

SEQ ID NO: 4329573 - DNA, 17 bp, Homo sapiens
catccacttcaggagcc

SEQ ID NO: 4329574 - DNA, 20 bp, Homo sapiens
catccacttcaggagcccta

SEQ ID NO: 4329575 - DNA, 23 bp, Homo sapiens
catcccgtaagaccaccttccct

SEQ ID NO: 4329576 - DNA, 14 bp, Homo sapiens
catcccttcctcct

SEQ ID NO: 4329577 - DNA, 22 bp, Homo sapiens
catcccttcctcctctcctgga

SEQ ID NO: 4329578 - DNA, 14 bp, Homo sapiens
catcctagccccac

SEQ ID NO: 4329579 - DNA, 16 bp, Homo sapiens
catcctagccccaccc

SEQ ID NO: 4329580 - DNA, 21 bp, Homo sapiens
catcctagccccacccagagg

SEQ ID NO: 4329581 - DNA, 14 bp, Homo sapiens
catcgcagcttcct

SEQ ID NO: 4329582 - DNA, 15 bp, Homo sapiens
catctaaagctttat

SEQ ID NO: 4329583 - DNA, 19 bp, Homo sapiens
catctaaagctttatcttt

SEQ ID NO: 4329584 - DNA, 20 bp, Homo sapiens
catctagtttccctggtgcc

SEQ ID NO: 4329585 - DNA, 21 bp, Homo sapiens
catctagtttccctggtgccc

SEQ ID NO: 4329586 - DNA, 17 bp, Homo sapiens
catctcccagatcctgg

SEQ ID NO: 4329587 - DNA, 13 bp, Homo sapiens
catctctgcctcc

SEQ ID NO: 4329588 - DNA, 11 bp, Homo sapiens
catctctgtga

SEQ ID NO: 4329589 - DNA, 16 bp, Homo sapiens
catctgactctctttt

SEQ ID NO: 4329590 - DNA, 14 bp, Homo sapiens
catctggcacgtgg

SEQ ID NO: 4329591 - DNA, 19 bp, Homo sapiens
catctggcacgtggccagg

SEQ ID NO: 4329592 - DNA, 21 bp, Homo sapiens
catctggcacgtggccaggag

SEQ ID NO: 4329593 - DNA, 23 bp, Homo sapiens
catctggcacgtggccaggagcc

SEQ ID NO: 4329594 - DNA, 19 bp, Homo sapiens
catctgtgcacactaagaa

SEQ ID NO: 4329595 - DNA, 15 bp, Homo sapiens
catcttacttgtcct

SEQ ID NO: 4329596 - DNA, 22 bp, Homo sapiens
catcttaggttggcaaaaaggc

SEQ ID NO: 4329597 - DNA, 16 bp, Homo sapiens
catcttttgtgagatg

SEQ ID NO: 4329598 - DNA, 21 bp, Homo sapiens
catgaagctggccctcagctc

SEQ ID NO: 4329599 - DNA, 16 bp, Homo sapiens
catgaaggacactctg

SEQ ID NO: 4329600 - DNA, 17 bp, Homo sapiens
catgaatttttatgatt

SEQ ID NO: 4329601 - DNA, 20 bp, Homo sapiens
catgaatttttatgatttct

SEQ ID NO: 4329602 - DNA, 20 bp, Homo sapiens
catgagtctgtttcccaagc

SEQ ID NO: 4329603 - DNA, 18 bp, Homo sapiens
gactgttttctcttgaga

SEQ ID NO: 4329604 - DNA, 20 bp, Homo sapiens
gactttgctgcattttacac

SEQ ID NO: 4329605 - DNA, 13 bp, Homo sapiens
gactttgctgtta

SEQ ID NO: 4329606 - DNA, 16 bp, Homo sapiens
gagaaaagagtgagaa

SEQ ID NO: 4329607 - DNA, 21 bp, Homo sapiens
gagaaaggggtgattgaaaga

SEQ ID NO: 4329608 - DNA, 20 bp, Homo sapiens
gagaaatgaagcagaggaag

SEQ ID NO: 4329609 - DNA, 21 bp, Homo sapiens
gagaaatgaagcagaggaagg

SEQ ID NO: 4329610 - DNA, 11 bp, Homo sapiens
gagaaatgcca

SEQ ID NO: 4329611 - DNA, 21 bp, Homo sapiens
gagaactacgcacagctgccg

SEQ ID NO: 4329612 - DNA, 16 bp, Homo sapiens
gagaagcggctggcag

SEQ ID NO: 4329613 - DNA, 19 bp, Homo sapiens
gagaaggagtgccatacct

SEQ ID NO: 4329614 - DNA, 12 bp, Homo sapiens
gagaagtgccct

SEQ ID NO: 4329615 - DNA, 23 bp, Homo sapiens
gagaatacacatataaaaacaat

SEQ ID NO: 4329616 - DNA, 21 bp, Homo sapiens
gagaattgctgaagggcattc

SEQ ID NO: 4329617 - DNA, 23 bp, Homo sapiens
gagacatcaaaaccaccctaacc

SEQ ID NO: 4329618 - DNA, 13 bp, Homo sapiens
gagaccagaagaa

SEQ ID NO: 4329619 - DNA, 14 bp, Homo sapiens
gagaccagaagaaa

SEQ ID NO: 4329620 - DNA, 16 bp, Homo sapiens
gagaccagaagaaaag

SEQ ID NO: 4329621 - DNA, 14 bp, Homo sapiens
gagacccacagccc

SEQ ID NO: 4329622 - DNA, 16 bp, Homo sapiens
gagacccacagccctg

SEQ ID NO: 4329623 - DNA, 19 bp, Homo sapiens
gagacccacagccctgaaa

SEQ ID NO: 4329624 - DNA, 20 bp, Homo sapiens
gagacccacagccctgaaac

SEQ ID NO: 4329625 - DNA, 21 bp, Homo sapiens
gagacctcaaatcactgcatt

SEQ ID NO: 4329626 - DNA, 17 bp, Homo sapiens
gagactaagagaaacct

SEQ ID NO: 4329627 - DNA, 12 bp, Homo sapiens
gagactctgaga

SEQ ID NO: 4329628 - DNA, 19 bp, Homo sapiens
gcagtgttctctctgaatg

SEQ ID NO: 4329629 - DNA, 15 bp, Homo sapiens
gcataatactaattt

SEQ ID NO: 4329630 - DNA, 12 bp, Homo sapiens
gcatatgttaaa

SEQ ID NO: 4329631 - DNA, 18 bp, Homo sapiens
gcatcacattgtcaccag

SEQ ID NO: 4329632 - DNA, 15 bp, Homo sapiens
gcatccacttcagga

SEQ ID NO: 4329633 - DNA, 21 bp, Homo sapiens
gcatcgaggaagggccgagga

SEQ ID NO: 4329634 - DNA, 11 bp, Homo sapiens
gcatctgcatg

SEQ ID NO: 4329635 - DNA, 19 bp, Homo sapiens
gcatctggcacgtggccag

SEQ ID NO: 4329636 - DNA, 21 bp, Homo sapiens
gcatctggcacgtggccagga

SEQ ID NO: 4329637 - DNA, 23 bp, Homo sapiens
gcatctggcacgtggccaggagc

SEQ ID NO: 4329638 - DNA, 14 bp, Homo sapiens
gcatgagtctgttt

SEQ ID NO: 4329639 - DNA, 23 bp, Homo sapiens
gcatgctttgagaccagaagaaa

SEQ ID NO: 4329640 - DNA, 13 bp, Homo sapiens
gcatggagactct

SEQ ID NO: 4329641 - DNA, 19 bp, Homo sapiens
gcatggagactctgagagc

SEQ ID NO: 4329642 - DNA, 20 bp, Homo sapiens
gcatggagactctgagagcg

SEQ ID NO: 4329643 - DNA, 14 bp, Homo sapiens
gcatggggcccctg

SEQ ID NO: 4329644 - DNA, 19 bp, Homo sapiens
gcatggggcccctggccca

SEQ ID NO: 4329645 - DNA, 21 bp, Homo sapiens
gcatggggcccctggcccaga

SEQ ID NO: 4329646 - DNA, 14 bp, Homo sapiens
gcatgtgccgaggt

SEQ ID NO: 4329647 - DNA, 23 bp, Homo sapiens
gcattaagtcagtggctttgcat

SEQ ID NO: 4329648 - DNA, 16 bp, Homo sapiens
gcattccttacttgca

SEQ ID NO: 4329649 - DNA, 19 bp, Homo sapiens
gcattccttacttgcactg

SEQ ID NO: 4329650 - DNA, 15 bp, Homo sapiens
gcattgagaaggaac

SEQ ID NO: 4329651 - DNA, 18 bp, Homo sapiens
gcatttcacgaactgttc

SEQ ID NO: 4329652 - DNA, 21 bp, Homo sapiens
gcatttcacgaactgttcaca

SEQ ID NO: 4329653 - DNA, 13 bp, Homo sapiens
gcatttgctgaat

SEQ ID NO: 4329654 - DNA, 14 bp, Homo sapiens
gcatttgctgaata

SEQ ID NO: 4329655 - DNA, 17 bp, Homo sapiens
gcatttgctgaatacag

SEQ ID NO: 4329656 - DNA, 22 bp, Homo sapiens
gcatttgctgttgtttctataa

SEQ ID NO: 4329657 - DNA, 16 bp, Homo sapiens
gccaaagcctcctcca

SEQ ID NO: 4329658 - DNA, 11 bp, Homo sapiens
gccaaagctgg

SEQ ID NO: 4329659 - DNA, 21 bp, Homo sapiens
gccaacacacgtccactccca

SEQ ID NO: 4329660 - DNA, 18 bp, Homo sapiens
gccaagctaatctgcctg

SEQ ID NO: 4329661 - DNA, 15 bp, Homo sapiens
gccaatatgacacag

SEQ ID NO: 4329662 - DNA, 16 bp, Homo sapiens
gccaatggagaaaatg

SEQ ID NO: 4329663 - DNA, 16 bp, Homo sapiens
gccacaccgctggctc

SEQ ID NO: 4329664 - DNA, 18 bp, Homo sapiens
gccacaccgctggctccg

SEQ ID NO: 4329665 - DNA, 21 bp, Homo sapiens
gccacaggcctccctgtttga

SEQ ID NO: 4329666 - DNA, 22 bp, Homo sapiens
gccacaggcctccctgtttgaa

SEQ ID NO: 4329667 - DNA, 19 bp, Homo sapiens
gccacagtggtactctgtg

SEQ ID NO: 4329668 - DNA, 23 bp, Homo sapiens
gccacagtggtactctgtgtctg

SEQ ID NO: 4329669 - DNA, 19 bp, Homo sapiens
gccaccagggcactgtctg

SEQ ID NO: 4329670 - DNA, 14 bp, Homo sapiens
gccaccctgtctca

SEQ ID NO: 4329671 - DNA, 22 bp, Homo sapiens
gccaccgccgactttgtacccc

SEQ ID NO: 4329672 - DNA, 16 bp, Homo sapiens
gccactagtaagtaat

SEQ ID NO: 4329673 - DNA, 18 bp, Homo sapiens
gccactgtgaagagaacc

SEQ ID NO: 4329674 - DNA, 19 bp, Homo sapiens
gccactgtgaagagaacca

SEQ ID NO: 4329675 - DNA, 15 bp, Homo sapiens
gccaggagccctggc

SEQ ID NO: 4329676 - DNA, 22 bp, Homo sapiens
gccaggcggacaaagttcagtg

SEQ ID NO: 4329677 - DNA, 22 bp, Homo sapiens
gccaggggaaaatcagcctgct

SEQ ID NO: 4329678 - DNA, 22 bp, Homo sapiens
gccataaaattgcagtttcatg

SEQ ID NO: 4329679 - DNA, 16 bp, Homo sapiens
gccataccttctccca

SEQ ID NO: 4329680 - DNA, 20 bp, Homo sapiens
gccataccttctcccaggcc

SEQ ID NO: 4329681 - DNA, 22 bp, Homo sapiens
gccataccttctcccaggcctc

SEQ ID NO: 4329682 - DNA, 18 bp, Homo sapiens
gccatatatgctgtattt

SEQ ID NO: 4329683 - DNA, 23 bp, Homo sapiens
gccatctgtgcacactaagaaat

SEQ ID NO: 4329684 - DNA, 18 bp, Homo sapiens
gccatgggaaatgagcca

SEQ ID NO: 4329685 - DNA, 20 bp, Homo sapiens
gccatgggaaatgagccagc

SEQ ID NO: 4329686 - DNA, 16 bp, Homo sapiens
gccatggtaccccctt

SEQ ID NO: 4329687 - DNA, 21 bp, Homo sapiens
gccattcctgttctctttgcc

SEQ ID NO: 4329688 - DNA, 22 bp, Homo sapiens
gcccaacaccagcccctgcccc

SEQ ID NO: 4329689 - DNA, 19 bp, Homo sapiens
gcccaagtccaaatgttta

SEQ ID NO: 4329690 - DNA, 16 bp, Homo sapiens
gcccaatggagaaatg

SEQ ID NO: 4329691 - DNA, 20 bp, Homo sapiens
gcccaatggagaaatgaagc

SEQ ID NO: 4329692 - DNA, 21 bp, Homo sapiens
gcccagagaagctggaagcct

SEQ ID NO: 4329693 - DNA, 22 bp, Homo sapiens
gcccagagaagctggaagcctg

SEQ ID NO: 4329694 - DNA, 19 bp, Homo sapiens
gcccagagttgctgtgccg

SEQ ID NO: 4329695 - DNA, 22 bp, Homo sapiens
gcccagccctctgtggccagga

SEQ ID NO: 4329696 - DNA, 13 bp, Homo sapiens
gcccagtccccca

SEQ ID NO: 4329697 - DNA, 14 bp, Homo sapiens
gcccagtcccccaa

SEQ ID NO: 4329698 - DNA, 15 bp, Homo sapiens
gcccagttggaaaat

SEQ ID NO: 4329699 - DNA, 18 bp, Homo sapiens
gcccatttcaattctcaa

SEQ ID NO: 4329700 - DNA, 19 bp, Homo sapiens
gcccatttcaattctcaaa

SEQ ID NO: 4329701 - DNA, 20 bp, Homo sapiens
gcccatttcaattctcaaaa

SEQ ID NO: 4329702 - DNA, 16 bp, Homo sapiens
gcccatttttgctaat

SEQ ID NO: 4329703 - DNA, 14 bp, Homo sapiens
gccccaaaggaaaa

SEQ ID NO: 4329704 - DNA, 20 bp, Homo sapiens
gccccaaaggaaaaagcaca

SEQ ID NO: 4329705 - DNA, 23 bp, Homo sapiens
gccccaagagcaggaggtgcctg

SEQ ID NO: 4329706 - DNA, 15 bp, Homo sapiens
gccccaatccagaga

SEQ ID NO: 4329707 - DNA, 16 bp, Homo sapiens
gccccagcccaagtcc

SEQ ID NO: 4329708 - DNA, 13 bp, Homo sapiens
gccccagccccaa

SEQ ID NO: 4329709 - DNA, 14 bp, Homo sapiens
gccccagccccaat

SEQ ID NO: 4329710 - DNA, 22 bp, Homo sapiens
gccccagccccaatccagagaa

SEQ ID NO: 4329711 - DNA, 20 bp, Homo sapiens
gccccagccccgtcccagag

SEQ ID NO: 4329712 - DNA, 21 bp, Homo sapiens
gccccagccccgtcccagagg

SEQ ID NO: 4329713 - DNA, 14 bp, Homo sapiens
gcccccacagccct

SEQ ID NO: 4329714 - DNA, 15 bp, Homo sapiens
gcccccacagccctg

SEQ ID NO: 4329715 - DNA, 16 bp, Homo sapiens
gccccctccctgctcc

SEQ ID NO: 4329716 - DNA, 22 bp, Homo sapiens
gccccgccccctccctgctccc

SEQ ID NO: 4329717 - DNA, 14 bp, Homo sapiens
gcccctgccaaggc

SEQ ID NO: 4329718 - DNA, 15 bp, Homo sapiens
gcccctgccccagcc

SEQ ID NO: 4329719 - DNA, 14 bp, Homo sapiens
gcccctgcttctcc

SEQ ID NO: 4329720 - DNA, 18 bp, Homo sapiens
gcccctgcttctccagcc

SEQ ID NO: 4329721 - DNA, 18 bp, Homo sapiens
gcccgagctgtttatgtt

SEQ ID NO: 4329722 - DNA, 19 bp, Homo sapiens
gcccgcaagagggacagag

SEQ ID NO: 4329723 - DNA, 14 bp, Homo sapiens
gcccgggagagact

SEQ ID NO: 4329724 - DNA, 18 bp, Homo sapiens
gcccggtgcagggcctgg

SEQ ID NO: 4329725 - DNA, 22 bp, Homo sapiens
gcccggtgcagggcctggcata

SEQ ID NO: 4329726 - DNA, 13 bp, Homo sapiens
gccctagaggaca

SEQ ID NO: 4329727 - DNA, 20 bp, Homo sapiens
cttagaaaaaccaccaccat

SEQ ID NO: 4329728 - DNA, 11 bp, Homo sapiens
cttagacactt

SEQ ID NO: 4329729 - DNA, 14 bp, Homo sapiens
cttagagcatctct

SEQ ID NO: 4329730 - DNA, 20 bp, Homo sapiens
cttagatgttccaaatttag

SEQ ID NO: 4329731 - DNA, 20 bp, Homo sapiens
cttagtaaaatttatttcat

SEQ ID NO: 4329732 - DNA, 19 bp, Homo sapiens
cttagtcccacagggaaat

SEQ ID NO: 4329733 - DNA, 14 bp, Homo sapiens
cttagtgaaaatac

SEQ ID NO: 4329734 - DNA, 22 bp, Homo sapiens
cttagtgcttcagagtttgtgt

SEQ ID NO: 4329735 - DNA, 13 bp, Homo sapiens
cttagttaaaaaa

SEQ ID NO: 4329736 - DNA, 15 bp, Homo sapiens
cttagttgatattca

SEQ ID NO: 4329737 - DNA, 14 bp, Homo sapiens
cttatctcactgtt

SEQ ID NO: 4329738 - DNA, 19 bp, Homo sapiens
cttatgattttattacaga

SEQ ID NO: 4329739 - DNA, 14 bp, Homo sapiens
cttatgtgttacat

SEQ ID NO: 4329740 - DNA, 15 bp, Homo sapiens
cttatgtgttacatt

SEQ ID NO: 4329741 - DNA, 17 bp, Homo sapiens
cttatgtgttacattat

SEQ ID NO: 4329742 - DNA, 18 bp, Homo sapiens
cttattgtaaattttaga

SEQ ID NO: 4329743 - DNA, 14 bp, Homo sapiens
cttcaatcccagcc

SEQ ID NO: 4329744 - DNA, 23 bp, Homo sapiens
cttcacatttgtatgtgtgtaga

SEQ ID NO: 4329745 - DNA, 21 bp, Homo sapiens
cttcactcatgcaaactgctt

SEQ ID NO: 4329746 - DNA, 17 bp, Homo sapiens
cttcactctaaaaatag

SEQ ID NO: 4329747 - DNA, 13 bp, Homo sapiens
cttcagctgactc

SEQ ID NO: 4329748 - DNA, 19 bp, Homo sapiens
cttcagctgacttttctgt

SEQ ID NO: 4329749 - DNA, 15 bp, Homo sapiens
cttcagtaagccgtg

SEQ ID NO: 4329750 - DNA, 23 bp, Homo sapiens
cttcagtaagccgtgattttcat

SEQ ID NO: 4329751 - DNA, 17 bp, Homo sapiens
cttcattagcttgtcta

SEQ ID NO: 4329752 - DNA, 20 bp, Homo sapiens
cttcattagcttgtctatta

SEQ ID NO: 4329753 - DNA, 22 bp, Homo sapiens
cttcattagcttgtctattatt

SEQ ID NO: 4329754 - DNA, 14 bp, Homo sapiens
cttccacctctggg

SEQ ID NO: 4329755 - DNA, 23 bp, Homo sapiens
cttccattgcaaaatagaagaag

SEQ ID NO: 4329756 - DNA, 12 bp, Homo sapiens
cttccccagctc

SEQ ID NO: 4329757 - DNA, 18 bp, Homo sapiens
cttccccagctcccccag

SEQ ID NO: 4329758 - DNA, 22 bp, Homo sapiens
cttccccagctcccccaggcag

SEQ ID NO: 4329759 - DNA, 20 bp, Homo sapiens
cttccccctttctctgcctg

SEQ ID NO: 4329760 - DNA, 17 bp, Homo sapiens
cttcccttcctcagcag

SEQ ID NO: 4329761 - DNA, 22 bp, Homo sapiens
cttcctccctgtctctgcatct

SEQ ID NO: 4329762 - DNA, 17 bp, Homo sapiens
cttttttgtttgtttct

SEQ ID NO: 4329763 - DNA, 22 bp, Homo sapiens
cttttttgtttgtttctttgtg

SEQ ID NO: 4329764 - DNA, 14 bp, Homo sapiens
ctttttttgttata

SEQ ID NO: 4329765 - DNA, 23 bp, Homo sapiens
ctttttttttttgtttgatgcag

SEQ ID NO: 4329766 - DNA, 15 bp, Homo sapiens
gaaaaaaaaatactt

SEQ ID NO: 4329767 - DNA, 21 bp, Homo sapiens
gaaaaaaactaaagttgaaaa

SEQ ID NO: 4329768 - DNA, 17 bp, Homo sapiens
gaaaaaaataactattt

SEQ ID NO: 4329769 - DNA, 19 bp, Homo sapiens
gaaaaaaataactattttg

SEQ ID NO: 4329770 - DNA, 21 bp, Homo sapiens
gaaaaacttttaggttgttac

SEQ ID NO: 4329771 - DNA, 22 bp, Homo sapiens
gaaaaacttttaggttgttacc

SEQ ID NO: 4329772 - DNA, 15 bp, Homo sapiens
gaaaaagaagaagga

SEQ ID NO: 4329773 - DNA, 13 bp, Homo sapiens
gaaaaaggaaaaa

SEQ ID NO: 4329774 - DNA, 14 bp, Homo sapiens
gaaaaaggaaaaat

SEQ ID NO: 4329775 - DNA, 20 bp, Homo sapiens
gaaaaagtgtacatgaagaa

SEQ ID NO: 4329776 - DNA, 14 bp, Homo sapiens
gaaaacaatttgca

SEQ ID NO: 4329777 - DNA, 10 bp, Homo sapiens
gaaaacacta

SEQ ID NO: 4329778 - DNA, 16 bp, Homo sapiens
gaaaacactaacaaaa

SEQ ID NO: 4329779 - DNA, 23 bp, Homo sapiens
gaaaacactaacaaaatttgaat

SEQ ID NO: 4329780 - DNA, 23 bp, Homo sapiens
gaaaacctttactagcatttaga

SEQ ID NO: 4329781 - DNA, 23 bp, Homo sapiens
gaaaagaaaaatgagcctggcaa

SEQ ID NO: 4329782 - DNA, 16 bp, Homo sapiens
gaaaatcatattgaga

SEQ ID NO: 4329783 - DNA, 22 bp, Homo sapiens
gaaaatgaatggacaaagctca

SEQ ID NO: 4329784 - DNA, 15 bp, Homo sapiens
gaaaatgagaatctg

SEQ ID NO: 4329785 - DNA, 13 bp, Homo sapiens
gaaaatgcatttt

SEQ ID NO: 4329786 - DNA, 19 bp, Homo sapiens
gaaaatggatatagaaaat

SEQ ID NO: 4329787 - DNA, 22 bp, Homo sapiens
gaaaatggatatagaaaatctt

SEQ ID NO: 4329788 - DNA, 16 bp, Homo sapiens
gaaacatagaaacata

SEQ ID NO: 4329789 - DNA, 18 bp, Homo sapiens
gaaacatagaaagacatg

SEQ ID NO: 4329790 - DNA, 17 bp, Homo sapiens
gaaacatgtgcccctgc

SEQ ID NO: 4329791 - DNA, 18 bp, Homo sapiens
gaaacatgtgcccctgcc

SEQ ID NO: 4329792 - DNA, 19 bp, Homo sapiens
gaaacccccttttcccttc

SEQ ID NO: 4329793 - DNA, 22 bp, Homo sapiens
gaaacccccttttcccttcagc

SEQ ID NO: 4329794 - DNA, 16 bp, Homo sapiens
gaaacccggtgcatct

SEQ ID NO: 4329795 - DNA, 23 bp, Homo sapiens
gaaacccggtgcatctggcacgt

SEQ ID NO: 4329796 - DNA, 19 bp, Homo sapiens
gaaacctgctctgtaggag

SEQ ID NO: 4329797 - DNA, 21 bp, Homo sapiens
gaaaccttgcaaactctataa

SEQ ID NO: 4329798 - DNA, 22 bp, Homo sapiens
gaaactgcttacagtttatttt

SEQ ID NO: 4329799 - DNA, 14 bp, Homo sapiens
gaaacttttgaaaa

SEQ ID NO: 4329800 - DNA, 16 bp, Homo sapiens
gaaacttttgaaaaag

SEQ ID NO: 4329801 - DNA, 22 bp, Homo sapiens
gaaagaaacccacagaagggga

SEQ ID NO: 4329802 - DNA, 21 bp, Homo sapiens
gaaagacatctgcctgtaatt

SEQ ID NO: 4329803 - DNA, 13 bp, Homo sapiens
gaaagaggaaccc

SEQ ID NO: 4329804 - DNA, 14 bp, Homo sapiens
gaaagaggaggcag

SEQ ID NO: 4329805 - DNA, 17 bp, Homo sapiens
gaaagccaccttgttac

SEQ ID NO: 4329806 - DNA, 17 bp, Homo sapiens
gaaagccctgagctttc

SEQ ID NO: 4329807 - DNA, 19 bp, Homo sapiens
gaaaggctatcctgctgaa

SEQ ID NO: 4329808 - DNA, 19 bp, Homo sapiens
gaaagtatagatggccaaa

SEQ ID NO: 4329809 - DNA, 13 bp, Homo sapiens
gaaagttgctttt

SEQ ID NO: 4329810 - DNA, 15 bp, Homo sapiens
gaaataaaaattatg

SEQ ID NO: 4329811 - DNA, 22 bp, Homo sapiens
gaaataattacttttgaaccat

SEQ ID NO: 4329812 - DNA, 22 bp, Homo sapiens
gaaatagaggtgatgctgctaa

SEQ ID NO: 4329813 - DNA, 15 bp, Homo sapiens
gaaatagttgtctgt

SEQ ID NO: 4329814 - DNA, 17 bp, Homo sapiens
gaaatagttgtctgtgc

SEQ ID NO: 4329815 - DNA, 18 bp, Homo sapiens
gaaatagttgtctgtgct

SEQ ID NO: 4329816 - DNA, 19 bp, Homo sapiens
gaaatagttgtctgtgctt

SEQ ID NO: 4329817 - DNA, 19 bp, Homo sapiens
gaaatagtttccaagaaat

SEQ ID NO: 4329818 - DNA, 17 bp, Homo sapiens
gaaatgaagcagaggaa

SEQ ID NO: 4329819 - DNA, 18 bp, Homo sapiens
gaaatgaagcagaggaag

SEQ ID NO: 4329820 - DNA, 13 bp, Homo sapiens
gaaatgtgtatct

SEQ ID NO: 4329821 - DNA, 15 bp, Homo sapiens
gaaatgtgtatctat

SEQ ID NO: 4329822 - DNA, 22 bp, Homo sapiens
gaaatgtgtatctatttatata

SEQ ID NO: 4329823 - DNA, 14 bp, Homo sapiens
gaaattaacaagaa

SEQ ID NO: 4329824 - DNA, 17 bp, Homo sapiens
gaaattaagaactgaat

SEQ ID NO: 4329825 - DNA, 16 bp, Homo sapiens
gaaattatacgtacat

SEQ ID NO: 4329826 - DNA, 22 bp, Homo sapiens
gaaattttagatattatcataa

SEQ ID NO: 4329827 - DNA, 17 bp, Homo sapiens
gaacaaagtgaaggaca

SEQ ID NO: 4329828 - DNA, 12 bp, Homo sapiens
gaacacagagaa

SEQ ID NO: 4329829 - DNA, 16 bp, Homo sapiens
gaacagcaggatgccc

SEQ ID NO: 4329830 - DNA, 15 bp, Homo sapiens
gaacagcctgagccg

SEQ ID NO: 4329831 - DNA, 15 bp, Homo sapiens
gaacatgcaagaatt

SEQ ID NO: 4329832 - DNA, 14 bp, Homo sapiens
gaacattaggaatt

SEQ ID NO: 4329833 - DNA, 15 bp, Homo sapiens
gaacattaggaattg

SEQ ID NO: 4329834 - DNA, 17 bp, Homo sapiens
gaacccccaaatttaat

SEQ ID NO: 4329835 - DNA, 19 bp, Homo sapiens
gaacccccacaaccccctc

SEQ ID NO: 4329836 - DNA, 12 bp, Homo sapiens
gaaccctttgtt

SEQ ID NO: 4329837 - DNA, 23 bp, Homo sapiens
gaaccctttgtttcttgtttatt

SEQ ID NO: 4329838 - DNA, 18 bp, Homo sapiens
gaacgtatttagccatta

SEQ ID NO: 4329839 - DNA, 14 bp, Homo sapiens
gaactgatacatct

SEQ ID NO: 4329840 - DNA, 23 bp, Homo sapiens
gaactgttcacactgcagagact

SEQ ID NO: 4329841 - DNA, 12 bp, Homo sapiens
gaagaacatgaa

SEQ ID NO: 4329842 - DNA, 14 bp, Homo sapiens
gaagaagaggaagt

SEQ ID NO: 4329843 - DNA, 14 bp, Homo sapiens
gaagaagctctctc

SEQ ID NO: 4329844 - DNA, 20 bp, Homo sapiens
gaagaaggagctcaactaaa

SEQ ID NO: 4329845 - DNA, 12 bp, Homo sapiens
gaagaagttttt

SEQ ID NO: 4329846 - DNA, 23 bp, Homo sapiens
gaagaatagcctattgtctttca

SEQ ID NO: 4329847 - DNA, 18 bp, Homo sapiens
gaagacccagcagatgtt

SEQ ID NO: 4329848 - DNA, 22 bp, Homo sapiens
gaagaggttttatttacatttt

SEQ ID NO: 4329849 - DNA, 20 bp, Homo sapiens
gaagataatattaaggaaga

SEQ ID NO: 4329850 - DNA, 16 bp, Homo sapiens
gaagatacacaagagg

SEQ ID NO: 4329851 - DNA, 18 bp, Homo sapiens
gaagatcacgctccccgc

SEQ ID NO: 4329852 - DNA, 12 bp, Homo sapiens
gaagatgggggc

SEQ ID NO: 4329853 - DNA, 18 bp, Homo sapiens
gaagatgggggcaagaag

SEQ ID NO: 4329854 - DNA, 21 bp, Homo sapiens
gaagatgttcaatagaacatg

SEQ ID NO: 4329855 - DNA, 23 bp, Homo sapiens
gaagatttgaaaacaaacttctc

SEQ ID NO: 4329856 - DNA, 19 bp, Homo sapiens
gaagatttgacgttgttgt

SEQ ID NO: 4329857 - DNA, 13 bp, Homo sapiens
gaagcaagaagaa

SEQ ID NO: 4329858 - DNA, 16 bp, Homo sapiens
gaagcaaggtctcaga

SEQ ID NO: 4329859 - DNA, 18 bp, Homo sapiens
gaagcaaggtctcagact

SEQ ID NO: 4329860 - DNA, 20 bp, Homo sapiens
gaagcaccagggagaggcct

SEQ ID NO: 4329861 - DNA, 13 bp, Homo sapiens
gaagcagaggaag

SEQ ID NO: 4329862 - DNA, 16 bp, Homo sapiens
gaagcagaggaaggaa

SEQ ID NO: 4329863 - DNA, 17 bp, Homo sapiens
gaagcagaggaaggaaa

SEQ ID NO: 4329864 - DNA, 12 bp, Homo sapiens
gaagcctgccct

SEQ ID NO: 4329865 - DNA, 14 bp, Homo sapiens
gaagcgctgttgcc

SEQ ID NO: 4329866 - DNA, 17 bp, Homo sapiens
gaagctggccctcagct

SEQ ID NO: 4329867 - DNA, 18 bp, Homo sapiens
gaaggattatatgtatta

SEQ ID NO: 4329868 - DNA, 19 bp, Homo sapiens
gaagggaacagcctgagcc

SEQ ID NO: 4329869 - DNA, 22 bp, Homo sapiens
gaagggaacccccaaatttaat

SEQ ID NO: 4329870 - DNA, 16 bp, Homo sapiens
gaaggggatgggaaat

SEQ ID NO: 4329871 - DNA, 23 bp, Homo sapiens
gaaggggatgggaaataaagaaa

SEQ ID NO: 4329872 - DNA, 16 bp, Homo sapiens
gaagtacagtcccagc

SEQ ID NO: 4329873 - DNA, 19 bp, Homo sapiens
gaagtgcccttaaggatca

SEQ ID NO: 4329874 - DNA, 14 bp, Homo sapiens
gaagtgcttattct

SEQ ID NO: 4329875 - DNA, 18 bp, Homo sapiens
gaagtgcttattctctca

SEQ ID NO: 4329876 - DNA, 19 bp, Homo sapiens
gaagttagagataattctg

SEQ ID NO: 4329877 - DNA, 14 bp, Homo sapiens
gaagttttttactt

SEQ ID NO: 4329878 - DNA, 22 bp, Homo sapiens
gaataaaaaataaataaaatgg

SEQ ID NO: 4329879 - DNA, 15 bp, Homo sapiens
gaataaatggtttct

SEQ ID NO: 4329880 - DNA, 18 bp, Homo sapiens
tgtgcctggttcgtgcca

SEQ ID NO: 4329881 - DNA, 21 bp, Homo sapiens
tgtgcgaagcaagaagaattg

SEQ ID NO: 4329882 - DNA, 16 bp, Homo sapiens
tgtgctgagcctgccc

SEQ ID NO: 4329883 - DNA, 17 bp, Homo sapiens
tgtgctgagcctgccca

SEQ ID NO: 4329884 - DNA, 14 bp, Homo sapiens
tgtgctgctgttct

SEQ ID NO: 4329885 - DNA, 14 bp, Homo sapiens
tgtgcttccttggt

SEQ ID NO: 4329886 - DNA, 20 bp, Homo sapiens
tgtgcttctccccagaattc

SEQ ID NO: 4329887 - DNA, 22 bp, Homo sapiens
tgtggaaaacaatttgcataat

SEQ ID NO: 4329888 - DNA, 20 bp, Homo sapiens
tgtggagaactcagtgccac

SEQ ID NO: 4329889 - DNA, 19 bp, Homo sapiens
tgtggaggagggagagccc

SEQ ID NO: 4329890 - DNA, 16 bp, Homo sapiens
tgtggccatatatgct

SEQ ID NO: 4329891 - DNA, 23 bp, Homo sapiens
tgtggccatatatgctgtatttc

SEQ ID NO: 4329892 - DNA, 21 bp, Homo sapiens
tgtggtcgtcatgctgtccgt

SEQ ID NO: 4329893 - DNA, 14 bp, Homo sapiens
tgtggttttatgga

SEQ ID NO: 4329894 - DNA, 19 bp, Homo sapiens
tgtgtaatctaagtatatg

SEQ ID NO: 4329895 - DNA, 18 bp, Homo sapiens
tgtgtagttccctctgcc

SEQ ID NO: 4329896 - DNA, 20 bp, Homo sapiens
tgtgtattgagtcttaactg

SEQ ID NO: 4329897 - DNA, 14 bp, Homo sapiens
tgtgtatttgtatt

SEQ ID NO: 4329898 - DNA, 16 bp, Homo sapiens
tgtgtatttgtattaa

SEQ ID NO: 4329899 - DNA, 17 bp, Homo sapiens
tgtgtcctgatggccca

SEQ ID NO: 4329900 - DNA, 15 bp, Homo sapiens
tgtgtctgtgttgct

SEQ ID NO: 4329901 - DNA, 15 bp, Homo sapiens
tgtgtgatggaggga

SEQ ID NO: 4329902 - DNA, 18 bp, Homo sapiens
tgtgtgcaactaactgac

SEQ ID NO: 4329903 - DNA, 17 bp, Homo sapiens
tgtgtgcatgtgccgag

SEQ ID NO: 4329904 - DNA, 15 bp, Homo sapiens
tgtgtgtatttgtat

SEQ ID NO: 4329905 - DNA, 15 bp, Homo sapiens
tgtgttacattattc

SEQ ID NO: 4329906 - DNA, 22 bp, Homo sapiens
tgtgttcattctgcattgagaa

SEQ ID NO: 4329907 - DNA, 20 bp, Homo sapiens
tgtgttctatccaaacatgt

SEQ ID NO: 4329908 - DNA, 20 bp, Homo sapiens
tgtgttgctttggatacaca

SEQ ID NO: 4329909 - DNA, 18 bp, Homo sapiens
tgtgtttttctccagtgc

SEQ ID NO: 4329910 - DNA, 19 bp, Homo sapiens
tgttactcttaattttaaa

SEQ ID NO: 4329911 - DNA, 18 bp, Homo sapiens
tgttagccacggaaacat

SEQ ID NO: 4329912 - DNA, 16 bp, Homo sapiens
tgttatagattgtctt

SEQ ID NO: 4329913 - DNA, 18 bp, Homo sapiens
tgttatagattgtcttaa

SEQ ID NO: 4329914 - DNA, 17 bp, Homo sapiens
tgttattaatgtttctt

SEQ ID NO: 4329915 - DNA, 13 bp, Homo sapiens
tgttcaagctttt

SEQ ID NO: 4329916 - DNA, 13 bp, Homo sapiens
tgttcaatgaaat

SEQ ID NO: 4329917 - DNA, 20 bp, Homo sapiens
tgttcaatgaaataaaagca

SEQ ID NO: 4329918 - DNA, 17 bp, Homo sapiens
tgttcacactgcagaga

SEQ ID NO: 4329919 - DNA, 14 bp, Homo sapiens
tgttcagtgttgac

SEQ ID NO: 4329920 - DNA, 15 bp, Homo sapiens
tgttcagtgttgaca

SEQ ID NO: 4329921 - DNA, 21 bp, Homo sapiens
tgttcagtgttgacatagcct

SEQ ID NO: 4329922 - DNA, 23 bp, Homo sapiens
tgttcattctgcattgagaagga

SEQ ID NO: 4329923 - DNA, 14 bp, Homo sapiens
tgttccagcttcta

SEQ ID NO: 4329924 - DNA, 21 bp, Homo sapiens
tgttcccccgccgcttttctc

SEQ ID NO: 4329925 - DNA, 16 bp, Homo sapiens
tgttcctttgaagaat

SEQ ID NO: 4329926 - DNA, 17 bp, Homo sapiens
tgttcctttgaagaatt

SEQ ID NO: 4329927 - DNA, 22 bp, Homo sapiens
tgttcctttgaagaattgtagt

SEQ ID NO: 4329928 - DNA, 14 bp, Homo sapiens
tgttctaaattcta

SEQ ID NO: 4329929 - DNA, 14 bp, Homo sapiens
tgttctatccaaac

SEQ ID NO: 4329930 - DNA, 14 bp, Homo sapiens
tgttctcagctccc

SEQ ID NO: 4329931 - DNA, 15 bp, Homo sapiens
tgttctcagctcccc

SEQ ID NO: 4329932 - DNA, 17 bp, Homo sapiens
tgttctcagctccccct

SEQ ID NO: 4329933 - DNA, 15 bp, Homo sapiens
tgttctctcttctcc

SEQ ID NO: 4329934 - DNA, 12 bp, Homo sapiens
tgttctgtgtac

SEQ ID NO: 4329935 - DNA, 12 bp, Homo sapiens
tgttcttaattt

SEQ ID NO: 4329936 - DNA, 13 bp, Homo sapiens
tgttgacatagcc

SEQ ID NO: 4329937 - DNA, 14 bp, Homo sapiens
tgttgacatagcct

SEQ ID NO: 4329938 - DNA, 16 bp, Homo sapiens
tgttgacatagccttt

SEQ ID NO: 4329939 - DNA, 16 bp, Homo sapiens
tgttgcccgccctcca

SEQ ID NO: 4329940 - DNA, 22 bp, Homo sapiens
ttatgaaattaacaagaactca

SEQ ID NO: 4329941 - DNA, 16 bp, Homo sapiens
ttatgattttattaca

SEQ ID NO: 4329942 - DNA, 22 bp, Homo sapiens
ttatgcactaaatatgaaccct

SEQ ID NO: 4329943 - DNA, 19 bp, Homo sapiens
ttatggagacctctccttc

SEQ ID NO: 4329944 - DNA, 13 bp, Homo sapiens
ttatgtcttggac

SEQ ID NO: 4329945 - DNA, 13 bp, Homo sapiens
ttatgtgttacat

SEQ ID NO: 4329946 - DNA, 14 bp, Homo sapiens
ttattaatgtttct

SEQ ID NO: 4329947 - DNA, 17 bp, Homo sapiens
ttattgcttagtaaaat

SEQ ID NO: 4329948 - DNA, 17 bp, Homo sapiens
ttattgcttattgctta

SEQ ID NO: 4329949 - DNA, 18 bp, Homo sapiens
ttattgttttaaaaagtt

SEQ ID NO: 4329950 - DNA, 13 bp, Homo sapiens
ttatttacatttt

SEQ ID NO: 4329951 - DNA, 16 bp, Homo sapiens
ttatttagttccttga

SEQ ID NO: 4329952 - DNA, 16 bp, Homo sapiens
ttatttatatcttgtt

SEQ ID NO: 4329953 - DNA, 19 bp, Homo sapiens
ttatttctctggcaaactt

SEQ ID NO: 4329954 - DNA, 13 bp, Homo sapiens
ttattttcattgt

SEQ ID NO: 4329955 - DNA, 23 bp, Homo sapiens
ttattttgaggtagaggaaaatc

SEQ ID NO: 4329956 - DNA, 12 bp, Homo sapiens
ttcaagtaacac

SEQ ID NO: 4329957 - DNA, 22 bp, Homo sapiens
ttcaatttggagcattaactaa

SEQ ID NO: 4329958 - DNA, 15 bp, Homo sapiens
ttcaccctgggcagt

SEQ ID NO: 4329959 - DNA, 14 bp, Homo sapiens
ttcacgaactgttc

SEQ ID NO: 4329960 - DNA, 13 bp, Homo sapiens
ttcacggaagagc

SEQ ID NO: 4329961 - DNA, 18 bp, Homo sapiens
ttcacggaagagccttgc

SEQ ID NO: 4329962 - DNA, 19 bp, Homo sapiens
ttcagattttaaaaagggt

SEQ ID NO: 4329963 - DNA, 17 bp, Homo sapiens
ttcagctctgcaagaat

SEQ ID NO: 4329964 - DNA, 17 bp, Homo sapiens
ttcagctgacttttctg

SEQ ID NO: 4329965 - DNA, 21 bp, Homo sapiens
ttcagctggttgaggtttcaa

SEQ ID NO: 4329966 - DNA, 16 bp, Homo sapiens
ttcagtagaattttag

SEQ ID NO: 4329967 - DNA, 17 bp, Homo sapiens
ttcagtagaattttagt

SEQ ID NO: 4329968 - DNA, 15 bp, Homo sapiens
ttcagtagtgagcag

SEQ ID NO: 4329969 - DNA, 23 bp, Homo sapiens
ttcagtgtcgggaattttccccg

SEQ ID NO: 4329970 - DNA, 13 bp, Homo sapiens
ttcagtgttgaca

SEQ ID NO: 4329971 - DNA, 15 bp, Homo sapiens
ttcagtgttgacata

SEQ ID NO: 4329972 - DNA, 17 bp, Homo sapiens
ttcagtgttgacatagc

SEQ ID NO: 4329973 - DNA, 18 bp, Homo sapiens
ttcagtgttgacatagcc

SEQ ID NO: 4329974 - DNA, 20 bp, Homo sapiens
ttcagtgttgacatagcctt

SEQ ID NO: 4329975 - DNA, 22 bp, Homo sapiens
ttcagtgttgacatagcctttg

SEQ ID NO: 4329976 - DNA, 20 bp, Homo sapiens
ttcagtttttttttttccag

SEQ ID NO: 4329977 - DNA, 17 bp, Homo sapiens
ttcatctcccagatcct

SEQ ID NO: 4329978 - DNA, 20 bp, Homo sapiens
ttcatcttccaactcaaact

SEQ ID NO: 4329979 - DNA, 16 bp, Homo sapiens
ttcatgcttctactgt

SEQ ID NO: 4329980 - DNA, 22 bp, Homo sapiens
ttcatgcttctactgtgacact

SEQ ID NO: 4329981 - DNA, 12 bp, Homo sapiens
ttcattctcata

SEQ ID NO: 4329982 - DNA, 18 bp, Homo sapiens
ttcattctgcattgagaa

SEQ ID NO: 4329983 - DNA, 22 bp, Homo sapiens
ttcattctgcattgagaaggaa

SEQ ID NO: 4329984 - DNA, 23 bp, Homo sapiens
ttccactgcaaataaagcctttt

SEQ ID NO: 4329985 - DNA, 20 bp, Homo sapiens
ttccatgaagtttgaacttc

SEQ ID NO: 4329986 - DNA, 13 bp, Homo sapiens
ttccattcttggt

SEQ ID NO: 4329987 - DNA, 18 bp, Homo sapiens
ttccattgacatttgaat

SEQ ID NO: 4329988 - DNA, 21 bp, Homo sapiens
ttccattgcaaaatagaagaa

SEQ ID NO: 4329989 - DNA, 17 bp, Homo sapiens
ttcccaagctagactgt

SEQ ID NO: 4329990 - DNA, 18 bp, Homo sapiens
ttcccaggtaatttaaat

SEQ ID NO: 4329991 - DNA, 14 bp, Homo sapiens
ttccccagctcccc

SEQ ID NO: 4329992 - DNA, 20 bp, Homo sapiens
ttccccagctcccccaggca

SEQ ID NO: 4329993 - DNA, 11 bp, Homo sapiens
ttcccccaccc

SEQ ID NO: 4329994 - DNA, 14 bp, Homo sapiens
ttccctacttgcag

SEQ ID NO: 4329995 - DNA, 15 bp, Homo sapiens
ttccctattagagaa

SEQ ID NO: 4329996 - DNA, 12 bp, Homo sapiens
ttccctctccca

SEQ ID NO: 4329997 - DNA, 13 bp, Homo sapiens
ttccctctcccac

SEQ ID NO: 4329998 - DNA, 16 bp, Homo sapiens
ttccctctcccaccca

SEQ ID NO: 4329999 - DNA, 21 bp, Homo sapiens
ttccctctcccacccaaggag

SEQ ID NO: 4330000 - DNA, 12 bp, Homo sapiens
ttccctctgcct

SEQ ID NO: 4330001 - DNA, 19 bp, Homo sapiens
ttccctctgcctgggatgc

SEQ ID NO: 4330002 - DNA, 16 bp, Homo sapiens
ttccctggtgggcctc

SEQ ID NO: 4330003 - DNA, 14 bp, Homo sapiens
ttcctaactgtgat

SEQ ID NO: 4330004 - DNA, 14 bp, Homo sapiens
ttcctacagcacta

SEQ ID NO: 4330005 - DNA, 15 bp, Homo sapiens
ttcctacagcactac

SEQ ID NO: 4330006 - DNA, 20 bp, Homo sapiens
ttcctacagcactactgggt

SEQ ID NO: 4330007 - DNA, 13 bp, Homo sapiens
ttcctcattagca

SEQ ID NO: 4330008 - DNA, 16 bp, Homo sapiens
ttcctccccattccta

SEQ ID NO: 4330009 - DNA, 23 bp, Homo sapiens
ttcctccctgtctctgcatctga

SEQ ID NO: 4330010 - DNA, 15 bp, Homo sapiens
ttcctcctctcctgg

SEQ ID NO: 4330011 - DNA, 19 bp, Homo sapiens
ttcctcctctcctggaaac

SEQ ID NO: 4330012 - DNA, 18 bp, Homo sapiens
ttcctctctttgttctca

SEQ ID NO: 4330013 - DNA, 16 bp, Homo sapiens
ttcctctttgccctga

SEQ ID NO: 4330014 - DNA, 22 bp, Homo sapiens
ttcctgattaccagtctgatta

SEQ ID NO: 4330015 - DNA, 15 bp, Homo sapiens
ttcctgtctgtttat

SEQ ID NO: 4330016 - DNA, 16 bp, Homo sapiens
ttcctgtctgtttata

SEQ ID NO: 4330017 - DNA, 15 bp, Homo sapiens
ttccttaaatgaact

SEQ ID NO: 4330018 - DNA, 22 bp, Homo sapiens
ttccttaaatgaactactgcta

SEQ ID NO: 4330019 - DNA, 13 bp, Homo sapiens
ttccttacttgca

SEQ ID NO: 4330020 - DNA, 17 bp, Homo sapiens
ttccttacttgcactgt

SEQ ID NO: 4330021 - DNA, 20 bp, Homo sapiens
ttccttgagttgattcagct

SEQ ID NO: 4330022 - DNA, 16 bp, Homo sapiens
ttcgcttgcttctgca

SEQ ID NO: 4330023 - DNA, 17 bp, Homo sapiens
ttcgcttgcttctgcag

SEQ ID NO: 4330024 - DNA, 16 bp, Homo sapiens
ttcgttagaccgctct

SEQ ID NO: 4330025 - DNA, 19 bp, Homo sapiens
ttctaatgttctaaattct

SEQ ID NO: 4330026 - DNA, 21 bp, Homo sapiens
ttctacaaagcactagagaat

SEQ ID NO: 4330027 - DNA, 18 bp, Homo sapiens
ttctacattattgcttat

SEQ ID NO: 4330028 - DNA, 14 bp, Homo sapiens
ttctaccccacctg

SEQ ID NO: 4330029 - DNA, 13 bp, Homo sapiens
ttctaggcctggg

SEQ ID NO: 4330030 - DNA, 22 bp, Homo sapiens
ttctatggagcaaaacaaagct

SEQ ID NO: 4330031 - DNA, 17 bp, Homo sapiens
ttctatttatttgactg

SEQ ID NO: 4330032 - DNA, 13 bp, Homo sapiens
ttctcagctcccc

SEQ ID NO: 4330033 - DNA, 20 bp, Homo sapiens
ttctcagctccccctgtccc

SEQ ID NO: 4330034 - DNA, 16 bp, Homo sapiens
ttctcataattcctac

SEQ ID NO: 4330035 - DNA, 19 bp, Homo sapiens
ttctcataattcctacagc

SEQ ID NO: 4330036 - DNA, 13 bp, Homo sapiens
ttctcattaaact

SEQ ID NO: 4330037 - DNA, 17 bp, Homo sapiens
ttctccagcctggaccc

SEQ ID NO: 4330038 - DNA, 13 bp, Homo sapiens
ttctccccagaat

SEQ ID NO: 4330039 - DNA, 12 bp, Homo sapiens
ttctccctagcc

SEQ ID NO: 4330040 - DNA, 17 bp, Homo sapiens
ttctctactctagggaa

SEQ ID NO: 4330041 - DNA, 17 bp, Homo sapiens
ttctctggcaaactttt

SEQ ID NO: 4330042 - DNA, 16 bp, Homo sapiens
ttctctttgccttgat

SEQ ID NO: 4330043 - DNA, 14 bp, Homo sapiens
ttctgaaatacttt

SEQ ID NO: 4330044 - DNA, 13 bp, Homo sapiens
ttctgagccccag

SEQ ID NO: 4330045 - DNA, 16 bp, Homo sapiens
ttctgagccccagccc

SEQ ID NO: 4330046 - DNA, 16 bp, Homo sapiens
ttctgatctgtacttt

SEQ ID NO: 4330047 - DNA, 15 bp, Homo sapiens
ttctgcagcaactcc

SEQ ID NO: 4330048 - DNA, 17 bp, Homo sapiens
ttctgcagcaactccca

SEQ ID NO: 4330049 - DNA, 14 bp, Homo sapiens
ttctgcattgagaa

SEQ ID NO: 4330050 - DNA, 12 bp, Homo sapiens
ttctggaagaaa

SEQ ID NO: 4330051 - DNA, 15 bp, Homo sapiens
ttctggaagaaaggc

SEQ ID NO: 4330052 - DNA, 12 bp, Homo sapiens
ttctggccttga

SEQ ID NO: 4330053 - DNA, 13 bp, Homo sapiens
ttctgtacttcct

SEQ ID NO: 4330054 - DNA, 20 bp, Homo sapiens
ttctgtagtttttaattaaa

SEQ ID NO: 4330055 - DNA, 21 bp, Homo sapiens
ttctgtagtttttaattaaaa

SEQ ID NO: 4330056 - DNA, 17 bp, Homo sapiens
ttctgtccgagctttga

SEQ ID NO: 4330057 - DNA, 14 bp, Homo sapiens
ttctgtgcatgtgc

SEQ ID NO: 4330058 - DNA, 17 bp, Homo sapiens
ttctgtggaaaacaatt

SEQ ID NO: 4330059 - DNA, 17 bp, Homo sapiens
ttgttatagattgtctt

SEQ ID NO: 4330060 - DNA, 14 bp, Homo sapiens
ttgttattaatgtt

SEQ ID NO: 4330061 - DNA, 16 bp, Homo sapiens
ttgtttaaatgccaaa

SEQ ID NO: 4330062 - DNA, 13 bp, Homo sapiens
ttgtttatacaca

SEQ ID NO: 4330063 - DNA, 18 bp, Homo sapiens
ttgtttcttgtttattga

SEQ ID NO: 4330064 - DNA, 13 bp, Homo sapiens
ttgtttctttgtg

SEQ ID NO: 4330065 - DNA, 12 bp, Homo sapiens
ttgtttgtttct

SEQ ID NO: 4330066 - DNA, 14 bp, Homo sapiens
ttgtttttctttct

SEQ ID NO: 4330067 - DNA, 22 bp, Homo sapiens
tttaaaaaattaaaaatgaaaa

SEQ ID NO: 4330068 - DNA, 20 bp, Homo sapiens
tttaaacaaaatttcacagt

SEQ ID NO: 4330069 - DNA, 13 bp, Homo sapiens
tttaaactctgcc

SEQ ID NO: 4330070 - DNA, 20 bp, Homo sapiens
tttaaagacccaacttgcca

SEQ ID NO: 4330071 - DNA, 14 bp, Homo sapiens
tttaaagtaaactt

SEQ ID NO: 4330072 - DNA, 21 bp, Homo sapiens
tttaaatcaaaaacttttcat

SEQ ID NO: 4330073 - DNA, 11 bp, Homo sapiens
tttaaatcatc

SEQ ID NO: 4330074 - DNA, 17 bp, Homo sapiens
tttaaattctcagtcat

SEQ ID NO: 4330075 - DNA, 20 bp, Homo sapiens
tttaaattggtcatggtaga

SEQ ID NO: 4330076 - DNA, 22 bp, Homo sapiens
tttaaccattgtcttgttctgt

SEQ ID NO: 4330077 - DNA, 21 bp, Homo sapiens
tttaatagaatatactgtctt

SEQ ID NO: 4330078 - DNA, 12 bp, Homo sapiens
tttaatataaac

SEQ ID NO: 4330079 - DNA, 21 bp, Homo sapiens
tttaatataagaatgagcctg

SEQ ID NO: 4330080 - DNA, 23 bp, Homo sapiens
tttaattaaaaactttaaagata

SEQ ID NO: 4330081 - DNA, 21 bp, Homo sapiens
tttacataagttcctatacct

SEQ ID NO: 4330082 - DNA, 15 bp, Homo sapiens
tttacattttagggt

SEQ ID NO: 4330083 - DNA, 13 bp, Homo sapiens
tttactcttaaat

SEQ ID NO: 4330084 - DNA, 19 bp, Homo sapiens
tttactgccttcctcctta

SEQ ID NO: 4330085 - DNA, 16 bp, Homo sapiens
tttactgctctagaaa

SEQ ID NO: 4330086 - DNA, 21 bp, Homo sapiens
tttactgctctagaaagtata

SEQ ID NO: 4330087 - DNA, 21 bp, Homo sapiens
tttagaagcaaagatttcagt

SEQ ID NO: 4330088 - DNA, 19 bp, Homo sapiens
tttagaccctattgctgct

SEQ ID NO: 4330089 - DNA, 23 bp, Homo sapiens
tttagtctttttttccttccttt

SEQ ID NO: 4330090 - DNA, 16 bp, Homo sapiens
tttagttacgtataat

SEQ ID NO: 4330091 - DNA, 21 bp, Homo sapiens
tttagttacgtataatgcttt

SEQ ID NO: 4330092 - DNA, 22 bp, Homo sapiens
tttagttacgtataatgctttc

SEQ ID NO: 4330093 - DNA, 21 bp, Homo sapiens
tttatacacaactttgcaaat

SEQ ID NO: 4330094 - DNA, 12 bp, Homo sapiens
tttatatttaaa

SEQ ID NO: 4330095 - DNA, 21 bp, Homo sapiens
tttatatttaaaaaattaaaa

SEQ ID NO: 4330096 - DNA, 21 bp, Homo sapiens
tttatcctagttccattcttg

SEQ ID NO: 4330097 - DNA, 20 bp, Homo sapiens
tttatctgatatgctgagaa

SEQ ID NO: 4330098 - DNA, 13 bp, Homo sapiens
tttatgtaatgaa

SEQ ID NO: 4330099 - DNA, 22 bp, Homo sapiens
tttatgtaatgaagtaaagcca

SEQ ID NO: 4330100 - DNA, 17 bp, Homo sapiens
tttatgtgtagttgtct

SEQ ID NO: 4330101 - DNA, 20 bp, Homo sapiens
tttattacttgtgcacttag

SEQ ID NO: 4330102 - DNA, 20 bp, Homo sapiens
tttattcagctagaatttct

SEQ ID NO: 4330103 - DNA, 21 bp, Homo sapiens
tttattgcatttgctgttgtt

SEQ ID NO: 4330104 - DNA, 13 bp, Homo sapiens
tttatttctctgg

SEQ ID NO: 4330105 - DNA, 21 bp, Homo sapiens
tttatttctctggcaaacttt

SEQ ID NO: 4330106 - DNA, 23 bp, Homo sapiens
tttcaaaacacatctttcctgtc

SEQ ID NO: 4330107 - DNA, 21 bp, Homo sapiens
tttcaattgcagatgccaaaa

SEQ ID NO: 4330108 - DNA, 23 bp, Homo sapiens
tttcacgaactgttcacactgca

SEQ ID NO: 4330109 - DNA, 13 bp, Homo sapiens
tttcagattttaa

SEQ ID NO: 4330110 - DNA, 23 bp, Homo sapiens
tttcatgttactgttgcagcttg

SEQ ID NO: 4330111 - DNA, 12 bp, Homo sapiens
tttcattccatt

SEQ ID NO: 4330112 - DNA, 16 bp, Homo sapiens
tttcattccattgcct

SEQ ID NO: 4330113 - DNA, 18 bp, Homo sapiens
tttcattgtgatttatat

SEQ ID NO: 4330114 - DNA, 12 bp, Homo sapiens
tttcatttcaga

SEQ ID NO: 4330115 - DNA, 19 bp, Homo sapiens
tttccaaaataatctatat

SEQ ID NO: 4330116 - DNA, 22 bp, Homo sapiens
tttccaaaataatctatattaa

SEQ ID NO: 4330117 - DNA, 14 bp, Homo sapiens
tttccaagaaattt

SEQ ID NO: 4330118 - DNA, 20 bp, Homo sapiens
tttccaagaaattttagata

SEQ ID NO: 4330119 - DNA, 18 bp, Homo sapiens
tttccagagttgttgttt

SEQ ID NO: 4330120 - DNA, 21 bp, Homo sapiens
tttcccaagctagactgtgtc

SEQ ID NO: 4330121 - DNA, 13 bp, Homo sapiens
tttcctaaatgtt

SEQ ID NO: 4330122 - DNA, 14 bp, Homo sapiens
tttcctaaatgttt

SEQ ID NO: 4330123 - DNA, 18 bp, Homo sapiens
tttcctccccattcctac

SEQ ID NO: 4330124 - DNA, 21 bp, Homo sapiens
tttcctcccttctttgcttct

SEQ ID NO: 4330125 - DNA, 23 bp, Homo sapiens
tttcctctctttgttctcagctc

SEQ ID NO: 4330126 - DNA, 14 bp, Homo sapiens
tttccttaccatac

SEQ ID NO: 4330127 - DNA, 15 bp, Homo sapiens
tttcgcttgcttctg

SEQ ID NO: 4330128 - DNA, 23 bp, Homo sapiens
tttctacaaagcactagagaatg

SEQ ID NO: 4330129 - DNA, 15 bp, Homo sapiens
tttctacattattgc

SEQ ID NO: 4330130 - DNA, 11 bp, Homo sapiens
tgctgaagtac

SEQ ID NO: 4330131 - DNA, 23 bp, Homo sapiens
tgctgaatacagaggcaactgca

SEQ ID NO: 4330132 - DNA, 17 bp, Homo sapiens
tgctgactgttttctct

SEQ ID NO: 4330133 - DNA, 16 bp, Homo sapiens
tgctgagtctcccaag

SEQ ID NO: 4330134 - DNA, 19 bp, Homo sapiens
tgctgagtgctatgtgtgc

SEQ ID NO: 4330135 - DNA, 23 bp, Homo sapiens
tgctgcaaacccatgaagctggc

SEQ ID NO: 4330136 - DNA, 18 bp, Homo sapiens
tgctgcataaaattctag

SEQ ID NO: 4330137 - DNA, 17 bp, Homo sapiens
tgctgctgctgccccag

SEQ ID NO: 4330138 - DNA, 15 bp, Homo sapiens
tgctgctgttctgtg

SEQ ID NO: 4330139 - DNA, 12 bp, Homo sapiens
tgctgcttgagg

SEQ ID NO: 4330140 - DNA, 18 bp, Homo sapiens
tgctgcttggagtgcccc

SEQ ID NO: 4330141 - DNA, 13 bp, Homo sapiens
tgctggaaaatca

SEQ ID NO: 4330142 - DNA, 17 bp, Homo sapiens
tgctggcctgactggtt

SEQ ID NO: 4330143 - DNA, 15 bp, Homo sapiens
tgctgggtgccaggt

SEQ ID NO: 4330144 - DNA, 17 bp, Homo sapiens
tgctgtatttctttgta

SEQ ID NO: 4330145 - DNA, 18 bp, Homo sapiens
tgctgtccgtgcttgctg

SEQ ID NO: 4330146 - DNA, 19 bp, Homo sapiens
tgctgtccgtgcttgctgg

SEQ ID NO: 4330147 - DNA, 17 bp, Homo sapiens
tgctgtgtagttccctc

SEQ ID NO: 4330148 - DNA, 23 bp, Homo sapiens
tgctgtgtagttccctctgcctg

SEQ ID NO: 4330149 - DNA, 14 bp, Homo sapiens
tgctgttctgtgta

SEQ ID NO: 4330150 - DNA, 15 bp, Homo sapiens
tgctgttctgtgtac

SEQ ID NO: 4330151 - DNA, 20 bp, Homo sapiens
tgctgttgtttctataaatg

SEQ ID NO: 4330152 - DNA, 23 bp, Homo sapiens
tgctgttgtttctataaatgact

SEQ ID NO: 4330153 - DNA, 22 bp, Homo sapiens
tgctgtttactcccttctgtag

SEQ ID NO: 4330154 - DNA, 14 bp, Homo sapiens
tgcttagtaaaatt

SEQ ID NO: 4330155 - DNA, 18 bp, Homo sapiens
tgcttagtgaaaatacta

SEQ ID NO: 4330156 - DNA, 13 bp, Homo sapiens
tgcttcacatttg

SEQ ID NO: 4330157 - DNA, 20 bp, Homo sapiens
tgcttcactcatgcaaactg

SEQ ID NO: 4330158 - DNA, 23 bp, Homo sapiens
tgcttcactcatgcaaactgctt

SEQ ID NO: 4330159 - DNA, 20 bp, Homo sapiens
tgcttcagagtttgtgtgta

SEQ ID NO: 4330160 - DNA, 22 bp, Homo sapiens
tgcttcagagtttgtgtgtatt

SEQ ID NO: 4330161 - DNA, 20 bp, Homo sapiens
tgcttccttggttcatgctt

SEQ ID NO: 4330162 - DNA, 12 bp, Homo sapiens
tgcttctcactg

SEQ ID NO: 4330163 - DNA, 15 bp, Homo sapiens
tgcttctcacttttt

SEQ ID NO: 4330164 - DNA, 13 bp, Homo sapiens
tgcttctccccag

SEQ ID NO: 4330165 - DNA, 14 bp, Homo sapiens
tgcttctccccaga

SEQ ID NO: 4330166 - DNA, 19 bp, Homo sapiens
tgcttctccccagaattca

SEQ ID NO: 4330167 - DNA, 13 bp, Homo sapiens
tgcttctctttgt

SEQ ID NO: 4330168 - DNA, 18 bp, Homo sapiens
tgcttctctttgtgcagt

SEQ ID NO: 4330169 - DNA, 14 bp, Homo sapiens
tgcttctgcagcaa

SEQ ID NO: 4330170 - DNA, 20 bp, Homo sapiens
tgcttctgcagcaactccca

SEQ ID NO: 4330171 - DNA, 18 bp, Homo sapiens
tgcttctttttcttaccc

SEQ ID NO: 4330172 - DNA, 20 bp, Homo sapiens
tgcttgagctttctgtgcat

SEQ ID NO: 4330173 - DNA, 21 bp, Homo sapiens
tgcttgagctttctgtgcatg

SEQ ID NO: 4330174 - DNA, 22 bp, Homo sapiens
tgcttgagctttctgtgcatgt

SEQ ID NO: 4330175 - DNA, 15 bp, Homo sapiens
tgcttggagtgcccc

SEQ ID NO: 4330176 - DNA, 18 bp, Homo sapiens
tgcttggagtgccccaag

SEQ ID NO: 4330177 - DNA, 19 bp, Homo sapiens
tgctttgtgcatatgttaa

SEQ ID NO: 4330178 - DNA, 17 bp, Homo sapiens
tggaaaaatagcctgcc

SEQ ID NO: 4330179 - DNA, 19 bp, Homo sapiens
tggaaaacaatttgcataa

SEQ ID NO: 4330180 - DNA, 14 bp, Homo sapiens
tggaaaatcatatt

SEQ ID NO: 4330181 - DNA, 19 bp, Homo sapiens
tggaaaatcatattgagaa

SEQ ID NO: 4330182 - DNA, 15 bp, Homo sapiens
tggaaataaaaatgt

SEQ ID NO: 4330183 - DNA, 16 bp, Homo sapiens
tggaacaaagtgaagg

SEQ ID NO: 4330184 - DNA, 18 bp, Homo sapiens
tggaagaagttttttact

SEQ ID NO: 4330185 - DNA, 21 bp, Homo sapiens
tggaatgattggttaaaatgt

SEQ ID NO: 4330186 - DNA, 20 bp, Homo sapiens
tggacagacactgttgcaaa

SEQ ID NO: 4330187 - DNA, 16 bp, Homo sapiens
tggacgctgccgggag

SEQ ID NO: 4330188 - DNA, 16 bp, Homo sapiens
tggactgtctgatcag

SEQ ID NO: 4330189 - DNA, 13 bp, Homo sapiens
tggagaaaatgaa

SEQ ID NO: 4330190 - DNA, 17 bp, Homo sapiens
tggagaaatgaagcaga

SEQ ID NO: 4330191 - DNA, 17 bp, Homo sapiens
tggagaattgctgaagg

SEQ ID NO: 4330192 - DNA, 18 bp, Homo sapiens
tggagaattgctgaaggg

SEQ ID NO: 4330193 - DNA, 22 bp, Homo sapiens
tggagagagtggtaaaaaagaa

SEQ ID NO: 4330194 - DNA, 23 bp, Homo sapiens
tggagagagtggtaaaaaagaaa

SEQ ID NO: 4330195 - DNA, 11 bp, Homo sapiens
tggagaggaag

SEQ ID NO: 4330196 - DNA, 18 bp, Homo sapiens
tggagcaaaacaaagctg

SEQ ID NO: 4330197 - DNA, 19 bp, Homo sapiens
tggagcccagttggaaaat

SEQ ID NO: 4330198 - DNA, 17 bp, Homo sapiens
tggaggagactgggcac

SEQ ID NO: 4330199 - DNA, 17 bp, Homo sapiens
tggagtctgaagcctgc

SEQ ID NO: 4330200 - DNA, 14 bp, Homo sapiens
tggagtggccactg

SEQ ID NO: 4330201 - DNA, 18 bp, Homo sapiens
tggagtggccactggcac

SEQ ID NO: 4330202 - DNA, 19 bp, Homo sapiens
tggagtggccactggcact

SEQ ID NO: 4330203 - DNA, 18 bp, Homo sapiens
tggagtgtttgaaaactg

SEQ ID NO: 4330204 - DNA, 14 bp, Homo sapiens
tggataataggaat

SEQ ID NO: 4330205 - DNA, 18 bp, Homo sapiens
tggataataggaattcaa

SEQ ID NO: 4330206 - DNA, 19 bp, Homo sapiens
tggatagaaaaaaactaaa

SEQ ID NO: 4330207 - DNA, 15 bp, Homo sapiens
tggattcacagacca

SEQ ID NO: 4330208 - DNA, 21 bp, Homo sapiens
tggcaacagttagctggagct

SEQ ID NO: 4330209 - DNA, 12 bp, Homo sapiens
tggcaaggagaa

SEQ ID NO: 4330210 - DNA, 19 bp, Homo sapiens
tggcaattccaatatttct

SEQ ID NO: 4330211 - DNA, 20 bp, Homo sapiens
tggcacgtggccaggagcca

SEQ ID NO: 4330212 - DNA, 16 bp, Homo sapiens
tggcatcgcagcttcc

SEQ ID NO: 4330213 - DNA, 13 bp, Homo sapiens
tggcatggagact

SEQ ID NO: 4330214 - DNA, 15 bp, Homo sapiens
tggcatggagactct

SEQ ID NO: 4330215 - DNA, 19 bp, Homo sapiens
tggcatggagactctgaga

SEQ ID NO: 4330216 - DNA, 18 bp, Homo sapiens
tggccactggcacttgcc

SEQ ID NO: 4330217 - DNA, 18 bp, Homo sapiens
tggccagactcccttgct

SEQ ID NO: 4330218 - DNA, 17 bp, Homo sapiens
tggccaggagccctggc

SEQ ID NO: 4330219 - DNA, 18 bp, Homo sapiens
tggccaggagccctggcc

SEQ ID NO: 4330220 - DNA, 22 bp, Homo sapiens
tggccatggtacccccttctgg

SEQ ID NO: 4330221 - DNA, 18 bp, Homo sapiens
tggcccaagtcattccta

SEQ ID NO: 4330222 - DNA, 14 bp, Homo sapiens
tggcccactgcatc

SEQ ID NO: 4330223 - DNA, 22 bp, Homo sapiens
tggccccccgaggctaaccctg

SEQ ID NO: 4330224 - DNA, 15 bp, Homo sapiens
tggcccctgagccca

SEQ ID NO: 4330225 - DNA, 21 bp, Homo sapiens
tggcccctgagcccagagaag

SEQ ID NO: 4330226 - DNA, 20 bp, Homo sapiens
tggcccgcaagagggacaga

SEQ ID NO: 4330227 - DNA, 18 bp, Homo sapiens
tggcccggaagaaccaga

SEQ ID NO: 4330228 - DNA, 14 bp, Homo sapiens
tggccctcccaggc

SEQ ID NO: 4330229 - DNA, 20 bp, Homo sapiens
tggcctatgtgcgaagcaag

SEQ ID NO: 4330230 - DNA, 12 bp, Homo sapiens
tggcctgactgg

SEQ ID NO: 4330231 - DNA, 19 bp, Homo sapiens
tggcgggatgggccaccgc

SEQ ID NO: 4330232 - DNA, 22 bp, Homo sapiens
tggctaatggagtgtttgaaaa

SEQ ID NO: 4330233 - DNA, 20 bp, Homo sapiens
tggctatctatacctgcctt

SEQ ID NO: 4330234 - DNA, 21 bp, Homo sapiens
tggctatctatacctgccttt

SEQ ID NO: 4330235 - DNA, 23 bp, Homo sapiens
tggctccaacccgttgggtccct

SEQ ID NO: 4330236 - DNA, 16 bp, Homo sapiens
tggctgcgtactccac

SEQ ID NO: 4330237 - DNA, 19 bp, Homo sapiens
tggctgcgtactccactgg

SEQ ID NO: 4330238 - DNA, 22 bp, Homo sapiens
tggctgttaaccacccgccccg

SEQ ID NO: 4330239 - DNA, 14 bp, Homo sapiens
tggcttgctgttta

SEQ ID NO: 4330240 - DNA, 22 bp, Homo sapiens
tggcttttcgcttgcttctgca

SEQ ID NO: 4330241 - DNA, 15 bp, Homo sapiens
tgggaaataaagaaa

SEQ ID NO: 4330242 - DNA, 18 bp, Homo sapiens
tgggaaataaagaaaatt

SEQ ID NO: 4330243 - DNA, 14 bp, Homo sapiens
tgggaaatgagcca

SEQ ID NO: 4330244 - DNA, 16 bp, Homo sapiens
tgggaaatgagccagc

SEQ ID NO: 4330245 - DNA, 15 bp, Homo sapiens
tgggaagatttgaaa

SEQ ID NO: 4330246 - DNA, 19 bp, Homo sapiens
tgggaggccaaggtgggag

SEQ ID NO: 4330247 - DNA, 18 bp, Homo sapiens
tgggagggaaaagggaag

SEQ ID NO: 4330248 - DNA, 18 bp, Homo sapiens
tgggagggaggcatctgc

SEQ ID NO: 4330249 - DNA, 23 bp, Homo sapiens
tgggagggaggcatctgcatggg

SEQ ID NO: 4330250 - DNA, 16 bp, Homo sapiens
tgataataatattgtt

SEQ ID NO: 4330251 - DNA, 18 bp, Homo sapiens
tgataataatattgtttt

SEQ ID NO: 4330252 - DNA, 16 bp, Homo sapiens
tgatacccaacagttt

SEQ ID NO: 4330253 - DNA, 19 bp, Homo sapiens
tgatacctattaaaggaaa

SEQ ID NO: 4330254 - DNA, 21 bp, Homo sapiens
tgatacctattaaaggaaaac

SEQ ID NO: 4330255 - DNA, 15 bp, Homo sapiens
tgatatgctgagaaa

SEQ ID NO: 4330256 - DNA, 16 bp, Homo sapiens
tgatattcaaggcttt

SEQ ID NO: 4330257 - DNA, 18 bp, Homo sapiens
tgatcacatctaaagctt

SEQ ID NO: 4330258 - DNA, 23 bp, Homo sapiens
tgatccctcagtctgagaggtta

SEQ ID NO: 4330259 - DNA, 15 bp, Homo sapiens
tgatctgtactttgt

SEQ ID NO: 4330260 - DNA, 22 bp, Homo sapiens
tgatctgttcagttaagttctt

SEQ ID NO: 4330261 - DNA, 15 bp, Homo sapiens
tgatctttgtttaaa

SEQ ID NO: 4330262 - DNA, 18 bp, Homo sapiens
tgatctttgtttaaatgc

SEQ ID NO: 4330263 - DNA, 21 bp, Homo sapiens
tgatctttgtttaaatgccaa

SEQ ID NO: 4330264 - DNA, 16 bp, Homo sapiens
tgatgactgctgattt

SEQ ID NO: 4330265 - DNA, 14 bp, Homo sapiens
tgatgatcctaggc

SEQ ID NO: 4330266 - DNA, 20 bp, Homo sapiens
tgatgatcctaggcatttgc

SEQ ID NO: 4330267 - DNA, 13 bp, Homo sapiens
tgatgcaggcact

SEQ ID NO: 4330268 - DNA, 13 bp, Homo sapiens
tgatgcatgcttt

SEQ ID NO: 4330269 - DNA, 16 bp, Homo sapiens
tgatgcccaccgagga

SEQ ID NO: 4330270 - DNA, 20 bp, Homo sapiens
tgatgccctgctccagggag

SEQ ID NO: 4330271 - DNA, 11 bp, Homo sapiens
tgatggaaaaa

SEQ ID NO: 4330272 - DNA, 15 bp, Homo sapiens
tgatggtttggaaaa

SEQ ID NO: 4330273 - DNA, 20 bp, Homo sapiens
tgatggtttggaaaataact

SEQ ID NO: 4330274 - DNA, 15 bp, Homo sapiens
tgatgtattctttta

SEQ ID NO: 4330275 - DNA, 20 bp, Homo sapiens
tgattaaccacttcagctga

SEQ ID NO: 4330276 - DNA, 22 bp, Homo sapiens
tgattataccatgtgtgctaat

SEQ ID NO: 4330277 - DNA, 15 bp, Homo sapiens
tgattccagaacaaa

SEQ ID NO: 4330278 - DNA, 12 bp, Homo sapiens
tgattgaaagaa

SEQ ID NO: 4330279 - DNA, 14 bp, Homo sapiens
tgattgaaagaaaa

SEQ ID NO: 4330280 - DNA, 16 bp, Homo sapiens
tgattggttaaaatgt

SEQ ID NO: 4330281 - DNA, 23 bp, Homo sapiens
tgatttagaagcaaagatttcag

SEQ ID NO: 4330282 - DNA, 15 bp, Homo sapiens
tgattttattacaga

SEQ ID NO: 4330283 - DNA, 15 bp, Homo sapiens
tgattttcattgctg

SEQ ID NO: 4330284 - DNA, 13 bp, Homo sapiens
tgcaaaatagaag

SEQ ID NO: 4330285 - DNA, 15 bp, Homo sapiens
tgcaaaatagaagaa

SEQ ID NO: 4330286 - DNA, 17 bp, Homo sapiens
tgcaaaatagaagaaga

SEQ ID NO: 4330287 - DNA, 14 bp, Homo sapiens
tgcaaacaaacaag

SEQ ID NO: 4330288 - DNA, 17 bp, Homo sapiens
tgcaaacccatgaagct

SEQ ID NO: 4330289 - DNA, 17 bp, Homo sapiens
tgcaaactctataaaga

SEQ ID NO: 4330290 - DNA, 19 bp, Homo sapiens
tgcaaactctataaagaaa

SEQ ID NO: 4330291 - DNA, 15 bp, Homo sapiens
tgcaaactgctttat

SEQ ID NO: 4330292 - DNA, 17 bp, Homo sapiens
tgcaaactgctttattt

SEQ ID NO: 4330293 - DNA, 21 bp, Homo sapiens
tgcaaactgctttattttccc

SEQ ID NO: 4330294 - DNA, 15 bp, Homo sapiens
tatcttgttattaat

SEQ ID NO: 4330295 - DNA, 16 bp, Homo sapiens
tatgaaattaacaaga

SEQ ID NO: 4330296 - DNA, 17 bp, Homo sapiens
tatgaaattaacaagaa

SEQ ID NO: 4330297 - DNA, 19 bp, Homo sapiens
tatgaaccctttgtttctt

SEQ ID NO: 4330298 - DNA, 20 bp, Homo sapiens
tatgaaccctttgtttcttg

SEQ ID NO: 4330299 - DNA, 14 bp, Homo sapiens
tatgaagtataaat

SEQ ID NO: 4330300 - DNA, 16 bp, Homo sapiens
tatgaagtataaatct

SEQ ID NO: 4330301 - DNA, 15 bp, Homo sapiens
tatgaccattgaaaa

SEQ ID NO: 4330302 - DNA, 22 bp, Homo sapiens
tatgagaaaaatattcaagtaa

SEQ ID NO: 4330303 - DNA, 12 bp, Homo sapiens
tatgatttcttg

SEQ ID NO: 4330304 - DNA, 21 bp, Homo sapiens
tatgattttatttaaactatt

SEQ ID NO: 4330305 - DNA, 15 bp, Homo sapiens
tatgcactaaatatg

SEQ ID NO: 4330306 - DNA, 23 bp, Homo sapiens
tatgcagaacgtatttagccatt

SEQ ID NO: 4330307 - DNA, 22 bp, Homo sapiens
tatgctcctagagaggagaaag

SEQ ID NO: 4330308 - DNA, 14 bp, Homo sapiens
tatgctgagaaatt

SEQ ID NO: 4330309 - DNA, 21 bp, Homo sapiens
tatggagactttgctgttact

SEQ ID NO: 4330310 - DNA, 15 bp, Homo sapiens
tatgtaacctattta

SEQ ID NO: 4330311 - DNA, 20 bp, Homo sapiens
tatgtatatatattctcagc

SEQ ID NO: 4330312 - DNA, 13 bp, Homo sapiens
tatgtgaaaagat

SEQ ID NO: 4330313 - DNA, 20 bp, Homo sapiens
tatgtgcgaagcaagaagaa

SEQ ID NO: 4330314 - DNA, 19 bp, Homo sapiens
tatgtggcccaagtcattc

SEQ ID NO: 4330315 - DNA, 16 bp, Homo sapiens
tatgtgtgtagactgt

SEQ ID NO: 4330316 - DNA, 13 bp, Homo sapiens
tatgtgttacatt

SEQ ID NO: 4330317 - DNA, 13 bp, Homo sapiens
tattaaaatgtaa

SEQ ID NO: 4330318 - DNA, 12 bp, Homo sapiens
tattaataaagc

SEQ ID NO: 4330319 - DNA, 17 bp, Homo sapiens
tattaataaagcattct

SEQ ID NO: 4330320 - DNA, 16 bp, Homo sapiens
tattacttgtgcactt

SEQ ID NO: 4330321 - DNA, 23 bp, Homo sapiens
tattataaatatatataaagaat

SEQ ID NO: 4330322 - DNA, 16 bp, Homo sapiens
tattatgggtatgtgt

SEQ ID NO: 4330323 - DNA, 11 bp, Homo sapiens
tattcaagtaa

SEQ ID NO: 4330324 - DNA, 16 bp, Homo sapiens
tattcaagtaacactt

SEQ ID NO: 4330325 - DNA, 19 bp, Homo sapiens
tattcagctagaatttctg

SEQ ID NO: 4330326 - DNA, 17 bp, Homo sapiens
tattgaaagttgctttt

SEQ ID NO: 4330327 - DNA, 23 bp, Homo sapiens
tattgagtcttaactgtatttca

SEQ ID NO: 4330328 - DNA, 22 bp, Homo sapiens
tattgagtttgtaggtaaaatg

SEQ ID NO: 4330329 - DNA, 13 bp, Homo sapiens
tattgatatatat

SEQ ID NO: 4330330 - DNA, 18 bp, Homo sapiens
tattgatcccttctcctg

SEQ ID NO: 4330331 - DNA, 16 bp, Homo sapiens
tattgcatttgctgtt

SEQ ID NO: 4330332 - DNA, 22 bp, Homo sapiens
tattgcatttgctgttgtttct

SEQ ID NO: 4330333 - DNA, 23 bp, Homo sapiens
tattgccttggctctatttggca

SEQ ID NO: 4330334 - DNA, 21 bp, Homo sapiens
tattgcttattgcttagtaaa

SEQ ID NO: 4330335 - DNA, 18 bp, Homo sapiens
tattggtatatttgtaga

SEQ ID NO: 4330336 - DNA, 23 bp, Homo sapiens
tattgtaatgccaatatgacaca

SEQ ID NO: 4330337 - DNA, 14 bp, Homo sapiens
tatttaaaaaatta

SEQ ID NO: 4330338 - DNA, 16 bp, Homo sapiens
tatttaaaaaattaaa

SEQ ID NO: 4330339 - DNA, 17 bp, Homo sapiens
tatttaaaaaattaaaa

SEQ ID NO: 4330340 - DNA, 21 bp, Homo sapiens
tatttaaaaaattaaaaatga

SEQ ID NO: 4330341 - DNA, 13 bp, Homo sapiens
tatttaaactatt

SEQ ID NO: 4330342 - DNA, 19 bp, Homo sapiens
tatttagactgtggccata

SEQ ID NO: 4330343 - DNA, 21 bp, Homo sapiens
tatttagactgtggccatata

SEQ ID NO: 4330344 - DNA, 19 bp, Homo sapiens
tatttagttacgtataatg

SEQ ID NO: 4330345 - DNA, 20 bp, Homo sapiens
tatttattacttgtgcactt

SEQ ID NO: 4330346 - DNA, 23 bp, Homo sapiens
tatttctgtggaaaacaatttgc

SEQ ID NO: 4330347 - DNA, 16 bp, Homo sapiens
tatttctttgtagaat

SEQ ID NO: 4330348 - DNA, 17 bp, Homo sapiens
tatttctttgtagaata

SEQ ID NO: 4330349 - DNA, 22 bp, Homo sapiens
tatttgggagggaaaagggaag

SEQ ID NO: 4330350 - DNA, 23 bp, Homo sapiens
tatttgggagggaaaagggaagt

SEQ ID NO: 4330351 - DNA, 22 bp, Homo sapiens
tatttgtagataccgagaatga

SEQ ID NO: 4330352 - DNA, 15 bp, Homo sapiens
tatttgtataaatta

SEQ ID NO: 4330353 - DNA, 11 bp, Homo sapiens
tatttgtatta

SEQ ID NO: 4330354 - DNA, 18 bp, Homo sapiens
tatttgtattaataaagc

SEQ ID NO: 4330355 - DNA, 19 bp, Homo sapiens
tatttgtattaataaagca

SEQ ID NO: 4330356 - DNA, 20 bp, Homo sapiens
tatttgtattaataaagcat

SEQ ID NO: 4330357 - DNA, 21 bp, Homo sapiens
tatttgtattaataaagcatt

SEQ ID NO: 4330358 - DNA, 14 bp, Homo sapiens
tattttcattgtga

SEQ ID NO: 4330359 - DNA, 20 bp, Homo sapiens
tattttccagccttatgtgt

SEQ ID NO: 4330360 - DNA, 20 bp, Homo sapiens
tattttccctacttgcagcg

SEQ ID NO: 4330361 - DNA, 23 bp, Homo sapiens
tattttgaggtagaggaaaatca

SEQ ID NO: 4330362 - DNA, 14 bp, Homo sapiens
tattttgataataa

SEQ ID NO: 4330363 - DNA, 18 bp, Homo sapiens
tattttgataataatatt

SEQ ID NO: 4330364 - DNA, 12 bp, Homo sapiens
tatttttattat

SEQ ID NO: 4330365 - DNA, 15 bp, Homo sapiens
tattttttaataaaa

SEQ ID NO: 4330366 - DNA, 16 bp, Homo sapiens
tattttttttaaatca

SEQ ID NO: 4330367 - DNA, 15 bp, Homo sapiens
tcaaaaaaagaaaaa

SEQ ID NO: 4330368 - DNA, 18 bp, Homo sapiens
tcaaaagaaaaggcaaaa

SEQ ID NO: 4330369 - DNA, 21 bp, Homo sapiens
tcaaaatggtgttgagattta

SEQ ID NO: 4330370 - DNA, 22 bp, Homo sapiens
tcaaacacttattgtttgaaag

SEQ ID NO: 4330371 - DNA, 15 bp, Homo sapiens
tcaaaccttaagata

SEQ ID NO: 4330372 - DNA, 14 bp, Homo sapiens
tcaaactcttaaaa

SEQ ID NO: 4330373 - DNA, 23 bp, Homo sapiens
tcaaagaggttttaaaaaaatcc

SEQ ID NO: 4330374 - DNA, 19 bp, Homo sapiens
tcaaagtggggtacagtaa

SEQ ID NO: 4330375 - DNA, 16 bp, Homo sapiens
tcaaatgatacagtca

SEQ ID NO: 4330376 - DNA, 20 bp, Homo sapiens
tcaacaaggtatacctcagt

SEQ ID NO: 4330377 - DNA, 17 bp, Homo sapiens
tcaacaatgattttctt

SEQ ID NO: 4330378 - DNA, 17 bp, Homo sapiens
tcaagcttttcctttct

SEQ ID NO: 4330379 - DNA, 18 bp, Homo sapiens
tcaagcttttcctttctt

SEQ ID NO: 4330380 - DNA, 22 bp, Homo sapiens
tcaagcttttcctttctttttt

SEQ ID NO: 4330381 - DNA, 20 bp, Homo sapiens
tcaaggaggtggtgaatttt

SEQ ID NO: 4330382 - DNA, 16 bp, Homo sapiens
tcaaggctttaaaagt

SEQ ID NO: 4330383 - DNA, 14 bp, Homo sapiens
tcaagtaacacttt

SEQ ID NO: 4330384 - DNA, 19 bp, Homo sapiens
tcaagtaagtagatgcctg

SEQ ID NO: 4330385 - DNA, 12 bp, Homo sapiens
tcaagtgtcacc

SEQ ID NO: 4330386 - DNA, 15 bp, Homo sapiens
tcaagtgtcacctcc

SEQ ID NO: 4330387 - DNA, 16 bp, Homo sapiens
tcaagtgtcacctcct

SEQ ID NO: 4330388 - DNA, 17 bp, Homo sapiens
tcaagtgtcacctcctt

SEQ ID NO: 4330389 - DNA, 22 bp, Homo sapiens
tcaagtgtcacctccttcccca

SEQ ID NO: 4330390 - DNA, 15 bp, Homo sapiens
tcaatagaacatgca

SEQ ID NO: 4330391 - DNA, 19 bp, Homo sapiens
tcaatatttactgagactt

SEQ ID NO: 4330392 - DNA, 15 bp, Homo sapiens
tccaaattgtgcttc

SEQ ID NO: 4330393 - DNA, 22 bp, Homo sapiens
tccaaattgtgcttctccccag

SEQ ID NO: 4330394 - DNA, 23 bp, Homo sapiens
tccaaattgtgcttctccccaga

SEQ ID NO: 4330395 - DNA, 21 bp, Homo sapiens
tccaacccgttgggtcccttg

SEQ ID NO: 4330396 - DNA, 15 bp, Homo sapiens
tccaagaaattttag

SEQ ID NO: 4330397 - DNA, 18 bp, Homo sapiens
tccaagggccgtgccctt

SEQ ID NO: 4330398 - DNA, 16 bp, Homo sapiens
tccaatatttctgctt

SEQ ID NO: 4330399 - DNA, 23 bp, Homo sapiens
tccaatatttctgctttctttga

SEQ ID NO: 4330400 - DNA, 21 bp, Homo sapiens
tccaatgatacccaacagttt

SEQ ID NO: 4330401 - DNA, 20 bp, Homo sapiens
tccaattctgaaatactttt

SEQ ID NO: 4330402 - DNA, 15 bp, Homo sapiens
tccacaaagagacca

SEQ ID NO: 4330403 - DNA, 19 bp, Homo sapiens
tccacaaagagaccagggg

SEQ ID NO: 4330404 - DNA, 17 bp, Homo sapiens
tccacacggagctcctg

SEQ ID NO: 4330405 - DNA, 16 bp, Homo sapiens
tccacccactaggtga

SEQ ID NO: 4330406 - DNA, 18 bp, Homo sapiens
tccactcccaagccacta

SEQ ID NO: 4330407 - DNA, 23 bp, Homo sapiens
tccagccaaagcctcctccagcc

SEQ ID NO: 4330408 - DNA, 17 bp, Homo sapiens
tccagccgtgtgtgcat

SEQ ID NO: 4330409 - DNA, 18 bp, Homo sapiens
tccagccgtgtgtgcatg

SEQ ID NO: 4330410 - DNA, 19 bp, Homo sapiens
tccagccgtgtgtgcatgt

SEQ ID NO: 4330411 - DNA, 18 bp, Homo sapiens
tccagcctggacccccag

SEQ ID NO: 4330412 - DNA, 22 bp, Homo sapiens
tccagcctggacccccagcttt

SEQ ID NO: 4330413 - DNA, 13 bp, Homo sapiens
tccagcctgggtg

SEQ ID NO: 4330414 - DNA, 16 bp, Homo sapiens
tccagctgggacctaa

SEQ ID NO: 4330415 - DNA, 23 bp, Homo sapiens
tccagctgggacctaatgctggc

SEQ ID NO: 4330416 - DNA, 17 bp, Homo sapiens
tccagctgttcagctgg

SEQ ID NO: 4330417 - DNA, 14 bp, Homo sapiens
gtttagtaatctaa

SEQ ID NO: 4330418 - DNA, 13 bp, Homo sapiens
gtttagtgtgctg

SEQ ID NO: 4330419 - DNA, 19 bp, Homo sapiens
gtttatacacaactttgca

SEQ ID NO: 4330420 - DNA, 23 bp, Homo sapiens
gtttatacacaactttgcaaatt

SEQ ID NO: 4330421 - DNA, 19 bp, Homo sapiens
gtttatctatcggaagaac

SEQ ID NO: 4330422 - DNA, 22 bp, Homo sapiens
gtttattgagtttgtaggtaaa

SEQ ID NO: 4330423 - DNA, 19 bp, Homo sapiens
gtttattttctgtgtaaaa

SEQ ID NO: 4330424 - DNA, 14 bp, Homo sapiens
gtttccctggtgcc

SEQ ID NO: 4330425 - DNA, 15 bp, Homo sapiens
gtttcctaactgtga

SEQ ID NO: 4330426 - DNA, 16 bp, Homo sapiens
gtttctataaatgact

SEQ ID NO: 4330427 - DNA, 18 bp, Homo sapiens
gtttctataaatgactat

SEQ ID NO: 4330428 - DNA, 20 bp, Homo sapiens
gtttctgatctgtactttgt

SEQ ID NO: 4330429 - DNA, 18 bp, Homo sapiens
gtttgagatcagcctggg

SEQ ID NO: 4330430 - DNA, 22 bp, Homo sapiens
gtttgatgcaggcacttattgt

SEQ ID NO: 4330431 - DNA, 17 bp, Homo sapiens
gtttgccaagctaatct

SEQ ID NO: 4330432 - DNA, 14 bp, Homo sapiens
gtttgtagtaaata

SEQ ID NO: 4330433 - DNA, 20 bp, Homo sapiens
gtttgtagtttttgctgaag

SEQ ID NO: 4330434 - DNA, 13 bp, Homo sapiens
gtttgtctgtgtg

SEQ ID NO: 4330435 - DNA, 17 bp, Homo sapiens
gtttgtgtgtatttgta

SEQ ID NO: 4330436 - DNA, 21 bp, Homo sapiens
gtttgtgtgtatttgtattaa

SEQ ID NO: 4330437 - DNA, 18 bp, Homo sapiens
gtttgttcctttgaagaa

SEQ ID NO: 4330438 - DNA, 14 bp, Homo sapiens
gttttaaatgtgtt

SEQ ID NO: 4330439 - DNA, 14 bp, Homo sapiens
gttttaatctactt

SEQ ID NO: 4330440 - DNA, 15 bp, Homo sapiens
gttttaatctacttt

SEQ ID NO: 4330441 - DNA, 23 bp, Homo sapiens
gttttaatctactttttgtattt

SEQ ID NO: 4330442 - DNA, 13 bp, Homo sapiens
gttttatttatat

SEQ ID NO: 4330443 - DNA, 19 bp, Homo sapiens
gttttctcttgagagggtg

SEQ ID NO: 4330444 - DNA, 18 bp, Homo sapiens
gtttttctaggcctgggg

SEQ ID NO: 4330445 - DNA, 16 bp, Homo sapiens
gtttttgtcttaaaaa

SEQ ID NO: 4330446 - DNA, 13 bp, Homo sapiens
gttttttactttg

SEQ ID NO: 4330447 - DNA, 12 bp, Homo sapiens
taaaaaagaaat

SEQ ID NO: 4330448 - DNA, 14 bp, Homo sapiens
taaaaaagaaatga

SEQ ID NO: 4330449 - DNA, 14 bp, Homo sapiens
taaaaaataaataa

SEQ ID NO: 4330450 - DNA, 20 bp, Homo sapiens
taaaaaataaataaaatgga

SEQ ID NO: 4330451 - DNA, 15 bp, Homo sapiens
taaaaactttaaaga

SEQ ID NO: 4330452 - DNA, 15 bp, Homo sapiens
taaaagagatctggg

SEQ ID NO: 4330453 - DNA, 18 bp, Homo sapiens
taaaagagatctgggcat

SEQ ID NO: 4330454 - DNA, 15 bp, Homo sapiens
taaaaggatagtatt

SEQ ID NO: 4330455 - DNA, 18 bp, Homo sapiens
taaaagtcattattcctg

SEQ ID NO: 4330456 - DNA, 12 bp, Homo sapiens
taaaataaaaaa

SEQ ID NO: 4330457 - DNA, 16 bp, Homo sapiens
taaaatagacactata

SEQ ID NO: 4330458 - DNA, 14 bp, Homo sapiens
taaaatcacatttt

SEQ ID NO: 4330459 - DNA, 21 bp, Homo sapiens
taaaatgagtaggatgtctct

SEQ ID NO: 4330460 - DNA, 13 bp, Homo sapiens
taaaatgtatttt

SEQ ID NO: 4330461 - DNA, 18 bp, Homo sapiens
taaaattgaaaacactaa

SEQ ID NO: 4330462 - DNA, 21 bp, Homo sapiens
taaaattgcagtttcatgtat

SEQ ID NO: 4330463 - DNA, 15 bp, Homo sapiens
taaacacataaatga

SEQ ID NO: 4330464 - DNA, 16 bp, Homo sapiens
taaacacataaatgaa

SEQ ID NO: 4330465 - DNA, 20 bp, Homo sapiens
taaacacataaatgaaagaa

SEQ ID NO: 4330466 - DNA, 13 bp, Homo sapiens
taaacctcctgcc

SEQ ID NO: 4330467 - DNA, 18 bp, Homo sapiens
taaacctcctgcctccca

SEQ ID NO: 4330468 - DNA, 17 bp, Homo sapiens
taaactagtttaagggt

SEQ ID NO: 4330469 - DNA, 16 bp, Homo sapiens
taaactctgccagaaa

SEQ ID NO: 4330470 - DNA, 13 bp, Homo sapiens
taaactgttttca

SEQ ID NO: 4330471 - DNA, 15 bp, Homo sapiens
taaactgttttcaag

SEQ ID NO: 4330472 - DNA, 22 bp, Homo sapiens
taaacttggtttttaaaaaact

SEQ ID NO: 4330473 - DNA, 14 bp, Homo sapiens
taaacttgtgtatt

SEQ ID NO: 4330474 - DNA, 18 bp, Homo sapiens
taaactttgaataaaaga

SEQ ID NO: 4330475 - DNA, 19 bp, Homo sapiens
taaagaaactgcttacagt

SEQ ID NO: 4330476 - DNA, 13 bp, Homo sapiens
taaagaaactttt

SEQ ID NO: 4330477 - DNA, 13 bp, Homo sapiens
taaagaaggaggt

SEQ ID NO: 4330478 - DNA, 18 bp, Homo sapiens
taaagacccaacttgcca

SEQ ID NO: 4330479 - DNA, 24 bp, Homo sapiens
taaagatatggagaattgctgaag

SEQ ID NO: 4330480 - DNA, 23 bp, Homo sapiens
taaagattagggaaaatggatat

SEQ ID NO: 4330481 - DNA, 15 bp, Homo sapiens
taaagcagtaaaata

SEQ ID NO: 4330482 - DNA, 19 bp, Homo sapiens
taaagccttttaaatcatc

SEQ ID NO: 4330483 - DNA, 17 bp, Homo sapiens
taaagcttctataaaat

SEQ ID NO: 4330484 - DNA, 18 bp, Homo sapiens
taaagcttgatttgatct

SEQ ID NO: 4330485 - DNA, 17 bp, Homo sapiens
taaagctttatctttgt

SEQ ID NO: 4330486 - DNA, 19 bp, Homo sapiens
taaagctttatctttgtgt

SEQ ID NO: 4330487 - DNA, 16 bp, Homo sapiens
taaaggcaaggaaatt

SEQ ID NO: 4330488 - DNA, 13 bp, Homo sapiens
taaagtcatcaaa

SEQ ID NO: 4330489 - DNA, 15 bp, Homo sapiens
taaagtcatcaaagt

SEQ ID NO: 4330490 - DNA, 17 bp, Homo sapiens
taaagtccctatagtat

SEQ ID NO: 4330491 - DNA, 15 bp, Homo sapiens
taaagttgaaaatac

SEQ ID NO: 4330492 - DNA, 18 bp, Homo sapiens
taaagttgaaaatacatt

SEQ ID NO: 4330493 - DNA, 21 bp, Homo sapiens
taaagttgaaaatacattctt

SEQ ID NO: 4330494 - DNA, 21 bp, Homo sapiens
taaataaaatggatagaaaaa

SEQ ID NO: 4330495 - DNA, 21 bp, Homo sapiens
taaataaactgttttcaagtc

SEQ ID NO: 4330496 - DNA, 21 bp, Homo sapiens
taaatagaaagagttctatgg

SEQ ID NO: 4330497 - DNA, 13 bp, Homo sapiens
taaatatatataa

SEQ ID NO: 4330498 - DNA, 14 bp, Homo sapiens
taaatatatataaa

SEQ ID NO: 4330499 - DNA, 18 bp, Homo sapiens
taaatatgagactattat

SEQ ID NO: 4330500 - DNA, 12 bp, Homo sapiens
taaatattaaag

SEQ ID NO: 4330501 - DNA, 14 bp, Homo sapiens
taaatcaaaaactt

SEQ ID NO: 4330502 - DNA, 12 bp, Homo sapiens
taaatctatgat

SEQ ID NO: 4330503 - DNA, 21 bp, Homo sapiens
taaatgaaagaaacccacaga

SEQ ID NO: 4330504 - DNA, 18 bp, Homo sapiens
taaatgaactactgctat

SEQ ID NO: 4330505 - DNA, 19 bp, Homo sapiens
taaatgaactactgctatt

SEQ ID NO: 4330506 - DNA, 14 bp, Homo sapiens
taaatgaatatttt

SEQ ID NO: 4330507 - DNA, 21 bp, Homo sapiens
taaatgaatattttgataata

SEQ ID NO: 4330508 - DNA, 15 bp, Homo sapiens
taaatgactattgta

SEQ ID NO: 4330509 - DNA, 18 bp, Homo sapiens
taaatgagggtttctgat

SEQ ID NO: 4330510 - DNA, 20 bp, Homo sapiens
taaatgccaaaatgtactta

SEQ ID NO: 4330511 - DNA, 18 bp, Homo sapiens
taaatgggagcaacatat

SEQ ID NO: 4330512 - DNA, 22 bp, Homo sapiens
taaatgggagcaacatatcagt

SEQ ID NO: 4330513 - DNA, 20 bp, Homo sapiens
taaatgtctagttgtaacac

SEQ ID NO: 4330514 - DNA, 16 bp, Homo sapiens
taaatgtggtgagaat

SEQ ID NO: 4330515 - DNA, 16 bp, Homo sapiens
taaatgttcaaactgt

SEQ ID NO: 4330516 - DNA, 15 bp, Homo sapiens
taaattaaataaact

SEQ ID NO: 4330517 - DNA, 23 bp, Homo sapiens
taaattataaaattgaaaacact

SEQ ID NO: 4330518 - DNA, 15 bp, Homo sapiens
taaattctcagtcat

SEQ ID NO: 4330519 - DNA, 14 bp, Homo sapiens
taacaaaatttgaa

SEQ ID NO: 4330520 - DNA, 23 bp, Homo sapiens
taacaaaatttgaataataaatc

SEQ ID NO: 4330521 - DNA, 18 bp, Homo sapiens
taacaccatgattaacca

SEQ ID NO: 4330522 - DNA, 18 bp, Homo sapiens
taacagctccatacttct

SEQ ID NO: 4330523 - DNA, 15 bp, Homo sapiens
taacatctgggtcta

SEQ ID NO: 4330524 - DNA, 19 bp, Homo sapiens
taacatctgggtctactca

SEQ ID NO: 4330525 - DNA, 20 bp, Homo sapiens
taacctccctcaacaaggta

SEQ ID NO: 4330526 - DNA, 12 bp, Homo sapiens
taactaaatgct

SEQ ID NO: 4330527 - DNA, 14 bp, Homo sapiens
taactaaatgctca

SEQ ID NO: 4330528 - DNA, 15 bp, Homo sapiens
taactaaatgctcat

SEQ ID NO: 4330529 - DNA, 18 bp, Homo sapiens
taactactgacgaaagag

SEQ ID NO: 4330530 - DNA, 20 bp, Homo sapiens
taactattttgttttaatct

SEQ ID NO: 4330531 - DNA, 19 bp, Homo sapiens
taactgactctgttattga

SEQ ID NO: 4330532 - DNA, 16 bp, Homo sapiens
taactgtatttcagta

SEQ ID NO: 4330533 - DNA, 14 bp, Homo sapiens
taactgtgatttgt

SEQ ID NO: 4330534 - DNA, 15 bp, Homo sapiens
taactttttttcagt

SEQ ID NO: 4330535 - DNA, 17 bp, Homo sapiens
taactttttttcagttc

SEQ ID NO: 4330536 - DNA, 11 bp, Homo sapiens
taagaaaagag

SEQ ID NO: 4330537 - DNA, 15 bp, Homo sapiens
taagaaataatgcct

SEQ ID NO: 4330538 - DNA, 20 bp, Homo sapiens
gtagataccgagaatgatcc

SEQ ID NO: 4330539 - DNA, 18 bp, Homo sapiens
gtgccataccttctccca

SEQ ID NO: 4330540 - DNA, 19 bp, Homo sapiens
ggagatcttcccctaacct

SEQ ID NO: 4330541 - DNA, 21 bp, Homo sapiens
ggagattttgaggtaaagata

SEQ ID NO: 4330542 - DNA, 22 bp, Homo sapiens
ggagcattggcccctgagccca

SEQ ID NO: 4330543 - DNA, 13 bp, Homo sapiens
ggagccccagccc

SEQ ID NO: 4330544 - DNA, 15 bp, Homo sapiens
ggagccccagccccg

SEQ ID NO: 4330545 - DNA, 15 bp, Homo sapiens
ggagcctcctgccca

SEQ ID NO: 4330546 - DNA, 19 bp, Homo sapiens
ggaggaaccgaggtgttgc

SEQ ID NO: 4330547 - DNA, 12 bp, Homo sapiens
ggaggaagagaa

SEQ ID NO: 4330548 - DNA, 16 bp, Homo sapiens
ggaggagagagggtct

SEQ ID NO: 4330549 - DNA, 23 bp, Homo sapiens
ggaggatcacttgagtccagaag

SEQ ID NO: 4330550 - DNA, 21 bp, Homo sapiens
ggaggatctcttgagcctggg

SEQ ID NO: 4330551 - DNA, 13 bp, Homo sapiens
ggaggcagaaaga

SEQ ID NO: 4330552 - DNA, 20 bp, Homo sapiens
ggaggccaaggtgggaggat

SEQ ID NO: 4330553 - DNA, 16 bp, Homo sapiens
ggaggggttgccacag

SEQ ID NO: 4330554 - DNA, 17 bp, Homo sapiens
ggaggggttgccacagg

SEQ ID NO: 4330555 - DNA, 22 bp, Homo sapiens
ggaggggttgccacaggcctcc

SEQ ID NO: 4330556 - DNA, 21 bp, Homo sapiens
ggaggttcgggattccctggt

SEQ ID NO: 4330557 - DNA, 23 bp, Homo sapiens
ggagtgccataccttctcccagg

SEQ ID NO: 4330558 - DNA, 22 bp, Homo sapiens
ggagtttatctatcggaagaac

SEQ ID NO: 4330559 - DNA, 14 bp, Homo sapiens
ggataataggaatt

SEQ ID NO: 4330560 - DNA, 16 bp, Homo sapiens
ggataataggaattca

SEQ ID NO: 4330561 - DNA, 18 bp, Homo sapiens
ggatagtatttttatcca

SEQ ID NO: 4330562 - DNA, 14 bp, Homo sapiens
ggatatactgcagc

SEQ ID NO: 4330563 - DNA, 14 bp, Homo sapiens
ggatcaccccagcc

SEQ ID NO: 4330564 - DNA, 22 bp, Homo sapiens
ggatcatatgaccattgaaaaa

SEQ ID NO: 4330565 - DNA, 16 bp, Homo sapiens
ggatcttttggacctg

SEQ ID NO: 4330566 - DNA, 19 bp, Homo sapiens
ggatcttttggacctggct

SEQ ID NO: 4330567 - DNA, 15 bp, Homo sapiens
ggatgatggaaaaat

SEQ ID NO: 4330568 - DNA, 19 bp, Homo sapiens
ggatgccctgttgggggct

SEQ ID NO: 4330569 - DNA, 14 bp, Homo sapiens
ggatgcccttcccc

SEQ ID NO: 4330570 - DNA, 16 bp, Homo sapiens
ggatgcccttccccct

SEQ ID NO: 4330571 - DNA, 14 bp, Homo sapiens
ggatgcggggcaga

SEQ ID NO: 4330572 - DNA, 20 bp, Homo sapiens
ggatggacgctgccgggaga

SEQ ID NO: 4330573 - DNA, 18 bp, Homo sapiens
ggatggatttccagccaa

SEQ ID NO: 4330574 - DNA, 14 bp, Homo sapiens
ggatgtgaagaaat

SEQ ID NO: 4330575 - DNA, 23 bp, Homo sapiens
ggcaaaaccttgtgactcagtgt

SEQ ID NO: 4330576 - DNA, 11 bp, Homo sapiens
ggcaaggaaat

SEQ ID NO: 4330577 - DNA, 14 bp, Homo sapiens
ggcaaggagaatat

SEQ ID NO: 4330578 - DNA, 15 bp, Homo sapiens
ggcaaggagaatatg

SEQ ID NO: 4330579 - DNA, 15 bp, Homo sapiens
ggcaccagcagcctg

SEQ ID NO: 4330580 - DNA, 16 bp, Homo sapiens
ggcaccagcagcctgg

SEQ ID NO: 4330581 - DNA, 12 bp, Homo sapiens
ggcacccctgcc

SEQ ID NO: 4330582 - DNA, 18 bp, Homo sapiens
ggcacccctgcctcctgc

SEQ ID NO: 4330583 - DNA, 17 bp, Homo sapiens
ggcacgtggccaggagc

SEQ ID NO: 4330584 - DNA, 19 bp, Homo sapiens
ggcacgtggccaggagcca

SEQ ID NO: 4330585 - DNA, 20 bp, Homo sapiens
ggcagaaatagttgtctgtg

SEQ ID NO: 4330586 - DNA, 15 bp, Homo sapiens
ggcagctctgagccg

SEQ ID NO: 4330587 - DNA, 14 bp, Homo sapiens
ggcagggcctggcg

SEQ ID NO: 4330588 - DNA, 12 bp, Homo sapiens
ggcagggtccta

SEQ ID NO: 4330589 - DNA, 19 bp, Homo sapiens
ggcagtgagtgccatgctt

SEQ ID NO: 4330590 - DNA, 19 bp, Homo sapiens
ggcatttcacgaactgttc

SEQ ID NO: 4330591 - DNA, 19 bp, Homo sapiens
ggccaatggagaaaatgaa

SEQ ID NO: 4330592 - DNA, 19 bp, Homo sapiens
ggccactggcacttgcctg

SEQ ID NO: 4330593 - DNA, 20 bp, Homo sapiens
ggccactgtgaagagaacca

SEQ ID NO: 4330594 - DNA, 15 bp, Homo sapiens
ggccagaaaaagaag

SEQ ID NO: 4330595 - DNA, 17 bp, Homo sapiens
ggccagaaaaagaagaa

SEQ ID NO: 4330596 - DNA, 14 bp, Homo sapiens
ggccaggagccatg

SEQ ID NO: 4330597 - DNA, 14 bp, Homo sapiens
ggccaggagccctg

SEQ ID NO: 4330598 - DNA, 17 bp, Homo sapiens
ggccaggagccctggcc

SEQ ID NO: 4330599 - DNA, 15 bp, Homo sapiens
ggccatatatgctgt

SEQ ID NO: 4330600 - DNA, 17 bp, Homo sapiens
ggcccctgagcccagag

SEQ ID NO: 4330601 - DNA, 16 bp, Homo sapiens
ggcccctgcttctcca

SEQ ID NO: 4330602 - DNA, 21 bp, Homo sapiens
ggcccctgcttctccagcctg

SEQ ID NO: 4330603 - DNA, 19 bp, Homo sapiens
ggcccgcaagagggacaga

SEQ ID NO: 4330604 - DNA, 14 bp, Homo sapiens
ggccctcccaggct

SEQ ID NO: 4330605 - DNA, 21 bp, Homo sapiens
ggccgcagccacaccgctggc

SEQ ID NO: 4330606 - DNA, 12 bp, Homo sapiens
ggccgctgcccc

SEQ ID NO: 4330607 - DNA, 14 bp, Homo sapiens
ggccgctgcccctg

SEQ ID NO: 4330608 - DNA, 16 bp, Homo sapiens
ggccgctgcccctgag

SEQ ID NO: 4330609 - DNA, 20 bp, Homo sapiens
ggccggagacccacagccct

SEQ ID NO: 4330610 - DNA, 22 bp, Homo sapiens
ggccggagacccacagccctga

SEQ ID NO: 4330611 - DNA, 23 bp, Homo sapiens
ggcctacctctcgtttctgccca

SEQ ID NO: 4330612 - DNA, 18 bp, Homo sapiens
ggcctcgacgtcccttgg

SEQ ID NO: 4330613 - DNA, 19 bp, Homo sapiens
ggcctcggctgtctcctgt

SEQ ID NO: 4330614 - DNA, 11 bp, Homo sapiens
ggcctctgccc

SEQ ID NO: 4330615 - DNA, 20 bp, Homo sapiens
ggcctctgccccaagagcag

SEQ ID NO: 4330616 - DNA, 18 bp, Homo sapiens
ggcctggcatagagtagg

SEQ ID NO: 4330617 - DNA, 23 bp, Homo sapiens
ggcctggcgggatgggccaccgc

SEQ ID NO: 4330618 - DNA, 19 bp, Homo sapiens
ggccttgacttatggctcg

SEQ ID NO: 4330619 - DNA, 13 bp, Homo sapiens
ggcctttggcttc

SEQ ID NO: 4330620 - DNA, 16 bp, Homo sapiens
ggcgggatgggccacc

SEQ ID NO: 4330621 - DNA, 13 bp, Homo sapiens
ggcggggccggga

SEQ ID NO: 4330622 - DNA, 18 bp, Homo sapiens
ggcgggtgatgagacctg

SEQ ID NO: 4330623 - DNA, 19 bp, Homo sapiens
ggcgggtgatgagacctgg

SEQ ID NO: 4330624 - DNA, 22 bp, Homo sapiens
ggctaatggagtgtttgaaaac

SEQ ID NO: 4330625 - DNA, 14 bp, Homo sapiens
ggctactctgccca

SEQ ID NO: 4330626 - DNA, 16 bp, Homo sapiens
ggctatcctgctgaaa

SEQ ID NO: 4330627 - DNA, 20 bp, Homo sapiens
ggctatctatacctgccttt

SEQ ID NO: 4330628 - DNA, 19 bp, Homo sapiens
ggctcagcaaaagatgctt

SEQ ID NO: 4330629 - DNA, 11 bp, Homo sapiens
ggctccccagt

SEQ ID NO: 4330630 - DNA, 14 bp, Homo sapiens
ggctctagcccaag

SEQ ID NO: 4330631 - DNA, 14 bp, Homo sapiens
ggctctctaagaaa

SEQ ID NO: 4330632 - DNA, 17 bp, Homo sapiens
ggctgaggcagtgctag

SEQ ID NO: 4330633 - DNA, 15 bp, Homo sapiens
ggctggagagctgct

SEQ ID NO: 4330634 - DNA, 12 bp, Homo sapiens
ggctgggcaggg

SEQ ID NO: 4330635 - DNA, 19 bp, Homo sapiens
ggctgggtggcaccagcag

SEQ ID NO: 4330636 - DNA, 13 bp, Homo sapiens
ggctggtcacctc

SEQ ID NO: 4330637 - DNA, 16 bp, Homo sapiens
ggctggtcacctccca

SEQ ID NO: 4330638 - DNA, 20 bp, Homo sapiens
ggcttcacggaagagccttg

SEQ ID NO: 4330639 - DNA, 20 bp, Homo sapiens
ggctttgcatagctttcaca

SEQ ID NO: 4330640 - DNA, 21 bp, Homo sapiens
ggctttgcatagctttcacaa

SEQ ID NO: 4330641 - DNA, 20 bp, Homo sapiens
ggcttttcgcttgcttctgc

SEQ ID NO: 4330642 - DNA, 21 bp, Homo sapiens
ggcttttcgcttgcttctgca

SEQ ID NO: 4330643 - DNA, 23 bp, Homo sapiens
ggctttttgtcaaataaaatgaa

SEQ ID NO: 4330644 - DNA, 13 bp, Homo sapiens
gggaaaatcagcc

SEQ ID NO: 4330645 - DNA, 14 bp, Homo sapiens
gggaaatgagccag

SEQ ID NO: 4330646 - DNA, 22 bp, Homo sapiens
gggaaggtgggtgaggctgggc

SEQ ID NO: 4330647 - DNA, 15 bp, Homo sapiens
gggaagtagtccttg

SEQ ID NO: 4330648 - DNA, 16 bp, Homo sapiens
gggaagtagtccttgg

SEQ ID NO: 4330649 - DNA, 16 bp, Homo sapiens
gggaatacatctgtgg

SEQ ID NO: 4330650 - DNA, 21 bp, Homo sapiens
gggaatctaatatccccaaat

SEQ ID NO: 4330651 - DNA, 13 bp, Homo sapiens
gggacagagcccg

SEQ ID NO: 4330652 - DNA, 14 bp, Homo sapiens
gggacagagcccgg

SEQ ID NO: 4330653 - DNA, 14 bp, Homo sapiens
gggagaaatgccag

SEQ ID NO: 4330654 - DNA, 13 bp, Homo sapiens
gggagcctcctgc

SEQ ID NO: 4330655 - DNA, 14 bp, Homo sapiens
gggagcctcctgcc

SEQ ID NO: 4330656 - DNA, 21 bp, Homo sapiens
gggagcctcctgcccagtccc

SEQ ID NO: 4330657 - DNA, 20 bp, Homo sapiens
gggagcgtgggctcagcagg

SEQ ID NO: 4330658 - DNA, 13 bp, Homo sapiens
gggaggagagagg

SEQ ID NO: 4330659 - DNA, 18 bp, Homo sapiens
gggaggcatctgcatggg

SEQ ID NO: 4330660 - DNA, 11 bp, Homo sapiens
gggagggatta

SEQ ID NO: 4330661 - DNA, 15 bp, Homo sapiens
gggaggtcgaggcag

SEQ ID NO: 4330662 - DNA, 19 bp, Homo sapiens
gggaggtcgaggcaggagg

SEQ ID NO: 4330663 - DNA, 20 bp, Homo sapiens
gggatggacgctgccgggag

SEQ ID NO: 4330664 - DNA, 13 bp, Homo sapiens
gggatgggccacc

SEQ ID NO: 4330665 - DNA, 15 bp, Homo sapiens
gggatgggccaccgc

SEQ ID NO: 4330666 - DNA, 13 bp, Homo sapiens
gggattccctggt

SEQ ID NO: 4330667 - DNA, 16 bp, Homo sapiens
gggcacagggtctcta

SEQ ID NO: 4330668 - DNA, 23 bp, Homo sapiens
gggcacatgctgagtctcccaag

SEQ ID NO: 4330669 - DNA, 16 bp, Homo sapiens
gggcacccctgcctcc

SEQ ID NO: 4330670 - DNA, 13 bp, Homo sapiens
gggcagggaagga

SEQ ID NO: 4330671 - DNA, 18 bp, Homo sapiens
gggcccctggcccagagt

SEQ ID NO: 4330672 - DNA, 16 bp, Homo sapiens
gggccgaggaatgtga

SEQ ID NO: 4330673 - DNA, 13 bp, Homo sapiens
gggccgggactgg

SEQ ID NO: 4330674 - DNA, 14 bp, Homo sapiens
gggccggggcctct

SEQ ID NO: 4330675 - DNA, 20 bp, Homo sapiens
gggcctggcgggatgggcca

SEQ ID NO: 4330676 - DNA, 22 bp, Homo sapiens
gggcctgggcggggccgcagcc

SEQ ID NO: 4330677 - DNA, 18 bp, Homo sapiens
gggcctgtagatcaggga

SEQ ID NO: 4330678 - DNA, 16 bp, Homo sapiens
gggcgcggtggctcac

SEQ ID NO: 4330679 - DNA, 19 bp, Homo sapiens
gggctcagccacagcctga

SEQ ID NO: 4330680 - DNA, 17 bp, Homo sapiens
gggctggtcacctccca

SEQ ID NO: 4330681 - DNA, 15 bp, Homo sapiens
gggcttcaggtctct

SEQ ID NO: 4330682 - DNA, 17 bp, Homo sapiens
ggggaaaatcagcctgc

SEQ ID NO: 4330683 - DNA, 22 bp, Homo sapiens
ggggaggggttgccacaggcct

SEQ ID NO: 4330684 - DNA, 16 bp, Homo sapiens
ggggatgtgaagaaat

SEQ ID NO: 4330685 - DNA, 14 bp, Homo sapiens
ggggccgggactgg

SEQ ID NO: 4330686 - DNA, 15 bp, Homo sapiens
ggggccgggactggg

SEQ ID NO: 4330687 - DNA, 18 bp, Homo sapiens
ggggccgggactgggggc

SEQ ID NO: 4330688 - DNA, 22 bp, Homo sapiens
ggggcctggcgggatgggccac

SEQ ID NO: 4330689 - DNA, 13 bp, Homo sapiens
ggggcttggggat

SEQ ID NO: 4330690 - DNA, 23 bp, Homo sapiens
gggggcaagaagatcacgctccc

SEQ ID NO: 4330691 - DNA, 12 bp, Homo sapiens
ggggtgcctgct

SEQ ID NO: 4330692 - DNA, 20 bp, Homo sapiens
ggggttgccacaggcctccc

SEQ ID NO: 4330693 - DNA, 18 bp, Homo sapiens
gggtataatgtgtctgtg

SEQ ID NO: 4330694 - DNA, 18 bp, Homo sapiens
gggtatgtgttgccaaag

SEQ ID NO: 4330695 - DNA, 20 bp, Homo sapiens
gggtcttcttttactggact

SEQ ID NO: 4330696 - DNA, 19 bp, Homo sapiens
gggtgacagagcaagtgag

SEQ ID NO: 4330697 - DNA, 13 bp, Homo sapiens
gggtgccaggtgc

SEQ ID NO: 4330698 - DNA, 16 bp, Homo sapiens
gggtgccaggtgctgg

SEQ ID NO: 4330699 - DNA, 14 bp, Homo sapiens
gggtggggaaggga

SEQ ID NO: 4330700 - DNA, 19 bp, Homo sapiens
gggttgccacaggcctccc

SEQ ID NO: 4330701 - DNA, 14 bp, Homo sapiens
ggtacagtaaagag

SEQ ID NO: 4330702 - DNA, 16 bp, Homo sapiens
ggtacccccttctggg

SEQ ID NO: 4330703 - DNA, 13 bp, Homo sapiens
ggtagaggaaaat

SEQ ID NO: 4330704 - DNA, 18 bp, Homo sapiens
ggtatattgtgtaaatat

SEQ ID NO: 4330705 - DNA, 17 bp, Homo sapiens
ggtcacctcccatcccg

SEQ ID NO: 4330706 - DNA, 18 bp, Homo sapiens
ggtcatgaaggacactct

SEQ ID NO: 4330707 - DNA, 20 bp, Homo sapiens
ggtcatgaaggacactctgc

SEQ ID NO: 4330708 - DNA, 16 bp, Homo sapiens
ggtccggggaggaggt

SEQ ID NO: 4330709 - DNA, 23 bp, Homo sapiens
ggtcctagaaattccccaccctg

SEQ ID NO: 4330710 - DNA, 13 bp, Homo sapiens
ggtcgaggcagga

SEQ ID NO: 4330711 - DNA, 21 bp, Homo sapiens
ggtcgtcatgctgtccgtgct

SEQ ID NO: 4330712 - DNA, 19 bp, Homo sapiens
ggtcgtttatgtgtgcaga

SEQ ID NO: 4330713 - DNA, 23 bp, Homo sapiens
ggtctctccctcccccagagccc

SEQ ID NO: 4330714 - DNA, 16 bp, Homo sapiens
ggtctctggtcctgtg

SEQ ID NO: 4330715 - DNA, 15 bp, Homo sapiens
ggtgagaagcagagg

SEQ ID NO: 4330716 - DNA, 21 bp, Homo sapiens
ggtgagctatagtgaagaata

SEQ ID NO: 4330717 - DNA, 23 bp, Homo sapiens
ggtgcatctggcacgtggccagg

SEQ ID NO: 4330718 - DNA, 14 bp, Homo sapiens
ggtgcctgctgtcc

SEQ ID NO: 4330719 - DNA, 19 bp, Homo sapiens
ggtgcgcacttacctgctt

SEQ ID NO: 4330720 - DNA, 14 bp, Homo sapiens
ggtggcaccagcag

SEQ ID NO: 4330721 - DNA, 20 bp, Homo sapiens
ggtgggaggatctcttgagc

SEQ ID NO: 4330722 - DNA, 17 bp, Homo sapiens
ggtgtcatttcattcca

SEQ ID NO: 4330723 - DNA, 12 bp, Homo sapiens
ggtgtggagaag

SEQ ID NO: 4330724 - DNA, 23 bp, Homo sapiens
ggtgtggagaagcggctggcagc

SEQ ID NO: 4330725 - DNA, 21 bp, Homo sapiens
ggtgtggtcgtcatgctgtcc

SEQ ID NO: 4330726 - DNA, 23 bp, Homo sapiens
ggtgtggtcgtcatgctgtccgt

SEQ ID NO: 4330727 - DNA, 19 bp, Homo sapiens
ggttagaccttatgttaga

SEQ ID NO: 4330728 - DNA, 15 bp, Homo sapiens
ggttcatgcttctac

SEQ ID NO: 4330729 - DNA, 16 bp, Homo sapiens
ggttctgggcctctga

SEQ ID NO: 4330730 - DNA, 12 bp, Homo sapiens
ggttgccacagg

SEQ ID NO: 4330731 - DNA, 14 bp, Homo sapiens
ggttgccacaggcc

SEQ ID NO: 4330732 - DNA, 18 bp, Homo sapiens
ggttgccacaggcctccc

SEQ ID NO: 4330733 - DNA, 18 bp, Homo sapiens
ggttggcaaaaaggcagg

SEQ ID NO: 4330734 - DNA, 11 bp, Homo sapiens
ggttgtcagaa

SEQ ID NO: 4330735 - DNA, 13 bp, Homo sapiens
ggtttaagctgtt

SEQ ID NO: 4330736 - DNA, 13 bp, Homo sapiens
ggtttagaacccc

SEQ ID NO: 4330737 - DNA, 16 bp, Homo sapiens
ggtttagaaccccagg

SEQ ID NO: 4330738 - DNA, 22 bp, Homo sapiens
ggtttctgatctgtactttgtg

SEQ ID NO: 4330739 - DNA, 13 bp, Homo sapiens
ggtttgagacaga

SEQ ID NO: 4330740 - DNA, 12 bp, Homo sapiens
ggtttttctccc

SEQ ID NO: 4330741 - DNA, 14 bp, Homo sapiens
gtaaaaaagaaatg

SEQ ID NO: 4330742 - DNA, 16 bp, Homo sapiens
gtaaaaaagaaatgaa

SEQ ID NO: 4330743 - DNA, 21 bp, Homo sapiens
gtaaaaagccctatgtgaaaa

SEQ ID NO: 4330744 - DNA, 17 bp, Homo sapiens
gtaaaatgtatttttct

SEQ ID NO: 4330745 - DNA, 13 bp, Homo sapiens
gtaaaatttattt

SEQ ID NO: 4330746 - DNA, 17 bp, Homo sapiens
gtaaacacataaatgaa

SEQ ID NO: 4330747 - DNA, 18 bp, Homo sapiens
gtaaacacataaatgaaa

SEQ ID NO: 4330748 - DNA, 15 bp, Homo sapiens
gtaaacttgtgtatt

SEQ ID NO: 4330749 - DNA, 16 bp, Homo sapiens
gtaactttttttcagt

SEQ ID NO: 4330750 - DNA, 16 bp, Homo sapiens
gtaagaccaccttccc

SEQ ID NO: 4330751 - DNA, 15 bp, Homo sapiens
gtaagtgaatttatg

SEQ ID NO: 4330752 - DNA, 14 bp, Homo sapiens
gtaataaaaagaga

SEQ ID NO: 4330753 - DNA, 17 bp, Homo sapiens
gtaatagattatagttg

SEQ ID NO: 4330754 - DNA, 17 bp, Homo sapiens
gtaatgccaatatgaca

SEQ ID NO: 4330755 - DNA, 20 bp, Homo sapiens
gtaatgcttagagaatgttc

SEQ ID NO: 4330756 - DNA, 21 bp, Homo sapiens
gtaatgtcagactttgctgca

SEQ ID NO: 4330757 - DNA, 22 bp, Homo sapiens
gtaatgtcagactttgctgcat

SEQ ID NO: 4330758 - DNA, 23 bp, Homo sapiens
gtaatgtcagactttgctgcatt

SEQ ID NO: 4330759 - DNA, 21 bp, Homo sapiens
gtaattatgcactaaatatga

SEQ ID NO: 4330760 - DNA, 23 bp, Homo sapiens
gtacagctgacggtttctccccg

SEQ ID NO: 4330761 - DNA, 15 bp, Homo sapiens
gtacataaacaatga

SEQ ID NO: 4330762 - DNA, 18 bp, Homo sapiens
gtacataaagtcatcaaa

SEQ ID NO: 4330763 - DNA, 10 bp, Homo sapiens
gtacatgtat

SEQ ID NO: 4330764 - DNA, 15 bp, Homo sapiens
gtaccagaagcaagg

SEQ ID NO: 4330765 - DNA, 21 bp, Homo sapiens
gtaccccccaacccctgagga

SEQ ID NO: 4330766 - DNA, 23 bp, Homo sapiens
gtacctcccctccccgccccctg

SEQ ID NO: 4330767 - DNA, 13 bp, Homo sapiens
gtacttaaatgag

SEQ ID NO: 4330768 - DNA, 21 bp, Homo sapiens
gtagaaagacatctgcctgta

SEQ ID NO: 4330769 - DNA, 15 bp, Homo sapiens
gtagaaagagtgtta

SEQ ID NO: 4330770 - DNA, 19 bp, Homo sapiens
gtagaattttagtcctgaa

SEQ ID NO: 4330771 - DNA, 18 bp, Homo sapiens
gtagacaatcattgtttt

SEQ ID NO: 4330772 - DNA, 15 bp, Homo sapiens
gtagagtgggagctg

SEQ ID NO: 4330773 - DNA, 22 bp, Homo sapiens
tactctaccctcttagaaaaac

SEQ ID NO: 4330774 - DNA, 11 bp, Homo sapiens
tactgaaagac

SEQ ID NO: 4330775 - DNA, 23 bp, Homo sapiens
tactgaagggaacagcctgagcc

SEQ ID NO: 4330776 - DNA, 17 bp, Homo sapiens
tactgatttagaagcaa

SEQ ID NO: 4330777 - DNA, 16 bp, Homo sapiens
tactgctctagaaagt

SEQ ID NO: 4330778 - DNA, 18 bp, Homo sapiens
tactgcttctctttgtgc

SEQ ID NO: 4330779 - DNA, 14 bp, Homo sapiens
tactgggtgtcatt

SEQ ID NO: 4330780 - DNA, 22 bp, Homo sapiens
tactgggtgtcatttcattcca

SEQ ID NO: 4330781 - DNA, 19 bp, Homo sapiens
tacttaaatatttgtaatt

SEQ ID NO: 4330782 - DNA, 20 bp, Homo sapiens
tacttctgagccccagcccc

SEQ ID NO: 4330783 - DNA, 12 bp, Homo sapiens
tacttgcactgt

SEQ ID NO: 4330784 - DNA, 15 bp, Homo sapiens
tactttaacctccct

SEQ ID NO: 4330785 - DNA, 21 bp, Homo sapiens
tactttgtggaccaattattg

SEQ ID NO: 4330786 - DNA, 14 bp, Homo sapiens
agaaacatacacaa

SEQ ID NO: 4330787 - DNA, 16 bp, Homo sapiens
agaaacatacacaagg

SEQ ID NO: 4330788 - DNA, 15 bp, Homo sapiens
agaaacccacagaag

SEQ ID NO: 4330789 - DNA, 19 bp, Homo sapiens
agaaacccacagaagggga

SEQ ID NO: 4330790 - DNA, 17 bp, Homo sapiens
agaaacttttgaaaaag

SEQ ID NO: 4330791 - DNA, 19 bp, Homo sapiens
agaaagatttggaaaattc

SEQ ID NO: 4330792 - DNA, 16 bp, Homo sapiens
agaaatagttgtctgt

SEQ ID NO: 4330793 - DNA, 19 bp, Homo sapiens
agaaatagttgtctgtgct

SEQ ID NO: 4330794 - DNA, 13 bp, Homo sapiens
agaaatcagaatt

SEQ ID NO: 4330795 - DNA, 14 bp, Homo sapiens
agaaatgaagcaga

SEQ ID NO: 4330796 - DNA, 20 bp, Homo sapiens
agaaatgaagcagaggaagg

SEQ ID NO: 4330797 - DNA, 21 bp, Homo sapiens
agaaattatacgtacatacac

SEQ ID NO: 4330798 - DNA, 20 bp, Homo sapiens
agaacaaacacctccccagc

SEQ ID NO: 4330799 - DNA, 21 bp, Homo sapiens
agaacatccccactgtcatgt

SEQ ID NO: 4330800 - DNA, 15 bp, Homo sapiens
agaacatgaatctct

SEQ ID NO: 4330801 - DNA, 19 bp, Homo sapiens
agaacatggccaatagtca

SEQ ID NO: 4330802 - DNA, 20 bp, Homo sapiens
agaaccaaaagttttcctga

SEQ ID NO: 4330803 - DNA, 13 bp, Homo sapiens
agaactcagtgcc

SEQ ID NO: 4330804 - DNA, 14 bp, Homo sapiens
agaactcagtgcca

SEQ ID NO: 4330805 - DNA, 19 bp, Homo sapiens
agaactcagtgccacacct

SEQ ID NO: 4330806 - DNA, 23 bp, Homo sapiens
agaagaaaatggatgacaaagaa

SEQ ID NO: 4330807 - DNA, 12 bp, Homo sapiens
agaagaaaattc

SEQ ID NO: 4330808 - DNA, 16 bp, Homo sapiens
agaagaaaattctcct

SEQ ID NO: 4330809 - DNA, 17 bp, Homo sapiens
agaagaaaattctcctg

SEQ ID NO: 4330810 - DNA, 14 bp, Homo sapiens
agaagaagaggaag

SEQ ID NO: 4330811 - DNA, 18 bp, Homo sapiens
agaagacactaattcctt

SEQ ID NO: 4330812 - DNA, 21 bp, Homo sapiens
agaagagattgtggtttcatt

SEQ ID NO: 4330813 - DNA, 22 bp, Homo sapiens
actcatgtgcgtttcatgtgtt

SEQ ID NO: 4330814 - DNA, 13 bp, Homo sapiens
actccagcctggg

SEQ ID NO: 4330815 - DNA, 14 bp, Homo sapiens
actccccacgggaa

SEQ ID NO: 4330816 - DNA, 22 bp, Homo sapiens
actcgcctactaagtacccttg

SEQ ID NO: 4330817 - DNA, 14 bp, Homo sapiens
actctaaaaataga

SEQ ID NO: 4330818 - DNA, 18 bp, Homo sapiens
actctataaagaaacttt

SEQ ID NO: 4330819 - DNA, 22 bp, Homo sapiens
actctcagcccagaagaaaatt

SEQ ID NO: 4330820 - DNA, 20 bp, Homo sapiens
actctctataagtgttcagt

SEQ ID NO: 4330821 - DNA, 23 bp, Homo sapiens
actctgaactggagctgctaagc

SEQ ID NO: 4330822 - DNA, 15 bp, Homo sapiens
actctgccagaaaaa

SEQ ID NO: 4330823 - DNA, 22 bp, Homo sapiens
actctgccagaaaaaaataact

SEQ ID NO: 4330824 - DNA, 16 bp, Homo sapiens
actcttaaatcatttg

SEQ ID NO: 4330825 - DNA, 20 bp, Homo sapiens
actcttaaatcatttggtta

SEQ ID NO: 4330826 - DNA, 13 bp, Homo sapiens
actcttaatttta

SEQ ID NO: 4330827 - DNA, 12 bp, Homo sapiens
actgaagctggg

SEQ ID NO: 4330828 - DNA, 13 bp, Homo sapiens
actgaagctgggg

SEQ ID NO: 4330829 - DNA, 21 bp, Homo sapiens
actgaagggaacagcctgagc

SEQ ID NO: 4330830 - DNA, 14 bp, Homo sapiens
actgaataaaaaat

SEQ ID NO: 4330831 - DNA, 11 bp, Homo sapiens
actgacatcag

SEQ ID NO: 4330832 - DNA, 15 bp, Homo sapiens
actgacatcagattt

SEQ ID NO: 4330833 - DNA, 18 bp, Homo sapiens
actgacatcagatttctt

SEQ ID NO: 4330834 - DNA, 15 bp, Homo sapiens
actgactctgttatt

SEQ ID NO: 4330835 - DNA, 16 bp, Homo sapiens
actgatagtgtccaaa

SEQ ID NO: 4330836 - DNA, 13 bp, Homo sapiens
aaaaaaaatactt

SEQ ID NO: 4330837 - DNA, 12 bp, Homo sapiens
aaaaaaataact

SEQ ID NO: 4330838 - DNA, 12 bp, Homo sapiens
aaaaacagagga

SEQ ID NO: 4330839 - DNA, 22 bp, Homo sapiens
aaaaaccacccacaaagaaaca

SEQ ID NO: 4330840 - DNA, 21 bp, Homo sapiens
aaaaacttttaggttgttacc

SEQ ID NO: 4330841 - DNA, 14 bp, Homo sapiens
aaaaagaaatgaaa

SEQ ID NO: 4330842 - DNA, 21 bp, Homo sapiens
aaaaagccctatgtgaaaaga

SEQ ID NO: 4330843 - DNA, 22 bp, Homo sapiens
aaaaagggtaacttgtttttat

SEQ ID NO: 4330844 - DNA, 14 bp, Homo sapiens
aaaaagtgtacatg

SEQ ID NO: 4330845 - DNA, 22 bp, Homo sapiens
aaaaagtgtacatgaagaatgt

SEQ ID NO: 4330846 - DNA, 22 bp, Homo sapiens
aaaaataaataaaatggataga

SEQ ID NO: 4330847 - DNA, 16 bp, Homo sapiens
aaaaattatgaaatat

SEQ ID NO: 4330848 - DNA, 22 bp, Homo sapiens
aaaacaggagcaaatggcgttt

SEQ ID NO: 4330849 - DNA, 12 bp, Homo sapiens
aaaacccaagtg

SEQ ID NO: 4330850 - DNA, 17 bp, Homo sapiens
aaaactaaagttgaaaa

SEQ ID NO: 4330851 - DNA, 18 bp, Homo sapiens
aaaactaaagttgaaaat

SEQ ID NO: 4330852 - DNA, 20 bp, Homo sapiens
aaaactgctgactgttttct

SEQ ID NO: 4330853 - DNA, 23 bp, Homo sapiens
aaaactgctgactgttttctctt

SEQ ID NO: 4330854 - DNA, 11 bp, Homo sapiens
aaaagaatgga

SEQ ID NO: 4330855 - DNA, 21 bp, Homo sapiens
aaaagaccttctccctagccc

SEQ ID NO: 4330856 - DNA, 20 bp, Homo sapiens
aaaagccctatgtgaaaaga

SEQ ID NO: 4330857 - DNA, 14 bp, Homo sapiens
aaaaggaaaaatgt

SEQ ID NO: 4330858 - DNA, 15 bp, Homo sapiens
aaaaggatagtattt

SEQ ID NO: 4330859 - DNA, 17 bp, Homo sapiens
aaaaggatgatggaaaa

SEQ ID NO: 4330860 - DNA, 12 bp, Homo sapiens
aaaagggaagta

SEQ ID NO: 4330861 - DNA, 18 bp, Homo sapiens
aaaagggaagtagtcctt

SEQ ID NO: 4330862 - DNA, 14 bp, Homo sapiens
aaaagtcagagtta

SEQ ID NO: 4330863 - DNA, 23 bp, Homo sapiens
aaaagtcgttttccaaactgact

SEQ ID NO: 4330864 - DNA, 17 bp, Homo sapiens
aaaagtggcatagagaa

SEQ ID NO: 4330865 - DNA, 10 bp, Homo sapiens
aaaatagaca

SEQ ID NO: 4330866 - DNA, 12 bp, Homo sapiens
aaaatagcctgc

SEQ ID NO: 4330867 - DNA, 15 bp, Homo sapiens
aaaatatatatataa

SEQ ID NO: 4330868 - DNA, 20 bp, Homo sapiens
aaaatatatatataaaatat

SEQ ID NO: 4330869 - DNA, 15 bp, Homo sapiens
aaaatattcaagtaa

SEQ ID NO: 4330870 - DNA, 18 bp, Homo sapiens
aaaatcacattttaagtg

SEQ ID NO: 4330871 - DNA, 16 bp, Homo sapiens
aaaatcatattgagaa

SEQ ID NO: 4330872 - DNA, 15 bp, Homo sapiens
aaaatctgattagaa

SEQ ID NO: 4330873 - DNA, 17 bp, Homo sapiens
aaaatgagaatctgtgc

SEQ ID NO: 4330874 - DNA, 21 bp, Homo sapiens
aaaatgagcctggcaagaatg

SEQ ID NO: 4330875 - DNA, 20 bp, Homo sapiens
aaaatgcattttcttcagaa

SEQ ID NO: 4330876 - DNA, 17 bp, Homo sapiens
aaaattcacagagtttc

SEQ ID NO: 4330877 - DNA, 13 bp, Homo sapiens
aaaattctcctga

SEQ ID NO: 4330878 - DNA, 13 bp, Homo sapiens
aaaatttatttca

SEQ ID NO: 4330879 - DNA, 14 bp, Homo sapiens
aaaatttcacagtt

SEQ ID NO: 4330880 - DNA, 13 bp, Homo sapiens
aaacaaaatttca

SEQ ID NO: 4330881 - DNA, 17 bp, Homo sapiens
aaacaaaatttcacagt

SEQ ID NO: 4330882 - DNA, 18 bp, Homo sapiens
aaacaaaatttcacagtt

SEQ ID NO: 4330883 - DNA, 23 bp, Homo sapiens
aaacaaaatttcacagttctgta

SEQ ID NO: 4330884 - DNA, 13 bp, Homo sapiens
aaacaaacttctc

SEQ ID NO: 4330885 - DNA, 22 bp, Homo sapiens
aaacaaacttctcgcaactgaa

SEQ ID NO: 4330886 - DNA, 20 bp, Homo sapiens
aaacaacagctcgatccaaa

SEQ ID NO: 4330887 - DNA, 22 bp, Homo sapiens
aaacaacagctcgatccaaatt

SEQ ID NO: 4330888 - DNA, 15 bp, Homo sapiens
aaacaatttgcataa

SEQ ID NO: 4330889 - DNA, 13 bp, Homo sapiens
aaacacctcccca

SEQ ID NO: 4330890 - DNA, 17 bp, Homo sapiens
aaacacctccccagccc

SEQ ID NO: 4330891 - DNA, 12 bp, Homo sapiens
aaacactaacaa

SEQ ID NO: 4330892 - DNA, 17 bp, Homo sapiens
aaacactaacaaaattt

SEQ ID NO: 4330893 - DNA, 21 bp, Homo sapiens
aaacacttattgtttgaaaga

SEQ ID NO: 4330894 - DNA, 22 bp, Homo sapiens
aaacacttattgtttgaaagac

SEQ ID NO: 4330895 - DNA, 17 bp, Homo sapiens
aaacagaggatgctgaa

SEQ ID NO: 4330896 - DNA, 19 bp, Homo sapiens
aaacagaggatgctgaagt

SEQ ID NO: 4330897 - DNA, 13 bp, Homo sapiens
aaacatagaaaga

SEQ ID NO: 4330898 - DNA, 15 bp, Homo sapiens
aaacatagaaagaca

SEQ ID NO: 4330899 - DNA, 16 bp, Homo sapiens
aaacatagaaagacat

SEQ ID NO: 4330900 - DNA, 13 bp, Homo sapiens
aaacatgtattta

SEQ ID NO: 4330901 - DNA, 19 bp, Homo sapiens
aaacatgtgcagatatcca

SEQ ID NO: 4330902 - DNA, 17 bp, Homo sapiens
aaacatgtgcccctgcc

SEQ ID NO: 4330903 - DNA, 23 bp, Homo sapiens
aaaccaagtcaagtgaaaaagga

SEQ ID NO: 4330904 - DNA, 16 bp, Homo sapiens
aaaccgccaaggctgg

SEQ ID NO: 4330905 - DNA, 19 bp, Homo sapiens
aaacgttgacccctttccc

SEQ ID NO: 4330906 - DNA, 21 bp, Homo sapiens
aaactaaagttgaaaatacat

SEQ ID NO: 4330907 - DNA, 22 bp, Homo sapiens
aaactatgtgttcaatgaaata

SEQ ID NO: 4330908 - DNA, 14 bp, Homo sapiens
aaactctataaaga

SEQ ID NO: 4330909 - DNA, 18 bp, Homo sapiens
aaactctataaagaaact

SEQ ID NO: 4330910 - DNA, 14 bp, Homo sapiens
aaactctgccagaa

SEQ ID NO: 4330911 - DNA, 14 bp, Homo sapiens
aaactgacatcaga

SEQ ID NO: 4330912 - DNA, 17 bp, Homo sapiens
aaactgcttacagttta

SEQ ID NO: 4330913 - DNA, 15 bp, Homo sapiens
aaactgctttatttt

SEQ ID NO: 4330914 - DNA, 17 bp, Homo sapiens
aaactgctttgtgcata

SEQ ID NO: 4330915 - DNA, 23 bp, Homo sapiens
aaacttctcgcaactgaaggaag

SEQ ID NO: 4330916 - DNA, 13 bp, Homo sapiens
aaacttgtgtatt

SEQ ID NO: 4330917 - DNA, 14 bp, Homo sapiens
aaactttgaataaa

SEQ ID NO: 4330918 - DNA, 15 bp, Homo sapiens
aaactttgaataaaa

SEQ ID NO: 4330919 - DNA, 19 bp, Homo sapiens
aaactttgaataaaagaat

SEQ ID NO: 4330920 - DNA, 13 bp, Homo sapiens
aaacttttgaaaa

SEQ ID NO: 4330921 - DNA, 13 bp, Homo sapiens
aaagaaacttttg

SEQ ID NO: 4330922 - DNA, 16 bp, Homo sapiens
aaagaaacttttgaaa

SEQ ID NO: 4330923 - DNA, 19 bp, Homo sapiens
aaagaaacttttgaaaaag

SEQ ID NO: 4330924 - DNA, 22 bp, Homo sapiens
aaagaaccaaaagttttcctga

SEQ ID NO: 4330925 - DNA, 14 bp, Homo sapiens
aaagactattttct

SEQ ID NO: 4330926 - DNA, 15 bp, Homo sapiens
aaagaggaggcagaa

SEQ ID NO: 4330927 - DNA, 14 bp, Homo sapiens
aaagagtgagaact

SEQ ID NO: 4330928 - DNA, 12 bp, Homo sapiens
aaagagttagaa

SEQ ID NO: 4330929 - DNA, 12 bp, Homo sapiens
aaagatgacaaa

SEQ ID NO: 4330930 - DNA, 14 bp, Homo sapiens
aaagatgcttctca

SEQ ID NO: 4330931 - DNA, 13 bp, Homo sapiens
aaagatttcagta

SEQ ID NO: 4330932 - DNA, 23 bp, Homo sapiens
aaagatttcagtagaattttagt

SEQ ID NO: 4330933 - DNA, 15 bp, Homo sapiens
aaagatttggaaaat

SEQ ID NO: 4330934 - DNA, 18 bp, Homo sapiens
aaagatttggaaaattca

SEQ ID NO: 4330935 - DNA, 17 bp, Homo sapiens
aaagcaattaaatgata

SEQ ID NO: 4330936 - DNA, 13 bp, Homo sapiens
aaagcacaagaag

SEQ ID NO: 4330937 - DNA, 16 bp, Homo sapiens
aaagcacaagaagcgt

SEQ ID NO: 4330938 - DNA, 18 bp, Homo sapiens
aaagcactagagaatgca

SEQ ID NO: 4330939 - DNA, 15 bp, Homo sapiens
aaagcagtaaaataa

SEQ ID NO: 4330940 - DNA, 15 bp, Homo sapiens
aaccaaagctggccc

SEQ ID NO: 4330941 - DNA, 17 bp, Homo sapiens
aaccaatagaaagcaaa

SEQ ID NO: 4330942 - DNA, 15 bp, Homo sapiens
aaccacccgccccgc

SEQ ID NO: 4330943 - DNA, 14 bp, Homo sapiens
aaccattgtcttgt

SEQ ID NO: 4330944 - DNA, 21 bp, Homo sapiens
aaccatttaaagaaagaatgc

SEQ ID NO: 4330945 - DNA, 20 bp, Homo sapiens
aacccagcagttctctgcca

SEQ ID NO: 4330946 - DNA, 17 bp, Homo sapiens
aacccatgaagctggcc

SEQ ID NO: 4330947 - DNA, 15 bp, Homo sapiens
aaccccaggtgagac

SEQ ID NO: 4330948 - DNA, 17 bp, Homo sapiens
aacccccttttcccttc

SEQ ID NO: 4330949 - DNA, 19 bp, Homo sapiens
aacccggtgcatctggcac

SEQ ID NO: 4330950 - DNA, 21 bp, Homo sapiens
aacccgttgggtcccttgctg

SEQ ID NO: 4330951 - DNA, 18 bp, Homo sapiens
aacctccctcaacaaggt

SEQ ID NO: 4330952 - DNA, 13 bp, Homo sapiens
aaccttgcaaact

SEQ ID NO: 4330953 - DNA, 20 bp, Homo sapiens
aaccttgcaaactctataaa

SEQ ID NO: 4330954 - DNA, 15 bp, Homo sapiens
aacgttgaccccttt

SEQ ID NO: 4330955 - DNA, 18 bp, Homo sapiens
aacgttgacccctttccc

SEQ ID NO: 4330956 - DNA, 18 bp, Homo sapiens
aactaaagttgaaaatac

SEQ ID NO: 4330957 - DNA, 19 bp, Homo sapiens
aactaaagttgaaaataca

SEQ ID NO: 4330958 - DNA, 20 bp, Homo sapiens
aactaactgactctgttatt

SEQ ID NO: 4330959 - DNA, 14 bp, Homo sapiens
aactacatctgcct

SEQ ID NO: 4330960 - DNA, 15 bp, Homo sapiens
aactacatctgcctc

SEQ ID NO: 4330961 - DNA, 16 bp, Homo sapiens
aactactgacgaaaga

SEQ ID NO: 4330962 - DNA, 17 bp, Homo sapiens
aactactgacgaaagag

SEQ ID NO: 4330963 - DNA, 23 bp, Homo sapiens
aactactgctattttttttaaat

SEQ ID NO: 4330964 - DNA, 16 bp, Homo sapiens
aactatattttcttta

SEQ ID NO: 4330965 - DNA, 16 bp, Homo sapiens
aactattttgttttaa

SEQ ID NO: 4330966 - DNA, 21 bp, Homo sapiens
aactcaaggaggtggtgaatt

SEQ ID NO: 4330967 - DNA, 17 bp, Homo sapiens
aactcagtgccacacct

SEQ ID NO: 4330968 - DNA, 16 bp, Homo sapiens
aactctataaagaaac

SEQ ID NO: 4330969 - DNA, 18 bp, Homo sapiens
aactctataaagaaactt

SEQ ID NO: 4330970 - DNA, 23 bp, Homo sapiens
aactctgccagaaaaaaataact

SEQ ID NO: 4330971 - DNA, 14 bp, Homo sapiens
aactgaaggaaggc

SEQ ID NO: 4330972 - DNA, 15 bp, Homo sapiens
aactgaataaaaaat

SEQ ID NO: 4330973 - DNA, 14 bp, Homo sapiens
aactgacatcagat

SEQ ID NO: 4330974 - DNA, 21 bp, Homo sapiens
aactgacatcagatttcttaa

SEQ ID NO: 4330975 - DNA, 15 bp, Homo sapiens
aactgctgactgttt

SEQ ID NO: 4330976 - DNA, 20 bp, Homo sapiens
aactggaattaaaaggatag

SEQ ID NO: 4330977 - DNA, 13 bp, Homo sapiens
aactggggaaaag

SEQ ID NO: 4330978 - DNA, 18 bp, Homo sapiens
aactggggaaaaggatga

SEQ ID NO: 4330979 - DNA, 17 bp, Homo sapiens
aactgttcctactttgt

SEQ ID NO: 4330980 - DNA, 11 bp, Homo sapiens
aacttgtgaat

SEQ ID NO: 4330981 - DNA, 17 bp, Homo sapiens
aacttgtgaatgcttct

SEQ ID NO: 4330982 - DNA, 17 bp, Homo sapiens
aactttaaagataagtc

SEQ ID NO: 4330983 - DNA, 18 bp, Homo sapiens
aactttgcaaattattta

SEQ ID NO: 4330984 - DNA, 23 bp, Homo sapiens
aacttttcatttcagattttaaa

SEQ ID NO: 4330985 - DNA, 18 bp, Homo sapiens
aagaaaaatgagcctggc

SEQ ID NO: 4330986 - DNA, 23 bp, Homo sapiens
aagaaaattctctcaagacttct

SEQ ID NO: 4330987 - DNA, 16 bp, Homo sapiens
aagaaacaaagcaaat

SEQ ID NO: 4330988 - DNA, 11 bp, Homo sapiens
aagaaactttt

SEQ ID NO: 4330989 - DNA, 16 bp, Homo sapiens
aagaacatgaatctct

SEQ ID NO: 4330990 - DNA, 17 bp, Homo sapiens
aagaactgaatccatat

SEQ ID NO: 4330991 - DNA, 21 bp, Homo sapiens
aagaagatcacgctccccgcc

SEQ ID NO: 4330992 - DNA, 15 bp, Homo sapiens
aagaagctctctcct

SEQ ID NO: 4330993 - DNA, 20 bp, Homo sapiens
aagaaggagctcaactaaaa

SEQ ID NO: 4330994 - DNA, 11 bp, Homo sapiens
aagaaggaggt

SEQ ID NO: 4330995 - DNA, 12 bp, Homo sapiens
aagaatatatat

SEQ ID NO: 4330996 - DNA, 21 bp, Homo sapiens
aagaatgagaaggagtcagaa

SEQ ID NO: 4330997 - DNA, 16 bp, Homo sapiens
aagaattgaagcagga

SEQ ID NO: 4330998 - DNA, 17 bp, Homo sapiens
aagaatttctggaagaa

SEQ ID NO: 4330999 - DNA, 19 bp, Homo sapiens
aagacactaattccttaaa

SEQ ID NO: 4331000 - DNA, 23 bp, Homo sapiens
aagacagagcagatcagtctttg

SEQ ID NO: 4331001 - DNA, 18 bp, Homo sapiens
aagacaggagtttatcta

SEQ ID NO: 4331002 - DNA, 13 bp, Homo sapiens
aagacatctgcct

SEQ ID NO: 4331003 - DNA, 14 bp, Homo sapiens
aagacatctgcctg

SEQ ID NO: 4331004 - DNA, 14 bp, Homo sapiens
aagacatgcttggg

SEQ ID NO: 4331005 - DNA, 18 bp, Homo sapiens
aagacccaacttgccaaa

SEQ ID NO: 4331006 - DNA, 14 bp, Homo sapiens
aagaccctttgttg

SEQ ID NO: 4331007 - DNA, 20 bp, Homo sapiens
aagaccctttgttgaaaaat

SEQ ID NO: 4331008 - DNA, 18 bp, Homo sapiens
aagaccttctccctagcc

SEQ ID NO: 4331009 - DNA, 15 bp, Homo sapiens
aagacttacctgaat

SEQ ID NO: 4331010 - DNA, 17 bp, Homo sapiens
aagacttacctgaataa

SEQ ID NO: 4331011 - DNA, 15 bp, Homo sapiens
aagagatgaaataat

SEQ ID NO: 4331012 - DNA, 17 bp, Homo sapiens
aagagatgaaataattt

SEQ ID NO: 4331013 - DNA, 17 bp, Homo sapiens
aagaggaggcagaaaga

SEQ ID NO: 4331014 - DNA, 20 bp, Homo sapiens
aagaggcttccaagcattac

SEQ ID NO: 4331015 - DNA, 16 bp, Homo sapiens
aagagggacagagccc

SEQ ID NO: 4331016 - DNA, 15 bp, Homo sapiens
aagagggagacagag

SEQ ID NO: 4331017 - DNA, 16 bp, Homo sapiens
aagagggagacagaga

SEQ ID NO: 4331018 - DNA, 22 bp, Homo sapiens
aagataatggataatcttcggc

SEQ ID NO: 4331019 - DNA, 15 bp, Homo sapiens
aagatatggagaatt

SEQ ID NO: 4331020 - DNA, 16 bp, Homo sapiens
aagatcacgctccccg

SEQ ID NO: 4331021 - DNA, 19 bp, Homo sapiens
aagatcacgctccccgcct

SEQ ID NO: 4331022 - DNA, 19 bp, Homo sapiens
aagatgcttctcactgcca

SEQ ID NO: 4331023 - DNA, 19 bp, Homo sapiens
aagatggagaggaagaaac

SEQ ID NO: 4331024 - DNA, 17 bp, Homo sapiens
aagatgttcaatagaac

SEQ ID NO: 4331025 - DNA, 18 bp, Homo sapiens
aagattagggaaaatgga

SEQ ID NO: 4331026 - DNA, 12 bp, Homo sapiens
aagatttggaaa

SEQ ID NO: 4331027 - DNA, 14 bp, Homo sapiens
aagatttggaaaat

SEQ ID NO: 4331028 - DNA, 16 bp, Homo sapiens
aagcaaagatttcagt

SEQ ID NO: 4331029 - DNA, 22 bp, Homo sapiens
aagcaaagatttcagtagaatt

SEQ ID NO: 4331030 - DNA, 12 bp, Homo sapiens
aagcaagaagaa

SEQ ID NO: 4331031 - DNA, 16 bp, Homo sapiens
aagcagaggaaggaaa

SEQ ID NO: 4331032 - DNA, 17 bp, Homo sapiens
aagcagaggaaggaaac

SEQ ID NO: 4331033 - DNA, 13 bp, Homo sapiens
aagcagtaaaata

SEQ ID NO: 4331034 - DNA, 18 bp, Homo sapiens
aagcagtaaaataaaaaa

SEQ ID NO: 4331035 - DNA, 16 bp, Homo sapiens
aagcatggattttccc

SEQ ID NO: 4331036 - DNA, 19 bp, Homo sapiens
aagcattactttaacctcc

SEQ ID NO: 4331037 - DNA, 20 bp, Homo sapiens
aagcatttttccatctgtgt

SEQ ID NO: 4331038 - DNA, 23 bp, Homo sapiens
aagccactagcccactccccagt

SEQ ID NO: 4331039 - DNA, 23 bp, Homo sapiens
aagccatcatcagcttaatttaa

SEQ ID NO: 4331040 - DNA, 18 bp, Homo sapiens
aagccggtggggggatga

SEQ ID NO: 4331041 - DNA, 20 bp, Homo sapiens
aagcctgcccttgtctgaga

SEQ ID NO: 4331042 - DNA, 16 bp, Homo sapiens
aagccttactcacctc

SEQ ID NO: 4331043 - DNA, 18 bp, Homo sapiens
aagccttactcacctctc

SEQ ID NO: 4331044 - DNA, 22 bp, Homo sapiens
aagcgctgttgcccgccctcca

SEQ ID NO: 4331045 - DNA, 23 bp, Homo sapiens
aagctcaggaggcgaataaatgt

SEQ ID NO: 4331046 - DNA, 21 bp, Homo sapiens
aagctccattgggactgattt

SEQ ID NO: 4331047 - DNA, 21 bp, Homo sapiens
aagctcccacacccacctctg

SEQ ID NO: 4331048 - DNA, 19 bp, Homo sapiens
aagctgcaccctcaggcag

SEQ ID NO: 4331049 - DNA, 20 bp, Homo sapiens
aagctgcaccctcaggcagg

SEQ ID NO: 4331050 - DNA, 13 bp, Homo sapiens
aagctgggcaggt

SEQ ID NO: 4331051 - DNA, 13 bp, Homo sapiens
aagctggggcttg

SEQ ID NO: 4331052 - DNA, 22 bp, Homo sapiens
aagcttacttccattgcaaaat

SEQ ID NO: 4331053 - DNA, 18 bp, Homo sapiens
aagcttctagacactcct

SEQ ID NO: 4331054 - DNA, 22 bp, Homo sapiens
aagcttctagacactccttgaa

SEQ ID NO: 4331055 - DNA, 13 bp, Homo sapiens
aagcttgtggagg

SEQ ID NO: 4331056 - DNA, 16 bp, Homo sapiens
aagctttatctttgtg

SEQ ID NO: 4331057 - DNA, 21 bp, Homo sapiens
aaggaaaaagcacaagaagcg

SEQ ID NO: 4331058 - DNA, 13 bp, Homo sapiens
aaggaaacataga

SEQ ID NO: 4331059 - DNA, 14 bp, Homo sapiens
aaggaaacatagaa

SEQ ID NO: 4331060 - DNA, 19 bp, Homo sapiens
aaggaaacatagaaagaca

SEQ ID NO: 4331061 - DNA, 19 bp, Homo sapiens
aaagcagtaaaataaaaaa

SEQ ID NO: 4331062 - DNA, 18 bp, Homo sapiens
aaagccttttaaatcatc

SEQ ID NO: 4331063 - DNA, 12 bp, Homo sapiens
aaagcttatttt

SEQ ID NO: 4331064 - DNA, 17 bp, Homo sapiens
aaagcttatttttatgt

SEQ ID NO: 4331065 - DNA, 15 bp, Homo sapiens
aaagctttatctttg

SEQ ID NO: 4331066 - DNA, 17 bp, Homo sapiens
aaagctttatctttgtg

SEQ ID NO: 4331067 - DNA, 19 bp, Homo sapiens
aaagctttatctttgtgta

SEQ ID NO: 4331068 - DNA, 11 bp, Homo sapiens
aaaggaaaaat

SEQ ID NO: 4331069 - DNA, 16 bp, Homo sapiens
aaaggaccgttttgta

SEQ ID NO: 4331070 - DNA, 21 bp, Homo sapiens
aaaggatagtatttttatcca

SEQ ID NO: 4331071 - DNA, 15 bp, Homo sapiens
aaaggatgatggaaa

SEQ ID NO: 4331072 - DNA, 18 bp, Homo sapiens
aaaggatgatggaaaaat

SEQ ID NO: 4331073 - DNA, 22 bp, Homo sapiens
aaaggggtgattgaaagaaaaa

SEQ ID NO: 4331074 - DNA, 17 bp, Homo sapiens
aaagtatagagagaagt

SEQ ID NO: 4331075 - DNA, 12 bp, Homo sapiens
aaagtcattatt

SEQ ID NO: 4331076 - DNA, 15 bp, Homo sapiens
aaagtcattattcct

SEQ ID NO: 4331077 - DNA, 15 bp, Homo sapiens
aaagtcgttttccaa

SEQ ID NO: 4331078 - DNA, 16 bp, Homo sapiens
aaagtcgttttccaaa

SEQ ID NO: 4331079 - DNA, 13 bp, Homo sapiens
aaagtggaaaaat

SEQ ID NO: 4331080 - DNA, 16 bp, Homo sapiens
aaagtggggtacagta

SEQ ID NO: 4331081 - DNA, 21 bp, Homo sapiens
aaagtgtacatgaagaatgta

SEQ ID NO: 4331082 - DNA, 16 bp, Homo sapiens
aaataaaatggataga

SEQ ID NO: 4331083 - DNA, 14 bp, Homo sapiens
aaataaactgtttt

SEQ ID NO: 4331084 - DNA, 18 bp, Homo sapiens
aaataaactgttttcaag

SEQ ID NO: 4331085 - DNA, 10 bp, Homo sapiens
aaataaagaa

SEQ ID NO: 4331086 - DNA, 12 bp, Homo sapiens
aaataaagcctt

SEQ ID NO: 4331087 - DNA, 16 bp, Homo sapiens
aaataaagccttttaa

SEQ ID NO: 4331088 - DNA, 16 bp, Homo sapiens
aaataaataaaatgga

SEQ ID NO: 4331089 - DNA, 15 bp, Homo sapiens
aaataaatagaaaga

SEQ ID NO: 4331090 - DNA, 12 bp, Homo sapiens
aaataactattt

SEQ ID NO: 4331091 - DNA, 13 bp, Homo sapiens
aaataactatttt

SEQ ID NO: 4331092 - DNA, 15 bp, Homo sapiens
aaataactattttgt

SEQ ID NO: 4331093 - DNA, 19 bp, Homo sapiens
aaataactattttgtttta

SEQ ID NO: 4331094 - DNA, 23 bp, Homo sapiens
aaataattgatcagatgctgaat

SEQ ID NO: 4331095 - DNA, 15 bp, Homo sapiens
aaatacattcttaaa

SEQ ID NO: 4331096 - DNA, 16 bp, Homo sapiens
aaatacattcttaaac

SEQ ID NO: 4331097 - DNA, 12 bp, Homo sapiens
aaatactagtgg

SEQ ID NO: 4331098 - DNA, 17 bp, Homo sapiens
aaatacttaaatatttg

SEQ ID NO: 4331099 - DNA, 15 bp, Homo sapiens
aaatagaaagagttc

SEQ ID NO: 4331100 - DNA, 23 bp, Homo sapiens
aaatagaaagagttctatggaga

SEQ ID NO: 4331101 - DNA, 14 bp, Homo sapiens
aaatagttgtctgt

SEQ ID NO: 4331102 - DNA, 19 bp, Homo sapiens
aaatagtttccaagaaatt

SEQ ID NO: 4331103 - DNA, 20 bp, Homo sapiens
aaatagtttccaagaaattt

SEQ ID NO: 4331104 - DNA, 21 bp, Homo sapiens
aaatatatataaagaatatat

SEQ ID NO: 4331105 - DNA, 13 bp, Homo sapiens
aaatatatgtata

SEQ ID NO: 4331106 - DNA, 12 bp, Homo sapiens
aaatattggtta

SEQ ID NO: 4331107 - DNA, 23 bp, Homo sapiens
aaatatttttttctttttaaaat

SEQ ID NO: 4331108 - DNA, 12 bp, Homo sapiens
aaatcaaaaact

SEQ ID NO: 4331109 - DNA, 15 bp, Homo sapiens
aaatcaaaaactttt

SEQ ID NO: 4331110 - DNA, 17 bp, Homo sapiens
aaatcaaaaacttttca

SEQ ID NO: 4331111 - DNA, 21 bp, Homo sapiens
aaatcaaaaacttttcatttc

SEQ ID NO: 4331112 - DNA, 20 bp, Homo sapiens
aaatcacattttaagtgctt

SEQ ID NO: 4331113 - DNA, 18 bp, Homo sapiens
aaatcagcctgctccagc

SEQ ID NO: 4331114 - DNA, 19 bp, Homo sapiens
aaatcagcctgctccagct

SEQ ID NO: 4331115 - DNA, 21 bp, Homo sapiens
aaatcagcctgctccagctgt

SEQ ID NO: 4331116 - DNA, 17 bp, Homo sapiens
aaatcatagtatatgat

SEQ ID NO: 4331117 - DNA, 20 bp, Homo sapiens
aaatcatttggcttgctgtt

SEQ ID NO: 4331118 - DNA, 18 bp, Homo sapiens
aaatcccttacctcggtg

SEQ ID NO: 4331119 - DNA, 17 bp, Homo sapiens
aaatcgatccatgtttt

SEQ ID NO: 4331120 - DNA, 16 bp, Homo sapiens
aaatctatgatatatt

SEQ ID NO: 4331121 - DNA, 23 bp, Homo sapiens
aaatctggggaagaggttttatt

SEQ ID NO: 4331122 - DNA, 14 bp, Homo sapiens
aaatgaaattgaca

SEQ ID NO: 4331123 - DNA, 19 bp, Homo sapiens
aaatgaactactgctattt

SEQ ID NO: 4331124 - DNA, 21 bp, Homo sapiens
aaatgaactactgctattttt

SEQ ID NO: 4331125 - DNA, 16 bp, Homo sapiens
aaatgaagcagaggaa

SEQ ID NO: 4331126 - DNA, 15 bp, Homo sapiens
aaatgaatattttga

SEQ ID NO: 4331127 - DNA, 18 bp, Homo sapiens
aaatgaatattttgataa

SEQ ID NO: 4331128 - DNA, 20 bp, Homo sapiens
aaatgaatggacaaagctca

SEQ ID NO: 4331129 - DNA, 15 bp, Homo sapiens
aaatgaatgttgtct

SEQ ID NO: 4331130 - DNA, 13 bp, Homo sapiens
aaatgcattttct

SEQ ID NO: 4331131 - DNA, 20 bp, Homo sapiens
aaatgcattttcttcagaat

SEQ ID NO: 4331132 - DNA, 11 bp, Homo sapiens
aaatgccaaaa

SEQ ID NO: 4331133 - DNA, 14 bp, Homo sapiens
aaatgccatgaaaa

SEQ ID NO: 4331134 - DNA, 13 bp, Homo sapiens
aaatgcccagctt

SEQ ID NO: 4331135 - DNA, 20 bp, Homo sapiens
aaatgcccatttttgctaat

SEQ ID NO: 4331136 - DNA, 19 bp, Homo sapiens
aaatggactggtttgagat

SEQ ID NO: 4331137 - DNA, 19 bp, Homo sapiens
aaatggatagaaaaaaact

SEQ ID NO: 4331138 - DNA, 17 bp, Homo sapiens
aaatggatgacaaagaa

SEQ ID NO: 4331139 - DNA, 21 bp, Homo sapiens
aaatggtttctcattaaactc

SEQ ID NO: 4331140 - DNA, 22 bp, Homo sapiens
aaatgtaatgtcagactttgct

SEQ ID NO: 4331141 - DNA, 19 bp, Homo sapiens
aaatgtctagttgtaacac

SEQ ID NO: 4331142 - DNA, 15 bp, Homo sapiens
aaatgtggtgagaat

SEQ ID NO: 4331143 - DNA, 18 bp, Homo sapiens
aaatgtggtgagaatgca

SEQ ID NO: 4331144 - DNA, 15 bp, Homo sapiens
aaatgttaagaaaga

SEQ ID NO: 4331145 - DNA, 11 bp, Homo sapiens
aaatgttggct

SEQ ID NO: 4331146 - DNA, 20 bp, Homo sapiens
aaatgtttacagggagcctc

SEQ ID NO: 4331147 - DNA, 14 bp, Homo sapiens
aaatgtttcataca

SEQ ID NO: 4331148 - DNA, 12 bp, Homo sapiens
aaattaacaaga

SEQ ID NO: 4331149 - DNA, 14 bp, Homo sapiens
aaattagggcaatt

SEQ ID NO: 4331150 - DNA, 17 bp, Homo sapiens
aaattattggtatattt

SEQ ID NO: 4331151 - DNA, 19 bp, Homo sapiens
aaattattggtatatttgt

SEQ ID NO: 4331152 - DNA, 15 bp, Homo sapiens
aaattcccaaatatt

SEQ ID NO: 4331153 - DNA, 16 bp, Homo sapiens
aaattccccaccctga

SEQ ID NO: 4331154 - DNA, 21 bp, Homo sapiens
aaattccgattagacctttat

SEQ ID NO: 4331155 - DNA, 11 bp, Homo sapiens
aaattgaaaac

SEQ ID NO: 4331156 - DNA, 22 bp, Homo sapiens
aaattgacaagctaggaaagag

SEQ ID NO: 4331157 - DNA, 19 bp, Homo sapiens
aaattgcagtttcatgtat

SEQ ID NO: 4331158 - DNA, 19 bp, Homo sapiens
aaatttcacagttctgtaa

SEQ ID NO: 4331159 - DNA, 15 bp, Homo sapiens
aacaaaatttgaata

SEQ ID NO: 4331160 - DNA, 15 bp, Homo sapiens
aacaaagctgatttc

SEQ ID NO: 4331161 - DNA, 18 bp, Homo sapiens
aacaaattgtttacataa

SEQ ID NO: 4331162 - DNA, 21 bp, Homo sapiens
aacaatttgcataatactaat

SEQ ID NO: 4331163 - DNA, 22 bp, Homo sapiens
aacaatttgcataatactaatt

SEQ ID NO: 4331164 - DNA, 12 bp, Homo sapiens
aacacagagaaa

SEQ ID NO: 4331165 - DNA, 15 bp, Homo sapiens
aacacataaatgaaa

SEQ ID NO: 4331166 - DNA, 17 bp, Homo sapiens
aacacatctttcctgtc

SEQ ID NO: 4331167 - DNA, 19 bp, Homo sapiens
aacaccagcccctgcccca

SEQ ID NO: 4331168 - DNA, 19 bp, Homo sapiens
aacacctctgcacaagctg

SEQ ID NO: 4331169 - DNA, 12 bp, Homo sapiens
aacactaacaaa

SEQ ID NO: 4331170 - DNA, 19 bp, Homo sapiens
aacactaacaaaatttgaa

SEQ ID NO: 4331171 - DNA, 15 bp, Homo sapiens
aacactacagagtac

SEQ ID NO: 4331172 - DNA, 24 bp, Homo sapiens
aacagctcgatccaaattgtgctt

SEQ ID NO: 4331173 - DNA, 13 bp, Homo sapiens
aacatagaaacat

SEQ ID NO: 4331174 - DNA, 19 bp, Homo sapiens
aacatagaaacatacacaa

SEQ ID NO: 4331175 - DNA, 15 bp, Homo sapiens
aacatcttacttgtc

SEQ ID NO: 4331176 - DNA, 20 bp, Homo sapiens
aacatcttacttgtcctttg

SEQ ID NO: 4331177 - DNA, 12 bp, Homo sapiens
aacatgtattta

SEQ ID NO: 4331178 - DNA, 15 bp, Homo sapiens
aacatgtatttatgt

SEQ ID NO: 4331179 - DNA, 13 bp, Homo sapiens
aacatgtgcccct

SEQ ID NO: 4331180 - DNA, 16 bp, Homo sapiens
aacattaggaattgtt

SEQ ID NO: 4331181 - DNA, 21 bp, Homo sapiens
aacattaggaattgtttatac

SEQ ID NO: 4331182 - DNA, 20 bp, Homo sapiens
aacattgggccacttcctaa

SEQ ID NO: 4331183 - DNA, 18 bp, Homo sapiens
agatttcttaatgtctgt

SEQ ID NO: 4331184 - DNA, 22 bp, Homo sapiens
agatttcttaatgtctgtcaga

SEQ ID NO: 4331185 - DNA, 14 bp, Homo sapiens
agatttgaaaacaa

SEQ ID NO: 4331186 - DNA, 20 bp, Homo sapiens
agatttgaaaacaaacttct

SEQ ID NO: 4331187 - DNA, 19 bp, Homo sapiens
agatttgacgttgttgtca

SEQ ID NO: 4331188 - DNA, 12 bp, Homo sapiens
agatttggaaaa

SEQ ID NO: 4331189 - DNA, 13 bp, Homo sapiens
agatttgtgttat

SEQ ID NO: 4331190 - DNA, 18 bp, Homo sapiens
agattttttttttaagtg

SEQ ID NO: 4331191 - DNA, 14 bp, Homo sapiens
agcaaagatttcag

SEQ ID NO: 4331192 - DNA, 15 bp, Homo sapiens
agcaagaagaattga

SEQ ID NO: 4331193 - DNA, 14 bp, Homo sapiens
agcaaggtctcaga

SEQ ID NO: 4331194 - DNA, 21 bp, Homo sapiens
agcaaggtctcagacttaaca

SEQ ID NO: 4331195 - DNA, 14 bp, Homo sapiens
agcaatattgcctg

SEQ ID NO: 4331196 - DNA, 15 bp, Homo sapiens
agcaatattgcctgt

SEQ ID NO: 4331197 - DNA, 19 bp, Homo sapiens
agcaatattgcctgtgctt

SEQ ID NO: 4331198 - DNA, 14 bp, Homo sapiens
agcaattaaatgat

SEQ ID NO: 4331199 - DNA, 15 bp, Homo sapiens
agcaattaaatgata

SEQ ID NO: 4331200 - DNA, 14 bp, Homo sapiens
agcaattttcgaac

SEQ ID NO: 4331201 - DNA, 12 bp, Homo sapiens
agcacaagaagc

SEQ ID NO: 4331202 - DNA, 13 bp, Homo sapiens
agcacaagaagcg

SEQ ID NO: 4331203 - DNA, 11 bp, Homo sapiens
agcacaattaa

SEQ ID NO: 4331204 - DNA, 17 bp, Homo sapiens
agcacatttcctctcta

SEQ ID NO: 4331205 - DNA, 18 bp, Homo sapiens
agcacatttcctctctat

SEQ ID NO: 4331206 - DNA, 17 bp, Homo sapiens
agcactactgggtgtca

SEQ ID NO: 4331207 - DNA, 22 bp, Homo sapiens
agcactactgggtgtcatttca

SEQ ID NO: 4331208 - DNA, 16 bp, Homo sapiens
agcactagagaatgca

SEQ ID NO: 4331209 - DNA, 15 bp, Homo sapiens
agcagaggaaggaaa

SEQ ID NO: 4331210 - DNA, 16 bp, Homo sapiens
agcagaggaaggaaac

SEQ ID NO: 4331211 - DNA, 13 bp, Homo sapiens
agcaggaggtgcc

SEQ ID NO: 4331212 - DNA, 13 bp, Homo sapiens
agcaggatgccct

SEQ ID NO: 4331213 - DNA, 14 bp, Homo sapiens
agcaggatgccctg

SEQ ID NO: 4331214 - DNA, 14 bp, Homo sapiens
agcagtaaaataaa

SEQ ID NO: 4331215 - DNA, 20 bp, Homo sapiens
agcagtgttctctctgaatg

SEQ ID NO: 4331216 - DNA, 16 bp, Homo sapiens
agcagttctctgccaa

SEQ ID NO: 4331217 - DNA, 23 bp, Homo sapiens
agcataaaaattagccaagtgtg

SEQ ID NO: 4331218 - DNA, 21 bp, Homo sapiens
agcatcagcacagctctcctc

SEQ ID NO: 4331219 - DNA, 18 bp, Homo sapiens
agcatctagtttccctgg

SEQ ID NO: 4331220 - DNA, 15 bp, Homo sapiens
agcatggggcccctg

SEQ ID NO: 4331221 - DNA, 21 bp, Homo sapiens
agcatggggcccctggcccag

SEQ ID NO: 4331222 - DNA, 16 bp, Homo sapiens
agcatgtgttcattct

SEQ ID NO: 4331223 - DNA, 19 bp, Homo sapiens
agcattaactaaatgctca

SEQ ID NO: 4331224 - DNA, 21 bp, Homo sapiens
agcattaactaaatgctcata

SEQ ID NO: 4331225 - DNA, 14 bp, Homo sapiens
agcattggcccctg

SEQ ID NO: 4331226 - DNA, 15 bp, Homo sapiens
agcatttagagcttt

SEQ ID NO: 4331227 - DNA, 20 bp, Homo sapiens
agcatttagagcttttcaga

SEQ ID NO: 4331228 - DNA, 22 bp, Homo sapiens
agcatttatttctctggcaaac

SEQ ID NO: 4331229 - DNA, 15 bp, Homo sapiens
agcattttgctaaat

SEQ ID NO: 4331230 - DNA, 16 bp, Homo sapiens
agccacaccgctggct

SEQ ID NO: 4331231 - DNA, 19 bp, Homo sapiens
agccacaccgctggctccg

SEQ ID NO: 4331232 - DNA, 15 bp, Homo sapiens
agccaccttgttaca

SEQ ID NO: 4331233 - DNA, 19 bp, Homo sapiens
agccacggaaacatagaaa

SEQ ID NO: 4331234 - DNA, 20 bp, Homo sapiens
agccatgggaaatgagccag

SEQ ID NO: 4331235 - DNA, 19 bp, Homo sapiens
agcccaatggagaaatgaa

SEQ ID NO: 4331236 - DNA, 13 bp, Homo sapiens
agccccacccaga

SEQ ID NO: 4331237 - DNA, 16 bp, Homo sapiens
agccccacccagaggt

SEQ ID NO: 4331238 - DNA, 13 bp, Homo sapiens
agccccagccccg

SEQ ID NO: 4331239 - DNA, 21 bp, Homo sapiens
agccccagccccgtcccagag

SEQ ID NO: 4331240 - DNA, 19 bp, Homo sapiens
agccccgtcccagaggccg

SEQ ID NO: 4331241 - DNA, 17 bp, Homo sapiens
agcccctcatgccacag

SEQ ID NO: 4331242 - DNA, 14 bp, Homo sapiens
agcccctctcacag

SEQ ID NO: 4331243 - DNA, 21 bp, Homo sapiens
agcccctgccccagcccaagt

SEQ ID NO: 4331244 - DNA, 23 bp, Homo sapiens
agccctattggcttactgaaaga

SEQ ID NO: 4331245 - DNA, 12 bp, Homo sapiens
agccctctgtgg

SEQ ID NO: 4331246 - DNA, 18 bp, Homo sapiens
agccctctgtggccagga

SEQ ID NO: 4331247 - DNA, 18 bp, Homo sapiens
agccctggcccgcaagag

SEQ ID NO: 4331248 - DNA, 18 bp, Homo sapiens
agcccttctaccccacct

SEQ ID NO: 4331249 - DNA, 20 bp, Homo sapiens
agccgagattgcaccactgc

SEQ ID NO: 4331250 - DNA, 21 bp, Homo sapiens
agccgcgctttcccctcctcc

SEQ ID NO: 4331251 - DNA, 16 bp, Homo sapiens
agccgtgtgtgcatgt

SEQ ID NO: 4331252 - DNA, 22 bp, Homo sapiens
agcctcccacgactgcccggca

SEQ ID NO: 4331253 - DNA, 18 bp, Homo sapiens
agcctctgggatctgcca

SEQ ID NO: 4331254 - DNA, 21 bp, Homo sapiens
agcctgcggctgccgggcggg

SEQ ID NO: 4331255 - DNA, 18 bp, Homo sapiens
agcctggacccccagctt

SEQ ID NO: 4331256 - DNA, 22 bp, Homo sapiens
agcctgggtgacagagcaagtg

SEQ ID NO: 4331257 - DNA, 22 bp, Homo sapiens
agcctgtccaatttctgctgta

SEQ ID NO: 4331258 - DNA, 18 bp, Homo sapiens
agccttaagcacaattaa

SEQ ID NO: 4331259 - DNA, 19 bp, Homo sapiens
agccttaagcacaattaat

SEQ ID NO: 4331260 - DNA, 19 bp, Homo sapiens
agccttagagcatctctgc

SEQ ID NO: 4331261 - DNA, 14 bp, Homo sapiens
agccttatgtgtta

SEQ ID NO: 4331262 - DNA, 16 bp, Homo sapiens
agccttatgtgttaca

SEQ ID NO: 4331263 - DNA, 17 bp, Homo sapiens
agccttatgtgttacat

SEQ ID NO: 4331264 - DNA, 19 bp, Homo sapiens
agccttgcggaaggttcta

SEQ ID NO: 4331265 - DNA, 21 bp, Homo sapiens
agcgctgttgcccgccctcca

SEQ ID NO: 4331266 - DNA, 13 bp, Homo sapiens
agcggctggcagc

SEQ ID NO: 4331267 - DNA, 22 bp, Homo sapiens
agcgtgggctcagcagggctgg

SEQ ID NO: 4331268 - DNA, 19 bp, Homo sapiens
agcgtggtttttatgtgta

SEQ ID NO: 4331269 - DNA, 18 bp, Homo sapiens
agctaaagaaactgctta

SEQ ID NO: 4331270 - DNA, 23 bp, Homo sapiens
agctaaagaaactgcttacagtt

SEQ ID NO: 4331271 - DNA, 23 bp, Homo sapiens
agctaatctgcctggttttattt

SEQ ID NO: 4331272 - DNA, 15 bp, Homo sapiens
agctacccttttcct

SEQ ID NO: 4331273 - DNA, 21 bp, Homo sapiens
agctacccttttcctttgtgg

SEQ ID NO: 4331274 - DNA, 18 bp, Homo sapiens
agctagtgccaaataatt

SEQ ID NO: 4331275 - DNA, 14 bp, Homo sapiens
agctattaaaatgt

SEQ ID NO: 4331276 - DNA, 18 bp, Homo sapiens
agctcaatcacactggaa

SEQ ID NO: 4331277 - DNA, 23 bp, Homo sapiens
agctcaggaggcgaataaatgtt

SEQ ID NO: 4331278 - DNA, 16 bp, Homo sapiens
agctcccccaggcaga

SEQ ID NO: 4331279 - DNA, 17 bp, Homo sapiens
agctccccctgtcccct

SEQ ID NO: 4331280 - DNA, 23 bp, Homo sapiens
agctccccctgtcccctcagctc

SEQ ID NO: 4331281 - DNA, 21 bp, Homo sapiens
agctcttttttgtttgtttct

SEQ ID NO: 4331282 - DNA, 15 bp, Homo sapiens
agctgaacctgggta

SEQ ID NO: 4331283 - DNA, 12 bp, Homo sapiens
agctgaagaaat

SEQ ID NO: 4331284 - DNA, 14 bp, Homo sapiens
agctgaagaaatta

SEQ ID NO: 4331285 - DNA, 15 bp, Homo sapiens
agctgacttttctgt

SEQ ID NO: 4331286 - DNA, 21 bp, Homo sapiens
agctgacttttctgtccgagc

SEQ ID NO: 4331287 - DNA, 22 bp, Homo sapiens
agctgatttcccttttttcttc

SEQ ID NO: 4331288 - DNA, 22 bp, Homo sapiens
agctgcaccctcaggcaggtgg

SEQ ID NO: 4331289 - DNA, 14 bp, Homo sapiens
agctgctaagctaa

SEQ ID NO: 4331290 - DNA, 21 bp, Homo sapiens
agctgctaagctaaagaaact

SEQ ID NO: 4331291 - DNA, 15 bp, Homo sapiens
agctggaagcctgcc

SEQ ID NO: 4331292 - DNA, 13 bp, Homo sapiens
agctggccctcag

SEQ ID NO: 4331293 - DNA, 18 bp, Homo sapiens
agctggccctcagctccc

SEQ ID NO: 4331294 - DNA, 22 bp, Homo sapiens
agctggccctcagctccctgac

SEQ ID NO: 4331295 - DNA, 23 bp, Homo sapiens
agctggccctcagctccctgacc

SEQ ID NO: 4331296 - DNA, 21 bp, Homo sapiens
agctgggacctaatgctggcc

SEQ ID NO: 4331297 - DNA, 13 bp, Homo sapiens
agctggtatattg

SEQ ID NO: 4331298 - DNA, 23 bp, Homo sapiens
agctggtatattgtgtaaatatt

SEQ ID NO: 4331299 - DNA, 14 bp, Homo sapiens
agctgttactgtct

SEQ ID NO: 4331300 - DNA, 17 bp, Homo sapiens
agctgtttatgttttta

SEQ ID NO: 4331301 - DNA, 12 bp, Homo sapiens
agcttatctcag

SEQ ID NO: 4331302 - DNA, 18 bp, Homo sapiens
agcttcctgtctgtttat

SEQ ID NO: 4331303 - DNA, 14 bp, Homo sapiens
aatccatgcttcac

SEQ ID NO: 4331304 - DNA, 12 bp, Homo sapiens
aatcgacatcct

SEQ ID NO: 4331305 - DNA, 13 bp, Homo sapiens
aatcgatccatgt

SEQ ID NO: 4331306 - DNA, 21 bp, Homo sapiens
aatctactttttgtatttagt

SEQ ID NO: 4331307 - DNA, 16 bp, Homo sapiens
aatctatgatatattt

SEQ ID NO: 4331308 - DNA, 17 bp, Homo sapiens
aatctcctctgctcatt

SEQ ID NO: 4331309 - DNA, 19 bp, Homo sapiens
aatctgagggttaatttct

SEQ ID NO: 4331310 - DNA, 20 bp, Homo sapiens
aatctgagggttaatttcta

SEQ ID NO: 4331311 - DNA, 15 bp, Homo sapiens
aatctgattagaagt

SEQ ID NO: 4331312 - DNA, 23 bp, Homo sapiens
aatctgccgctttgtctgtccag

SEQ ID NO: 4331313 - DNA, 19 bp, Homo sapiens
aatcttagtatagtagaaa

SEQ ID NO: 4331314 - DNA, 22 bp, Homo sapiens
aatcttagtatagtagaaagac

SEQ ID NO: 4331315 - DNA, 12 bp, Homo sapiens
aatgaaaacctt

SEQ ID NO: 4331316 - DNA, 19 bp, Homo sapiens
aatgaaaagtcgttttcca

SEQ ID NO: 4331317 - DNA, 13 bp, Homo sapiens
aatgaaagaaacc

SEQ ID NO: 4331318 - DNA, 14 bp, Homo sapiens
aatgaactactgct

SEQ ID NO: 4331319 - DNA, 15 bp, Homo sapiens
aatgagggtttctga

SEQ ID NO: 4331320 - DNA, 16 bp, Homo sapiens
aatgagggtttctgat

SEQ ID NO: 4331321 - DNA, 18 bp, Homo sapiens
aatgagtaggatgtctct

SEQ ID NO: 4331322 - DNA, 17 bp, Homo sapiens
aatgatacccaacagtt

SEQ ID NO: 4331323 - DNA, 23 bp, Homo sapiens
aatgatcacatctaaagctttat

SEQ ID NO: 4331324 - DNA, 21 bp, Homo sapiens
aatgatgatcctaggcatttg

SEQ ID NO: 4331325 - DNA, 17 bp, Homo sapiens
aatgatgccctgctcca

SEQ ID NO: 4331326 - DNA, 16 bp, Homo sapiens
aatgcacagatatact

SEQ ID NO: 4331327 - DNA, 21 bp, Homo sapiens
aatgcacgcgtgcatatgcta

SEQ ID NO: 4331328 - DNA, 20 bp, Homo sapiens
aatgccaggcggacaaagtt

SEQ ID NO: 4331329 - DNA, 14 bp, Homo sapiens
aatgcccatttttg

SEQ ID NO: 4331330 - DNA, 18 bp, Homo sapiens
aatgcccgtaatgcttag

SEQ ID NO: 4331331 - DNA, 19 bp, Homo sapiens
aatgcccgtaatgcttaga

SEQ ID NO: 4331332 - DNA, 17 bp, Homo sapiens
aatgctattttaaaaaa

SEQ ID NO: 4331333 - DNA, 15 bp, Homo sapiens
aatgctcaagaatgt

SEQ ID NO: 4331334 - DNA, 19 bp, Homo sapiens
aatgctgagctgaagaaat

SEQ ID NO: 4331335 - DNA, 21 bp, Homo sapiens
aatgctggcctgactggttgt

SEQ ID NO: 4331336 - DNA, 14 bp, Homo sapiens
aatggaatccatct

SEQ ID NO: 4331337 - DNA, 20 bp, Homo sapiens
aatggacaaagctcaggaat

SEQ ID NO: 4331338 - DNA, 14 bp, Homo sapiens
aatggacattttct

SEQ ID NO: 4331339 - DNA, 19 bp, Homo sapiens
aatggagaaaatgaatgga

SEQ ID NO: 4331340 - DNA, 16 bp, Homo sapiens
aatggagtgtttgaaa

SEQ ID NO: 4331341 - DNA, 19 bp, Homo sapiens
aatggagtgtttgaaaact

SEQ ID NO: 4331342 - DNA, 20 bp, Homo sapiens
aatggagtgtttgaaaactg

SEQ ID NO: 4331343 - DNA, 22 bp, Homo sapiens
aatggatatagaaaatcttagt

SEQ ID NO: 4331344 - DNA, 23 bp, Homo sapiens
aatggatatagaaaatcttagta

SEQ ID NO: 4331345 - DNA, 20 bp, Homo sapiens
aatggtaggtcaagtaataa

SEQ ID NO: 4331346 - DNA, 22 bp, Homo sapiens
aatgtagccctctccaaatcaa

SEQ ID NO: 4331347 - DNA, 18 bp, Homo sapiens
aatgtaggcacttttatt

SEQ ID NO: 4331348 - DNA, 22 bp, Homo sapiens
aatgtaggcacttttattttca

SEQ ID NO: 4331349 - DNA, 19 bp, Homo sapiens
aatgtagggttatatttgg

SEQ ID NO: 4331350 - DNA, 14 bp, Homo sapiens
aatgtatttttcta

SEQ ID NO: 4331351 - DNA, 14 bp, Homo sapiens
aatgtctgtcagaa

SEQ ID NO: 4331352 - DNA, 16 bp, Homo sapiens
aatgtgtttttctcca

SEQ ID NO: 4331353 - DNA, 22 bp, Homo sapiens
aatgttaagaaagaagaccctt

SEQ ID NO: 4331354 - DNA, 22 bp, Homo sapiens
aatgttggacagacactgttgc

SEQ ID NO: 4331355 - DNA, 22 bp, Homo sapiens
aatgtttagtgtgctgctgttc

SEQ ID NO: 4331356 - DNA, 16 bp, Homo sapiens
aatgtttattccttga

SEQ ID NO: 4331357 - DNA, 17 bp, Homo sapiens
aattaaaaatgaaaatt

SEQ ID NO: 4331358 - DNA, 22 bp, Homo sapiens
aattaaaaggatagtattttta

SEQ ID NO: 4331359 - DNA, 14 bp, Homo sapiens
aattaaatgatatt

SEQ ID NO: 4331360 - DNA, 15 bp, Homo sapiens
aattaacaagaactc

SEQ ID NO: 4331361 - DNA, 21 bp, Homo sapiens
aattaacaagaactcattatt

SEQ ID NO: 4331362 - DNA, 23 bp, Homo sapiens
aattacgttcttacaagcttaaa

SEQ ID NO: 4331363 - DNA, 20 bp, Homo sapiens
aattagaagaaaatggatga

SEQ ID NO: 4331364 - DNA, 22 bp, Homo sapiens
aattagtcgggcatgagtctgt

SEQ ID NO: 4331365 - DNA, 24 bp, Homo sapiens
aattagtcgggcatgagtctgttt

SEQ ID NO: 4331366 - DNA, 17 bp, Homo sapiens
aattataaaattgaaaa

SEQ ID NO: 4331367 - DNA, 18 bp, Homo sapiens
aattataaaattgaaaac

SEQ ID NO: 4331368 - DNA, 20 bp, Homo sapiens
aattatccattacgtgcatt

SEQ ID NO: 4331369 - DNA, 22 bp, Homo sapiens
aattatccattacgtgcattta

SEQ ID NO: 4331370 - DNA, 19 bp, Homo sapiens
aattatgcactaaatatga

SEQ ID NO: 4331371 - DNA, 13 bp, Homo sapiens
aattattgatata

SEQ ID NO: 4331372 - DNA, 17 bp, Homo sapiens
aattattgatatatatt

SEQ ID NO: 4331373 - DNA, 20 bp, Homo sapiens
aattattggtatatttgtag

SEQ ID NO: 4331374 - DNA, 23 bp, Homo sapiens
aattattttgagtggcaaaataa

SEQ ID NO: 4331375 - DNA, 16 bp, Homo sapiens
aattcatacctccctc

SEQ ID NO: 4331376 - DNA, 10 bp, Homo sapiens
aattcctaca

SEQ ID NO: 4331377 - DNA, 14 bp, Homo sapiens
aattccttaaatga

SEQ ID NO: 4331378 - DNA, 14 bp, Homo sapiens
aattctataaaaac

SEQ ID NO: 4331379 - DNA, 18 bp, Homo sapiens
aattctgtttttctaggc

SEQ ID NO: 4331380 - DNA, 13 bp, Homo sapiens
aattgaaaacact

SEQ ID NO: 4331381 - DNA, 15 bp, Homo sapiens
aattgaaaacactaa

SEQ ID NO: 4331382 - DNA, 13 bp, Homo sapiens
aattgagaaaaga

SEQ ID NO: 4331383 - DNA, 22 bp, Homo sapiens
aattgatcataggtatttcaaa

SEQ ID NO: 4331384 - DNA, 14 bp, Homo sapiens
aattgcagtttcat

SEQ ID NO: 4331385 - DNA, 21 bp, Homo sapiens
aattgcagtttcatgtatgta

SEQ ID NO: 4331386 - DNA, 21 bp, Homo sapiens
aattgctgaagggcattcttt

SEQ ID NO: 4331387 - DNA, 14 bp, Homo sapiens
aattggcataattt

SEQ ID NO: 4331388 - DNA, 17 bp, Homo sapiens
aattggtctgaaaggct

SEQ ID NO: 4331389 - DNA, 14 bp, Homo sapiens
aattgtcaaaattg

SEQ ID NO: 4331390 - DNA, 12 bp, Homo sapiens
aattgtgcttct

SEQ ID NO: 4331391 - DNA, 13 bp, Homo sapiens
aattgtgcttctc

SEQ ID NO: 4331392 - DNA, 13 bp, Homo sapiens
aatttaattaaag

SEQ ID NO: 4331393 - DNA, 14 bp, Homo sapiens
aatttactggccac

SEQ ID NO: 4331394 - DNA, 14 bp, Homo sapiens
aatttcacagttct

SEQ ID NO: 4331395 - DNA, 18 bp, Homo sapiens
aatttcacagttctgtaa

SEQ ID NO: 4331396 - DNA, 20 bp, Homo sapiens
aatttgaataataaatcgat

SEQ ID NO: 4331397 - DNA, 22 bp, Homo sapiens
aatttgcataatactaatttat

SEQ ID NO: 4331398 - DNA, 19 bp, Homo sapiens
aatttggcaaaacaaaatg

SEQ ID NO: 4331399 - DNA, 14 bp, Homo sapiens
aattttagatatta

SEQ ID NO: 4331400 - DNA, 18 bp, Homo sapiens
acaaaatttcacagttct

SEQ ID NO: 4331401 - DNA, 23 bp, Homo sapiens
acaaaatttgaataataaatcga

SEQ ID NO: 4331402 - DNA, 15 bp, Homo sapiens
acaaagcgtgcacaa

SEQ ID NO: 4331403 - DNA, 14 bp, Homo sapiens
acaaagttcagtgt

SEQ ID NO: 4331404 - DNA, 15 bp, Homo sapiens
acaaatatatgtata

SEQ ID NO: 4331405 - DNA, 23 bp, Homo sapiens
acaaattttttaatttccaaaat

SEQ ID NO: 4331406 - DNA, 19 bp, Homo sapiens
acaactgcataacctttac

SEQ ID NO: 4331407 - DNA, 24 bp, Homo sapiens
acaagccttactcacctctctcta

SEQ ID NO: 4331408 - DNA, 13 bp, Homo sapiens
acaagctaggaaa

SEQ ID NO: 4331409 - DNA, 15 bp, Homo sapiens
acaagctaggaaaga

SEQ ID NO: 4331410 - DNA, 18 bp, Homo sapiens
acaagctaggaaagagga

SEQ ID NO: 4331411 - DNA, 13 bp, Homo sapiens
acaagctgcaccc

SEQ ID NO: 4331412 - DNA, 23 bp, Homo sapiens
acaagctgcaccctcaggcaggt

SEQ ID NO: 4331413 - DNA, 13 bp, Homo sapiens
acaaggattgaaa

SEQ ID NO: 4331414 - DNA, 15 bp, Homo sapiens
acaaggccagaaaaa

SEQ ID NO: 4331415 - DNA, 18 bp, Homo sapiens
acaaggccagaaaaagaa

SEQ ID NO: 4331416 - DNA, 19 bp, Homo sapiens
acaaggccagaaaaagaag

SEQ ID NO: 4331417 - DNA, 18 bp, Homo sapiens
acaaggggcaaatgaatt

SEQ ID NO: 4331418 - DNA, 20 bp, Homo sapiens
acaatcattgttttgaatat

SEQ ID NO: 4331419 - DNA, 20 bp, Homo sapiens
acacaagagggactgtattt

SEQ ID NO: 4331420 - DNA, 22 bp, Homo sapiens
acacaaggccagaaaaagaaga

SEQ ID NO: 4331421 - DNA, 20 bp, Homo sapiens
acacaaggggcaaatgaatt

SEQ ID NO: 4331422 - DNA, 15 bp, Homo sapiens
acacagcttgtgaat

SEQ ID NO: 4331423 - DNA, 16 bp, Homo sapiens
aaggagctcaactaaa

SEQ ID NO: 4331424 - DNA, 20 bp, Homo sapiens
aaggaggaagagaaaaaata

SEQ ID NO: 4331425 - DNA, 17 bp, Homo sapiens
aaggatagtatttttat

SEQ ID NO: 4331426 - DNA, 16 bp, Homo sapiens
aaggatatactgcagc

SEQ ID NO: 4331427 - DNA, 23 bp, Homo sapiens
aaggatcttttgtccattccatt

SEQ ID NO: 4331428 - DNA, 13 bp, Homo sapiens
aaggattaatgaa

SEQ ID NO: 4331429 - DNA, 18 bp, Homo sapiens
aaggattaatgaaaacct

SEQ ID NO: 4331430 - DNA, 14 bp, Homo sapiens
aaggattgaaaatt

SEQ ID NO: 4331431 - DNA, 20 bp, Homo sapiens
aaggccacaaaagttccctc

SEQ ID NO: 4331432 - DNA, 23 bp, Homo sapiens
aaggccacaaaagttccctctca

SEQ ID NO: 4331433 - DNA, 22 bp, Homo sapiens
aaggccagaaaaagaagaagga

SEQ ID NO: 4331434 - DNA, 19 bp, Homo sapiens
aaggccggagacccacagc

SEQ ID NO: 4331435 - DNA, 21 bp, Homo sapiens
aaggccggagacccacagccc

SEQ ID NO: 4331436 - DNA, 22 bp, Homo sapiens
aaggccggagacccacagccct

SEQ ID NO: 4331437 - DNA, 23 bp, Homo sapiens
aaggccggagacccacagccctg

SEQ ID NO: 4331438 - DNA, 21 bp, Homo sapiens
aaggctgctgcaagtcattga

SEQ ID NO: 4331439 - DNA, 19 bp, Homo sapiens
aaggctgggggaagaagct

SEQ ID NO: 4331440 - DNA, 17 bp, Homo sapiens
aagggaacagcctgagc

SEQ ID NO: 4331441 - DNA, 19 bp, Homo sapiens
aagggaacagcctgagccg

SEQ ID NO: 4331442 - DNA, 20 bp, Homo sapiens
aagggaacccccaaatttaa

SEQ ID NO: 4331443 - DNA, 15 bp, Homo sapiens
aagggagaaatgcca

SEQ ID NO: 4331444 - DNA, 21 bp, Homo sapiens
aagggccaatggagaaaatga

SEQ ID NO: 4331445 - DNA, 21 bp, Homo sapiens
aaggtaatgtagggttatatt

SEQ ID NO: 4331446 - DNA, 13 bp, Homo sapiens
aaggtatacctca

SEQ ID NO: 4331447 - DNA, 19 bp, Homo sapiens
aaggtgggtgaggctgggc

SEQ ID NO: 4331448 - DNA, 17 bp, Homo sapiens
aagtaaagccattaaat

SEQ ID NO: 4331449 - DNA, 13 bp, Homo sapiens
aagtaacacttta

SEQ ID NO: 4331450 - DNA, 17 bp, Homo sapiens
aagtaatatttaaagat

SEQ ID NO: 4331451 - DNA, 16 bp, Homo sapiens
aagtaattatgcacta

SEQ ID NO: 4331452 - DNA, 19 bp, Homo sapiens
aagtaattatgcactaaat

SEQ ID NO: 4331453 - DNA, 18 bp, Homo sapiens
aagtacaatgtgtttttc

SEQ ID NO: 4331454 - DNA, 19 bp, Homo sapiens
aagtacaatgtgtttttct

SEQ ID NO: 4331455 - DNA, 16 bp, Homo sapiens
aagtaccaatctctgc

SEQ ID NO: 4331456 - DNA, 17 bp, Homo sapiens
aagtagacaatcattgt

SEQ ID NO: 4331457 - DNA, 17 bp, Homo sapiens
aagtagtccttggcata

SEQ ID NO: 4331458 - DNA, 17 bp, Homo sapiens
aagtatagagagaagtt

SEQ ID NO: 4331459 - DNA, 19 bp, Homo sapiens
aagtatatgtgagaaatca

SEQ ID NO: 4331460 - DNA, 13 bp, Homo sapiens
aagtcctgctttc

SEQ ID NO: 4331461 - DNA, 17 bp, Homo sapiens
aagtcgttttccaaact

SEQ ID NO: 4331462 - DNA, 20 bp, Homo sapiens
aagtgaaacgtaattgtaca

SEQ ID NO: 4331463 - DNA, 19 bp, Homo sapiens
aagtggaaaaatagcctgc

SEQ ID NO: 4331464 - DNA, 21 bp, Homo sapiens
aagtggaaaaatagcctgcct

SEQ ID NO: 4331465 - DNA, 16 bp, Homo sapiens
aagtggccactggcat

SEQ ID NO: 4331466 - DNA, 18 bp, Homo sapiens
aagtgtacatgaagaatg

SEQ ID NO: 4331467 - DNA, 20 bp, Homo sapiens
aagtgtcacctccttcccca

SEQ ID NO: 4331468 - DNA, 21 bp, Homo sapiens
aagtgtcacctccttccccag

SEQ ID NO: 4331469 - DNA, 13 bp, Homo sapiens
aagtgtggtagag

SEQ ID NO: 4331470 - DNA, 23 bp, Homo sapiens
aagtgtgtggtcccaagttggaa

SEQ ID NO: 4331471 - DNA, 13 bp, Homo sapiens
aagtgttcagtgt

SEQ ID NO: 4331472 - DNA, 14 bp, Homo sapiens
aagtgttcagtgtt

SEQ ID NO: 4331473 - DNA, 18 bp, Homo sapiens
aagtgttcagtgttgaca

SEQ ID NO: 4331474 - DNA, 21 bp, Homo sapiens
aagtgttcagtgttgacatag

SEQ ID NO: 4331475 - DNA, 22 bp, Homo sapiens
aagtgttcagtgttgacatagc

SEQ ID NO: 4331476 - DNA, 16 bp, Homo sapiens
aagttagagataattc

SEQ ID NO: 4331477 - DNA, 17 bp, Homo sapiens
aagttagagataattct

SEQ ID NO: 4331478 - DNA, 15 bp, Homo sapiens
aagttcttctccaat

SEQ ID NO: 4331479 - DNA, 13 bp, Homo sapiens
aagttgaaaatac

SEQ ID NO: 4331480 - DNA, 14 bp, Homo sapiens
aagttgaaaataca

SEQ ID NO: 4331481 - DNA, 16 bp, Homo sapiens
aagttgaaaatacatt

SEQ ID NO: 4331482 - DNA, 17 bp, Homo sapiens
aagttgaaaatacattc

SEQ ID NO: 4331483 - DNA, 21 bp, Homo sapiens
aagttgctaactgggaagaac

SEQ ID NO: 4331484 - DNA, 20 bp, Homo sapiens
aagtttgagatcagcctggg

SEQ ID NO: 4331485 - DNA, 22 bp, Homo sapiens
aagtttgtagtttttgctgaag

SEQ ID NO: 4331486 - DNA, 16 bp, Homo sapiens
aagttttttactttgg

SEQ ID NO: 4331487 - DNA, 18 bp, Homo sapiens
aataaaatggatagaaaa

SEQ ID NO: 4331488 - DNA, 12 bp, Homo sapiens
aataaactgttt

SEQ ID NO: 4331489 - DNA, 17 bp, Homo sapiens
aataaactgttttcaag

SEQ ID NO: 4331490 - DNA, 15 bp, Homo sapiens
aataaactttgaata

SEQ ID NO: 4331491 - DNA, 11 bp, Homo sapiens
aataaagaaaa

SEQ ID NO: 4331492 - DNA, 12 bp, Homo sapiens
aataaagaaaat

SEQ ID NO: 4331493 - DNA, 17 bp, Homo sapiens
aataaagaaaattctct

SEQ ID NO: 4331494 - DNA, 15 bp, Homo sapiens
aataaagagttagaa

SEQ ID NO: 4331495 - DNA, 11 bp, Homo sapiens
aataaagcatt

SEQ ID NO: 4331496 - DNA, 13 bp, Homo sapiens
aataaagcattct

SEQ ID NO: 4331497 - DNA, 14 bp, Homo sapiens
aataaagcattctt

SEQ ID NO: 4331498 - DNA, 16 bp, Homo sapiens
aataaagccttttaaa

SEQ ID NO: 4331499 - DNA, 11 bp, Homo sapiens
aataactattt

SEQ ID NO: 4331500 - DNA, 21 bp, Homo sapiens
aataactattttgttttaatc

SEQ ID NO: 4331501 - DNA, 18 bp, Homo sapiens
aatacacatataaaaaca

SEQ ID NO: 4331502 - DNA, 20 bp, Homo sapiens
aatacacatataaaaacaat

SEQ ID NO: 4331503 - DNA, 11 bp, Homo sapiens
aatacatctgt

SEQ ID NO: 4331504 - DNA, 13 bp, Homo sapiens
aatactaatttat

SEQ ID NO: 4331505 - DNA, 22 bp, Homo sapiens
aatactctaccctcttagaaaa

SEQ ID NO: 4331506 - DNA, 12 bp, Homo sapiens
aatagaagaaga

SEQ ID NO: 4331507 - DNA, 20 bp, Homo sapiens
aatagcctgcctcttctcta

SEQ ID NO: 4331508 - DNA, 18 bp, Homo sapiens
aatagtcatatgtgaaga

SEQ ID NO: 4331509 - DNA, 15 bp, Homo sapiens
aatagttgtctgtgc

SEQ ID NO: 4331510 - DNA, 16 bp, Homo sapiens
aatagttgtctgtgct

SEQ ID NO: 4331511 - DNA, 12 bp, Homo sapiens
aatagtttccaa

SEQ ID NO: 4331512 - DNA, 11 bp, Homo sapiens
aatatactttt

SEQ ID NO: 4331513 - DNA, 18 bp, Homo sapiens
aatatactttttttgtta

SEQ ID NO: 4331514 - DNA, 22 bp, Homo sapiens
aatatactttttttgttataga

SEQ ID NO: 4331515 - DNA, 19 bp, Homo sapiens
aatatatataaagaatata

SEQ ID NO: 4331516 - DNA, 17 bp, Homo sapiens
aatatatatataaaata

SEQ ID NO: 4331517 - DNA, 12 bp, Homo sapiens
aatatattactg

SEQ ID NO: 4331518 - DNA, 13 bp, Homo sapiens
aatatatttgtca

SEQ ID NO: 4331519 - DNA, 19 bp, Homo sapiens
aatatatttgtcatatgct

SEQ ID NO: 4331520 - DNA, 18 bp, Homo sapiens
aatatgaaccctttgttt

SEQ ID NO: 4331521 - DNA, 10 bp, Homo sapiens
aatatgctta

SEQ ID NO: 4331522 - DNA, 11 bp, Homo sapiens
aatatgcttac

SEQ ID NO: 4331523 - DNA, 16 bp, Homo sapiens
aatattatgattttat

SEQ ID NO: 4331524 - DNA, 13 bp, Homo sapiens
aatattcaagtaa

SEQ ID NO: 4331525 - DNA, 22 bp, Homo sapiens
aatattgtgttgtgcagcatta

SEQ ID NO: 4331526 - DNA, 20 bp, Homo sapiens
aatatttaaagattatagct

SEQ ID NO: 4331527 - DNA, 17 bp, Homo sapiens
aatatttctgctttctt

SEQ ID NO: 4331528 - DNA, 15 bp, Homo sapiens
aatattttgataata

SEQ ID NO: 4331529 - DNA, 22 bp, Homo sapiens
aatattttgataataatattgt

SEQ ID NO: 4331530 - DNA, 23 bp, Homo sapiens
aatatttttgaaaggcatgttcc

SEQ ID NO: 4331531 - DNA, 15 bp, Homo sapiens
aatcaaaaacttttc

SEQ ID NO: 4331532 - DNA, 18 bp, Homo sapiens
aatcaaaataaaaattaa

SEQ ID NO: 4331533 - DNA, 17 bp, Homo sapiens
aatcacccagttgtgct

SEQ ID NO: 4331534 - DNA, 18 bp, Homo sapiens
aatcactctgtccttgga

SEQ ID NO: 4331535 - DNA, 17 bp, Homo sapiens
aatcagaattggcataa

SEQ ID NO: 4331536 - DNA, 20 bp, Homo sapiens
aatcatattgagaataatta

SEQ ID NO: 4331537 - DNA, 21 bp, Homo sapiens
aatcatgtctgtatccccagt

SEQ ID NO: 4331538 - DNA, 13 bp, Homo sapiens
aatcattatgttt

SEQ ID NO: 4331539 - DNA, 14 bp, Homo sapiens
aatcattatgtttc

SEQ ID NO: 4331540 - DNA, 14 bp, Homo sapiens
aatcattgttttga

SEQ ID NO: 4331541 - DNA, 17 bp, Homo sapiens
aatcattgttttgaata

SEQ ID NO: 4331542 - DNA, 19 bp, Homo sapiens
aatccaaacccactcttca

SEQ ID NO: 4331543 - DNA, 18 bp, Homo sapiens
aatccagagaagcgctgt

SEQ ID NO: 4331544 - DNA, 20 bp, Homo sapiens
agcttgactaatggaatgat

SEQ ID NO: 4331545 - DNA, 17 bp, Homo sapiens
agcttgatttgatcttt

SEQ ID NO: 4331546 - DNA, 19 bp, Homo sapiens
agcttgatttgatctttgt

SEQ ID NO: 4331547 - DNA, 23 bp, Homo sapiens
agcttgtgaatgtttagtgtgct

SEQ ID NO: 4331548 - DNA, 21 bp, Homo sapiens
agcttgtgctgagcctgccca

SEQ ID NO: 4331549 - DNA, 23 bp, Homo sapiens
agcttgtggaggagggagagccc

SEQ ID NO: 4331550 - DNA, 13 bp, Homo sapiens
agctttatctttg

SEQ ID NO: 4331551 - DNA, 14 bp, Homo sapiens
agctttatctttgt

SEQ ID NO: 4331552 - DNA, 16 bp, Homo sapiens
agctttatctttgtgt

SEQ ID NO: 4331553 - DNA, 18 bp, Homo sapiens
agctttctgtgcatgtgc

SEQ ID NO: 4331554 - DNA, 15 bp, Homo sapiens
agcttttcagaacat

SEQ ID NO: 4331555 - DNA, 12 bp, Homo sapiens
agcttttccttt

SEQ ID NO: 4331556 - DNA, 15 bp, Homo sapiens
agcttttcctttctt

SEQ ID NO: 4331557 - DNA, 23 bp, Homo sapiens
aggaaaaacagaggatgctgaag

SEQ ID NO: 4331558 - DNA, 17 bp, Homo sapiens
aggaaaaagcacaagaa

SEQ ID NO: 4331559 - DNA, 23 bp, Homo sapiens
aggaaaatcaatgctttatctga

SEQ ID NO: 4331560 - DNA, 21 bp, Homo sapiens
aggaaagaggaggcagaaaga

SEQ ID NO: 4331561 - DNA, 21 bp, Homo sapiens
aggaacccccacaaccccctc

SEQ ID NO: 4331562 - DNA, 14 bp, Homo sapiens
aggaagagaaaaaa

SEQ ID NO: 4331563 - DNA, 20 bp, Homo sapiens
aggaagatgttcaatagaac

SEQ ID NO: 4331564 - DNA, 23 bp, Homo sapiens
aggaagatttgacgttgttgtca

SEQ ID NO: 4331565 - DNA, 21 bp, Homo sapiens
aggaaggaaacatagaaagac

SEQ ID NO: 4331566 - DNA, 22 bp, Homo sapiens
aggaatcctacgctatgtagaa

SEQ ID NO: 4331567 - DNA, 23 bp, Homo sapiens
aggaatcctacgctatgtagaat

SEQ ID NO: 4331568 - DNA, 19 bp, Homo sapiens
aggacaaaaagaccttctc

SEQ ID NO: 4331569 - DNA, 22 bp, Homo sapiens
aggacaaaaagaccttctccct

SEQ ID NO: 4331570 - DNA, 14 bp, Homo sapiens
aggaccgttttgta

SEQ ID NO: 4331571 - DNA, 15 bp, Homo sapiens
aggagaagagttgag

SEQ ID NO: 4331572 - DNA, 14 bp, Homo sapiens
aggagaggggcaca

SEQ ID NO: 4331573 - DNA, 20 bp, Homo sapiens
aggagattggatttgctgtg

SEQ ID NO: 4331574 - DNA, 17 bp, Homo sapiens
aggagccccagccccgt

SEQ ID NO: 4331575 - DNA, 10 bp, Homo sapiens
aggagccctg

SEQ ID NO: 4331576 - DNA, 15 bp, Homo sapiens
aggaggcgaataaat

SEQ ID NO: 4331577 - DNA, 19 bp, Homo sapiens
aggaggcgaataaatgttc

SEQ ID NO: 4331578 - DNA, 14 bp, Homo sapiens
aggagtcctttctt

SEQ ID NO: 4331579 - DNA, 15 bp, Homo sapiens
aggagtcctttcttt

SEQ ID NO: 4331580 - DNA, 23 bp, Homo sapiens
aggagtttatctatcggaagaac

SEQ ID NO: 4331581 - DNA, 14 bp, Homo sapiens
aggatagtattttt

SEQ ID NO: 4331582 - DNA, 18 bp, Homo sapiens
aggatcaccccagccccc

SEQ ID NO: 4331583 - DNA, 12 bp, Homo sapiens
aggatctcttga

SEQ ID NO: 4331584 - DNA, 17 bp, Homo sapiens
aggatctcttgagcctg

SEQ ID NO: 4331585 - DNA, 18 bp, Homo sapiens
aggatctcttgagcctgg

SEQ ID NO: 4331586 - DNA, 19 bp, Homo sapiens
aggatctcttgagcctggg

SEQ ID NO: 4331587 - DNA, 14 bp, Homo sapiens
aggatgatggaaaa

SEQ ID NO: 4331588 - DNA, 15 bp, Homo sapiens
aggatgatggaaaaa

SEQ ID NO: 4331589 - DNA, 13 bp, Homo sapiens
aggatgccctgtt

SEQ ID NO: 4331590 - DNA, 13 bp, Homo sapiens
aggatgctgaagt

SEQ ID NO: 4331591 - DNA, 13 bp, Homo sapiens
aggattaatgaaa

SEQ ID NO: 4331592 - DNA, 15 bp, Homo sapiens
aggattatatgtatt

SEQ ID NO: 4331593 - DNA, 19 bp, Homo sapiens
aggcaactgcattggcttt

SEQ ID NO: 4331594 - DNA, 14 bp, Homo sapiens
aggcacttattgta

SEQ ID NO: 4331595 - DNA, 18 bp, Homo sapiens
aggcacttattgtaaatt

SEQ ID NO: 4331596 - DNA, 18 bp, Homo sapiens
aggcacttttattttcat

SEQ ID NO: 4331597 - DNA, 20 bp, Homo sapiens
aggcagaaatagttgtctgt

SEQ ID NO: 4331598 - DNA, 23 bp, Homo sapiens
aggcagcctttttctggccttga

SEQ ID NO: 4331599 - DNA, 15 bp, Homo sapiens
aggcagctctgagcc

SEQ ID NO: 4331600 - DNA, 20 bp, Homo sapiens
aggcaggatcaaagacacac

SEQ ID NO: 4331601 - DNA, 22 bp, Homo sapiens
aggcatcactgattccctctcc

SEQ ID NO: 4331602 - DNA, 16 bp, Homo sapiens
aggcatttgctgaata

SEQ ID NO: 4331603 - DNA, 20 bp, Homo sapiens
aggcatttgctgaatacaga

SEQ ID NO: 4331604 - DNA, 16 bp, Homo sapiens
aggccaaacatggcca

SEQ ID NO: 4331605 - DNA, 16 bp, Homo sapiens
aggccaaggtgggagg

SEQ ID NO: 4331606 - DNA, 18 bp, Homo sapiens
aggccaaggtgggaggat

SEQ ID NO: 4331607 - DNA, 18 bp, Homo sapiens
aggccagaaaaagaagaa

SEQ ID NO: 4331608 - DNA, 14 bp, Homo sapiens
aggccgctgcccct

SEQ ID NO: 4331609 - DNA, 19 bp, Homo sapiens
aggccgctgcccctgagtt

SEQ ID NO: 4331610 - DNA, 20 bp, Homo sapiens
aggccgctgcccctgagttc

SEQ ID NO: 4331611 - DNA, 17 bp, Homo sapiens
aggccggagacccacag

SEQ ID NO: 4331612 - DNA, 19 bp, Homo sapiens
aggccggagacccacagcc

SEQ ID NO: 4331613 - DNA, 17 bp, Homo sapiens
aggcctcggctgtctcc

SEQ ID NO: 4331614 - DNA, 20 bp, Homo sapiens
aggcctcggctgtctcctgt

SEQ ID NO: 4331615 - DNA, 21 bp, Homo sapiens
aggcctcggctgtctcctgtc

SEQ ID NO: 4331616 - DNA, 12 bp, Homo sapiens
aggcctctgccc

SEQ ID NO: 4331617 - DNA, 12 bp, Homo sapiens
aggcctggggac

SEQ ID NO: 4331618 - DNA, 13 bp, Homo sapiens
aggcgaataaatg

SEQ ID NO: 4331619 - DNA, 15 bp, Homo sapiens
aggcgaataaatgtt

SEQ ID NO: 4331620 - DNA, 19 bp, Homo sapiens
aggcggacaaagttcagtg

SEQ ID NO: 4331621 - DNA, 19 bp, Homo sapiens
aggctgcagtgagccgaga

SEQ ID NO: 4331622 - DNA, 16 bp, Homo sapiens
aggctgcgtctggagg

SEQ ID NO: 4331623 - DNA, 17 bp, Homo sapiens
aggctgggcagggcctg

SEQ ID NO: 4331624 - DNA, 22 bp, Homo sapiens
aggctgggggaagaagctctct

SEQ ID NO: 4331625 - DNA, 14 bp, Homo sapiens
agggaaaagggaag

SEQ ID NO: 4331626 - DNA, 18 bp, Homo sapiens
agggaacagcctgagccg

SEQ ID NO: 4331627 - DNA, 15 bp, Homo sapiens
agggaagtagtcctt

SEQ ID NO: 4331628 - DNA, 22 bp, Homo sapiens
agggaatctaatatccccaaat

SEQ ID NO: 4331629 - DNA, 15 bp, Homo sapiens
agggacagagcccgg

SEQ ID NO: 4331630 - DNA, 19 bp, Homo sapiens
agggacagagcccgggaga

SEQ ID NO: 4331631 - DNA, 19 bp, Homo sapiens
agggactgtatttctgtgg

SEQ ID NO: 4331632 - DNA, 21 bp, Homo sapiens
agggactgtatttctgtggaa

SEQ ID NO: 4331633 - DNA, 12 bp, Homo sapiens
agggagaaatgc

SEQ ID NO: 4331634 - DNA, 12 bp, Homo sapiens
agggagagccct

SEQ ID NO: 4331635 - DNA, 13 bp, Homo sapiens
agggagaggcctc

SEQ ID NO: 4331636 - DNA, 17 bp, Homo sapiens
agggagcctcctgccca

SEQ ID NO: 4331637 - DNA, 15 bp, Homo sapiens
agggaggcatctgca

SEQ ID NO: 4331638 - DNA, 21 bp, Homo sapiens
agggcaaatccagtcccaatg

SEQ ID NO: 4331639 - DNA, 17 bp, Homo sapiens
agggcaattggaacaaa

SEQ ID NO: 4331640 - DNA, 18 bp, Homo sapiens
agggcaggttagagacag

SEQ ID NO: 4331641 - DNA, 17 bp, Homo sapiens
agggccaatggagaaaa

SEQ ID NO: 4331642 - DNA, 18 bp, Homo sapiens
agggccaatggagaaaat

SEQ ID NO: 4331643 - DNA, 23 bp, Homo sapiens
agggccctttcttgcactgtcca

SEQ ID NO: 4331644 - DNA, 12 bp, Homo sapiens
agggcctggcat

SEQ ID NO: 4331645 - DNA, 23 bp, Homo sapiens
agggcttctgccatttctgagat

SEQ ID NO: 4331646 - DNA, 22 bp, Homo sapiens
aggggaaaatcagcctgctcca

SEQ ID NO: 4331647 - DNA, 21 bp, Homo sapiens
aggggacagatttgaggactg

SEQ ID NO: 4331648 - DNA, 21 bp, Homo sapiens
aggggcgggtgatgagacctg

SEQ ID NO: 4331649 - DNA, 17 bp, Homo sapiens
aggggctattgggccct

SEQ ID NO: 4331650 - DNA, 18 bp, Homo sapiens
aggggtgattgaaagaaa

SEQ ID NO: 4331651 - DNA, 16 bp, Homo sapiens
aggggttgccacaggc

SEQ ID NO: 4331652 - DNA, 20 bp, Homo sapiens
aggggttgccacaggcctcc

SEQ ID NO: 4331653 - DNA, 17 bp, Homo sapiens
agggtggaaaaatgccc

SEQ ID NO: 4331654 - DNA, 14 bp, Homo sapiens
agggttatatttgg

SEQ ID NO: 4331655 - DNA, 19 bp, Homo sapiens
agggttctgctcggcttct

SEQ ID NO: 4331656 - DNA, 12 bp, Homo sapiens
aggtaaagatat

SEQ ID NO: 4331657 - DNA, 18 bp, Homo sapiens
aggtaccatggccattca

SEQ ID NO: 4331658 - DNA, 17 bp, Homo sapiens
aggtatattggaagagg

SEQ ID NO: 4331659 - DNA, 15 bp, Homo sapiens
aggtcaagtaataaa

SEQ ID NO: 4331660 - DNA, 19 bp, Homo sapiens
aggtcatcccttcctcctc

SEQ ID NO: 4331661 - DNA, 14 bp, Homo sapiens
aggtcccttgtttc

SEQ ID NO: 4331662 - DNA, 16 bp, Homo sapiens
aggtccggggaggagg

SEQ ID NO: 4331663 - DNA, 15 bp, Homo sapiens
aggtctctccctccc

SEQ ID NO: 4331664 - DNA, 14 bp, Homo sapiens
acacagttaaataa

SEQ ID NO: 4331665 - DNA, 16 bp, Homo sapiens
acacataaatgaaaga

SEQ ID NO: 4331666 - DNA, 18 bp, Homo sapiens
acacataaatgaaagaaa

SEQ ID NO: 4331667 - DNA, 22 bp, Homo sapiens
acacatacatacatacatacaa

SEQ ID NO: 4331668 - DNA, 14 bp, Homo sapiens
acacatataaaaac

SEQ ID NO: 4331669 - DNA, 17 bp, Homo sapiens
acacatcgttcgattta

SEQ ID NO: 4331670 - DNA, 18 bp, Homo sapiens
acacatgtgctgatgttt

SEQ ID NO: 4331671 - DNA, 22 bp, Homo sapiens
acaccaccgaatatattactga

SEQ ID NO: 4331672 - DNA, 16 bp, Homo sapiens
acacccacctctgcca

SEQ ID NO: 4331673 - DNA, 14 bp, Homo sapiens
acaccgctggctcc

SEQ ID NO: 4331674 - DNA, 15 bp, Homo sapiens
acaccgctggctccg

SEQ ID NO: 4331675 - DNA, 23 bp, Homo sapiens
acacggggcaggaccttccttcc

SEQ ID NO: 4331676 - DNA, 15 bp, Homo sapiens
acacgtccactccca

SEQ ID NO: 4331677 - DNA, 13 bp, Homo sapiens
acactaattcctt

SEQ ID NO: 4331678 - DNA, 15 bp, Homo sapiens
acactaattccttaa

SEQ ID NO: 4331679 - DNA, 18 bp, Homo sapiens
acactaattccttaaatg

SEQ ID NO: 4331680 - DNA, 19 bp, Homo sapiens
acactaattccttaaatga

SEQ ID NO: 4331681 - DNA, 15 bp, Homo sapiens
acactaggagactgg

SEQ ID NO: 4331682 - DNA, 13 bp, Homo sapiens
acactgttgcaaa

SEQ ID NO: 4331683 - DNA, 20 bp, Homo sapiens
acactgttgtccttaaaatt

SEQ ID NO: 4331684 - DNA, 19 bp, Homo sapiens
acacttatctcactgtttt

SEQ ID NO: 4331685 - DNA, 16 bp, Homo sapiens
acagaaatgtttttaa

SEQ ID NO: 4331686 - DNA, 18 bp, Homo sapiens
acagaaggggatgggaaa

SEQ ID NO: 4331687 - DNA, 14 bp, Homo sapiens
acagacactacatt

SEQ ID NO: 4331688 - DNA, 17 bp, Homo sapiens
acagacagggagaagtt

SEQ ID NO: 4331689 - DNA, 15 bp, Homo sapiens
acagagcccgggaga

SEQ ID NO: 4331690 - DNA, 16 bp, Homo sapiens
acagaggatgctgaag

SEQ ID NO: 4331691 - DNA, 18 bp, Homo sapiens
acagaggatgctgaagta

SEQ ID NO: 4331692 - DNA, 22 bp, Homo sapiens
acagaggatgctgaagtacagt

SEQ ID NO: 4331693 - DNA, 15 bp, Homo sapiens
acagagtttgtagta

SEQ ID NO: 4331694 - DNA, 19 bp, Homo sapiens
acagatatactttgtggac

SEQ ID NO: 4331695 - DNA, 16 bp, Homo sapiens
acagcactactgggtg

SEQ ID NO: 4331696 - DNA, 17 bp, Homo sapiens
acagcactactgggtgt

SEQ ID NO: 4331697 - DNA, 18 bp, Homo sapiens
acagcactactgggtgtc

SEQ ID NO: 4331698 - DNA, 19 bp, Homo sapiens
acagcactactgggtgtca

SEQ ID NO: 4331699 - DNA, 15 bp, Homo sapiens
acagcaggatgccct

SEQ ID NO: 4331700 - DNA, 10 bp, Homo sapiens
acagccctgg

SEQ ID NO: 4331701 - DNA, 12 bp, Homo sapiens
acagcctgagcc

SEQ ID NO: 4331702 - DNA, 20 bp, Homo sapiens
acagctgacggtttctcccc

SEQ ID NO: 4331703 - DNA, 16 bp, Homo sapiens
acaggcagctctgagc

SEQ ID NO: 4331704 - DNA, 16 bp, Homo sapiens
acaggcctccctgttt

SEQ ID NO: 4331705 - DNA, 13 bp, Homo sapiens
acagggagaagtt

SEQ ID NO: 4331706 - DNA, 14 bp, Homo sapiens
acagggagcctcct

SEQ ID NO: 4331707 - DNA, 15 bp, Homo sapiens
acagggagcctcctg

SEQ ID NO: 4331708 - DNA, 17 bp, Homo sapiens
acagggagcctcctgcc

SEQ ID NO: 4331709 - DNA, 13 bp, Homo sapiens
acaggtaaacaca

SEQ ID NO: 4331710 - DNA, 15 bp, Homo sapiens
acaggtaaacacata

SEQ ID NO: 4331711 - DNA, 17 bp, Homo sapiens
acaggtaaacacataaa

SEQ ID NO: 4331712 - DNA, 21 bp, Homo sapiens
acaggtaaacacataaatgaa

SEQ ID NO: 4331713 - DNA, 12 bp, Homo sapiens
acagtaatgtag

SEQ ID NO: 4331714 - DNA, 11 bp, Homo sapiens
acagtacaatc

SEQ ID NO: 4331715 - DNA, 15 bp, Homo sapiens
acagtcaggacacat

SEQ ID NO: 4331716 - DNA, 22 bp, Homo sapiens
acagtcccagcacatttcctct

SEQ ID NO: 4331717 - DNA, 12 bp, Homo sapiens
acagtggatgcc

SEQ ID NO: 4331718 - DNA, 12 bp, Homo sapiens
acagttctgtaa

SEQ ID NO: 4331719 - DNA, 13 bp, Homo sapiens
acagttctgtaat

SEQ ID NO: 4331720 - DNA, 16 bp, Homo sapiens
acagttctgtaatgta

SEQ ID NO: 4331721 - DNA, 15 bp, Homo sapiens
acagttgaaaaacag

SEQ ID NO: 4331722 - DNA, 20 bp, Homo sapiens
acagttgaaaaacagctgag

SEQ ID NO: 4331723 - DNA, 13 bp, Homo sapiens
acataaacaatga

SEQ ID NO: 4331724 - DNA, 14 bp, Homo sapiens
acataaatgaaaga

SEQ ID NO: 4331725 - DNA, 15 bp, Homo sapiens
acatagaaacataca

SEQ ID NO: 4331726 - DNA, 18 bp, Homo sapiens
acatagaaacatacacaa

SEQ ID NO: 4331727 - DNA, 19 bp, Homo sapiens
acatagtttcttttttaat

SEQ ID NO: 4331728 - DNA, 13 bp, Homo sapiens
acatataaaaaca

SEQ ID NO: 4331729 - DNA, 21 bp, Homo sapiens
acatatcagtcgtgtcaccag

SEQ ID NO: 4331730 - DNA, 15 bp, Homo sapiens
acatcctagccccac

SEQ ID NO: 4331731 - DNA, 18 bp, Homo sapiens
acatcctagccccaccca

SEQ ID NO: 4331732 - DNA, 21 bp, Homo sapiens
acatcctagccccacccagag

SEQ ID NO: 4331733 - DNA, 16 bp, Homo sapiens
acatcgttcgatttaa

SEQ ID NO: 4331734 - DNA, 23 bp, Homo sapiens
acatctgcctgtaattaaactag

SEQ ID NO: 4331735 - DNA, 14 bp, Homo sapiens
acatctttcctgtc

SEQ ID NO: 4331736 - DNA, 21 bp, Homo sapiens
acatgaatttttatgatttct

SEQ ID NO: 4331737 - DNA, 23 bp, Homo sapiens
acatgagactaagagaaaccttg

SEQ ID NO: 4331738 - DNA, 12 bp, Homo sapiens
acatgcaagaat

SEQ ID NO: 4331739 - DNA, 22 bp, Homo sapiens
acatgcaagaatttctggaaga

SEQ ID NO: 4331740 - DNA, 19 bp, Homo sapiens
acatggccagactcccttg

SEQ ID NO: 4331741 - DNA, 18 bp, Homo sapiens
acatgggctatcagggag

SEQ ID NO: 4331742 - DNA, 23 bp, Homo sapiens
acatgggctatcagggaggaaga

SEQ ID NO: 4331743 - DNA, 13 bp, Homo sapiens
acatgtatttatg

SEQ ID NO: 4331744 - DNA, 15 bp, Homo sapiens
acatgtatttatgta

SEQ ID NO: 4331745 - DNA, 21 bp, Homo sapiens
acatgtccttgtgtgttttga

SEQ ID NO: 4331746 - DNA, 17 bp, Homo sapiens
acatgtgcagatatcca

SEQ ID NO: 4331747 - DNA, 16 bp, Homo sapiens
acatgtgcccctgcca

SEQ ID NO: 4331748 - DNA, 11 bp, Homo sapiens
acattcactgg

SEQ ID NO: 4331749 - DNA, 23 bp, Homo sapiens
acattcttggttgttaatttaga

SEQ ID NO: 4331750 - DNA, 19 bp, Homo sapiens
acattgggccacttcctaa

SEQ ID NO: 4331751 - DNA, 19 bp, Homo sapiens
acattgtcaccagactcac

SEQ ID NO: 4331752 - DNA, 13 bp, Homo sapiens
acatttcctctct

SEQ ID NO: 4331753 - DNA, 20 bp, Homo sapiens
acattttcttttattatcag

SEQ ID NO: 4331754 - DNA, 21 bp, Homo sapiens
acattttcttttattatcagt

SEQ ID NO: 4331755 - DNA, 15 bp, Homo sapiens
accaaagcaattaaa

SEQ ID NO: 4331756 - DNA, 15 bp, Homo sapiens
accaatgttctctct

SEQ ID NO: 4331757 - DNA, 16 bp, Homo sapiens
accacccacaaagaaa

SEQ ID NO: 4331758 - DNA, 23 bp, Homo sapiens
accacgggtctgccatgctctgg

SEQ ID NO: 4331759 - DNA, 15 bp, Homo sapiens
accacttcagctgac

SEQ ID NO: 4331760 - DNA, 13 bp, Homo sapiens
accagaagaaaag

SEQ ID NO: 4331761 - DNA, 21 bp, Homo sapiens
accagaagtgcagcccctctc

SEQ ID NO: 4331762 - DNA, 13 bp, Homo sapiens
accagcagcctgg

SEQ ID NO: 4331763 - DNA, 22 bp, Homo sapiens
accagcaggaggttctgggcct

SEQ ID NO: 4331764 - DNA, 16 bp, Homo sapiens
accagcccctgcccca

SEQ ID NO: 4331765 - DNA, 20 bp, Homo sapiens
accagctggtatattgtgta

SEQ ID NO: 4331766 - DNA, 17 bp, Homo sapiens
accaggagggagagcct

SEQ ID NO: 4331767 - DNA, 15 bp, Homo sapiens
accagggagaggcct

SEQ ID NO: 4331768 - DNA, 16 bp, Homo sapiens
accagtgggtctggtg

SEQ ID NO: 4331769 - DNA, 22 bp, Homo sapiens
accatctctgtgattacctctc

SEQ ID NO: 4331770 - DNA, 15 bp, Homo sapiens
accattgaaaaagga

SEQ ID NO: 4331771 - DNA, 17 bp, Homo sapiens
accattgaaaaaggaaa

SEQ ID NO: 4331772 - DNA, 20 bp, Homo sapiens
accattgaaaaaggaaaaat

SEQ ID NO: 4331773 - DNA, 15 bp, Homo sapiens
accattttcaatttg

SEQ ID NO: 4331774 - DNA, 17 bp, Homo sapiens
accatttttcattcact

SEQ ID NO: 4331775 - DNA, 17 bp, Homo sapiens
acccacaaagaaacaaa

SEQ ID NO: 4331776 - DNA, 14 bp, Homo sapiens
acccacagccctga

SEQ ID NO: 4331777 - DNA, 17 bp, Homo sapiens
acccacagccctgaaac

SEQ ID NO: 4331778 - DNA, 19 bp, Homo sapiens
acccacgtgacaccaccga

SEQ ID NO: 4331779 - DNA, 19 bp, Homo sapiens
acccagcagttctctgcca

SEQ ID NO: 4331780 - DNA, 16 bp, Homo sapiens
acccagctctgttcca

SEQ ID NO: 4331781 - DNA, 15 bp, Homo sapiens
acccatgaagctggc

SEQ ID NO: 4331782 - DNA, 21 bp, Homo sapiens
acccatgaagctggccctcag

SEQ ID NO: 4331783 - DNA, 12 bp, Homo sapiens
accccagccccc

SEQ ID NO: 4331784 - DNA, 19 bp, Homo sapiens
accccagcccccacagccc

SEQ ID NO: 4331785 - DNA, 20 bp, Homo sapiens
accccagcccccacagccct

SEQ ID NO: 4331786 - DNA, 18 bp, Homo sapiens
aggtgcgcacttacctgc

SEQ ID NO: 4331787 - DNA, 23 bp, Homo sapiens
aggtgcgtcccccgttgtgcctg

SEQ ID NO: 4331788 - DNA, 16 bp, Homo sapiens
aggtggtaggaggagg

SEQ ID NO: 4331789 - DNA, 17 bp, Homo sapiens
aggttctgggcctctga

SEQ ID NO: 4331790 - DNA, 18 bp, Homo sapiens
aggtttgttcctttgaag

SEQ ID NO: 4331791 - DNA, 15 bp, Homo sapiens
agtaaacttgtgtat

SEQ ID NO: 4331792 - DNA, 22 bp, Homo sapiens
agtaaagaggcttccaagcatt

SEQ ID NO: 4331793 - DNA, 23 bp, Homo sapiens
agtaaagaggcttccaagcatta

SEQ ID NO: 4331794 - DNA, 18 bp, Homo sapiens
agtaaatattatgatttt

SEQ ID NO: 4331795 - DNA, 21 bp, Homo sapiens
agtaaatattatgattttatt

SEQ ID NO: 4331796 - DNA, 12 bp, Homo sapiens
agtaacacttta

SEQ ID NO: 4331797 - DNA, 14 bp, Homo sapiens
agtaagtaattatg

SEQ ID NO: 4331798 - DNA, 22 bp, Homo sapiens
agtaataaaaagagatgaaata

SEQ ID NO: 4331799 - DNA, 16 bp, Homo sapiens
agtaatatttaaagat

SEQ ID NO: 4331800 - DNA, 18 bp, Homo sapiens
agtacaatgtgtttttct

SEQ ID NO: 4331801 - DNA, 20 bp, Homo sapiens
agtacaatgtgtttttctcc

SEQ ID NO: 4331802 - DNA, 15 bp, Homo sapiens
agtacagtcccagca

SEQ ID NO: 4331803 - DNA, 12 bp, Homo sapiens
agtacccttggg

SEQ ID NO: 4331804 - DNA, 23 bp, Homo sapiens
agtacctcccctccccgccccct

SEQ ID NO: 4331805 - DNA, 21 bp, Homo sapiens
agtactgtttaccatttttca

SEQ ID NO: 4331806 - DNA, 16 bp, Homo sapiens
agtagaaagacatctg

SEQ ID NO: 4331807 - DNA, 22 bp, Homo sapiens
agtagaaagacatctgcctgta

SEQ ID NO: 4331808 - DNA, 12 bp, Homo sapiens
agtagaaagagt

SEQ ID NO: 4331809 - DNA, 15 bp, Homo sapiens
agtagaaagagtgtt

SEQ ID NO: 4331810 - DNA, 13 bp, Homo sapiens
agtataaatctgg

SEQ ID NO: 4331811 - DNA, 15 bp, Homo sapiens
agtataatctcctct

SEQ ID NO: 4331812 - DNA, 14 bp, Homo sapiens
agtatagagagaag

SEQ ID NO: 4331813 - DNA, 21 bp, Homo sapiens
agtatatgattataatgctat

SEQ ID NO: 4331814 - DNA, 14 bp, Homo sapiens
agtatattatgtat

SEQ ID NO: 4331815 - DNA, 17 bp, Homo sapiens
agtatattatgtattta

SEQ ID NO: 4331816 - DNA, 16 bp, Homo sapiens
agtatcaacttcccag

SEQ ID NO: 4331817 - DNA, 22 bp, Homo sapiens
agtatttaactacatctgcctc

SEQ ID NO: 4331818 - DNA, 23 bp, Homo sapiens
agtatttgaaactgaatgtttat

SEQ ID NO: 4331819 - DNA, 18 bp, Homo sapiens
agtattttccagccttat

SEQ ID NO: 4331820 - DNA, 20 bp, Homo sapiens
agtcaactggggaaaaggat

SEQ ID NO: 4331821 - DNA, 19 bp, Homo sapiens
agtcaagaggtttttctcc

SEQ ID NO: 4331822 - DNA, 20 bp, Homo sapiens
agtcaagtgaaaaaggagga

SEQ ID NO: 4331823 - DNA, 16 bp, Homo sapiens
agtcagagttaaaata

SEQ ID NO: 4331824 - DNA, 18 bp, Homo sapiens
agtcagagttaaaatata

SEQ ID NO: 4331825 - DNA, 20 bp, Homo sapiens
agtcagccattcctgttctc

SEQ ID NO: 4331826 - DNA, 16 bp, Homo sapiens
agtcatcgactcagtt

SEQ ID NO: 4331827 - DNA, 20 bp, Homo sapiens
agtccaaatgtgatcaactg

SEQ ID NO: 4331828 - DNA, 19 bp, Homo sapiens
agtccaaatgtttacaggg

SEQ ID NO: 4331829 - DNA, 23 bp, Homo sapiens
agtccaactcttccacctctggg

SEQ ID NO: 4331830 - DNA, 23 bp, Homo sapiens
agtcctgggtaaatgtggtgaga

SEQ ID NO: 4331831 - DNA, 12 bp, Homo sapiens
agtcgggcatga

SEQ ID NO: 4331832 - DNA, 16 bp, Homo sapiens
agtcgggcatgagtct

SEQ ID NO: 4331833 - DNA, 14 bp, Homo sapiens
agtctcccaaggct

SEQ ID NO: 4331834 - DNA, 21 bp, Homo sapiens
agtctgattataccatgtgtg

SEQ ID NO: 4331835 - DNA, 23 bp, Homo sapiens
agtctgattataccatgtgtgct

SEQ ID NO: 4331836 - DNA, 16 bp, Homo sapiens
agtctggggtgggagg

SEQ ID NO: 4331837 - DNA, 17 bp, Homo sapiens
agtcttaactgtatttc

SEQ ID NO: 4331838 - DNA, 19 bp, Homo sapiens
agtcttaactgtatttcag

SEQ ID NO: 4331839 - DNA, 21 bp, Homo sapiens
agtcttcataccccagaaatt

SEQ ID NO: 4331840 - DNA, 22 bp, Homo sapiens
agtcttcataccccagaaatta

SEQ ID NO: 4331841 - DNA, 16 bp, Homo sapiens
agtgaacttgggaggg

SEQ ID NO: 4331842 - DNA, 20 bp, Homo sapiens
agtgaacttgggccactgtg

SEQ ID NO: 4331843 - DNA, 23 bp, Homo sapiens
agtgaagaataggtgcaaacaaa

SEQ ID NO: 4331844 - DNA, 17 bp, Homo sapiens
agtgaatttatgagatt

SEQ ID NO: 4331845 - DNA, 18 bp, Homo sapiens
agtgaatttatgagattt

SEQ ID NO: 4331846 - DNA, 21 bp, Homo sapiens
agtgagaccctgtctcaaaaa

SEQ ID NO: 4331847 - DNA, 16 bp, Homo sapiens
agtgagtgccatgctt

SEQ ID NO: 4331848 - DNA, 23 bp, Homo sapiens
agtgagttttactcttaaatcat

SEQ ID NO: 4331849 - DNA, 14 bp, Homo sapiens
agtgcaagattttt

SEQ ID NO: 4331850 - DNA, 23 bp, Homo sapiens
agtgccataccttctcccaggcc

SEQ ID NO: 4331851 - DNA, 13 bp, Homo sapiens
agtgccatgcttt

SEQ ID NO: 4331852 - DNA, 20 bp, Homo sapiens
agtgccccaaggaggtggct

SEQ ID NO: 4331853 - DNA, 20 bp, Homo sapiens
agtgcctgctgggtgccagg

SEQ ID NO: 4331854 - DNA, 13 bp, Homo sapiens
agtgctatgtgtg

SEQ ID NO: 4331855 - DNA, 18 bp, Homo sapiens
agtgctgtcttgatgact

SEQ ID NO: 4331856 - DNA, 22 bp, Homo sapiens
agtgcttattctctcatcacag

SEQ ID NO: 4331857 - DNA, 14 bp, Homo sapiens
agtgcttcacattt

SEQ ID NO: 4331858 - DNA, 17 bp, Homo sapiens
agtgcttcagagtttgt

SEQ ID NO: 4331859 - DNA, 21 bp, Homo sapiens
agtgcttcagagtttgtgtgt

SEQ ID NO: 4331860 - DNA, 12 bp, Homo sapiens
agtggccactgg

SEQ ID NO: 4331861 - DNA, 15 bp, Homo sapiens
agtgggaagtgaatc

SEQ ID NO: 4331862 - DNA, 19 bp, Homo sapiens
agtgggtctggtggtgctg

SEQ ID NO: 4331863 - DNA, 16 bp, Homo sapiens
agtggtaaaaaagaaa

SEQ ID NO: 4331864 - DNA, 23 bp, Homo sapiens
agtggtactctgtgtctggcagg

SEQ ID NO: 4331865 - DNA, 16 bp, Homo sapiens
agtgtacatgaagaat

SEQ ID NO: 4331866 - DNA, 13 bp, Homo sapiens
agtgtcacctcct

SEQ ID NO: 4331867 - DNA, 20 bp, Homo sapiens
agtgtcacctccttccccag

SEQ ID NO: 4331868 - DNA, 14 bp, Homo sapiens
agtgtcatttcttt

SEQ ID NO: 4331869 - DNA, 17 bp, Homo sapiens
agtgtcgggaattttcc

SEQ ID NO: 4331870 - DNA, 16 bp, Homo sapiens
agtgttcagtgttgac

SEQ ID NO: 4331871 - DNA, 23 bp, Homo sapiens
agtgttcagtgttgacatagcct

SEQ ID NO: 4331872 - DNA, 15 bp, Homo sapiens
agtgttctctctgaa

SEQ ID NO: 4331873 - DNA, 12 bp, Homo sapiens
agtgttgacata

SEQ ID NO: 4331874 - DNA, 16 bp, Homo sapiens
agtgttgacatagcct

SEQ ID NO: 4331875 - DNA, 17 bp, Homo sapiens
agttaaaatcacatttt

SEQ ID NO: 4331876 - DNA, 19 bp, Homo sapiens
agttaagtgtcatttcttt

SEQ ID NO: 4331877 - DNA, 15 bp, Homo sapiens
agttacttagaatgc

SEQ ID NO: 4331878 - DNA, 14 bp, Homo sapiens
agttataaaactat

SEQ ID NO: 4331879 - DNA, 20 bp, Homo sapiens
agttataaaactatgtgttc

SEQ ID NO: 4331880 - DNA, 21 bp, Homo sapiens
agttatataaaggcaaggaaa

SEQ ID NO: 4331881 - DNA, 13 bp, Homo sapiens
agttccattcttg

SEQ ID NO: 4331882 - DNA, 14 bp, Homo sapiens
agttccattcttgg

SEQ ID NO: 4331883 - DNA, 14 bp, Homo sapiens
agttccctctgcct

SEQ ID NO: 4331884 - DNA, 16 bp, Homo sapiens
agttccctctgcctgg

SEQ ID NO: 4331885 - DNA, 19 bp, Homo sapiens
agttccctctgcctgggat

SEQ ID NO: 4331886 - DNA, 23 bp, Homo sapiens
agttcctcattagcattttgcta

SEQ ID NO: 4331887 - DNA, 23 bp, Homo sapiens
agttctatggagactttgctgtt

SEQ ID NO: 4331888 - DNA, 18 bp, Homo sapiens
agttctgacactgtgtgt

SEQ ID NO: 4331889 - DNA, 15 bp, Homo sapiens
agttctgtaatgtag

SEQ ID NO: 4331890 - DNA, 13 bp, Homo sapiens
agttcttctcccg

SEQ ID NO: 4331891 - DNA, 12 bp, Homo sapiens
agttgaaaatac

SEQ ID NO: 4331892 - DNA, 17 bp, Homo sapiens
agttgaaaatacattct

SEQ ID NO: 4331893 - DNA, 14 bp, Homo sapiens
agttgcagaaaatg

SEQ ID NO: 4331894 - DNA, 20 bp, Homo sapiens
agttgtctgaattgagaaaa

SEQ ID NO: 4331895 - DNA, 12 bp, Homo sapiens
agttgtctgtgc

SEQ ID NO: 4331896 - DNA, 21 bp, Homo sapiens
agtttatctatcggaagaaca

SEQ ID NO: 4331897 - DNA, 22 bp, Homo sapiens
agtttatctatcggaagaacat

SEQ ID NO: 4331898 - DNA, 18 bp, Homo sapiens
agtttattttctgtgtaa

SEQ ID NO: 4331899 - DNA, 14 bp, Homo sapiens
agtttccaagaaat

SEQ ID NO: 4331900 - DNA, 19 bp, Homo sapiens
agtttgagatcagcctggg

SEQ ID NO: 4331901 - DNA, 22 bp, Homo sapiens
agtttgctaaattgagaggggc

SEQ ID NO: 4331902 - DNA, 19 bp, Homo sapiens
agtttggaaataaaaatgt

SEQ ID NO: 4331903 - DNA, 20 bp, Homo sapiens
agtttggaaataaaaatgtt

SEQ ID NO: 4331904 - DNA, 17 bp, Homo sapiens
agtttgtagtaaatatt

SEQ ID NO: 4331905 - DNA, 17 bp, Homo sapiens
agtttgtgtgtatttgt

SEQ ID NO: 4331906 - DNA, 14 bp, Homo sapiens
caagtttttctctc

SEQ ID NO: 4331907 - DNA, 20 bp, Homo sapiens
caataccagcaggaggttct

SEQ ID NO: 4331908 - DNA, 22 bp, Homo sapiens
caatagaaagcaaacatgtgca

SEQ ID NO: 4331909 - DNA, 15 bp, Homo sapiens
caatagaacatgcaa

SEQ ID NO: 4331910 - DNA, 17 bp, Homo sapiens
caatagtcatatgtgaa

SEQ ID NO: 4331911 - DNA, 12 bp, Homo sapiens
caatatgacaca

SEQ ID NO: 4331912 - DNA, 21 bp, Homo sapiens
caatatgacacagcttgtgaa

SEQ ID NO: 4331913 - DNA, 23 bp, Homo sapiens
caatatttctgctttctttgatt

SEQ ID NO: 4331914 - DNA, 17 bp, Homo sapiens
caatcattgttttgaat

SEQ ID NO: 4331915 - DNA, 20 bp, Homo sapiens
caatcattgttttgaatatt

SEQ ID NO: 4331916 - DNA, 21 bp, Homo sapiens
caatctgggaagatttgaaaa

SEQ ID NO: 4331917 - DNA, 15 bp, Homo sapiens
caatcttaagaggat

SEQ ID NO: 4331918 - DNA, 20 bp, Homo sapiens
caatgatacccaacagttta

SEQ ID NO: 4331919 - DNA, 19 bp, Homo sapiens
caatgatcacatctaaagc

SEQ ID NO: 4331920 - DNA, 15 bp, Homo sapiens
caatggagaaaatga

SEQ ID NO: 4331921 - DNA, 17 bp, Homo sapiens
caatggagaaaatgaat

SEQ ID NO: 4331922 - DNA, 16 bp, Homo sapiens
caatggtcctgacttt

SEQ ID NO: 4331923 - DNA, 19 bp, Homo sapiens
caatgtgaaaagaaaaatg

SEQ ID NO: 4331924 - DNA, 12 bp, Homo sapiens
caattaattaaa

SEQ ID NO: 4331925 - DNA, 15 bp, Homo sapiens
caattattgatatat

SEQ ID NO: 4331926 - DNA, 17 bp, Homo sapiens
caattattgatatatat

SEQ ID NO: 4331927 - DNA, 20 bp, Homo sapiens
caattattgatatatattat

SEQ ID NO: 4331928 - DNA, 16 bp, Homo sapiens
caattccaatatttct

SEQ ID NO: 4331929 - DNA, 18 bp, Homo sapiens
caattgcagatgccaaaa

SEQ ID NO: 4331930 - DNA, 13 bp, Homo sapiens
caatttctgctgt

SEQ ID NO: 4331931 - DNA, 16 bp, Homo sapiens
caatttgttcttgtat

SEQ ID NO: 4331932 - DNA, 14 bp, Homo sapiens
cacaaagaaacaaa

SEQ ID NO: 4331933 - DNA, 14 bp, Homo sapiens
cacaaagagaccag

SEQ ID NO: 4331934 - DNA, 14 bp, Homo sapiens
cacaactttgcaaa

SEQ ID NO: 4331935 - DNA, 16 bp, Homo sapiens
cacaactttgcaaatt

SEQ ID NO: 4331936 - DNA, 20 bp, Homo sapiens
cacaagagggactgtatttc

SEQ ID NO: 4331937 - DNA, 15 bp, Homo sapiens
cacaaggccagaaaa

SEQ ID NO: 4331938 - DNA, 22 bp, Homo sapiens
cacaaggccagaaaaagaagaa

SEQ ID NO: 4331939 - DNA, 17 bp, Homo sapiens
cacacatagtttctttt

SEQ ID NO: 4331940 - DNA, 14 bp, Homo sapiens
cacacccacctctg

SEQ ID NO: 4331941 - DNA, 14 bp, Homo sapiens
cacaccgctggctc

SEQ ID NO: 4331942 - DNA, 15 bp, Homo sapiens
cacaccgctggctcc

SEQ ID NO: 4331943 - DNA, 22 bp, Homo sapiens
cacacggacactcaaaagctgg

SEQ ID NO: 4331944 - DNA, 18 bp, Homo sapiens
cacacggagctcctggca

SEQ ID NO: 4331945 - DNA, 19 bp, Homo sapiens
cacagagtttgtagtaaat

SEQ ID NO: 4331946 - DNA, 19 bp, Homo sapiens
cacagatatactttgtgga

SEQ ID NO: 4331947 - DNA, 11 bp, Homo sapiens
cacagccctga

SEQ ID NO: 4331948 - DNA, 13 bp, Homo sapiens
cacagccctgaaa

SEQ ID NO: 4331949 - DNA, 13 bp, Homo sapiens
cacagccctggaa

SEQ ID NO: 4331950 - DNA, 11 bp, Homo sapiens
cacagcctctg

SEQ ID NO: 4331951 - DNA, 21 bp, Homo sapiens
cacagcctgacacagtgctcg

SEQ ID NO: 4331952 - DNA, 15 bp, Homo sapiens
cacagcttgtgaatg

SEQ ID NO: 4331953 - DNA, 18 bp, Homo sapiens
cacagggaaatgtgtatc

SEQ ID NO: 4331954 - DNA, 21 bp, Homo sapiens
cacagtccaactcttccacct

SEQ ID NO: 4331955 - DNA, 15 bp, Homo sapiens
cacagtgggaagaat

SEQ ID NO: 4331956 - DNA, 13 bp, Homo sapiens
cacataaatgaaa

SEQ ID NO: 4331957 - DNA, 18 bp, Homo sapiens
cacataggctggtggcct

SEQ ID NO: 4331958 - DNA, 15 bp, Homo sapiens
cacatataaaaacaa

SEQ ID NO: 4331959 - DNA, 14 bp, Homo sapiens
cacatctaaagctt

SEQ ID NO: 4331960 - DNA, 18 bp, Homo sapiens
cacatctaaagctttatc

SEQ ID NO: 4331961 - DNA, 19 bp, Homo sapiens
cacatctaaagctttatct

SEQ ID NO: 4331962 - DNA, 18 bp, Homo sapiens
cacatgctgagtctccca

SEQ ID NO: 4331963 - DNA, 21 bp, Homo sapiens
cacatgctgagtctcccaagg

SEQ ID NO: 4331964 - DNA, 22 bp, Homo sapiens
cacattcttaacacatgtcctt

SEQ ID NO: 4331965 - DNA, 13 bp, Homo sapiens
caccagcccctgc

SEQ ID NO: 4331966 - DNA, 16 bp, Homo sapiens
caccagcccctgcccc

SEQ ID NO: 4331967 - DNA, 15 bp, Homo sapiens
caccagggagaggcc

SEQ ID NO: 4331968 - DNA, 23 bp, Homo sapiens
caccagggagaggcctcggctgt

SEQ ID NO: 4331969 - DNA, 23 bp, Homo sapiens
caccattcctggaaaccacagtc

SEQ ID NO: 4331970 - DNA, 13 bp, Homo sapiens
cacccaaggagaa

SEQ ID NO: 4331971 - DNA, 16 bp, Homo sapiens
cacccacaaagaaaca

SEQ ID NO: 4331972 - DNA, 12 bp, Homo sapiens
cacccacctctg

SEQ ID NO: 4331973 - DNA, 19 bp, Homo sapiens
cacccagaggtggccctcc

SEQ ID NO: 4331974 - DNA, 21 bp, Homo sapiens
caccccagcccccacagccct

SEQ ID NO: 4331975 - DNA, 13 bp, Homo sapiens
cacccctgcctcc

SEQ ID NO: 4331976 - DNA, 14 bp, Homo sapiens
cacccctgcctcct

SEQ ID NO: 4331977 - DNA, 16 bp, Homo sapiens
cacccctgcctcctgc

SEQ ID NO: 4331978 - DNA, 18 bp, Homo sapiens
cacccctgcctcctgcct

SEQ ID NO: 4331979 - DNA, 16 bp, Homo sapiens
cacccgacctctgact

SEQ ID NO: 4331980 - DNA, 17 bp, Homo sapiens
cacccgccccgccccct

SEQ ID NO: 4331981 - DNA, 19 bp, Homo sapiens
cacccgccccgccccctcc

SEQ ID NO: 4331982 - DNA, 14 bp, Homo sapiens
caccctcaggcagg

SEQ ID NO: 4331983 - DNA, 16 bp, Homo sapiens
caccgaggagccccag

SEQ ID NO: 4331984 - DNA, 22 bp, Homo sapiens
caccgccgactttgtacccccc

SEQ ID NO: 4331985 - DNA, 15 bp, Homo sapiens
cacctattgaattac

SEQ ID NO: 4331986 - DNA, 11 bp, Homo sapiens
cacctcccatc

SEQ ID NO: 4331987 - DNA, 13 bp, Homo sapiens
cacctccttcccc

SEQ ID NO: 4331988 - DNA, 12 bp, Homo sapiens
caccttgttaca

SEQ ID NO: 4331989 - DNA, 22 bp, Homo sapiens
cacgactgttgtacaagctcag

SEQ ID NO: 4331990 - DNA, 19 bp, Homo sapiens
cacgcctgtaatcctagca

SEQ ID NO: 4331991 - DNA, 20 bp, Homo sapiens
cacgctccccgcctgttccc

SEQ ID NO: 4331992 - DNA, 16 bp, Homo sapiens
cacggagctcctggca

SEQ ID NO: 4331993 - DNA, 15 bp, Homo sapiens
cacgggtctgccatg

SEQ ID NO: 4331994 - DNA, 17 bp, Homo sapiens
cacgtccactcccaagc

SEQ ID NO: 4331995 - DNA, 20 bp, Homo sapiens
cacgtgccattgtctttcct

SEQ ID NO: 4331996 - DNA, 15 bp, Homo sapiens
cacgtggccaggagc

SEQ ID NO: 4331997 - DNA, 16 bp, Homo sapiens
cacgtggccaggagcc

SEQ ID NO: 4331998 - DNA, 17 bp, Homo sapiens
cacgtggccaggagcca

SEQ ID NO: 4331999 - DNA, 15 bp, Homo sapiens
cactaacaaaatttg

SEQ ID NO: 4332000 - DNA, 14 bp, Homo sapiens
cactactgggtgtc

SEQ ID NO: 4332001 - DNA, 21 bp, Homo sapiens
cactactgggtgtcatttcat

SEQ ID NO: 4332002 - DNA, 15 bp, Homo sapiens
cactaggagactggt

SEQ ID NO: 4332003 - DNA, 21 bp, Homo sapiens
cactagtaagtaattatgcac

SEQ ID NO: 4332004 - DNA, 17 bp, Homo sapiens
cactcaaaagctgggca

SEQ ID NO: 4332005 - DNA, 18 bp, Homo sapiens
cactcaaaagctgggcag

SEQ ID NO: 4332006 - DNA, 19 bp, Homo sapiens
cactcatgcaaactgcttt

SEQ ID NO: 4332007 - DNA, 22 bp, Homo sapiens
cactcatgcaaactgctttatt

SEQ ID NO: 4332008 - DNA, 13 bp, Homo sapiens
cactcattcctgt

SEQ ID NO: 4332009 - DNA, 15 bp, Homo sapiens
cactcattcctgtag

SEQ ID NO: 4332010 - DNA, 14 bp, Homo sapiens
cactcccaagccac

SEQ ID NO: 4332011 - DNA, 17 bp, Homo sapiens
cactctaaaaatagaat

SEQ ID NO: 4332012 - DNA, 20 bp, Homo sapiens
cactgcactccagcctgggt

SEQ ID NO: 4332013 - DNA, 21 bp, Homo sapiens
cactgcattcattctgagccc

SEQ ID NO: 4332014 - DNA, 17 bp, Homo sapiens
cactgccatgccagctt

SEQ ID NO: 4332015 - DNA, 22 bp, Homo sapiens
cactgtaagactcattccctag

SEQ ID NO: 4332016 - DNA, 16 bp, Homo sapiens
cactgtctgcgtgact

SEQ ID NO: 4332017 - DNA, 19 bp, Homo sapiens
cactgtgtgtttgggaagg

SEQ ID NO: 4332018 - DNA, 12 bp, Homo sapiens
cacttcagctga

SEQ ID NO: 4332019 - DNA, 21 bp, Homo sapiens
cacttctcttaaacttgtgaa

SEQ ID NO: 4332020 - DNA, 13 bp, Homo sapiens
cacttgagtccag

SEQ ID NO: 4332021 - DNA, 14 bp, Homo sapiens
cagaaaaagaagaa

SEQ ID NO: 4332022 - DNA, 13 bp, Homo sapiens
cagaaaatgaact

SEQ ID NO: 4332023 - DNA, 16 bp, Homo sapiens
cagaaagatttggaaa

SEQ ID NO: 4332024 - DNA, 11 bp, Homo sapiens
cagaaatgttt

SEQ ID NO: 4332025 - DNA, 17 bp, Homo sapiens
cagaaatgtttttaaca

SEQ ID NO: 4332026 - DNA, 18 bp, Homo sapiens
cagaaatgtttttaacac

SEQ ID NO: 4332027 - DNA, 14 bp, Homo sapiens
cagaaattattggt

SEQ ID NO: 4332028 - DNA, 15 bp, Homo sapiens
attttcattgtgatt

SEQ ID NO: 4332029 - DNA, 20 bp, Homo sapiens
attttccagccttatgtgtt

SEQ ID NO: 4332030 - DNA, 12 bp, Homo sapiens
attttctgtgta

SEQ ID NO: 4332031 - DNA, 18 bp, Homo sapiens
attttctgtgtaaaatga

SEQ ID NO: 4332032 - DNA, 13 bp, Homo sapiens
attttcttcagaa

SEQ ID NO: 4332033 - DNA, 15 bp, Homo sapiens
attttcttcagaatt

SEQ ID NO: 4332034 - DNA, 14 bp, Homo sapiens
attttcttttatta

SEQ ID NO: 4332035 - DNA, 17 bp, Homo sapiens
attttgaggtaaagata

SEQ ID NO: 4332036 - DNA, 18 bp, Homo sapiens
attttgaggtaaagatat

SEQ ID NO: 4332037 - DNA, 18 bp, Homo sapiens
attttgaggtagaggaaa

SEQ ID NO: 4332038 - DNA, 21 bp, Homo sapiens
attttgtttttgtcttaaaaa

SEQ ID NO: 4332039 - DNA, 13 bp, Homo sapiens
atttttaaccact

SEQ ID NO: 4332040 - DNA, 17 bp, Homo sapiens
atttttaacctcaaaat

SEQ ID NO: 4332041 - DNA, 15 bp, Homo sapiens
atttttccatctgtg

SEQ ID NO: 4332042 - DNA, 16 bp, Homo sapiens
atttttccatctgtgt

SEQ ID NO: 4332043 - DNA, 19 bp, Homo sapiens
atttttgtaaactggaatt

SEQ ID NO: 4332044 - DNA, 13 bp, Homo sapiens
attttttaataaa

SEQ ID NO: 4332045 - DNA, 21 bp, Homo sapiens
atttttttaaacaaaatttca

SEQ ID NO: 4332046 - DNA, 18 bp, Homo sapiens
attttttttaaatcaaaa

SEQ ID NO: 4332047 - DNA, 16 bp, Homo sapiens
caaaaagaccttctcc

SEQ ID NO: 4332048 - DNA, 9 bp, Homo sapiens
caaaaagcc

SEQ ID NO: 4332049 - DNA, 13 bp, Homo sapiens
caaaacaaaatgt

SEQ ID NO: 4332050 - DNA, 23 bp, Homo sapiens
caaaacaaagctgatttcccttt

SEQ ID NO: 4332051 - DNA, 15 bp, Homo sapiens
caaaacggttttact

SEQ ID NO: 4332052 - DNA, 20 bp, Homo sapiens
caaaactgctttgtgcatat

SEQ ID NO: 4332053 - DNA, 16 bp, Homo sapiens
caaaagatgcttctca

SEQ ID NO: 4332054 - DNA, 15 bp, Homo sapiens
caaaagctgggcagg

SEQ ID NO: 4332055 - DNA, 16 bp, Homo sapiens
caaaagggagaacatg

SEQ ID NO: 4332056 - DNA, 14 bp, Homo sapiens
caaaataaatgttg

SEQ ID NO: 4332057 - DNA, 20 bp, Homo sapiens
caaaatagaagaagaggaag

SEQ ID NO: 4332058 - DNA, 12 bp, Homo sapiens
caaaatattttc

SEQ ID NO: 4332059 - DNA, 17 bp, Homo sapiens
caaaatctgattagaag

SEQ ID NO: 4332060 - DNA, 17 bp, Homo sapiens
caaaatgtacttaaatg

SEQ ID NO: 4332061 - DNA, 11 bp, Homo sapiens
caaaatgttgg

SEQ ID NO: 4332062 - DNA, 16 bp, Homo sapiens
caaaatgttggctgcg

SEQ ID NO: 4332063 - DNA, 16 bp, Homo sapiens
caaaatttcacagttc

SEQ ID NO: 4332064 - DNA, 18 bp, Homo sapiens
caaaatttcacagttctg

SEQ ID NO: 4332065 - DNA, 22 bp, Homo sapiens
caaacacttattgtttgaaaga

SEQ ID NO: 4332066 - DNA, 19 bp, Homo sapiens
caaacccatgaagctggcc

SEQ ID NO: 4332067 - DNA, 17 bp, Homo sapiens
caaactctataaagaaa

SEQ ID NO: 4332068 - DNA, 13 bp, Homo sapiens
caaacttctcgca

SEQ ID NO: 4332069 - DNA, 15 bp, Homo sapiens
caaagaaacaaagca

SEQ ID NO: 4332070 - DNA, 16 bp, Homo sapiens
caaagaaacaaagcaa

SEQ ID NO: 4332071 - DNA, 17 bp, Homo sapiens
caaagaaacaaagcaaa

SEQ ID NO: 4332072 - DNA, 15 bp, Homo sapiens
caaagacacacagga

SEQ ID NO: 4332073 - DNA, 14 bp, Homo sapiens
caaagaggttttaa

SEQ ID NO: 4332074 - DNA, 21 bp, Homo sapiens
caaagataagacttgtttctt

SEQ ID NO: 4332075 - DNA, 13 bp, Homo sapiens
caaagatttcagt

SEQ ID NO: 4332076 - DNA, 19 bp, Homo sapiens
caaagatttcagtagaatt

SEQ ID NO: 4332077 - DNA, 15 bp, Homo sapiens
caaagcaacctttcc

SEQ ID NO: 4332078 - DNA, 18 bp, Homo sapiens
caaagctgatttcccttt

SEQ ID NO: 4332079 - DNA, 17 bp, Homo sapiens
caaagctggctttttgt

SEQ ID NO: 4332080 - DNA, 23 bp, Homo sapiens
caaagtgaaggacatagaggtat

SEQ ID NO: 4332081 - DNA, 13 bp, Homo sapiens
caaagttcagtgt

SEQ ID NO: 4332082 - DNA, 12 bp, Homo sapiens
caaataaaatga

SEQ ID NO: 4332083 - DNA, 13 bp, Homo sapiens
caaataaagcctt

SEQ ID NO: 4332084 - DNA, 23 bp, Homo sapiens
caaataaagccttttaaatcatc

SEQ ID NO: 4332085 - DNA, 13 bp, Homo sapiens
caaatatatgtat

SEQ ID NO: 4332086 - DNA, 12 bp, Homo sapiens
caaatggctgct

SEQ ID NO: 4332087 - DNA, 16 bp, Homo sapiens
caaatgtgatcaactg

SEQ ID NO: 4332088 - DNA, 20 bp, Homo sapiens
caaatgtgatcaactgttca

SEQ ID NO: 4332089 - DNA, 14 bp, Homo sapiens
caaattagggcaat

SEQ ID NO: 4332090 - DNA, 12 bp, Homo sapiens
caaattatttat

SEQ ID NO: 4332091 - DNA, 16 bp, Homo sapiens
caaattatttattact

SEQ ID NO: 4332092 - DNA, 17 bp, Homo sapiens
caaattatttattactt

SEQ ID NO: 4332093 - DNA, 19 bp, Homo sapiens
caaattgtgcttctcccca

SEQ ID NO: 4332094 - DNA, 23 bp, Homo sapiens
caaattgtgcttctccccagaat

SEQ ID NO: 4332095 - DNA, 19 bp, Homo sapiens
caaatttgaaaataattgt

SEQ ID NO: 4332096 - DNA, 20 bp, Homo sapiens
caacagtttatttttattat

SEQ ID NO: 4332097 - DNA, 16 bp, Homo sapiens
caacccctgaggaaga

SEQ ID NO: 4332098 - DNA, 23 bp, Homo sapiens
caacccgttgggtcccttgctgc

SEQ ID NO: 4332099 - DNA, 23 bp, Homo sapiens
caactcaagtgtcacctccttcc

SEQ ID NO: 4332100 - DNA, 13 bp, Homo sapiens
caactcccacgac

SEQ ID NO: 4332101 - DNA, 17 bp, Homo sapiens
caactcccacgactgtt

SEQ ID NO: 4332102 - DNA, 14 bp, Homo sapiens
caactgaaggaagg

SEQ ID NO: 4332103 - DNA, 15 bp, Homo sapiens
caactgaaggaaggc

SEQ ID NO: 4332104 - DNA, 15 bp, Homo sapiens
caactgcataacctt

SEQ ID NO: 4332105 - DNA, 17 bp, Homo sapiens
caactggggaaaaggat

SEQ ID NO: 4332106 - DNA, 14 bp, Homo sapiens
caagaaattttaga

SEQ ID NO: 4332107 - DNA, 18 bp, Homo sapiens
caagaagatcacgctccc

SEQ ID NO: 4332108 - DNA, 19 bp, Homo sapiens
caagaagatcacgctcccc

SEQ ID NO: 4332109 - DNA, 20 bp, Homo sapiens
caagaagatcacgctccccg

SEQ ID NO: 4332110 - DNA, 23 bp, Homo sapiens
caagaagatcacgctccccgcct

SEQ ID NO: 4332111 - DNA, 22 bp, Homo sapiens
caagaattgaagcaggactaaa

SEQ ID NO: 4332112 - DNA, 19 bp, Homo sapiens
caagaatttctggaagaaa

SEQ ID NO: 4332113 - DNA, 20 bp, Homo sapiens
caagaatttctggaagaaag

SEQ ID NO: 4332114 - DNA, 22 bp, Homo sapiens
caagaatttctggaagaaaggc

SEQ ID NO: 4332115 - DNA, 16 bp, Homo sapiens
caagatggagaggaag

SEQ ID NO: 4332116 - DNA, 17 bp, Homo sapiens
caagatggagaggaaga

SEQ ID NO: 4332117 - DNA, 19 bp, Homo sapiens
caagatggagaggaagaaa

SEQ ID NO: 4332118 - DNA, 21 bp, Homo sapiens
caagattttttttttaagtga

SEQ ID NO: 4332119 - DNA, 13 bp, Homo sapiens
caagcattacttt

SEQ ID NO: 4332120 - DNA, 14 bp, Homo sapiens
caagcattacttta

SEQ ID NO: 4332121 - DNA, 14 bp, Homo sapiens
caagccactagccc

SEQ ID NO: 4332122 - DNA, 14 bp, Homo sapiens
caagccttactcac

SEQ ID NO: 4332123 - DNA, 20 bp, Homo sapiens
caagccttactcacctctct

SEQ ID NO: 4332124 - DNA, 21 bp, Homo sapiens
caagctaatctgcctggtttt

SEQ ID NO: 4332125 - DNA, 16 bp, Homo sapiens
caagctagactgtgtc

SEQ ID NO: 4332126 - DNA, 17 bp, Homo sapiens
caagctagactgtgtct

SEQ ID NO: 4332127 - DNA, 20 bp, Homo sapiens
caagctagactgtgtctgaa

SEQ ID NO: 4332128 - DNA, 18 bp, Homo sapiens
caagctgcaccctcaggc

SEQ ID NO: 4332129 - DNA, 21 bp, Homo sapiens
caagctgcaccctcaggcagg

SEQ ID NO: 4332130 - DNA, 14 bp, Homo sapiens
caagcttaaagctt

SEQ ID NO: 4332131 - DNA, 15 bp, Homo sapiens
caagcttttcctttc

SEQ ID NO: 4332132 - DNA, 16 bp, Homo sapiens
caagcttttcctttct

SEQ ID NO: 4332133 - DNA, 15 bp, Homo sapiens
caaggattgaaaatt

SEQ ID NO: 4332134 - DNA, 22 bp, Homo sapiens
caaggccggagacccacagccc

SEQ ID NO: 4332135 - DNA, 23 bp, Homo sapiens
caaggccggagacccacagccct

SEQ ID NO: 4332136 - DNA, 12 bp, Homo sapiens
caaggctgcagt

SEQ ID NO: 4332137 - DNA, 15 bp, Homo sapiens
caaggctgcagtgag

SEQ ID NO: 4332138 - DNA, 17 bp, Homo sapiens
caaggctgcgtctggag

SEQ ID NO: 4332139 - DNA, 14 bp, Homo sapiens
caaggtggcccgga

SEQ ID NO: 4332140 - DNA, 12 bp, Homo sapiens
caagtaacactt

SEQ ID NO: 4332141 - DNA, 16 bp, Homo sapiens
caagtaacactttaaa

SEQ ID NO: 4332142 - DNA, 23 bp, Homo sapiens
caagtaacactttaaaaccagtt

SEQ ID NO: 4332143 - DNA, 18 bp, Homo sapiens
caagtaaggcttttaatt

SEQ ID NO: 4332144 - DNA, 20 bp, Homo sapiens
caagtatgaagtataaatct

SEQ ID NO: 4332145 - DNA, 18 bp, Homo sapiens
caagtcattcctaatctt

SEQ ID NO: 4332146 - DNA, 19 bp, Homo sapiens
caagtgaaaaaggaggaag

SEQ ID NO: 4332147 - DNA, 15 bp, Homo sapiens
caagtgtcacctcct

SEQ ID NO: 4332148 - DNA, 23 bp, Homo sapiens
caagtgtcacctccttccccagc

SEQ ID NO: 4332149 - DNA, 17 bp, Homo sapiens
attataatgctatttta

SEQ ID NO: 4332150 - DNA, 14 bp, Homo sapiens
attataccatgtgt

SEQ ID NO: 4332151 - DNA, 20 bp, Homo sapiens
attatccattacgtgcattt

SEQ ID NO: 4332152 - DNA, 21 bp, Homo sapiens
attatccattacgtgcattta

SEQ ID NO: 4332153 - DNA, 13 bp, Homo sapiens
attatgaaatatg

SEQ ID NO: 4332154 - DNA, 12 bp, Homo sapiens
attatgatttta

SEQ ID NO: 4332155 - DNA, 15 bp, Homo sapiens
attatgtaacctatt

SEQ ID NO: 4332156 - DNA, 22 bp, Homo sapiens
attatgtttcctaactgtgatt

SEQ ID NO: 4332157 - DNA, 22 bp, Homo sapiens
attattagattgccaatactca

SEQ ID NO: 4332158 - DNA, 13 bp, Homo sapiens
attattgatatat

SEQ ID NO: 4332159 - DNA, 17 bp, Homo sapiens
attattggtatatttgt

SEQ ID NO: 4332160 - DNA, 20 bp, Homo sapiens
attattggtatatttgtaga

SEQ ID NO: 4332161 - DNA, 13 bp, Homo sapiens
attatttattact

SEQ ID NO: 4332162 - DNA, 14 bp, Homo sapiens
attatttattactt

SEQ ID NO: 4332163 - DNA, 22 bp, Homo sapiens
attatttattacttgtgcactt

SEQ ID NO: 4332164 - DNA, 18 bp, Homo sapiens
attatttcagattcctca

SEQ ID NO: 4332165 - DNA, 20 bp, Homo sapiens
attattttgaggtagaggaa

SEQ ID NO: 4332166 - DNA, 12 bp, Homo sapiens
attcaaggctta

SEQ ID NO: 4332167 - DNA, 20 bp, Homo sapiens
attcaaggctttaaaagtca

SEQ ID NO: 4332168 - DNA, 14 bp, Homo sapiens
attcaagtaacact

SEQ ID NO: 4332169 - DNA, 16 bp, Homo sapiens
attcaccctgggcagt

SEQ ID NO: 4332170 - DNA, 17 bp, Homo sapiens
attcagctagaatttct

SEQ ID NO: 4332171 - DNA, 15 bp, Homo sapiens
attccaatatttctg

SEQ ID NO: 4332172 - DNA, 19 bp, Homo sapiens
attccattaataactgaat

SEQ ID NO: 4332173 - DNA, 23 bp, Homo sapiens
attccccttttttctctatgtac

SEQ ID NO: 4332174 - DNA, 17 bp, Homo sapiens
attccctctcccaccca

SEQ ID NO: 4332175 - DNA, 15 bp, Homo sapiens
attcctacagcacta

SEQ ID NO: 4332176 - DNA, 15 bp, Homo sapiens
attccttaaatgaac

SEQ ID NO: 4332177 - DNA, 20 bp, Homo sapiens
attccttaaatgaactactg

SEQ ID NO: 4332178 - DNA, 15 bp, Homo sapiens
attccttacttgcac

SEQ ID NO: 4332179 - DNA, 16 bp, Homo sapiens
attccttacttgcact

SEQ ID NO: 4332180 - DNA, 18 bp, Homo sapiens
attccttacttgcactgt

SEQ ID NO: 4332181 - DNA, 19 bp, Homo sapiens
attctcataattcctacag

SEQ ID NO: 4332182 - DNA, 18 bp, Homo sapiens
attctccttttatgtgta

SEQ ID NO: 4332183 - DNA, 19 bp, Homo sapiens
attctccttttatgtgtag

SEQ ID NO: 4332184 - DNA, 21 bp, Homo sapiens
attctctcaagacttctccag

SEQ ID NO: 4332185 - DNA, 15 bp, Homo sapiens
attctgatcaatcat

SEQ ID NO: 4332186 - DNA, 15 bp, Homo sapiens
attctgcattgagaa

SEQ ID NO: 4332187 - DNA, 14 bp, Homo sapiens
attcttatgcttat

SEQ ID NO: 4332188 - DNA, 19 bp, Homo sapiens
attcttggttgttaattta

SEQ ID NO: 4332189 - DNA, 14 bp, Homo sapiens
attctttgcattcc

SEQ ID NO: 4332190 - DNA, 19 bp, Homo sapiens
attgaaaacactaacaaaa

SEQ ID NO: 4332191 - DNA, 22 bp, Homo sapiens
attgaaaacactaacaaaattt

SEQ ID NO: 4332192 - DNA, 12 bp, Homo sapiens
attgaaagaaaa

SEQ ID NO: 4332193 - DNA, 14 bp, Homo sapiens
attgaaagaaaaaa

SEQ ID NO: 4332194 - DNA, 22 bp, Homo sapiens
attgaaatagtttccaagaaat

SEQ ID NO: 4332195 - DNA, 22 bp, Homo sapiens
attgagaaaagagtgagaacta

SEQ ID NO: 4332196 - DNA, 18 bp, Homo sapiens
attgagaataagaatttg

SEQ ID NO: 4332197 - DNA, 18 bp, Homo sapiens
attgagtcttaactgtat

SEQ ID NO: 4332198 - DNA, 17 bp, Homo sapiens
attgcaaaatagaagaa

SEQ ID NO: 4332199 - DNA, 23 bp, Homo sapiens
attgcaaaatagaagaagaggaa

SEQ ID NO: 4332200 - DNA, 19 bp, Homo sapiens
attgcaccattttcaattt

SEQ ID NO: 4332201 - DNA, 11 bp, Homo sapiens
attgcactagg

SEQ ID NO: 4332202 - DNA, 15 bp, Homo sapiens
attgcactaggaatt

SEQ ID NO: 4332203 - DNA, 22 bp, Homo sapiens
attgccgtcctggactctgtgt

SEQ ID NO: 4332204 - DNA, 12 bp, Homo sapiens
attgctgcttga

SEQ ID NO: 4332205 - DNA, 14 bp, Homo sapiens
attgcttgagctca

SEQ ID NO: 4332206 - DNA, 18 bp, Homo sapiens
attgcttgagctcaggag

SEQ ID NO: 4332207 - DNA, 16 bp, Homo sapiens
attgggggatgtgaag

SEQ ID NO: 4332208 - DNA, 21 bp, Homo sapiens
attgggggatgtgaagaaata

SEQ ID NO: 4332209 - DNA, 19 bp, Homo sapiens
attgtagggttattagtcc

SEQ ID NO: 4332210 - DNA, 15 bp, Homo sapiens
attgtagttcttagt

SEQ ID NO: 4332211 - DNA, 16 bp, Homo sapiens
attgtatttaaaggta

SEQ ID NO: 4332212 - DNA, 14 bp, Homo sapiens
attgtccagctggg

SEQ ID NO: 4332213 - DNA, 14 bp, Homo sapiens
attgtgcttctccc

SEQ ID NO: 4332214 - DNA, 18 bp, Homo sapiens
attgtgcttctccccaga

SEQ ID NO: 4332215 - DNA, 18 bp, Homo sapiens
attgttccaaatgaatgt

SEQ ID NO: 4332216 - DNA, 23 bp, Homo sapiens
attgtttatacacaactttgcaa

SEQ ID NO: 4332217 - DNA, 17 bp, Homo sapiens
attgttttgaatattac

SEQ ID NO: 4332218 - DNA, 22 bp, Homo sapiens
attgttttgaatattactccta

SEQ ID NO: 4332219 - DNA, 20 bp, Homo sapiens
atttaaaaaattaaaaatga

SEQ ID NO: 4332220 - DNA, 17 bp, Homo sapiens
atttaaactattcagag

SEQ ID NO: 4332221 - DNA, 12 bp, Homo sapiens
atttaaactctg

SEQ ID NO: 4332222 - DNA, 17 bp, Homo sapiens
atttaaactctgccaga

SEQ ID NO: 4332223 - DNA, 14 bp, Homo sapiens
atttaaattggtca

SEQ ID NO: 4332224 - DNA, 21 bp, Homo sapiens
atttaagtttgtagtttttgc

SEQ ID NO: 4332225 - DNA, 14 bp, Homo sapiens
atttacaggacttc

SEQ ID NO: 4332226 - DNA, 15 bp, Homo sapiens
atttacaggacttct

SEQ ID NO: 4332227 - DNA, 18 bp, Homo sapiens
atttacaggacttctctt

SEQ ID NO: 4332228 - DNA, 13 bp, Homo sapiens
atttactggccac

SEQ ID NO: 4332229 - DNA, 17 bp, Homo sapiens
atttagaagcaaagatt

SEQ ID NO: 4332230 - DNA, 23 bp, Homo sapiens
atttagaagcaaagatttcagta

SEQ ID NO: 4332231 - DNA, 18 bp, Homo sapiens
atttagagcgtttggtta

SEQ ID NO: 4332232 - DNA, 22 bp, Homo sapiens
atttagagcttttcagaacatc

SEQ ID NO: 4332233 - DNA, 17 bp, Homo sapiens
atttagtagttatttgt

SEQ ID NO: 4332234 - DNA, 21 bp, Homo sapiens
atttagttacgtataatgctt

SEQ ID NO: 4332235 - DNA, 15 bp, Homo sapiens
atttatatcttgtta

SEQ ID NO: 4332236 - DNA, 17 bp, Homo sapiens
atttatgagatttactg

SEQ ID NO: 4332237 - DNA, 15 bp, Homo sapiens
atttattacttgtgc

SEQ ID NO: 4332238 - DNA, 16 bp, Homo sapiens
atttattacttgtgca

SEQ ID NO: 4332239 - DNA, 21 bp, Homo sapiens
atttattacttgtgcacttag

SEQ ID NO: 4332240 - DNA, 17 bp, Homo sapiens
atttcacagttctgtaa

SEQ ID NO: 4332241 - DNA, 11 bp, Homo sapiens
atttcagattt

SEQ ID NO: 4332242 - DNA, 15 bp, Homo sapiens
atttcagattttaaa

SEQ ID NO: 4332243 - DNA, 11 bp, Homo sapiens
atttcattcca

SEQ ID NO: 4332244 - DNA, 16 bp, Homo sapiens
atttcattccattgcc

SEQ ID NO: 4332245 - DNA, 17 bp, Homo sapiens
atttccaaaataatcta

SEQ ID NO: 4332246 - DNA, 20 bp, Homo sapiens
atttcctctctatctttttt

SEQ ID NO: 4332247 - DNA, 16 bp, Homo sapiens
atttctctggcaaact

SEQ ID NO: 4332248 - DNA, 14 bp, Homo sapiens
atttctggaagaaa

SEQ ID NO: 4332249 - DNA, 20 bp, Homo sapiens
atttctgtggaaaacaattt

SEQ ID NO: 4332250 - DNA, 19 bp, Homo sapiens
atttcttaatgtctgtcag

SEQ ID NO: 4332251 - DNA, 16 bp, Homo sapiens
atttcttgtgatgtat

SEQ ID NO: 4332252 - DNA, 21 bp, Homo sapiens
atttcttgtgatgtattcttt

SEQ ID NO: 4332253 - DNA, 17 bp, Homo sapiens
atttgaaaataattgtt

SEQ ID NO: 4332254 - DNA, 13 bp, Homo sapiens
atttgatctttgt

SEQ ID NO: 4332255 - DNA, 22 bp, Homo sapiens
atttgatctttgtttaaatgcc

SEQ ID NO: 4332256 - DNA, 23 bp, Homo sapiens
atttgatctttgtttaaatgcca

SEQ ID NO: 4332257 - DNA, 14 bp, Homo sapiens
atttgcataatact

SEQ ID NO: 4332258 - DNA, 19 bp, Homo sapiens
atttgcataatactaattt

SEQ ID NO: 4332259 - DNA, 23 bp, Homo sapiens
atttgcataatactaatttattg

SEQ ID NO: 4332260 - DNA, 20 bp, Homo sapiens
atttggcttgctgtttactc

SEQ ID NO: 4332261 - DNA, 18 bp, Homo sapiens
atttgtataaattaaata

SEQ ID NO: 4332262 - DNA, 13 bp, Homo sapiens
atttgtattaata

SEQ ID NO: 4332263 - DNA, 12 bp, Homo sapiens
attttaaaaaat

SEQ ID NO: 4332264 - DNA, 15 bp, Homo sapiens
attttaaaaagggta

SEQ ID NO: 4332265 - DNA, 22 bp, Homo sapiens
attttaaaaagggtaacttgtt

SEQ ID NO: 4332266 - DNA, 22 bp, Homo sapiens
attttaaagacccaacttgcca

SEQ ID NO: 4332267 - DNA, 22 bp, Homo sapiens
attttaataaactttgaataaa

SEQ ID NO: 4332268 - DNA, 21 bp, Homo sapiens
attttagaaacccctctgtag

SEQ ID NO: 4332269 - DNA, 16 bp, Homo sapiens
atgccaatatgacaca

SEQ ID NO: 4332270 - DNA, 22 bp, Homo sapiens
atgccacagtggtactctgtgt

SEQ ID NO: 4332271 - DNA, 14 bp, Homo sapiens
atgcccaccgagga

SEQ ID NO: 4332272 - DNA, 23 bp, Homo sapiens
atgcccaccgaggagccccagcc

SEQ ID NO: 4332273 - DNA, 15 bp, Homo sapiens
atgccctatgtgtat

SEQ ID NO: 4332274 - DNA, 14 bp, Homo sapiens
atgccctgctccag

SEQ ID NO: 4332275 - DNA, 21 bp, Homo sapiens
atgccctgttgggggcttcag

SEQ ID NO: 4332276 - DNA, 20 bp, Homo sapiens
atgccgaacattaggaattg

SEQ ID NO: 4332277 - DNA, 19 bp, Homo sapiens
atgccttcgggaaaattca

SEQ ID NO: 4332278 - DNA, 21 bp, Homo sapiens
atgctaagagtcctgggtaaa

SEQ ID NO: 4332279 - DNA, 17 bp, Homo sapiens
atgctacacatatgtgc

SEQ ID NO: 4332280 - DNA, 15 bp, Homo sapiens
atgctattttaaaaa

SEQ ID NO: 4332281 - DNA, 13 bp, Homo sapiens
atgctctaacaaa

SEQ ID NO: 4332282 - DNA, 17 bp, Homo sapiens
atgctgaagtacagtcc

SEQ ID NO: 4332283 - DNA, 16 bp, Homo sapiens
atgctgagctgaagaa

SEQ ID NO: 4332284 - DNA, 19 bp, Homo sapiens
atgctgagctgaagaaatt

SEQ ID NO: 4332285 - DNA, 18 bp, Homo sapiens
atgctggcctgactggtt

SEQ ID NO: 4332286 - DNA, 22 bp, Homo sapiens
atgctggcctgactggttgtca

SEQ ID NO: 4332287 - DNA, 12 bp, Homo sapiens
atgctgtatttc

SEQ ID NO: 4332288 - DNA, 18 bp, Homo sapiens
atgctgtatttctttgta

SEQ ID NO: 4332289 - DNA, 17 bp, Homo sapiens
atgctgtccgtgcttgc

SEQ ID NO: 4332290 - DNA, 16 bp, Homo sapiens
atgcttctcatcttgt

SEQ ID NO: 4332291 - DNA, 22 bp, Homo sapiens
atgcttctcatcttgtgaaatg

SEQ ID NO: 4332292 - DNA, 22 bp, Homo sapiens
atgctttgagaccagaagaaaa

SEQ ID NO: 4332293 - DNA, 22 bp, Homo sapiens
atggaatgattggttaaaatgt

SEQ ID NO: 4332294 - DNA, 22 bp, Homo sapiens
atggacattttcttttattatc

SEQ ID NO: 4332295 - DNA, 21 bp, Homo sapiens
atggacccaatatttaccaga

SEQ ID NO: 4332296 - DNA, 21 bp, Homo sapiens
atggacgctgccgggagactg

SEQ ID NO: 4332297 - DNA, 17 bp, Homo sapiens
atggagaaaatgaatgg

SEQ ID NO: 4332298 - DNA, 18 bp, Homo sapiens
atggagaaaatgaatgga

SEQ ID NO: 4332299 - DNA, 17 bp, Homo sapiens
atggagaattgctgaag

SEQ ID NO: 4332300 - DNA, 17 bp, Homo sapiens
atggagactttgctgtt

SEQ ID NO: 4332301 - DNA, 13 bp, Homo sapiens
atggagaggaaga

SEQ ID NO: 4332302 - DNA, 15 bp, Homo sapiens
atggagaggaagaaa

SEQ ID NO: 4332303 - DNA, 16 bp, Homo sapiens
atggaggcctacctct

SEQ ID NO: 4332304 - DNA, 16 bp, Homo sapiens
atggagtgtttgaaaa

SEQ ID NO: 4332305 - DNA, 19 bp, Homo sapiens
atggagtgtttgaaaactg

SEQ ID NO: 4332306 - DNA, 14 bp, Homo sapiens
atggatagaaaaaa

SEQ ID NO: 4332307 - DNA, 21 bp, Homo sapiens
atggatagaaaaaaactaaag

SEQ ID NO: 4332308 - DNA, 22 bp, Homo sapiens
atggatgcaaagtacaatgtgt

SEQ ID NO: 4332309 - DNA, 16 bp, Homo sapiens
atggcatggagactct

SEQ ID NO: 4332310 - DNA, 21 bp, Homo sapiens
atggcatggagactctgagag

SEQ ID NO: 4332311 - DNA, 21 bp, Homo sapiens
atggccaatagtcatatgtga

SEQ ID NO: 4332312 - DNA, 19 bp, Homo sapiens
atggccaggatcctctcct

SEQ ID NO: 4332313 - DNA, 21 bp, Homo sapiens
atggcctatgtgcgaagcaag

SEQ ID NO: 4332314 - DNA, 22 bp, Homo sapiens
atggctgctttgacaaggcaga

SEQ ID NO: 4332315 - DNA, 17 bp, Homo sapiens
atgggaaataaagaaaa

SEQ ID NO: 4332316 - DNA, 22 bp, Homo sapiens
atgggaaataaagaaaattctc

SEQ ID NO: 4332317 - DNA, 18 bp, Homo sapiens
atgggtaatataaagtgt

SEQ ID NO: 4332318 - DNA, 20 bp, Homo sapiens
atgggtatgtgttgccaaag

SEQ ID NO: 4332319 - DNA, 15 bp, Homo sapiens
atggtacccccttct

SEQ ID NO: 4332320 - DNA, 17 bp, Homo sapiens
atggtacccccttctgg

SEQ ID NO: 4332321 - DNA, 22 bp, Homo sapiens
atggtagggtataatgtgtctg

SEQ ID NO: 4332322 - DNA, 12 bp, Homo sapiens
atggtttggaaa

SEQ ID NO: 4332323 - DNA, 15 bp, Homo sapiens
atggtttggaaaata

SEQ ID NO: 4332324 - DNA, 20 bp, Homo sapiens
atggtttggaaaataacttt

SEQ ID NO: 4332325 - DNA, 17 bp, Homo sapiens
atgtaatgaagtaaagc

SEQ ID NO: 4332326 - DNA, 13 bp, Homo sapiens
atgtaatgtcaga

SEQ ID NO: 4332327 - DNA, 13 bp, Homo sapiens
atgtagaaatgtt

SEQ ID NO: 4332328 - DNA, 13 bp, Homo sapiens
atgtagactctga

SEQ ID NO: 4332329 - DNA, 19 bp, Homo sapiens
atgtagtcagactgacact

SEQ ID NO: 4332330 - DNA, 14 bp, Homo sapiens
atgtatatatattc

SEQ ID NO: 4332331 - DNA, 17 bp, Homo sapiens
atgtatatatattctca

SEQ ID NO: 4332332 - DNA, 21 bp, Homo sapiens
atgtatgccttcgggaaaatt

SEQ ID NO: 4332333 - DNA, 15 bp, Homo sapiens
atgtatttttctaca

SEQ ID NO: 4332334 - DNA, 19 bp, Homo sapiens
atgtatttttctacattat

SEQ ID NO: 4332335 - DNA, 18 bp, Homo sapiens
atgtcagactttgctgca

SEQ ID NO: 4332336 - DNA, 17 bp, Homo sapiens
atgtccttcagctgact

SEQ ID NO: 4332337 - DNA, 19 bp, Homo sapiens
atgtctgtatccccagtgc

SEQ ID NO: 4332338 - DNA, 13 bp, Homo sapiens
atgtctgtcagaa

SEQ ID NO: 4332339 - DNA, 17 bp, Homo sapiens
atgtctgtcagaagaca

SEQ ID NO: 4332340 - DNA, 22 bp, Homo sapiens
atgtctgtcagaagacactaat

SEQ ID NO: 4332341 - DNA, 22 bp, Homo sapiens
atgtgaaaagatcccaagatgg

SEQ ID NO: 4332342 - DNA, 12 bp, Homo sapiens
atgtgaagaaat

SEQ ID NO: 4332343 - DNA, 13 bp, Homo sapiens
atgtgaagaaata

SEQ ID NO: 4332344 - DNA, 14 bp, Homo sapiens
atgtgaagaaataa

SEQ ID NO: 4332345 - DNA, 18 bp, Homo sapiens
atgtgaaggacatgagac

SEQ ID NO: 4332346 - DNA, 21 bp, Homo sapiens
atgtgcagatatccaaacaag

SEQ ID NO: 4332347 - DNA, 14 bp, Homo sapiens
atgtgcttctcagt

SEQ ID NO: 4332348 - DNA, 21 bp, Homo sapiens
atgtggcccaagtcattccta

SEQ ID NO: 4332349 - DNA, 18 bp, Homo sapiens
atgtggtcttatgatttt

SEQ ID NO: 4332350 - DNA, 22 bp, Homo sapiens
atgtgtatctatttatatatca

SEQ ID NO: 4332351 - DNA, 21 bp, Homo sapiens
atgtgtattaggattggggga

SEQ ID NO: 4332352 - DNA, 20 bp, Homo sapiens
atgtgtctgtgttgcttcaa

SEQ ID NO: 4332353 - DNA, 21 bp, Homo sapiens
atgtgtgtagactgtaacttt

SEQ ID NO: 4332354 - DNA, 16 bp, Homo sapiens
atgtgttgccaaagct

SEQ ID NO: 4332355 - DNA, 20 bp, Homo sapiens
atgtgttggggagacatcaa

SEQ ID NO: 4332356 - DNA, 16 bp, Homo sapiens
atgtgtttttctccag

SEQ ID NO: 4332357 - DNA, 17 bp, Homo sapiens
atgtgtttttctccagt

SEQ ID NO: 4332358 - DNA, 17 bp, Homo sapiens
atgttgggtttgagaca

SEQ ID NO: 4332359 - DNA, 17 bp, Homo sapiens
atgttgtgttgttatca

SEQ ID NO: 4332360 - DNA, 22 bp, Homo sapiens
atgtttaatgaagtcactattt

SEQ ID NO: 4332361 - DNA, 14 bp, Homo sapiens
atgtttattccttg

SEQ ID NO: 4332362 - DNA, 21 bp, Homo sapiens
atgtttcacataaaacctcat

SEQ ID NO: 4332363 - DNA, 13 bp, Homo sapiens
atgtttccaacct

SEQ ID NO: 4332364 - DNA, 13 bp, Homo sapiens
atgtttttaacac

SEQ ID NO: 4332365 - DNA, 19 bp, Homo sapiens
attaaaatgtaactgacct

SEQ ID NO: 4332366 - DNA, 15 bp, Homo sapiens
attaaactgattcca

SEQ ID NO: 4332367 - DNA, 15 bp, Homo sapiens
attaaagccttaagc

SEQ ID NO: 4332368 - DNA, 12 bp, Homo sapiens
attaaaggaaaa

SEQ ID NO: 4332369 - DNA, 17 bp, Homo sapiens
attaaataaactgtttt

SEQ ID NO: 4332370 - DNA, 20 bp, Homo sapiens
attaaccacttcagctgact

SEQ ID NO: 4332371 - DNA, 15 bp, Homo sapiens
attaactaaatgctc

SEQ ID NO: 4332372 - DNA, 17 bp, Homo sapiens
attaagaactgaatcca

SEQ ID NO: 4332373 - DNA, 17 bp, Homo sapiens
attaataaagcattctt

SEQ ID NO: 4332374 - DNA, 23 bp, Homo sapiens
attacagaaatgtttttaacact

SEQ ID NO: 4332375 - DNA, 14 bp, Homo sapiens
attacgtgcattta

SEQ ID NO: 4332376 - DNA, 18 bp, Homo sapiens
attacgtgcatttaaact

SEQ ID NO: 4332377 - DNA, 23 bp, Homo sapiens
attacgtgcatttaaactctgcc

SEQ ID NO: 4332378 - DNA, 19 bp, Homo sapiens
attactcctatttttgtaa

SEQ ID NO: 4332379 - DNA, 20 bp, Homo sapiens
attactgatttagaagcaaa

SEQ ID NO: 4332380 - DNA, 17 bp, Homo sapiens
attacttctgagcccca

SEQ ID NO: 4332381 - DNA, 13 bp, Homo sapiens
attagaagaaaat

SEQ ID NO: 4332382 - DNA, 14 bp, Homo sapiens
attagaagaaaatg

SEQ ID NO: 4332383 - DNA, 20 bp, Homo sapiens
attagaagtataaggtgctc

SEQ ID NO: 4332384 - DNA, 13 bp, Homo sapiens
attagagaagaga

SEQ ID NO: 4332385 - DNA, 12 bp, Homo sapiens
attataaaattg

SEQ ID NO: 4332386 - DNA, 23 bp, Homo sapiens
attataaaattgaaaacactaac

SEQ ID NO: 4332387 - DNA, 17 bp, Homo sapiens
attataaatatatataa

SEQ ID NO: 4332388 - DNA, 20 bp, Homo sapiens
attataaatatatataaaga

SEQ ID NO: 4332389 - DNA, 23 bp, Homo sapiens
atcaaagaggttttaaaaaaatc

SEQ ID NO: 4332390 - DNA, 20 bp, Homo sapiens
atcaaagtggggtacagtaa

SEQ ID NO: 4332391 - DNA, 17 bp, Homo sapiens
atcacagtgggaagaat

SEQ ID NO: 4332392 - DNA, 19 bp, Homo sapiens
atcacagtgggaagaatag

SEQ ID NO: 4332393 - DNA, 16 bp, Homo sapiens
atcacatctaaagctt

SEQ ID NO: 4332394 - DNA, 13 bp, Homo sapiens
atcaccagacagg

SEQ ID NO: 4332395 - DNA, 15 bp, Homo sapiens
atcaccccagccccc

SEQ ID NO: 4332396 - DNA, 18 bp, Homo sapiens
atcaccccagcccccaca

SEQ ID NO: 4332397 - DNA, 23 bp, Homo sapiens
atcaccccagcccccacagccct

SEQ ID NO: 4332398 - DNA, 18 bp, Homo sapiens
atcacctctcttcttagt

SEQ ID NO: 4332399 - DNA, 23 bp, Homo sapiens
atcacgctccccgcctgttcccc

SEQ ID NO: 4332400 - DNA, 20 bp, Homo sapiens
atcactaatactaattcatt

SEQ ID NO: 4332401 - DNA, 17 bp, Homo sapiens
atcactgattccctctc

SEQ ID NO: 4332402 - DNA, 20 bp, Homo sapiens
atcactgattccctctccca

SEQ ID NO: 4332403 - DNA, 21 bp, Homo sapiens
atcactgcattcattctgagc

SEQ ID NO: 4332404 - DNA, 22 bp, Homo sapiens
atcagaggtcatcccttcctcc

SEQ ID NO: 4332405 - DNA, 21 bp, Homo sapiens
atcagatgctgaattgagaat

SEQ ID NO: 4332406 - DNA, 17 bp, Homo sapiens
atcagcaatattgcctg

SEQ ID NO: 4332407 - DNA, 18 bp, Homo sapiens
atcagcaatattgcctgt

SEQ ID NO: 4332408 - DNA, 19 bp, Homo sapiens
atcagcctgctccagctgt

SEQ ID NO: 4332409 - DNA, 15 bp, Homo sapiens
atcagcttaatttaa

SEQ ID NO: 4332410 - DNA, 21 bp, Homo sapiens
atcagggaggaagatgttcaa

SEQ ID NO: 4332411 - DNA, 22 bp, Homo sapiens
atcagttaaaatcacattttaa

SEQ ID NO: 4332412 - DNA, 22 bp, Homo sapiens
atcataatttctttttggtaaa

SEQ ID NO: 4332413 - DNA, 18 bp, Homo sapiens
atcatattgagaataatt

SEQ ID NO: 4332414 - DNA, 19 bp, Homo sapiens
atcatattggtgctgagtg

SEQ ID NO: 4332415 - DNA, 15 bp, Homo sapiens
atcatgctcatgtat

SEQ ID NO: 4332416 - DNA, 15 bp, Homo sapiens
atcattgttttgaat

SEQ ID NO: 4332417 - DNA, 20 bp, Homo sapiens
atccaaacatgtatttatgt

SEQ ID NO: 4332418 - DNA, 21 bp, Homo sapiens
atccaaacatgtatttatgta

SEQ ID NO: 4332419 - DNA, 23 bp, Homo sapiens
atccaaattgtgcttctccccag

SEQ ID NO: 4332420 - DNA, 15 bp, Homo sapiens
atccacttcaggagc

SEQ ID NO: 4332421 - DNA, 18 bp, Homo sapiens
atccagctagtgccaaat

SEQ ID NO: 4332422 - DNA, 10 bp, Homo sapiens
atccatgctt

SEQ ID NO: 4332423 - DNA, 14 bp, Homo sapiens
atccatgcttcact

SEQ ID NO: 4332424 - DNA, 23 bp, Homo sapiens
atcccaagatggagaggaagaaa

SEQ ID NO: 4332425 - DNA, 14 bp, Homo sapiens
atcccatttaaaaa

SEQ ID NO: 4332426 - DNA, 23 bp, Homo sapiens
atcccgtaagaccaccttccctt

SEQ ID NO: 4332427 - DNA, 20 bp, Homo sapiens
atcccttcctcctctcctgg

SEQ ID NO: 4332428 - DNA, 15 bp, Homo sapiens
atccgccctgcagca

SEQ ID NO: 4332429 - DNA, 11 bp, Homo sapiens
atcctacagta

SEQ ID NO: 4332430 - DNA, 15 bp, Homo sapiens
atcctagccccaccc

SEQ ID NO: 4332431 - DNA, 21 bp, Homo sapiens
atcctagccccacccagaggt

SEQ ID NO: 4332432 - DNA, 14 bp, Homo sapiens
atcctagttccatt

SEQ ID NO: 4332433 - DNA, 22 bp, Homo sapiens
atcctgctgaaagtcctgcttt

SEQ ID NO: 4332434 - DNA, 12 bp, Homo sapiens
atcctgtaataa

SEQ ID NO: 4332435 - DNA, 23 bp, Homo sapiens
atctaagtatatgtgagaaatca

SEQ ID NO: 4332436 - DNA, 22 bp, Homo sapiens
atctaatgagttgctggaaaat

SEQ ID NO: 4332437 - DNA, 18 bp, Homo sapiens
atctagtttccctggtgc

SEQ ID NO: 4332438 - DNA, 16 bp, Homo sapiens
atctatattaaatgag

SEQ ID NO: 4332439 - DNA, 23 bp, Homo sapiens
atctatcggaagaacatgaatct

SEQ ID NO: 4332440 - DNA, 14 bp, Homo sapiens
atctcagggcctgg

SEQ ID NO: 4332441 - DNA, 16 bp, Homo sapiens
atctcagggcctggtc

SEQ ID NO: 4332442 - DNA, 16 bp, Homo sapiens
atctcctctgctcatt

SEQ ID NO: 4332443 - DNA, 20 bp, Homo sapiens
atctctaacagctccatact

SEQ ID NO: 4332444 - DNA, 19 bp, Homo sapiens
atctctgtgattacctctc

SEQ ID NO: 4332445 - DNA, 15 bp, Homo sapiens
atctcttgagcctgg

SEQ ID NO: 4332446 - DNA, 13 bp, Homo sapiens
atctgatatgctg

SEQ ID NO: 4332447 - DNA, 22 bp, Homo sapiens
atctggcacgtggccaggagcc

SEQ ID NO: 4332448 - DNA, 23 bp, Homo sapiens
atctggcacgtggccaggagcca

SEQ ID NO: 4332449 - DNA, 23 bp, Homo sapiens
atctggcttttcgcttgcttctg

SEQ ID NO: 4332450 - DNA, 19 bp, Homo sapiens
atctgggaagatttgaaaa

SEQ ID NO: 4332451 - DNA, 11 bp, Homo sapiens
atctgtacttt

SEQ ID NO: 4332452 - DNA, 13 bp, Homo sapiens
atctgtactttgt

SEQ ID NO: 4332453 - DNA, 15 bp, Homo sapiens
atctgtactttgtgt

SEQ ID NO: 4332454 - DNA, 18 bp, Homo sapiens
atcttacttgtcctttga

SEQ ID NO: 4332455 - DNA, 19 bp, Homo sapiens
atcttgttattaatgtttc

SEQ ID NO: 4332456 - DNA, 16 bp, Homo sapiens
atctttctattccaaa

SEQ ID NO: 4332457 - DNA, 21 bp, Homo sapiens
atctttcttttgattcttcct

SEQ ID NO: 4332458 - DNA, 18 bp, Homo sapiens
atctttgtttaaatgcca

SEQ ID NO: 4332459 - DNA, 16 bp, Homo sapiens
atgaaattgacaagct

SEQ ID NO: 4332460 - DNA, 15 bp, Homo sapiens
atgaagcagaggaag

SEQ ID NO: 4332461 - DNA, 18 bp, Homo sapiens
atgaagcagaggaaggaa

SEQ ID NO: 4332462 - DNA, 20 bp, Homo sapiens
atgaagcagaggaaggaaac

SEQ ID NO: 4332463 - DNA, 17 bp, Homo sapiens
atgaagtcactattttg

SEQ ID NO: 4332464 - DNA, 15 bp, Homo sapiens
atgaatacagcattt

SEQ ID NO: 4332465 - DNA, 12 bp, Homo sapiens
atgaatattttg

SEQ ID NO: 4332466 - DNA, 15 bp, Homo sapiens
atgaatattttgata

SEQ ID NO: 4332467 - DNA, 23 bp, Homo sapiens
atgaattagaagaaaatggatga

SEQ ID NO: 4332468 - DNA, 16 bp, Homo sapiens
atgaatttttatgatt

SEQ ID NO: 4332469 - DNA, 18 bp, Homo sapiens
atgacacagcttgtgaat

SEQ ID NO: 4332470 - DNA, 19 bp, Homo sapiens
atgacacagcttgtgaatg

SEQ ID NO: 4332471 - DNA, 19 bp, Homo sapiens
atgacaggcctgaagatat

SEQ ID NO: 4332472 - DNA, 22 bp, Homo sapiens
atgacaggcctgaagatattac

SEQ ID NO: 4332473 - DNA, 24 bp, Homo sapiens
atgacaggcctgaagatattacta

SEQ ID NO: 4332474 - DNA, 18 bp, Homo sapiens
atgaccattgaaaaagga

SEQ ID NO: 4332475 - DNA, 21 bp, Homo sapiens
atgaccattgaaaaaggaaaa

SEQ ID NO: 4332476 - DNA, 14 bp, Homo sapiens
atgactattgtaat

SEQ ID NO: 4332477 - DNA, 15 bp, Homo sapiens
atgactattgtaatg

SEQ ID NO: 4332478 - DNA, 17 bp, Homo sapiens
atgactattgtaatgcc

SEQ ID NO: 4332479 - DNA, 22 bp, Homo sapiens
atgagatttactgctctagaaa

SEQ ID NO: 4332480 - DNA, 12 bp, Homo sapiens
atgagcctggca

SEQ ID NO: 4332481 - DNA, 13 bp, Homo sapiens
atgaggggagggg

SEQ ID NO: 4332482 - DNA, 14 bp, Homo sapiens
atgaggggaggggg

SEQ ID NO: 4332483 - DNA, 17 bp, Homo sapiens
atgagtaggatgtctct

SEQ ID NO: 4332484 - DNA, 14 bp, Homo sapiens
atgagtctgtttcc

SEQ ID NO: 4332485 - DNA, 14 bp, Homo sapiens
atgataactactga

SEQ ID NO: 4332486 - DNA, 21 bp, Homo sapiens
atgatacctattaaaggaaaa

SEQ ID NO: 4332487 - DNA, 17 bp, Homo sapiens
atgatatatttatatca

SEQ ID NO: 4332488 - DNA, 18 bp, Homo sapiens
atgatatatttatatcat

SEQ ID NO: 4332489 - DNA, 21 bp, Homo sapiens
atgatccctcagtctgagagg

SEQ ID NO: 4332490 - DNA, 21 bp, Homo sapiens
atgatgccgaacattaggaat

SEQ ID NO: 4332491 - DNA, 15 bp, Homo sapiens
atgatgtttcacata

SEQ ID NO: 4332492 - DNA, 15 bp, Homo sapiens
atgattataatgcta

SEQ ID NO: 4332493 - DNA, 15 bp, Homo sapiens
atgattggttcagtt

SEQ ID NO: 4332494 - DNA, 20 bp, Homo sapiens
atgatttcttgtgatgtatt

SEQ ID NO: 4332495 - DNA, 13 bp, Homo sapiens
atgattttattac

SEQ ID NO: 4332496 - DNA, 20 bp, Homo sapiens
atgattttatttaaactatt

SEQ ID NO: 4332497 - DNA, 14 bp, Homo sapiens
atgcaaactgcttt

SEQ ID NO: 4332498 - DNA, 16 bp, Homo sapiens
atgcaaactgctttat

SEQ ID NO: 4332499 - DNA, 14 bp, Homo sapiens
atgcaaagtacaat

SEQ ID NO: 4332500 - DNA, 15 bp, Homo sapiens
atgcaaagtacaatg

SEQ ID NO: 4332501 - DNA, 17 bp, Homo sapiens
atgcaaagtacaatgtg

SEQ ID NO: 4332502 - DNA, 15 bp, Homo sapiens
atgcacagatatact

SEQ ID NO: 4332503 - DNA, 19 bp, Homo sapiens
atgcacagatatactttgt

SEQ ID NO: 4332504 - DNA, 18 bp, Homo sapiens
atgcagaacgtatttagc

SEQ ID NO: 4332505 - DNA, 20 bp, Homo sapiens
atgcagaatgtttttaaaat

SEQ ID NO: 4332506 - DNA, 21 bp, Homo sapiens
atgcaggcacttattgtaaat

SEQ ID NO: 4332507 - DNA, 15 bp, Homo sapiens
atgcattttcttcag

SEQ ID NO: 4332508 - DNA, 18 bp, Homo sapiens
atgccaaaaaagatgcca

SEQ ID NO: 4332509 - DNA, 22 bp, Homo sapiens
agtttgtgtgtatttgtattaa

SEQ ID NO: 4332510 - DNA, 19 bp, Homo sapiens
agttttactcttaaatcat

SEQ ID NO: 4332511 - DNA, 19 bp, Homo sapiens
agttttttactttggttta

SEQ ID NO: 4332512 - DNA, 17 bp, Homo sapiens
agtttttttttttccag

SEQ ID NO: 4332513 - DNA, 17 bp, Homo sapiens
ataaaaattatgaaata

SEQ ID NO: 4332514 - DNA, 18 bp, Homo sapiens
ataaaagtactgaagacc

SEQ ID NO: 4332515 - DNA, 17 bp, Homo sapiens
ataaaatggatagaaaa

SEQ ID NO: 4332516 - DNA, 23 bp, Homo sapiens
ataaaatggatagaaaaaaacta

SEQ ID NO: 4332517 - DNA, 18 bp, Homo sapiens
ataaaattgaaaacacta

SEQ ID NO: 4332518 - DNA, 18 bp, Homo sapiens
ataaacaatgatgccctg

SEQ ID NO: 4332519 - DNA, 13 bp, Homo sapiens
ataaagaaacttt

SEQ ID NO: 4332520 - DNA, 20 bp, Homo sapiens
ataaagaaacttttgaaaaa

SEQ ID NO: 4332521 - DNA, 12 bp, Homo sapiens
ataaagcattct

SEQ ID NO: 4332522 - DNA, 14 bp, Homo sapiens
ataaagtaacagta

SEQ ID NO: 4332523 - DNA, 11 bp, Homo sapiens
ataaagtatag

SEQ ID NO: 4332524 - DNA, 14 bp, Homo sapiens
ataaataaaatgga

SEQ ID NO: 4332525 - DNA, 20 bp, Homo sapiens
ataaataaaatggatagaaa

SEQ ID NO: 4332526 - DNA, 18 bp, Homo sapiens
ataaatagaaaagtagac

SEQ ID NO: 4332527 - DNA, 13 bp, Homo sapiens
ataaatagaaaga

SEQ ID NO: 4332528 - DNA, 18 bp, Homo sapiens
ataaattaaataaactgt

SEQ ID NO: 4332529 - DNA, 20 bp, Homo sapiens
ataaattaaataaactgttt

SEQ ID NO: 4332530 - DNA, 18 bp, Homo sapiens
ataaccaaagcaattaaa

SEQ ID NO: 4332531 - DNA, 23 bp, Homo sapiens
ataaccatttaaagaaagaatgc

SEQ ID NO: 4332532 - DNA, 21 bp, Homo sapiens
ataagtaatatttaaagatta

SEQ ID NO: 4332533 - DNA, 18 bp, Homo sapiens
ataagtgttcagtgttga

SEQ ID NO: 4332534 - DNA, 20 bp, Homo sapiens
ataagtgttcagtgttgaca

SEQ ID NO: 4332535 - DNA, 22 bp, Homo sapiens
ataagtgttcagtgttgacata

SEQ ID NO: 4332536 - DNA, 21 bp, Homo sapiens
ataataaatcgatccatgttt

SEQ ID NO: 4332537 - DNA, 18 bp, Homo sapiens
ataatataccaatgcttt

SEQ ID NO: 4332538 - DNA, 16 bp, Homo sapiens
ataatattgtttttct

SEQ ID NO: 4332539 - DNA, 14 bp, Homo sapiens
ataatcatgctcat

SEQ ID NO: 4332540 - DNA, 18 bp, Homo sapiens
ataatcatgctcatgtat

SEQ ID NO: 4332541 - DNA, 15 bp, Homo sapiens
ataatctatattaaa

SEQ ID NO: 4332542 - DNA, 15 bp, Homo sapiens
ataatctcctctgct

SEQ ID NO: 4332543 - DNA, 20 bp, Homo sapiens
ataatgctattttaaaaaat

SEQ ID NO: 4332544 - DNA, 14 bp, Homo sapiens
ataatgtgtctgtg

SEQ ID NO: 4332545 - DNA, 15 bp, Homo sapiens
ataatgtgtctgtgt

SEQ ID NO: 4332546 - DNA, 13 bp, Homo sapiens
ataattactacat

SEQ ID NO: 4332547 - DNA, 14 bp, Homo sapiens
ataattacttttga

SEQ ID NO: 4332548 - DNA, 19 bp, Homo sapiens
ataattagtcgggcatgag

SEQ ID NO: 4332549 - DNA, 13 bp, Homo sapiens
ataattcctacag

SEQ ID NO: 4332550 - DNA, 18 bp, Homo sapiens
atacaaagcgtgcacaag

SEQ ID NO: 4332551 - DNA, 13 bp, Homo sapiens
atacacaactttg

SEQ ID NO: 4332552 - DNA, 19 bp, Homo sapiens
atacacaactttgcaaatt

SEQ ID NO: 4332553 - DNA, 14 bp, Homo sapiens
atacacacatacat

SEQ ID NO: 4332554 - DNA, 21 bp, Homo sapiens
atacacacatagtttcttttt

SEQ ID NO: 4332555 - DNA, 18 bp, Homo sapiens
atacacagttaaataaat

SEQ ID NO: 4332556 - DNA, 20 bp, Homo sapiens
atacacagttaaataaatag

SEQ ID NO: 4332557 - DNA, 19 bp, Homo sapiens
atacatacaaatatatgta

SEQ ID NO: 4332558 - DNA, 14 bp, Homo sapiens
atacatacatacat

SEQ ID NO: 4332559 - DNA, 15 bp, Homo sapiens
atacatctgatgcat

SEQ ID NO: 4332560 - DNA, 17 bp, Homo sapiens
atacccaacagtttatt

SEQ ID NO: 4332561 - DNA, 22 bp, Homo sapiens
atacccaacagtttatttttat

SEQ ID NO: 4332562 - DNA, 14 bp, Homo sapiens
atacctattaaagg

SEQ ID NO: 4332563 - DNA, 19 bp, Homo sapiens
atacctattaaaggaaaac

SEQ ID NO: 4332564 - DNA, 15 bp, Homo sapiens
atacgtacatacaca

SEQ ID NO: 4332565 - DNA, 18 bp, Homo sapiens
atacgtacatacacacat

SEQ ID NO: 4332566 - DNA, 23 bp, Homo sapiens
atacgtacatacacacatacata

SEQ ID NO: 4332567 - DNA, 12 bp, Homo sapiens
atactaatttat

SEQ ID NO: 4332568 - DNA, 13 bp, Homo sapiens
atactaatttatt

SEQ ID NO: 4332569 - DNA, 16 bp, Homo sapiens
atactttgtggaccaa

SEQ ID NO: 4332570 - DNA, 12 bp, Homo sapiens
atagaaagacat

SEQ ID NO: 4332571 - DNA, 12 bp, Homo sapiens
atagaaagcaaa

SEQ ID NO: 4332572 - DNA, 15 bp, Homo sapiens
atagaaagcaaacat

SEQ ID NO: 4332573 - DNA, 12 bp, Homo sapiens
atagaagaagag

SEQ ID NO: 4332574 - DNA, 16 bp, Homo sapiens
atagaagaagaggaag

SEQ ID NO: 4332575 - DNA, 14 bp, Homo sapiens
atagaatttccaat

SEQ ID NO: 4332576 - DNA, 15 bp, Homo sapiens
atagagaccaggagg

SEQ ID NO: 4332577 - DNA, 16 bp, Homo sapiens
atagagaccaggaggg

SEQ ID NO: 4332578 - DNA, 14 bp, Homo sapiens
atagattgcaaata

SEQ ID NO: 4332579 - DNA, 14 bp, Homo sapiens
atagattgtcttaa

SEQ ID NO: 4332580 - DNA, 18 bp, Homo sapiens
atagcatggggcccctgg

SEQ ID NO: 4332581 - DNA, 18 bp, Homo sapiens
atagcctgcctcttctct

SEQ ID NO: 4332582 - DNA, 17 bp, Homo sapiens
atagctcccaaaagaat

SEQ ID NO: 4332583 - DNA, 17 bp, Homo sapiens
ataggctggtggccttg

SEQ ID NO: 4332584 - DNA, 19 bp, Homo sapiens
ataggctggtggccttggg

SEQ ID NO: 4332585 - DNA, 23 bp, Homo sapiens
atagtagaaagacatctgcctgt

SEQ ID NO: 4332586 - DNA, 22 bp, Homo sapiens
atagtatatgattataatgcta

SEQ ID NO: 4332587 - DNA, 17 bp, Homo sapiens
atagtcatatgtgaaga

SEQ ID NO: 4332588 - DNA, 14 bp, Homo sapiens
atagtgaagaatag

SEQ ID NO: 4332589 - DNA, 23 bp, Homo sapiens
atagttttacccataagtaatat

SEQ ID NO: 4332590 - DNA, 17 bp, Homo sapiens
atataaaaacaatatat

SEQ ID NO: 4332591 - DNA, 15 bp, Homo sapiens
atataaagaatatat

SEQ ID NO: 4332592 - DNA, 17 bp, Homo sapiens
atataaaggcaaggaaa

SEQ ID NO: 4332593 - DNA, 16 bp, Homo sapiens
atataatcatgctcat

SEQ ID NO: 4332594 - DNA, 14 bp, Homo sapiens
atatagaaaatctt

SEQ ID NO: 4332595 - DNA, 18 bp, Homo sapiens
atatataaaagtctgagt

SEQ ID NO: 4332596 - DNA, 17 bp, Homo sapiens
atatataaagaatatat

SEQ ID NO: 4332597 - DNA, 15 bp, Homo sapiens
atatataaagtatag

SEQ ID NO: 4332598 - DNA, 13 bp, Homo sapiens
atatatataaaga

SEQ ID NO: 4332599 - DNA, 14 bp, Homo sapiens
atatatcatagtat

SEQ ID NO: 4332600 - DNA, 16 bp, Homo sapiens
atatatgctgtatttc

SEQ ID NO: 4332601 - DNA, 12 bp, Homo sapiens
atatattactga

SEQ ID NO: 4332602 - DNA, 14 bp, Homo sapiens
atatatttatatca

SEQ ID NO: 4332603 - DNA, 16 bp, Homo sapiens
atatcatatataaaag

SEQ ID NO: 4332604 - DNA, 19 bp, Homo sapiens
atatgaaccctttgtttct

SEQ ID NO: 4332605 - DNA, 20 bp, Homo sapiens
atatgacacagcttgtgaat

SEQ ID NO: 4332606 - DNA, 18 bp, Homo sapiens
atatgaccattgaaaaag

SEQ ID NO: 4332607 - DNA, 13 bp, Homo sapiens
atatgattgtatt

SEQ ID NO: 4332608 - DNA, 21 bp, Homo sapiens
atatgattgtatttaaaggta

SEQ ID NO: 4332609 - DNA, 20 bp, Homo sapiens
atatgctacacatatgtgct

SEQ ID NO: 4332610 - DNA, 13 bp, Homo sapiens
atatgctgagaaa

SEQ ID NO: 4332611 - DNA, 13 bp, Homo sapiens
atatgctgtattt

SEQ ID NO: 4332612 - DNA, 13 bp, Homo sapiens
atatgtatatata

SEQ ID NO: 4332613 - DNA, 17 bp, Homo sapiens
atatgtatatatattct

SEQ ID NO: 4332614 - DNA, 19 bp, Homo sapiens
atatgtatatatattctca

SEQ ID NO: 4332615 - DNA, 14 bp, Homo sapiens
atatgtgagaaatc

SEQ ID NO: 4332616 - DNA, 15 bp, Homo sapiens
atatgtgcttctcag

SEQ ID NO: 4332617 - DNA, 17 bp, Homo sapiens
atatgttaaagcttatt

SEQ ID NO: 4332618 - DNA, 13 bp, Homo sapiens
atattaaatgagg

SEQ ID NO: 4332619 - DNA, 13 bp, Homo sapiens
atattacaacaag

SEQ ID NO: 4332620 - DNA, 15 bp, Homo sapiens
atattactgatttag

SEQ ID NO: 4332621 - DNA, 21 bp, Homo sapiens
atattcaaggctttaaaagtc

SEQ ID NO: 4332622 - DNA, 18 bp, Homo sapiens
atattcaagtaacacttt

SEQ ID NO: 4332623 - DNA, 18 bp, Homo sapiens
atattcatgcttcttcct

SEQ ID NO: 4332624 - DNA, 15 bp, Homo sapiens
atattggtgctgagt

SEQ ID NO: 4332625 - DNA, 17 bp, Homo sapiens
atattgtgtaaatatta

SEQ ID NO: 4332626 - DNA, 13 bp, Homo sapiens
atatttaaagatt

SEQ ID NO: 4332627 - DNA, 14 bp, Homo sapiens
atatttaaagatta

SEQ ID NO: 4332628 - DNA, 22 bp, Homo sapiens
atatttactgagacttcgaaga

SEQ ID NO: 4332629 - DNA, 12 bp, Homo sapiens
atcaaaaacttt

SEQ ID NO: 4332630 - DNA, 15 bp, Homo sapiens
atcaaaaacttttca

SEQ ID NO: 4332631 - DNA, 14 bp, Homo sapiens
cccttgcccttgga

SEQ ID NO: 4332632 - DNA, 20 bp, Homo sapiens
cccttgctgcaaacccatga

SEQ ID NO: 4332633 - DNA, 23 bp, Homo sapiens
cccttgctgcaaacccatgaagc

SEQ ID NO: 4332634 - DNA, 18 bp, Homo sapiens
cccttggagctgccgtgc

SEQ ID NO: 4332635 - DNA, 23 bp, Homo sapiens
cccttgtctgagatgctggtaat

SEQ ID NO: 4332636 - DNA, 19 bp, Homo sapiens
ccctttctctgcctggcaa

SEQ ID NO: 4332637 - DNA, 14 bp, Homo sapiens
ccgagctgtttatg

SEQ ID NO: 4332638 - DNA, 18 bp, Homo sapiens
ccgaggagccccagcccc

SEQ ID NO: 4332639 - DNA, 20 bp, Homo sapiens
ccgaggagccccagccccgt

SEQ ID NO: 4332640 - DNA, 13 bp, Homo sapiens
ccgagtttgctaa

SEQ ID NO: 4332641 - DNA, 16 bp, Homo sapiens
ccgcagccacaccgct

SEQ ID NO: 4332642 - DNA, 22 bp, Homo sapiens
ccgcagccacaccgctggctcc

SEQ ID NO: 4332643 - DNA, 16 bp, Homo sapiens
ccgccatgctcctggc

SEQ ID NO: 4332644 - DNA, 22 bp, Homo sapiens
ccgccccctgaaacatgtgccc

SEQ ID NO: 4332645 - DNA, 14 bp, Homo sapiens
ccgccctccaccca

SEQ ID NO: 4332646 - DNA, 15 bp, Homo sapiens
ccgccctccacccac

SEQ ID NO: 4332647 - DNA, 20 bp, Homo sapiens
ccgccgactttgtacccccc

SEQ ID NO: 4332648 - DNA, 13 bp, Homo sapiens
ccgccgcttttct

SEQ ID NO: 4332649 - DNA, 16 bp, Homo sapiens
ccgcctcccgccaccc

SEQ ID NO: 4332650 - DNA, 19 bp, Homo sapiens
ccgcctcccgccaccctgt

SEQ ID NO: 4332651 - DNA, 23 bp, Homo sapiens
ccgcctcccgccaccctgtctca

SEQ ID NO: 4332652 - DNA, 17 bp, Homo sapiens
ccgcctgttcccccgcc

SEQ ID NO: 4332653 - DNA, 20 bp, Homo sapiens
ccgcctgttcccccgccgct

SEQ ID NO: 4332654 - DNA, 22 bp, Homo sapiens
ccgcgaaacccggtgcatctgg

SEQ ID NO: 4332655 - DNA, 13 bp, Homo sapiens
ccgctggctccgc

SEQ ID NO: 4332656 - DNA, 17 bp, Homo sapiens
ccggaagaaccagaagt

SEQ ID NO: 4332657 - DNA, 15 bp, Homo sapiens
ccggagacccacagc

SEQ ID NO: 4332658 - DNA, 16 bp, Homo sapiens
ccggagacccacagcc

SEQ ID NO: 4332659 - DNA, 20 bp, Homo sapiens
ccggagacccacagccctga

SEQ ID NO: 4332660 - DNA, 15 bp, Homo sapiens
ccgggagactgccag

SEQ ID NO: 4332661 - DNA, 17 bp, Homo sapiens
ccgggagactgccagtg

SEQ ID NO: 4332662 - DNA, 12 bp, Homo sapiens
ccgggccggggc

SEQ ID NO: 4332663 - DNA, 20 bp, Homo sapiens
ccgggcgcggtggctcacgc

SEQ ID NO: 4332664 - DNA, 19 bp, Homo sapiens
ccggtgcagggcctggcat

SEQ ID NO: 4332665 - DNA, 20 bp, Homo sapiens
ccggtgcagggcctggcata

SEQ ID NO: 4332666 - DNA, 20 bp, Homo sapiens
ccggtgcatctggcacgtgg

SEQ ID NO: 4332667 - DNA, 19 bp, Homo sapiens
ccgtcccagaggccgctgc

SEQ ID NO: 4332668 - DNA, 18 bp, Homo sapiens
ccgtgcccttgcccttgg

SEQ ID NO: 4332669 - DNA, 15 bp, Homo sapiens
ccgtgtgtgcatgtg

SEQ ID NO: 4332670 - DNA, 14 bp, Homo sapiens
ccgttgtgcctggt

SEQ ID NO: 4332671 - DNA, 20 bp, Homo sapiens
cctaaaagagatctgggcat

SEQ ID NO: 4332672 - DNA, 18 bp, Homo sapiens
cctaatgccctatgtgta

SEQ ID NO: 4332673 - DNA, 20 bp, Homo sapiens
cctaatgccctatgtgtata

SEQ ID NO: 4332674 - DNA, 13 bp, Homo sapiens
cctaatgctggcc

SEQ ID NO: 4332675 - DNA, 12 bp, Homo sapiens
cctacagcacta

SEQ ID NO: 4332676 - DNA, 18 bp, Homo sapiens
cctacagcactactgggt

SEQ ID NO: 4332677 - DNA, 19 bp, Homo sapiens
cctacagcactactgggtg

SEQ ID NO: 4332678 - DNA, 20 bp, Homo sapiens
cctacagcactactgggtgt

SEQ ID NO: 4332679 - DNA, 22 bp, Homo sapiens
cctacagcactactgggtgtca

SEQ ID NO: 4332680 - DNA, 13 bp, Homo sapiens
cctacagtacaat

SEQ ID NO: 4332681 - DNA, 12 bp, Homo sapiens
cctactcctgga

SEQ ID NO: 4332682 - DNA, 23 bp, Homo sapiens
cctactgaagggaacagcctgag

SEQ ID NO: 4332683 - DNA, 21 bp, Homo sapiens
cctagaaattccccaccctga

SEQ ID NO: 4332684 - DNA, 12 bp, Homo sapiens
cctagccccacc

SEQ ID NO: 4332685 - DNA, 14 bp, Homo sapiens
cctagccccaccca

SEQ ID NO: 4332686 - DNA, 21 bp, Homo sapiens
cctagcccttctaccccacct

SEQ ID NO: 4332687 - DNA, 23 bp, Homo sapiens
cctagcccttctaccccacctga

SEQ ID NO: 4332688 - DNA, 18 bp, Homo sapiens
cctagttccattcttggt

SEQ ID NO: 4332689 - DNA, 16 bp, Homo sapiens
cctatctagcatttat

SEQ ID NO: 4332690 - DNA, 22 bp, Homo sapiens
cctatctagcatttatttctct

SEQ ID NO: 4332691 - DNA, 17 bp, Homo sapiens
cctatgtgaaaagatcc

SEQ ID NO: 4332692 - DNA, 21 bp, Homo sapiens
cctatgtgcgaagcaagaaga

SEQ ID NO: 4332693 - DNA, 16 bp, Homo sapiens
cctattaaaggaaaac

SEQ ID NO: 4332694 - DNA, 18 bp, Homo sapiens
cctcaacaaggtatacct

SEQ ID NO: 4332695 - DNA, 16 bp, Homo sapiens
cctcaacacctctgca

SEQ ID NO: 4332696 - DNA, 11 bp, Homo sapiens
cctcagctcca

SEQ ID NO: 4332697 - DNA, 11 bp, Homo sapiens
cctcagctccc

SEQ ID NO: 4332698 - DNA, 15 bp, Homo sapiens
cctcagctccctgac

SEQ ID NO: 4332699 - DNA, 22 bp, Homo sapiens
cctcaggctccccagtgctcct

SEQ ID NO: 4332700 - DNA, 15 bp, Homo sapiens
cctcatgccacagtg

SEQ ID NO: 4332701 - DNA, 19 bp, Homo sapiens
cctccacaaagagaccagg

SEQ ID NO: 4332702 - DNA, 21 bp, Homo sapiens
cctccacaaagagaccagggg

SEQ ID NO: 4332703 - DNA, 20 bp, Homo sapiens
cctccatctcagactgtgga

SEQ ID NO: 4332704 - DNA, 12 bp, Homo sapiens
cctcccaggctg

SEQ ID NO: 4332705 - DNA, 15 bp, Homo sapiens
cctcccccagagccc

SEQ ID NO: 4332706 - DNA, 16 bp, Homo sapiens
cctccccgccccctga

SEQ ID NO: 4332707 - DNA, 18 bp, Homo sapiens
cctccccgccccctgaaa

SEQ ID NO: 4332708 - DNA, 13 bp, Homo sapiens
cctccctgctccc

SEQ ID NO: 4332709 - DNA, 14 bp, Homo sapiens
cctccctgctccca

SEQ ID NO: 4332710 - DNA, 15 bp, Homo sapiens
cctccctgctcccag

SEQ ID NO: 4332711 - DNA, 17 bp, Homo sapiens
cctccctgtctctgcat

SEQ ID NO: 4332712 - DNA, 17 bp, Homo sapiens
cctcctaatggcatgga

SEQ ID NO: 4332713 - DNA, 12 bp, Homo sapiens
cctcctccagcc

SEQ ID NO: 4332714 - DNA, 12 bp, Homo sapiens
cctcctctcctg

SEQ ID NO: 4332715 - DNA, 13 bp, Homo sapiens
cctcctctcctgg

SEQ ID NO: 4332716 - DNA, 14 bp, Homo sapiens
cctcctctcctgga

SEQ ID NO: 4332717 - DNA, 16 bp, Homo sapiens
cctcctgatgtttttc

SEQ ID NO: 4332718 - DNA, 19 bp, Homo sapiens
cctcctgcccagtccccca

SEQ ID NO: 4332719 - DNA, 17 bp, Homo sapiens
cctcctgggcatgtttg

SEQ ID NO: 4332720 - DNA, 22 bp, Homo sapiens
cctcctgggcatgtttgtctgt

SEQ ID NO: 4332721 - DNA, 18 bp, Homo sapiens
cctcctgtgcctcccttt

SEQ ID NO: 4332722 - DNA, 23 bp, Homo sapiens
cctccttatcctacagtacaatc

SEQ ID NO: 4332723 - DNA, 23 bp, Homo sapiens
cctccttccccagctcccccagg

SEQ ID NO: 4332724 - DNA, 19 bp, Homo sapiens
cctctcacaggcagctctg

SEQ ID NO: 4332725 - DNA, 10 bp, Homo sapiens
cctctcctgg

SEQ ID NO: 4332726 - DNA, 14 bp, Homo sapiens
cctctcctggaaac

SEQ ID NO: 4332727 - DNA, 18 bp, Homo sapiens
cctctcctggaaacagac

SEQ ID NO: 4332728 - DNA, 14 bp, Homo sapiens
cctctcctttgaaa

SEQ ID NO: 4332729 - DNA, 17 bp, Homo sapiens
cctctcgtttctgccca

SEQ ID NO: 4332730 - DNA, 18 bp, Homo sapiens
cctctcgtttctgcccag

SEQ ID NO: 4332731 - DNA, 18 bp, Homo sapiens
cctctctttcaattgcag

SEQ ID NO: 4332732 - DNA, 15 bp, Homo sapiens
cctctctttgttctc

SEQ ID NO: 4332733 - DNA, 21 bp, Homo sapiens
cctctctttgttctcagctcc

SEQ ID NO: 4332734 - DNA, 22 bp, Homo sapiens
cctctctttgttctcagctccc

SEQ ID NO: 4332735 - DNA, 22 bp, Homo sapiens
cctctgactgatggtttggaaa

SEQ ID NO: 4332736 - DNA, 14 bp, Homo sapiens
cctctgccccaaga

SEQ ID NO: 4332737 - DNA, 12 bp, Homo sapiens
cctctgcctggg

SEQ ID NO: 4332738 - DNA, 13 bp, Homo sapiens
cctctgcctggga

SEQ ID NO: 4332739 - DNA, 18 bp, Homo sapiens
cctctgcctgggatgccc

SEQ ID NO: 4332740 - DNA, 17 bp, Homo sapiens
cctctgggatctgccaa

SEQ ID NO: 4332741 - DNA, 15 bp, Homo sapiens
cctctgtggccagga

SEQ ID NO: 4332742 - DNA, 18 bp, Homo sapiens
cctctgtgtctgctctca

SEQ ID NO: 4332743 - DNA, 14 bp, Homo sapiens
cctcttactggggc

SEQ ID NO: 4332744 - DNA, 15 bp, Homo sapiens
cctctttcctctctt

SEQ ID NO: 4332745 - DNA, 23 bp, Homo sapiens
cctctttcctctctttgttctca

SEQ ID NO: 4332746 - DNA, 13 bp, Homo sapiens
cctgaaaattgta

SEQ ID NO: 4332747 - DNA, 19 bp, Homo sapiens
cctgaaacatgtgcccctg

SEQ ID NO: 4332748 - DNA, 20 bp, Homo sapiens
cctgaaacatgtgcccctgc

SEQ ID NO: 4332749 - DNA, 18 bp, Homo sapiens
cctgaaagccctgagctt

SEQ ID NO: 4332750 - DNA, 22 bp, Homo sapiens
cctgaaagctgggagcgtgggc

SEQ ID NO: 4332751 - DNA, 14 bp, Homo sapiens
cctgaccccctgtc

SEQ ID NO: 4332752 - DNA, 16 bp, Homo sapiens
cccagaagaaaattct

SEQ ID NO: 4332753 - DNA, 11 bp, Homo sapiens
cccagaattca

SEQ ID NO: 4332754 - DNA, 23 bp, Homo sapiens
cccagagaagctggaagcctgcc

SEQ ID NO: 4332755 - DNA, 10 bp, Homo sapiens
cccagagccc

SEQ ID NO: 4332756 - DNA, 11 bp, Homo sapiens
cccagagcccc

SEQ ID NO: 4332757 - DNA, 13 bp, Homo sapiens
cccagaggtggcc

SEQ ID NO: 4332758 - DNA, 16 bp, Homo sapiens
cccagaggtggccctc

SEQ ID NO: 4332759 - DNA, 20 bp, Homo sapiens
cccagagttgctgtgccgtg

SEQ ID NO: 4332760 - DNA, 14 bp, Homo sapiens
cccagatcctggaa

SEQ ID NO: 4332761 - DNA, 17 bp, Homo sapiens
cccagatcctggaaaca

SEQ ID NO: 4332762 - DNA, 19 bp, Homo sapiens
cccagccccaatccagaga

SEQ ID NO: 4332763 - DNA, 15 bp, Homo sapiens
cccagcccccacagc

SEQ ID NO: 4332764 - DNA, 18 bp, Homo sapiens
cccagccccgtcccagag

SEQ ID NO: 4332765 - DNA, 20 bp, Homo sapiens
cccagccccgtcccagaggc

SEQ ID NO: 4332766 - DNA, 20 bp, Homo sapiens
cccagccctccccgcagtgg

SEQ ID NO: 4332767 - DNA, 14 bp, Homo sapiens
cccagccctctgtg

SEQ ID NO: 4332768 - DNA, 16 bp, Homo sapiens
cccagccctctgtggc

SEQ ID NO: 4332769 - DNA, 23 bp, Homo sapiens
cccagccctctgtggccaggagc

SEQ ID NO: 4332770 - DNA, 16 bp, Homo sapiens
cccagctcccccaggc

SEQ ID NO: 4332771 - DNA, 17 bp, Homo sapiens
cccagctcccccaggca

SEQ ID NO: 4332772 - DNA, 19 bp, Homo sapiens
cccagctctctctcctgga

SEQ ID NO: 4332773 - DNA, 21 bp, Homo sapiens
cccagctctctctcctggagt

SEQ ID NO: 4332774 - DNA, 13 bp, Homo sapiens
cccaggctggtat

SEQ ID NO: 4332775 - DNA, 16 bp, Homo sapiens
cccaggggaggtgtat

SEQ ID NO: 4332776 - DNA, 15 bp, Homo sapiens
cccaggtgagacctc

SEQ ID NO: 4332777 - DNA, 15 bp, Homo sapiens
cccagtgccgagaag

SEQ ID NO: 4332778 - DNA, 15 bp, Homo sapiens
cccagtgctcctggc

SEQ ID NO: 4332779 - DNA, 15 bp, Homo sapiens
cccagttggaaaatt

SEQ ID NO: 4332780 - DNA, 19 bp, Homo sapiens
cccagttggaggagactgg

SEQ ID NO: 4332781 - DNA, 20 bp, Homo sapiens
cccagttggaggagactggg

SEQ ID NO: 4332782 - DNA, 18 bp, Homo sapiens
cccatagagaccaggagg

SEQ ID NO: 4332783 - DNA, 20 bp, Homo sapiens
cccatagagaccaggaggga

SEQ ID NO: 4332784 - DNA, 15 bp, Homo sapiens
cccatgaagctggcc

SEQ ID NO: 4332785 - DNA, 17 bp, Homo sapiens
cccatgaagctggccct

SEQ ID NO: 4332786 - DNA, 22 bp, Homo sapiens
cccatgaagctggccctcagct

SEQ ID NO: 4332787 - DNA, 17 bp, Homo sapiens
ccccaacccctgaggaa

SEQ ID NO: 4332788 - DNA, 16 bp, Homo sapiens
ccccaagagcaggagg

SEQ ID NO: 4332789 - DNA, 14 bp, Homo sapiens
ccccacagccctgg

SEQ ID NO: 4332790 - DNA, 17 bp, Homo sapiens
ccccacagccctggaat

SEQ ID NO: 4332791 - DNA, 13 bp, Homo sapiens
ccccaccccagag

SEQ ID NO: 4332792 - DNA, 14 bp, Homo sapiens
ccccacctgacctc

SEQ ID NO: 4332793 - DNA, 11 bp, Homo sapiens
ccccagagttg

SEQ ID NO: 4332794 - DNA, 13 bp, Homo sapiens
ccccagcccaagt

SEQ ID NO: 4332795 - DNA, 14 bp, Homo sapiens
ccccagcccaagtc

SEQ ID NO: 4332796 - DNA, 15 bp, Homo sapiens
ccccagcccaagtcc

SEQ ID NO: 4332797 - DNA, 16 bp, Homo sapiens
ccccagcccaagtcca

SEQ ID NO: 4332798 - DNA, 12 bp, Homo sapiens
ccccagccccca

SEQ ID NO: 4332799 - DNA, 21 bp, Homo sapiens
ccccagccccgtcccagaggc

SEQ ID NO: 4332800 - DNA, 19 bp, Homo sapiens
ccccagctcccccaggcag

SEQ ID NO: 4332801 - DNA, 23 bp, Homo sapiens
ccccagtgcccggtgcagggcct

SEQ ID NO: 4332802 - DNA, 18 bp, Homo sapiens
ccccagtgctcctggccc

SEQ ID NO: 4332803 - DNA, 22 bp, Homo sapiens
ccccagtgctcctggcccttct

SEQ ID NO: 4332804 - DNA, 18 bp, Homo sapiens
ccccatagagaccaggag

SEQ ID NO: 4332805 - DNA, 14 bp, Homo sapiens
cccccaacccctga

SEQ ID NO: 4332806 - DNA, 16 bp, Homo sapiens
cccccaacccctgagg

SEQ ID NO: 4332807 - DNA, 18 bp, Homo sapiens
cccccagctttgcccaac

SEQ ID NO: 4332808 - DNA, 15 bp, Homo sapiens
ccccctccctgctcc

SEQ ID NO: 4332809 - DNA, 23 bp, Homo sapiens
ccccctgaaacatgtgcccctgc

SEQ ID NO: 4332810 - DNA, 19 bp, Homo sapiens
ccccctgtcccctcagctc

SEQ ID NO: 4332811 - DNA, 12 bp, Homo sapiens
cccccttctggg

SEQ ID NO: 4332812 - DNA, 21 bp, Homo sapiens
ccccctttctctgcctggcaa

SEQ ID NO: 4332813 - DNA, 23 bp, Homo sapiens
ccccgccccctccctgctcccag

SEQ ID NO: 4332814 - DNA, 14 bp, Homo sapiens
ccccgccccctgaa

SEQ ID NO: 4332815 - DNA, 20 bp, Homo sapiens
ccccggcggggtgcctgctg

SEQ ID NO: 4332816 - DNA, 21 bp, Homo sapiens
ccccgtcccagaggccgctgc

SEQ ID NO: 4332817 - DNA, 13 bp, Homo sapiens
cccctcagctcca

SEQ ID NO: 4332818 - DNA, 19 bp, Homo sapiens
cccctccacaaagagacca

SEQ ID NO: 4332819 - DNA, 18 bp, Homo sapiens
cccctccctgctcccagc

SEQ ID NO: 4332820 - DNA, 18 bp, Homo sapiens
cccctgaaacatgtgccc

SEQ ID NO: 4332821 - DNA, 21 bp, Homo sapiens
cccctgaaacatgtgcccctg

SEQ ID NO: 4332822 - DNA, 19 bp, Homo sapiens
cccctgccaaggccggaga

SEQ ID NO: 4332823 - DNA, 13 bp, Homo sapiens
cccctgcttctcc

SEQ ID NO: 4332824 - DNA, 11 bp, Homo sapiens
cccctggccca

SEQ ID NO: 4332825 - DNA, 17 bp, Homo sapiens
cccctgtcctaggtcat

SEQ ID NO: 4332826 - DNA, 23 bp, Homo sapiens
ccccttctgggcatctgttctgg

SEQ ID NO: 4332827 - DNA, 13 bp, Homo sapiens
cccctttccccca

SEQ ID NO: 4332828 - DNA, 21 bp, Homo sapiens
cccctttcccccaccccagag

SEQ ID NO: 4332829 - DNA, 14 bp, Homo sapiens
cccgagctgtttat

SEQ ID NO: 4332830 - DNA, 21 bp, Homo sapiens
cccgcaagagggacagagccc

SEQ ID NO: 4332831 - DNA, 22 bp, Homo sapiens
cccgcaagagggacagagcccg

SEQ ID NO: 4332832 - DNA, 18 bp, Homo sapiens
cccgccaccctgtctcag

SEQ ID NO: 4332833 - DNA, 18 bp, Homo sapiens
cccggaagaaccagaagt

SEQ ID NO: 4332834 - DNA, 20 bp, Homo sapiens
cccggcggggtgcctgctgt

SEQ ID NO: 4332835 - DNA, 22 bp, Homo sapiens
cccgggtttggctgagcctggc

SEQ ID NO: 4332836 - DNA, 24 bp, Homo sapiens
cccgtaagaccaccttcccttcct

SEQ ID NO: 4332837 - DNA, 15 bp, Homo sapiens
cccgttgtgcctggt

SEQ ID NO: 4332838 - DNA, 12 bp, Homo sapiens
ccctaaactgta

SEQ ID NO: 4332839 - DNA, 13 bp, Homo sapiens
ccctacttgcagc

SEQ ID NO: 4332840 - DNA, 21 bp, Homo sapiens
ccctagaggacactaggagac

SEQ ID NO: 4332841 - DNA, 22 bp, Homo sapiens
ccctagatctttctattccaaa

SEQ ID NO: 4332842 - DNA, 21 bp, Homo sapiens
ccctagcccttctaccccacc

SEQ ID NO: 4332843 - DNA, 12 bp, Homo sapiens
ccctcaacaagg

SEQ ID NO: 4332844 - DNA, 18 bp, Homo sapiens
ccctccacaaagagacca

SEQ ID NO: 4332845 - DNA, 12 bp, Homo sapiens
ccctccacccac

SEQ ID NO: 4332846 - DNA, 15 bp, Homo sapiens
ccctccccgccccct

SEQ ID NO: 4332847 - DNA, 20 bp, Homo sapiens
ccctctcccacccaaggaga

SEQ ID NO: 4332848 - DNA, 11 bp, Homo sapiens
ccctctgcctg

SEQ ID NO: 4332849 - DNA, 20 bp, Homo sapiens
ccctctgcctgggatgccct

SEQ ID NO: 4332850 - DNA, 18 bp, Homo sapiens
ccctctgtggccaggagc

SEQ ID NO: 4332851 - DNA, 21 bp, Homo sapiens
ccctctgtggccaggagccct

SEQ ID NO: 4332852 - DNA, 23 bp, Homo sapiens
ccctctgtggccaggagccctgg

SEQ ID NO: 4332853 - DNA, 17 bp, Homo sapiens
ccctgaaacatgtgccc

SEQ ID NO: 4332854 - DNA, 19 bp, Homo sapiens
ccctgaaacatgtgcccct

SEQ ID NO: 4332855 - DNA, 21 bp, Homo sapiens
ccctgaaacatgtgcccctgc

SEQ ID NO: 4332856 - DNA, 15 bp, Homo sapiens
ccctgaaacgagaag

SEQ ID NO: 4332857 - DNA, 20 bp, Homo sapiens
ccctgaaacgagaagtgccc

SEQ ID NO: 4332858 - DNA, 16 bp, Homo sapiens
ccctgcagcagaacct

SEQ ID NO: 4332859 - DNA, 18 bp, Homo sapiens
ccctgccaaggccggaga

SEQ ID NO: 4332860 - DNA, 17 bp, Homo sapiens
ccctgctgacctcccac

SEQ ID NO: 4332861 - DNA, 17 bp, Homo sapiens
ccctgcttctccagcct

SEQ ID NO: 4332862 - DNA, 22 bp, Homo sapiens
ccctgggatggacgctgccggg

SEQ ID NO: 4332863 - DNA, 16 bp, Homo sapiens
ccctgggcagtgagtg

SEQ ID NO: 4332864 - DNA, 16 bp, Homo sapiens
ccctgtctctgcatct

SEQ ID NO: 4332865 - DNA, 16 bp, Homo sapiens
ccctgttgggggcttc

SEQ ID NO: 4332866 - DNA, 14 bp, Homo sapiens
cccttccctggagg

SEQ ID NO: 4332867 - DNA, 20 bp, Homo sapiens
cccttccctggaggtctctc

SEQ ID NO: 4332868 - DNA, 13 bp, Homo sapiens
cccttcctcctct

SEQ ID NO: 4332869 - DNA, 17 bp, Homo sapiens
cccttcctcctctcctg

SEQ ID NO: 4332870 - DNA, 19 bp, Homo sapiens
cccttcctgtccccagggg

SEQ ID NO: 4332871 - DNA, 20 bp, Homo sapiens
cccttcctgtccccagggga

SEQ ID NO: 4332872 - DNA, 22 bp, Homo sapiens
cccttctaccccacctgacctc

SEQ ID NO: 4332873 - DNA, 12 bp, Homo sapiens
ccacagccctgg

SEQ ID NO: 4332874 - DNA, 13 bp, Homo sapiens
ccacagccctgga

SEQ ID NO: 4332875 - DNA, 21 bp, Homo sapiens
ccacagggaaatgtgtatcta

SEQ ID NO: 4332876 - DNA, 11 bp, Homo sapiens
ccaccagggca

SEQ ID NO: 4332877 - DNA, 17 bp, Homo sapiens
ccaccagggcactgtct

SEQ ID NO: 4332878 - DNA, 16 bp, Homo sapiens
ccaccattcctggaaa

SEQ ID NO: 4332879 - DNA, 14 bp, Homo sapiens
ccacccaaggagaa

SEQ ID NO: 4332880 - DNA, 19 bp, Homo sapiens
ccacccagaggtggccctc

SEQ ID NO: 4332881 - DNA, 22 bp, Homo sapiens
ccacccagaggtggccctccca

SEQ ID NO: 4332882 - DNA, 16 bp, Homo sapiens
ccaccccagagttggg

SEQ ID NO: 4332883 - DNA, 19 bp, Homo sapiens
ccacccctcaacacctctg

SEQ ID NO: 4332884 - DNA, 16 bp, Homo sapiens
ccaccctgaaagccct

SEQ ID NO: 4332885 - DNA, 11 bp, Homo sapiens
ccaccctgtct

SEQ ID NO: 4332886 - DNA, 18 bp, Homo sapiens
ccaccgaggagccccagc

SEQ ID NO: 4332887 - DNA, 12 bp, Homo sapiens
ccacctctgcca

SEQ ID NO: 4332888 - DNA, 13 bp, Homo sapiens
ccacctctgccac

SEQ ID NO: 4332889 - DNA, 20 bp, Homo sapiens
ccaccttcccttcctcagca

SEQ ID NO: 4332890 - DNA, 24 bp, Homo sapiens
ccaccttcccttcctcagcaggcc

SEQ ID NO: 4332891 - DNA, 13 bp, Homo sapiens
ccaccttgttaca

SEQ ID NO: 4332892 - DNA, 12 bp, Homo sapiens
ccacgattttaa

SEQ ID NO: 4332893 - DNA, 20 bp, Homo sapiens
ccactggcacttgcctgctg

SEQ ID NO: 4332894 - DNA, 20 bp, Homo sapiens
ccactggcatcgcagcttcc

SEQ ID NO: 4332895 - DNA, 17 bp, Homo sapiens
ccactgtcatgtgtctc

SEQ ID NO: 4332896 - DNA, 13 bp, Homo sapiens
ccacttcagctga

SEQ ID NO: 4332897 - DNA, 19 bp, Homo sapiens
ccagaaaaaaaaaaactta

SEQ ID NO: 4332898 - DNA, 11 bp, Homo sapiens
ccagaagaaaa

SEQ ID NO: 4332899 - DNA, 13 bp, Homo sapiens
ccagaagaaaaga

SEQ ID NO: 4332900 - DNA, 15 bp, Homo sapiens
ccagaggccgctgcc

SEQ ID NO: 4332901 - DNA, 18 bp, Homo sapiens
ccagaggccgctgcccct

SEQ ID NO: 4332902 - DNA, 20 bp, Homo sapiens
ccagaggccgctgcccctga

SEQ ID NO: 4332903 - DNA, 21 bp, Homo sapiens
ccagaggccgctgcccctgag

SEQ ID NO: 4332904 - DNA, 18 bp, Homo sapiens
ccagagtcacaagtagcc

SEQ ID NO: 4332905 - DNA, 14 bp, Homo sapiens
ccagcacatttcct

SEQ ID NO: 4332906 - DNA, 19 bp, Homo sapiens
ccagcagcctggaccctgt

SEQ ID NO: 4332907 - DNA, 18 bp, Homo sapiens
ccagccaaagcctcctcc

SEQ ID NO: 4332908 - DNA, 15 bp, Homo sapiens
ccagcccccacagcc

SEQ ID NO: 4332909 - DNA, 16 bp, Homo sapiens
ccagccccgtcccaga

SEQ ID NO: 4332910 - DNA, 13 bp, Homo sapiens
ccagccctctgtg

SEQ ID NO: 4332911 - DNA, 14 bp, Homo sapiens
ccagccgccatgct

SEQ ID NO: 4332912 - DNA, 19 bp, Homo sapiens
ccagccgctcggaggcccc

SEQ ID NO: 4332913 - DNA, 21 bp, Homo sapiens
ccagccgtgtgtgcatgtgcc

SEQ ID NO: 4332914 - DNA, 18 bp, Homo sapiens
ccagcctggacccccagc

SEQ ID NO: 4332915 - DNA, 13 bp, Homo sapiens
ccagcctgggtga

SEQ ID NO: 4332916 - DNA, 14 bp, Homo sapiens
ccagccttatgtgt

SEQ ID NO: 4332917 - DNA, 13 bp, Homo sapiens
ccagctcccccag

SEQ ID NO: 4332918 - DNA, 15 bp, Homo sapiens
ccagctctctctcct

SEQ ID NO: 4332919 - DNA, 16 bp, Homo sapiens
ccagcttatctcaggg

SEQ ID NO: 4332920 - DNA, 18 bp, Homo sapiens
ccagctttgcccaacacc

SEQ ID NO: 4332921 - DNA, 19 bp, Homo sapiens
ccagctttgcccaacacca

SEQ ID NO: 4332922 - DNA, 20 bp, Homo sapiens
ccaggaagtgcttattctct

SEQ ID NO: 4332923 - DNA, 15 bp, Homo sapiens
ccaggagccatgaca

SEQ ID NO: 4332924 - DNA, 18 bp, Homo sapiens
ccaggagccatgacaggg

SEQ ID NO: 4332925 - DNA, 16 bp, Homo sapiens
ccaggagccctggccc

SEQ ID NO: 4332926 - DNA, 19 bp, Homo sapiens
ccaggagggagagcctctg

SEQ ID NO: 4332927 - DNA, 20 bp, Homo sapiens
ccaggagggagagcctctgt

SEQ ID NO: 4332928 - DNA, 19 bp, Homo sapiens
ccaggcagaaatagttgtc

SEQ ID NO: 4332929 - DNA, 13 bp, Homo sapiens
ccaggcatggtgg

SEQ ID NO: 4332930 - DNA, 14 bp, Homo sapiens
ccaggcctctgccc

SEQ ID NO: 4332931 - DNA, 13 bp, Homo sapiens
ccagggagaggcc

SEQ ID NO: 4332932 - DNA, 19 bp, Homo sapiens
ccaggggaaaatcagcctg

SEQ ID NO: 4332933 - DNA, 16 bp, Homo sapiens
ccagtcccccaacccc

SEQ ID NO: 4332934 - DNA, 21 bp, Homo sapiens
ccagtcccccaaccccagccg

SEQ ID NO: 4332935 - DNA, 19 bp, Homo sapiens
ccagtgcccggtgcagggc

SEQ ID NO: 4332936 - DNA, 20 bp, Homo sapiens
ccagtgccgagaaggaagcc

SEQ ID NO: 4332937 - DNA, 22 bp, Homo sapiens
ccagtgctaagctgccctgagg

SEQ ID NO: 4332938 - DNA, 20 bp, Homo sapiens
ccagtggagacggaatctgc

SEQ ID NO: 4332939 - DNA, 17 bp, Homo sapiens
ccagtgttccccccata

SEQ ID NO: 4332940 - DNA, 18 bp, Homo sapiens
ccagttacccaaaatctg

SEQ ID NO: 4332941 - DNA, 13 bp, Homo sapiens
ccagttggaaaat

SEQ ID NO: 4332942 - DNA, 14 bp, Homo sapiens
ccataccttctccc

SEQ ID NO: 4332943 - DNA, 16 bp, Homo sapiens
ccataccttctcccag

SEQ ID NO: 4332944 - DNA, 19 bp, Homo sapiens
ccataccttctcccaggcc

SEQ ID NO: 4332945 - DNA, 17 bp, Homo sapiens
ccatagagtaatgatgt

SEQ ID NO: 4332946 - DNA, 19 bp, Homo sapiens
ccatatatgctgtatttct

SEQ ID NO: 4332947 - DNA, 16 bp, Homo sapiens
ccatatggaggcctga

SEQ ID NO: 4332948 - DNA, 19 bp, Homo sapiens
ccatcccgtaagaccacct

SEQ ID NO: 4332949 - DNA, 21 bp, Homo sapiens
ccatctgtgcacactaagaaa

SEQ ID NO: 4332950 - DNA, 21 bp, Homo sapiens
ccatgacaggcctgaagatat

SEQ ID NO: 4332951 - DNA, 18 bp, Homo sapiens
ccatgcccttacacgtgc

SEQ ID NO: 4332952 - DNA, 21 bp, Homo sapiens
ccatgcccttacacgtgcgtg

SEQ ID NO: 4332953 - DNA, 18 bp, Homo sapiens
ccatgctcctggcccact

SEQ ID NO: 4332954 - DNA, 13 bp, Homo sapiens
ccatgcttcactc

SEQ ID NO: 4332955 - DNA, 14 bp, Homo sapiens
ccatggtaccccct

SEQ ID NO: 4332956 - DNA, 15 bp, Homo sapiens
ccatggtaccccctt

SEQ ID NO: 4332957 - DNA, 19 bp, Homo sapiens
ccatggtacccccttctgg

SEQ ID NO: 4332958 - DNA, 14 bp, Homo sapiens
ccatgtatgtggta

SEQ ID NO: 4332959 - DNA, 21 bp, Homo sapiens
ccatgtgtgctaatatacttt

SEQ ID NO: 4332960 - DNA, 18 bp, Homo sapiens
ccatgttttgtttacggt

SEQ ID NO: 4332961 - DNA, 19 bp, Homo sapiens
ccattaaatgaatattttg

SEQ ID NO: 4332962 - DNA, 15 bp, Homo sapiens
ccattaataactgaa

SEQ ID NO: 4332963 - DNA, 21 bp, Homo sapiens
ccattaataactgaataaaaa

SEQ ID NO: 4332964 - DNA, 22 bp, Homo sapiens
ccattacgtgcatttaaactct

SEQ ID NO: 4332965 - DNA, 22 bp, Homo sapiens
ccattcctggaaaccacagtcc

SEQ ID NO: 4332966 - DNA, 11 bp, Homo sapiens
ccattcttggt

SEQ ID NO: 4332967 - DNA, 17 bp, Homo sapiens
ccattgaaaaaggaaaa

SEQ ID NO: 4332968 - DNA, 19 bp, Homo sapiens
ccattgaaaaaggaaaaat

SEQ ID NO: 4332969 - DNA, 21 bp, Homo sapiens
ccattgacatttgaatttgga

SEQ ID NO: 4332970 - DNA, 15 bp, Homo sapiens
ccattgggactgatt

SEQ ID NO: 4332971 - DNA, 16 bp, Homo sapiens
ccattgtcttgttctg

SEQ ID NO: 4332972 - DNA, 20 bp, Homo sapiens
ccattgtcttgttctgtgat

SEQ ID NO: 4332973 - DNA, 20 bp, Homo sapiens
ccattgtctttcctcccttc

SEQ ID NO: 4332974 - DNA, 20 bp, Homo sapiens
ccatttgctactgtacataa

SEQ ID NO: 4332975 - DNA, 18 bp, Homo sapiens
ccatttttgctaattatc

SEQ ID NO: 4332976 - DNA, 19 bp, Homo sapiens
cccaaaatctgattagaag

SEQ ID NO: 4332977 - DNA, 14 bp, Homo sapiens
cccaaatggctgct

SEQ ID NO: 4332978 - DNA, 16 bp, Homo sapiens
cccaacaccagcccct

SEQ ID NO: 4332979 - DNA, 12 bp, Homo sapiens
cccaacccctga

SEQ ID NO: 4332980 - DNA, 14 bp, Homo sapiens
cccaacccctgagg

SEQ ID NO: 4332981 - DNA, 21 bp, Homo sapiens
cccaagctagactgtgtctga

SEQ ID NO: 4332982 - DNA, 13 bp, Homo sapiens
cccaaggaggtgg

SEQ ID NO: 4332983 - DNA, 12 bp, Homo sapiens
cccaagtccaaa

SEQ ID NO: 4332984 - DNA, 15 bp, Homo sapiens
cccaatccagagaag

SEQ ID NO: 4332985 - DNA, 22 bp, Homo sapiens
cccaatggagaaatgaagcaga

SEQ ID NO: 4332986 - DNA, 21 bp, Homo sapiens
cccacaaaggagagctagcag

SEQ ID NO: 4332987 - DNA, 12 bp, Homo sapiens
cccacagccctg

SEQ ID NO: 4332988 - DNA, 12 bp, Homo sapiens
cccacagggaaa

SEQ ID NO: 4332989 - DNA, 12 bp, Homo sapiens
cccacccaagga

SEQ ID NO: 4332990 - DNA, 16 bp, Homo sapiens
cccacccagaggtggc

SEQ ID NO: 4332991 - DNA, 14 bp, Homo sapiens
cccaccccagagtt

SEQ ID NO: 4332992 - DNA, 14 bp, Homo sapiens
cccaccgaggagcc

SEQ ID NO: 4332993 - DNA, 13 bp, Homo sapiens
cccacctctgcca

SEQ ID NO: 4332994 - DNA, 15 bp, Homo sapiens
cccacctgacctctg

SEQ ID NO: 4332995 - DNA, 20 bp, Homo sapiens
catgcttctcatcttgtgaa

SEQ ID NO: 4332996 - DNA, 16 bp, Homo sapiens
catgcttcttccttac

SEQ ID NO: 4332997 - DNA, 21 bp, Homo sapiens
catgctttgagaccagaagaa

SEQ ID NO: 4332998 - DNA, 16 bp, Homo sapiens
catggagactctgaga

SEQ ID NO: 4332999 - DNA, 14 bp, Homo sapiens
catggccagactcc

SEQ ID NO: 4333000 - DNA, 19 bp, Homo sapiens
catggccagactcccttgc

SEQ ID NO: 4333001 - DNA, 18 bp, Homo sapiens
catggccattcagcacag

SEQ ID NO: 4333002 - DNA, 19 bp, Homo sapiens
catggggcccctggcccag

SEQ ID NO: 4333003 - DNA, 21 bp, Homo sapiens
catggtacccccttctgggca

SEQ ID NO: 4333004 - DNA, 14 bp, Homo sapiens
catgtagctgagtt

SEQ ID NO: 4333005 - DNA, 21 bp, Homo sapiens
catgtatgtggtatgtatatt

SEQ ID NO: 4333006 - DNA, 18 bp, Homo sapiens
catgtctgtatccccagt

SEQ ID NO: 4333007 - DNA, 22 bp, Homo sapiens
catgtctgtatccccagtgccc

SEQ ID NO: 4333008 - DNA, 23 bp, Homo sapiens
catgtctgtatccccagtgcccg

SEQ ID NO: 4333009 - DNA, 14 bp, Homo sapiens
catgtgcccctgcc

SEQ ID NO: 4333010 - DNA, 19 bp, Homo sapiens
catgtgcgtttcatgtgtt

SEQ ID NO: 4333011 - DNA, 21 bp, Homo sapiens
catgttgggtttgagacagac

SEQ ID NO: 4333012 - DNA, 22 bp, Homo sapiens
catgttggtcaaaagctggatt

SEQ ID NO: 4333013 - DNA, 18 bp, Homo sapiens
catgtttgtctgtgtgct

SEQ ID NO: 4333014 - DNA, 23 bp, Homo sapiens
catgtttgtctgtgtgctgtaac

SEQ ID NO: 4333015 - DNA, 15 bp, Homo sapiens
catgttttgtttacg

SEQ ID NO: 4333016 - DNA, 15 bp, Homo sapiens
cattaaatgaatatt

SEQ ID NO: 4333017 - DNA, 16 bp, Homo sapiens
cattaagtcagtggct

SEQ ID NO: 4333018 - DNA, 15 bp, Homo sapiens
cattaataactgaat

SEQ ID NO: 4333019 - DNA, 19 bp, Homo sapiens
cattaataactgaataaaa

SEQ ID NO: 4333020 - DNA, 21 bp, Homo sapiens
cattaataactgaataaaaaa

SEQ ID NO: 4333021 - DNA, 16 bp, Homo sapiens
cattacgtgcatttaa

SEQ ID NO: 4333022 - DNA, 13 bp, Homo sapiens
cattaggaattgt

SEQ ID NO: 4333023 - DNA, 20 bp, Homo sapiens
cattaggaattgtttataca

SEQ ID NO: 4333024 - DNA, 21 bp, Homo sapiens
cattaggaattgtttatacac

SEQ ID NO: 4333025 - DNA, 20 bp, Homo sapiens
cattatgtttcctaactgtg

SEQ ID NO: 4333026 - DNA, 13 bp, Homo sapiens
cattcacttctct

SEQ ID NO: 4333027 - DNA, 14 bp, Homo sapiens
cattccattgccta

SEQ ID NO: 4333028 - DNA, 16 bp, Homo sapiens
cattccattgcctagc

SEQ ID NO: 4333029 - DNA, 19 bp, Homo sapiens
cattcctggaaaccacagt

SEQ ID NO: 4333030 - DNA, 18 bp, Homo sapiens
cattcctgttctctttgc

SEQ ID NO: 4333031 - DNA, 15 bp, Homo sapiens
cattccttacttgca

SEQ ID NO: 4333032 - DNA, 18 bp, Homo sapiens
cattccttacttgcactg

SEQ ID NO: 4333033 - DNA, 19 bp, Homo sapiens
cattctcataattcctaca

SEQ ID NO: 4333034 - DNA, 23 bp, Homo sapiens
cattctcataattcctacagcac

SEQ ID NO: 4333035 - DNA, 18 bp, Homo sapiens
cattctcggtacttctgt

SEQ ID NO: 4333036 - DNA, 20 bp, Homo sapiens
cattctgcattgagaaggaa

SEQ ID NO: 4333037 - DNA, 18 bp, Homo sapiens
cattcttggttgttaatt

SEQ ID NO: 4333038 - DNA, 14 bp, Homo sapiens
cattgagaaggaac

SEQ ID NO: 4333039 - DNA, 15 bp, Homo sapiens
cattgcaaaatagaa

SEQ ID NO: 4333040 - DNA, 16 bp, Homo sapiens
cattgcctagctcttt

SEQ ID NO: 4333041 - DNA, 18 bp, Homo sapiens
cattgctgggcttgtctg

SEQ ID NO: 4333042 - DNA, 15 bp, Homo sapiens
cattgtctttcctcc

SEQ ID NO: 4333043 - DNA, 18 bp, Homo sapiens
cattgtctttcctccctt

SEQ ID NO: 4333044 - DNA, 22 bp, Homo sapiens
cattgtctttcctcccttcttt

SEQ ID NO: 4333045 - DNA, 12 bp, Homo sapiens
cattgtgattta

SEQ ID NO: 4333046 - DNA, 16 bp, Homo sapiens
cattgttttgaatatt

SEQ ID NO: 4333047 - DNA, 12 bp, Homo sapiens
catttaaactct

SEQ ID NO: 4333048 - DNA, 13 bp, Homo sapiens
catttaaactctg

SEQ ID NO: 4333049 - DNA, 19 bp, Homo sapiens
catttagagcttttcagaa

SEQ ID NO: 4333050 - DNA, 17 bp, Homo sapiens
catttcacgaactgttc

SEQ ID NO: 4333051 - DNA, 13 bp, Homo sapiens
catttcagatttt

SEQ ID NO: 4333052 - DNA, 19 bp, Homo sapiens
catttcagattttaaaaag

SEQ ID NO: 4333053 - DNA, 13 bp, Homo sapiens
catttcattccat

SEQ ID NO: 4333054 - DNA, 15 bp, Homo sapiens
catttcattccattg

SEQ ID NO: 4333055 - DNA, 21 bp, Homo sapiens
catttcattccattgcctagc

SEQ ID NO: 4333056 - DNA, 21 bp, Homo sapiens
catttcctctctatctttttt

SEQ ID NO: 4333057 - DNA, 13 bp, Homo sapiens
catttgctgaata

SEQ ID NO: 4333058 - DNA, 13 bp, Homo sapiens
catttgctgttgt

SEQ ID NO: 4333059 - DNA, 16 bp, Homo sapiens
catttggcttgctgtt

SEQ ID NO: 4333060 - DNA, 16 bp, Homo sapiens
catttggttaaatcat

SEQ ID NO: 4333061 - DNA, 22 bp, Homo sapiens
catttgtatgtgtgtagactgt

SEQ ID NO: 4333062 - DNA, 16 bp, Homo sapiens
cattttaagtgcttca

SEQ ID NO: 4333063 - DNA, 17 bp, Homo sapiens
cattttacacatgtgct

SEQ ID NO: 4333064 - DNA, 21 bp, Homo sapiens
cattttcttcagaattatcca

SEQ ID NO: 4333065 - DNA, 22 bp, Homo sapiens
cattttcttcagaattatccat

SEQ ID NO: 4333066 - DNA, 16 bp, Homo sapiens
cattttcttttattat

SEQ ID NO: 4333067 - DNA, 21 bp, Homo sapiens
cattttgctaaatgtgaatga

SEQ ID NO: 4333068 - DNA, 13 bp, Homo sapiens
catttttcattca

SEQ ID NO: 4333069 - DNA, 13 bp, Homo sapiens
catttttgctaat

SEQ ID NO: 4333070 - DNA, 15 bp, Homo sapiens
catttttgctaatta

SEQ ID NO: 4333071 - DNA, 17 bp, Homo sapiens
ccaaaagttttcctgag

SEQ ID NO: 4333072 - DNA, 18 bp, Homo sapiens
ccaaaagttttcctgaga

SEQ ID NO: 4333073 - DNA, 15 bp, Homo sapiens
ccaaacatgtattta

SEQ ID NO: 4333074 - DNA, 14 bp, Homo sapiens
ccaaacgtatttta

SEQ ID NO: 4333075 - DNA, 16 bp, Homo sapiens
ccaaagctggcccagt

SEQ ID NO: 4333076 - DNA, 12 bp, Homo sapiens
ccaaaggaaaaa

SEQ ID NO: 4333077 - DNA, 20 bp, Homo sapiens
ccaaatggctgctttgacaa

SEQ ID NO: 4333078 - DNA, 23 bp, Homo sapiens
ccaaatgtttacagggagcctcc

SEQ ID NO: 4333079 - DNA, 22 bp, Homo sapiens
ccaaattgctcctaagcttcaa

SEQ ID NO: 4333080 - DNA, 21 bp, Homo sapiens
ccaaattgtgcttctccccag

SEQ ID NO: 4333081 - DNA, 19 bp, Homo sapiens
ccaacacacgtccactccc

SEQ ID NO: 4333082 - DNA, 20 bp, Homo sapiens
ccaacccgttgggtcccttg

SEQ ID NO: 4333083 - DNA, 21 bp, Homo sapiens
ccaacccgttgggtcccttgc

SEQ ID NO: 4333084 - DNA, 18 bp, Homo sapiens
ccaactgtgttcattaga

SEQ ID NO: 4333085 - DNA, 14 bp, Homo sapiens
ccaagagcaggagg

SEQ ID NO: 4333086 - DNA, 20 bp, Homo sapiens
ccaagagcaggaggtgcctg

SEQ ID NO: 4333087 - DNA, 19 bp, Homo sapiens
ccaagatggagaggaagaa

SEQ ID NO: 4333088 - DNA, 19 bp, Homo sapiens
ccaagcattactttaacct

SEQ ID NO: 4333089 - DNA, 15 bp, Homo sapiens
ccaagctagactgtg

SEQ ID NO: 4333090 - DNA, 11 bp, Homo sapiens
ccaaggagaac

SEQ ID NO: 4333091 - DNA, 22 bp, Homo sapiens
ccaaggctcagaggagccaata

SEQ ID NO: 4333092 - DNA, 17 bp, Homo sapiens
ccaaggctgcgtctgga

SEQ ID NO: 4333093 - DNA, 19 bp, Homo sapiens
ccaaggctgcgtctggagg

SEQ ID NO: 4333094 - DNA, 14 bp, Homo sapiens
ccaaggctggggga

SEQ ID NO: 4333095 - DNA, 18 bp, Homo sapiens
ccaaggtgggaggattgc

SEQ ID NO: 4333096 - DNA, 21 bp, Homo sapiens
ccaagtatgaagtataaatct

SEQ ID NO: 4333097 - DNA, 14 bp, Homo sapiens
ccaagtcattccta

SEQ ID NO: 4333098 - DNA, 12 bp, Homo sapiens
ccaatagaaagc

SEQ ID NO: 4333099 - DNA, 17 bp, Homo sapiens
ccaatagtcatatgtga

SEQ ID NO: 4333100 - DNA, 13 bp, Homo sapiens
ccaatatgacaca

SEQ ID NO: 4333101 - DNA, 20 bp, Homo sapiens
ccaatccagagaagcgctgt

SEQ ID NO: 4333102 - DNA, 21 bp, Homo sapiens
ccaatgatacccaacagttta

SEQ ID NO: 4333103 - DNA, 18 bp, Homo sapiens
ccaatgcttttatcaaac

SEQ ID NO: 4333104 - DNA, 17 bp, Homo sapiens
ccaatggagaaaatgaa

SEQ ID NO: 4333105 - DNA, 16 bp, Homo sapiens
ccaatggagaaatgaa

SEQ ID NO: 4333106 - DNA, 22 bp, Homo sapiens
ccaattattgatatatattata

SEQ ID NO: 4333107 - DNA, 14 bp, Homo sapiens
ccaattctgaaata

SEQ ID NO: 4333108 - DNA, 16 bp, Homo sapiens
ccacaaagagaccagg

SEQ ID NO: 4333109 - DNA, 18 bp, Homo sapiens
ccacaaaggagagctagc

SEQ ID NO: 4333110 - DNA, 16 bp, Homo sapiens
ccacaagccttactca

SEQ ID NO: 4333111 - DNA, 15 bp, Homo sapiens
ccacacccacctctg

SEQ ID NO: 4333112 - DNA, 17 bp, Homo sapiens
ccacacccacctctgcc

SEQ ID NO: 4333113 - DNA, 16 bp, Homo sapiens
ccacacggagctcctg

SEQ ID NO: 4333114 - DNA, 13 bp, Homo sapiens
ccacagccctgaa

SEQ ID NO: 4333115 - DNA, 22 bp, Homo sapiens
cagaacgtatttagccattacc

SEQ ID NO: 4333116 - DNA, 14 bp, Homo sapiens
cagaagaaaattct

SEQ ID NO: 4333117 - DNA, 18 bp, Homo sapiens
cagaaggggatgggaaat

SEQ ID NO: 4333118 - DNA, 21 bp, Homo sapiens
cagaaggggatgggaaataaa

SEQ ID NO: 4333119 - DNA, 18 bp, Homo sapiens
cagaatggaatccatctg

SEQ ID NO: 4333120 - DNA, 22 bp, Homo sapiens
cagaatggaatccatctgtctc

SEQ ID NO: 4333121 - DNA, 17 bp, Homo sapiens
cagaatgtttttaaaat

SEQ ID NO: 4333122 - DNA, 17 bp, Homo sapiens
cagaattatccattacg

SEQ ID NO: 4333123 - DNA, 22 bp, Homo sapiens
cagaattatccattacgtgcat

SEQ ID NO: 4333124 - DNA, 13 bp, Homo sapiens
cagaattgatcat

SEQ ID NO: 4333125 - DNA, 15 bp, Homo sapiens
cagacactgttgcaa

SEQ ID NO: 4333126 - DNA, 22 bp, Homo sapiens
cagacactgttgcaaaggtagg

SEQ ID NO: 4333127 - DNA, 17 bp, Homo sapiens
cagaccaagtccaagcc

SEQ ID NO: 4333128 - DNA, 17 bp, Homo sapiens
cagacgtaggggagggg

SEQ ID NO: 4333129 - DNA, 22 bp, Homo sapiens
cagacgtcgtacccagccatgt

SEQ ID NO: 4333130 - DNA, 23 bp, Homo sapiens
cagacgtcgtacccagccatgtg

SEQ ID NO: 4333131 - DNA, 15 bp, Homo sapiens
cagactctcagccca

SEQ ID NO: 4333132 - DNA, 18 bp, Homo sapiens
cagactctcagcccagaa

SEQ ID NO: 4333133 - DNA, 18 bp, Homo sapiens
cagacttaacagacccag

SEQ ID NO: 4333134 - DNA, 14 bp, Homo sapiens
cagagcaagtgaga

SEQ ID NO: 4333135 - DNA, 20 bp, Homo sapiens
cagagcaagtgagaccctgt

SEQ ID NO: 4333136 - DNA, 22 bp, Homo sapiens
cagagcagatcagtctttgtca

SEQ ID NO: 4333137 - DNA, 17 bp, Homo sapiens
cagagccaccagggcac

SEQ ID NO: 4333138 - DNA, 18 bp, Homo sapiens
cagagcccgggagagact

SEQ ID NO: 4333139 - DNA, 17 bp, Homo sapiens
cagaggccgctgcccct

SEQ ID NO: 4333140 - DNA, 18 bp, Homo sapiens
cagaggccgctgcccctg

SEQ ID NO: 4333141 - DNA, 13 bp, Homo sapiens
cagaggtggccct

SEQ ID NO: 4333142 - DNA, 16 bp, Homo sapiens
cagaggtggccctccc

SEQ ID NO: 4333143 - DNA, 17 bp, Homo sapiens
cagaggtggccctccca

SEQ ID NO: 4333144 - DNA, 18 bp, Homo sapiens
cagaggtggccctcccag

SEQ ID NO: 4333145 - DNA, 19 bp, Homo sapiens
cagaggtggccctcccagg

SEQ ID NO: 4333146 - DNA, 23 bp, Homo sapiens
cagagtcacaagtagcctctggg

SEQ ID NO: 4333147 - DNA, 14 bp, Homo sapiens
cagagttaaaatat

SEQ ID NO: 4333148 - DNA, 22 bp, Homo sapiens
cagagtttgtagtaaatattat

SEQ ID NO: 4333149 - DNA, 12 bp, Homo sapiens
cagagtttgtgt

SEQ ID NO: 4333150 - DNA, 21 bp, Homo sapiens
cagagtttgtgtgtatttgta

SEQ ID NO: 4333151 - DNA, 17 bp, Homo sapiens
cagatatccaaacaaga

SEQ ID NO: 4333152 - DNA, 17 bp, Homo sapiens
cagatgtttaatgaagt

SEQ ID NO: 4333153 - DNA, 21 bp, Homo sapiens
cagatttcttaatgtctgtca

SEQ ID NO: 4333154 - DNA, 14 bp, Homo sapiens
cagatttgtgttat

SEQ ID NO: 4333155 - DNA, 13 bp, Homo sapiens
cagattttaaaaa

SEQ ID NO: 4333156 - DNA, 18 bp, Homo sapiens
cagcacagctctcctcct

SEQ ID NO: 4333157 - DNA, 23 bp, Homo sapiens
cagcacatttcctctctatcttt

SEQ ID NO: 4333158 - DNA, 13 bp, Homo sapiens
cagcagatgttta

SEQ ID NO: 4333159 - DNA, 12 bp, Homo sapiens
cagcagcctgga

SEQ ID NO: 4333160 - DNA, 14 bp, Homo sapiens
cagcagcctggacc

SEQ ID NO: 4333161 - DNA, 22 bp, Homo sapiens
cagcaggaggttctgggcctct

SEQ ID NO: 4333162 - DNA, 22 bp, Homo sapiens
cagcagggctggtcacctccca

SEQ ID NO: 4333163 - DNA, 16 bp, Homo sapiens
cagcagttctctgcca

SEQ ID NO: 4333164 - DNA, 14 bp, Homo sapiens
cagcatcagcacag

SEQ ID NO: 4333165 - DNA, 18 bp, Homo sapiens
cagccaaagcctcctcca

SEQ ID NO: 4333166 - DNA, 22 bp, Homo sapiens
cagccatagcttgattgctcag

SEQ ID NO: 4333167 - DNA, 20 bp, Homo sapiens
cagccatgggaaatgagcca

SEQ ID NO: 4333168 - DNA, 21 bp, Homo sapiens
cagccatgggaaatgagccag

SEQ ID NO: 4333169 - DNA, 13 bp, Homo sapiens
cagccattcctgt

SEQ ID NO: 4333170 - DNA, 19 bp, Homo sapiens
cagccattcctgttctctt

SEQ ID NO: 4333171 - DNA, 10 bp, Homo sapiens
cagcccaagt

SEQ ID NO: 4333172 - DNA, 21 bp, Homo sapiens
cagccccaatccagagaagcg

SEQ ID NO: 4333173 - DNA, 16 bp, Homo sapiens
cagcccccacagccct

SEQ ID NO: 4333174 - DNA, 18 bp, Homo sapiens
cagccccgtcccagaggc

SEQ ID NO: 4333175 - DNA, 22 bp, Homo sapiens
cagcccctgccccagcccaagt

SEQ ID NO: 4333176 - DNA, 19 bp, Homo sapiens
cagcccggggcaggtgcag

SEQ ID NO: 4333177 - DNA, 13 bp, Homo sapiens
cagccctctgtgg

SEQ ID NO: 4333178 - DNA, 20 bp, Homo sapiens
cagccctctgtggccaggag

SEQ ID NO: 4333179 - DNA, 22 bp, Homo sapiens
cagccctctgtggccaggagcc

SEQ ID NO: 4333180 - DNA, 20 bp, Homo sapiens
cagcccttcctccctgtctc

SEQ ID NO: 4333181 - DNA, 13 bp, Homo sapiens
cagccgtgtgtgc

SEQ ID NO: 4333182 - DNA, 19 bp, Homo sapiens
cagccgtgtgtgcatgtgc

SEQ ID NO: 4333183 - DNA, 17 bp, Homo sapiens
cagcctctgaaaaccaa

SEQ ID NO: 4333184 - DNA, 16 bp, Homo sapiens
cagcctgctccagctg

SEQ ID NO: 4333185 - DNA, 17 bp, Homo sapiens
cagcctgctccagctgt

SEQ ID NO: 4333186 - DNA, 19 bp, Homo sapiens
cagcctgctccagctgttc

SEQ ID NO: 4333187 - DNA, 14 bp, Homo sapiens
cagcgccaagtggc

SEQ ID NO: 4333188 - DNA, 17 bp, Homo sapiens
cagcgccaagtggccac

SEQ ID NO: 4333189 - DNA, 22 bp, Homo sapiens
cagcgtggtttttatgtgtatt

SEQ ID NO: 4333190 - DNA, 14 bp, Homo sapiens
cagctcccccaggc

SEQ ID NO: 4333191 - DNA, 16 bp, Homo sapiens
cagctcccccaggcag

SEQ ID NO: 4333192 - DNA, 18 bp, Homo sapiens
cagctcccccaggcagaa

SEQ ID NO: 4333193 - DNA, 13 bp, Homo sapiens
cagctccccctgt

SEQ ID NO: 4333194 - DNA, 16 bp, Homo sapiens
cagctccccctgtccc

SEQ ID NO: 4333195 - DNA, 15 bp, Homo sapiens
cagctccctgacccc

SEQ ID NO: 4333196 - DNA, 19 bp, Homo sapiens
cagctccctgaccccctgt

SEQ ID NO: 4333197 - DNA, 16 bp, Homo sapiens
cagctctctctcctgg

SEQ ID NO: 4333198 - DNA, 21 bp, Homo sapiens
cagctctgcaagaattgaagc

SEQ ID NO: 4333199 - DNA, 22 bp, Homo sapiens
cagctgacggtttctccccgga

SEQ ID NO: 4333200 - DNA, 14 bp, Homo sapiens
cagctgggacctaa

SEQ ID NO: 4333201 - DNA, 17 bp, Homo sapiens
cagctgggacctaatgc

SEQ ID NO: 4333202 - DNA, 18 bp, Homo sapiens
cagctgggacctaatgct

SEQ ID NO: 4333203 - DNA, 18 bp, Homo sapiens
cagctggttgaggtttca

SEQ ID NO: 4333204 - DNA, 22 bp, Homo sapiens
cagctggttgtaccctctccag

SEQ ID NO: 4333205 - DNA, 15 bp, Homo sapiens
cagctgttcagctgg

SEQ ID NO: 4333206 - DNA, 23 bp, Homo sapiens
cagcttgtgctgagcctgcccag

SEQ ID NO: 4333207 - DNA, 12 bp, Homo sapiens
cagctttgtttg

SEQ ID NO: 4333208 - DNA, 21 bp, Homo sapiens
cagctttgtttgttgtcagct

SEQ ID NO: 4333209 - DNA, 23 bp, Homo sapiens
cagctttgtttgttgtcagctga

SEQ ID NO: 4333210 - DNA, 21 bp, Homo sapiens
caggaagtgcttattctctca

SEQ ID NO: 4333211 - DNA, 13 bp, Homo sapiens
caggacctcaggt

SEQ ID NO: 4333212 - DNA, 11 bp, Homo sapiens
caggagcccta

SEQ ID NO: 4333213 - DNA, 16 bp, Homo sapiens
caggagccctggcccg

SEQ ID NO: 4333214 - DNA, 19 bp, Homo sapiens
caggaggatcacttgagtc

SEQ ID NO: 4333215 - DNA, 18 bp, Homo sapiens
caggaggcgaataaatgt

SEQ ID NO: 4333216 - DNA, 19 bp, Homo sapiens
caggaggcgaataaatgtt

SEQ ID NO: 4333217 - DNA, 20 bp, Homo sapiens
caggaggttctgggcctctg

SEQ ID NO: 4333218 - DNA, 22 bp, Homo sapiens
caggagtttgagaccaacctgg

SEQ ID NO: 4333219 - DNA, 18 bp, Homo sapiens
caggatgccctgttgggg

SEQ ID NO: 4333220 - DNA, 15 bp, Homo sapiens
caggcagaaatagtt

SEQ ID NO: 4333221 - DNA, 21 bp, Homo sapiens
caggcagaaatagttgtctgt

SEQ ID NO: 4333222 - DNA, 17 bp, Homo sapiens
caggcagctctgagccg

SEQ ID NO: 4333223 - DNA, 18 bp, Homo sapiens
caggcatcactgattccc

SEQ ID NO: 4333224 - DNA, 16 bp, Homo sapiens
caggccaaacatggcc

SEQ ID NO: 4333225 - DNA, 13 bp, Homo sapiens
caggcctctgccc

SEQ ID NO: 4333226 - DNA, 19 bp, Homo sapiens
caggctactctgcccaccc

SEQ ID NO: 4333227 - DNA, 13 bp, Homo sapiens
cagggaaatgtgt

SEQ ID NO: 4333228 - DNA, 20 bp, Homo sapiens
cagggagaagttgagcaggt

SEQ ID NO: 4333229 - DNA, 14 bp, Homo sapiens
cagggagaggcctc

SEQ ID NO: 4333230 - DNA, 12 bp, Homo sapiens
cagggagcctcc

SEQ ID NO: 4333231 - DNA, 13 bp, Homo sapiens
cagggagcctcct

SEQ ID NO: 4333232 - DNA, 18 bp, Homo sapiens
cagggaggaagatgttca

SEQ ID NO: 4333233 - DNA, 11 bp, Homo sapiens
cagggcctggc

SEQ ID NO: 4333234 - DNA, 12 bp, Homo sapiens
cagggcctggca

SEQ ID NO: 4333235 - DNA, 13 bp, Homo sapiens
cagggcctggcat

SEQ ID NO: 4333236 - DNA, 17 bp, Homo sapiens
caggggaaaatcagcct

SEQ ID NO: 4333237 - DNA, 19 bp, Homo sapiens
caggggaaaatcagcctgc

SEQ ID NO: 4333238 - DNA, 20 bp, Homo sapiens
caggggatgtacatctctcc

SEQ ID NO: 4333239 - DNA, 22 bp, Homo sapiens
caggggcgggtgatgagacctg

SEQ ID NO: 4333240 - DNA, 21 bp, Homo sapiens
cagggtctctaccatcccctg

SEQ ID NO: 4333241 - DNA, 20 bp, Homo sapiens
caggtaaacacataaatgaa

SEQ ID NO: 4333242 - DNA, 12 bp, Homo sapiens
caggtctctgtg

SEQ ID NO: 4333243 - DNA, 14 bp, Homo sapiens
caggtgctgggaat

SEQ ID NO: 4333244 - DNA, 21 bp, Homo sapiens
caggttggtgggggcctcggt

SEQ ID NO: 4333245 - DNA, 14 bp, Homo sapiens
caggtttaagctgt

SEQ ID NO: 4333246 - DNA, 13 bp, Homo sapiens
cagtaaaataaaa

SEQ ID NO: 4333247 - DNA, 16 bp, Homo sapiens
cagtaaaataaaaaac

SEQ ID NO: 4333248 - DNA, 21 bp, Homo sapiens
cagtaatgtagaaatgtttca

SEQ ID NO: 4333249 - DNA, 16 bp, Homo sapiens
cagtacctcccctccc

SEQ ID NO: 4333250 - DNA, 23 bp, Homo sapiens
cagtacctcccctccccgccccc

SEQ ID NO: 4333251 - DNA, 12 bp, Homo sapiens
cagtagaaagag

SEQ ID NO: 4333252 - DNA, 14 bp, Homo sapiens
cagtagaattttag

SEQ ID NO: 4333253 - DNA, 16 bp, Homo sapiens
cagtcccagcacattt

SEQ ID NO: 4333254 - DNA, 16 bp, Homo sapiens
cagtcccccaacccca

SEQ ID NO: 4333255 - DNA, 18 bp, Homo sapiens
cagtgagtgccatgcttt

SEQ ID NO: 4333256 - DNA, 20 bp, Homo sapiens
cagtgcccggtgcagggcct

SEQ ID NO: 4333257 - DNA, 21 bp, Homo sapiens
cagtgcccggtgcagggcctg

SEQ ID NO: 4333258 - DNA, 22 bp, Homo sapiens
cagtgcccggtgcagggcctgg

SEQ ID NO: 4333259 - DNA, 17 bp, Homo sapiens
cagtgctaagctgccct

SEQ ID NO: 4333260 - DNA, 19 bp, Homo sapiens
cagtgctaagctgccctga

SEQ ID NO: 4333261 - DNA, 20 bp, Homo sapiens
cagtgctaagctgccctgag

SEQ ID NO: 4333262 - DNA, 15 bp, Homo sapiens
cagtgctcctggccc

SEQ ID NO: 4333263 - DNA, 14 bp, Homo sapiens
cagtggctttgcat

SEQ ID NO: 4333264 - DNA, 13 bp, Homo sapiens
cagtgggaagaat

SEQ ID NO: 4333265 - DNA, 20 bp, Homo sapiens
cagtggtactctgtgtctgg

SEQ ID NO: 4333266 - DNA, 12 bp, Homo sapiens
cagtgtatttta

SEQ ID NO: 4333267 - DNA, 14 bp, Homo sapiens
cagtgtattttaaa

SEQ ID NO: 4333268 - DNA, 18 bp, Homo sapiens
cagtgtattttaaattct

SEQ ID NO: 4333269 - DNA, 14 bp, Homo sapiens
cagtgttagtattc

SEQ ID NO: 4333270 - DNA, 13 bp, Homo sapiens
cagtgttcccccc

SEQ ID NO: 4333271 - DNA, 18 bp, Homo sapiens
cagtgttccccccataga

SEQ ID NO: 4333272 - DNA, 12 bp, Homo sapiens
cagtgttgacat

SEQ ID NO: 4333273 - DNA, 13 bp, Homo sapiens
cagtgttgacata

SEQ ID NO: 4333274 - DNA, 16 bp, Homo sapiens
cagtgttgacatagcc

SEQ ID NO: 4333275 - DNA, 18 bp, Homo sapiens
cagttaaaatcacatttt

SEQ ID NO: 4333276 - DNA, 15 bp, Homo sapiens
cagttaagttcttct

SEQ ID NO: 4333277 - DNA, 19 bp, Homo sapiens
cagttaagttcttctcccg

SEQ ID NO: 4333278 - DNA, 15 bp, Homo sapiens
cagttataagcgtat

SEQ ID NO: 4333279 - DNA, 16 bp, Homo sapiens
cagttcatatgcagaa

SEQ ID NO: 4333280 - DNA, 18 bp, Homo sapiens
cagttccacggttgctaa

SEQ ID NO: 4333281 - DNA, 14 bp, Homo sapiens
cagttccttggcct

SEQ ID NO: 4333282 - DNA, 14 bp, Homo sapiens
cagttctctgccaa

SEQ ID NO: 4333283 - DNA, 16 bp, Homo sapiens
cagttctctgccaaag

SEQ ID NO: 4333284 - DNA, 18 bp, Homo sapiens
cagttgaaaaacagctga

SEQ ID NO: 4333285 - DNA, 15 bp, Homo sapiens
cagttgcagaaaatg

SEQ ID NO: 4333286 - DNA, 17 bp, Homo sapiens
cagttgcagaaaatgaa

SEQ ID NO: 4333287 - DNA, 18 bp, Homo sapiens
cagttgcagaaaatgaac

SEQ ID NO: 4333288 - DNA, 12 bp, Homo sapiens
cagttggaaaat

SEQ ID NO: 4333289 - DNA, 18 bp, Homo sapiens
cagtttcatgtatgtata

SEQ ID NO: 4333290 - DNA, 14 bp, Homo sapiens
cagttttgtttagt

SEQ ID NO: 4333291 - DNA, 13 bp, Homo sapiens
cataaaattctag

SEQ ID NO: 4333292 - DNA, 12 bp, Homo sapiens
cataaatgaaag

SEQ ID NO: 4333293 - DNA, 13 bp, Homo sapiens
cataaatgaaaga

SEQ ID NO: 4333294 - DNA, 17 bp, Homo sapiens
cataagtaatatttaaa

SEQ ID NO: 4333295 - DNA, 18 bp, Homo sapiens
cataagtaatatttaaag

SEQ ID NO: 4333296 - DNA, 18 bp, Homo sapiens
catacaaatatatgtata

SEQ ID NO: 4333297 - DNA, 20 bp, Homo sapiens
catacaaatatatgtatata

SEQ ID NO: 4333298 - DNA, 20 bp, Homo sapiens
catacacaaggccagaaaaa

SEQ ID NO: 4333299 - DNA, 11 bp, Homo sapiens
catagaaagac

SEQ ID NO: 4333300 - DNA, 13 bp, Homo sapiens
catagaaagacat

SEQ ID NO: 4333301 - DNA, 15 bp, Homo sapiens
catagagaatacaca

SEQ ID NO: 4333302 - DNA, 16 bp, Homo sapiens
catagagaatacacat

SEQ ID NO: 4333303 - DNA, 19 bp, Homo sapiens
catagagtaggtactccat

SEQ ID NO: 4333304 - DNA, 11 bp, Homo sapiens
catagcctttg

SEQ ID NO: 4333305 - DNA, 14 bp, Homo sapiens
catagcctttgtgc

SEQ ID NO: 4333306 - DNA, 19 bp, Homo sapiens
cataggctggtggccttgg

SEQ ID NO: 4333307 - DNA, 16 bp, Homo sapiens
cataggtatttcaaaa

SEQ ID NO: 4333308 - DNA, 22 bp, Homo sapiens
catataaaaacaatatatttgt

SEQ ID NO: 4333309 - DNA, 13 bp, Homo sapiens
catatataaaagt

SEQ ID NO: 4333310 - DNA, 15 bp, Homo sapiens
catatatgctgtatt

SEQ ID NO: 4333311 - DNA, 19 bp, Homo sapiens
catatatgctgtatttctt

SEQ ID NO: 4333312 - DNA, 18 bp, Homo sapiens
catatgaccattgaaaaa

SEQ ID NO: 4333313 - DNA, 14 bp, Homo sapiens
catatgtgcttctc

SEQ ID NO: 4333314 - DNA, 14 bp, Homo sapiens
catcagatttctta

SEQ ID NO: 4333315 - DNA, 19 bp, Homo sapiens
catccacttcaggagccct

SEQ ID NO: 4333316 - DNA, 14 bp, Homo sapiens
catcccctgtagag

SEQ ID NO: 4333317 - DNA, 18 bp, Homo sapiens
catcccgtaagaccacct

SEQ ID NO: 4333318 - DNA, 22 bp, Homo sapiens
catcccgtaagaccaccttccc

SEQ ID NO: 4333319 - DNA, 20 bp, Homo sapiens
catcccttcctcctctcctg

SEQ ID NO: 4333320 - DNA, 23 bp, Homo sapiens
catcccttcctcctctcctggaa

SEQ ID NO: 4333321 - DNA, 17 bp, Homo sapiens
catcctagccccaccca

SEQ ID NO: 4333322 - DNA, 20 bp, Homo sapiens
catcctagccccacccagag

SEQ ID NO: 4333323 - DNA, 22 bp, Homo sapiens
catcctagccccacccagaggt

SEQ ID NO: 4333324 - DNA, 23 bp, Homo sapiens
catcctagccccacccagaggtg

SEQ ID NO: 4333325 - DNA, 15 bp, Homo sapiens
catcgcagcttcctg

SEQ ID NO: 4333326 - DNA, 18 bp, Homo sapiens
catctaaagctttatctt

SEQ ID NO: 4333327 - DNA, 18 bp, Homo sapiens
catctcccagatcctgga

SEQ ID NO: 4333328 - DNA, 19 bp, Homo sapiens
catctcccagatcctggaa

SEQ ID NO: 4333329 - DNA, 16 bp, Homo sapiens
catctctacaaaaagc

SEQ ID NO: 4333330 - DNA, 16 bp, Homo sapiens
catctgcctgtaatta

SEQ ID NO: 4333331 - DNA, 23 bp, Homo sapiens
catctgtctccctccccaaatgg

SEQ ID NO: 4333332 - DNA, 16 bp, Homo sapiens
catctgtggacaagac

SEQ ID NO: 4333333 - DNA, 17 bp, Homo sapiens
catcttacttgtccttt

SEQ ID NO: 4333334 - DNA, 21 bp, Homo sapiens
catcttaggttggcaaaaagg

SEQ ID NO: 4333335 - DNA, 14 bp, Homo sapiens
catcttttgtgaga

SEQ ID NO: 4333336 - DNA, 13 bp, Homo sapiens
catgaagaatgta

SEQ ID NO: 4333337 - DNA, 13 bp, Homo sapiens
catgaagctggcc

SEQ ID NO: 4333338 - DNA, 16 bp, Homo sapiens
catgaagctggccctc

SEQ ID NO: 4333339 - DNA, 21 bp, Homo sapiens
catgaaggacactctgcaggg

SEQ ID NO: 4333340 - DNA, 14 bp, Homo sapiens
catgaatggagatg

SEQ ID NO: 4333341 - DNA, 14 bp, Homo sapiens
catgagactaagag

SEQ ID NO: 4333342 - DNA, 14 bp, Homo sapiens
catgagtctgtttc

SEQ ID NO: 4333343 - DNA, 15 bp, Homo sapiens
catgagtctgtttcc

SEQ ID NO: 4333344 - DNA, 21 bp, Homo sapiens
catgagtctgtttcccaagct

SEQ ID NO: 4333345 - DNA, 14 bp, Homo sapiens
catgatacctatta

SEQ ID NO: 4333346 - DNA, 22 bp, Homo sapiens
catgattaaccacttcagctga

SEQ ID NO: 4333347 - DNA, 15 bp, Homo sapiens
catgcaaactgcttt

SEQ ID NO: 4333348 - DNA, 23 bp, Homo sapiens
catgcaaactgctttattttccc

SEQ ID NO: 4333349 - DNA, 22 bp, Homo sapiens
catgcaagaatttctggaagaa

SEQ ID NO: 4333350 - DNA, 20 bp, Homo sapiens
catgctcatgtatatttagt

SEQ ID NO: 4333351 - DNA, 16 bp, Homo sapiens
catgctcctggcccac

SEQ ID NO: 4333352 - DNA, 20 bp, Homo sapiens
catgctcctggcccactgca

SEQ ID NO: 4333353 - DNA, 20 bp, Homo sapiens
catgctgagtctcccaaggc

SEQ ID NO: 4333354 - DNA, 21 bp, Homo sapiens
catgctgtccgtgcttgctgg

SEQ ID NO: 4333355 - DNA, 12 bp, Homo sapiens
catgcttcactc

SEQ ID NO: 4333356 - DNA, 14 bp, Homo sapiens
cctgacctctgcaa

SEQ ID NO: 4333357 - DNA, 15 bp, Homo sapiens
cctgacctctgcaag

SEQ ID NO: 4333358 - DNA, 17 bp, Homo sapiens
cctgactggttgtcaga

SEQ ID NO: 4333359 - DNA, 15 bp, Homo sapiens
cctgagcccagagaa

SEQ ID NO: 4333360 - DNA, 16 bp, Homo sapiens
cctgagctttctgcta

SEQ ID NO: 4333361 - DNA, 22 bp, Homo sapiens
cctgaggctctctaagaaaaga

SEQ ID NO: 4333362 - DNA, 12 bp, Homo sapiens
cctgagttctga

SEQ ID NO: 4333363 - DNA, 17 bp, Homo sapiens
cctgagttctgacactg

SEQ ID NO: 4333364 - DNA, 20 bp, Homo sapiens
cctgataaaacaacagctcg

SEQ ID NO: 4333365 - DNA, 14 bp, Homo sapiens
cctgatgtttttcc

SEQ ID NO: 4333366 - DNA, 15 bp, Homo sapiens
cctgcacctctggat

SEQ ID NO: 4333367 - DNA, 21 bp, Homo sapiens
cctgccaaggccggagaccca

SEQ ID NO: 4333368 - DNA, 22 bp, Homo sapiens
cctgccaaggccggagacccac

SEQ ID NO: 4333369 - DNA, 12 bp, Homo sapiens
cctgccaggcat

SEQ ID NO: 4333370 - DNA, 16 bp, Homo sapiens
cctgccaggcatggtg

SEQ ID NO: 4333371 - DNA, 19 bp, Homo sapiens
cctgcccagtcccccaacc

SEQ ID NO: 4333372 - DNA, 23 bp, Homo sapiens
cctgcccagttggaggagactgg

SEQ ID NO: 4333373 - DNA, 13 bp, Homo sapiens
cctgccccagccc

SEQ ID NO: 4333374 - DNA, 19 bp, Homo sapiens
cctgccccagcccaagtcc

SEQ ID NO: 4333375 - DNA, 23 bp, Homo sapiens
cctgccctcaggctccccagtgc

SEQ ID NO: 4333376 - DNA, 16 bp, Homo sapiens
cctgcctcctgcctcc

SEQ ID NO: 4333377 - DNA, 13 bp, Homo sapiens
cctgctccagctg

SEQ ID NO: 4333378 - DNA, 11 bp, Homo sapiens
cctgctcccag

SEQ ID NO: 4333379 - DNA, 12 bp, Homo sapiens
cctgctcccagc

SEQ ID NO: 4333380 - DNA, 15 bp, Homo sapiens
cctgctgctgctgcc

SEQ ID NO: 4333381 - DNA, 19 bp, Homo sapiens
cctgctgggtgccaggtgc

SEQ ID NO: 4333382 - DNA, 15 bp, Homo sapiens
cctgcttctccagcc

SEQ ID NO: 4333383 - DNA, 20 bp, Homo sapiens
cctgcttctccagcctggac

SEQ ID NO: 4333384 - DNA, 21 bp, Homo sapiens
cctgcttgagctttctgtgca

SEQ ID NO: 4333385 - DNA, 23 bp, Homo sapiens
cctgcttgagctttctgtgcatg

SEQ ID NO: 4333386 - DNA, 17 bp, Homo sapiens
cctggaaacagacaggg

SEQ ID NO: 4333387 - DNA, 16 bp, Homo sapiens
cctggaaaccacagtc

SEQ ID NO: 4333388 - DNA, 16 bp, Homo sapiens
cctggacccccagctt

SEQ ID NO: 4333389 - DNA, 17 bp, Homo sapiens
cctggactctgtgtgag

SEQ ID NO: 4333390 - DNA, 18 bp, Homo sapiens
cctggagtctgaagcctg

SEQ ID NO: 4333391 - DNA, 11 bp, Homo sapiens
cctggcataga

SEQ ID NO: 4333392 - DNA, 20 bp, Homo sapiens
cctggcccgcaagagggaca

SEQ ID NO: 4333393 - DNA, 22 bp, Homo sapiens
cctggcccgcaagagggacaga

SEQ ID NO: 4333394 - DNA, 21 bp, Homo sapiens
cctggcggaggtggagtggcc

SEQ ID NO: 4333395 - DNA, 22 bp, Homo sapiens
cctggcggaggtggagtggcca

SEQ ID NO: 4333396 - DNA, 20 bp, Homo sapiens
cctggcgggatgggccaccg

SEQ ID NO: 4333397 - DNA, 22 bp, Homo sapiens
cctgggaggtcaaggctgcagt

SEQ ID NO: 4333398 - DNA, 12 bp, Homo sapiens
cctgggatgccc

SEQ ID NO: 4333399 - DNA, 18 bp, Homo sapiens
cctgggatgcccttcccc

SEQ ID NO: 4333400 - DNA, 14 bp, Homo sapiens
cctgggatggacgc

SEQ ID NO: 4333401 - DNA, 19 bp, Homo sapiens
cctgggcagtgagtgccat

SEQ ID NO: 4333402 - DNA, 21 bp, Homo sapiens
cctgggcggggccgcagccac

SEQ ID NO: 4333403 - DNA, 15 bp, Homo sapiens
cctggttgggtggca

SEQ ID NO: 4333404 - DNA, 20 bp, Homo sapiens
cctgtaatcctagcactttg

SEQ ID NO: 4333405 - DNA, 16 bp, Homo sapiens
cctgtagagtgggagc

SEQ ID NO: 4333406 - DNA, 21 bp, Homo sapiens
cctgtagagtgggagctgagt

SEQ ID NO: 4333407 - DNA, 20 bp, Homo sapiens
cctgtccaatttctgctgta

SEQ ID NO: 4333408 - DNA, 18 bp, Homo sapiens
cctgtcccctcagctcca

SEQ ID NO: 4333409 - DNA, 22 bp, Homo sapiens
cctgttcccccgccgcttttct

SEQ ID NO: 4333410 - DNA, 16 bp, Homo sapiens
cctgttgggggcttca

SEQ ID NO: 4333411 - DNA, 17 bp, Homo sapiens
ccttaaatgaactactg

SEQ ID NO: 4333412 - DNA, 23 bp, Homo sapiens
ccttaaccctaaaattttaaggc

SEQ ID NO: 4333413 - DNA, 20 bp, Homo sapiens
ccttacctcggtgccttcct

SEQ ID NO: 4333414 - DNA, 15 bp, Homo sapiens
ccttactcacctctc

SEQ ID NO: 4333415 - DNA, 17 bp, Homo sapiens
ccttatgtgttacatta

SEQ ID NO: 4333416 - DNA, 18 bp, Homo sapiens
ccttatgtgttacattat

SEQ ID NO: 4333417 - DNA, 14 bp, Homo sapiens
ccttcagcttgctt

SEQ ID NO: 4333418 - DNA, 22 bp, Homo sapiens
ccttccccagctcccccaggca

SEQ ID NO: 4333419 - DNA, 19 bp, Homo sapiens
ccttccccctttctctgcc

SEQ ID NO: 4333420 - DNA, 20 bp, Homo sapiens
ccttccccctttctctgcct

SEQ ID NO: 4333421 - DNA, 17 bp, Homo sapiens
ccttcctccctgtctct

SEQ ID NO: 4333422 - DNA, 17 bp, Homo sapiens
ccttcctcctctcctgg

SEQ ID NO: 4333423 - DNA, 12 bp, Homo sapiens
ccttcctcctta

SEQ ID NO: 4333424 - DNA, 17 bp, Homo sapiens
ccttcctgtccccaggg

SEQ ID NO: 4333425 - DNA, 17 bp, Homo sapiens
ccttctaccccacctga

SEQ ID NO: 4333426 - DNA, 13 bp, Homo sapiens
ccttctcccaggc

SEQ ID NO: 4333427 - DNA, 13 bp, Homo sapiens
ccttctccctagc

SEQ ID NO: 4333428 - DNA, 16 bp, Homo sapiens
ccttctccctagccct

SEQ ID NO: 4333429 - DNA, 17 bp, Homo sapiens
ccttgacttatggctcg

SEQ ID NO: 4333430 - DNA, 17 bp, Homo sapiens
ccttgatgttgtgttgt

SEQ ID NO: 4333431 - DNA, 16 bp, Homo sapiens
ccttgcaaactctata

SEQ ID NO: 4333432 - DNA, 18 bp, Homo sapiens
ccttgcaaactctataaa

SEQ ID NO: 4333433 - DNA, 13 bp, Homo sapiens
ccttgcacctgag

SEQ ID NO: 4333434 - DNA, 20 bp, Homo sapiens
ccttgcacctgagcctgttc

SEQ ID NO: 4333435 - DNA, 23 bp, Homo sapiens
ccttgcacctgagcctgttccca

SEQ ID NO: 4333436 - DNA, 16 bp, Homo sapiens
ccttggagctgccgtg

SEQ ID NO: 4333437 - DNA, 22 bp, Homo sapiens
ccttggagctgccgtgcctgtg

SEQ ID NO: 4333438 - DNA, 16 bp, Homo sapiens
ccttggatcagaggtc

SEQ ID NO: 4333439 - DNA, 19 bp, Homo sapiens
ccttggggtggtgctgggt

SEQ ID NO: 4333440 - DNA, 21 bp, Homo sapiens
cctttaggatgttttcctcct

SEQ ID NO: 4333441 - DNA, 19 bp, Homo sapiens
cctttcccccaccccagag

SEQ ID NO: 4333442 - DNA, 15 bp, Homo sapiens
cctttctctgcctgg

SEQ ID NO: 4333443 - DNA, 20 bp, Homo sapiens
cctttcttgcactgtccagc

SEQ ID NO: 4333444 - DNA, 16 bp, Homo sapiens
cctttcttttttttct

SEQ ID NO: 4333445 - DNA, 17 bp, Homo sapiens
cctttgaaacctgctct

SEQ ID NO: 4333446 - DNA, 14 bp, Homo sapiens
cctttgaagaattg

SEQ ID NO: 4333447 - DNA, 22 bp, Homo sapiens
cctttgtggttttatggagacc

SEQ ID NO: 4333448 - DNA, 14 bp, Homo sapiens
cctttgtttcttgt

SEQ ID NO: 4333449 - DNA, 18 bp, Homo sapiens
cgaaaacgttgacccctt

SEQ ID NO: 4333450 - DNA, 19 bp, Homo sapiens
cgaaacccggtgcatctgg

SEQ ID NO: 4333451 - DNA, 21 bp, Homo sapiens
cgaactggttgtagtgggaag

SEQ ID NO: 4333452 - DNA, 20 bp, Homo sapiens
cgaattgtgtggagaactca

SEQ ID NO: 4333453 - DNA, 23 bp, Homo sapiens
cgactttgtaccccccaacccct

SEQ ID NO: 4333454 - DNA, 21 bp, Homo sapiens
cgagctgtttatgtttttata

SEQ ID NO: 4333455 - DNA, 21 bp, Homo sapiens
cgaggaatgtgaagccagatc

SEQ ID NO: 4333456 - DNA, 12 bp, Homo sapiens
cgagtttgctaa

SEQ ID NO: 4333457 - DNA, 13 bp, Homo sapiens
cgatggaggccta

SEQ ID NO: 4333458 - DNA, 20 bp, Homo sapiens
cgcaagagggacagagcccg

SEQ ID NO: 4333459 - DNA, 22 bp, Homo sapiens
cgcaatgaaaagtcgttttcca

SEQ ID NO: 4333460 - DNA, 15 bp, Homo sapiens
cgcacttacctgctt

SEQ ID NO: 4333461 - DNA, 19 bp, Homo sapiens
cgcacttacctgcttgagc

SEQ ID NO: 4333462 - DNA, 22 bp, Homo sapiens
cgcagccacaccgctggctccg

SEQ ID NO: 4333463 - DNA, 16 bp, Homo sapiens
cgccaaggctggggga

SEQ ID NO: 4333464 - DNA, 15 bp, Homo sapiens
cgccaccattcctgg

SEQ ID NO: 4333465 - DNA, 15 bp, Homo sapiens
cgccaccctgtctca

SEQ ID NO: 4333466 - DNA, 22 bp, Homo sapiens
cgccaggggaaaatcagcctgc

SEQ ID NO: 4333467 - DNA, 17 bp, Homo sapiens
cgccatgctcctggccc

SEQ ID NO: 4333468 - DNA, 14 bp, Homo sapiens
cgccccctccctgc

SEQ ID NO: 4333469 - DNA, 13 bp, Homo sapiens
cgccccctgaaac

SEQ ID NO: 4333470 - DNA, 18 bp, Homo sapiens
cgccctccacccactagg

SEQ ID NO: 4333471 - DNA, 17 bp, Homo sapiens
cgccgcttttctcctct

SEQ ID NO: 4333472 - DNA, 20 bp, Homo sapiens
cgcctcccgccaccctgtct

SEQ ID NO: 4333473 - DNA, 15 bp, Homo sapiens
cgcctgttcccccgc

SEQ ID NO: 4333474 - DNA, 22 bp, Homo sapiens
cgcgctttcccctcctccctgg

SEQ ID NO: 4333475 - DNA, 13 bp, Homo sapiens
cgctcatctggct

SEQ ID NO: 4333476 - DNA, 15 bp, Homo sapiens
ctataaagaaacttt

SEQ ID NO: 4333477 - DNA, 11 bp, Homo sapiens
ctataaatgac

SEQ ID NO: 4333478 - DNA, 16 bp, Homo sapiens
ctataaatgactattg

SEQ ID NO: 4333479 - DNA, 18 bp, Homo sapiens
ctataagtgttcagtgtt

SEQ ID NO: 4333480 - DNA, 23 bp, Homo sapiens
ctataagtgttcagtgttgacat

SEQ ID NO: 4333481 - DNA, 19 bp, Homo sapiens
ctatagcagtgttctctct

SEQ ID NO: 4333482 - DNA, 14 bp, Homo sapiens
ctatagtgaagaat

SEQ ID NO: 4333483 - DNA, 13 bp, Homo sapiens
ctatattaaatga

SEQ ID NO: 4333484 - DNA, 14 bp, Homo sapiens
ctatattaaatgag

SEQ ID NO: 4333485 - DNA, 13 bp, Homo sapiens
ctatatttttaaa

SEQ ID NO: 4333486 - DNA, 18 bp, Homo sapiens
ctatcaaaaactgacttt

SEQ ID NO: 4333487 - DNA, 23 bp, Homo sapiens
ctatcaaaaactgactttattta

SEQ ID NO: 4333488 - DNA, 17 bp, Homo sapiens
ctatcagggaggaagat

SEQ ID NO: 4333489 - DNA, 14 bp, Homo sapiens
ctatccaaacatgt

SEQ ID NO: 4333490 - DNA, 18 bp, Homo sapiens
ctatccaaacatgtattt

SEQ ID NO: 4333491 - DNA, 19 bp, Homo sapiens
ctatccaaacatgtattta

SEQ ID NO: 4333492 - DNA, 17 bp, Homo sapiens
ctatctagcatttattt

SEQ ID NO: 4333493 - DNA, 19 bp, Homo sapiens
ctatctagcatttatttct

SEQ ID NO: 4333494 - DNA, 19 bp, Homo sapiens
ctatctatacctgcctttt

SEQ ID NO: 4333495 - DNA, 17 bp, Homo sapiens
ctatggagactttgctg

SEQ ID NO: 4333496 - DNA, 18 bp, Homo sapiens
ctatggagactttgctgt

SEQ ID NO: 4333497 - DNA, 13 bp, Homo sapiens
ctatgtgaaaaga

SEQ ID NO: 4333498 - DNA, 17 bp, Homo sapiens
ctatgtgcgaagcaaga

SEQ ID NO: 4333499 - DNA, 15 bp, Homo sapiens
ctattaaaatgtaac

SEQ ID NO: 4333500 - DNA, 14 bp, Homo sapiens
ctattaaaggaaaa

SEQ ID NO: 4333501 - DNA, 18 bp, Homo sapiens
ctattggcttactgaaag

SEQ ID NO: 4333502 - DNA, 16 bp, Homo sapiens
ctattgggccctagag

SEQ ID NO: 4333503 - DNA, 14 bp, Homo sapiens
ctatttacctccta

SEQ ID NO: 4333504 - DNA, 12 bp, Homo sapiens
ctattttctatt

SEQ ID NO: 4333505 - DNA, 14 bp, Homo sapiens
ctatttttctatga

SEQ ID NO: 4333506 - DNA, 15 bp, Homo sapiens
ctatttttgtaaact

SEQ ID NO: 4333507 - DNA, 13 bp, Homo sapiens
ctattttttaata

SEQ ID NO: 4333508 - DNA, 15 bp, Homo sapiens
ctattttttaataaa

SEQ ID NO: 4333509 - DNA, 17 bp, Homo sapiens
ctattttttttaaatca

SEQ ID NO: 4333510 - DNA, 17 bp, Homo sapiens
ctcaagtgtcacctcct

SEQ ID NO: 4333511 - DNA, 14 bp, Homo sapiens
ctcacaaagataag

SEQ ID NO: 4333512 - DNA, 20 bp, Homo sapiens
ctcacaggcagctctgagcc

SEQ ID NO: 4333513 - DNA, 15 bp, Homo sapiens
ctcacctctctctaa

SEQ ID NO: 4333514 - DNA, 19 bp, Homo sapiens
ctcactgccatgccagctt

SEQ ID NO: 4333515 - DNA, 23 bp, Homo sapiens
ctcagattggaatgttacatctg

SEQ ID NO: 4333516 - DNA, 20 bp, Homo sapiens
ctcagcaaaagatgcttctc

SEQ ID NO: 4333517 - DNA, 21 bp, Homo sapiens
ctcagcaaaagatgcttctca

SEQ ID NO: 4333518 - DNA, 12 bp, Homo sapiens
ctcagcagggct

SEQ ID NO: 4333519 - DNA, 13 bp, Homo sapiens
ctcagcagggctg

SEQ ID NO: 4333520 - DNA, 14 bp, Homo sapiens
ctcagcagggctgg

SEQ ID NO: 4333521 - DNA, 15 bp, Homo sapiens
ctcagccacagcctg

SEQ ID NO: 4333522 - DNA, 13 bp, Homo sapiens
ctcagcccagaag

SEQ ID NO: 4333523 - DNA, 12 bp, Homo sapiens
ctcagctccccc

SEQ ID NO: 4333524 - DNA, 14 bp, Homo sapiens
ctcagctccccctg

SEQ ID NO: 4333525 - DNA, 15 bp, Homo sapiens
ctcagctccccctgt

SEQ ID NO: 4333526 - DNA, 21 bp, Homo sapiens
ctcagctccctgaccccctgt

SEQ ID NO: 4333527 - DNA, 13 bp, Homo sapiens
ctcaggaggcgaa

SEQ ID NO: 4333528 - DNA, 18 bp, Homo sapiens
ctcaggaggcgaataaat

SEQ ID NO: 4333529 - DNA, 22 bp, Homo sapiens
ctcaggaggcgaataaatgttc

SEQ ID NO: 4333530 - DNA, 18 bp, Homo sapiens
ctcaggagtttgagacca

SEQ ID NO: 4333531 - DNA, 23 bp, Homo sapiens
ctcaggagtttgagaccaacctg

SEQ ID NO: 4333532 - DNA, 14 bp, Homo sapiens
ctcagggcctggtc

SEQ ID NO: 4333533 - DNA, 15 bp, Homo sapiens
ctcagtacctcccct

SEQ ID NO: 4333534 - DNA, 18 bp, Homo sapiens
ctcagttgttaacttcta

SEQ ID NO: 4333535 - DNA, 18 bp, Homo sapiens
ctcatacacagttaaata

SEQ ID NO: 4333536 - DNA, 18 bp, Homo sapiens
ctcatgcaaactgcttta

SEQ ID NO: 4333537 - DNA, 21 bp, Homo sapiens
ctcatgcaaactgctttattt

SEQ ID NO: 4333538 - DNA, 18 bp, Homo sapiens
ctcattaaactgattcca

SEQ ID NO: 4333539 - DNA, 13 bp, Homo sapiens
ctcattattttga

SEQ ID NO: 4333540 - DNA, 12 bp, Homo sapiens
ctcattcctgta

SEQ ID NO: 4333541 - DNA, 14 bp, Homo sapiens
ctccaaatcaagga

SEQ ID NO: 4333542 - DNA, 19 bp, Homo sapiens
ctccaattctgaaatactt

SEQ ID NO: 4333543 - DNA, 20 bp, Homo sapiens
ctccaattctgaaatacttt

SEQ ID NO: 4333544 - DNA, 18 bp, Homo sapiens
ctccagctgttcagctgg

SEQ ID NO: 4333545 - DNA, 22 bp, Homo sapiens
ctccagtgctgtccatgcttct

SEQ ID NO: 4333546 - DNA, 18 bp, Homo sapiens
ctcccaaggctgcgtctg

SEQ ID NO: 4333547 - DNA, 22 bp, Homo sapiens
ctcccaaggctgcgtctggagg

SEQ ID NO: 4333548 - DNA, 15 bp, Homo sapiens
ctcccacaaaggaga

SEQ ID NO: 4333549 - DNA, 23 bp, Homo sapiens
ctcccacctatccgccctgcagc

SEQ ID NO: 4333550 - DNA, 14 bp, Homo sapiens
ctcccactgagttt

SEQ ID NO: 4333551 - DNA, 14 bp, Homo sapiens
ctcccagatcctgg

SEQ ID NO: 4333552 - DNA, 17 bp, Homo sapiens
ctcccagctctctctcc

SEQ ID NO: 4333553 - DNA, 20 bp, Homo sapiens
ctcccagctctctctcctgg

SEQ ID NO: 4333554 - DNA, 19 bp, Homo sapiens
ctcccataggctgtgttta

SEQ ID NO: 4333555 - DNA, 22 bp, Homo sapiens
ctccccacgggaaactcaagga

SEQ ID NO: 4333556 - DNA, 11 bp, Homo sapiens
ctccccagaat

SEQ ID NO: 4333557 - DNA, 19 bp, Homo sapiens
ctccccagttggcccttct

SEQ ID NO: 4333558 - DNA, 14 bp, Homo sapiens
ctccccattcctac

SEQ ID NO: 4333559 - DNA, 14 bp, Homo sapiens
ctcccccagagccc

SEQ ID NO: 4333560 - DNA, 13 bp, Homo sapiens
ctccccctgtccc

SEQ ID NO: 4333561 - DNA, 14 bp, Homo sapiens
ctccccgcctgttc

SEQ ID NO: 4333562 - DNA, 18 bp, Homo sapiens
ctccccgcctgttccccc

SEQ ID NO: 4333563 - DNA, 20 bp, Homo sapiens
ctccctagcccttctacccc

SEQ ID NO: 4333564 - DNA, 23 bp, Homo sapiens
ctccctagcccttctaccccacc

SEQ ID NO: 4333565 - DNA, 18 bp, Homo sapiens
ctccctcccccagagccc

SEQ ID NO: 4333566 - DNA, 19 bp, Homo sapiens
ctccctcccccagagcccc

SEQ ID NO: 4333567 - DNA, 15 bp, Homo sapiens
ctccctgaccccctg

SEQ ID NO: 4333568 - DNA, 17 bp, Homo sapiens
ctccctggcaaggagaa

SEQ ID NO: 4333569 - DNA, 15 bp, Homo sapiens
ctccctgtctctgca

SEQ ID NO: 4333570 - DNA, 23 bp, Homo sapiens
ctccctgtttgaagcctgccctt

SEQ ID NO: 4333571 - DNA, 21 bp, Homo sapiens
ctcccttgctttttgctgtgt

SEQ ID NO: 4333572 - DNA, 19 bp, Homo sapiens
ctcctagagaggagaaagg

SEQ ID NO: 4333573 - DNA, 22 bp, Homo sapiens
ctcctccagccgccatgctcct

SEQ ID NO: 4333574 - DNA, 12 bp, Homo sapiens
ctcctctcctgg

SEQ ID NO: 4333575 - DNA, 13 bp, Homo sapiens
ctcctctcctgga

SEQ ID NO: 4333576 - DNA, 15 bp, Homo sapiens
ctcctctttcctctc

SEQ ID NO: 4333577 - DNA, 14 bp, Homo sapiens
ctcctgcactgttt

SEQ ID NO: 4333578 - DNA, 14 bp, Homo sapiens
ctcctgcccagtcc

SEQ ID NO: 4333579 - DNA, 17 bp, Homo sapiens
ctcctgcccagtccccc

SEQ ID NO: 4333580 - DNA, 22 bp, Homo sapiens
ctcctggaaacagacagggaga

SEQ ID NO: 4333581 - DNA, 17 bp, Homo sapiens
ctcctggagtctgaagc

SEQ ID NO: 4333582 - DNA, 16 bp, Homo sapiens
ctcctggcccactgca

SEQ ID NO: 4333583 - DNA, 19 bp, Homo sapiens
ctcctggcccactgcatcg

SEQ ID NO: 4333584 - DNA, 21 bp, Homo sapiens
ctcctgggcatgtttgtctgt

SEQ ID NO: 4333585 - DNA, 23 bp, Homo sapiens
ctcctgggcatgtttgtctgtgt

SEQ ID NO: 4333586 - DNA, 14 bp, Homo sapiens
ctcctgtccccggc

SEQ ID NO: 4333587 - DNA, 13 bp, Homo sapiens
ctccttccccagc

SEQ ID NO: 4333588 - DNA, 14 bp, Homo sapiens
ctccttccccagct

SEQ ID NO: 4333589 - DNA, 18 bp, Homo sapiens
ctccttccccagctcccc

SEQ ID NO: 4333590 - DNA, 19 bp, Homo sapiens
ctcctttgaaacctgctct

SEQ ID NO: 4333591 - DNA, 15 bp, Homo sapiens
ctccttttatgtgta

SEQ ID NO: 4333592 - DNA, 14 bp, Homo sapiens
ctcgacgtcccttg

SEQ ID NO: 4333593 - DNA, 15 bp, Homo sapiens
ctcgacgtcccttgg

SEQ ID NO: 4333594 - DNA, 17 bp, Homo sapiens
ctcgacgtcccttggat

SEQ ID NO: 4333595 - DNA, 21 bp, Homo sapiens
ctcgatccaaattgtgcttct

SEQ ID NO: 4333596 - DNA, 13 bp, Homo sapiens
ctcgcaactgaag

SEQ ID NO: 4333597 - DNA, 17 bp, Homo sapiens
ctcggctgtctcctgtc

SEQ ID NO: 4333598 - DNA, 14 bp, Homo sapiens
cgctcggaggcccc

SEQ ID NO: 4333599 - DNA, 15 bp, Homo sapiens
cgctcggaggcccca

SEQ ID NO: 4333600 - DNA, 16 bp, Homo sapiens
cgctcggaggccccaa

SEQ ID NO: 4333601 - DNA, 19 bp, Homo sapiens
cgctcggaggccccaaagg

SEQ ID NO: 4333602 - DNA, 23 bp, Homo sapiens
cgctcgtgtgttctatccaaaca

SEQ ID NO: 4333603 - DNA, 13 bp, Homo sapiens
cgctctcttttct

SEQ ID NO: 4333604 - DNA, 13 bp, Homo sapiens
cgctgcccctgag

SEQ ID NO: 4333605 - DNA, 21 bp, Homo sapiens
cgctgttgatcccctctctgt

SEQ ID NO: 4333606 - DNA, 22 bp, Homo sapiens
cgctgttgatcccctctctgtg

SEQ ID NO: 4333607 - DNA, 15 bp, Homo sapiens
cgcttgcttctgcag

SEQ ID NO: 4333608 - DNA, 17 bp, Homo sapiens
cgcttgcttctgcagca

SEQ ID NO: 4333609 - DNA, 21 bp, Homo sapiens
cgcttgcttctgcagcaactc

SEQ ID NO: 4333610 - DNA, 22 bp, Homo sapiens
cgcttgcttctgcagcaactcc

SEQ ID NO: 4333611 - DNA, 20 bp, Homo sapiens
cgcttgggaggggccggagg

SEQ ID NO: 4333612 - DNA, 16 bp, Homo sapiens
cgctttcccctcctcc

SEQ ID NO: 4333613 - DNA, 13 bp, Homo sapiens
cggaaacatagaa

SEQ ID NO: 4333614 - DNA, 18 bp, Homo sapiens
cggacaaagttcagtgtc

SEQ ID NO: 4333615 - DNA, 13 bp, Homo sapiens
cggacactcgcct

SEQ ID NO: 4333616 - DNA, 14 bp, Homo sapiens
cggagctcctggca

SEQ ID NO: 4333617 - DNA, 14 bp, Homo sapiens
cggaggccccaaag

SEQ ID NO: 4333618 - DNA, 18 bp, Homo sapiens
cggaggccccaaaggaaa

SEQ ID NO: 4333619 - DNA, 15 bp, Homo sapiens
cggctgccgggcggg

SEQ ID NO: 4333620 - DNA, 12 bp, Homo sapiens
cggctgtctcct

SEQ ID NO: 4333621 - DNA, 15 bp, Homo sapiens
cggctgtctcctgtc

SEQ ID NO: 4333622 - DNA, 18 bp, Homo sapiens
cggcttcttggaccttgg

SEQ ID NO: 4333623 - DNA, 22 bp, Homo sapiens
cgggactgggggcgggactggg

SEQ ID NO: 4333624 - DNA, 17 bp, Homo sapiens
cgggactgggggcgggg

SEQ ID NO: 4333625 - DNA, 22 bp, Homo sapiens
cgggagactgccagtggagacg

SEQ ID NO: 4333626 - DNA, 18 bp, Homo sapiens
cgggaggtcgaggcagga

SEQ ID NO: 4333627 - DNA, 11 bp, Homo sapiens
cgggctcagca

SEQ ID NO: 4333628 - DNA, 19 bp, Homo sapiens
cgggctcagcaaaagatgc

SEQ ID NO: 4333629 - DNA, 13 bp, Homo sapiens
cggggccgcagcc

SEQ ID NO: 4333630 - DNA, 18 bp, Homo sapiens
cgggtctgccatgctctg

SEQ ID NO: 4333631 - DNA, 20 bp, Homo sapiens
cggtgcatctggcacgtggc

SEQ ID NO: 4333632 - DNA, 18 bp, Homo sapiens
cgtaagaccaccttccct

SEQ ID NO: 4333633 - DNA, 17 bp, Homo sapiens
cgtacccagccatgtgt

SEQ ID NO: 4333634 - DNA, 17 bp, Homo sapiens
cgtaggggaggggttgc

SEQ ID NO: 4333635 - DNA, 14 bp, Homo sapiens
cgtataatgctttc

SEQ ID NO: 4333636 - DNA, 22 bp, Homo sapiens
cgtatttagactgtggccatat

SEQ ID NO: 4333637 - DNA, 21 bp, Homo sapiens
cgtcccagaggccgctgcccc

SEQ ID NO: 4333638 - DNA, 19 bp, Homo sapiens
cgtcccccgttgtgcctgg

SEQ ID NO: 4333639 - DNA, 17 bp, Homo sapiens
cgtcgtacccagccatg

SEQ ID NO: 4333640 - DNA, 24 bp, Homo sapiens
cgtctggaggggcccctgcttctc

SEQ ID NO: 4333641 - DNA, 17 bp, Homo sapiens
cgtgcatttaaactctg

SEQ ID NO: 4333642 - DNA, 14 bp, Homo sapiens
cgtgccattgtctt

SEQ ID NO: 4333643 - DNA, 17 bp, Homo sapiens
cgtgccattgtctttcc

SEQ ID NO: 4333644 - DNA, 18 bp, Homo sapiens
cgtgccattgtctttcct

SEQ ID NO: 4333645 - DNA, 21 bp, Homo sapiens
cgtgccattgtctttcctccc

SEQ ID NO: 4333646 - DNA, 23 bp, Homo sapiens
cgtgtccaagggccgtgcccttg

SEQ ID NO: 4333647 - DNA, 13 bp, Homo sapiens
cgtgtgtgcatgt

SEQ ID NO: 4333648 - DNA, 16 bp, Homo sapiens
cgttagaccgctctct

SEQ ID NO: 4333649 - DNA, 16 bp, Homo sapiens
cgttcttacaagctta

SEQ ID NO: 4333650 - DNA, 17 bp, Homo sapiens
cgttgacccctttcccc

SEQ ID NO: 4333651 - DNA, 13 bp, Homo sapiens
cgttgttgtcatt

SEQ ID NO: 4333652 - DNA, 19 bp, Homo sapiens
cgtttggttaaagtatgtc

SEQ ID NO: 4333653 - DNA, 19 bp, Homo sapiens
ctaaaagtggcatagagaa

SEQ ID NO: 4333654 - DNA, 20 bp, Homo sapiens
ctaaaagtggcatagagaat

SEQ ID NO: 4333655 - DNA, 22 bp, Homo sapiens
ctaaaagttaagtgtcatttct

SEQ ID NO: 4333656 - DNA, 23 bp, Homo sapiens
ctaaaagttaagtgtcatttctt

SEQ ID NO: 4333657 - DNA, 17 bp, Homo sapiens
ctaaagcagtaaaataa

SEQ ID NO: 4333658 - DNA, 18 bp, Homo sapiens
ctaaagggagaaatgcca

SEQ ID NO: 4333659 - DNA, 17 bp, Homo sapiens
ctaaagttgaaaataca

SEQ ID NO: 4333660 - DNA, 22 bp, Homo sapiens
ctaaattataaaattgaaaaca

SEQ ID NO: 4333661 - DNA, 21 bp, Homo sapiens
ctaacctcgctcgatgactgt

SEQ ID NO: 4333662 - DNA, 14 bp, Homo sapiens
ctaactgggaagaa

SEQ ID NO: 4333663 - DNA, 15 bp, Homo sapiens
ctaactgggaagaac

SEQ ID NO: 4333664 - DNA, 12 bp, Homo sapiens
ctaagaaaagag

SEQ ID NO: 4333665 - DNA, 20 bp, Homo sapiens
ctaagaaatgggactctgaa

SEQ ID NO: 4333666 - DNA, 13 bp, Homo sapiens
ctaatatactttt

SEQ ID NO: 4333667 - DNA, 17 bp, Homo sapiens
ctaatatccccaaatta

SEQ ID NO: 4333668 - DNA, 11 bp, Homo sapiens
ctaatctgcct

SEQ ID NO: 4333669 - DNA, 19 bp, Homo sapiens
ctaatctgcctggttttat

SEQ ID NO: 4333670 - DNA, 12 bp, Homo sapiens
ctaatgctggcc

SEQ ID NO: 4333671 - DNA, 13 bp, Homo sapiens
ctaatgctggcct

SEQ ID NO: 4333672 - DNA, 19 bp, Homo sapiens
ctaatggagtgtttgaaaa

SEQ ID NO: 4333673 - DNA, 21 bp, Homo sapiens
ctaatggagtgtttgaaaact

SEQ ID NO: 4333674 - DNA, 22 bp, Homo sapiens
ctaatggagtgtttgaaaactg

SEQ ID NO: 4333675 - DNA, 12 bp, Homo sapiens
ctaatggcatgg

SEQ ID NO: 4333676 - DNA, 18 bp, Homo sapiens
ctaatggcatggagactc

SEQ ID NO: 4333677 - DNA, 14 bp, Homo sapiens
ctaattccttaaat

SEQ ID NO: 4333678 - DNA, 16 bp, Homo sapiens
ctaattccttaaatga

SEQ ID NO: 4333679 - DNA, 20 bp, Homo sapiens
ctaattccttaaatgaacta

SEQ ID NO: 4333680 - DNA, 13 bp, Homo sapiens
ctacagttgaaaa

SEQ ID NO: 4333681 - DNA, 22 bp, Homo sapiens
ctacattaccctaatggctgct

SEQ ID NO: 4333682 - DNA, 16 bp, Homo sapiens
ctaccccacctgacct

SEQ ID NO: 4333683 - DNA, 17 bp, Homo sapiens
ctacccgcatcttctgt

SEQ ID NO: 4333684 - DNA, 17 bp, Homo sapiens
ctaccctcctgcactgt

SEQ ID NO: 4333685 - DNA, 19 bp, Homo sapiens
ctaccctcctgcactgttt

SEQ ID NO: 4333686 - DNA, 16 bp, Homo sapiens
ctacctgcacctctgg

SEQ ID NO: 4333687 - DNA, 17 bp, Homo sapiens
ctacctgcacctctgga

SEQ ID NO: 4333688 - DNA, 19 bp, Homo sapiens
ctacctttttatatttaaa

SEQ ID NO: 4333689 - DNA, 21 bp, Homo sapiens
ctactgaagggaacagcctga

SEQ ID NO: 4333690 - DNA, 14 bp, Homo sapiens
ctactgggtgtcat

SEQ ID NO: 4333691 - DNA, 21 bp, Homo sapiens
ctactttgtatagctaagtga

SEQ ID NO: 4333692 - DNA, 11 bp, Homo sapiens
ctactttttgt

SEQ ID NO: 4333693 - DNA, 18 bp, Homo sapiens
ctactttttgtatttagt

SEQ ID NO: 4333694 - DNA, 16 bp, Homo sapiens
ctagaaacagatcttg

SEQ ID NO: 4333695 - DNA, 14 bp, Homo sapiens
ctagactgtgtctg

SEQ ID NO: 4333696 - DNA, 16 bp, Homo sapiens
ctagactgtgtctgaa

SEQ ID NO: 4333697 - DNA, 16 bp, Homo sapiens
ctagagaatgcacaga

SEQ ID NO: 4333698 - DNA, 13 bp, Homo sapiens
ctagagaggagaa

SEQ ID NO: 4333699 - DNA, 14 bp, Homo sapiens
ctagagaggagaaa

SEQ ID NO: 4333700 - DNA, 17 bp, Homo sapiens
ctagagtgaacttgggc

SEQ ID NO: 4333701 - DNA, 21 bp, Homo sapiens
ctagagtgaacttgggccact

SEQ ID NO: 4333702 - DNA, 17 bp, Homo sapiens
ctagcatttagagcttt

SEQ ID NO: 4333703 - DNA, 16 bp, Homo sapiens
ctagcatttatttctc

SEQ ID NO: 4333704 - DNA, 17 bp, Homo sapiens
ctagcccactccccagt

SEQ ID NO: 4333705 - DNA, 19 bp, Homo sapiens
ctagccccacccagaggtg

SEQ ID NO: 4333706 - DNA, 22 bp, Homo sapiens
ctagccccacccagaggtggcc

SEQ ID NO: 4333707 - DNA, 20 bp, Homo sapiens
ctagcccttctaccccacct

SEQ ID NO: 4333708 - DNA, 23 bp, Homo sapiens
ctagcccttctaccccacctgac

SEQ ID NO: 4333709 - DNA, 20 bp, Homo sapiens
ctaggagaagagttgaggaa

SEQ ID NO: 4333710 - DNA, 13 bp, Homo sapiens
ctaggagactggt

SEQ ID NO: 4333711 - DNA, 19 bp, Homo sapiens
ctagggaaaaaccagcgtg

SEQ ID NO: 4333712 - DNA, 12 bp, Homo sapiens
ctaggggaggag

SEQ ID NO: 4333713 - DNA, 15 bp, Homo sapiens
ctaggggaggagaga

SEQ ID NO: 4333714 - DNA, 23 bp, Homo sapiens
ctaggtcatgaaggacactctgc

SEQ ID NO: 4333715 - DNA, 22 bp, Homo sapiens
ctagtaagtaattatgcactaa

SEQ ID NO: 4333716 - DNA, 18 bp, Homo sapiens
ctagtcaactggggaaaa

SEQ ID NO: 4333717 - DNA, 21 bp, Homo sapiens
ctagtcaactggggaaaagga

SEQ ID NO: 4333718 - DNA, 17 bp, Homo sapiens
ctcggcttcttggacct

SEQ ID NO: 4333719 - DNA, 19 bp, Homo sapiens
ctcggcttcttggaccttg

SEQ ID NO: 4333720 - DNA, 23 bp, Homo sapiens
ctcggtgtggagaagcggctggc

SEQ ID NO: 4333721 - DNA, 14 bp, Homo sapiens
ctctaaaaatagaa

SEQ ID NO: 4333722 - DNA, 21 bp, Homo sapiens
ctctaacagctccatacttct

SEQ ID NO: 4333723 - DNA, 12 bp, Homo sapiens
ctctaagaaaag

SEQ ID NO: 4333724 - DNA, 23 bp, Homo sapiens
ctctagggaaaaaccagcgtgtg

SEQ ID NO: 4333725 - DNA, 23 bp, Homo sapiens
ctctataaagaaacttttgaaaa

SEQ ID NO: 4333726 - DNA, 19 bp, Homo sapiens
ctctataagtgttcagtgt

SEQ ID NO: 4333727 - DNA, 22 bp, Homo sapiens
ctctataagtgttcagtgttga

SEQ ID NO: 4333728 - DNA, 23 bp, Homo sapiens
ctctataagtgttcagtgttgac

SEQ ID NO: 4333729 - DNA, 13 bp, Homo sapiens
ctctcagcccaga

SEQ ID NO: 4333730 - DNA, 20 bp, Homo sapiens
ctctccttttccttaccata

SEQ ID NO: 4333731 - DNA, 16 bp, Homo sapiens
ctctctaagtttagaa

SEQ ID NO: 4333732 - DNA, 13 bp, Homo sapiens
ctctctcctccct

SEQ ID NO: 4333733 - DNA, 13 bp, Homo sapiens
ctctctcctggag

SEQ ID NO: 4333734 - DNA, 15 bp, Homo sapiens
ctctctctctttttc

SEQ ID NO: 4333735 - DNA, 14 bp, Homo sapiens
ctctctctttttct

SEQ ID NO: 4333736 - DNA, 18 bp, Homo sapiens
ctctctctttttcttttc

SEQ ID NO: 4333737 - DNA, 17 bp, Homo sapiens
ctctctgtggctccaac

SEQ ID NO: 4333738 - DNA, 18 bp, Homo sapiens
ctctctttgttctcagct

SEQ ID NO: 4333739 - DNA, 20 bp, Homo sapiens
ctctctttgttctcagctcc

SEQ ID NO: 4333740 - DNA, 21 bp, Homo sapiens
ctctctttgttctcagctccc

SEQ ID NO: 4333741 - DNA, 17 bp, Homo sapiens
ctctcttttctgtactt

SEQ ID NO: 4333742 - DNA, 21 bp, Homo sapiens
ctctctttttcttttctatgg

SEQ ID NO: 4333743 - DNA, 13 bp, Homo sapiens
ctctgcaagaggg

SEQ ID NO: 4333744 - DNA, 14 bp, Homo sapiens
ctctgcacaagctg

SEQ ID NO: 4333745 - DNA, 15 bp, Homo sapiens
ctctgcacaagctgc

SEQ ID NO: 4333746 - DNA, 18 bp, Homo sapiens
ctctgcacaagctgcacc

SEQ ID NO: 4333747 - DNA, 12 bp, Homo sapiens
ctctgccaaagc

SEQ ID NO: 4333748 - DNA, 11 bp, Homo sapiens
ctctgccactc

SEQ ID NO: 4333749 - DNA, 13 bp, Homo sapiens
ctctgcctggcaa

SEQ ID NO: 4333750 - DNA, 13 bp, Homo sapiens
ctctgggatctgc

SEQ ID NO: 4333751 - DNA, 15 bp, Homo sapiens
ctctgggatctgcca

SEQ ID NO: 4333752 - DNA, 21 bp, Homo sapiens
ctctggggaagatggagcagg

SEQ ID NO: 4333753 - DNA, 15 bp, Homo sapiens
ctctgtcaatgaaaa

SEQ ID NO: 4333754 - DNA, 16 bp, Homo sapiens
ctctgtggccaggagc

SEQ ID NO: 4333755 - DNA, 22 bp, Homo sapiens
ctctgtggccaggagccctggc

SEQ ID NO: 4333756 - DNA, 15 bp, Homo sapiens
ctctgtggctccaac

SEQ ID NO: 4333757 - DNA, 14 bp, Homo sapiens
ctctgtgtctggca

SEQ ID NO: 4333758 - DNA, 17 bp, Homo sapiens
ctctgtgtctggcaggc

SEQ ID NO: 4333759 - DNA, 21 bp, Homo sapiens
ctctgtgtgagcgtgtccaca

SEQ ID NO: 4333760 - DNA, 13 bp, Homo sapiens
ctctgttttgtaa

SEQ ID NO: 4333761 - DNA, 13 bp, Homo sapiens
ctcttaaatcatt

SEQ ID NO: 4333762 - DNA, 15 bp, Homo sapiens
ctcttcagactctca

SEQ ID NO: 4333763 - DNA, 15 bp, Homo sapiens
ctcttgagcctggga

SEQ ID NO: 4333764 - DNA, 12 bp, Homo sapiens
ctctttgccctg

SEQ ID NO: 4333765 - DNA, 19 bp, Homo sapiens
ctctttgccctgaggctca

SEQ ID NO: 4333766 - DNA, 15 bp, Homo sapiens
ctctttggacactca

SEQ ID NO: 4333767 - DNA, 14 bp, Homo sapiens
ctctttgtgcagtg

SEQ ID NO: 4333768 - DNA, 19 bp, Homo sapiens
ctctttgttctcagctccc

SEQ ID NO: 4333769 - DNA, 17 bp, Homo sapiens
ctcttttttgtttgttt

SEQ ID NO: 4333770 - DNA, 20 bp, Homo sapiens
ctcttttttgtttgtttctt

SEQ ID NO: 4333771 - DNA, 21 bp, Homo sapiens
ctgaaacgagaagtgccctta

SEQ ID NO: 4333772 - DNA, 15 bp, Homo sapiens
ctgaaagccctgagc

SEQ ID NO: 4333773 - DNA, 15 bp, Homo sapiens
ctgaaccaatagaaa

SEQ ID NO: 4333774 - DNA, 19 bp, Homo sapiens
ctgaactggagctgctaag

SEQ ID NO: 4333775 - DNA, 12 bp, Homo sapiens
ctgaagaaatta

SEQ ID NO: 4333776 - DNA, 19 bp, Homo sapiens
ctgaagtacagtcccagca

SEQ ID NO: 4333777 - DNA, 22 bp, Homo sapiens
ctgaagtacagtcccagcacat

SEQ ID NO: 4333778 - DNA, 16 bp, Homo sapiens
ctgaagtcaaacctta

SEQ ID NO: 4333779 - DNA, 16 bp, Homo sapiens
ctgaataaaaaataaa

SEQ ID NO: 4333780 - DNA, 16 bp, Homo sapiens
ctgaatcatgtctgta

SEQ ID NO: 4333781 - DNA, 16 bp, Homo sapiens
ctgaatccatatttca

SEQ ID NO: 4333782 - DNA, 13 bp, Homo sapiens
ctgaattgagaaa

SEQ ID NO: 4333783 - DNA, 12 bp, Homo sapiens
ctgacactgtgt

SEQ ID NO: 4333784 - DNA, 22 bp, Homo sapiens
ctgactctcttttgaggtccct

SEQ ID NO: 4333785 - DNA, 21 bp, Homo sapiens
ctgactggattcattctcata

SEQ ID NO: 4333786 - DNA, 17 bp, Homo sapiens
ctgactggttgtcagaa

SEQ ID NO: 4333787 - DNA, 21 bp, Homo sapiens
ctgactggttgtcagaatgga

SEQ ID NO: 4333788 - DNA, 18 bp, Homo sapiens
ctgactgttttctcttga

SEQ ID NO: 4333789 - DNA, 20 bp, Homo sapiens
ctgagacttcgaagacccag

SEQ ID NO: 4333790 - DNA, 20 bp, Homo sapiens
ctgagaggttagaatgatca

SEQ ID NO: 4333791 - DNA, 21 bp, Homo sapiens
ctgagatcaaaacggttttac

SEQ ID NO: 4333792 - DNA, 16 bp, Homo sapiens
ctgagccccagcccca

SEQ ID NO: 4333793 - DNA, 14 bp, Homo sapiens
ctgagctgaagaaa

SEQ ID NO: 4333794 - DNA, 18 bp, Homo sapiens
ctgaggaagatgggggca

SEQ ID NO: 4333795 - DNA, 19 bp, Homo sapiens
ctgaggctctctaagaaaa

SEQ ID NO: 4333796 - DNA, 22 bp, Homo sapiens
ctgaggctctctaagaaaagag

SEQ ID NO: 4333797 - DNA, 13 bp, Homo sapiens
ctgagggcaaatc

SEQ ID NO: 4333798 - DNA, 24 bp, Homo sapiens
ctgaggttagcccaatggagaaat

SEQ ID NO: 4333799 - DNA, 18 bp, Homo sapiens
ctgagtatagtatttaac

SEQ ID NO: 4333800 - DNA, 15 bp, Homo sapiens
ctgagtctcccaagg

SEQ ID NO: 4333801 - DNA, 16 bp, Homo sapiens
ctgagtctcccaaggc

SEQ ID NO: 4333802 - DNA, 20 bp, Homo sapiens
ctgagtgctatgtgtgctta

SEQ ID NO: 4333803 - DNA, 22 bp, Homo sapiens
ctgagtgctatgtgtgcttata

SEQ ID NO: 4333804 - DNA, 14 bp, Homo sapiens
ctgagtgtatttta

SEQ ID NO: 4333805 - DNA, 19 bp, Homo sapiens
ctgatatgctgagaaatta

SEQ ID NO: 4333806 - DNA, 14 bp, Homo sapiens
ctgatctgtacttt

SEQ ID NO: 4333807 - DNA, 18 bp, Homo sapiens
ctgatctgtactttgtgt

SEQ ID NO: 4333808 - DNA, 21 bp, Homo sapiens
ctgatgcccaccgaggagccc

SEQ ID NO: 4333809 - DNA, 15 bp, Homo sapiens
ctgatggtttggaaa

SEQ ID NO: 4333810 - DNA, 21 bp, Homo sapiens
ctgatttagaagcaaagattt

SEQ ID NO: 4333811 - DNA, 14 bp, Homo sapiens
ctgatttccctttt

SEQ ID NO: 4333812 - DNA, 21 bp, Homo sapiens
ctgcaaacccatgaagctggc

SEQ ID NO: 4333813 - DNA, 14 bp, Homo sapiens
ctgcaaataaagcc

SEQ ID NO: 4333814 - DNA, 17 bp, Homo sapiens
ctgcaaataaagccttt

SEQ ID NO: 4333815 - DNA, 18 bp, Homo sapiens
ctgcaagcatttttccat

SEQ ID NO: 4333816 - DNA, 20 bp, Homo sapiens
ctgcaagcatttttccatct

SEQ ID NO: 4333817 - DNA, 22 bp, Homo sapiens
ctgcaagtcattgagtgacttt

SEQ ID NO: 4333818 - DNA, 22 bp, Homo sapiens
ctgcacaagctgcaccctcagg

SEQ ID NO: 4333819 - DNA, 16 bp, Homo sapiens
ctgcaccctcaggcag

SEQ ID NO: 4333820 - DNA, 17 bp, Homo sapiens
ctgcaccctcaggcagg

SEQ ID NO: 4333821 - DNA, 15 bp, Homo sapiens
ctgcactccagcctg

SEQ ID NO: 4333822 - DNA, 20 bp, Homo sapiens
ctgcactccagcctgggtga

SEQ ID NO: 4333823 - DNA, 19 bp, Homo sapiens
ctgcagagactaatgttgg

SEQ ID NO: 4333824 - DNA, 16 bp, Homo sapiens
ctgcagcaactcccac

SEQ ID NO: 4333825 - DNA, 16 bp, Homo sapiens
ctgcaggtccggggag

SEQ ID NO: 4333826 - DNA, 13 bp, Homo sapiens
ctgcataaaattc

SEQ ID NO: 4333827 - DNA, 19 bp, Homo sapiens
ctgcattcattctgagccc

SEQ ID NO: 4333828 - DNA, 14 bp, Homo sapiens
ctgcattgagaagg

SEQ ID NO: 4333829 - DNA, 14 bp, Homo sapiens
ctgcattttacaca

SEQ ID NO: 4333830 - DNA, 19 bp, Homo sapiens
ctgccaaagcttgtggagg

SEQ ID NO: 4333831 - DNA, 22 bp, Homo sapiens
ctgccaaggccggagacccaca

SEQ ID NO: 4333832 - DNA, 23 bp, Homo sapiens
ctgccaaggccggagacccacag

SEQ ID NO: 4333833 - DNA, 13 bp, Homo sapiens
ctgccaggcatgg

SEQ ID NO: 4333834 - DNA, 19 bp, Homo sapiens
ctgccatgccagcttatct

SEQ ID NO: 4333835 - DNA, 15 bp, Homo sapiens
ctgccatgctctgga

SEQ ID NO: 4333836 - DNA, 17 bp, Homo sapiens
ctgccccagcccaagtc

SEQ ID NO: 4333837 - DNA, 21 bp, Homo sapiens
ctgcccctgagttctgacact

SEQ ID NO: 4333838 - DNA, 13 bp, Homo sapiens
ctgcccggcaggg

SEQ ID NO: 4333839 - DNA, 17 bp, Homo sapiens
cttggaaatgttaagaa

SEQ ID NO: 4333840 - DNA, 19 bp, Homo sapiens
cttggaaatgttaagaaag

SEQ ID NO: 4333841 - DNA, 21 bp, Homo sapiens
cttggacctatcaaaaactga

SEQ ID NO: 4333842 - DNA, 13 bp, Homo sapiens
cttggagctgccg

SEQ ID NO: 4333843 - DNA, 18 bp, Homo sapiens
cttggagtgccccaagga

SEQ ID NO: 4333844 - DNA, 14 bp, Homo sapiens
cttgggagggggca

SEQ ID NO: 4333845 - DNA, 23 bp, Homo sapiens
cttggggctcagccacagcctga

SEQ ID NO: 4333846 - DNA, 19 bp, Homo sapiens
cttgggtcctactcctgga

SEQ ID NO: 4333847 - DNA, 20 bp, Homo sapiens
cttgggtcctactcctggag

SEQ ID NO: 4333848 - DNA, 22 bp, Homo sapiens
cttgggtcctactcctggagca

SEQ ID NO: 4333849 - DNA, 17 bp, Homo sapiens
cttggtcaagtttttct

SEQ ID NO: 4333850 - DNA, 20 bp, Homo sapiens
cttggtcaagtttttctctc

SEQ ID NO: 4333851 - DNA, 12 bp, Homo sapiens
cttggtgttatc

SEQ ID NO: 4333852 - DNA, 19 bp, Homo sapiens
cttggttcatgcttctact

SEQ ID NO: 4333853 - DNA, 19 bp, Homo sapiens
cttgtcctttgaggcccca

SEQ ID NO: 4333854 - DNA, 21 bp, Homo sapiens
cttgtcctttgaggccccaac

SEQ ID NO: 4333855 - DNA, 15 bp, Homo sapiens
cttgtctattattga

SEQ ID NO: 4333856 - DNA, 13 bp, Homo sapiens
cttgtctgtagat

SEQ ID NO: 4333857 - DNA, 15 bp, Homo sapiens
cttgtgaatgcttct

SEQ ID NO: 4333858 - DNA, 19 bp, Homo sapiens
cttgtgaatgcttctcact

SEQ ID NO: 4333859 - DNA, 17 bp, Homo sapiens
cttgtgactcagtgtat

SEQ ID NO: 4333860 - DNA, 19 bp, Homo sapiens
cttgtgtgttttgagagta

SEQ ID NO: 4333861 - DNA, 17 bp, Homo sapiens
cttgttattaatgtttc

SEQ ID NO: 4333862 - DNA, 18 bp, Homo sapiens
cttgttattaatgtttct

SEQ ID NO: 4333863 - DNA, 20 bp, Homo sapiens
cttgttctgtgatgagggga

SEQ ID NO: 4333864 - DNA, 16 bp, Homo sapiens
ctttaaaaccagttac

SEQ ID NO: 4333865 - DNA, 21 bp, Homo sapiens
ctttaaagataagtctacatt

SEQ ID NO: 4333866 - DNA, 21 bp, Homo sapiens
ctttacaggtatttataatat

SEQ ID NO: 4333867 - DNA, 17 bp, Homo sapiens
ctttaggatgagcaaaa

SEQ ID NO: 4333868 - DNA, 15 bp, Homo sapiens
ctttatctttgtgta

SEQ ID NO: 4333869 - DNA, 24 bp, Homo sapiens
ctttatttattgcttagtgaaaat

SEQ ID NO: 4333870 - DNA, 13 bp, Homo sapiens
ctttcatctccca

SEQ ID NO: 4333871 - DNA, 23 bp, Homo sapiens
ctttcatgttactgttgcagctt

SEQ ID NO: 4333872 - DNA, 19 bp, Homo sapiens
ctttcccaggtaatttaaa

SEQ ID NO: 4333873 - DNA, 14 bp, Homo sapiens
ctttccccacacct

SEQ ID NO: 4333874 - DNA, 11 bp, Homo sapiens
ctttcccccac

SEQ ID NO: 4333875 - DNA, 13 bp, Homo sapiens
ctttcccccaccc

SEQ ID NO: 4333876 - DNA, 17 bp, Homo sapiens
ctttcctatctagcatt

SEQ ID NO: 4333877 - DNA, 19 bp, Homo sapiens
ctttcctcccttctttgct

SEQ ID NO: 4333878 - DNA, 17 bp, Homo sapiens
ctttccttagttaaaaa

SEQ ID NO: 4333879 - DNA, 23 bp, Homo sapiens
ctttctacaaagcactagagaat

SEQ ID NO: 4333880 - DNA, 16 bp, Homo sapiens
ctttctctgcctggca

SEQ ID NO: 4333881 - DNA, 23 bp, Homo sapiens
ctttctgagtgagttttactctt

SEQ ID NO: 4333882 - DNA, 14 bp, Homo sapiens
ctttctgtgcatgt

SEQ ID NO: 4333883 - DNA, 16 bp, Homo sapiens
ctttctgtgcatgtgc

SEQ ID NO: 4333884 - DNA, 20 bp, Homo sapiens
ctttctgtgcatgtgcaggt

SEQ ID NO: 4333885 - DNA, 19 bp, Homo sapiens
ctttcttttttttcttggt

SEQ ID NO: 4333886 - DNA, 11 bp, Homo sapiens
ctttgaagaat

SEQ ID NO: 4333887 - DNA, 11 bp, Homo sapiens
ctttgaagcca

SEQ ID NO: 4333888 - DNA, 21 bp, Homo sapiens
ctttgaggccccaactcaagt

SEQ ID NO: 4333889 - DNA, 13 bp, Homo sapiens
ctttgattctcct

SEQ ID NO: 4333890 - DNA, 14 bp, Homo sapiens
ctttgccctgaggc

SEQ ID NO: 4333891 - DNA, 15 bp, Homo sapiens
ctttgccctgaggct

SEQ ID NO: 4333892 - DNA, 21 bp, Homo sapiens
ctttgctgttactgcttctct

SEQ ID NO: 4333893 - DNA, 23 bp, Homo sapiens
ctttgctgttactgcttctcttt

SEQ ID NO: 4333894 - DNA, 15 bp, Homo sapiens
ctttgcttctttttc

SEQ ID NO: 4333895 - DNA, 23 bp, Homo sapiens
ctttgggaggccaaggtgggagg

SEQ ID NO: 4333896 - DNA, 24 bp, Homo sapiens
ctttgggccaatttactggccact

SEQ ID NO: 4333897 - DNA, 21 bp, Homo sapiens
ctttgtaccccccaacccctg

SEQ ID NO: 4333898 - DNA, 16 bp, Homo sapiens
ctttgtcaatgctcta

SEQ ID NO: 4333899 - DNA, 13 bp, Homo sapiens
ctttgtgtaatct

SEQ ID NO: 4333900 - DNA, 17 bp, Homo sapiens
ctttgtgtaatctaagt

SEQ ID NO: 4333901 - DNA, 14 bp, Homo sapiens
ctttgtgtttagct

SEQ ID NO: 4333902 - DNA, 14 bp, Homo sapiens
ctttgttctcagct

SEQ ID NO: 4333903 - DNA, 20 bp, Homo sapiens
ctttgttctcagctccccct

SEQ ID NO: 4333904 - DNA, 16 bp, Homo sapiens
ctttgttgaaaaatgt

SEQ ID NO: 4333905 - DNA, 15 bp, Homo sapiens
ctttgtttaaatgcc

SEQ ID NO: 4333906 - DNA, 12 bp, Homo sapiens
cttttaaatcat

SEQ ID NO: 4333907 - DNA, 13 bp, Homo sapiens
cttttaaatcatc

SEQ ID NO: 4333908 - DNA, 19 bp, Homo sapiens
cttttactggactgtctga

SEQ ID NO: 4333909 - DNA, 16 bp, Homo sapiens
cttttatgaaattaac

SEQ ID NO: 4333910 - DNA, 14 bp, Homo sapiens
cttttattttcatt

SEQ ID NO: 4333911 - DNA, 14 bp, Homo sapiens
cttttcatttcaga

SEQ ID NO: 4333912 - DNA, 18 bp, Homo sapiens
cttttcatttcagatttt

SEQ ID NO: 4333913 - DNA, 11 bp, Homo sapiens
cttttcccttc

SEQ ID NO: 4333914 - DNA, 14 bp, Homo sapiens
cttttcctttcttt

SEQ ID NO: 4333915 - DNA, 16 bp, Homo sapiens
cttttcctttgtggtt

SEQ ID NO: 4333916 - DNA, 18 bp, Homo sapiens
cttttcgcttgcttctgc

SEQ ID NO: 4333917 - DNA, 21 bp, Homo sapiens
cttttcgcttgcttctgcagc

SEQ ID NO: 4333918 - DNA, 18 bp, Homo sapiens
cttttctgtccgagcttt

SEQ ID NO: 4333919 - DNA, 19 bp, Homo sapiens
cttttgaaaaagtgtacat

SEQ ID NO: 4333920 - DNA, 20 bp, Homo sapiens
cttttgaaaaagtgtacatg

SEQ ID NO: 4333921 - DNA, 16 bp, Homo sapiens
cttttgaggtccctgt

SEQ ID NO: 4333922 - DNA, 17 bp, Homo sapiens
cttttggaaataattac

SEQ ID NO: 4333923 - DNA, 22 bp, Homo sapiens
ctttttcttaccctctctttca

SEQ ID NO: 4333924 - DNA, 18 bp, Homo sapiens
ctttttcttttctatgga

SEQ ID NO: 4333925 - DNA, 15 bp, Homo sapiens
ctttttggtaaatat

SEQ ID NO: 4333926 - DNA, 15 bp, Homo sapiens
cttttttgtttgttt

SEQ ID NO: 4333927 - DNA, 14 bp, Homo sapiens
cttttttttcttgg

SEQ ID NO: 4333928 - DNA, 18 bp, Homo sapiens
ctttttttttttgtttga

SEQ ID NO: 4333929 - DNA, 13 bp, Homo sapiens
gaaaaaaactaaa

SEQ ID NO: 4333930 - DNA, 20 bp, Homo sapiens
gaaaaaactttgctccaggc

SEQ ID NO: 4333931 - DNA, 21 bp, Homo sapiens
gaaaaacagaggatgctgaag

SEQ ID NO: 4333932 - DNA, 11 bp, Homo sapiens
gaaaaagaaaa

SEQ ID NO: 4333933 - DNA, 16 bp, Homo sapiens
gaaaaagcacaagaag

SEQ ID NO: 4333934 - DNA, 15 bp, Homo sapiens
gaaaaaggaggaaga

SEQ ID NO: 4333935 - DNA, 15 bp, Homo sapiens
gaaaaagtgtacatg

SEQ ID NO: 4333936 - DNA, 22 bp, Homo sapiens
gaaaacactaacaaaatttgaa

SEQ ID NO: 4333937 - DNA, 15 bp, Homo sapiens
gaaaaccagtgggtc

SEQ ID NO: 4333938 - DNA, 15 bp, Homo sapiens
gaaaacgttgacccc

SEQ ID NO: 4333939 - DNA, 17 bp, Homo sapiens
gaaaactcattactttt

SEQ ID NO: 4333940 - DNA, 13 bp, Homo sapiens
gaaaactgacatc

SEQ ID NO: 4333941 - DNA, 17 bp, Homo sapiens
gaaaagagtgagaacta

SEQ ID NO: 4333942 - DNA, 19 bp, Homo sapiens
gaaaaggatgatggaaaaa

SEQ ID NO: 4333943 - DNA, 23 bp, Homo sapiens
gaaaagtagacaatcattgtttt

SEQ ID NO: 4333944 - DNA, 14 bp, Homo sapiens
gaaaatcaatgctt

SEQ ID NO: 4333945 - DNA, 20 bp, Homo sapiens
gaaaatcagcctgctccagc

SEQ ID NO: 4333946 - DNA, 22 bp, Homo sapiens
gaaaatcagcctgctccagctg

SEQ ID NO: 4333947 - DNA, 17 bp, Homo sapiens
gaaaatcatattgagaa

SEQ ID NO: 4333948 - DNA, 12 bp, Homo sapiens
gaaaatgcattt

SEQ ID NO: 4333949 - DNA, 16 bp, Homo sapiens
gaaaatgcattttctt

SEQ ID NO: 4333950 - DNA, 21 bp, Homo sapiens
gaaaatgccatgaaaattgct

SEQ ID NO: 4333951 - DNA, 19 bp, Homo sapiens
gaaaattctctcaagactt

SEQ ID NO: 4333952 - DNA, 14 bp, Homo sapiens
gaaacaaagcaaat

SEQ ID NO: 4333953 - DNA, 17 bp, Homo sapiens
gaaacatagaaagacat

SEQ ID NO: 4333954 - DNA, 16 bp, Homo sapiens
gaaacatgtgcccctg

SEQ ID NO: 4333955 - DNA, 17 bp, Homo sapiens
gaaacccggtgcatctg

SEQ ID NO: 4333956 - DNA, 19 bp, Homo sapiens
gaaacgagaagtgccctta

SEQ ID NO: 4333957 - DNA, 13 bp, Homo sapiens
gaaacttttgaaa

SEQ ID NO: 4333958 - DNA, 15 bp, Homo sapiens
gaaacttttgaaaaa

SEQ ID NO: 4333959 - DNA, 15 bp, Homo sapiens
gaaagacatctgcct

SEQ ID NO: 4333960 - DNA, 19 bp, Homo sapiens
ctgtgtcagcatagaagta

SEQ ID NO: 4333961 - DNA, 20 bp, Homo sapiens
ctgtgtcagcatagaagtaa

SEQ ID NO: 4333962 - DNA, 18 bp, Homo sapiens
ctgtgtcctgatggccca

SEQ ID NO: 4333963 - DNA, 18 bp, Homo sapiens
ctgtgtctgaatcatgtc

SEQ ID NO: 4333964 - DNA, 16 bp, Homo sapiens
ctgtgtctgctctcat

SEQ ID NO: 4333965 - DNA, 22 bp, Homo sapiens
ctgtgtcttcacctcatttata

SEQ ID NO: 4333966 - DNA, 19 bp, Homo sapiens
ctgtgtgagcgtgtccaca

SEQ ID NO: 4333967 - DNA, 12 bp, Homo sapiens
ctgttcagctgg

SEQ ID NO: 4333968 - DNA, 15 bp, Homo sapiens
ctgttctgtgtacat

SEQ ID NO: 4333969 - DNA, 18 bp, Homo sapiens
ctgttctgtgtacataaa

SEQ ID NO: 4333970 - DNA, 22 bp, Homo sapiens
ctgttctgtgtacataaagtca

SEQ ID NO: 4333971 - DNA, 19 bp, Homo sapiens
ctgttgatcccctctctgt

SEQ ID NO: 4333972 - DNA, 22 bp, Homo sapiens
ctgttgatcccctctctgtggc

SEQ ID NO: 4333973 - DNA, 14 bp, Homo sapiens
ctgttgggggcttc

SEQ ID NO: 4333974 - DNA, 16 bp, Homo sapiens
ctgttgggggcttcag

SEQ ID NO: 4333975 - DNA, 18 bp, Homo sapiens
ctgttgtttctataaatg

SEQ ID NO: 4333976 - DNA, 19 bp, Homo sapiens
ctgttgtttctataaatga

SEQ ID NO: 4333977 - DNA, 21 bp, Homo sapiens
ctgttgtttctataaatgact

SEQ ID NO: 4333978 - DNA, 22 bp, Homo sapiens
ctgtttactcccttctgtagtt

SEQ ID NO: 4333979 - DNA, 11 bp, Homo sapiens
ctgttttcaag

SEQ ID NO: 4333980 - DNA, 14 bp, Homo sapiens
ctgttttctcttga

SEQ ID NO: 4333981 - DNA, 15 bp, Homo sapiens
cttaaagcttgattt

SEQ ID NO: 4333982 - DNA, 16 bp, Homo sapiens
cttaaatcatttggtt

SEQ ID NO: 4333983 - DNA, 18 bp, Homo sapiens
cttaaatgaactactgct

SEQ ID NO: 4333984 - DNA, 17 bp, Homo sapiens
cttaactgtatttcagt

SEQ ID NO: 4333985 - DNA, 20 bp, Homo sapiens
cttaactgtatttcagtatt

SEQ ID NO: 4333986 - DNA, 18 bp, Homo sapiens
cttaagctgtagagagtg

SEQ ID NO: 4333987 - DNA, 23 bp, Homo sapiens
cttaaggatcaccccagccccca

SEQ ID NO: 4333988 - DNA, 16 bp, Homo sapiens
cttaatgtctgtcaga

SEQ ID NO: 4333989 - DNA, 12 bp, Homo sapiens
cttaatttaagt

SEQ ID NO: 4333990 - DNA, 19 bp, Homo sapiens
cttaatttttttgttgttg

SEQ ID NO: 4333991 - DNA, 18 bp, Homo sapiens
cttacaagcttaaagctt

SEQ ID NO: 4333992 - DNA, 14 bp, Homo sapiens
cttaccataccact

SEQ ID NO: 4333993 - DNA, 15 bp, Homo sapiens
cttaccctctctttc

SEQ ID NO: 4333994 - DNA, 14 bp, Homo sapiens
cttacctgcttgag

SEQ ID NO: 4333995 - DNA, 19 bp, Homo sapiens
cttactcacctctctctaa

SEQ ID NO: 4333996 - DNA, 14 bp, Homo sapiens
cttactgaaagaca

SEQ ID NO: 4333997 - DNA, 22 bp, Homo sapiens
cttacttgtcctttgaggcccc

SEQ ID NO: 4333998 - DNA, 18 bp, Homo sapiens
cttagactcctcttccca

SEQ ID NO: 4333999 - DNA, 20 bp, Homo sapiens
cttagagaatgttctcctaa

SEQ ID NO: 4334000 - DNA, 18 bp, Homo sapiens
cttagatgttccaaattt

SEQ ID NO: 4334001 - DNA, 21 bp, Homo sapiens
cttaggttggcaaaaaggcag

SEQ ID NO: 4334002 - DNA, 23 bp, Homo sapiens
cttaggttggcaaaaaggcagga

SEQ ID NO: 4334003 - DNA, 18 bp, Homo sapiens
cttagtagtttttacaaa

SEQ ID NO: 4334004 - DNA, 22 bp, Homo sapiens
cttagtccctaatcatgtttct

SEQ ID NO: 4334005 - DNA, 20 bp, Homo sapiens
cttagtgcttcagagtttgt

SEQ ID NO: 4334006 - DNA, 23 bp, Homo sapiens
cttagtgcttcagagtttgtgtg

SEQ ID NO: 4334007 - DNA, 20 bp, Homo sapiens
cttatcctacagtacaatca

SEQ ID NO: 4334008 - DNA, 15 bp, Homo sapiens
cttatgattttatta

SEQ ID NO: 4334009 - DNA, 17 bp, Homo sapiens
cttatgattttattaca

SEQ ID NO: 4334010 - DNA, 13 bp, Homo sapiens
cttatgtgttaca

SEQ ID NO: 4334011 - DNA, 22 bp, Homo sapiens
cttcaaggatatactgcagctt

SEQ ID NO: 4334012 - DNA, 19 bp, Homo sapiens
cttcacggaagagccttgc

SEQ ID NO: 4334013 - DNA, 23 bp, Homo sapiens
cttcactcatgcaaactgcttta

SEQ ID NO: 4334014 - DNA, 18 bp, Homo sapiens
cttcagaattatccatta

SEQ ID NO: 4334015 - DNA, 20 bp, Homo sapiens
cttcagaattatccattacg

SEQ ID NO: 4334016 - DNA, 14 bp, Homo sapiens
cttcagactctcag

SEQ ID NO: 4334017 - DNA, 13 bp, Homo sapiens
cttcagagtttgt

SEQ ID NO: 4334018 - DNA, 17 bp, Homo sapiens
cttcagagtttgtgtgt

SEQ ID NO: 4334019 - DNA, 18 bp, Homo sapiens
cttcagagtttgtgtgta

SEQ ID NO: 4334020 - DNA, 21 bp, Homo sapiens
cttcagagtttgtgtgtattt

SEQ ID NO: 4334021 - DNA, 18 bp, Homo sapiens
cttcagatttgtgttata

SEQ ID NO: 4334022 - DNA, 14 bp, Homo sapiens
cttcaggagcccta

SEQ ID NO: 4334023 - DNA, 14 bp, Homo sapiens
cttcaggtctctgt

SEQ ID NO: 4334024 - DNA, 16 bp, Homo sapiens
cttcagtaagccgtga

SEQ ID NO: 4334025 - DNA, 15 bp, Homo sapiens
cttccccagctcccc

SEQ ID NO: 4334026 - DNA, 22 bp, Homo sapiens
cttcctaatgccctatgtgtat

SEQ ID NO: 4334027 - DNA, 23 bp, Homo sapiens
cttcctaatgccctatgtgtata

SEQ ID NO: 4334028 - DNA, 16 bp, Homo sapiens
cttcctaccctcctgc

SEQ ID NO: 4334029 - DNA, 17 bp, Homo sapiens
cttcctcctctcctgga

SEQ ID NO: 4334030 - DNA, 19 bp, Homo sapiens
cttcctgattaccagtctg

SEQ ID NO: 4334031 - DNA, 15 bp, Homo sapiens
cttcctgtctgttta

SEQ ID NO: 4334032 - DNA, 16 bp, Homo sapiens
cttcctgtctgtttat

SEQ ID NO: 4334033 - DNA, 21 bp, Homo sapiens
cttcgggaggtcgaggcagga

SEQ ID NO: 4334034 - DNA, 14 bp, Homo sapiens
cttcggggaccagc

SEQ ID NO: 4334035 - DNA, 17 bp, Homo sapiens
cttctaccccacctgac

SEQ ID NO: 4334036 - DNA, 12 bp, Homo sapiens
cttctataaaat

SEQ ID NO: 4334037 - DNA, 16 bp, Homo sapiens
cttctcactgccatgc

SEQ ID NO: 4334038 - DNA, 20 bp, Homo sapiens
cttctcagttgcagaaaatg

SEQ ID NO: 4334039 - DNA, 19 bp, Homo sapiens
cttctcccaggcctctgcc

SEQ ID NO: 4334040 - DNA, 14 bp, Homo sapiens
cttctccctagccc

SEQ ID NO: 4334041 - DNA, 16 bp, Homo sapiens
cttctcgcaactgaag

SEQ ID NO: 4334042 - DNA, 15 bp, Homo sapiens
cttctctttgtgcag

SEQ ID NO: 4334043 - DNA, 18 bp, Homo sapiens
cttctgagccccagcccc

SEQ ID NO: 4334044 - DNA, 19 bp, Homo sapiens
cttctgagccccagcccca

SEQ ID NO: 4334045 - DNA, 16 bp, Homo sapiens
cttctgcagcaactcc

SEQ ID NO: 4334046 - DNA, 17 bp, Homo sapiens
cttctgcagcaactccc

SEQ ID NO: 4334047 - DNA, 18 bp, Homo sapiens
cttctgcagcaactccca

SEQ ID NO: 4334048 - DNA, 19 bp, Homo sapiens
cttctgcagcaactcccac

SEQ ID NO: 4334049 - DNA, 21 bp, Homo sapiens
cttctgcagcaactcccacga

SEQ ID NO: 4334050 - DNA, 23 bp, Homo sapiens
cttctgcagcaactcccacgact

SEQ ID NO: 4334051 - DNA, 20 bp, Homo sapiens
cttctgggcatctgttctgg

SEQ ID NO: 4334052 - DNA, 21 bp, Homo sapiens
cttctgggcatctgttctggt

SEQ ID NO: 4334053 - DNA, 18 bp, Homo sapiens
cttctgtagtttttaatt

SEQ ID NO: 4334054 - DNA, 17 bp, Homo sapiens
cttctgtggtccctctg

SEQ ID NO: 4334055 - DNA, 14 bp, Homo sapiens
cttctttattgcac

SEQ ID NO: 4334056 - DNA, 16 bp, Homo sapiens
cttctttcactactca

SEQ ID NO: 4334057 - DNA, 18 bp, Homo sapiens
cttctttgcttctttttc

SEQ ID NO: 4334058 - DNA, 22 bp, Homo sapiens
cttgacgggagcattggcccct

SEQ ID NO: 4334059 - DNA, 19 bp, Homo sapiens
cttgacttatggctcgctt

SEQ ID NO: 4334060 - DNA, 14 bp, Homo sapiens
cttgagagggtgga

SEQ ID NO: 4334061 - DNA, 18 bp, Homo sapiens
cttgagctttctgtgcat

SEQ ID NO: 4334062 - DNA, 19 bp, Homo sapiens
cttgagctttctgtgcatg

SEQ ID NO: 4334063 - DNA, 20 bp, Homo sapiens
cttgagctttctgtgcatgt

SEQ ID NO: 4334064 - DNA, 22 bp, Homo sapiens
cttgagctttctgtgcatgtgc

SEQ ID NO: 4334065 - DNA, 19 bp, Homo sapiens
cttgagttgattcagctct

SEQ ID NO: 4334066 - DNA, 20 bp, Homo sapiens
cttgagttgattcagctctg

SEQ ID NO: 4334067 - DNA, 21 bp, Homo sapiens
cttgagttgattcagctctgc

SEQ ID NO: 4334068 - DNA, 15 bp, Homo sapiens
cttgatgactgctga

SEQ ID NO: 4334069 - DNA, 16 bp, Homo sapiens
cttgatgactgctgat

SEQ ID NO: 4334070 - DNA, 17 bp, Homo sapiens
cttgatgactgctgatt

SEQ ID NO: 4334071 - DNA, 21 bp, Homo sapiens
cttgcaaactctataaagaaa

SEQ ID NO: 4334072 - DNA, 15 bp, Homo sapiens
cttgcacctgagcct

SEQ ID NO: 4334073 - DNA, 18 bp, Homo sapiens
cttgcattaaaggagatc

SEQ ID NO: 4334074 - DNA, 15 bp, Homo sapiens
cttgccaaaatgttg

SEQ ID NO: 4334075 - DNA, 14 bp, Homo sapiens
cttgcccttggagc

SEQ ID NO: 4334076 - DNA, 14 bp, Homo sapiens
cttgcctgctgctt

SEQ ID NO: 4334077 - DNA, 21 bp, Homo sapiens
cttgcttctgcagcaactccc

SEQ ID NO: 4334078 - DNA, 22 bp, Homo sapiens
cttgcttctgcagcaactccca

SEQ ID NO: 4334079 - DNA, 16 bp, Homo sapiens
ctgcccttgtctgaga

SEQ ID NO: 4334080 - DNA, 20 bp, Homo sapiens
ctgccgctttgtctgtccag

SEQ ID NO: 4334081 - DNA, 18 bp, Homo sapiens
ctgccgggagactgccag

SEQ ID NO: 4334082 - DNA, 13 bp, Homo sapiens
ctgcctccaaccc

SEQ ID NO: 4334083 - DNA, 18 bp, Homo sapiens
ctgcctccaacccagcag

SEQ ID NO: 4334084 - DNA, 14 bp, Homo sapiens
ctgcctcctgcctc

SEQ ID NO: 4334085 - DNA, 19 bp, Homo sapiens
ctgcctgggatgcccttcc

SEQ ID NO: 4334086 - DNA, 23 bp, Homo sapiens
ctgcctgggatgcccttccccct

SEQ ID NO: 4334087 - DNA, 19 bp, Homo sapiens
ctgcctggttttatttata

SEQ ID NO: 4334088 - DNA, 14 bp, Homo sapiens
ctgccttcctcctt

SEQ ID NO: 4334089 - DNA, 15 bp, Homo sapiens
ctgccttcctcctta

SEQ ID NO: 4334090 - DNA, 19 bp, Homo sapiens
ctgcgaaaacgttgacccc

SEQ ID NO: 4334091 - DNA, 21 bp, Homo sapiens
ctgcgaaaacgttgacccctt

SEQ ID NO: 4334092 - DNA, 22 bp, Homo sapiens
ctgcgtctggaggggcccctgc

SEQ ID NO: 4334093 - DNA, 21 bp, Homo sapiens
ctgctaaagggagaaatgcca

SEQ ID NO: 4334094 - DNA, 19 bp, Homo sapiens
ctgctaagctaaagaaact

SEQ ID NO: 4334095 - DNA, 21 bp, Homo sapiens
ctgctacccagaaccttttta

SEQ ID NO: 4334096 - DNA, 21 bp, Homo sapiens
ctgctattttttttaaatcaa

SEQ ID NO: 4334097 - DNA, 15 bp, Homo sapiens
ctgctccagctgttc

SEQ ID NO: 4334098 - DNA, 22 bp, Homo sapiens
ctgctcggcttcttggaccttg

SEQ ID NO: 4334099 - DNA, 20 bp, Homo sapiens
ctgctgaaagtcctgctttc

SEQ ID NO: 4334100 - DNA, 21 bp, Homo sapiens
ctgctgactgttttctcttga

SEQ ID NO: 4334101 - DNA, 16 bp, Homo sapiens
ctgctgggtgccaggt

SEQ ID NO: 4334102 - DNA, 21 bp, Homo sapiens
ctgctgggtgccaggtgctgg

SEQ ID NO: 4334103 - DNA, 19 bp, Homo sapiens
ctgcttcaatcccagccta

SEQ ID NO: 4334104 - DNA, 16 bp, Homo sapiens
ctgcttctccagcctg

SEQ ID NO: 4334105 - DNA, 16 bp, Homo sapiens
ctgcttggagtgcccc

SEQ ID NO: 4334106 - DNA, 18 bp, Homo sapiens
ctgcttggagtgccccaa

SEQ ID NO: 4334107 - DNA, 23 bp, Homo sapiens
ctgcttggagtgccccaaggagg

SEQ ID NO: 4334108 - DNA, 15 bp, Homo sapiens
ctgctttctttgatt

SEQ ID NO: 4334109 - DNA, 15 bp, Homo sapiens
ctgctttgtgcatat

SEQ ID NO: 4334110 - DNA, 16 bp, Homo sapiens
ctgctttgtgcatatg

SEQ ID NO: 4334111 - DNA, 18 bp, Homo sapiens
ctggaaacagacagggag

SEQ ID NO: 4334112 - DNA, 12 bp, Homo sapiens
ctggaagaaagg

SEQ ID NO: 4334113 - DNA, 17 bp, Homo sapiens
ctggaagaaaggctgtg

SEQ ID NO: 4334114 - DNA, 14 bp, Homo sapiens
ctggacccccagct

SEQ ID NO: 4334115 - DNA, 15 bp, Homo sapiens
ctggaccctgtggat

SEQ ID NO: 4334116 - DNA, 13 bp, Homo sapiens
ctggagcactgta

SEQ ID NO: 4334117 - DNA, 15 bp, Homo sapiens
ctggaggggcccctg

SEQ ID NO: 4334118 - DNA, 16 bp, Homo sapiens
ctggaggggcccctgc

SEQ ID NO: 4334119 - DNA, 17 bp, Homo sapiens
ctggaggggcccctgct

SEQ ID NO: 4334120 - DNA, 19 bp, Homo sapiens
ctggagtccacacttgaat

SEQ ID NO: 4334121 - DNA, 16 bp, Homo sapiens
ctggattcacagacca

SEQ ID NO: 4334122 - DNA, 17 bp, Homo sapiens
ctggcacgtggccagga

SEQ ID NO: 4334123 - DNA, 14 bp, Homo sapiens
ctggcacttgcctg

SEQ ID NO: 4334124 - DNA, 20 bp, Homo sapiens
ctggcaggctactctgccca

SEQ ID NO: 4334125 - DNA, 17 bp, Homo sapiens
ctggcatcgcagcttcc

SEQ ID NO: 4334126 - DNA, 13 bp, Homo sapiens
ctggcccactgca

SEQ ID NO: 4334127 - DNA, 15 bp, Homo sapiens
ctggcccactgcatc

SEQ ID NO: 4334128 - DNA, 16 bp, Homo sapiens
ctggccctcagctccc

SEQ ID NO: 4334129 - DNA, 23 bp, Homo sapiens
ctggccctcagctccctgacccc

SEQ ID NO: 4334130 - DNA, 22 bp, Homo sapiens
ctggcccttctatttatttgac

SEQ ID NO: 4334131 - DNA, 13 bp, Homo sapiens
ctggccttgactt

SEQ ID NO: 4334132 - DNA, 23 bp, Homo sapiens
ctggctaatggagtgtttgaaaa

SEQ ID NO: 4334133 - DNA, 21 bp, Homo sapiens
ctggctgggtggcaccagcag

SEQ ID NO: 4334134 - DNA, 23 bp, Homo sapiens
ctggcttttcgcttgcttctgca

SEQ ID NO: 4334135 - DNA, 19 bp, Homo sapiens
ctggctttttgtcaaataa

SEQ ID NO: 4334136 - DNA, 13 bp, Homo sapiens
ctgggaagaacaa

SEQ ID NO: 4334137 - DNA, 21 bp, Homo sapiens
ctgggacctaatgctggcctg

SEQ ID NO: 4334138 - DNA, 22 bp, Homo sapiens
ctgggacctaatgctggcctga

SEQ ID NO: 4334139 - DNA, 15 bp, Homo sapiens
ctgggatgcccttcc

SEQ ID NO: 4334140 - DNA, 16 bp, Homo sapiens
ctgggatgcccttccc

SEQ ID NO: 4334141 - DNA, 18 bp, Homo sapiens
ctgggatgcccttccccc

SEQ ID NO: 4334142 - DNA, 19 bp, Homo sapiens
ctgggcacccctgcctcct

SEQ ID NO: 4334143 - DNA, 14 bp, Homo sapiens
ctgggcagggcctg

SEQ ID NO: 4334144 - DNA, 17 bp, Homo sapiens
ctgggcagtgagtgcca

SEQ ID NO: 4334145 - DNA, 22 bp, Homo sapiens
ctgggcagtgagtgccatgctt

SEQ ID NO: 4334146 - DNA, 21 bp, Homo sapiens
ctgggcatgtttgtctgtgtg

SEQ ID NO: 4334147 - DNA, 16 bp, Homo sapiens
ctgggcggggccgcag

SEQ ID NO: 4334148 - DNA, 22 bp, Homo sapiens
ctgggcggggccgcagccacac

SEQ ID NO: 4334149 - DNA, 12 bp, Homo sapiens
ctgggctctgtc

SEQ ID NO: 4334150 - DNA, 19 bp, Homo sapiens
ctgggcttggtaagtgaat

SEQ ID NO: 4334151 - DNA, 18 bp, Homo sapiens
ctgggcttgtctgtagat

SEQ ID NO: 4334152 - DNA, 18 bp, Homo sapiens
ctggggcaggctgcttca

SEQ ID NO: 4334153 - DNA, 17 bp, Homo sapiens
ctgggggcggggcctgg

SEQ ID NO: 4334154 - DNA, 24 bp, Homo sapiens
ctggggtttagaaccccaggtgag

SEQ ID NO: 4334155 - DNA, 22 bp, Homo sapiens
ctgggtaactagggaagataat

SEQ ID NO: 4334156 - DNA, 20 bp, Homo sapiens
ctgggtggcaccagcagcct

SEQ ID NO: 4334157 - DNA, 20 bp, Homo sapiens
ctggtatattgtgtaaatat

SEQ ID NO: 4334158 - DNA, 14 bp, Homo sapiens
ctggtcacctccca

SEQ ID NO: 4334159 - DNA, 16 bp, Homo sapiens
ctggtcacctcccatc

SEQ ID NO: 4334160 - DNA, 15 bp, Homo sapiens
ctggtctttcctctg

SEQ ID NO: 4334161 - DNA, 19 bp, Homo sapiens
ctggtgcccttccctggag

SEQ ID NO: 4334162 - DNA, 17 bp, Homo sapiens
ctggtggccttgggcct

SEQ ID NO: 4334163 - DNA, 16 bp, Homo sapiens
ctggttcgtgccatgc

SEQ ID NO: 4334164 - DNA, 21 bp, Homo sapiens
ctggttgtaccctctccaggc

SEQ ID NO: 4334165 - DNA, 18 bp, Homo sapiens
ctgtaactttttttcagt

SEQ ID NO: 4334166 - DNA, 20 bp, Homo sapiens
ctgtaactttttttcagttc

SEQ ID NO: 4334167 - DNA, 21 bp, Homo sapiens
ctgtaatgtaggcacttttat

SEQ ID NO: 4334168 - DNA, 16 bp, Homo sapiens
ctgtactttgtgttta

SEQ ID NO: 4334169 - DNA, 13 bp, Homo sapiens
ctgtagagtggga

SEQ ID NO: 4334170 - DNA, 16 bp, Homo sapiens
ctgtatccccagtgcc

SEQ ID NO: 4334171 - DNA, 18 bp, Homo sapiens
ctgtatccccagtgcccg

SEQ ID NO: 4334172 - DNA, 19 bp, Homo sapiens
ctgtatttcagtattttcc

SEQ ID NO: 4334173 - DNA, 15 bp, Homo sapiens
ctgtatttctttgta

SEQ ID NO: 4334174 - DNA, 21 bp, Homo sapiens
ctgtccagccgtgtgtgcatg

SEQ ID NO: 4334175 - DNA, 22 bp, Homo sapiens
ctgtcccagtgccgagaaggaa

SEQ ID NO: 4334176 - DNA, 22 bp, Homo sapiens
ctgtccccggcggggtgcctgc

SEQ ID NO: 4334177 - DNA, 14 bp, Homo sapiens
ctgtcccctcagct

SEQ ID NO: 4334178 - DNA, 22 bp, Homo sapiens
ctgtcctaggtcatgaaggaca

SEQ ID NO: 4334179 - DNA, 16 bp, Homo sapiens
ctgtctcaaaaaaaga

SEQ ID NO: 4334180 - DNA, 23 bp, Homo sapiens
ctgtctccctccccaaatggctg

SEQ ID NO: 4334181 - DNA, 12 bp, Homo sapiens
ctgtctctctct

SEQ ID NO: 4334182 - DNA, 20 bp, Homo sapiens
ctgtctctctctctttttct

SEQ ID NO: 4334183 - DNA, 15 bp, Homo sapiens
ctgtctctgcatctg

SEQ ID NO: 4334184 - DNA, 20 bp, Homo sapiens
ctgtctgatcagggtggagg

SEQ ID NO: 4334185 - DNA, 14 bp, Homo sapiens
ctgtctgtttatat

SEQ ID NO: 4334186 - DNA, 22 bp, Homo sapiens
ctgtctttggataataggaatt

SEQ ID NO: 4334187 - DNA, 15 bp, Homo sapiens
ctgtgaagagaacca

SEQ ID NO: 4334188 - DNA, 11 bp, Homo sapiens
ctgtgcatgtg

SEQ ID NO: 4334189 - DNA, 23 bp, Homo sapiens
ctgtgcttctcttctttattgca

SEQ ID NO: 4334190 - DNA, 23 bp, Homo sapiens
ctgtggaagggccaatggagaaa

SEQ ID NO: 4334191 - DNA, 17 bp, Homo sapiens
ctgtggatgataaaaca

SEQ ID NO: 4334192 - DNA, 12 bp, Homo sapiens
ctgtggccagga

SEQ ID NO: 4334193 - DNA, 13 bp, Homo sapiens
ctgtggccaggag

SEQ ID NO: 4334194 - DNA, 17 bp, Homo sapiens
ctgtggccatatatgct

SEQ ID NO: 4334195 - DNA, 12 bp, Homo sapiens
ctgtggtccctc

SEQ ID NO: 4334196 - DNA, 21 bp, Homo sapiens
ctgtgtagttccctctgcctg

SEQ ID NO: 4334197 - DNA, 22 bp, Homo sapiens
ctgtgtagttccctctgcctgg

SEQ ID NO: 4334198 - DNA, 23 bp, Homo sapiens
ctgtgtagttccctctgcctggg

SEQ ID NO: 4334199 - DNA, 17 bp, Homo sapiens
gggaggggggcacatgc

SEQ ID NO: 4334200 - DNA, 16 bp, Homo sapiens
gggatgggccaccgcc

SEQ ID NO: 4334201 - DNA, 14 bp, Homo sapiens
gggatgtgaagaaa

SEQ ID NO: 4334202 - DNA, 12 bp, Homo sapiens
gggattccctgg

SEQ ID NO: 4334203 - DNA, 20 bp, Homo sapiens
gggcacatgctgagtctccc

SEQ ID NO: 4334204 - DNA, 12 bp, Homo sapiens
gggcacccctgc

SEQ ID NO: 4334205 - DNA, 13 bp, Homo sapiens
gggcacccctgcc

SEQ ID NO: 4334206 - DNA, 20 bp, Homo sapiens
gggcactgtctgcgtgacta

SEQ ID NO: 4334207 - DNA, 18 bp, Homo sapiens
gggcagagccaccagggc

SEQ ID NO: 4334208 - DNA, 16 bp, Homo sapiens
gggcagtgagtgccat

SEQ ID NO: 4334209 - DNA, 20 bp, Homo sapiens
gggcagtgagtgccatgctt

SEQ ID NO: 4334210 - DNA, 16 bp, Homo sapiens
gggcatgaatggagat

SEQ ID NO: 4334211 - DNA, 15 bp, Homo sapiens
gggcatgagtctgtt

SEQ ID NO: 4334212 - DNA, 22 bp, Homo sapiens
gggcatgagtctgtttcccaag

SEQ ID NO: 4334213 - DNA, 14 bp, Homo sapiens
gggccaatggagaa

SEQ ID NO: 4334214 - DNA, 20 bp, Homo sapiens
gggccctttcttgcactgtc

SEQ ID NO: 4334215 - DNA, 23 bp, Homo sapiens
gggccgcagccacaccgctggct

SEQ ID NO: 4334216 - DNA, 15 bp, Homo sapiens
gggccggggcctctg

SEQ ID NO: 4334217 - DNA, 18 bp, Homo sapiens
gggccgtgcccttgccct

SEQ ID NO: 4334218 - DNA, 18 bp, Homo sapiens
gggcctcgacgtcccttg

SEQ ID NO: 4334219 - DNA, 22 bp, Homo sapiens
gggcctcggtgtggagaagcgg

SEQ ID NO: 4334220 - DNA, 14 bp, Homo sapiens
gggcctggcataga

SEQ ID NO: 4334221 - DNA, 18 bp, Homo sapiens
gggcctggcatagagtag

SEQ ID NO: 4334222 - DNA, 22 bp, Homo sapiens
gggctcagcaaaagatgcttct

SEQ ID NO: 4334223 - DNA, 18 bp, Homo sapiens
gggctcagcagggctggt

SEQ ID NO: 4334224 - DNA, 16 bp, Homo sapiens
gggctgaggtgggagg

SEQ ID NO: 4334225 - DNA, 22 bp, Homo sapiens
gggctgcgaaaacgttgacccc

SEQ ID NO: 4334226 - DNA, 13 bp, Homo sapiens
gggctggtcacct

SEQ ID NO: 4334227 - DNA, 16 bp, Homo sapiens
gggcttcaggtctctg

SEQ ID NO: 4334228 - DNA, 24 bp, Homo sapiens
ggggaaaatcagcctgctccagct

SEQ ID NO: 4334229 - DNA, 18 bp, Homo sapiens
ggggaccgtctttacccc

SEQ ID NO: 4334230 - DNA, 16 bp, Homo sapiens
ggggagaaactgaagc

SEQ ID NO: 4334231 - DNA, 17 bp, Homo sapiens
ggggatcacagcctctg

SEQ ID NO: 4334232 - DNA, 22 bp, Homo sapiens
ggggcaagaagatcacgctccc

SEQ ID NO: 4334233 - DNA, 15 bp, Homo sapiens
ggggcccctggccca

SEQ ID NO: 4334234 - DNA, 15 bp, Homo sapiens
ggggcggggccggga

SEQ ID NO: 4334235 - DNA, 17 bp, Homo sapiens
gggggatcacagcctct

SEQ ID NO: 4334236 - DNA, 14 bp, Homo sapiens
gggtagggaatgtt

SEQ ID NO: 4334237 - DNA, 22 bp, Homo sapiens
gggtatgtgttgccaaagctgg

SEQ ID NO: 4334238 - DNA, 18 bp, Homo sapiens
gggtcctactcctggagc

SEQ ID NO: 4334239 - DNA, 19 bp, Homo sapiens
gggtcctactcctggagca

SEQ ID NO: 4334240 - DNA, 17 bp, Homo sapiens
gggtgaagtgcctgctg

SEQ ID NO: 4334241 - DNA, 13 bp, Homo sapiens
gggtggtgctggg

SEQ ID NO: 4334242 - DNA, 20 bp, Homo sapiens
gggtttagaaccccaggtga

SEQ ID NO: 4334243 - DNA, 12 bp, Homo sapiens
gggtttgagaca

SEQ ID NO: 4334244 - DNA, 14 bp, Homo sapiens
gggtttgagacaga

SEQ ID NO: 4334245 - DNA, 15 bp, Homo sapiens
ggtaaaatgtatttt

SEQ ID NO: 4334246 - DNA, 17 bp, Homo sapiens
ggtaaaatgtatttttc

SEQ ID NO: 4334247 - DNA, 18 bp, Homo sapiens
ggtaactagggaagataa

SEQ ID NO: 4334248 - DNA, 21 bp, Homo sapiens
ggtaacttgtttttattgcat

SEQ ID NO: 4334249 - DNA, 17 bp, Homo sapiens
ggtaattattttgagtg

SEQ ID NO: 4334250 - DNA, 21 bp, Homo sapiens
ggtactccataaaaggtgtgt

SEQ ID NO: 4334251 - DNA, 12 bp, Homo sapiens
ggtactctgtgt

SEQ ID NO: 4334252 - DNA, 15 bp, Homo sapiens
ggtactctgtgtctg

SEQ ID NO: 4334253 - DNA, 11 bp, Homo sapiens
ggtagaggaaa

SEQ ID NO: 4334254 - DNA, 21 bp, Homo sapiens
ggtatcaactaggggaggaga

SEQ ID NO: 4334255 - DNA, 17 bp, Homo sapiens
ggtatgtgttgccaaag

SEQ ID NO: 4334256 - DNA, 14 bp, Homo sapiens
ggtatttataatat

SEQ ID NO: 4334257 - DNA, 12 bp, Homo sapiens
ggtcacctccca

SEQ ID NO: 4334258 - DNA, 23 bp, Homo sapiens
ggtcatgaaggacactctgcagg

SEQ ID NO: 4334259 - DNA, 14 bp, Homo sapiens
ggtcatgtcctgag

SEQ ID NO: 4334260 - DNA, 22 bp, Homo sapiens
ggtcattacttctgagccccag

SEQ ID NO: 4334261 - DNA, 13 bp, Homo sapiens
ggtcccttgctgc

SEQ ID NO: 4334262 - DNA, 17 bp, Homo sapiens
ggtcctactcctggagc

SEQ ID NO: 4334263 - DNA, 18 bp, Homo sapiens
ggtcctactcctggagca

SEQ ID NO: 4334264 - DNA, 21 bp, Homo sapiens
ggtcctactcctggagcactg

SEQ ID NO: 4334265 - DNA, 14 bp, Homo sapiens
ggtcgtcatgctgt

SEQ ID NO: 4334266 - DNA, 21 bp, Homo sapiens
ggtgaacagcaggatgccctg

SEQ ID NO: 4334267 - DNA, 22 bp, Homo sapiens
ggtgaacagcaggatgccctgt

SEQ ID NO: 4334268 - DNA, 14 bp, Homo sapiens
ggtgattgaaagaa

SEQ ID NO: 4334269 - DNA, 18 bp, Homo sapiens
ggtgattgaaagaaaaaa

SEQ ID NO: 4334270 - DNA, 16 bp, Homo sapiens
ggtgcagggcctggca

SEQ ID NO: 4334271 - DNA, 17 bp, Homo sapiens
ggtgcagggcctggcat

SEQ ID NO: 4334272 - DNA, 18 bp, Homo sapiens
ggtgcagggcctggcata

SEQ ID NO: 4334273 - DNA, 17 bp, Homo sapiens
ggtgcccttccctggag

SEQ ID NO: 4334274 - DNA, 18 bp, Homo sapiens
ggtgcctgaaagctggga

SEQ ID NO: 4334275 - DNA, 12 bp, Homo sapiens
ggtgcctgctgt

SEQ ID NO: 4334276 - DNA, 20 bp, Homo sapiens
ggtggcaccagcagcctgga

SEQ ID NO: 4334277 - DNA, 15 bp, Homo sapiens
ggtggccctcccagg

SEQ ID NO: 4334278 - DNA, 16 bp, Homo sapiens
ggtggccctcccaggc

SEQ ID NO: 4334279 - DNA, 20 bp, Homo sapiens
ggtgggaggattgcttgagc

SEQ ID NO: 4334280 - DNA, 21 bp, Homo sapiens
ggtggttatggagagggtgtc

SEQ ID NO: 4334281 - DNA, 14 bp, Homo sapiens
ggtgtggagaagcg

SEQ ID NO: 4334282 - DNA, 11 bp, Homo sapiens
ggtgtggggga

SEQ ID NO: 4334283 - DNA, 17 bp, Homo sapiens
ggtgttagtgtcagcca

SEQ ID NO: 4334284 - DNA, 17 bp, Homo sapiens
ggttcgggattccctgg

SEQ ID NO: 4334285 - DNA, 15 bp, Homo sapiens
ggtttcttttggaaa

SEQ ID NO: 4334286 - DNA, 13 bp, Homo sapiens
gtaaaataaaaaa

SEQ ID NO: 4334287 - DNA, 23 bp, Homo sapiens
gtaaaatgagtaggatgtctctt

SEQ ID NO: 4334288 - DNA, 12 bp, Homo sapiens
gtaaacacataa

SEQ ID NO: 4334289 - DNA, 14 bp, Homo sapiens
gtaaacacataaat

SEQ ID NO: 4334290 - DNA, 16 bp, Homo sapiens
gtaaacacataaatga

SEQ ID NO: 4334291 - DNA, 17 bp, Homo sapiens
gtaaactggaattaaaa

SEQ ID NO: 4334292 - DNA, 18 bp, Homo sapiens
gtaaactggaattaaaag

SEQ ID NO: 4334293 - DNA, 15 bp, Homo sapiens
gtaaagccattaaat

SEQ ID NO: 4334294 - DNA, 12 bp, Homo sapiens
gtaaatattatg

SEQ ID NO: 4334295 - DNA, 13 bp, Homo sapiens
gtaaatattatga

SEQ ID NO: 4334296 - DNA, 22 bp, Homo sapiens
gtaacttgtttttattgcattt

SEQ ID NO: 4334297 - DNA, 17 bp, Homo sapiens
gtaactttttttcagtt

SEQ ID NO: 4334298 - DNA, 19 bp, Homo sapiens
gtaagaaagccaccttgtt

SEQ ID NO: 4334299 - DNA, 17 bp, Homo sapiens
gtaagaccaccttccct

SEQ ID NO: 4334300 - DNA, 20 bp, Homo sapiens
gtaagaccaccttcccttcc

SEQ ID NO: 4334301 - DNA, 13 bp, Homo sapiens
gtaatgaagtaaa

SEQ ID NO: 4334302 - DNA, 14 bp, Homo sapiens
gtaatgatggaact

SEQ ID NO: 4334303 - DNA, 19 bp, Homo sapiens
gtaatgccaatatgacaca

SEQ ID NO: 4334304 - DNA, 21 bp, Homo sapiens
gtaatgtagggttatatttgg

SEQ ID NO: 4334305 - DNA, 12 bp, Homo sapiens
gtaatgtcagac

SEQ ID NO: 4334306 - DNA, 17 bp, Homo sapiens
gtacaatgtgtttttct

SEQ ID NO: 4334307 - DNA, 12 bp, Homo sapiens
gtacagtcccag

SEQ ID NO: 4334308 - DNA, 16 bp, Homo sapiens
gtacatacacacatac

SEQ ID NO: 4334309 - DNA, 14 bp, Homo sapiens
gtacatgaagaatg

SEQ ID NO: 4334310 - DNA, 18 bp, Homo sapiens
gtacatgaagaatgtagc

SEQ ID NO: 4334311 - DNA, 23 bp, Homo sapiens
gtaccagaagcaaggtctcagac

SEQ ID NO: 4334312 - DNA, 18 bp, Homo sapiens
gtacccagccatgtgttg

SEQ ID NO: 4334313 - DNA, 12 bp, Homo sapiens
gtacccccttct

SEQ ID NO: 4334314 - DNA, 15 bp, Homo sapiens
gtacccccttctggg

SEQ ID NO: 4334315 - DNA, 21 bp, Homo sapiens
gtacgatggaggcctacctct

SEQ ID NO: 4334316 - DNA, 11 bp, Homo sapiens
gtactctgtgt

SEQ ID NO: 4334317 - DNA, 17 bp, Homo sapiens
gtactctgtgtctggca

SEQ ID NO: 4334318 - DNA, 13 bp, Homo sapiens
gtactgtttacca

SEQ ID NO: 4334319 - DNA, 12 bp, Homo sapiens
gtacttaaatga

SEQ ID NO: 4334320 - DNA, 14 bp, Homo sapiens
gtacttaaatgagt

SEQ ID NO: 4334321 - DNA, 15 bp, Homo sapiens
ggagaggaagaaacg

SEQ ID NO: 4334322 - DNA, 22 bp, Homo sapiens
ggagccccagccccgtcccaga

SEQ ID NO: 4334323 - DNA, 21 bp, Homo sapiens
ggagcgtgggctcagcagggc

SEQ ID NO: 4334324 - DNA, 14 bp, Homo sapiens
ggagctcctggcag

SEQ ID NO: 4334325 - DNA, 12 bp, Homo sapiens
ggaggagactgg

SEQ ID NO: 4334326 - DNA, 18 bp, Homo sapiens
ggaggagggagagccctg

SEQ ID NO: 4334327 - DNA, 17 bp, Homo sapiens
ggaggatctcttgagcc

SEQ ID NO: 4334328 - DNA, 15 bp, Homo sapiens
ggaggcatctgcatg

SEQ ID NO: 4334329 - DNA, 17 bp, Homo sapiens
ggaggcatctgcatggg

SEQ ID NO: 4334330 - DNA, 18 bp, Homo sapiens
ggaggccaaggtgggagg

SEQ ID NO: 4334331 - DNA, 16 bp, Homo sapiens
ggaggcctacctctcg

SEQ ID NO: 4334332 - DNA, 17 bp, Homo sapiens
ggagggaaggggacaga

SEQ ID NO: 4334333 - DNA, 14 bp, Homo sapiens
ggagggagagccct

SEQ ID NO: 4334334 - DNA, 15 bp, Homo sapiens
ggagggagagccctg

SEQ ID NO: 4334335 - DNA, 18 bp, Homo sapiens
ggagggagagcctctgtt

SEQ ID NO: 4334336 - DNA, 13 bp, Homo sapiens
ggaggggcccctg

SEQ ID NO: 4334337 - DNA, 21 bp, Homo sapiens
ggaggggcccctgcttctcca

SEQ ID NO: 4334338 - DNA, 18 bp, Homo sapiens
ggaggggttgccacaggc

SEQ ID NO: 4334339 - DNA, 19 bp, Homo sapiens
ggaggggttgccacaggcc

SEQ ID NO: 4334340 - DNA, 21 bp, Homo sapiens
ggaggtgcctgaaagctggga

SEQ ID NO: 4334341 - DNA, 17 bp, Homo sapiens
ggaggtggtgaattttt

SEQ ID NO: 4334342 - DNA, 18 bp, Homo sapiens
ggaggttctgggcctctg

SEQ ID NO: 4334343 - DNA, 19 bp, Homo sapiens
ggaggttctgggcctctga

SEQ ID NO: 4334344 - DNA, 16 bp, Homo sapiens
ggagtctgaagcctgc

SEQ ID NO: 4334345 - DNA, 15 bp, Homo sapiens
ggagtgtttgaaaac

SEQ ID NO: 4334346 - DNA, 19 bp, Homo sapiens
ggagtgtttgaaaactgac

SEQ ID NO: 4334347 - DNA, 12 bp, Homo sapiens
ggatagaaaaaa

SEQ ID NO: 4334348 - DNA, 18 bp, Homo sapiens
ggatcaccccagccccca

SEQ ID NO: 4334349 - DNA, 15 bp, Homo sapiens
ggatcagaggtcatc

SEQ ID NO: 4334350 - DNA, 16 bp, Homo sapiens
ggatgacaaagaaaat

SEQ ID NO: 4334351 - DNA, 17 bp, Homo sapiens
ggatgacaaagaaaatg

SEQ ID NO: 4334352 - DNA, 13 bp, Homo sapiens
ggatgatggaaaa

SEQ ID NO: 4334353 - DNA, 11 bp, Homo sapiens
ggatgctgaag

SEQ ID NO: 4334354 - DNA, 21 bp, Homo sapiens
ggatgggaaataaagaaaatt

SEQ ID NO: 4334355 - DNA, 14 bp, Homo sapiens
ggatgggccaccgc

SEQ ID NO: 4334356 - DNA, 15 bp, Homo sapiens
ggatgtgaagaaata

SEQ ID NO: 4334357 - DNA, 22 bp, Homo sapiens
ggattcattctcataattccta

SEQ ID NO: 4334358 - DNA, 15 bp, Homo sapiens
ggcacccctgcctcc

SEQ ID NO: 4334359 - DNA, 22 bp, Homo sapiens
ggcactgtctgcgtgactattt

SEQ ID NO: 4334360 - DNA, 22 bp, Homo sapiens
ggcacttattgtaaattttaga

SEQ ID NO: 4334361 - DNA, 16 bp, Homo sapiens
ggcacttgattccttg

SEQ ID NO: 4334362 - DNA, 20 bp, Homo sapiens
ggcagaaagatttggaaaat

SEQ ID NO: 4334363 - DNA, 16 bp, Homo sapiens
ggcagaaatagttgtc

SEQ ID NO: 4334364 - DNA, 17 bp, Homo sapiens
ggcagaaatagttgtct

SEQ ID NO: 4334365 - DNA, 21 bp, Homo sapiens
ggcagaaatagttgtctgtgc

SEQ ID NO: 4334366 - DNA, 13 bp, Homo sapiens
ggcagctctgagc

SEQ ID NO: 4334367 - DNA, 18 bp, Homo sapiens
ggcaggaggatcacttga

SEQ ID NO: 4334368 - DNA, 22 bp, Homo sapiens
ggcaggtggagagagtggtaaa

SEQ ID NO: 4334369 - DNA, 20 bp, Homo sapiens
ggcatcactgattccctctc

SEQ ID NO: 4334370 - DNA, 16 bp, Homo sapiens
ggcatcatcctcagca

SEQ ID NO: 4334371 - DNA, 18 bp, Homo sapiens
ggcatcatcctcagcagc

SEQ ID NO: 4334372 - DNA, 13 bp, Homo sapiens
ggcatctgcatgg

SEQ ID NO: 4334373 - DNA, 17 bp, Homo sapiens
ggcatgagtctgtttcc

SEQ ID NO: 4334374 - DNA, 19 bp, Homo sapiens
ggcatgagtctgtttccca

SEQ ID NO: 4334375 - DNA, 22 bp, Homo sapiens
ggcatgagtctgtttcccaagc

SEQ ID NO: 4334376 - DNA, 13 bp, Homo sapiens
ggcatggagactc

SEQ ID NO: 4334377 - DNA, 14 bp, Homo sapiens
ggcatggagactct

SEQ ID NO: 4334378 - DNA, 18 bp, Homo sapiens
ggcatggagactctgaga

SEQ ID NO: 4334379 - DNA, 14 bp, Homo sapiens
ggcatgttcctctg

SEQ ID NO: 4334380 - DNA, 23 bp, Homo sapiens
ggcatgtttgtctgtgtgctgta

SEQ ID NO: 4334381 - DNA, 19 bp, Homo sapiens
ggcattctcggtacttctg

SEQ ID NO: 4334382 - DNA, 14 bp, Homo sapiens
ggcatttgctgaat

SEQ ID NO: 4334383 - DNA, 19 bp, Homo sapiens
ggccaaacatggccagact

SEQ ID NO: 4334384 - DNA, 13 bp, Homo sapiens
ggccaaggtggga

SEQ ID NO: 4334385 - DNA, 16 bp, Homo sapiens
ggccaatttactggcc

SEQ ID NO: 4334386 - DNA, 16 bp, Homo sapiens
ggccactgtgaagaga

SEQ ID NO: 4334387 - DNA, 19 bp, Homo sapiens
ggccagaaaaagaagaagg

SEQ ID NO: 4334388 - DNA, 13 bp, Homo sapiens
ggccaggagccct

SEQ ID NO: 4334389 - DNA, 19 bp, Homo sapiens
ggccatggtacccccttct

SEQ ID NO: 4334390 - DNA, 18 bp, Homo sapiens
ggcccctgagcccagaga

SEQ ID NO: 4334391 - DNA, 17 bp, Homo sapiens
ggccctcagctccctga

SEQ ID NO: 4334392 - DNA, 13 bp, Homo sapiens
ggccctcccaggc

SEQ ID NO: 4334393 - DNA, 22 bp, Homo sapiens
ggccctttcttgcactgtccag

SEQ ID NO: 4334394 - DNA, 13 bp, Homo sapiens
ggccgcagccaca

SEQ ID NO: 4334395 - DNA, 19 bp, Homo sapiens
ggccgggggcggggccggg

SEQ ID NO: 4334396 - DNA, 14 bp, Homo sapiens
ggccgtgcccttgc

SEQ ID NO: 4334397 - DNA, 12 bp, Homo sapiens
ggcctacctctc

SEQ ID NO: 4334398 - DNA, 17 bp, Homo sapiens
ggcctcggctgtctcct

SEQ ID NO: 4334399 - DNA, 20 bp, Homo sapiens
ggcctcggtgtggagaagcg

SEQ ID NO: 4334400 - DNA, 16 bp, Homo sapiens
ggcctctgccccaaga

SEQ ID NO: 4334401 - DNA, 19 bp, Homo sapiens
ggcctgactggttgtcaga

SEQ ID NO: 4334402 - DNA, 11 bp, Homo sapiens
ggcgaataaat

SEQ ID NO: 4334403 - DNA, 17 bp, Homo sapiens
ggcgaataaatgttcaa

SEQ ID NO: 4334404 - DNA, 18 bp, Homo sapiens
ggcgaataaatgttcaaa

SEQ ID NO: 4334405 - DNA, 20 bp, Homo sapiens
ggcgctgggtattggaaatg

SEQ ID NO: 4334406 - DNA, 17 bp, Homo sapiens
ggcggggccgggactgg

SEQ ID NO: 4334407 - DNA, 13 bp, Homo sapiens
ggcgggtggcgct

SEQ ID NO: 4334408 - DNA, 17 bp, Homo sapiens
ggctaatggagtgtttg

SEQ ID NO: 4334409 - DNA, 23 bp, Homo sapiens
ggctaatggagtgtttgaaaact

SEQ ID NO: 4334410 - DNA, 20 bp, Homo sapiens
ggctactctgcccaccccag

SEQ ID NO: 4334411 - DNA, 23 bp, Homo sapiens
ggctcagcaaaagatgcttctca

SEQ ID NO: 4334412 - DNA, 18 bp, Homo sapiens
ggctcagccacagcctga

SEQ ID NO: 4334413 - DNA, 19 bp, Homo sapiens
ggctccccagtgctcctgg

SEQ ID NO: 4334414 - DNA, 21 bp, Homo sapiens
ggctccccagtgctcctggcc

SEQ ID NO: 4334415 - DNA, 16 bp, Homo sapiens
ggctctctaagaaaag

SEQ ID NO: 4334416 - DNA, 19 bp, Homo sapiens
ggctctctaagaaaagaga

SEQ ID NO: 4334417 - DNA, 21 bp, Homo sapiens
ggctctctaagaaaagagagg

SEQ ID NO: 4334418 - DNA, 22 bp, Homo sapiens
ggctgccgggcgggtggcgctg

SEQ ID NO: 4334419 - DNA, 21 bp, Homo sapiens
ggctgcgaaaacgttgacccc

SEQ ID NO: 4334420 - DNA, 21 bp, Homo sapiens
ggctgcgtctggaggggcccc

SEQ ID NO: 4334421 - DNA, 17 bp, Homo sapiens
ggctggtcacctcccat

SEQ ID NO: 4334422 - DNA, 13 bp, Homo sapiens
ggctggtggcctt

SEQ ID NO: 4334423 - DNA, 19 bp, Homo sapiens
ggctgtctcctgtccccgg

SEQ ID NO: 4334424 - DNA, 21 bp, Homo sapiens
ggcttcacggaagagccttgc

SEQ ID NO: 4334425 - DNA, 19 bp, Homo sapiens
ggcttttcgcttgcttctg

SEQ ID NO: 4334426 - DNA, 22 bp, Homo sapiens
gggaaaaaactttgctccaggc

SEQ ID NO: 4334427 - DNA, 17 bp, Homo sapiens
gggaacagcctgagccg

SEQ ID NO: 4334428 - DNA, 18 bp, Homo sapiens
gggaagaagctctctcct

SEQ ID NO: 4334429 - DNA, 22 bp, Homo sapiens
gggaagctcccacacccacctc

SEQ ID NO: 4334430 - DNA, 13 bp, Homo sapiens
gggactgtatttc

SEQ ID NO: 4334431 - DNA, 16 bp, Homo sapiens
gggagaacatggccaa

SEQ ID NO: 4334432 - DNA, 12 bp, Homo sapiens
gggagagactcg

SEQ ID NO: 4334433 - DNA, 11 bp, Homo sapiens
gggagagccct

SEQ ID NO: 4334434 - DNA, 12 bp, Homo sapiens
gggagagccctg

SEQ ID NO: 4334435 - DNA, 12 bp, Homo sapiens
gggagcctcctg

SEQ ID NO: 4334436 - DNA, 21 bp, Homo sapiens
gggaggattgcttgagctcag

SEQ ID NO: 4334437 - DNA, 23 bp, Homo sapiens
gggaggattgcttgagctcagga

SEQ ID NO: 4334438 - DNA, 13 bp, Homo sapiens
gggagggaaaagg

SEQ ID NO: 4334439 - DNA, 16 bp, Homo sapiens
gggagggaggcatctg

SEQ ID NO: 4334440 - DNA, 14 bp, Homo sapiens
gggagggagtctgg

SEQ ID NO: 4334441 - DNA, 15 bp, Homo sapiens
gggagggagtctggg

SEQ ID NO: 4334442 - DNA, 22 bp, Homo sapiens
gctgagtgggggatcacagcct

SEQ ID NO: 4334443 - DNA, 18 bp, Homo sapiens
gctgatatgcaagtaaga

SEQ ID NO: 4334444 - DNA, 21 bp, Homo sapiens
gctgcaaacccatgaagctgg

SEQ ID NO: 4334445 - DNA, 13 bp, Homo sapiens
gctgcaccctcag

SEQ ID NO: 4334446 - DNA, 16 bp, Homo sapiens
gctgcaccctcaggca

SEQ ID NO: 4334447 - DNA, 14 bp, Homo sapiens
gctgcatgcctggt

SEQ ID NO: 4334448 - DNA, 18 bp, Homo sapiens
gctgcatgcctggtcttt

SEQ ID NO: 4334449 - DNA, 19 bp, Homo sapiens
gctgccgggagactgccag

SEQ ID NO: 4334450 - DNA, 22 bp, Homo sapiens
gctgcgtctggaggggcccctg

SEQ ID NO: 4334451 - DNA, 20 bp, Homo sapiens
gctgctaagctaaagaaact

SEQ ID NO: 4334452 - DNA, 15 bp, Homo sapiens
gctgctgttctgtgt

SEQ ID NO: 4334453 - DNA, 17 bp, Homo sapiens
gctgcttggagtgcccc

SEQ ID NO: 4334454 - DNA, 19 bp, Homo sapiens
gctgcttggagtgccccaa

SEQ ID NO: 4334455 - DNA, 21 bp, Homo sapiens
gctggccctcagctccctgac

SEQ ID NO: 4334456 - DNA, 22 bp, Homo sapiens
gctggctttttgtcaaataaaa

SEQ ID NO: 4334457 - DNA, 20 bp, Homo sapiens
gctgggaatacatctgtgga

SEQ ID NO: 4334458 - DNA, 20 bp, Homo sapiens
gctgggacctaatgctggcc

SEQ ID NO: 4334459 - DNA, 14 bp, Homo sapiens
gctgggcaggttgg

SEQ ID NO: 4334460 - DNA, 23 bp, Homo sapiens
gctgggtattggaaatggatgca

SEQ ID NO: 4334461 - DNA, 22 bp, Homo sapiens
gctgggtggcaccagcagcctg

SEQ ID NO: 4334462 - DNA, 15 bp, Homo sapiens
gctggtcacctccca

SEQ ID NO: 4334463 - DNA, 17 bp, Homo sapiens
gctggtcacctcccatc

SEQ ID NO: 4334464 - DNA, 20 bp, Homo sapiens
gctggtcacctcccatcccg

SEQ ID NO: 4334465 - DNA, 20 bp, Homo sapiens
gctggttgtaccctctccag

SEQ ID NO: 4334466 - DNA, 22 bp, Homo sapiens
gctgtatttctttgtagaataa

SEQ ID NO: 4334467 - DNA, 12 bp, Homo sapiens
gctgtctcctgt

SEQ ID NO: 4334468 - DNA, 20 bp, Homo sapiens
gctgtcttgatgactgctga

SEQ ID NO: 4334469 - DNA, 19 bp, Homo sapiens
gctgtgtagttccctctgc

SEQ ID NO: 4334470 - DNA, 15 bp, Homo sapiens
gctgttactgcttct

SEQ ID NO: 4334471 - DNA, 15 bp, Homo sapiens
gctgttgtttctata

SEQ ID NO: 4334472 - DNA, 20 bp, Homo sapiens
gctgttgtttctataaatga

SEQ ID NO: 4334473 - DNA, 21 bp, Homo sapiens
gctgttgtttctataaatgac

SEQ ID NO: 4334474 - DNA, 22 bp, Homo sapiens
gctgttgtttctataaatgact

SEQ ID NO: 4334475 - DNA, 17 bp, Homo sapiens
gctgtttatgtttttat

SEQ ID NO: 4334476 - DNA, 11 bp, Homo sapiens
gcttaaagctt

SEQ ID NO: 4334477 - DNA, 14 bp, Homo sapiens
gcttactgaaagac

SEQ ID NO: 4334478 - DNA, 15 bp, Homo sapiens
gcttactgaaagaca

SEQ ID NO: 4334479 - DNA, 16 bp, Homo sapiens
gcttagtgaaaatact

SEQ ID NO: 4334480 - DNA, 17 bp, Homo sapiens
gcttattgcttagtaaa

SEQ ID NO: 4334481 - DNA, 15 bp, Homo sapiens
gcttatttttatgtg

SEQ ID NO: 4334482 - DNA, 21 bp, Homo sapiens
gcttcaaggatatactgcagc

SEQ ID NO: 4334483 - DNA, 12 bp, Homo sapiens
gcttcacatttg

SEQ ID NO: 4334484 - DNA, 15 bp, Homo sapiens
gcttcacggaagagc

SEQ ID NO: 4334485 - DNA, 16 bp, Homo sapiens
gcttcactcatgcaaa

SEQ ID NO: 4334486 - DNA, 21 bp, Homo sapiens
gcttcactcatgcaaactgct

SEQ ID NO: 4334487 - DNA, 22 bp, Homo sapiens
gcttcactcatgcaaactgctt

SEQ ID NO: 4334488 - DNA, 18 bp, Homo sapiens
gcttcagagtttgtgtgt

SEQ ID NO: 4334489 - DNA, 20 bp, Homo sapiens
gcttcagagtttgtgtgtat

SEQ ID NO: 4334490 - DNA, 16 bp, Homo sapiens
gcttcaggtctctgtg

SEQ ID NO: 4334491 - DNA, 17 bp, Homo sapiens
gcttctagacactcctt

SEQ ID NO: 4334492 - DNA, 17 bp, Homo sapiens
gcttctcactgccatgc

SEQ ID NO: 4334493 - DNA, 13 bp, Homo sapiens
gcttctccccaga

SEQ ID NO: 4334494 - DNA, 14 bp, Homo sapiens
gcttctctttgtgc

SEQ ID NO: 4334495 - DNA, 12 bp, Homo sapiens
gcttctgcagca

SEQ ID NO: 4334496 - DNA, 20 bp, Homo sapiens
gcttgagctttctgtgcatg

SEQ ID NO: 4334497 - DNA, 23 bp, Homo sapiens
gcttgagctttctgtgcatgtgc

SEQ ID NO: 4334498 - DNA, 23 bp, Homo sapiens
gcttgatttgatctttgtttaaa

SEQ ID NO: 4334499 - DNA, 13 bp, Homo sapiens
gcttgcttctgca

SEQ ID NO: 4334500 - DNA, 20 bp, Homo sapiens
gcttgggtcctactcctgga

SEQ ID NO: 4334501 - DNA, 13 bp, Homo sapiens
gctttactgcctt

SEQ ID NO: 4334502 - DNA, 14 bp, Homo sapiens
gctttatctttgtg

SEQ ID NO: 4334503 - DNA, 19 bp, Homo sapiens
gctttctttgattctcctt

SEQ ID NO: 4334504 - DNA, 17 bp, Homo sapiens
gctttgagaccagaaga

SEQ ID NO: 4334505 - DNA, 18 bp, Homo sapiens
gctttgagaccagaagaa

SEQ ID NO: 4334506 - DNA, 22 bp, Homo sapiens
gctttgcccaacaccagcccct

SEQ ID NO: 4334507 - DNA, 15 bp, Homo sapiens
gctttgtctgtccag

SEQ ID NO: 4334508 - DNA, 14 bp, Homo sapiens
gcttttattgcacc

SEQ ID NO: 4334509 - DNA, 19 bp, Homo sapiens
ggaaaaaactttgctccag

SEQ ID NO: 4334510 - DNA, 16 bp, Homo sapiens
ggaaaaagcacaagaa

SEQ ID NO: 4334511 - DNA, 13 bp, Homo sapiens
ggaaaaatagcct

SEQ ID NO: 4334512 - DNA, 23 bp, Homo sapiens
ggaaaaggatgatggaaaaatca

SEQ ID NO: 4334513 - DNA, 12 bp, Homo sapiens
ggaaaagggaag

SEQ ID NO: 4334514 - DNA, 23 bp, Homo sapiens
ggaaaatcagcctgctccagctg

SEQ ID NO: 4334515 - DNA, 22 bp, Homo sapiens
ggaaaatcatattgagaataat

SEQ ID NO: 4334516 - DNA, 15 bp, Homo sapiens
ggaaacatagaaaga

SEQ ID NO: 4334517 - DNA, 16 bp, Homo sapiens
ggaaacatagaaagac

SEQ ID NO: 4334518 - DNA, 21 bp, Homo sapiens
ggaaagaggaggcagaaagat

SEQ ID NO: 4334519 - DNA, 16 bp, Homo sapiens
ggaaataaagaaaatt

SEQ ID NO: 4334520 - DNA, 15 bp, Homo sapiens
ggaaatgttaagaaa

SEQ ID NO: 4334521 - DNA, 16 bp, Homo sapiens
ggaacagcctgagccg

SEQ ID NO: 4334522 - DNA, 17 bp, Homo sapiens
ggaacccccaaatttaa

SEQ ID NO: 4334523 - DNA, 15 bp, Homo sapiens
ggaagaaccagaagt

SEQ ID NO: 4334524 - DNA, 16 bp, Homo sapiens
ggaagacaatgtgaaa

SEQ ID NO: 4334525 - DNA, 19 bp, Homo sapiens
ggaagatgggggcaagaag

SEQ ID NO: 4334526 - DNA, 20 bp, Homo sapiens
ggaagatgggggcaagaaga

SEQ ID NO: 4334527 - DNA, 13 bp, Homo sapiens
ggaagatgttcaa

SEQ ID NO: 4334528 - DNA, 14 bp, Homo sapiens
ggaagatttgaaaa

SEQ ID NO: 4334529 - DNA, 19 bp, Homo sapiens
ggaaggaaacatagaaaga

SEQ ID NO: 4334530 - DNA, 21 bp, Homo sapiens
ggaaggaaacatagaaagaca

SEQ ID NO: 4334531 - DNA, 21 bp, Homo sapiens
ggaaggagaaggagtgccata

SEQ ID NO: 4334532 - DNA, 18 bp, Homo sapiens
ggaagggccaatggagaa

SEQ ID NO: 4334533 - DNA, 19 bp, Homo sapiens
ggaagggcgggcaaggagt

SEQ ID NO: 4334534 - DNA, 19 bp, Homo sapiens
ggaaggtcccttgtttcca

SEQ ID NO: 4334535 - DNA, 18 bp, Homo sapiens
ggaagtttcatatattgt

SEQ ID NO: 4334536 - DNA, 21 bp, Homo sapiens
ggacaaaaagaccttctccct

SEQ ID NO: 4334537 - DNA, 18 bp, Homo sapiens
ggacagacactgttgcaa

SEQ ID NO: 4334538 - DNA, 11 bp, Homo sapiens
ggacagagccc

SEQ ID NO: 4334539 - DNA, 13 bp, Homo sapiens
ggacagagcccgg

SEQ ID NO: 4334540 - DNA, 22 bp, Homo sapiens
ggacagagcccgggagagactc

SEQ ID NO: 4334541 - DNA, 23 bp, Homo sapiens
ggacatagaggtatattggaaga

SEQ ID NO: 4334542 - DNA, 20 bp, Homo sapiens
ggacatgagactaagagaaa

SEQ ID NO: 4334543 - DNA, 23 bp, Homo sapiens
ggacctcaggtgagaagcagagg

SEQ ID NO: 4334544 - DNA, 23 bp, Homo sapiens
ggactctgaactggagctgctaa

SEQ ID NO: 4334545 - DNA, 13 bp, Homo sapiens
ggactctgtgtga

SEQ ID NO: 4334546 - DNA, 14 bp, Homo sapiens
ggactgaagctggg

SEQ ID NO: 4334547 - DNA, 10 bp, Homo sapiens
ggactggggg

SEQ ID NO: 4334548 - DNA, 18 bp, Homo sapiens
ggactgtatttctgtgga

SEQ ID NO: 4334549 - DNA, 14 bp, Homo sapiens
ggactgtctgatca

SEQ ID NO: 4334550 - DNA, 14 bp, Homo sapiens
ggagaaactgaagc

SEQ ID NO: 4334551 - DNA, 23 bp, Homo sapiens
ggagaaaggggtgattgaaagaa

SEQ ID NO: 4334552 - DNA, 14 bp, Homo sapiens
ggagaaatgaagca

SEQ ID NO: 4334553 - DNA, 13 bp, Homo sapiens
ggagaaatgccag

SEQ ID NO: 4334554 - DNA, 19 bp, Homo sapiens
ggagaactcagtgccacac

SEQ ID NO: 4334555 - DNA, 19 bp, Homo sapiens
ggagacagagatgtgcaga

SEQ ID NO: 4334556 - DNA, 14 bp, Homo sapiens
ggagacccacagcc

SEQ ID NO: 4334557 - DNA, 18 bp, Homo sapiens
ggagacccacagccctga

SEQ ID NO: 4334558 - DNA, 21 bp, Homo sapiens
ggagacccacagccctgaaac

SEQ ID NO: 4334559 - DNA, 17 bp, Homo sapiens
ggagagagggtctccag

SEQ ID NO: 4334560 - DNA, 11 bp, Homo sapiens
ggagagccctg

SEQ ID NO: 4334561 - DNA, 17 bp, Homo sapiens
ggagagctagcagcagg

SEQ ID NO: 4334562 - DNA, 18 bp, Homo sapiens
gccctgaaacgagaagtg

SEQ ID NO: 4334563 - DNA, 22 bp, Homo sapiens
gccctgaaacgagaagtgccct

SEQ ID NO: 4334564 - DNA, 14 bp, Homo sapiens
gccctgagctttct

SEQ ID NO: 4334565 - DNA, 16 bp, Homo sapiens
gccctgagctttctgc

SEQ ID NO: 4334566 - DNA, 15 bp, Homo sapiens
gccctgcccttccct

SEQ ID NO: 4334567 - DNA, 18 bp, Homo sapiens
gcccttaaggatcacccc

SEQ ID NO: 4334568 - DNA, 21 bp, Homo sapiens
gcccttaaggatcaccccagc

SEQ ID NO: 4334569 - DNA, 23 bp, Homo sapiens
gcccttccccctttctctgcctg

SEQ ID NO: 4334570 - DNA, 18 bp, Homo sapiens
gcccttctaccccacctg

SEQ ID NO: 4334571 - DNA, 20 bp, Homo sapiens
gcccttgcccttggagctgc

SEQ ID NO: 4334572 - DNA, 20 bp, Homo sapiens
gccctttcttgcactgtcca

SEQ ID NO: 4334573 - DNA, 22 bp, Homo sapiens
gccctttcttgcactgtccagc

SEQ ID NO: 4334574 - DNA, 21 bp, Homo sapiens
gccgagtccgggccggggcct

SEQ ID NO: 4334575 - DNA, 16 bp, Homo sapiens
gccgctcggaggcccc

SEQ ID NO: 4334576 - DNA, 21 bp, Homo sapiens
gccgctcggaggccccaaagg

SEQ ID NO: 4334577 - DNA, 14 bp, Homo sapiens
gccgctgcccctga

SEQ ID NO: 4334578 - DNA, 17 bp, Homo sapiens
gccggagacccacagcc

SEQ ID NO: 4334579 - DNA, 20 bp, Homo sapiens
gccggagacccacagccctg

SEQ ID NO: 4334580 - DNA, 13 bp, Homo sapiens
gccggaggaaccg

SEQ ID NO: 4334581 - DNA, 19 bp, Homo sapiens
gccgggagactgccagtgg

SEQ ID NO: 4334582 - DNA, 21 bp, Homo sapiens
gccgggagactgccagtggag

SEQ ID NO: 4334583 - DNA, 19 bp, Homo sapiens
gcctactaagtacccttgg

SEQ ID NO: 4334584 - DNA, 21 bp, Homo sapiens
gcctcccgccaccctgtctca

SEQ ID NO: 4334585 - DNA, 16 bp, Homo sapiens
gcctcccttttctcct

SEQ ID NO: 4334586 - DNA, 12 bp, Homo sapiens
gcctcctgccca

SEQ ID NO: 4334587 - DNA, 18 bp, Homo sapiens
gcctcgacgtcccttgga

SEQ ID NO: 4334588 - DNA, 15 bp, Homo sapiens
gcctcggctgtctcc

SEQ ID NO: 4334589 - DNA, 17 bp, Homo sapiens
gcctctgccccaagagc

SEQ ID NO: 4334590 - DNA, 23 bp, Homo sapiens
gcctcttctctactctagggaaa

SEQ ID NO: 4334591 - DNA, 14 bp, Homo sapiens
gcctgcccttgtct

SEQ ID NO: 4334592 - DNA, 15 bp, Homo sapiens
gcctgctccagctgt

SEQ ID NO: 4334593 - DNA, 16 bp, Homo sapiens
gcctgctgggtgccag

SEQ ID NO: 4334594 - DNA, 14 bp, Homo sapiens
gcctggaccctgtg

SEQ ID NO: 4334595 - DNA, 9 bp, Homo sapiens
gcctggcaa

SEQ ID NO: 4334596 - DNA, 17 bp, Homo sapiens
gcctggcggaggtggag

SEQ ID NO: 4334597 - DNA, 19 bp, Homo sapiens
gcctggctggagagctgct

SEQ ID NO: 4334598 - DNA, 16 bp, Homo sapiens
gcctgggatgcccttc

SEQ ID NO: 4334599 - DNA, 19 bp, Homo sapiens
gcctgggatgcccttcccc

SEQ ID NO: 4334600 - DNA, 15 bp, Homo sapiens
gcctggttcgtgcca

SEQ ID NO: 4334601 - DNA, 20 bp, Homo sapiens
gcctgtaatcctagcacttt

SEQ ID NO: 4334602 - DNA, 22 bp, Homo sapiens
gcctgttcccactcagcagtga

SEQ ID NO: 4334603 - DNA, 15 bp, Homo sapiens
gcctgttttgagacc

SEQ ID NO: 4334604 - DNA, 21 bp, Homo sapiens
gcctgttttgagaccagaagg

SEQ ID NO: 4334605 - DNA, 15 bp, Homo sapiens
gccttactcacctct

SEQ ID NO: 4334606 - DNA, 19 bp, Homo sapiens
gccttagagcatctctgcc

SEQ ID NO: 4334607 - DNA, 23 bp, Homo sapiens
gccttatgtgttacattattcca

SEQ ID NO: 4334608 - DNA, 13 bp, Homo sapiens
gccttgggccttg

SEQ ID NO: 4334609 - DNA, 24 bp, Homo sapiens
gccttggggctcagccacagcctg

SEQ ID NO: 4334610 - DNA, 21 bp, Homo sapiens
gcgaaaacgttgacccctttc

SEQ ID NO: 4334611 - DNA, 17 bp, Homo sapiens
gcgaaacccccttttcc

SEQ ID NO: 4334612 - DNA, 21 bp, Homo sapiens
gcgaaacccccttttcccttc

SEQ ID NO: 4334613 - DNA, 22 bp, Homo sapiens
gcgaaacccggtgcatctggca

SEQ ID NO: 4334614 - DNA, 14 bp, Homo sapiens
gcgaataaatgttc

SEQ ID NO: 4334615 - DNA, 18 bp, Homo sapiens
gcgagaactacgcacagc

SEQ ID NO: 4334616 - DNA, 13 bp, Homo sapiens
gcgctgttgcccg

SEQ ID NO: 4334617 - DNA, 16 bp, Homo sapiens
gcgctttcccctcctc

SEQ ID NO: 4334618 - DNA, 22 bp, Homo sapiens
gcggaggtggagtggccactgg

SEQ ID NO: 4334619 - DNA, 16 bp, Homo sapiens
gcggcctttggcttca

SEQ ID NO: 4334620 - DNA, 15 bp, Homo sapiens
gcgggatgggccacc

SEQ ID NO: 4334621 - DNA, 14 bp, Homo sapiens
gcggggtgcctgct

SEQ ID NO: 4334622 - DNA, 16 bp, Homo sapiens
gcgggtgatgagacct

SEQ ID NO: 4334623 - DNA, 22 bp, Homo sapiens
gctaaattataaaattgaaaac

SEQ ID NO: 4334624 - DNA, 23 bp, Homo sapiens
gctaaattataaaattgaaaaca

SEQ ID NO: 4334625 - DNA, 16 bp, Homo sapiens
gctaagctaaagaaac

SEQ ID NO: 4334626 - DNA, 21 bp, Homo sapiens
gctaagctaaagaaactgctt

SEQ ID NO: 4334627 - DNA, 14 bp, Homo sapiens
gctaagctgccctg

SEQ ID NO: 4334628 - DNA, 13 bp, Homo sapiens
gctaatatacttt

SEQ ID NO: 4334629 - DNA, 14 bp, Homo sapiens
gctaatatactttt

SEQ ID NO: 4334630 - DNA, 19 bp, Homo sapiens
gctaatggagtgtttgaaa

SEQ ID NO: 4334631 - DNA, 22 bp, Homo sapiens
gctaatggagtgtttgaaaact

SEQ ID NO: 4334632 - DNA, 15 bp, Homo sapiens
gctacacatatgtgc

SEQ ID NO: 4334633 - DNA, 14 bp, Homo sapiens
gctacccagaacct

SEQ ID NO: 4334634 - DNA, 17 bp, Homo sapiens
gctacctgcacctctgg

SEQ ID NO: 4334635 - DNA, 20 bp, Homo sapiens
gctacggggaaaatgcattt

SEQ ID NO: 4334636 - DNA, 13 bp, Homo sapiens
gctactctgccca

SEQ ID NO: 4334637 - DNA, 12 bp, Homo sapiens
gctagactgtgt

SEQ ID NO: 4334638 - DNA, 15 bp, Homo sapiens
gctagactgtgtctg

SEQ ID NO: 4334639 - DNA, 17 bp, Homo sapiens
gctagactgtgtctgaa

SEQ ID NO: 4334640 - DNA, 22 bp, Homo sapiens
gctagtcaactggggaaaagga

SEQ ID NO: 4334641 - DNA, 18 bp, Homo sapiens
gctagtgccaaataattg

SEQ ID NO: 4334642 - DNA, 14 bp, Homo sapiens
gctatagtgaagaa

SEQ ID NO: 4334643 - DNA, 15 bp, Homo sapiens
gctatagtgaagaat

SEQ ID NO: 4334644 - DNA, 18 bp, Homo sapiens
gctatatttttaaagaag

SEQ ID NO: 4334645 - DNA, 20 bp, Homo sapiens
gctatcctgctgaaagtcct

SEQ ID NO: 4334646 - DNA, 18 bp, Homo sapiens
gctattttttttaaatca

SEQ ID NO: 4334647 - DNA, 19 bp, Homo sapiens
gctattttttttaaatcaa

SEQ ID NO: 4334648 - DNA, 20 bp, Homo sapiens
gctattttttttaaatcaaa

SEQ ID NO: 4334649 - DNA, 19 bp, Homo sapiens
gctcaagcaggaagttcaa

SEQ ID NO: 4334650 - DNA, 13 bp, Homo sapiens
gctcaaggctgtg

SEQ ID NO: 4334651 - DNA, 23 bp, Homo sapiens
gctcagcaaaagatgcttctcac

SEQ ID NO: 4334652 - DNA, 15 bp, Homo sapiens
gctcagccacagcct

SEQ ID NO: 4334653 - DNA, 22 bp, Homo sapiens
gctcaggaggcgaataaatgtt

SEQ ID NO: 4334654 - DNA, 23 bp, Homo sapiens
gctcaggaggcgaataaatgttc

SEQ ID NO: 4334655 - DNA, 15 bp, Homo sapiens
gctcatgtatattta

SEQ ID NO: 4334656 - DNA, 22 bp, Homo sapiens
gctccagacgtaggggaggggt

SEQ ID NO: 4334657 - DNA, 22 bp, Homo sapiens
gctcccacacccacctctgcca

SEQ ID NO: 4334658 - DNA, 23 bp, Homo sapiens
gctcccacacccacctctgccac

SEQ ID NO: 4334659 - DNA, 9 bp, Homo sapiens
gctcccagc

SEQ ID NO: 4334660 - DNA, 18 bp, Homo sapiens
gctcccagctctctctcc

SEQ ID NO: 4334661 - DNA, 14 bp, Homo sapiens
gctcccccaggcag

SEQ ID NO: 4334662 - DNA, 13 bp, Homo sapiens
gctccccctgtcc

SEQ ID NO: 4334663 - DNA, 16 bp, Homo sapiens
gctccccgcctgttcc

SEQ ID NO: 4334664 - DNA, 20 bp, Homo sapiens
gctccccgcctgttcccccg

SEQ ID NO: 4334665 - DNA, 23 bp, Homo sapiens
gctccctctctccacacggagct

SEQ ID NO: 4334666 - DNA, 19 bp, Homo sapiens
gctccctgaccccctgtcc

SEQ ID NO: 4334667 - DNA, 15 bp, Homo sapiens
gctcctggcccactg

SEQ ID NO: 4334668 - DNA, 20 bp, Homo sapiens
gctcgatccaaattgtgctt

SEQ ID NO: 4334669 - DNA, 15 bp, Homo sapiens
gctcgatgactgtga

SEQ ID NO: 4334670 - DNA, 14 bp, Homo sapiens
gctctctctcctgg

SEQ ID NO: 4334671 - DNA, 18 bp, Homo sapiens
gctctcttttctgtactt

SEQ ID NO: 4334672 - DNA, 19 bp, Homo sapiens
gctctcttttctgtacttc

SEQ ID NO: 4334673 - DNA, 21 bp, Homo sapiens
gctctggaggagcaagggggc

SEQ ID NO: 4334674 - DNA, 16 bp, Homo sapiens
gctgaaagtcctgctt

SEQ ID NO: 4334675 - DNA, 17 bp, Homo sapiens
gctgaaagtcctgcttt

SEQ ID NO: 4334676 - DNA, 14 bp, Homo sapiens
gctgaattgagaat

SEQ ID NO: 4334677 - DNA, 15 bp, Homo sapiens
gctgacggtttctcc

SEQ ID NO: 4334678 - DNA, 19 bp, Homo sapiens
gctgacggtttctccccgg

SEQ ID NO: 4334679 - DNA, 14 bp, Homo sapiens
gctgagcctgccca

SEQ ID NO: 4334680 - DNA, 14 bp, Homo sapiens
gctgagctgaagaa

SEQ ID NO: 4334681 - DNA, 14 bp, Homo sapiens
gctgaggtgggagg

SEQ ID NO: 4334682 - DNA, 21 bp, Homo sapiens
gcagaaatagttgtctgtgct

SEQ ID NO: 4334683 - DNA, 22 bp, Homo sapiens
gcagaaatagttgtctgtgctt

SEQ ID NO: 4334684 - DNA, 13 bp, Homo sapiens
gcagaatgttttt

SEQ ID NO: 4334685 - DNA, 14 bp, Homo sapiens
gcagaggaaggaaa

SEQ ID NO: 4334686 - DNA, 14 bp, Homo sapiens
gcagagttgaccag

SEQ ID NO: 4334687 - DNA, 18 bp, Homo sapiens
gcagatgtttaatgaagt

SEQ ID NO: 4334688 - DNA, 15 bp, Homo sapiens
gcagcaactcccacg

SEQ ID NO: 4334689 - DNA, 16 bp, Homo sapiens
gcagcaactcccacga

SEQ ID NO: 4334690 - DNA, 16 bp, Homo sapiens
gcagccacaccgctgg

SEQ ID NO: 4334691 - DNA, 14 bp, Homo sapiens
gcagctctgagccg

SEQ ID NO: 4334692 - DNA, 23 bp, Homo sapiens
gcagctttactgccttcctcctt

SEQ ID NO: 4334693 - DNA, 23 bp, Homo sapiens
gcaggaggatcacttgagtccag

SEQ ID NO: 4334694 - DNA, 17 bp, Homo sapiens
gcaggatgccctgttgg

SEQ ID NO: 4334695 - DNA, 16 bp, Homo sapiens
gcaggctactctgccc

SEQ ID NO: 4334696 - DNA, 13 bp, Homo sapiens
gcagggcctggcg

SEQ ID NO: 4334697 - DNA, 20 bp, Homo sapiens
gcagggctggtcacctccca

SEQ ID NO: 4334698 - DNA, 15 bp, Homo sapiens
gcagtcatcaacaaa

SEQ ID NO: 4334699 - DNA, 12 bp, Homo sapiens
gcagtgagagtt

SEQ ID NO: 4334700 - DNA, 14 bp, Homo sapiens
gcagttctctgcca

SEQ ID NO: 4334701 - DNA, 22 bp, Homo sapiens
gcagtttcatgtatgtatataa

SEQ ID NO: 4334702 - DNA, 15 bp, Homo sapiens
gcataaaaattagcc

SEQ ID NO: 4334703 - DNA, 12 bp, Homo sapiens
gcataaaattct

SEQ ID NO: 4334704 - DNA, 15 bp, Homo sapiens
gcataatttgtctta

SEQ ID NO: 4334705 - DNA, 18 bp, Homo sapiens
gcatccacttcaggagcc

SEQ ID NO: 4334706 - DNA, 20 bp, Homo sapiens
gcatctagtttccctggtgc

SEQ ID NO: 4334707 - DNA, 20 bp, Homo sapiens
gcatctggcacgtggccagg

SEQ ID NO: 4334708 - DNA, 22 bp, Homo sapiens
gcatctggcacgtggccaggag

SEQ ID NO: 4334709 - DNA, 13 bp, Homo sapiens
gcatctgttctgg

SEQ ID NO: 4334710 - DNA, 15 bp, Homo sapiens
gcatgagattttgga

SEQ ID NO: 4334711 - DNA, 16 bp, Homo sapiens
gcatggagactctgag

SEQ ID NO: 4334712 - DNA, 13 bp, Homo sapiens
gcatggggcccct

SEQ ID NO: 4334713 - DNA, 22 bp, Homo sapiens
gcatggggcccctggcccagag

SEQ ID NO: 4334714 - DNA, 22 bp, Homo sapiens
gcatggttcattttctgatgcc

SEQ ID NO: 4334715 - DNA, 12 bp, Homo sapiens
gcatgtgcaggt

SEQ ID NO: 4334716 - DNA, 16 bp, Homo sapiens
gcattaactaaatgct

SEQ ID NO: 4334717 - DNA, 17 bp, Homo sapiens
gcattaactaaatgctc

SEQ ID NO: 4334718 - DNA, 18 bp, Homo sapiens
gcattaactaaatgctca

SEQ ID NO: 4334719 - DNA, 16 bp, Homo sapiens
gcattcattctgagcc

SEQ ID NO: 4334720 - DNA, 12 bp, Homo sapiens
gcattctttccc

SEQ ID NO: 4334721 - DNA, 20 bp, Homo sapiens
gcattgagaaggaactgata

SEQ ID NO: 4334722 - DNA, 16 bp, Homo sapiens
gcattggcccctgagc

SEQ ID NO: 4334723 - DNA, 22 bp, Homo sapiens
gcattggcccctgagcccagag

SEQ ID NO: 4334724 - DNA, 19 bp, Homo sapiens
gcatttagagcttttcaga

SEQ ID NO: 4334725 - DNA, 15 bp, Homo sapiens
gcatttatttctctg

SEQ ID NO: 4334726 - DNA, 19 bp, Homo sapiens
gcatttttccatctgtgtg

SEQ ID NO: 4334727 - DNA, 18 bp, Homo sapiens
gccaaaatgttggctgcg

SEQ ID NO: 4334728 - DNA, 19 bp, Homo sapiens
gccaaagcctcctccagcc

SEQ ID NO: 4334729 - DNA, 23 bp, Homo sapiens
gccaaaggaccgttttgtattgc

SEQ ID NO: 4334730 - DNA, 14 bp, Homo sapiens
gccaaggccggaga

SEQ ID NO: 4334731 - DNA, 14 bp, Homo sapiens
gccaaggtgggagg

SEQ ID NO: 4334732 - DNA, 15 bp, Homo sapiens
gccaaggtgggagga

SEQ ID NO: 4334733 - DNA, 17 bp, Homo sapiens
gccaatttactggccac

SEQ ID NO: 4334734 - DNA, 12 bp, Homo sapiens
gccacaggcctc

SEQ ID NO: 4334735 - DNA, 21 bp, Homo sapiens
gccaccagggcactgtctgcg

SEQ ID NO: 4334736 - DNA, 16 bp, Homo sapiens
gccaccattcctggaa

SEQ ID NO: 4334737 - DNA, 22 bp, Homo sapiens
gccaccttgttacaaatttttt

SEQ ID NO: 4334738 - DNA, 15 bp, Homo sapiens
gccactggcacttgc

SEQ ID NO: 4334739 - DNA, 14 bp, Homo sapiens
gccagaaaaagaag

SEQ ID NO: 4334740 - DNA, 17 bp, Homo sapiens
gccagaaaaagaagaag

SEQ ID NO: 4334741 - DNA, 14 bp, Homo sapiens
gccagactcccttg

SEQ ID NO: 4334742 - DNA, 13 bp, Homo sapiens
gccaggagccctg

SEQ ID NO: 4334743 - DNA, 14 bp, Homo sapiens
gccaggagccctgg

SEQ ID NO: 4334744 - DNA, 21 bp, Homo sapiens
gccaggggaaaatcagcctgc

SEQ ID NO: 4334745 - DNA, 23 bp, Homo sapiens
gccaggggaaaatcagcctgctc

SEQ ID NO: 4334746 - DNA, 13 bp, Homo sapiens
gccagtggagacg

SEQ ID NO: 4334747 - DNA, 14 bp, Homo sapiens
gccataccttctcc

SEQ ID NO: 4334748 - DNA, 16 bp, Homo sapiens
gccatatatgctgtat

SEQ ID NO: 4334749 - DNA, 21 bp, Homo sapiens
gccatctgtgcacactaagaa

SEQ ID NO: 4334750 - DNA, 13 bp, Homo sapiens
gccatgccagctt

SEQ ID NO: 4334751 - DNA, 24 bp, Homo sapiens
gccatgctcctggcccactgcatc

SEQ ID NO: 4334752 - DNA, 14 bp, Homo sapiens
gccatggtaccccc

SEQ ID NO: 4334753 - DNA, 23 bp, Homo sapiens
gccattaaatgaatattttgata

SEQ ID NO: 4334754 - DNA, 15 bp, Homo sapiens
gccattcctgttctc

SEQ ID NO: 4334755 - DNA, 17 bp, Homo sapiens
gcccaacaccagcccct

SEQ ID NO: 4334756 - DNA, 23 bp, Homo sapiens
gcccacaagccttactcacctct

SEQ ID NO: 4334757 - DNA, 15 bp, Homo sapiens
gcccaccgaggagcc

SEQ ID NO: 4334758 - DNA, 17 bp, Homo sapiens
gcccaccgaggagcccc

SEQ ID NO: 4334759 - DNA, 21 bp, Homo sapiens
gcccaccgaggagccccagcc

SEQ ID NO: 4334760 - DNA, 23 bp, Homo sapiens
gcccaccgaggagccccagcccc

SEQ ID NO: 4334761 - DNA, 18 bp, Homo sapiens
gcccagaagaaaattctc

SEQ ID NO: 4334762 - DNA, 21 bp, Homo sapiens
gcccagaagaaaattctcctg

SEQ ID NO: 4334763 - DNA, 21 bp, Homo sapiens
gcccagccctctgtggccagg

SEQ ID NO: 4334764 - DNA, 15 bp, Homo sapiens
gcccagtcccccaac

SEQ ID NO: 4334765 - DNA, 18 bp, Homo sapiens
gcccagttggaaaattcc

SEQ ID NO: 4334766 - DNA, 16 bp, Homo sapiens
gcccagttggaggaga

SEQ ID NO: 4334767 - DNA, 14 bp, Homo sapiens
gcccatttttgcta

SEQ ID NO: 4334768 - DNA, 17 bp, Homo sapiens
gccccaatccagagaag

SEQ ID NO: 4334769 - DNA, 23 bp, Homo sapiens
gccccaatccagagaagcgctgt

SEQ ID NO: 4334770 - DNA, 13 bp, Homo sapiens
gccccacccagag

SEQ ID NO: 4334771 - DNA, 14 bp, Homo sapiens
gccccacccagagg

SEQ ID NO: 4334772 - DNA, 21 bp, Homo sapiens
gccccacccagaggtggccct

SEQ ID NO: 4334773 - DNA, 15 bp, Homo sapiens
gccccagcccaagtc

SEQ ID NO: 4334774 - DNA, 12 bp, Homo sapiens
gccccagccccg

SEQ ID NO: 4334775 - DNA, 11 bp, Homo sapiens
gcccccacagc

SEQ ID NO: 4334776 - DNA, 13 bp, Homo sapiens
gcccccacagccc

SEQ ID NO: 4334777 - DNA, 18 bp, Homo sapiens
gcccccacagccctggaa

SEQ ID NO: 4334778 - DNA, 11 bp, Homo sapiens
gccccctgaaa

SEQ ID NO: 4334779 - DNA, 12 bp, Homo sapiens
gccccctgaaac

SEQ ID NO: 4334780 - DNA, 23 bp, Homo sapiens
gccccctgaaacatgtgcccctg

SEQ ID NO: 4334781 - DNA, 16 bp, Homo sapiens
gccccgtcccagaggc

SEQ ID NO: 4334782 - DNA, 15 bp, Homo sapiens
gcccctctcacaggc

SEQ ID NO: 4334783 - DNA, 19 bp, Homo sapiens
gcccctctcacaggcagct

SEQ ID NO: 4334784 - DNA, 20 bp, Homo sapiens
gcccctgccaaggccggaga

SEQ ID NO: 4334785 - DNA, 15 bp, Homo sapiens
gcccctgcttctcca

SEQ ID NO: 4334786 - DNA, 15 bp, Homo sapiens
gcccctggcccagag

SEQ ID NO: 4334787 - DNA, 22 bp, Homo sapiens
gcccgagctgtttatgttttta

SEQ ID NO: 4334788 - DNA, 16 bp, Homo sapiens
gcccgcaagagggaca

SEQ ID NO: 4334789 - DNA, 20 bp, Homo sapiens
gcccgcaagagggacagagc

SEQ ID NO: 4334790 - DNA, 21 bp, Homo sapiens
gcccgcaagagggacagagcc

SEQ ID NO: 4334791 - DNA, 22 bp, Homo sapiens
gcccgcaagagggacagagccc

SEQ ID NO: 4334792 - DNA, 16 bp, Homo sapiens
gcccggaagaaccaga

SEQ ID NO: 4334793 - DNA, 16 bp, Homo sapiens
gcccgggagagactcg

SEQ ID NO: 4334794 - DNA, 14 bp, Homo sapiens
gcccggtgcagggc

SEQ ID NO: 4334795 - DNA, 16 bp, Homo sapiens
gcccggtgcagggcct

SEQ ID NO: 4334796 - DNA, 23 bp, Homo sapiens
gccctagaggacactaggagact

SEQ ID NO: 4334797 - DNA, 14 bp, Homo sapiens
gccctatgtgaaaa

SEQ ID NO: 4334798 - DNA, 14 bp, Homo sapiens
gccctcagctccct

SEQ ID NO: 4334799 - DNA, 16 bp, Homo sapiens
gccctcagctccctga

SEQ ID NO: 4334800 - DNA, 14 bp, Homo sapiens
gccctccacccact

SEQ ID NO: 4334801 - DNA, 20 bp, Homo sapiens
gccctctgtggccaggagcc

SEQ ID NO: 4334802 - DNA, 23 bp, Homo sapiens
gccctctgtggccaggagccctg

SEQ ID NO: 4334803 - DNA, 21 bp, Homo sapiens
gagtgtgtgtgtgtgtctgta

SEQ ID NO: 4334804 - DNA, 18 bp, Homo sapiens
gagtgtttgaaaactgac

SEQ ID NO: 4334805 - DNA, 20 bp, Homo sapiens
gagttctatggagactttgc

SEQ ID NO: 4334806 - DNA, 15 bp, Homo sapiens
gagttgaggaactgt

SEQ ID NO: 4334807 - DNA, 18 bp, Homo sapiens
gagttgattcagctctgc

SEQ ID NO: 4334808 - DNA, 23 bp, Homo sapiens
gataagacttgtttctttctgtc

SEQ ID NO: 4334809 - DNA, 20 bp, Homo sapiens
gataataatattgtttttct

SEQ ID NO: 4334810 - DNA, 13 bp, Homo sapiens
gataataggaatt

SEQ ID NO: 4334811 - DNA, 18 bp, Homo sapiens
gataatggataatcttcg

SEQ ID NO: 4334812 - DNA, 22 bp, Homo sapiens
gatacacaagagggactgtatt

SEQ ID NO: 4334813 - DNA, 18 bp, Homo sapiens
gatacccaacagtttatt

SEQ ID NO: 4334814 - DNA, 20 bp, Homo sapiens
gatactaaaagttcttctcc

SEQ ID NO: 4334815 - DNA, 18 bp, Homo sapiens
gatagaaaaaaactaaag

SEQ ID NO: 4334816 - DNA, 22 bp, Homo sapiens
gatagcatggggcccctggccc

SEQ ID NO: 4334817 - DNA, 22 bp, Homo sapiens
gatatactttgtggaccaatta

SEQ ID NO: 4334818 - DNA, 23 bp, Homo sapiens
gatatatattataaatatatata

SEQ ID NO: 4334819 - DNA, 17 bp, Homo sapiens
gatatgctgagaaatta

SEQ ID NO: 4334820 - DNA, 16 bp, Homo sapiens
gatcaaagacacacag

SEQ ID NO: 4334821 - DNA, 15 bp, Homo sapiens
gatcagaggtcatcc

SEQ ID NO: 4334822 - DNA, 23 bp, Homo sapiens
gatcagatgctgaattgagaata

SEQ ID NO: 4334823 - DNA, 19 bp, Homo sapiens
gatccaaattgtgcttctc

SEQ ID NO: 4334824 - DNA, 15 bp, Homo sapiens
gatcccctctctgtg

SEQ ID NO: 4334825 - DNA, 21 bp, Homo sapiens
gatcccctctctgtggctcca

SEQ ID NO: 4334826 - DNA, 18 bp, Homo sapiens
gatcctaggcatttgctg

SEQ ID NO: 4334827 - DNA, 17 bp, Homo sapiens
gatcctctcctttgaaa

SEQ ID NO: 4334828 - DNA, 21 bp, Homo sapiens
gatcctctcctttgaaacctg

SEQ ID NO: 4334829 - DNA, 12 bp, Homo sapiens
gatctcttgagc

SEQ ID NO: 4334830 - DNA, 17 bp, Homo sapiens
gatctttgtttaaatgc

SEQ ID NO: 4334831 - DNA, 20 bp, Homo sapiens
gatctttgtttaaatgccaa

SEQ ID NO: 4334832 - DNA, 15 bp, Homo sapiens
gatcttttggacctg

SEQ ID NO: 4334833 - DNA, 12 bp, Homo sapiens
gatgatggaaaa

SEQ ID NO: 4334834 - DNA, 16 bp, Homo sapiens
gatgatggaaaaatca

SEQ ID NO: 4334835 - DNA, 19 bp, Homo sapiens
gatgcccaccgaggagccc

SEQ ID NO: 4334836 - DNA, 20 bp, Homo sapiens
gatgcccaccgaggagcccc

SEQ ID NO: 4334837 - DNA, 14 bp, Homo sapiens
gatgcccttccccc

SEQ ID NO: 4334838 - DNA, 17 bp, Homo sapiens
gatgcggggcagagcca

SEQ ID NO: 4334839 - DNA, 17 bp, Homo sapiens
gatgctaagagtcctgg

SEQ ID NO: 4334840 - DNA, 17 bp, Homo sapiens
gatgctggtaatggcca

SEQ ID NO: 4334841 - DNA, 20 bp, Homo sapiens
gatgctggtaatggccatgg

SEQ ID NO: 4334842 - DNA, 14 bp, Homo sapiens
gatggaaaaatcac

SEQ ID NO: 4334843 - DNA, 14 bp, Homo sapiens
gatggacgctgccg

SEQ ID NO: 4334844 - DNA, 17 bp, Homo sapiens
gatggacgctgccggga

SEQ ID NO: 4334845 - DNA, 19 bp, Homo sapiens
gatggacgctgccgggaga

SEQ ID NO: 4334846 - DNA, 12 bp, Homo sapiens
gatggagaggaa

SEQ ID NO: 4334847 - DNA, 18 bp, Homo sapiens
gatggaggcctacctctc

SEQ ID NO: 4334848 - DNA, 14 bp, Homo sapiens
gatgggccaccgcc

SEQ ID NO: 4334849 - DNA, 15 bp, Homo sapiens
gatgttcaatagaac

SEQ ID NO: 4334850 - DNA, 12 bp, Homo sapiens
gattaatgaaaa

SEQ ID NO: 4334851 - DNA, 19 bp, Homo sapiens
gattaccagtctgattata

SEQ ID NO: 4334852 - DNA, 14 bp, Homo sapiens
gattagacctttat

SEQ ID NO: 4334853 - DNA, 18 bp, Homo sapiens
gattagacctttatccag

SEQ ID NO: 4334854 - DNA, 14 bp, Homo sapiens
gattataatgctat

SEQ ID NO: 4334855 - DNA, 16 bp, Homo sapiens
gattatcagtagaaag

SEQ ID NO: 4334856 - DNA, 15 bp, Homo sapiens
gattcagctctgcaa

SEQ ID NO: 4334857 - DNA, 13 bp, Homo sapiens
gattccctctccc

SEQ ID NO: 4334858 - DNA, 14 bp, Homo sapiens
gattgaaagaaaaa

SEQ ID NO: 4334859 - DNA, 18 bp, Homo sapiens
gattggatttgctgtgac

SEQ ID NO: 4334860 - DNA, 19 bp, Homo sapiens
gattgggggatgtgaagaa

SEQ ID NO: 4334861 - DNA, 21 bp, Homo sapiens
gattgggggatgtgaagaaat

SEQ ID NO: 4334862 - DNA, 15 bp, Homo sapiens
gattggttaaaatgt

SEQ ID NO: 4334863 - DNA, 16 bp, Homo sapiens
gattggttaaaatgtg

SEQ ID NO: 4334864 - DNA, 13 bp, Homo sapiens
gatttcagtagaa

SEQ ID NO: 4334865 - DNA, 15 bp, Homo sapiens
gatttcagtagaatt

SEQ ID NO: 4334866 - DNA, 22 bp, Homo sapiens
gatttcagtagaattttagtcc

SEQ ID NO: 4334867 - DNA, 22 bp, Homo sapiens
gatttcttaatgtctgtcagaa

SEQ ID NO: 4334868 - DNA, 20 bp, Homo sapiens
gatttcttgtgatgtattct

SEQ ID NO: 4334869 - DNA, 15 bp, Homo sapiens
gatttgaaaaacttt

SEQ ID NO: 4334870 - DNA, 20 bp, Homo sapiens
gatttgaaaacaaacttctc

SEQ ID NO: 4334871 - DNA, 15 bp, Homo sapiens
gatttgatctttgtt

SEQ ID NO: 4334872 - DNA, 19 bp, Homo sapiens
gattttattacagaaatgt

SEQ ID NO: 4334873 - DNA, 19 bp, Homo sapiens
gattttttttttaagtgac

SEQ ID NO: 4334874 - DNA, 14 bp, Homo sapiens
gcaaaaaggcagga

SEQ ID NO: 4334875 - DNA, 16 bp, Homo sapiens
gcaaaagatgcttctc

SEQ ID NO: 4334876 - DNA, 14 bp, Homo sapiens
gcaaaatagaagaa

SEQ ID NO: 4334877 - DNA, 19 bp, Homo sapiens
gcaaaatagaagaagagga

SEQ ID NO: 4334878 - DNA, 22 bp, Homo sapiens
gcaaaatagaagaagaggaagt

SEQ ID NO: 4334879 - DNA, 14 bp, Homo sapiens
gcaaacccatgaag

SEQ ID NO: 4334880 - DNA, 20 bp, Homo sapiens
gcaaacccatgaagctggcc

SEQ ID NO: 4334881 - DNA, 23 bp, Homo sapiens
gcaaacccatgaagctggccctc

SEQ ID NO: 4334882 - DNA, 18 bp, Homo sapiens
gcaaactctataaagaaa

SEQ ID NO: 4334883 - DNA, 13 bp, Homo sapiens
gcaaactgcttta

SEQ ID NO: 4334884 - DNA, 21 bp, Homo sapiens
gcaaactgctttattttccct

SEQ ID NO: 4334885 - DNA, 15 bp, Homo sapiens
gcaaagatttcagta

SEQ ID NO: 4334886 - DNA, 16 bp, Homo sapiens
gcaaagtacaatgtgt

SEQ ID NO: 4334887 - DNA, 15 bp, Homo sapiens
gcaaataaagccttt

SEQ ID NO: 4334888 - DNA, 16 bp, Homo sapiens
gcaaataaagcctttt

SEQ ID NO: 4334889 - DNA, 21 bp, Homo sapiens
gcaacatcagctttctaatgt

SEQ ID NO: 4334890 - DNA, 14 bp, Homo sapiens
gcaactcatcttag

SEQ ID NO: 4334891 - DNA, 10 bp, Homo sapiens
gcaactgaag

SEQ ID NO: 4334892 - DNA, 18 bp, Homo sapiens
gcaactgcattggctttg

SEQ ID NO: 4334893 - DNA, 19 bp, Homo sapiens
gcaagaagatcacgctccc

SEQ ID NO: 4334894 - DNA, 18 bp, Homo sapiens
gcaagaatttctggaaga

SEQ ID NO: 4334895 - DNA, 20 bp, Homo sapiens
gcaagaatttctggaagaaa

SEQ ID NO: 4334896 - DNA, 14 bp, Homo sapiens
gcaatgtgataaaa

SEQ ID NO: 4334897 - DNA, 23 bp, Homo sapiens
gcaatttttccatgaagtttgaa

SEQ ID NO: 4334898 - DNA, 19 bp, Homo sapiens
gcacagatatactttgtgg

SEQ ID NO: 4334899 - DNA, 22 bp, Homo sapiens
gcacataggctggtggccttgg

SEQ ID NO: 4334900 - DNA, 21 bp, Homo sapiens
gcaccactgcactccagcctg

SEQ ID NO: 4334901 - DNA, 14 bp, Homo sapiens
gcaccagcagcctg

SEQ ID NO: 4334902 - DNA, 15 bp, Homo sapiens
gcaccagcagcctgg

SEQ ID NO: 4334903 - DNA, 18 bp, Homo sapiens
gcaccagggagaggcctc

SEQ ID NO: 4334904 - DNA, 15 bp, Homo sapiens
gcacccctgcctcct

SEQ ID NO: 4334905 - DNA, 16 bp, Homo sapiens
gcacccctgcctcctg

SEQ ID NO: 4334906 - DNA, 15 bp, Homo sapiens
gcaccctcaggcagg

SEQ ID NO: 4334907 - DNA, 11 bp, Homo sapiens
gcacctgagcc

SEQ ID NO: 4334908 - DNA, 19 bp, Homo sapiens
gcacgggattcatgcagtg

SEQ ID NO: 4334909 - DNA, 14 bp, Homo sapiens
gcactaaatatgaa

SEQ ID NO: 4334910 - DNA, 15 bp, Homo sapiens
gcactaaatatgaac

SEQ ID NO: 4334911 - DNA, 19 bp, Homo sapiens
gcactactgggtgtcattt

SEQ ID NO: 4334912 - DNA, 20 bp, Homo sapiens
gcactagagaatgcacagat

SEQ ID NO: 4334913 - DNA, 13 bp, Homo sapiens
gcactaggaattc

SEQ ID NO: 4334914 - DNA, 14 bp, Homo sapiens
gcactccagcctgg

SEQ ID NO: 4334915 - DNA, 15 bp, Homo sapiens
gcactccagcctggg

SEQ ID NO: 4334916 - DNA, 17 bp, Homo sapiens
gcactgtccagctggtt

SEQ ID NO: 4334917 - DNA, 17 bp, Homo sapiens
gcacttacctgcttgag

SEQ ID NO: 4334918 - DNA, 23 bp, Homo sapiens
gcacttacctgcttgagctttct

SEQ ID NO: 4334919 - DNA, 22 bp, Homo sapiens
gcacttcgggaggtcgaggcag

SEQ ID NO: 4334920 - DNA, 13 bp, Homo sapiens
gcacttgcctgct

SEQ ID NO: 4334921 - DNA, 18 bp, Homo sapiens
gcagaaagatttggaaaa

SEQ ID NO: 4334922 - DNA, 19 bp, Homo sapiens
gcagaaagatttggaaaat

SEQ ID NO: 4334923 - DNA, 21 bp, Homo sapiens
gcagaaagatttggaaaattc

SEQ ID NO: 4334924 - DNA, 22 bp, Homo sapiens
gactaagagaaaccttgcaaac

SEQ ID NO: 4334925 - DNA, 15 bp, Homo sapiens
gactcagtgtatttt

SEQ ID NO: 4334926 - DNA, 21 bp, Homo sapiens
gactctcagcccagaagaaaa

SEQ ID NO: 4334927 - DNA, 20 bp, Homo sapiens
gactctgaactggagctgct

SEQ ID NO: 4334928 - DNA, 12 bp, Homo sapiens
gactgaagctgg

SEQ ID NO: 4334929 - DNA, 13 bp, Homo sapiens
gactgcccggcag

SEQ ID NO: 4334930 - DNA, 16 bp, Homo sapiens
gactggaggaacacag

SEQ ID NO: 4334931 - DNA, 22 bp, Homo sapiens
gactgggcacccctgcctcctg

SEQ ID NO: 4334932 - DNA, 20 bp, Homo sapiens
gactggttgtcagaatggaa

SEQ ID NO: 4334933 - DNA, 21 bp, Homo sapiens
gactgtaactttttttcagtt

SEQ ID NO: 4334934 - DNA, 22 bp, Homo sapiens
gactgtggccatatatgctgta

SEQ ID NO: 4334935 - DNA, 23 bp, Homo sapiens
gactgtggccatatatgctgtat

SEQ ID NO: 4334936 - DNA, 11 bp, Homo sapiens
gactgtgtctg

SEQ ID NO: 4334937 - DNA, 22 bp, Homo sapiens
gactgtgtctgaatcatgtctg

SEQ ID NO: 4334938 - DNA, 14 bp, Homo sapiens
gacttactgcattg

SEQ ID NO: 4334939 - DNA, 15 bp, Homo sapiens
gacttgtttctttct

SEQ ID NO: 4334940 - DNA, 16 bp, Homo sapiens
gacttgtttctttctg

SEQ ID NO: 4334941 - DNA, 17 bp, Homo sapiens
gacttgtttctttctgt

SEQ ID NO: 4334942 - DNA, 16 bp, Homo sapiens
gactttcctaaatgtt

SEQ ID NO: 4334943 - DNA, 21 bp, Homo sapiens
gactttgctgcattttacaca

SEQ ID NO: 4334944 - DNA, 23 bp, Homo sapiens
gacttttctgtccgagctttgaa

SEQ ID NO: 4334945 - DNA, 19 bp, Homo sapiens
gagaaaatgaatggacaaa

SEQ ID NO: 4334946 - DNA, 15 bp, Homo sapiens
gagaaactgaagccg

SEQ ID NO: 4334947 - DNA, 22 bp, Homo sapiens
gagaaaggggtgattgaaagaa

SEQ ID NO: 4334948 - DNA, 16 bp, Homo sapiens
gagaaatgaagcagag

SEQ ID NO: 4334949 - DNA, 13 bp, Homo sapiens
gagaacatggcca

SEQ ID NO: 4334950 - DNA, 15 bp, Homo sapiens
gagaactcagtgcca

SEQ ID NO: 4334951 - DNA, 16 bp, Homo sapiens
gagaagcagaggaagg

SEQ ID NO: 4334952 - DNA, 15 bp, Homo sapiens
gagaagcggctggca

SEQ ID NO: 4334953 - DNA, 17 bp, Homo sapiens
gagaagcggctggcagc

SEQ ID NO: 4334954 - DNA, 14 bp, Homo sapiens
gagaaggaactgat

SEQ ID NO: 4334955 - DNA, 12 bp, Homo sapiens
gagaaggaagcc

SEQ ID NO: 4334956 - DNA, 12 bp, Homo sapiens
gagaatgcacag

SEQ ID NO: 4334957 - DNA, 19 bp, Homo sapiens
gagacacggggcaggacct

SEQ ID NO: 4334958 - DNA, 10 bp, Homo sapiens
gagacagaca

SEQ ID NO: 4334959 - DNA, 17 bp, Homo sapiens
gagaccagaagaaaaga

SEQ ID NO: 4334960 - DNA, 20 bp, Homo sapiens
gagaccagaagaaaagactt

SEQ ID NO: 4334961 - DNA, 12 bp, Homo sapiens
gagaccaggagg

SEQ ID NO: 4334962 - DNA, 18 bp, Homo sapiens
gagaccaggagggagagc

SEQ ID NO: 4334963 - DNA, 21 bp, Homo sapiens
gagaccctgtctcaaaaaaag

SEQ ID NO: 4334964 - DNA, 13 bp, Homo sapiens
gagactaagagaa

SEQ ID NO: 4334965 - DNA, 18 bp, Homo sapiens
gagactgggcacccctgc

SEQ ID NO: 4334966 - DNA, 19 bp, Homo sapiens
gagactgggcacccctgcc

SEQ ID NO: 4334967 - DNA, 13 bp, Homo sapiens
gagactttgctgt

SEQ ID NO: 4334968 - DNA, 17 bp, Homo sapiens
gagactttgctgttact

SEQ ID NO: 4334969 - DNA, 15 bp, Homo sapiens
gagagccctgtccct

SEQ ID NO: 4334970 - DNA, 16 bp, Homo sapiens
gagagtggtaaaaaag

SEQ ID NO: 4334971 - DNA, 14 bp, Homo sapiens
gagatgtaattgtt

SEQ ID NO: 4334972 - DNA, 21 bp, Homo sapiens
gagattatcagtagaaagagt

SEQ ID NO: 4334973 - DNA, 21 bp, Homo sapiens
gagattgcaccactgcactcc

SEQ ID NO: 4334974 - DNA, 17 bp, Homo sapiens
gagattggatttgctgt

SEQ ID NO: 4334975 - DNA, 20 bp, Homo sapiens
gagcaacatatcagtcgtgt

SEQ ID NO: 4334976 - DNA, 16 bp, Homo sapiens
gagcaggaggtgcctg

SEQ ID NO: 4334977 - DNA, 12 bp, Homo sapiens
gagcaggtatca

SEQ ID NO: 4334978 - DNA, 18 bp, Homo sapiens
gagcaggtctttgggaag

SEQ ID NO: 4334979 - DNA, 18 bp, Homo sapiens
gagcattaactaaatgct

SEQ ID NO: 4334980 - DNA, 18 bp, Homo sapiens
gagccaataaacctgtaa

SEQ ID NO: 4334981 - DNA, 20 bp, Homo sapiens
gagccaccagggcactgtct

SEQ ID NO: 4334982 - DNA, 12 bp, Homo sapiens
gagccagcccaa

SEQ ID NO: 4334983 - DNA, 18 bp, Homo sapiens
gagcccagttggaaaatt

SEQ ID NO: 4334984 - DNA, 15 bp, Homo sapiens
gagccccagccccgt

SEQ ID NO: 4334985 - DNA, 12 bp, Homo sapiens
gagcccctcatg

SEQ ID NO: 4334986 - DNA, 20 bp, Homo sapiens
gagccctggcccgcaagagg

SEQ ID NO: 4334987 - DNA, 14 bp, Homo sapiens
gagccctgtccctg

SEQ ID NO: 4334988 - DNA, 15 bp, Homo sapiens
gagccctgtccctgc

SEQ ID NO: 4334989 - DNA, 17 bp, Homo sapiens
gagcctcctgcccagtc

SEQ ID NO: 4334990 - DNA, 19 bp, Homo sapiens
gagcctcctgcccagtccc

SEQ ID NO: 4334991 - DNA, 12 bp, Homo sapiens
gagcctctgttt

SEQ ID NO: 4334992 - DNA, 13 bp, Homo sapiens
gagcctgggaggt

SEQ ID NO: 4334993 - DNA, 21 bp, Homo sapiens
gagcctgggaggtcaaggctg

SEQ ID NO: 4334994 - DNA, 14 bp, Homo sapiens
gagcgaattgtgtg

SEQ ID NO: 4334995 - DNA, 20 bp, Homo sapiens
gagcgtacgatggaggccta

SEQ ID NO: 4334996 - DNA, 14 bp, Homo sapiens
gagcgtgggctcag

SEQ ID NO: 4334997 - DNA, 21 bp, Homo sapiens
gagcgtgggctcagcagggct

SEQ ID NO: 4334998 - DNA, 13 bp, Homo sapiens
gagctttctgtgc

SEQ ID NO: 4334999 - DNA, 14 bp, Homo sapiens
gagctttctgtgca

SEQ ID NO: 4335000 - DNA, 16 bp, Homo sapiens
gagctttctgtgcatg

SEQ ID NO: 4335001 - DNA, 21 bp, Homo sapiens
gagctttctgtgcatgtgcag

SEQ ID NO: 4335002 - DNA, 22 bp, Homo sapiens
gaggaaccgaggtgttgccagt

SEQ ID NO: 4335003 - DNA, 22 bp, Homo sapiens
gaggaaggaaacatagaaagac

SEQ ID NO: 4335004 - DNA, 16 bp, Homo sapiens
gaggaatgtgaagcca

SEQ ID NO: 4335005 - DNA, 17 bp, Homo sapiens
gaggaatgtgaagccag

SEQ ID NO: 4335006 - DNA, 19 bp, Homo sapiens
gaggacactaggagactgg

SEQ ID NO: 4335007 - DNA, 20 bp, Homo sapiens
gaggaccctggaaatggact

SEQ ID NO: 4335008 - DNA, 16 bp, Homo sapiens
gaggactgaagctggg

SEQ ID NO: 4335009 - DNA, 12 bp, Homo sapiens
gaggagccccag

SEQ ID NO: 4335010 - DNA, 16 bp, Homo sapiens
gaggagggagagccct

SEQ ID NO: 4335011 - DNA, 20 bp, Homo sapiens
gaggattgcttgagctcagg

SEQ ID NO: 4335012 - DNA, 13 bp, Homo sapiens
gaggcagaaagat

SEQ ID NO: 4335013 - DNA, 23 bp, Homo sapiens
gaggcagaaagatttggaaaatt

SEQ ID NO: 4335014 - DNA, 17 bp, Homo sapiens
gaggccaaggtgggagg

SEQ ID NO: 4335015 - DNA, 22 bp, Homo sapiens
gaggccaaggtgggaggattgc

SEQ ID NO: 4335016 - DNA, 13 bp, Homo sapiens
gaggccccaaagg

SEQ ID NO: 4335017 - DNA, 14 bp, Homo sapiens
gaggcgaataaatg

SEQ ID NO: 4335018 - DNA, 20 bp, Homo sapiens
gaggcgaataaatgttcaaa

SEQ ID NO: 4335019 - DNA, 20 bp, Homo sapiens
gaggctctctaagaaaagag

SEQ ID NO: 4335020 - DNA, 13 bp, Homo sapiens
gagggacagagcc

SEQ ID NO: 4335021 - DNA, 14 bp, Homo sapiens
gagggagagccctg

SEQ ID NO: 4335022 - DNA, 16 bp, Homo sapiens
gagggagagcctctgt

SEQ ID NO: 4335023 - DNA, 13 bp, Homo sapiens
gaggggccggagg

SEQ ID NO: 4335024 - DNA, 17 bp, Homo sapiens
gaggggttgccacaggc

SEQ ID NO: 4335025 - DNA, 13 bp, Homo sapiens
gaggtagaggaaa

SEQ ID NO: 4335026 - DNA, 18 bp, Homo sapiens
gaggtagaggaaaatcaa

SEQ ID NO: 4335027 - DNA, 14 bp, Homo sapiens
gaggtatattggaa

SEQ ID NO: 4335028 - DNA, 12 bp, Homo sapiens
gaggtcatccct

SEQ ID NO: 4335029 - DNA, 18 bp, Homo sapiens
gaggtcatcccttcctcc

SEQ ID NO: 4335030 - DNA, 17 bp, Homo sapiens
gaggtcgtttatgtgtg

SEQ ID NO: 4335031 - DNA, 18 bp, Homo sapiens
gaggtggagtggccactg

SEQ ID NO: 4335032 - DNA, 18 bp, Homo sapiens
gaggtggccctcccaggc

SEQ ID NO: 4335033 - DNA, 16 bp, Homo sapiens
gaggtgttgccagtgc

SEQ ID NO: 4335034 - DNA, 20 bp, Homo sapiens
gaggttagcccaatggagaa

SEQ ID NO: 4335035 - DNA, 14 bp, Homo sapiens
gaggttctgggcct

SEQ ID NO: 4335036 - DNA, 19 bp, Homo sapiens
gaggttttaaaaaaatccc

SEQ ID NO: 4335037 - DNA, 13 bp, Homo sapiens
gagtaatgatgta

SEQ ID NO: 4335038 - DNA, 14 bp, Homo sapiens
gagtaatgatgtaa

SEQ ID NO: 4335039 - DNA, 16 bp, Homo sapiens
gagtcctttcttttga

SEQ ID NO: 4335040 - DNA, 16 bp, Homo sapiens
gagtctgtttcccaag

SEQ ID NO: 4335041 - DNA, 20 bp, Homo sapiens
gagtgccataccttctccca

SEQ ID NO: 4335042 - DNA, 23 bp, Homo sapiens
gagtgccataccttctcccaggc

SEQ ID NO: 4335043 - DNA, 14 bp, Homo sapiens
gagtgctatgtgtg

SEQ ID NO: 4335044 - DNA, 13 bp, Homo sapiens
gagtgggtgaata

SEQ ID NO: 4335045 - DNA, 17 bp, Homo sapiens
gagtgtgcctgaagtcc

SEQ ID NO: 4335046 - DNA, 15 bp, Homo sapiens
gaaagatttggaaaa

SEQ ID NO: 4335047 - DNA, 21 bp, Homo sapiens
gaaaggggtgattgaaagaaa

SEQ ID NO: 4335048 - DNA, 21 bp, Homo sapiens
gaaagttgctaactgggaaga

SEQ ID NO: 4335049 - DNA, 13 bp, Homo sapiens
gaaataaagaaaa

SEQ ID NO: 4335050 - DNA, 18 bp, Homo sapiens
gaaataaagaaaattctc

SEQ ID NO: 4335051 - DNA, 19 bp, Homo sapiens
gaaataaagaaaattctct

SEQ ID NO: 4335052 - DNA, 18 bp, Homo sapiens
gaaatagtttccaagaaa

SEQ ID NO: 4335053 - DNA, 22 bp, Homo sapiens
gaaatgaagcagaggaaggaaa

SEQ ID NO: 4335054 - DNA, 17 bp, Homo sapiens
gaaatgctcaagaatgt

SEQ ID NO: 4335055 - DNA, 14 bp, Homo sapiens
gaaatgggactctg

SEQ ID NO: 4335056 - DNA, 14 bp, Homo sapiens
gaaatgtttttaac

SEQ ID NO: 4335057 - DNA, 18 bp, Homo sapiens
gaaattaacaagaactca

SEQ ID NO: 4335058 - DNA, 21 bp, Homo sapiens
gaaattattggtatatttgta

SEQ ID NO: 4335059 - DNA, 13 bp, Homo sapiens
gaacagcctgagc

SEQ ID NO: 4335060 - DNA, 21 bp, Homo sapiens
gaacattaggaattgtttata

SEQ ID NO: 4335061 - DNA, 18 bp, Homo sapiens
gaaccagaagtgcagccc

SEQ ID NO: 4335062 - DNA, 22 bp, Homo sapiens
gaaccctaaagcagtaaaataa

SEQ ID NO: 4335063 - DNA, 20 bp, Homo sapiens
gaaccctttgtttcttgttt

SEQ ID NO: 4335064 - DNA, 12 bp, Homo sapiens
gaactactgcta

SEQ ID NO: 4335065 - DNA, 15 bp, Homo sapiens
gaactactgctattt

SEQ ID NO: 4335066 - DNA, 17 bp, Homo sapiens
gaactggttgtagtggg

SEQ ID NO: 4335067 - DNA, 20 bp, Homo sapiens
gaactggttgtagtgggaag

SEQ ID NO: 4335068 - DNA, 13 bp, Homo sapiens
gaacttgggaggg

SEQ ID NO: 4335069 - DNA, 12 bp, Homo sapiens
gaagaaaagact

SEQ ID NO: 4335070 - DNA, 23 bp, Homo sapiens
gaagaatgtagccctctccaaat

SEQ ID NO: 4335071 - DNA, 12 bp, Homo sapiens
gaagagccttgc

SEQ ID NO: 4335072 - DNA, 23 bp, Homo sapiens
gaagagttgaggaactgtacaga

SEQ ID NO: 4335073 - DNA, 16 bp, Homo sapiens
gaagatcacgctcccc

SEQ ID NO: 4335074 - DNA, 16 bp, Homo sapiens
gaagatttgaaaacaa

SEQ ID NO: 4335075 - DNA, 18 bp, Homo sapiens
gaagatttgaaaacaaac

SEQ ID NO: 4335076 - DNA, 18 bp, Homo sapiens
gaagcaaagatttcagta

SEQ ID NO: 4335077 - DNA, 17 bp, Homo sapiens
gaagcaagaagaattga

SEQ ID NO: 4335078 - DNA, 14 bp, Homo sapiens
gaagcagaggaagg

SEQ ID NO: 4335079 - DNA, 18 bp, Homo sapiens
gaagcagaggaaggaaac

SEQ ID NO: 4335080 - DNA, 15 bp, Homo sapiens
gaagcgctcatctgg

SEQ ID NO: 4335081 - DNA, 24 bp, Homo sapiens
gaagcgctgttgcccgccctccac

SEQ ID NO: 4335082 - DNA, 14 bp, Homo sapiens
gaagctcccacacc

SEQ ID NO: 4335083 - DNA, 12 bp, Homo sapiens
gaagctggccct

SEQ ID NO: 4335084 - DNA, 22 bp, Homo sapiens
gaagctggccctcagctccctg

SEQ ID NO: 4335085 - DNA, 15 bp, Homo sapiens
gaaggaaacatagaa

SEQ ID NO: 4335086 - DNA, 13 bp, Homo sapiens
gaaggacatagag

SEQ ID NO: 4335087 - DNA, 22 bp, Homo sapiens
gaaggagtgccataccttctcc

SEQ ID NO: 4335088 - DNA, 18 bp, Homo sapiens
gaagggaacagcctgagc

SEQ ID NO: 4335089 - DNA, 20 bp, Homo sapiens
gaagggaacagcctgagccg

SEQ ID NO: 4335090 - DNA, 16 bp, Homo sapiens
gaaggtgggtgaggct

SEQ ID NO: 4335091 - DNA, 15 bp, Homo sapiens
gaagtaaagccatta

SEQ ID NO: 4335092 - DNA, 15 bp, Homo sapiens
gaagtataaggtgct

SEQ ID NO: 4335093 - DNA, 12 bp, Homo sapiens
gaagtgcagccc

SEQ ID NO: 4335094 - DNA, 18 bp, Homo sapiens
gaagttagagataattct

SEQ ID NO: 4335095 - DNA, 18 bp, Homo sapiens
gaatacacatataaaaac

SEQ ID NO: 4335096 - DNA, 19 bp, Homo sapiens
gaatacacatataaaaaca

SEQ ID NO: 4335097 - DNA, 22 bp, Homo sapiens
gaatacacatataaaaacaata

SEQ ID NO: 4335098 - DNA, 15 bp, Homo sapiens
gaatacgaacttaaa

SEQ ID NO: 4335099 - DNA, 21 bp, Homo sapiens
gaatcatgtctgtatccccag

SEQ ID NO: 4335100 - DNA, 19 bp, Homo sapiens
gaatccatatttcaacaga

SEQ ID NO: 4335101 - DNA, 15 bp, Homo sapiens
gaatctggacatttg

SEQ ID NO: 4335102 - DNA, 20 bp, Homo sapiens
gaatctgtgcagtcatcaac

SEQ ID NO: 4335103 - DNA, 15 bp, Homo sapiens
gaatgaaaactcatt

SEQ ID NO: 4335104 - DNA, 17 bp, Homo sapiens
gaatgatccctcagtct

SEQ ID NO: 4335105 - DNA, 20 bp, Homo sapiens
gaatgattggttaaaatgtg

SEQ ID NO: 4335106 - DNA, 15 bp, Homo sapiens
gaatgcacagatata

SEQ ID NO: 4335107 - DNA, 17 bp, Homo sapiens
gaatgcacagatatact

SEQ ID NO: 4335108 - DNA, 14 bp, Homo sapiens
gaatgccataaaat

SEQ ID NO: 4335109 - DNA, 19 bp, Homo sapiens
gaatgctgagctgaagaaa

SEQ ID NO: 4335110 - DNA, 18 bp, Homo sapiens
gaatggaatccatctgtc

SEQ ID NO: 4335111 - DNA, 13 bp, Homo sapiens
gaatgtgaagcca

SEQ ID NO: 4335112 - DNA, 23 bp, Homo sapiens
gaatgtttagtgtgctgctgttc

SEQ ID NO: 4335113 - DNA, 14 bp, Homo sapiens
gaatgtttattcct

SEQ ID NO: 4335114 - DNA, 20 bp, Homo sapiens
gaattaaaaggatagtattt

SEQ ID NO: 4335115 - DNA, 22 bp, Homo sapiens
gaattaccatagagtaatgatg

SEQ ID NO: 4335116 - DNA, 15 bp, Homo sapiens
gaattagaagaaaat

SEQ ID NO: 4335117 - DNA, 15 bp, Homo sapiens
gaattatccattacg

SEQ ID NO: 4335118 - DNA, 16 bp, Homo sapiens
gaattatccattacgt

SEQ ID NO: 4335119 - DNA, 17 bp, Homo sapiens
gaattcaatttggcaaa

SEQ ID NO: 4335120 - DNA, 21 bp, Homo sapiens
gaattcttatgcttataatat

SEQ ID NO: 4335121 - DNA, 14 bp, Homo sapiens
gaattgaagcagga

SEQ ID NO: 4335122 - DNA, 21 bp, Homo sapiens
gaattggcataatttgtctta

SEQ ID NO: 4335123 - DNA, 15 bp, Homo sapiens
gaattgtttatacac

SEQ ID NO: 4335124 - DNA, 16 bp, Homo sapiens
gaatttcatgtgaatc

SEQ ID NO: 4335125 - DNA, 16 bp, Homo sapiens
gaatttctggaagaaa

SEQ ID NO: 4335126 - DNA, 21 bp, Homo sapiens
gacacacaggagtcctttctt

SEQ ID NO: 4335127 - DNA, 22 bp, Homo sapiens
gacaccatcttttgtgagatgt

SEQ ID NO: 4335128 - DNA, 22 bp, Homo sapiens
gacaccttttctatttacctcc

SEQ ID NO: 4335129 - DNA, 20 bp, Homo sapiens
gacactaattccttaaatga

SEQ ID NO: 4335130 - DNA, 21 bp, Homo sapiens
gacactaattccttaaatgaa

SEQ ID NO: 4335131 - DNA, 15 bp, Homo sapiens
gacactccttgaaat

SEQ ID NO: 4335132 - DNA, 18 bp, Homo sapiens
gacagacactgttgcaaa

SEQ ID NO: 4335133 - DNA, 21 bp, Homo sapiens
gacagagcaagtgagaccctg

SEQ ID NO: 4335134 - DNA, 11 bp, Homo sapiens
gacagagcccg

SEQ ID NO: 4335135 - DNA, 22 bp, Homo sapiens
gacagatttgaggactgaagct

SEQ ID NO: 4335136 - DNA, 15 bp, Homo sapiens
gacatagaggtatat

SEQ ID NO: 4335137 - DNA, 13 bp, Homo sapiens
gacatagcctttg

SEQ ID NO: 4335138 - DNA, 14 bp, Homo sapiens
gacatagcctttgt

SEQ ID NO: 4335139 - DNA, 17 bp, Homo sapiens
gacatcagatttcttaa

SEQ ID NO: 4335140 - DNA, 20 bp, Homo sapiens
gacatctgcctgtaattaaa

SEQ ID NO: 4335141 - DNA, 17 bp, Homo sapiens
gacatgagactaagaga

SEQ ID NO: 4335142 - DNA, 18 bp, Homo sapiens
gacatgagactaagagaa

SEQ ID NO: 4335143 - DNA, 21 bp, Homo sapiens
gacatgggctatcagggagga

SEQ ID NO: 4335144 - DNA, 12 bp, Homo sapiens
gacattcactgg

SEQ ID NO: 4335145 - DNA, 17 bp, Homo sapiens
gacattttcttttatta

SEQ ID NO: 4335146 - DNA, 15 bp, Homo sapiens
gaccaagtccaagcc

SEQ ID NO: 4335147 - DNA, 18 bp, Homo sapiens
gaccaccttcccttcctc

SEQ ID NO: 4335148 - DNA, 22 bp, Homo sapiens
gaccaccttcccttcctcagca

SEQ ID NO: 4335149 - DNA, 12 bp, Homo sapiens
gaccagaagaaa

SEQ ID NO: 4335150 - DNA, 15 bp, Homo sapiens
gaccagaagaaaaga

SEQ ID NO: 4335151 - DNA, 15 bp, Homo sapiens
gaccaggagggagag

SEQ ID NO: 4335152 - DNA, 18 bp, Homo sapiens
gaccaggagggagagcct

SEQ ID NO: 4335153 - DNA, 19 bp, Homo sapiens
gaccaggagggagagcctc

SEQ ID NO: 4335154 - DNA, 15 bp, Homo sapiens
gaccattgaaaaagg

SEQ ID NO: 4335155 - DNA, 17 bp, Homo sapiens
gacccacagccctgaaa

SEQ ID NO: 4335156 - DNA, 18 bp, Homo sapiens
gacccacagccctgaaac

SEQ ID NO: 4335157 - DNA, 12 bp, Homo sapiens
gacccctttccc

SEQ ID NO: 4335158 - DNA, 18 bp, Homo sapiens
gacccctttcccccaccc

SEQ ID NO: 4335159 - DNA, 23 bp, Homo sapiens
gaccctgtctcaaaaaaagaaaa

SEQ ID NO: 4335160 - DNA, 17 bp, Homo sapiens
gaccctttgttgaaaaa

SEQ ID NO: 4335161 - DNA, 18 bp, Homo sapiens
gacctcaggtgagaagca

SEQ ID NO: 4335162 - DNA, 19 bp, Homo sapiens
gacctcaggtgagaagcag

SEQ ID NO: 4335163 - DNA, 15 bp, Homo sapiens
gacctggctaatgga

SEQ ID NO: 4335164 - DNA, 12 bp, Homo sapiens
gacctttatcca

SEQ ID NO: 4335165 - DNA, 18 bp, Homo sapiens
gacggaaatgaaattgtc

SEQ ID NO: 4335166 - DNA, 20 bp, Homo sapiens
gacgtcgtacccagccatgt

SEQ ID NO: 4335167 - DNA, 15 bp, Homo sapiens
taacctcaaaatggt

SEQ ID NO: 4335168 - DNA, 17 bp, Homo sapiens
taacctccctcaacaag

SEQ ID NO: 4335169 - DNA, 23 bp, Homo sapiens
taactattttgttttaatctact

SEQ ID NO: 4335170 - DNA, 15 bp, Homo sapiens
taactgaataaaaaa

SEQ ID NO: 4335171 - DNA, 16 bp, Homo sapiens
taactgaataaaaaat

SEQ ID NO: 4335172 - DNA, 15 bp, Homo sapiens
taactgactctgtta

SEQ ID NO: 4335173 - DNA, 17 bp, Homo sapiens
taactgtatttcagtat

SEQ ID NO: 4335174 - DNA, 18 bp, Homo sapiens
taactgtatttcagtatt

SEQ ID NO: 4335175 - DNA, 18 bp, Homo sapiens
taacttacatgactttct

SEQ ID NO: 4335176 - DNA, 20 bp, Homo sapiens
taacttgtttttattgcatt

SEQ ID NO: 4335177 - DNA, 23 bp, Homo sapiens
taagaatttgaggtctacattct

SEQ ID NO: 4335178 - DNA, 16 bp, Homo sapiens
taagaccaccttccct

SEQ ID NO: 4335179 - DNA, 18 bp, Homo sapiens
taagacttgtttctttct

SEQ ID NO: 4335180 - DNA, 21 bp, Homo sapiens
taagagaaaccttgcaaactc

SEQ ID NO: 4335181 - DNA, 18 bp, Homo sapiens
taagctaaagaaactgct

SEQ ID NO: 4335182 - DNA, 18 bp, Homo sapiens
taaggatcaccccagccc

SEQ ID NO: 4335183 - DNA, 16 bp, Homo sapiens
taagtactgtttacca

SEQ ID NO: 4335184 - DNA, 17 bp, Homo sapiens
taagtatttgaaactga

SEQ ID NO: 4335185 - DNA, 16 bp, Homo sapiens
taagtgtcatttcttt

SEQ ID NO: 4335186 - DNA, 20 bp, Homo sapiens
taagtgttcagtgttgacat

SEQ ID NO: 4335187 - DNA, 21 bp, Homo sapiens
taagtgttcagtgttgacata

SEQ ID NO: 4335188 - DNA, 23 bp, Homo sapiens
taagtgttcagtgttgacatagc

SEQ ID NO: 4335189 - DNA, 15 bp, Homo sapiens
taagttcctatacct

SEQ ID NO: 4335190 - DNA, 16 bp, Homo sapiens
taagtttagaagcgct

SEQ ID NO: 4335191 - DNA, 20 bp, Homo sapiens
taataaaagtactgaagacc

SEQ ID NO: 4335192 - DNA, 10 bp, Homo sapiens
taataaagca

SEQ ID NO: 4335193 - DNA, 14 bp, Homo sapiens
taataatattgttt

SEQ ID NO: 4335194 - DNA, 14 bp, Homo sapiens
taatactaatttat

SEQ ID NO: 4335195 - DNA, 16 bp, Homo sapiens
taatatcctgtaataa

SEQ ID NO: 4335196 - DNA, 15 bp, Homo sapiens
taatattgtttttct

SEQ ID NO: 4335197 - DNA, 20 bp, Homo sapiens
taatattgtttttctttcta

SEQ ID NO: 4335198 - DNA, 17 bp, Homo sapiens
taatcagcaatattgcc

SEQ ID NO: 4335199 - DNA, 17 bp, Homo sapiens
taatcatgctcatgtat

SEQ ID NO: 4335200 - DNA, 22 bp, Homo sapiens
taatctcctctgctcattaaac

SEQ ID NO: 4335201 - DNA, 21 bp, Homo sapiens
taatctgagggttaatttcta

SEQ ID NO: 4335202 - DNA, 11 bp, Homo sapiens
taatcttggtc

SEQ ID NO: 4335203 - DNA, 16 bp, Homo sapiens
taatgaagtaaagcca

SEQ ID NO: 4335204 - DNA, 18 bp, Homo sapiens
taatgatgtaacagtgca

SEQ ID NO: 4335205 - DNA, 23 bp, Homo sapiens
taatgccaatatgacacagcttg

SEQ ID NO: 4335206 - DNA, 15 bp, Homo sapiens
taatgccctatgtgt

SEQ ID NO: 4335207 - DNA, 16 bp, Homo sapiens
taatgctggcctgact

SEQ ID NO: 4335208 - DNA, 22 bp, Homo sapiens
taatgctggcctgactggttgt

SEQ ID NO: 4335209 - DNA, 13 bp, Homo sapiens
taatgctttctga

SEQ ID NO: 4335210 - DNA, 20 bp, Homo sapiens
taatggagtgtttgaaaact

SEQ ID NO: 4335211 - DNA, 21 bp, Homo sapiens
taatggagtgtttgaaaactg

SEQ ID NO: 4335212 - DNA, 19 bp, Homo sapiens
taatggccatggtaccccc

SEQ ID NO: 4335213 - DNA, 17 bp, Homo sapiens
taatgtagaaatgtttc

SEQ ID NO: 4335214 - DNA, 22 bp, Homo sapiens
taatgtagggttatatttggga

SEQ ID NO: 4335215 - DNA, 11 bp, Homo sapiens
taatgtcagac

SEQ ID NO: 4335216 - DNA, 19 bp, Homo sapiens
taatgtcagactttgctgc

SEQ ID NO: 4335217 - DNA, 16 bp, Homo sapiens
taatgttctaaattct

SEQ ID NO: 4335218 - DNA, 21 bp, Homo sapiens
taatgttggacagacactgtt

SEQ ID NO: 4335219 - DNA, 13 bp, Homo sapiens
taattaaaaactt

SEQ ID NO: 4335220 - DNA, 15 bp, Homo sapiens
taattaaaaacttta

SEQ ID NO: 4335221 - DNA, 19 bp, Homo sapiens
taattaaaaactttaaaga

SEQ ID NO: 4335222 - DNA, 20 bp, Homo sapiens
taattaaaaactttaaagat

SEQ ID NO: 4335223 - DNA, 22 bp, Homo sapiens
taattagtcgggcatgagtctg

SEQ ID NO: 4335224 - DNA, 14 bp, Homo sapiens
taattatgtaacct

SEQ ID NO: 4335225 - DNA, 21 bp, Homo sapiens
taattatttcagattcctcag

SEQ ID NO: 4335226 - DNA, 21 bp, Homo sapiens
taattcctacagcactactgg

SEQ ID NO: 4335227 - DNA, 14 bp, Homo sapiens
taattccttaaatg

SEQ ID NO: 4335228 - DNA, 23 bp, Homo sapiens
taattccttaaatgaactactgc

SEQ ID NO: 4335229 - DNA, 20 bp, Homo sapiens
taattgtgaggggtttcttt

SEQ ID NO: 4335230 - DNA, 16 bp, Homo sapiens
taatttaagtttgtag

SEQ ID NO: 4335231 - DNA, 14 bp, Homo sapiens
taattttaggaggt

SEQ ID NO: 4335232 - DNA, 22 bp, Homo sapiens
tacaaaactgctttgtgcatat

SEQ ID NO: 4335233 - DNA, 23 bp, Homo sapiens
tacaaaactgctttgtgcatatg

SEQ ID NO: 4335234 - DNA, 18 bp, Homo sapiens
tacaaagcactagagaat

SEQ ID NO: 4335235 - DNA, 16 bp, Homo sapiens
tacaaattttttaatt

SEQ ID NO: 4335236 - DNA, 17 bp, Homo sapiens
tacaagcttaaagcttg

SEQ ID NO: 4335237 - DNA, 19 bp, Homo sapiens
tacaatgtgtttttctcca

SEQ ID NO: 4335238 - DNA, 20 bp, Homo sapiens
tacaatgtgtttttctccag

SEQ ID NO: 4335239 - DNA, 12 bp, Homo sapiens
tacaatttctat

SEQ ID NO: 4335240 - DNA, 15 bp, Homo sapiens
tacacaactttgcaa

SEQ ID NO: 4335241 - DNA, 13 bp, Homo sapiens
tacacagttaaat

SEQ ID NO: 4335242 - DNA, 15 bp, Homo sapiens
tacacatataaaaac

SEQ ID NO: 4335243 - DNA, 15 bp, Homo sapiens
tacacatatgtgctt

SEQ ID NO: 4335244 - DNA, 18 bp, Homo sapiens
tacagcactactgggtgt

SEQ ID NO: 4335245 - DNA, 12 bp, Homo sapiens
tacagtaaagag

SEQ ID NO: 4335246 - DNA, 20 bp, Homo sapiens
tacagtaaagaggcttccaa

SEQ ID NO: 4335247 - DNA, 20 bp, Homo sapiens
tacagtacaatcagcagtct

SEQ ID NO: 4335248 - DNA, 20 bp, Homo sapiens
tacagtttattttctgtgta

SEQ ID NO: 4335249 - DNA, 14 bp, Homo sapiens
tacataaacaatga

SEQ ID NO: 4335250 - DNA, 15 bp, Homo sapiens
tacatacaaatatat

SEQ ID NO: 4335251 - DNA, 12 bp, Homo sapiens
tacatacataca

SEQ ID NO: 4335252 - DNA, 23 bp, Homo sapiens
tacatctgtctttcatctcccag

SEQ ID NO: 4335253 - DNA, 15 bp, Homo sapiens
tacatgactttcttt

SEQ ID NO: 4335254 - DNA, 13 bp, Homo sapiens
tacattaaacaat

SEQ ID NO: 4335255 - DNA, 15 bp, Homo sapiens
tacattattccaatg

SEQ ID NO: 4335256 - DNA, 14 bp, Homo sapiens
tacattattgctta

SEQ ID NO: 4335257 - DNA, 15 bp, Homo sapiens
taccaagtatgaagt

SEQ ID NO: 4335258 - DNA, 16 bp, Homo sapiens
taccaagtatgaagta

SEQ ID NO: 4335259 - DNA, 19 bp, Homo sapiens
taccaatgcttttatcaaa

SEQ ID NO: 4335260 - DNA, 18 bp, Homo sapiens
taccatagagtaatgatg

SEQ ID NO: 4335261 - DNA, 17 bp, Homo sapiens
taccatcccctgtagag

SEQ ID NO: 4335262 - DNA, 17 bp, Homo sapiens
tacccaacagtttattt

SEQ ID NO: 4335263 - DNA, 15 bp, Homo sapiens
tacccagccatgtgt

SEQ ID NO: 4335264 - DNA, 16 bp, Homo sapiens
taccccacctgacctc

SEQ ID NO: 4335265 - DNA, 13 bp, Homo sapiens
tacccccttctgg

SEQ ID NO: 4335266 - DNA, 23 bp, Homo sapiens
tacccccttctgggcatctgttc

SEQ ID NO: 4335267 - DNA, 20 bp, Homo sapiens
tacccttggggtggtgctgg

SEQ ID NO: 4335268 - DNA, 17 bp, Homo sapiens
tacctcagttccacggt

SEQ ID NO: 4335269 - DNA, 22 bp, Homo sapiens
tacctcagttccacggttgcta

SEQ ID NO: 4335270 - DNA, 12 bp, Homo sapiens
tacctccctcct

SEQ ID NO: 4335271 - DNA, 15 bp, Homo sapiens
tacctgccttttaag

SEQ ID NO: 4335272 - DNA, 19 bp, Homo sapiens
tacctgccttttaagtttg

SEQ ID NO: 4335273 - DNA, 13 bp, Homo sapiens
tacctgcttgagc

SEQ ID NO: 4335274 - DNA, 22 bp, Homo sapiens
tacctgcttgagctttctgtgc

SEQ ID NO: 4335275 - DNA, 12 bp, Homo sapiens
taccttctccca

SEQ ID NO: 4335276 - DNA, 13 bp, Homo sapiens
taccttctcccag

SEQ ID NO: 4335277 - DNA, 23 bp, Homo sapiens
taccttctcccaggcctctgccc

SEQ ID NO: 4335278 - DNA, 14 bp, Homo sapiens
tacctttttatatt

SEQ ID NO: 4335279 - DNA, 19 bp, Homo sapiens
tacggggaaaatgcatttt

SEQ ID NO: 4335280 - DNA, 11 bp, Homo sapiens
tacgtgcattt

SEQ ID NO: 4335281 - DNA, 19 bp, Homo sapiens
tacgtgcatttaaactctg

SEQ ID NO: 4335282 - DNA, 14 bp, Homo sapiens
tactaatttattgc

SEQ ID NO: 4335283 - DNA, 16 bp, Homo sapiens
tactccactggtctgt

SEQ ID NO: 4335284 - DNA, 20 bp, Homo sapiens
tactccactggtctgtcttt

SEQ ID NO: 4335285 - DNA, 12 bp, Homo sapiens
tactctgcccac

SEQ ID NO: 4335286 - DNA, 22 bp, Homo sapiens
tactcttaaatcatttggttaa

SEQ ID NO: 4335287 - DNA, 20 bp, Homo sapiens
tactgaagggaacagcctga

SEQ ID NO: 4335288 - DNA, 12 bp, Homo sapiens
gttgtcagaatg

SEQ ID NO: 4335289 - DNA, 13 bp, Homo sapiens
gttgtcattgtcc

SEQ ID NO: 4335290 - DNA, 11 bp, Homo sapiens
gttgtctgtgc

SEQ ID NO: 4335291 - DNA, 20 bp, Homo sapiens
gttgtctgtgcttccttggt

SEQ ID NO: 4335292 - DNA, 12 bp, Homo sapiens
gttgtgcctggt

SEQ ID NO: 4335293 - DNA, 15 bp, Homo sapiens
gttgtgggtgggaga

SEQ ID NO: 4335294 - DNA, 13 bp, Homo sapiens
gttgttaatttag

SEQ ID NO: 4335295 - DNA, 18 bp, Homo sapiens
gttgttcaagcttttcct

SEQ ID NO: 4335296 - DNA, 22 bp, Homo sapiens
gttgttgtcattgtccagctgg

SEQ ID NO: 4335297 - DNA, 14 bp, Homo sapiens
gtttaaatgccaaa

SEQ ID NO: 4335298 - DNA, 16 bp, Homo sapiens
gtttacagggagcctc

SEQ ID NO: 4335299 - DNA, 17 bp, Homo sapiens
gtttacagggagcctcc

SEQ ID NO: 4335300 - DNA, 19 bp, Homo sapiens
gtttacagggagcctcctg

SEQ ID NO: 4335301 - DNA, 16 bp, Homo sapiens
gtttaccatttttcat

SEQ ID NO: 4335302 - DNA, 13 bp, Homo sapiens
gtttactcccttc

SEQ ID NO: 4335303 - DNA, 17 bp, Homo sapiens
gtttatatattgaaagt

SEQ ID NO: 4335304 - DNA, 15 bp, Homo sapiens
gtttcatgtatgtat

SEQ ID NO: 4335305 - DNA, 14 bp, Homo sapiens
gtttctataaatga

SEQ ID NO: 4335306 - DNA, 15 bp, Homo sapiens
gtttctataaatgac

SEQ ID NO: 4335307 - DNA, 20 bp, Homo sapiens
gtttctataaatgactattg

SEQ ID NO: 4335308 - DNA, 23 bp, Homo sapiens
gtttctataaatgactattgtaa

SEQ ID NO: 4335309 - DNA, 23 bp, Homo sapiens
gtttctcccataggctgtgttta

SEQ ID NO: 4335310 - DNA, 20 bp, Homo sapiens
gtttctgcccagccctctgt

SEQ ID NO: 4335311 - DNA, 20 bp, Homo sapiens
gtttctttctgtctctctct

SEQ ID NO: 4335312 - DNA, 14 bp, Homo sapiens
gtttctttgtgttg

SEQ ID NO: 4335313 - DNA, 20 bp, Homo sapiens
gtttcttttttaatagaata

SEQ ID NO: 4335314 - DNA, 20 bp, Homo sapiens
gtttgaaaactgacatcaga

SEQ ID NO: 4335315 - DNA, 13 bp, Homo sapiens
gtttgaaagactt

SEQ ID NO: 4335316 - DNA, 14 bp, Homo sapiens
gtttgtaggtaaaa

SEQ ID NO: 4335317 - DNA, 16 bp, Homo sapiens
gtttgtgtgtatttgt

SEQ ID NO: 4335318 - DNA, 12 bp, Homo sapiens
gtttgtttcttt

SEQ ID NO: 4335319 - DNA, 15 bp, Homo sapiens
gtttgtttctttgtg

SEQ ID NO: 4335320 - DNA, 24 bp, Homo sapiens
gttttatttatatcttgttattaa

SEQ ID NO: 4335321 - DNA, 11 bp, Homo sapiens
gttttccaaac

SEQ ID NO: 4335322 - DNA, 12 bp, Homo sapiens
gttttctcttga

SEQ ID NO: 4335323 - DNA, 18 bp, Homo sapiens
gttttgaatattactcct

SEQ ID NO: 4335324 - DNA, 15 bp, Homo sapiens
gttttgtattgcttc

SEQ ID NO: 4335325 - DNA, 13 bp, Homo sapiens
gtttttatgtgta

SEQ ID NO: 4335326 - DNA, 12 bp, Homo sapiens
gtttttattgca

SEQ ID NO: 4335327 - DNA, 13 bp, Homo sapiens
gtttttgctgaag

SEQ ID NO: 4335328 - DNA, 20 bp, Homo sapiens
taaaaaactgctgactgttt

SEQ ID NO: 4335329 - DNA, 18 bp, Homo sapiens
taaaaaattaaaaatgaa

SEQ ID NO: 4335330 - DNA, 22 bp, Homo sapiens
taaaaaccacccacaaagaaac

SEQ ID NO: 4335331 - DNA, 23 bp, Homo sapiens
taaaaaccacccacaaagaaaca

SEQ ID NO: 4335332 - DNA, 22 bp, Homo sapiens
taaaaagccctatgtgaaaaga

SEQ ID NO: 4335333 - DNA, 15 bp, Homo sapiens
taaaaagtggaaaaa

SEQ ID NO: 4335334 - DNA, 21 bp, Homo sapiens
taaaaagttatataaaggcaa

SEQ ID NO: 4335335 - DNA, 17 bp, Homo sapiens
taaaaataaatagaaaa

SEQ ID NO: 4335336 - DNA, 12 bp, Homo sapiens
taaaaatagaat

SEQ ID NO: 4335337 - DNA, 17 bp, Homo sapiens
taaaacaacagctcgat

SEQ ID NO: 4335338 - DNA, 22 bp, Homo sapiens
taaaacaacagctcgatccaaa

SEQ ID NO: 4335339 - DNA, 13 bp, Homo sapiens
taaaacccaagtg

SEQ ID NO: 4335340 - DNA, 21 bp, Homo sapiens
taaaaccccagccaactcatt

SEQ ID NO: 4335341 - DNA, 21 bp, Homo sapiens
taaaagtactgaagacccgtt

SEQ ID NO: 4335342 - DNA, 18 bp, Homo sapiens
taaaagttaagtgtcatt

SEQ ID NO: 4335343 - DNA, 22 bp, Homo sapiens
taaaagttaagtgtcatttctt

SEQ ID NO: 4335344 - DNA, 17 bp, Homo sapiens
taaaatatttttgaaag

SEQ ID NO: 4335345 - DNA, 17 bp, Homo sapiens
taaaatgacttttatta

SEQ ID NO: 4335346 - DNA, 15 bp, Homo sapiens
taaaatggacatttt

SEQ ID NO: 4335347 - DNA, 17 bp, Homo sapiens
taaaatggatagaaaaa

SEQ ID NO: 4335348 - DNA, 14 bp, Homo sapiens
taaaatgtattttt

SEQ ID NO: 4335349 - DNA, 17 bp, Homo sapiens
taaaatgtatttttcta

SEQ ID NO: 4335350 - DNA, 17 bp, Homo sapiens
taaaattgaaaacacta

SEQ ID NO: 4335351 - DNA, 17 bp, Homo sapiens
taaaattgcagtttcat

SEQ ID NO: 4335352 - DNA, 18 bp, Homo sapiens
taaaattgcagtttcatg

SEQ ID NO: 4335353 - DNA, 22 bp, Homo sapiens
taaaattgcagtttcatgtatg

SEQ ID NO: 4335354 - DNA, 19 bp, Homo sapiens
taaacacataaatgaaaga

SEQ ID NO: 4335355 - DNA, 16 bp, Homo sapiens
taaaccgccaaggctg

SEQ ID NO: 4335356 - DNA, 23 bp, Homo sapiens
taaactagttgtctgaattgaga

SEQ ID NO: 4335357 - DNA, 12 bp, Homo sapiens
taaactctgcca

SEQ ID NO: 4335358 - DNA, 22 bp, Homo sapiens
taaactggaattaaaaggatag

SEQ ID NO: 4335359 - DNA, 16 bp, Homo sapiens
taaactgttttcaagt

SEQ ID NO: 4335360 - DNA, 13 bp, Homo sapiens
taaacttgtgaat

SEQ ID NO: 4335361 - DNA, 13 bp, Homo sapiens
taaacttgtgtat

SEQ ID NO: 4335362 - DNA, 19 bp, Homo sapiens
taaactttgaataaaagaa

SEQ ID NO: 4335363 - DNA, 17 bp, Homo sapiens
taaagaaaattctctca

SEQ ID NO: 4335364 - DNA, 14 bp, Homo sapiens
taaagaaactgctt

SEQ ID NO: 4335365 - DNA, 17 bp, Homo sapiens
taaagaaactgcttaca

SEQ ID NO: 4335366 - DNA, 20 bp, Homo sapiens
taaagaaacttttgaaaaag

SEQ ID NO: 4335367 - DNA, 11 bp, Homo sapiens
taaagaaggag

SEQ ID NO: 4335368 - DNA, 14 bp, Homo sapiens
taaagaatatatat

SEQ ID NO: 4335369 - DNA, 14 bp, Homo sapiens
taaagaggcttcca

SEQ ID NO: 4335370 - DNA, 17 bp, Homo sapiens
taaagataagtctacat

SEQ ID NO: 4335371 - DNA, 16 bp, Homo sapiens
taaagatatggagaat

SEQ ID NO: 4335372 - DNA, 15 bp, Homo sapiens
taaagattagggaaa

SEQ ID NO: 4335373 - DNA, 20 bp, Homo sapiens
taaagccttaagcacaatta

SEQ ID NO: 4335374 - DNA, 17 bp, Homo sapiens
taaagccttttaaatca

SEQ ID NO: 4335375 - DNA, 23 bp, Homo sapiens
taaagctccattgggactgattt

SEQ ID NO: 4335376 - DNA, 22 bp, Homo sapiens
taaagcttgatttgatctttgt

SEQ ID NO: 4335377 - DNA, 12 bp, Homo sapiens
taaagctttatc

SEQ ID NO: 4335378 - DNA, 15 bp, Homo sapiens
taaagctttatcttt

SEQ ID NO: 4335379 - DNA, 18 bp, Homo sapiens
taaagctttatctttgtg

SEQ ID NO: 4335380 - DNA, 21 bp, Homo sapiens
taaagctttatctttgtgtaa

SEQ ID NO: 4335381 - DNA, 14 bp, Homo sapiens
taaaggcaaggaaa

SEQ ID NO: 4335382 - DNA, 16 bp, Homo sapiens
taaaggtacaatcaaa

SEQ ID NO: 4335383 - DNA, 19 bp, Homo sapiens
taaagtccctatagtatat

SEQ ID NO: 4335384 - DNA, 13 bp, Homo sapiens
taaataaactgtt

SEQ ID NO: 4335385 - DNA, 14 bp, Homo sapiens
taaataaactgttt

SEQ ID NO: 4335386 - DNA, 13 bp, Homo sapiens
taaataaatagaa

SEQ ID NO: 4335387 - DNA, 15 bp, Homo sapiens
taaatatatataaag

SEQ ID NO: 4335388 - DNA, 20 bp, Homo sapiens
taaatatatataaagaatat

SEQ ID NO: 4335389 - DNA, 23 bp, Homo sapiens
taaatatgaaccctttgtttctt

SEQ ID NO: 4335390 - DNA, 15 bp, Homo sapiens
taaatattatgattt

SEQ ID NO: 4335391 - DNA, 18 bp, Homo sapiens
taaatattatgattttat

SEQ ID NO: 4335392 - DNA, 12 bp, Homo sapiens
taaatgaaagaa

SEQ ID NO: 4335393 - DNA, 14 bp, Homo sapiens
taaatgaaagaaac

SEQ ID NO: 4335394 - DNA, 17 bp, Homo sapiens
taaatgaactactgcta

SEQ ID NO: 4335395 - DNA, 16 bp, Homo sapiens
taaatgactattgtaa

SEQ ID NO: 4335396 - DNA, 16 bp, Homo sapiens
taaatgccaaaatgta

SEQ ID NO: 4335397 - DNA, 19 bp, Homo sapiens
taaatgtggtgagaatgca

SEQ ID NO: 4335398 - DNA, 17 bp, Homo sapiens
taaattaaataaactgt

SEQ ID NO: 4335399 - DNA, 17 bp, Homo sapiens
taaattataaaattgaa

SEQ ID NO: 4335400 - DNA, 21 bp, Homo sapiens
taaattataaaattgaaaaca

SEQ ID NO: 4335401 - DNA, 16 bp, Homo sapiens
taaattctataaaaac

SEQ ID NO: 4335402 - DNA, 16 bp, Homo sapiens
taaattggtcatggta

SEQ ID NO: 4335403 - DNA, 15 bp, Homo sapiens
taacaaaatttgaat

SEQ ID NO: 4335404 - DNA, 14 bp, Homo sapiens
taacacatgtcctt

SEQ ID NO: 4335405 - DNA, 20 bp, Homo sapiens
taacagctccatacttcttt

SEQ ID NO: 4335406 - DNA, 17 bp, Homo sapiens
taaccacccgccccgcc

SEQ ID NO: 4335407 - DNA, 23 bp, Homo sapiens
taaccaggaagtgcttattctct

SEQ ID NO: 4335408 - DNA, 18 bp, Homo sapiens
taaccatttaaagaaaga

SEQ ID NO: 4335409 - DNA, 23 bp, Homo sapiens
taacctatttatcgcaacatgaa

SEQ ID NO: 4335410 - DNA, 16 bp, Homo sapiens
gtgaagtgcctgctgg

SEQ ID NO: 4335411 - DNA, 14 bp, Homo sapiens
gtgaatgcttctca

SEQ ID NO: 4335412 - DNA, 17 bp, Homo sapiens
gtgactcagtgtatttt

SEQ ID NO: 4335413 - DNA, 22 bp, Homo sapiens
gtgactgcaagcatttttccat

SEQ ID NO: 4335414 - DNA, 15 bp, Homo sapiens
gtgaggctgggcagg

SEQ ID NO: 4335415 - DNA, 19 bp, Homo sapiens
gtgaggctgggcagggcct

SEQ ID NO: 4335416 - DNA, 22 bp, Homo sapiens
gtgaggggtttcttttggaaat

SEQ ID NO: 4335417 - DNA, 21 bp, Homo sapiens
gtgagttttactcttaaatca

SEQ ID NO: 4335418 - DNA, 15 bp, Homo sapiens
gtgatcaactgttca

SEQ ID NO: 4335419 - DNA, 14 bp, Homo sapiens
gtgatgagacctgg

SEQ ID NO: 4335420 - DNA, 12 bp, Homo sapiens
gtgattacctct

SEQ ID NO: 4335421 - DNA, 12 bp, Homo sapiens
gtgattttcatt

SEQ ID NO: 4335422 - DNA, 15 bp, Homo sapiens
gtgcacactaagaaa

SEQ ID NO: 4335423 - DNA, 16 bp, Homo sapiens
gtgcagacaattctcc

SEQ ID NO: 4335424 - DNA, 18 bp, Homo sapiens
gtgcatatgttaaagctt

SEQ ID NO: 4335425 - DNA, 21 bp, Homo sapiens
gtgcatctggcacgtggccag

SEQ ID NO: 4335426 - DNA, 22 bp, Homo sapiens
gtgcatctggcacgtggccagg

SEQ ID NO: 4335427 - DNA, 12 bp, Homo sapiens
gtgcatgtgccg

SEQ ID NO: 4335428 - DNA, 22 bp, Homo sapiens
gtgcatttaaactctgccagaa

SEQ ID NO: 4335429 - DNA, 13 bp, Homo sapiens
gtgccaggtgctg

SEQ ID NO: 4335430 - DNA, 22 bp, Homo sapiens
gtgcccggtgcagggcctggca

SEQ ID NO: 4335431 - DNA, 17 bp, Homo sapiens
gtgcctgaaagctggga

SEQ ID NO: 4335432 - DNA, 23 bp, Homo sapiens
gtgcctgaaagctgggagcgtgg

SEQ ID NO: 4335433 - DNA, 18 bp, Homo sapiens
gtgcctgctgggtgccag

SEQ ID NO: 4335434 - DNA, 11 bp, Homo sapiens
gtgcctgctgt

SEQ ID NO: 4335435 - DNA, 20 bp, Homo sapiens
gtgcgcacttacctgcttga

SEQ ID NO: 4335436 - DNA, 23 bp, Homo sapiens
gtgcgcacttacctgcttgagct

SEQ ID NO: 4335437 - DNA, 13 bp, Homo sapiens
gtgctgagcctgc

SEQ ID NO: 4335438 - DNA, 14 bp, Homo sapiens
gtgcttcagagttt

SEQ ID NO: 4335439 - DNA, 18 bp, Homo sapiens
gtgcttcagagtttgtgt

SEQ ID NO: 4335440 - DNA, 22 bp, Homo sapiens
gtggaaaacaatttgcataata

SEQ ID NO: 4335441 - DNA, 16 bp, Homo sapiens
gtggaaccaaagctgg

SEQ ID NO: 4335442 - DNA, 13 bp, Homo sapiens
gtggaagtcttgg

SEQ ID NO: 4335443 - DNA, 19 bp, Homo sapiens
gtggagactgcaagtaagg

SEQ ID NO: 4335444 - DNA, 14 bp, Homo sapiens
gtggcaccagcagc

SEQ ID NO: 4335445 - DNA, 19 bp, Homo sapiens
gtggcaccagcagcctgga

SEQ ID NO: 4335446 - DNA, 18 bp, Homo sapiens
gtggccaggagccctggc

SEQ ID NO: 4335447 - DNA, 23 bp, Homo sapiens
gtggcccggaagaaccagaagtg

SEQ ID NO: 4335448 - DNA, 14 bp, Homo sapiens
gtggctcacgcctg

SEQ ID NO: 4335449 - DNA, 13 bp, Homo sapiens
gtgggaagaatag

SEQ ID NO: 4335450 - DNA, 14 bp, Homo sapiens
gtgggatgggcagg

SEQ ID NO: 4335451 - DNA, 17 bp, Homo sapiens
gtgggctcagcagggct

SEQ ID NO: 4335452 - DNA, 14 bp, Homo sapiens
gtggggaagggaag

SEQ ID NO: 4335453 - DNA, 13 bp, Homo sapiens
gtgggtgaggctg

SEQ ID NO: 4335454 - DNA, 16 bp, Homo sapiens
gtgggtgaggctgggc

SEQ ID NO: 4335455 - DNA, 17 bp, Homo sapiens
gtggtaaaaaagaaatg

SEQ ID NO: 4335456 - DNA, 20 bp, Homo sapiens
gtgtattgagtcttaactgt

SEQ ID NO: 4335457 - DNA, 22 bp, Homo sapiens
gtgtattgagtcttaactgtat

SEQ ID NO: 4335458 - DNA, 14 bp, Homo sapiens
gtgtatttgtatta

SEQ ID NO: 4335459 - DNA, 20 bp, Homo sapiens
gtgtatttgtattaataaag

SEQ ID NO: 4335460 - DNA, 22 bp, Homo sapiens
gtgtatttgtattaataaagca

SEQ ID NO: 4335461 - DNA, 17 bp, Homo sapiens
gtgtcacctccttcccc

SEQ ID NO: 4335462 - DNA, 20 bp, Homo sapiens
gtgtcacctccttccccagc

SEQ ID NO: 4335463 - DNA, 22 bp, Homo sapiens
gtgtcacctccttccccagctc

SEQ ID NO: 4335464 - DNA, 23 bp, Homo sapiens
gtgtccaagggccgtgcccttgc

SEQ ID NO: 4335465 - DNA, 14 bp, Homo sapiens
gtgtccggtccctg

SEQ ID NO: 4335466 - DNA, 13 bp, Homo sapiens
gtgtctgaatcat

SEQ ID NO: 4335467 - DNA, 14 bp, Homo sapiens
gtgtgagtgtgtgt

SEQ ID NO: 4335468 - DNA, 15 bp, Homo sapiens
gtgtgatggagggaa

SEQ ID NO: 4335469 - DNA, 19 bp, Homo sapiens
gtgtggagaactcagtgcc

SEQ ID NO: 4335470 - DNA, 14 bp, Homo sapiens
gtgtgtgcatgtgc

SEQ ID NO: 4335471 - DNA, 17 bp, Homo sapiens
gtgtgtgcatgtgccga

SEQ ID NO: 4335472 - DNA, 20 bp, Homo sapiens
gtgttccccccatagagacc

SEQ ID NO: 4335473 - DNA, 21 bp, Homo sapiens
gtgttccccccatagagacca

SEQ ID NO: 4335474 - DNA, 16 bp, Homo sapiens
gtgttgacatagcctt

SEQ ID NO: 4335475 - DNA, 17 bp, Homo sapiens
gtgttgacatagccttt

SEQ ID NO: 4335476 - DNA, 18 bp, Homo sapiens
gtgttgacatagcctttg

SEQ ID NO: 4335477 - DNA, 12 bp, Homo sapiens
gtgttgccaaag

SEQ ID NO: 4335478 - DNA, 13 bp, Homo sapiens
gtgtttgaaaact

SEQ ID NO: 4335479 - DNA, 21 bp, Homo sapiens
gtgtttgaaaactgacatcag

SEQ ID NO: 4335480 - DNA, 17 bp, Homo sapiens
gttaaaatcacatttta

SEQ ID NO: 4335481 - DNA, 20 bp, Homo sapiens
gttaaaatcacattttaagt

SEQ ID NO: 4335482 - DNA, 12 bp, Homo sapiens
gttaaaatgtga

SEQ ID NO: 4335483 - DNA, 14 bp, Homo sapiens
gttaaatcatttgg

SEQ ID NO: 4335484 - DNA, 18 bp, Homo sapiens
gttaaccacccgccccgc

SEQ ID NO: 4335485 - DNA, 15 bp, Homo sapiens
gttaaggttagacct

SEQ ID NO: 4335486 - DNA, 22 bp, Homo sapiens
gttaaggttagaccttatgtta

SEQ ID NO: 4335487 - DNA, 20 bp, Homo sapiens
gttagaatgatcatctgtaa

SEQ ID NO: 4335488 - DNA, 17 bp, Homo sapiens
gttagagataattctga

SEQ ID NO: 4335489 - DNA, 15 bp, Homo sapiens
gttcaatagaacatg

SEQ ID NO: 4335490 - DNA, 15 bp, Homo sapiens
gttcaatgaaataaa

SEQ ID NO: 4335491 - DNA, 21 bp, Homo sapiens
gttcagtgtcgggaattttcc

SEQ ID NO: 4335492 - DNA, 11 bp, Homo sapiens
gttcagtgttg

SEQ ID NO: 4335493 - DNA, 20 bp, Homo sapiens
gttcagtgttgacatagcct

SEQ ID NO: 4335494 - DNA, 22 bp, Homo sapiens
gttcagtgttgacatagccttt

SEQ ID NO: 4335495 - DNA, 20 bp, Homo sapiens
gttcagtttttttttttcca

SEQ ID NO: 4335496 - DNA, 20 bp, Homo sapiens
gttccactgcaaataaagcc

SEQ ID NO: 4335497 - DNA, 17 bp, Homo sapiens
gttcgggattccctggt

SEQ ID NO: 4335498 - DNA, 13 bp, Homo sapiens
gttctaaattcta

SEQ ID NO: 4335499 - DNA, 12 bp, Homo sapiens
gttctatccaaa

SEQ ID NO: 4335500 - DNA, 22 bp, Homo sapiens
gttctatccaaacatgtattta

SEQ ID NO: 4335501 - DNA, 21 bp, Homo sapiens
gttctatggagactttgctgt

SEQ ID NO: 4335502 - DNA, 14 bp, Homo sapiens
gttctcagctcccc

SEQ ID NO: 4335503 - DNA, 15 bp, Homo sapiens
gttctctcttctcca

SEQ ID NO: 4335504 - DNA, 12 bp, Homo sapiens
gttctctgccaa

SEQ ID NO: 4335505 - DNA, 14 bp, Homo sapiens
gttctgggcctctg

SEQ ID NO: 4335506 - DNA, 15 bp, Homo sapiens
gttctttctggagtc

SEQ ID NO: 4335507 - DNA, 17 bp, Homo sapiens
gttgaaaaacagctgag

SEQ ID NO: 4335508 - DNA, 15 bp, Homo sapiens
gttgaaaaatgttgc

SEQ ID NO: 4335509 - DNA, 19 bp, Homo sapiens
gttgaaaatacattcttaa

SEQ ID NO: 4335510 - DNA, 12 bp, Homo sapiens
gttgacatagcc

SEQ ID NO: 4335511 - DNA, 14 bp, Homo sapiens
gttgacatagcctt

SEQ ID NO: 4335512 - DNA, 15 bp, Homo sapiens
gttgacccctttccc

SEQ ID NO: 4335513 - DNA, 21 bp, Homo sapiens
gttgacccctttcccccaccc

SEQ ID NO: 4335514 - DNA, 23 bp, Homo sapiens
gttgagcgtacgatggaggccta

SEQ ID NO: 4335515 - DNA, 16 bp, Homo sapiens
gttgaggaactgtaca

SEQ ID NO: 4335516 - DNA, 17 bp, Homo sapiens
gttgaggaactgtacag

SEQ ID NO: 4335517 - DNA, 21 bp, Homo sapiens
gttgatggtagggtataatgt

SEQ ID NO: 4335518 - DNA, 15 bp, Homo sapiens
gttgcaggacctcag

SEQ ID NO: 4335519 - DNA, 16 bp, Homo sapiens
gttgcccgccctccac

SEQ ID NO: 4335520 - DNA, 21 bp, Homo sapiens
gttgcccgccctccacccact

SEQ ID NO: 4335521 - DNA, 13 bp, Homo sapiens
gttgctggaaaat

SEQ ID NO: 4335522 - DNA, 14 bp, Homo sapiens
gttgctggaaaatc

SEQ ID NO: 4335523 - DNA, 19 bp, Homo sapiens
gttgctggaaaatcatatt

SEQ ID NO: 4335524 - DNA, 17 bp, Homo sapiens
gttgctgtgccgtgtcc

SEQ ID NO: 4335525 - DNA, 15 bp, Homo sapiens
gttgcttttattgca

SEQ ID NO: 4335526 - DNA, 18 bp, Homo sapiens
gttggaaatattcatgct

SEQ ID NO: 4335527 - DNA, 13 bp, Homo sapiens
gttggaggagact

SEQ ID NO: 4335528 - DNA, 18 bp, Homo sapiens
gttggcaaaaaggcagga

SEQ ID NO: 4335529 - DNA, 18 bp, Homo sapiens
gttgtaccctctccaggc

SEQ ID NO: 4335530 - DNA, 10 bp, Homo sapiens
gttgtcagaa

SEQ ID NO: 4335531 - DNA, 19 bp, Homo sapiens
gtacttaaatgagttactt

SEQ ID NO: 4335532 - DNA, 21 bp, Homo sapiens
gtacttcctgagtggccaggg

SEQ ID NO: 4335533 - DNA, 18 bp, Homo sapiens
gtagacacgctcttctat

SEQ ID NO: 4335534 - DNA, 19 bp, Homo sapiens
gtagacacgctcttctatt

SEQ ID NO: 4335535 - DNA, 15 bp, Homo sapiens
gtagaggaaaatcaa

SEQ ID NO: 4335536 - DNA, 13 bp, Homo sapiens
gtagagtgggagc

SEQ ID NO: 4335537 - DNA, 15 bp, Homo sapiens
gtagagtgtgcctga

SEQ ID NO: 4335538 - DNA, 17 bp, Homo sapiens
gtagataccgagaatga

SEQ ID NO: 4335539 - DNA, 16 bp, Homo sapiens
gtaggcacttttattt

SEQ ID NO: 4335540 - DNA, 13 bp, Homo sapiens
gtagtttttacaa

SEQ ID NO: 4335541 - DNA, 14 bp, Homo sapiens
gtataatgctttct

SEQ ID NO: 4335542 - DNA, 21 bp, Homo sapiens
gtataatgtgtctgtgttgct

SEQ ID NO: 4335543 - DNA, 15 bp, Homo sapiens
gtatagatggccaaa

SEQ ID NO: 4335544 - DNA, 18 bp, Homo sapiens
gtatagtaccagaagcaa

SEQ ID NO: 4335545 - DNA, 19 bp, Homo sapiens
gtatatgtgagaaatcaga

SEQ ID NO: 4335546 - DNA, 16 bp, Homo sapiens
gtatattatgtattta

SEQ ID NO: 4335547 - DNA, 15 bp, Homo sapiens
gtatatttgtagata

SEQ ID NO: 4335548 - DNA, 21 bp, Homo sapiens
gtatgccttcgggaaaattca

SEQ ID NO: 4335549 - DNA, 23 bp, Homo sapiens
gtatgtatataatcatgctcatg

SEQ ID NO: 4335550 - DNA, 22 bp, Homo sapiens
gtatgtatgccttcgggaaaat

SEQ ID NO: 4335551 - DNA, 23 bp, Homo sapiens
gtatgtatgccttcgggaaaatt

SEQ ID NO: 4335552 - DNA, 13 bp, Homo sapiens
gtattaataaagc

SEQ ID NO: 4335553 - DNA, 18 bp, Homo sapiens
gtattcttttatgaaatt

SEQ ID NO: 4335554 - DNA, 22 bp, Homo sapiens
gtatttaactacatctgcctcg

SEQ ID NO: 4335555 - DNA, 18 bp, Homo sapiens
gtatttatctgcaaggtt

SEQ ID NO: 4335556 - DNA, 12 bp, Homo sapiens
gtatttgtatta

SEQ ID NO: 4335557 - DNA, 14 bp, Homo sapiens
gtatttgtattaat

SEQ ID NO: 4335558 - DNA, 16 bp, Homo sapiens
gtatttgtattaataa

SEQ ID NO: 4335559 - DNA, 17 bp, Homo sapiens
gtatttgtattaataaa

SEQ ID NO: 4335560 - DNA, 22 bp, Homo sapiens
gtatttgtattaataaagcatt

SEQ ID NO: 4335561 - DNA, 13 bp, Homo sapiens
gtattttccagcc

SEQ ID NO: 4335562 - DNA, 20 bp, Homo sapiens
gtcaagaggtttttctcccc

SEQ ID NO: 4335563 - DNA, 15 bp, Homo sapiens
gtcaagtaataaaaa

SEQ ID NO: 4335564 - DNA, 18 bp, Homo sapiens
gtcaagtgaaaaaggagg

SEQ ID NO: 4335565 - DNA, 23 bp, Homo sapiens
gtcacatttgttagccacggaaa

SEQ ID NO: 4335566 - DNA, 15 bp, Homo sapiens
gtcacctccttcccc

SEQ ID NO: 4335567 - DNA, 14 bp, Homo sapiens
gtcagaagacacta

SEQ ID NO: 4335568 - DNA, 20 bp, Homo sapiens
gtcagaatggaatccatctg

SEQ ID NO: 4335569 - DNA, 23 bp, Homo sapiens
gtcagaatggaatccatctgtct

SEQ ID NO: 4335570 - DNA, 20 bp, Homo sapiens
gtcagactttgctgcatttt

SEQ ID NO: 4335571 - DNA, 16 bp, Homo sapiens
gtcagagttaaaatat

SEQ ID NO: 4335572 - DNA, 14 bp, Homo sapiens
gtcaggacacatcg

SEQ ID NO: 4335573 - DNA, 23 bp, Homo sapiens
gtcatatgctcctagagaggaga

SEQ ID NO: 4335574 - DNA, 14 bp, Homo sapiens
gtcatcaacaaaag

SEQ ID NO: 4335575 - DNA, 19 bp, Homo sapiens
gtcatcccttcctcctctc

SEQ ID NO: 4335576 - DNA, 22 bp, Homo sapiens
gtcatgaaggacactctgcagg

SEQ ID NO: 4335577 - DNA, 21 bp, Homo sapiens
gtcatggtagatttttttcat

SEQ ID NO: 4335578 - DNA, 20 bp, Homo sapiens
gtcattacttctgagcccca

SEQ ID NO: 4335579 - DNA, 15 bp, Homo sapiens
gtcattgtccagctg

SEQ ID NO: 4335580 - DNA, 15 bp, Homo sapiens
gtcatttcattccat

SEQ ID NO: 4335581 - DNA, 20 bp, Homo sapiens
gtcatttcattccattgcct

SEQ ID NO: 4335582 - DNA, 18 bp, Homo sapiens
gtccaaatgtttacaggg

SEQ ID NO: 4335583 - DNA, 22 bp, Homo sapiens
gtccaactcttccacctctggg

SEQ ID NO: 4335584 - DNA, 14 bp, Homo sapiens
gtccaatttctgct

SEQ ID NO: 4335585 - DNA, 16 bp, Homo sapiens
gtccaatttctgctgt

SEQ ID NO: 4335586 - DNA, 15 bp, Homo sapiens
gtccagccgtgtgtg

SEQ ID NO: 4335587 - DNA, 16 bp, Homo sapiens
gtccagccgtgtgtgc

SEQ ID NO: 4335588 - DNA, 19 bp, Homo sapiens
gtccagccgtgtgtgcatg

SEQ ID NO: 4335589 - DNA, 23 bp, Homo sapiens
gtccagccgtgtgtgcatgtgcc

SEQ ID NO: 4335590 - DNA, 14 bp, Homo sapiens
gtccatgcttctca

SEQ ID NO: 4335591 - DNA, 21 bp, Homo sapiens
gtcccagaggccgctgcccct

SEQ ID NO: 4335592 - DNA, 22 bp, Homo sapiens
gtcccagaggccgctgcccctg

SEQ ID NO: 4335593 - DNA, 23 bp, Homo sapiens
gtcccagaggccgctgcccctga

SEQ ID NO: 4335594 - DNA, 20 bp, Homo sapiens
gtcccagcacatttcctctc

SEQ ID NO: 4335595 - DNA, 19 bp, Homo sapiens
gtcccccgttgtgcctggt

SEQ ID NO: 4335596 - DNA, 22 bp, Homo sapiens
gtccccggcggggtgcctgctg

SEQ ID NO: 4335597 - DNA, 14 bp, Homo sapiens
gtcccctcagctcc

SEQ ID NO: 4335598 - DNA, 15 bp, Homo sapiens
gtcccttgctgcaaa

SEQ ID NO: 4335599 - DNA, 17 bp, Homo sapiens
gtcccttgtttccagct

SEQ ID NO: 4335600 - DNA, 23 bp, Homo sapiens
gtccgtgcttgctggtgcctctt

SEQ ID NO: 4335601 - DNA, 12 bp, Homo sapiens
gtcctaggtcat

SEQ ID NO: 4335602 - DNA, 17 bp, Homo sapiens
gtcctaggtcatgaagg

SEQ ID NO: 4335603 - DNA, 22 bp, Homo sapiens
gtcctgaggctctctaagaaaa

SEQ ID NO: 4335604 - DNA, 15 bp, Homo sapiens
gtcctgctttcctat

SEQ ID NO: 4335605 - DNA, 20 bp, Homo sapiens
gtccttgcacctgagcctgt

SEQ ID NO: 4335606 - DNA, 13 bp, Homo sapiens
gtcctttcttttg

SEQ ID NO: 4335607 - DNA, 16 bp, Homo sapiens
gtcctttgaggcccca

SEQ ID NO: 4335608 - DNA, 12 bp, Homo sapiens
gtcgaggcagga

SEQ ID NO: 4335609 - DNA, 11 bp, Homo sapiens
gtcgggcatga

SEQ ID NO: 4335610 - DNA, 14 bp, Homo sapiens
gtcgtttatgtgtg

SEQ ID NO: 4335611 - DNA, 12 bp, Homo sapiens
gtcgttttccaa

SEQ ID NO: 4335612 - DNA, 20 bp, Homo sapiens
gtctaccaatctgggaagat

SEQ ID NO: 4335613 - DNA, 9 bp, Homo sapiens
gtctccagt

SEQ ID NO: 4335614 - DNA, 18 bp, Homo sapiens
gtctccagtgttcccccc

SEQ ID NO: 4335615 - DNA, 23 bp, Homo sapiens
gtctccagtgttccccccataga

SEQ ID NO: 4335616 - DNA, 12 bp, Homo sapiens
gtctcccaaggc

SEQ ID NO: 4335617 - DNA, 21 bp, Homo sapiens
gtctcctttctcagccacaaa

SEQ ID NO: 4335618 - DNA, 22 bp, Homo sapiens
gtctctccctcccccagagccc

SEQ ID NO: 4335619 - DNA, 22 bp, Homo sapiens
gtctctcttcagactctcagcc

SEQ ID NO: 4335620 - DNA, 23 bp, Homo sapiens
gtctcttggaaatgttaagaaag

SEQ ID NO: 4335621 - DNA, 16 bp, Homo sapiens
gtctgaagcctgcagg

SEQ ID NO: 4335622 - DNA, 17 bp, Homo sapiens
gtctgaagcctgcaggt

SEQ ID NO: 4335623 - DNA, 17 bp, Homo sapiens
gtctgaatcatgtctgt

SEQ ID NO: 4335624 - DNA, 24 bp, Homo sapiens
gtctgaatcatgtctgtatcccca

SEQ ID NO: 4335625 - DNA, 14 bp, Homo sapiens
gtctgaattgagaa

SEQ ID NO: 4335626 - DNA, 15 bp, Homo sapiens
gtctgaattgagaaa

SEQ ID NO: 4335627 - DNA, 18 bp, Homo sapiens
gtctgaattgagaaaaga

SEQ ID NO: 4335628 - DNA, 22 bp, Homo sapiens
gtctgagaggttagaatgatca

SEQ ID NO: 4335629 - DNA, 17 bp, Homo sapiens
gtctggaggggcccctg

SEQ ID NO: 4335630 - DNA, 20 bp, Homo sapiens
gtctggcaggctactctgcc

SEQ ID NO: 4335631 - DNA, 15 bp, Homo sapiens
gtctggtggtgctgg

SEQ ID NO: 4335632 - DNA, 15 bp, Homo sapiens
gtctgtatccccagt

SEQ ID NO: 4335633 - DNA, 16 bp, Homo sapiens
gtctgtatccccagtg

SEQ ID NO: 4335634 - DNA, 19 bp, Homo sapiens
gtctgtatccccagtgccc

SEQ ID NO: 4335635 - DNA, 15 bp, Homo sapiens
gtctgtcagaagaca

SEQ ID NO: 4335636 - DNA, 14 bp, Homo sapiens
gtctgtgtgctgta

SEQ ID NO: 4335637 - DNA, 16 bp, Homo sapiens
gtctgtgttgcttcaa

SEQ ID NO: 4335638 - DNA, 15 bp, Homo sapiens
gtcttagttgatatt

SEQ ID NO: 4335639 - DNA, 20 bp, Homo sapiens
gtctttcctcccttctttgc

SEQ ID NO: 4335640 - DNA, 19 bp, Homo sapiens
gtctttggataataggaat

SEQ ID NO: 4335641 - DNA, 12 bp, Homo sapiens
gtgaaaagatcc

SEQ ID NO: 4335642 - DNA, 21 bp, Homo sapiens
gtgaaaagatcccaagatgga

SEQ ID NO: 4335643 - DNA, 17 bp, Homo sapiens
gtgaaacgtaattgtac

SEQ ID NO: 4335644 - DNA, 19 bp, Homo sapiens
gtgaaacgtaattgtacaa

SEQ ID NO: 4335645 - DNA, 16 bp, Homo sapiens
gtgaaatggccaggat

SEQ ID NO: 4335646 - DNA, 13 bp, Homo sapiens
gtgaactgggcat

SEQ ID NO: 4335647 - DNA, 17 bp, Homo sapiens
gtgaacttgggccactg

SEQ ID NO: 4335648 - DNA, 15 bp, Homo sapiens
gtgaagaaataagta

SEQ ID NO: 4335649 - DNA, 16 bp, Homo sapiens
gtgaagacagagcaga

SEQ ID NO: 4335650 - DNA, 19 bp, Homo sapiens
gtgaagacagagcagatca

SEQ ID NO: 4335651 - DNA, 12 bp, Homo sapiens
tatataaaatat

SEQ ID NO: 4335652 - DNA, 18 bp, Homo sapiens
tatataaagaatatatat

SEQ ID NO: 4335653 - DNA, 19 bp, Homo sapiens
tatataaagaatatatata

SEQ ID NO: 4335654 - DNA, 18 bp, Homo sapiens
tatataaaggcaaggaaa

SEQ ID NO: 4335655 - DNA, 12 bp, Homo sapiens
tatataaagtat

SEQ ID NO: 4335656 - DNA, 13 bp, Homo sapiens
tatatataaaata

SEQ ID NO: 4335657 - DNA, 12 bp, Homo sapiens
tatatataaaga

SEQ ID NO: 4335658 - DNA, 13 bp, Homo sapiens
tatatataaagta

SEQ ID NO: 4335659 - DNA, 12 bp, Homo sapiens
tatatatataaa

SEQ ID NO: 4335660 - DNA, 15 bp, Homo sapiens
tatatattgaaagtt

SEQ ID NO: 4335661 - DNA, 19 bp, Homo sapiens
tatatattgaaagttgctt

SEQ ID NO: 4335662 - DNA, 23 bp, Homo sapiens
tatatcctctggaaaaggctttc

SEQ ID NO: 4335663 - DNA, 14 bp, Homo sapiens
tatattataaatat

SEQ ID NO: 4335664 - DNA, 21 bp, Homo sapiens
tatattataaatatatataaa

SEQ ID NO: 4335665 - DNA, 16 bp, Homo sapiens
tatatttagttacgta

SEQ ID NO: 4335666 - DNA, 14 bp, Homo sapiens
tatatttttaaaga

SEQ ID NO: 4335667 - DNA, 17 bp, Homo sapiens
tatatttttaaagaagg

SEQ ID NO: 4335668 - DNA, 15 bp, Homo sapiens
tatcagggaggaaga

SEQ ID NO: 4335669 - DNA, 15 bp, Homo sapiens
tatcagtagaaagag

SEQ ID NO: 4335670 - DNA, 15 bp, Homo sapiens
tatcataatttcttt

SEQ ID NO: 4335671 - DNA, 14 bp, Homo sapiens
tatccaaacatgta

SEQ ID NO: 4335672 - DNA, 17 bp, Homo sapiens
tatccattacgtgcatt

SEQ ID NO: 4335673 - DNA, 13 bp, Homo sapiens
tatccccaaatta

SEQ ID NO: 4335674 - DNA, 13 bp, Homo sapiens
tatcctgctgaaa

SEQ ID NO: 4335675 - DNA, 12 bp, Homo sapiens
tatcctgtaata

SEQ ID NO: 4335676 - DNA, 22 bp, Homo sapiens
tatcctttgtggcaccttttct

SEQ ID NO: 4335677 - DNA, 15 bp, Homo sapiens
tatcggaagaacatg

SEQ ID NO: 4335678 - DNA, 17 bp, Homo sapiens
tatcggaagaacatgaa

SEQ ID NO: 4335679 - DNA, 23 bp, Homo sapiens
tatctaatgagttgctggaaaat

SEQ ID NO: 4335680 - DNA, 20 bp, Homo sapiens
tatctagcatttatttctct

SEQ ID NO: 4335681 - DNA, 18 bp, Homo sapiens
tatctatcggaagaacat

SEQ ID NO: 4335682 - DNA, 19 bp, Homo sapiens
tatctatcggaagaacatg

SEQ ID NO: 4335683 - DNA, 14 bp, Homo sapiens
tatctatttatata

SEQ ID NO: 4335684 - DNA, 16 bp, Homo sapiens
tatctgatatgctgag

SEQ ID NO: 4335685 - DNA, 13 bp, Homo sapiens
tatgaaatcatag

SEQ ID NO: 4335686 - DNA, 18 bp, Homo sapiens
tatgaaatcatagtatat

SEQ ID NO: 4335687 - DNA, 22 bp, Homo sapiens
tatgaccattgaaaaaggaaaa

SEQ ID NO: 4335688 - DNA, 20 bp, Homo sapiens
tatgagaaaaatattcaagt

SEQ ID NO: 4335689 - DNA, 16 bp, Homo sapiens
tatgagatttactgct

SEQ ID NO: 4335690 - DNA, 16 bp, Homo sapiens
tatgatatatttatat

SEQ ID NO: 4335691 - DNA, 21 bp, Homo sapiens
tatgatatatttatatcatat

SEQ ID NO: 4335692 - DNA, 17 bp, Homo sapiens
tatgattggttcagttt

SEQ ID NO: 4335693 - DNA, 18 bp, Homo sapiens
tatgattggttcagtttt

SEQ ID NO: 4335694 - DNA, 15 bp, Homo sapiens
tatgattttattaca

SEQ ID NO: 4335695 - DNA, 18 bp, Homo sapiens
tatgattttattacagaa

SEQ ID NO: 4335696 - DNA, 18 bp, Homo sapiens
tatgattttatttaaact

SEQ ID NO: 4335697 - DNA, 16 bp, Homo sapiens
tatgcactaaatatga

SEQ ID NO: 4335698 - DNA, 19 bp, Homo sapiens
tatgcagaacgtatttagc

SEQ ID NO: 4335699 - DNA, 20 bp, Homo sapiens
tatgcagaacgtatttagcc

SEQ ID NO: 4335700 - DNA, 14 bp, Homo sapiens
tatgctgtatttct

SEQ ID NO: 4335701 - DNA, 16 bp, Homo sapiens
tatgctgtatttcttt

SEQ ID NO: 4335702 - DNA, 17 bp, Homo sapiens
tatgctgtatttctttg

SEQ ID NO: 4335703 - DNA, 18 bp, Homo sapiens
tatgctgtatttctttgt

SEQ ID NO: 4335704 - DNA, 23 bp, Homo sapiens
tatgctgtatttctttgtagaat

SEQ ID NO: 4335705 - DNA, 16 bp, Homo sapiens
tatggagaattgctga

SEQ ID NO: 4335706 - DNA, 18 bp, Homo sapiens
tatggagaattgctgaag

SEQ ID NO: 4335707 - DNA, 19 bp, Homo sapiens
tatggagactttgctgtta

SEQ ID NO: 4335708 - DNA, 19 bp, Homo sapiens
tatggctatctatacctgc

SEQ ID NO: 4335709 - DNA, 23 bp, Homo sapiens
tatgtaatgaagtaaagccatta

SEQ ID NO: 4335710 - DNA, 15 bp, Homo sapiens
tatgtatatatattc

SEQ ID NO: 4335711 - DNA, 20 bp, Homo sapiens
tatgtgagaaatcagaattg

SEQ ID NO: 4335712 - DNA, 16 bp, Homo sapiens
tatgtgcttctcagtt

SEQ ID NO: 4335713 - DNA, 23 bp, Homo sapiens
tatgtggcccaagtcattcctaa

SEQ ID NO: 4335714 - DNA, 14 bp, Homo sapiens
tatgtggtcttatg

SEQ ID NO: 4335715 - DNA, 16 bp, Homo sapiens
tatgtttttataaaaa

SEQ ID NO: 4335716 - DNA, 13 bp, Homo sapiens
tattaaaggaaaa

SEQ ID NO: 4335717 - DNA, 14 bp, Homo sapiens
tattaaggaagaca

SEQ ID NO: 4335718 - DNA, 13 bp, Homo sapiens
tattaataaagca

SEQ ID NO: 4335719 - DNA, 18 bp, Homo sapiens
tattaataaagcattctt

SEQ ID NO: 4335720 - DNA, 16 bp, Homo sapiens
tattaatgtttcttct

SEQ ID NO: 4335721 - DNA, 15 bp, Homo sapiens
tattacagaaatgtt

SEQ ID NO: 4335722 - DNA, 22 bp, Homo sapiens
tattacagaaatgtttttaaca

SEQ ID NO: 4335723 - DNA, 17 bp, Homo sapiens
tattactcctatttttg

SEQ ID NO: 4335724 - DNA, 13 bp, Homo sapiens
tattactgattta

SEQ ID NO: 4335725 - DNA, 16 bp, Homo sapiens
tattactgatttagaa

SEQ ID NO: 4335726 - DNA, 23 bp, Homo sapiens
tattacttgtgcacttagtagtt

SEQ ID NO: 4335727 - DNA, 13 bp, Homo sapiens
tattataaatata

SEQ ID NO: 4335728 - DNA, 20 bp, Homo sapiens
tattataaatatatataaag

SEQ ID NO: 4335729 - DNA, 19 bp, Homo sapiens
tattatttttttaaacaaa

SEQ ID NO: 4335730 - DNA, 13 bp, Homo sapiens
tattcaagtaaca

SEQ ID NO: 4335731 - DNA, 17 bp, Homo sapiens
tattcaagtaacacttt

SEQ ID NO: 4335732 - DNA, 23 bp, Homo sapiens
tattcccaagctctagtgggaag

SEQ ID NO: 4335733 - DNA, 16 bp, Homo sapiens
tattcttttatgaaat

SEQ ID NO: 4335734 - DNA, 16 bp, Homo sapiens
tattgaagatacacaa

SEQ ID NO: 4335735 - DNA, 16 bp, Homo sapiens
tattgagaataattat

SEQ ID NO: 4335736 - DNA, 16 bp, Homo sapiens
tattgcttagtaaaat

SEQ ID NO: 4335737 - DNA, 19 bp, Homo sapiens
tattgcttagtgaaaatac

SEQ ID NO: 4335738 - DNA, 19 bp, Homo sapiens
tattggaaatggatgcaaa

SEQ ID NO: 4335739 - DNA, 13 bp, Homo sapiens
tattggtgctgag

SEQ ID NO: 4335740 - DNA, 15 bp, Homo sapiens
tattgtttgaaagac

SEQ ID NO: 4335741 - DNA, 20 bp, Homo sapiens
tatttaaactattcagagga

SEQ ID NO: 4335742 - DNA, 13 bp, Homo sapiens
tatttaactacat

SEQ ID NO: 4335743 - DNA, 15 bp, Homo sapiens
tatttagccattacc

SEQ ID NO: 4335744 - DNA, 22 bp, Homo sapiens
tatttagccattacccacgtga

SEQ ID NO: 4335745 - DNA, 13 bp, Homo sapiens
tatttagttacgt

SEQ ID NO: 4335746 - DNA, 22 bp, Homo sapiens
tatttagttacgtataatgctt

SEQ ID NO: 4335747 - DNA, 23 bp, Homo sapiens
tatttagttacgtataatgcttt

SEQ ID NO: 4335748 - DNA, 15 bp, Homo sapiens
tatttatatcatata

SEQ ID NO: 4335749 - DNA, 20 bp, Homo sapiens
tatttctctggcaaactttt

SEQ ID NO: 4335750 - DNA, 15 bp, Homo sapiens
tatttctgctttctt

SEQ ID NO: 4335751 - DNA, 19 bp, Homo sapiens
tatttgaaactgaatgttt

SEQ ID NO: 4335752 - DNA, 23 bp, Homo sapiens
tatttgggctctgaaataaaaat

SEQ ID NO: 4335753 - DNA, 13 bp, Homo sapiens
tatttgtattaat

SEQ ID NO: 4335754 - DNA, 14 bp, Homo sapiens
tatttgtattaata

SEQ ID NO: 4335755 - DNA, 13 bp, Homo sapiens
tattttaaaaaat

SEQ ID NO: 4335756 - DNA, 18 bp, Homo sapiens
tattttccagccttatgt

SEQ ID NO: 4335757 - DNA, 12 bp, Homo sapiens
tattttctgtgt

SEQ ID NO: 4335758 - DNA, 13 bp, Homo sapiens
tattttctgtgta

SEQ ID NO: 4335759 - DNA, 19 bp, Homo sapiens
tattttctgtgtaaaatga

SEQ ID NO: 4335760 - DNA, 17 bp, Homo sapiens
tattttgttttaatcta

SEQ ID NO: 4335761 - DNA, 20 bp, Homo sapiens
tatttttctacattattgct

SEQ ID NO: 4335762 - DNA, 20 bp, Homo sapiens
tatttttttctttttaaaat

SEQ ID NO: 4335763 - DNA, 12 bp, Homo sapiens
tcaaaaactttt

SEQ ID NO: 4335764 - DNA, 18 bp, Homo sapiens
tcaaaataaaaattaaat

SEQ ID NO: 4335765 - DNA, 17 bp, Homo sapiens
tcaaagtggggtacagt

SEQ ID NO: 4335766 - DNA, 21 bp, Homo sapiens
tcaacagagccctattggctt

SEQ ID NO: 4335767 - DNA, 12 bp, Homo sapiens
tcaactaaaagt

SEQ ID NO: 4335768 - DNA, 17 bp, Homo sapiens
tcaactggggaaaagga

SEQ ID NO: 4335769 - DNA, 19 bp, Homo sapiens
tcaaggatatactgcagct

SEQ ID NO: 4335770 - DNA, 20 bp, Homo sapiens
tcaaggatcttttggacctg

SEQ ID NO: 4335771 - DNA, 15 bp, Homo sapiens
tcaaggctgtgcagg

SEQ ID NO: 4335772 - DNA, 22 bp, Homo sapiens
tactgaagggaacagcctgagc

SEQ ID NO: 4335773 - DNA, 15 bp, Homo sapiens
tactgacgaaagagt

SEQ ID NO: 4335774 - DNA, 16 bp, Homo sapiens
tactgacgaaagagtc

SEQ ID NO: 4335775 - DNA, 16 bp, Homo sapiens
tactgcattgccgaca

SEQ ID NO: 4335776 - DNA, 19 bp, Homo sapiens
tactgccttcctccttatc

SEQ ID NO: 4335777 - DNA, 21 bp, Homo sapiens
tactgcttctctttgtgcagt

SEQ ID NO: 4335778 - DNA, 17 bp, Homo sapiens
tactgggtgtcatttca

SEQ ID NO: 4335779 - DNA, 23 bp, Homo sapiens
tactgggtgtcatttcattccat

SEQ ID NO: 4335780 - DNA, 21 bp, Homo sapiens
tactgtacataaacaatgatg

SEQ ID NO: 4335781 - DNA, 21 bp, Homo sapiens
tactgtcttcagtaagccgtg

SEQ ID NO: 4335782 - DNA, 12 bp, Homo sapiens
tacttaaatgag

SEQ ID NO: 4335783 - DNA, 15 bp, Homo sapiens
tacttacggttttaa

SEQ ID NO: 4335784 - DNA, 21 bp, Homo sapiens
tacttacggttttaaatgtgt

SEQ ID NO: 4335785 - DNA, 22 bp, Homo sapiens
tacttcctgagtggccagggaa

SEQ ID NO: 4335786 - DNA, 15 bp, Homo sapiens
tacttctgagcccca

SEQ ID NO: 4335787 - DNA, 16 bp, Homo sapiens
tacttctgagccccag

SEQ ID NO: 4335788 - DNA, 11 bp, Homo sapiens
tacttgcactg

SEQ ID NO: 4335789 - DNA, 13 bp, Homo sapiens
tacttgtgcactt

SEQ ID NO: 4335790 - DNA, 15 bp, Homo sapiens
tactttaatataaac

SEQ ID NO: 4335791 - DNA, 13 bp, Homo sapiens
tacttttgagtat

SEQ ID NO: 4335792 - DNA, 22 bp, Homo sapiens
tacttttgagtatggctatcta

SEQ ID NO: 4335793 - DNA, 15 bp, Homo sapiens
tactttttttgttat

SEQ ID NO: 4335794 - DNA, 16 bp, Homo sapiens
tagaaaagtagacaat

SEQ ID NO: 4335795 - DNA, 14 bp, Homo sapiens
tagaaagagttcta

SEQ ID NO: 4335796 - DNA, 15 bp, Homo sapiens
tagaacatgcaagaa

SEQ ID NO: 4335797 - DNA, 20 bp, Homo sapiens
tagaacatgcaagaatttct

SEQ ID NO: 4335798 - DNA, 18 bp, Homo sapiens
tagaagcaaagatttcag

SEQ ID NO: 4335799 - DNA, 19 bp, Homo sapiens
tagaagcaaagatttcagt

SEQ ID NO: 4335800 - DNA, 19 bp, Homo sapiens
tagaagcgctcatctggct

SEQ ID NO: 4335801 - DNA, 17 bp, Homo sapiens
tagaataaatggtttct

SEQ ID NO: 4335802 - DNA, 17 bp, Homo sapiens
tagaatgaaaactcatt

SEQ ID NO: 4335803 - DNA, 16 bp, Homo sapiens
tagacaatcattgttt

SEQ ID NO: 4335804 - DNA, 23 bp, Homo sapiens
tagacacccgccctgcccttccc

SEQ ID NO: 4335805 - DNA, 22 bp, Homo sapiens
tagactgtaactttttttcagt

SEQ ID NO: 4335806 - DNA, 23 bp, Homo sapiens
tagactgtgtctgaatcatgtct

SEQ ID NO: 4335807 - DNA, 14 bp, Homo sapiens
tagagaatacacat

SEQ ID NO: 4335808 - DNA, 22 bp, Homo sapiens
tagagaatgcacagatatactt

SEQ ID NO: 4335809 - DNA, 16 bp, Homo sapiens
tagagaccaggaggga

SEQ ID NO: 4335810 - DNA, 14 bp, Homo sapiens
tagagataattctg

SEQ ID NO: 4335811 - DNA, 18 bp, Homo sapiens
tagagcttttcagaacat

SEQ ID NO: 4335812 - DNA, 19 bp, Homo sapiens
tagaggacactaggagact

SEQ ID NO: 4335813 - DNA, 20 bp, Homo sapiens
tagaggacactaggagactg

SEQ ID NO: 4335814 - DNA, 12 bp, Homo sapiens
tagagtgggagc

SEQ ID NO: 4335815 - DNA, 15 bp, Homo sapiens
tagatttgaaaaact

SEQ ID NO: 4335816 - DNA, 17 bp, Homo sapiens
tagatttgaaaaacttt

SEQ ID NO: 4335817 - DNA, 17 bp, Homo sapiens
tagcagtgttctctctg

SEQ ID NO: 4335818 - DNA, 17 bp, Homo sapiens
tagccacggaaacatag

SEQ ID NO: 4335819 - DNA, 20 bp, Homo sapiens
tagccatgtagtgctctcag

SEQ ID NO: 4335820 - DNA, 16 bp, Homo sapiens
tagccccacccagagg

SEQ ID NO: 4335821 - DNA, 17 bp, Homo sapiens
tagcccttctaccccac

SEQ ID NO: 4335822 - DNA, 12 bp, Homo sapiens
tagcctattgtc

SEQ ID NO: 4335823 - DNA, 14 bp, Homo sapiens
tagcctattgtctt

SEQ ID NO: 4335824 - DNA, 19 bp, Homo sapiens
tagctacctttttatattt

SEQ ID NO: 4335825 - DNA, 23 bp, Homo sapiens
tagctcttttttgtttgtttctt

SEQ ID NO: 4335826 - DNA, 20 bp, Homo sapiens
tagcttgattgctcagagaa

SEQ ID NO: 4335827 - DNA, 17 bp, Homo sapiens
tagcttgtctattattg

SEQ ID NO: 4335828 - DNA, 23 bp, Homo sapiens
taggaaagaggaggcagaaagat

SEQ ID NO: 4335829 - DNA, 18 bp, Homo sapiens
taggaattctttgcattc

SEQ ID NO: 4335830 - DNA, 17 bp, Homo sapiens
taggaattgtttataca

SEQ ID NO: 4335831 - DNA, 12 bp, Homo sapiens
taggagactggt

SEQ ID NO: 4335832 - DNA, 23 bp, Homo sapiens
taggatcatatgaccattgaaaa

SEQ ID NO: 4335833 - DNA, 24 bp, Homo sapiens
taggatgggagagctagaaagttg

SEQ ID NO: 4335834 - DNA, 20 bp, Homo sapiens
taggatgtctcttggaaatg

SEQ ID NO: 4335835 - DNA, 22 bp, Homo sapiens
taggcacttttattttcattgt

SEQ ID NO: 4335836 - DNA, 21 bp, Homo sapiens
taggcaggtggagagagtggt

SEQ ID NO: 4335837 - DNA, 20 bp, Homo sapiens
tagggaaaatggatatagaa

SEQ ID NO: 4335838 - DNA, 23 bp, Homo sapiens
taggggaggggttgccacaggcc

SEQ ID NO: 4335839 - DNA, 13 bp, Homo sapiens
tagggtataatgt

SEQ ID NO: 4335840 - DNA, 17 bp, Homo sapiens
tagggttatatttggga

SEQ ID NO: 4335841 - DNA, 14 bp, Homo sapiens
taggtatttcaaaa

SEQ ID NO: 4335842 - DNA, 19 bp, Homo sapiens
taggtcaagtaataaaaag

SEQ ID NO: 4335843 - DNA, 20 bp, Homo sapiens
taggtcaagtaataaaaaga

SEQ ID NO: 4335844 - DNA, 22 bp, Homo sapiens
taggtgagctatagtgaagaat

SEQ ID NO: 4335845 - DNA, 15 bp, Homo sapiens
tagtaaaatttattt

SEQ ID NO: 4335846 - DNA, 16 bp, Homo sapiens
tagtaagtaattatgc

SEQ ID NO: 4335847 - DNA, 21 bp, Homo sapiens
tagtaagtaattatgcactaa

SEQ ID NO: 4335848 - DNA, 15 bp, Homo sapiens
tagtagtttttacaa

SEQ ID NO: 4335849 - DNA, 18 bp, Homo sapiens
tagtatttaactacatct

SEQ ID NO: 4335850 - DNA, 15 bp, Homo sapiens
tagtatttttatcca

SEQ ID NO: 4335851 - DNA, 16 bp, Homo sapiens
tagtcaactggggaaa

SEQ ID NO: 4335852 - DNA, 20 bp, Homo sapiens
tagtcaactggggaaaagga

SEQ ID NO: 4335853 - DNA, 13 bp, Homo sapiens
tagtccttggcat

SEQ ID NO: 4335854 - DNA, 14 bp, Homo sapiens
tagtccttggcata

SEQ ID NO: 4335855 - DNA, 21 bp, Homo sapiens
tagtctttttttccttccttt

SEQ ID NO: 4335856 - DNA, 14 bp, Homo sapiens
tagtgctacctgca

SEQ ID NO: 4335857 - DNA, 15 bp, Homo sapiens
tagtgcttcagagtt

SEQ ID NO: 4335858 - DNA, 22 bp, Homo sapiens
tagtgcttcagagtttgtgtgt

SEQ ID NO: 4335859 - DNA, 18 bp, Homo sapiens
tagttacgtataatgctt

SEQ ID NO: 4335860 - DNA, 14 bp, Homo sapiens
tagttagattccaa

SEQ ID NO: 4335861 - DNA, 17 bp, Homo sapiens
tagttccattcttggtc

SEQ ID NO: 4335862 - DNA, 14 bp, Homo sapiens
tagttccctctgcc

SEQ ID NO: 4335863 - DNA, 19 bp, Homo sapiens
tagttgtctgaattgagaa

SEQ ID NO: 4335864 - DNA, 21 bp, Homo sapiens
tagttgtctgaattgagaaaa

SEQ ID NO: 4335865 - DNA, 14 bp, Homo sapiens
tagttgtctgtgct

SEQ ID NO: 4335866 - DNA, 18 bp, Homo sapiens
tagtttaagggtggaaaa

SEQ ID NO: 4335867 - DNA, 19 bp, Homo sapiens
tagtttttacaaaactgct

SEQ ID NO: 4335868 - DNA, 15 bp, Homo sapiens
tagtttttgctgaag

SEQ ID NO: 4335869 - DNA, 11 bp, Homo sapiens
tataaaaacaa

SEQ ID NO: 4335870 - DNA, 12 bp, Homo sapiens
tataaaaacaat

SEQ ID NO: 4335871 - DNA, 16 bp, Homo sapiens
tataaaattgaaaaca

SEQ ID NO: 4335872 - DNA, 20 bp, Homo sapiens
tataaagaaacttttgaaaa

SEQ ID NO: 4335873 - DNA, 18 bp, Homo sapiens
tataaagtatagagagaa

SEQ ID NO: 4335874 - DNA, 19 bp, Homo sapiens
tataaagtatagagagaag

SEQ ID NO: 4335875 - DNA, 20 bp, Homo sapiens
tataaagtatagagagaagt

SEQ ID NO: 4335876 - DNA, 20 bp, Homo sapiens
tataaatatatataaagaat

SEQ ID NO: 4335877 - DNA, 11 bp, Homo sapiens
tataaatgact

SEQ ID NO: 4335878 - DNA, 22 bp, Homo sapiens
tataaattaaataaactgtttt

SEQ ID NO: 4335879 - DNA, 23 bp, Homo sapiens
tataaccaaagcaattaaatgat

SEQ ID NO: 4335880 - DNA, 21 bp, Homo sapiens
tataagaatgagcctgtccaa

SEQ ID NO: 4335881 - DNA, 23 bp, Homo sapiens
tataagtgttcagtgttgacata

SEQ ID NO: 4335882 - DNA, 23 bp, Homo sapiens
tataatcatgctcatgtatattt

SEQ ID NO: 4335883 - DNA, 12 bp, Homo sapiens
tataatgctttc

SEQ ID NO: 4335884 - DNA, 18 bp, Homo sapiens
tatacctgccttttaagt

SEQ ID NO: 4335885 - DNA, 13 bp, Homo sapiens
tatactgcagctt

SEQ ID NO: 4335886 - DNA, 17 bp, Homo sapiens
tatagaaaatcttagta

SEQ ID NO: 4335887 - DNA, 14 bp, Homo sapiens
tatagatggccaaa

SEQ ID NO: 4335888 - DNA, 14 bp, Homo sapiens
tatagattgtctta

SEQ ID NO: 4335889 - DNA, 16 bp, Homo sapiens
tatagattgtcttaat

SEQ ID NO: 4335890 - DNA, 19 bp, Homo sapiens
tatagcagtgttctctctg

SEQ ID NO: 4335891 - DNA, 11 bp, Homo sapiens
tatataaaata

SEQ ID NO: 4335892 - DNA, 23 bp, Homo sapiens
tcaagtgaaaaaggaggaagaga

SEQ ID NO: 4335893 - DNA, 15 bp, Homo sapiens
tcaatcattttggag

SEQ ID NO: 4335894 - DNA, 16 bp, Homo sapiens
tcaatgctctaacaaa

SEQ ID NO: 4335895 - DNA, 18 bp, Homo sapiens
tcaattgcagatgccaaa

SEQ ID NO: 4335896 - DNA, 17 bp, Homo sapiens
tcacagtgggaagaata

SEQ ID NO: 4335897 - DNA, 14 bp, Homo sapiens
tcacagttctgtaa

SEQ ID NO: 4335898 - DNA, 17 bp, Homo sapiens
tcacataaaacctcatt

SEQ ID NO: 4335899 - DNA, 19 bp, Homo sapiens
tcacatctaaagctttatc

SEQ ID NO: 4335900 - DNA, 22 bp, Homo sapiens
tcacatctaaagctttatcttt

SEQ ID NO: 4335901 - DNA, 18 bp, Homo sapiens
tcacattttaagtgcttc

SEQ ID NO: 4335902 - DNA, 13 bp, Homo sapiens
tcaccccagcccc

SEQ ID NO: 4335903 - DNA, 14 bp, Homo sapiens
tcaccctgggcagt

SEQ ID NO: 4335904 - DNA, 15 bp, Homo sapiens
tcacctccttcccca

SEQ ID NO: 4335905 - DNA, 16 bp, Homo sapiens
tcacctccttccccag

SEQ ID NO: 4335906 - DNA, 19 bp, Homo sapiens
tcacctccttccccagctc

SEQ ID NO: 4335907 - DNA, 17 bp, Homo sapiens
tcacctctcttcttagt

SEQ ID NO: 4335908 - DNA, 16 bp, Homo sapiens
tcacgctccccgcctg

SEQ ID NO: 4335909 - DNA, 21 bp, Homo sapiens
tcacgctccccgcctgttccc

SEQ ID NO: 4335910 - DNA, 20 bp, Homo sapiens
tcactcatgcaaactgcttt

SEQ ID NO: 4335911 - DNA, 17 bp, Homo sapiens
tcactctaaaaatagaa

SEQ ID NO: 4335912 - DNA, 19 bp, Homo sapiens
tcactgcattcattctgag

SEQ ID NO: 4335913 - DNA, 20 bp, Homo sapiens
tcactgcattcattctgagc

SEQ ID NO: 4335914 - DNA, 18 bp, Homo sapiens
tcactttttttttttgtt

SEQ ID NO: 4335915 - DNA, 20 bp, Homo sapiens
tcagaatggaatccatctgt

SEQ ID NO: 4335916 - DNA, 22 bp, Homo sapiens
tcagaatggaatccatctgtct

SEQ ID NO: 4335917 - DNA, 19 bp, Homo sapiens
tcagaattatccattacgt

SEQ ID NO: 4335918 - DNA, 22 bp, Homo sapiens
tcagaattatccattacgtgca

SEQ ID NO: 4335919 - DNA, 19 bp, Homo sapiens
tcagactctcagcccagaa

SEQ ID NO: 4335920 - DNA, 18 bp, Homo sapiens
tcagactgacactactaa

SEQ ID NO: 4335921 - DNA, 15 bp, Homo sapiens
tcagactttgctgca

SEQ ID NO: 4335922 - DNA, 18 bp, Homo sapiens
tcagactttgctgcattt

SEQ ID NO: 4335923 - DNA, 19 bp, Homo sapiens
tcagactttgctgcatttt

SEQ ID NO: 4335924 - DNA, 15 bp, Homo sapiens
tcagagtttgtgtgt

SEQ ID NO: 4335925 - DNA, 20 bp, Homo sapiens
tcagagtttgtgtgtatttg

SEQ ID NO: 4335926 - DNA, 21 bp, Homo sapiens
tcagagtttgtgtgtatttgt

SEQ ID NO: 4335927 - DNA, 23 bp, Homo sapiens
tcagagtttgtgtgtatttgtat

SEQ ID NO: 4335928 - DNA, 11 bp, Homo sapiens
tcagatttctt

SEQ ID NO: 4335929 - DNA, 13 bp, Homo sapiens
tcagattttaaaa

SEQ ID NO: 4335930 - DNA, 16 bp, Homo sapiens
tcagattttaaaaagg

SEQ ID NO: 4335931 - DNA, 13 bp, Homo sapiens
tcagccacagcct

SEQ ID NO: 4335932 - DNA, 14 bp, Homo sapiens
tcagccattcctgt

SEQ ID NO: 4335933 - DNA, 12 bp, Homo sapiens
tcagcccagaag

SEQ ID NO: 4335934 - DNA, 13 bp, Homo sapiens
tcagcccagaaga

SEQ ID NO: 4335935 - DNA, 15 bp, Homo sapiens
tcagcccagaagaaa

SEQ ID NO: 4335936 - DNA, 24 bp, Homo sapiens
tcagcccagaagaaaattctcctg

SEQ ID NO: 4335937 - DNA, 12 bp, Homo sapiens
tcagcctgggca

SEQ ID NO: 4335938 - DNA, 15 bp, Homo sapiens
tcagcgtggttttta

SEQ ID NO: 4335939 - DNA, 22 bp, Homo sapiens
tcagctccccctgtcccctcag

SEQ ID NO: 4335940 - DNA, 12 bp, Homo sapiens
tcagctccctga

SEQ ID NO: 4335941 - DNA, 21 bp, Homo sapiens
tcagcttgcttagatgttcca

SEQ ID NO: 4335942 - DNA, 22 bp, Homo sapiens
tcaggaatcctacgctatgtag

SEQ ID NO: 4335943 - DNA, 17 bp, Homo sapiens
tcaggaggcgaataaat

SEQ ID NO: 4335944 - DNA, 13 bp, Homo sapiens
tcagggaggaaga

SEQ ID NO: 4335945 - DNA, 19 bp, Homo sapiens
tcaggggatgtacatctct

SEQ ID NO: 4335946 - DNA, 12 bp, Homo sapiens
tcaggggtgtgc

SEQ ID NO: 4335947 - DNA, 15 bp, Homo sapiens
tcaggtaacactaca

SEQ ID NO: 4335948 - DNA, 15 bp, Homo sapiens
tcaggtgagaagcag

SEQ ID NO: 4335949 - DNA, 23 bp, Homo sapiens
tcaggtgagaagcagaggaagga

SEQ ID NO: 4335950 - DNA, 16 bp, Homo sapiens
tcagtacctcccctcc

SEQ ID NO: 4335951 - DNA, 13 bp, Homo sapiens
tcagtagaaagag

SEQ ID NO: 4335952 - DNA, 14 bp, Homo sapiens
tcagtagaatttta

SEQ ID NO: 4335953 - DNA, 17 bp, Homo sapiens
tcagtagtgagcagcat

SEQ ID NO: 4335954 - DNA, 14 bp, Homo sapiens
tcagtctttgtcaa

SEQ ID NO: 4335955 - DNA, 15 bp, Homo sapiens
tcagtggctttgcat

SEQ ID NO: 4335956 - DNA, 11 bp, Homo sapiens
tcagtgttgac

SEQ ID NO: 4335957 - DNA, 15 bp, Homo sapiens
tcagtgttgacatag

SEQ ID NO: 4335958 - DNA, 18 bp, Homo sapiens
tcagtgttgacatagcct

SEQ ID NO: 4335959 - DNA, 19 bp, Homo sapiens
tcagtgttgacatagcctt

SEQ ID NO: 4335960 - DNA, 20 bp, Homo sapiens
tcagtgttgacatagccttt

SEQ ID NO: 4335961 - DNA, 16 bp, Homo sapiens
tcagttcatatgcaga

SEQ ID NO: 4335962 - DNA, 13 bp, Homo sapiens
tcagttgcagaaa

SEQ ID NO: 4335963 - DNA, 18 bp, Homo sapiens
tcagtttttttttttcca

SEQ ID NO: 4335964 - DNA, 19 bp, Homo sapiens
tcagtttttttttttccag

SEQ ID NO: 4335965 - DNA, 17 bp, Homo sapiens
tcatacacagttaaata

SEQ ID NO: 4335966 - DNA, 17 bp, Homo sapiens
tcataccccagaaatta

SEQ ID NO: 4335967 - DNA, 15 bp, Homo sapiens
tcatacctccctcct

SEQ ID NO: 4335968 - DNA, 15 bp, Homo sapiens
tcatagattgcaaat

SEQ ID NO: 4335969 - DNA, 16 bp, Homo sapiens
tcatagtataaatcta

SEQ ID NO: 4335970 - DNA, 17 bp, Homo sapiens
tcatagtataaatctat

SEQ ID NO: 4335971 - DNA, 18 bp, Homo sapiens
tcatagtgtcaagaagga

SEQ ID NO: 4335972 - DNA, 20 bp, Homo sapiens
tcatatgaccattgaaaaag

SEQ ID NO: 4335973 - DNA, 23 bp, Homo sapiens
tcatatgcagaacgtatttagcc

SEQ ID NO: 4335974 - DNA, 13 bp, Homo sapiens
tcatattgagaat

SEQ ID NO: 4335975 - DNA, 17 bp, Homo sapiens
tcatattgagaataatt

SEQ ID NO: 4335976 - DNA, 22 bp, Homo sapiens
tcatcccttcctcctctcctgg

SEQ ID NO: 4335977 - DNA, 23 bp, Homo sapiens
tcatcccttcctcctctcctgga

SEQ ID NO: 4335978 - DNA, 17 bp, Homo sapiens
tcatcgctcgtgtgttc

SEQ ID NO: 4335979 - DNA, 17 bp, Homo sapiens
tcatgcaaactgcttta

SEQ ID NO: 4335980 - DNA, 19 bp, Homo sapiens
tcatgcaaactgctttatt

SEQ ID NO: 4335981 - DNA, 16 bp, Homo sapiens
tcatgctgtccgtgct

SEQ ID NO: 4335982 - DNA, 14 bp, Homo sapiens
tcatggtagatttt

SEQ ID NO: 4335983 - DNA, 16 bp, Homo sapiens
tcatgtatgtatataa

SEQ ID NO: 4335984 - DNA, 21 bp, Homo sapiens
tcatgtatgtatataatcatg

SEQ ID NO: 4335985 - DNA, 13 bp, Homo sapiens
tcatgtctgtatc

SEQ ID NO: 4335986 - DNA, 13 bp, Homo sapiens
tcatgttggtcaa

SEQ ID NO: 4335987 - DNA, 19 bp, Homo sapiens
tcattaaactctaaagatt

SEQ ID NO: 4335988 - DNA, 19 bp, Homo sapiens
tcattacttctgagcccca

SEQ ID NO: 4335989 - DNA, 18 bp, Homo sapiens
tcattagcttgtctatta

SEQ ID NO: 4335990 - DNA, 13 bp, Homo sapiens
tcattccattgcc

SEQ ID NO: 4335991 - DNA, 14 bp, Homo sapiens
tcatttcattccat

SEQ ID NO: 4335992 - DNA, 16 bp, Homo sapiens
tcatttggcttgctgt

SEQ ID NO: 4335993 - DNA, 21 bp, Homo sapiens
tcatttggcttgctgtttact

SEQ ID NO: 4335994 - DNA, 17 bp, Homo sapiens
tcattttgcctgagtgt

SEQ ID NO: 4335995 - DNA, 15 bp, Homo sapiens
tccaaacatgtattt

SEQ ID NO: 4335996 - DNA, 20 bp, Homo sapiens
tccaaacatgtatttatgta

SEQ ID NO: 4335997 - DNA, 13 bp, Homo sapiens
tccaaatcaagga

SEQ ID NO: 4335998 - DNA, 18 bp, Homo sapiens
tccaactgtgttcattag

SEQ ID NO: 4335999 - DNA, 22 bp, Homo sapiens
tccaagaaattttagatattat

SEQ ID NO: 4336000 - DNA, 14 bp, Homo sapiens
tccaagggccgtgc

SEQ ID NO: 4336001 - DNA, 15 bp, Homo sapiens
tccaagggccgtgcc

SEQ ID NO: 4336002 - DNA, 13 bp, Homo sapiens
tccaatatttctg

SEQ ID NO: 4336003 - DNA, 22 bp, Homo sapiens
tccaatgatacccaacagttta

SEQ ID NO: 4336004 - DNA, 17 bp, Homo sapiens
tccaattttttcttaaa

SEQ ID NO: 4336005 - DNA, 22 bp, Homo sapiens
tccacacggagctcctggcagc

SEQ ID NO: 4336006 - DNA, 23 bp, Homo sapiens
tccacggttgctaaattataaaa

SEQ ID NO: 4336007 - DNA, 14 bp, Homo sapiens
tccactcccaagcc

SEQ ID NO: 4336008 - DNA, 17 bp, Homo sapiens
tccactgcaaataaagc

SEQ ID NO: 4336009 - DNA, 18 bp, Homo sapiens
tccactgcaaataaagcc

SEQ ID NO: 4336010 - DNA, 19 bp, Homo sapiens
tccactgcaaataaagcct

SEQ ID NO: 4336011 - DNA, 16 bp, Homo sapiens
tccagaatggggctta

SEQ ID NO: 4336012 - DNA, 18 bp, Homo sapiens
tccagagaagcgctgttg

SEQ ID NO: 4336013 - DNA, 11 bp, Homo sapiens
tccagcctggg

SEQ ID NO: 4336014 - DNA, 18 bp, Homo sapiens
tccagctagtgccaaata

SEQ ID NO: 4336015 - DNA, 12 bp, Homo sapiens
tccagctgggac

SEQ ID NO: 4336016 - DNA, 21 bp, Homo sapiens
tccagctgggacctaatgctg

SEQ ID NO: 4336017 - DNA, 22 bp, Homo sapiens
tccaggagattggatttgctgt

SEQ ID NO: 4336018 - DNA, 23 bp, Homo sapiens
tccaggagattggatttgctgtg

SEQ ID NO: 4336019 - DNA, 9 bp, Homo sapiens
tccatgctt

SEQ ID NO: 4336020 - DNA, 18 bp, Homo sapiens
tccatgtggttcttcaaa

SEQ ID NO: 4336021 - DNA, 21 bp, Homo sapiens
tccattaataactgaataaaa

SEQ ID NO: 4336022 - DNA, 22 bp, Homo sapiens
tccattaataactgaataaaaa

SEQ ID NO: 4336023 - DNA, 15 bp, Homo sapiens
tccattacgtgcatt

SEQ ID NO: 4336024 - DNA, 17 bp, Homo sapiens
tccattacgtgcattta

SEQ ID NO: 4336025 - DNA, 23 bp, Homo sapiens
tccattacgtgcatttaaactct

SEQ ID NO: 4336026 - DNA, 12 bp, Homo sapiens
tccattcttggt

SEQ ID NO: 4336027 - DNA, 19 bp, Homo sapiens
tccattgcaaaatagaaga

SEQ ID NO: 4336028 - DNA, 20 bp, Homo sapiens
tccattgcaaaatagaagaa

SEQ ID NO: 4336029 - DNA, 20 bp, Homo sapiens
tcccacacccacctctgcca

SEQ ID NO: 4336030 - DNA, 20 bp, Homo sapiens
tcccacagggaaatgtgtat

SEQ ID NO: 4336031 - DNA, 16 bp, Homo sapiens
tcccacccaaggagaa

SEQ ID NO: 4336032 - DNA, 23 bp, Homo sapiens
tcccacgactgttgtacaagctc

SEQ ID NO: 4336033 - DNA, 14 bp, Homo sapiens
tcccactgaaggat

SEQ ID NO: 4336034 - DNA, 22 bp, Homo sapiens
tcccagaggccgctgcccctga

SEQ ID NO: 4336035 - DNA, 16 bp, Homo sapiens
tcccagatacttgggg

SEQ ID NO: 4336036 - DNA, 11 bp, Homo sapiens
tcccaggcctc

SEQ ID NO: 4336037 - DNA, 16 bp, Homo sapiens
tcccaggcctctgccc

SEQ ID NO: 4336038 - DNA, 22 bp, Homo sapiens
tcccagtgccgagaaggaagcc

SEQ ID NO: 4336039 - DNA, 15 bp, Homo sapiens
tccccaaatggctgc

SEQ ID NO: 4336040 - DNA, 16 bp, Homo sapiens
tccccaaatggctgct

SEQ ID NO: 4336041 - DNA, 23 bp, Homo sapiens
tccccaccctgaaagccctgagc

SEQ ID NO: 4336042 - DNA, 16 bp, Homo sapiens
tccccagctcccccag

SEQ ID NO: 4336043 - DNA, 19 bp, Homo sapiens
tccccagctcccccaggca

SEQ ID NO: 4336044 - DNA, 13 bp, Homo sapiens
tccccagtgcccg

SEQ ID NO: 4336045 - DNA, 15 bp, Homo sapiens
tccccagtgcccggt

SEQ ID NO: 4336046 - DNA, 15 bp, Homo sapiens
tccccagtgctcctg

SEQ ID NO: 4336047 - DNA, 20 bp, Homo sapiens
tccccagtgctcctggccct

SEQ ID NO: 4336048 - DNA, 15 bp, Homo sapiens
tcccccaaccccagc

SEQ ID NO: 4336049 - DNA, 14 bp, Homo sapiens
tcccccaggcagaa

SEQ ID NO: 4336050 - DNA, 22 bp, Homo sapiens
tccccccatagagaccaggagg

SEQ ID NO: 4336051 - DNA, 20 bp, Homo sapiens
tccccctttctctgcctggc

SEQ ID NO: 4336052 - DNA, 18 bp, Homo sapiens
tccccgccccctgaaaca

SEQ ID NO: 4336053 - DNA, 14 bp, Homo sapiens
tccccgcctgttcc

SEQ ID NO: 4336054 - DNA, 20 bp, Homo sapiens
tccccggcggggtgcctgct

SEQ ID NO: 4336055 - DNA, 14 bp, Homo sapiens
tcccctcaaaaagc

SEQ ID NO: 4336056 - DNA, 12 bp, Homo sapiens
tcccctcagctc

SEQ ID NO: 4336057 - DNA, 14 bp, Homo sapiens
tcccctcagctcca

SEQ ID NO: 4336058 - DNA, 18 bp, Homo sapiens
tcccctccccgccccctg

SEQ ID NO: 4336059 - DNA, 18 bp, Homo sapiens
tcccctctctgtggctcc

SEQ ID NO: 4336060 - DNA, 19 bp, Homo sapiens
tcccctctctgtggctcca

SEQ ID NO: 4336061 - DNA, 22 bp, Homo sapiens
tcccctgtagagtgggagctga

SEQ ID NO: 4336062 - DNA, 16 bp, Homo sapiens
tcccgccaccctgtct

SEQ ID NO: 4336063 - DNA, 17 bp, Homo sapiens
tcccgccaccctgtctc

SEQ ID NO: 4336064 - DNA, 18 bp, Homo sapiens
tcccgccaccctgtctca

SEQ ID NO: 4336065 - DNA, 21 bp, Homo sapiens
tcccgggtttggctgagcctg

SEQ ID NO: 4336066 - DNA, 21 bp, Homo sapiens
tcccgtaagaccaccttccct

SEQ ID NO: 4336067 - DNA, 15 bp, Homo sapiens
tccctacttgcagcg

SEQ ID NO: 4336068 - DNA, 14 bp, Homo sapiens
tccctccccaaatg

SEQ ID NO: 4336069 - DNA, 15 bp, Homo sapiens
tccctccccaaatgg

SEQ ID NO: 4336070 - DNA, 15 bp, Homo sapiens
tccctcccccagagc

SEQ ID NO: 4336071 - DNA, 18 bp, Homo sapiens
tccctctcccacccaagg

SEQ ID NO: 4336072 - DNA, 21 bp, Homo sapiens
tccctctctccacacggagct

SEQ ID NO: 4336073 - DNA, 18 bp, Homo sapiens
tccctctgcctgggatgc

SEQ ID NO: 4336074 - DNA, 22 bp, Homo sapiens
tccctctgcctgggatgccctt

SEQ ID NO: 4336075 - DNA, 14 bp, Homo sapiens
tccctgaccccctg

SEQ ID NO: 4336076 - DNA, 16 bp, Homo sapiens
tccctgaccccctgtc

SEQ ID NO: 4336077 - DNA, 19 bp, Homo sapiens
tccctggaggtctctccct

SEQ ID NO: 4336078 - DNA, 15 bp, Homo sapiens
tccctgtctctgcat

SEQ ID NO: 4336079 - DNA, 19 bp, Homo sapiens
tccctgtctctgcatctga

SEQ ID NO: 4336080 - DNA, 15 bp, Homo sapiens
tcccttctcctgccc

SEQ ID NO: 4336081 - DNA, 20 bp, Homo sapiens
tcccttctttgcttcttttt

SEQ ID NO: 4336082 - DNA, 20 bp, Homo sapiens
tcccttgctttttgctgtgt

SEQ ID NO: 4336083 - DNA, 16 bp, Homo sapiens
tcccttggatcagagg

SEQ ID NO: 4336084 - DNA, 22 bp, Homo sapiens
tccctttccaaatgcccagctt

SEQ ID NO: 4336085 - DNA, 20 bp, Homo sapiens
tcctaatgccctatgtgtat

SEQ ID NO: 4336086 - DNA, 14 bp, Homo sapiens
tcctaatggcatgg

SEQ ID NO: 4336087 - DNA, 22 bp, Homo sapiens
tcctaatggcatggagactctg

SEQ ID NO: 4336088 - DNA, 13 bp, Homo sapiens
tcctacagcacta

SEQ ID NO: 4336089 - DNA, 15 bp, Homo sapiens
tcctacagcactact

SEQ ID NO: 4336090 - DNA, 14 bp, Homo sapiens
tcctacagtacaat

SEQ ID NO: 4336091 - DNA, 16 bp, Homo sapiens
tcctacagtacaatca

SEQ ID NO: 4336092 - DNA, 15 bp, Homo sapiens
tcctactcctggagc

SEQ ID NO: 4336093 - DNA, 16 bp, Homo sapiens
tcctactcctggagca

SEQ ID NO: 4336094 - DNA, 12 bp, Homo sapiens
tcctagacactc

SEQ ID NO: 4336095 - DNA, 19 bp, Homo sapiens
tcctagccccacccagagg

SEQ ID NO: 4336096 - DNA, 14 bp, Homo sapiens
tcctcagcaggcca

SEQ ID NO: 4336097 - DNA, 14 bp, Homo sapiens
tcctcctctcctgg

SEQ ID NO: 4336098 - DNA, 23 bp, Homo sapiens
tcctctcctttgaaacctgctct

SEQ ID NO: 4336099 - DNA, 15 bp, Homo sapiens
tcctctctttgttct

SEQ ID NO: 4336100 - DNA, 19 bp, Homo sapiens
tcctctctttgttctcagc

SEQ ID NO: 4336101 - DNA, 12 bp, Homo sapiens
tcctcttcccag

SEQ ID NO: 4336102 - DNA, 17 bp, Homo sapiens
tcctcttcccagagtca

SEQ ID NO: 4336103 - DNA, 14 bp, Homo sapiens
tcctctttgccctg

SEQ ID NO: 4336104 - DNA, 16 bp, Homo sapiens
tcctgagtggccaggg

SEQ ID NO: 4336105 - DNA, 18 bp, Homo sapiens
tcctgattaccagtctga

SEQ ID NO: 4336106 - DNA, 15 bp, Homo sapiens
tcctgcactgtttaa

SEQ ID NO: 4336107 - DNA, 14 bp, Homo sapiens
tcctgcccagtccc

SEQ ID NO: 4336108 - DNA, 17 bp, Homo sapiens
tcctgcccagtccccca

SEQ ID NO: 4336109 - DNA, 23 bp, Homo sapiens
tcctgcctcccgcctcccgccac

SEQ ID NO: 4336110 - DNA, 21 bp, Homo sapiens
tcctgctgaaagtcctgcttt

SEQ ID NO: 4336111 - DNA, 22 bp, Homo sapiens
tcctgctgaaagtcctgctttc

SEQ ID NO: 4336112 - DNA, 13 bp, Homo sapiens
tcctggagcactg

SEQ ID NO: 4336113 - DNA, 20 bp, Homo sapiens
tcctgggcatgtttgtctgt

SEQ ID NO: 4336114 - DNA, 16 bp, Homo sapiens
tcctgttctctttgcc

SEQ ID NO: 4336115 - DNA, 11 bp, Homo sapiens
tccttaaatga

SEQ ID NO: 4336116 - DNA, 14 bp, Homo sapiens
tccttacttgcact

SEQ ID NO: 4336117 - DNA, 20 bp, Homo sapiens
tccttcagctgactccagta

SEQ ID NO: 4336118 - DNA, 13 bp, Homo sapiens
tccttcctaccct

SEQ ID NO: 4336119 - DNA, 14 bp, Homo sapiens
tccttgcacctgag

SEQ ID NO: 4336120 - DNA, 17 bp, Homo sapiens
tccttgcacctgagcct

SEQ ID NO: 4336121 - DNA, 18 bp, Homo sapiens
tccttgcacctgagcctg

SEQ ID NO: 4336122 - DNA, 16 bp, Homo sapiens
tccttggaagtttcat

SEQ ID NO: 4336123 - DNA, 21 bp, Homo sapiens
tcctttcttttttttcttggt

SEQ ID NO: 4336124 - DNA, 17 bp, Homo sapiens
tcctttgtggttttatg

SEQ ID NO: 4336125 - DNA, 12 bp, Homo sapiens
tccttttatgtg

SEQ ID NO: 4336126 - DNA, 15 bp, Homo sapiens
tcgacatcctagccc

SEQ ID NO: 4336127 - DNA, 12 bp, Homo sapiens
tcgcaactgaag

SEQ ID NO: 4336128 - DNA, 23 bp, Homo sapiens
tcgcccacaagccttactcacct

SEQ ID NO: 4336129 - DNA, 23 bp, Homo sapiens
tcgctgtgtcagcatagaagtaa

SEQ ID NO: 4336130 - DNA, 16 bp, Homo sapiens
tcgcttgcttctgcag

SEQ ID NO: 4336131 - DNA, 15 bp, Homo sapiens
tcggaagaacatgaa

SEQ ID NO: 4336132 - DNA, 14 bp, Homo sapiens
tcgggattccctgg

SEQ ID NO: 4336133 - DNA, 15 bp, Homo sapiens
tcgggattccctggt

SEQ ID NO: 4336134 - DNA, 14 bp, Homo sapiens
tcttaaacttgtga

SEQ ID NO: 4336135 - DNA, 16 bp, Homo sapiens
tcttaaacttgtgaat

SEQ ID NO: 4336136 - DNA, 15 bp, Homo sapiens
tcttaaatcatttgg

SEQ ID NO: 4336137 - DNA, 14 bp, Homo sapiens
tcttaactgtattt

SEQ ID NO: 4336138 - DNA, 22 bp, Homo sapiens
tcttacttgtcctttgaggccc

SEQ ID NO: 4336139 - DNA, 20 bp, Homo sapiens
tcttaggttggcaaaaaggc

SEQ ID NO: 4336140 - DNA, 20 bp, Homo sapiens
tcttagtgcttcagagtttg

SEQ ID NO: 4336141 - DNA, 21 bp, Homo sapiens
tcttagtgcttcagagtttgt

SEQ ID NO: 4336142 - DNA, 15 bp, Homo sapiens
tcttatgattttatt

SEQ ID NO: 4336143 - DNA, 17 bp, Homo sapiens
tcttatgcttataatat

SEQ ID NO: 4336144 - DNA, 19 bp, Homo sapiens
tcttcagaattatccatta

SEQ ID NO: 4336145 - DNA, 20 bp, Homo sapiens
tcttcagactctcagcccag

SEQ ID NO: 4336146 - DNA, 23 bp, Homo sapiens
tcttcagactctcagcccagaag

SEQ ID NO: 4336147 - DNA, 15 bp, Homo sapiens
tcttcaggtaacact

SEQ ID NO: 4336148 - DNA, 18 bp, Homo sapiens
tcttcaggtaacactaca

SEQ ID NO: 4336149 - DNA, 15 bp, Homo sapiens
tcttcagtaagccgt

SEQ ID NO: 4336150 - DNA, 14 bp, Homo sapiens
tcttccacctctgg

SEQ ID NO: 4336151 - DNA, 14 bp, Homo sapiens
tcttcccagagtca

SEQ ID NO: 4336152 - DNA, 15 bp, Homo sapiens
tcttcccagagtcac

SEQ ID NO: 4336153 - DNA, 19 bp, Homo sapiens
tcttcccccgctaattcat

SEQ ID NO: 4336154 - DNA, 20 bp, Homo sapiens
tcttctccaattctgaaata

SEQ ID NO: 4336155 - DNA, 13 bp, Homo sapiens
tcttctttattgc

SEQ ID NO: 4336156 - DNA, 18 bp, Homo sapiens
tcttctttattgcactag

SEQ ID NO: 4336157 - DNA, 13 bp, Homo sapiens
tcttgagcctggg

SEQ ID NO: 4336158 - DNA, 16 bp, Homo sapiens
tcttgagcctgggagg

SEQ ID NO: 4336159 - DNA, 15 bp, Homo sapiens
tcttgcactgtccag

SEQ ID NO: 4336160 - DNA, 19 bp, Homo sapiens
tcttgcactgtccagctgg

SEQ ID NO: 4336161 - DNA, 18 bp, Homo sapiens
tcttggacctatcaaaaa

SEQ ID NO: 4336162 - DNA, 22 bp, Homo sapiens
tcttggacctatcaaaaactga

SEQ ID NO: 4336163 - DNA, 14 bp, Homo sapiens
tcttggaccttggc

SEQ ID NO: 4336164 - DNA, 22 bp, Homo sapiens
tcttggtcaagtttttctctca

SEQ ID NO: 4336165 - DNA, 18 bp, Homo sapiens
tcttggtcatgtcctgag

SEQ ID NO: 4336166 - DNA, 14 bp, Homo sapiens
tcttgtgaaatggc

SEQ ID NO: 4336167 - DNA, 21 bp, Homo sapiens
tctttacccctgctgacctcc

SEQ ID NO: 4336168 - DNA, 20 bp, Homo sapiens
tctttattgcactaggaatt

SEQ ID NO: 4336169 - DNA, 15 bp, Homo sapiens
tctttcctcccttct

SEQ ID NO: 4336170 - DNA, 23 bp, Homo sapiens
tctttgcattccttacttgcact

SEQ ID NO: 4336171 - DNA, 21 bp, Homo sapiens
tctttggataataggaattca

SEQ ID NO: 4336172 - DNA, 15 bp, Homo sapiens
tctttgtcaatgctc

SEQ ID NO: 4336173 - DNA, 16 bp, Homo sapiens
tctttgttctcagctc

SEQ ID NO: 4336174 - DNA, 17 bp, Homo sapiens
tctttgttctcagctcc

SEQ ID NO: 4336175 - DNA, 17 bp, Homo sapiens
tctttgtttaaatgcca

SEQ ID NO: 4336176 - DNA, 12 bp, Homo sapiens
tcttttattatc

SEQ ID NO: 4336177 - DNA, 16 bp, Homo sapiens
tcttttggaaataatt

SEQ ID NO: 4336178 - DNA, 22 bp, Homo sapiens
tcttttttttaggcaaaacctt

SEQ ID NO: 4336179 - DNA, 21 bp, Homo sapiens
tgaaaaaggaaaaatgtagac

SEQ ID NO: 4336180 - DNA, 22 bp, Homo sapiens
tgaaaaagtgtacatgaagaat

SEQ ID NO: 4336181 - DNA, 16 bp, Homo sapiens
tgaaaacaaacttctc

SEQ ID NO: 4336182 - DNA, 13 bp, Homo sapiens
tgaaaacactaac

SEQ ID NO: 4336183 - DNA, 13 bp, Homo sapiens
tgaaaataattgt

SEQ ID NO: 4336184 - DNA, 18 bp, Homo sapiens
tgaaacatgtgcccctgc

SEQ ID NO: 4336185 - DNA, 20 bp, Homo sapiens
tgaaacgagaagtgccctta

SEQ ID NO: 4336186 - DNA, 12 bp, Homo sapiens
tgaaataaaaat

SEQ ID NO: 4336187 - DNA, 16 bp, Homo sapiens
tgaaataaaaattatg

SEQ ID NO: 4336188 - DNA, 21 bp, Homo sapiens
tgaaatagtttccaagaaatt

SEQ ID NO: 4336189 - DNA, 15 bp, Homo sapiens
tgaaattaacaagaa

SEQ ID NO: 4336190 - DNA, 17 bp, Homo sapiens
tgaaccaatagaaagca

SEQ ID NO: 4336191 - DNA, 15 bp, Homo sapiens
tgaactactgctatt

SEQ ID NO: 4336192 - DNA, 21 bp, Homo sapiens
tgaagaaaccttcagatttgt

SEQ ID NO: 4336193 - DNA, 23 bp, Homo sapiens
tgaagaaattatacgtacataca

SEQ ID NO: 4336194 - DNA, 21 bp, Homo sapiens
tgaagaataggtgcaaacaaa

SEQ ID NO: 4336195 - DNA, 19 bp, Homo sapiens
tgaagaattgtagttctta

SEQ ID NO: 4336196 - DNA, 20 bp, Homo sapiens
tgaagcaccagggagaggcc

SEQ ID NO: 4336197 - DNA, 22 bp, Homo sapiens
tgaagcaccagggagaggcctc

SEQ ID NO: 4336198 - DNA, 11 bp, Homo sapiens
tgaagcagagg

SEQ ID NO: 4336199 - DNA, 13 bp, Homo sapiens
tgaagcagaggaa

SEQ ID NO: 4336200 - DNA, 17 bp, Homo sapiens
tgaagcagaggaaggaa

SEQ ID NO: 4336201 - DNA, 23 bp, Homo sapiens
tgaagccagatctcgggactcag

SEQ ID NO: 4336202 - DNA, 13 bp, Homo sapiens
tgaagctggccct

SEQ ID NO: 4336203 - DNA, 17 bp, Homo sapiens
tgaagctggccctcagc

SEQ ID NO: 4336204 - DNA, 18 bp, Homo sapiens
tgaagctggccctcagct

SEQ ID NO: 4336205 - DNA, 19 bp, Homo sapiens
tgaagctggccctcagctc

SEQ ID NO: 4336206 - DNA, 14 bp, Homo sapiens
tgaaggaaggctga

SEQ ID NO: 4336207 - DNA, 18 bp, Homo sapiens
tgaaggattaatgaaaac

SEQ ID NO: 4336208 - DNA, 16 bp, Homo sapiens
tgaagtacagtcccag

SEQ ID NO: 4336209 - DNA, 19 bp, Homo sapiens
tgaagtcaaaccttaagat

SEQ ID NO: 4336210 - DNA, 22 bp, Homo sapiens
tgaagtcaaaccttaagataat

SEQ ID NO: 4336211 - DNA, 22 bp, Homo sapiens
tgaataaaaaataaataaaatg

SEQ ID NO: 4336212 - DNA, 12 bp, Homo sapiens
tgaataatacag

SEQ ID NO: 4336213 - DNA, 22 bp, Homo sapiens
tgaatattactcctatttttgt

SEQ ID NO: 4336214 - DNA, 13 bp, Homo sapiens
tgaatcatgtctg

SEQ ID NO: 4336215 - DNA, 23 bp, Homo sapiens
tgaatcatgtctgtatccccagt

SEQ ID NO: 4336216 - DNA, 18 bp, Homo sapiens
tgaatgctgagctgaaga

SEQ ID NO: 4336217 - DNA, 20 bp, Homo sapiens
tgaatgctgagctgaagaaa

SEQ ID NO: 4336218 - DNA, 19 bp, Homo sapiens
tgaattagaagaaaatgga

SEQ ID NO: 4336219 - DNA, 20 bp, Homo sapiens
tgaatttatgagatttactg

SEQ ID NO: 4336220 - DNA, 12 bp, Homo sapiens
tgaatttttaat

SEQ ID NO: 4336221 - DNA, 17 bp, Homo sapiens
tgacacagcttgtgaat

SEQ ID NO: 4336222 - DNA, 21 bp, Homo sapiens
tgacacttatctcactgtttt

SEQ ID NO: 4336223 - DNA, 20 bp, Homo sapiens
tgacataattgtccagttat

SEQ ID NO: 4336224 - DNA, 12 bp, Homo sapiens
tgacatagcctt

SEQ ID NO: 4336225 - DNA, 16 bp, Homo sapiens
tgacatagcctttgtg

SEQ ID NO: 4336226 - DNA, 17 bp, Homo sapiens
tgacatagcctttgtgc

SEQ ID NO: 4336227 - DNA, 17 bp, Homo sapiens
tgacatcagatttctta

SEQ ID NO: 4336228 - DNA, 21 bp, Homo sapiens
tgacatcagatttcttaatgt

SEQ ID NO: 4336229 - DNA, 13 bp, Homo sapiens
tgacattcactgg

SEQ ID NO: 4336230 - DNA, 15 bp, Homo sapiens
tgaccattgaaaaag

SEQ ID NO: 4336231 - DNA, 17 bp, Homo sapiens
tgaccattgaaaaagga

SEQ ID NO: 4336232 - DNA, 14 bp, Homo sapiens
tgacccctttcccc

SEQ ID NO: 4336233 - DNA, 16 bp, Homo sapiens
tgacccctttccccca

SEQ ID NO: 4336234 - DNA, 17 bp, Homo sapiens
tgacccctttcccccac

SEQ ID NO: 4336235 - DNA, 18 bp, Homo sapiens
tgacccctttcccccacc

SEQ ID NO: 4336236 - DNA, 20 bp, Homo sapiens
tgacccctttcccccacccc

SEQ ID NO: 4336237 - DNA, 21 bp, Homo sapiens
tgacctcccacctatccgccc

SEQ ID NO: 4336238 - DNA, 15 bp, Homo sapiens
tgacgttgttgtcat

SEQ ID NO: 4336239 - DNA, 20 bp, Homo sapiens
tgacgttgttgtcattgtcc

SEQ ID NO: 4336240 - DNA, 17 bp, Homo sapiens
tgactattttttaataa

SEQ ID NO: 4336241 - DNA, 19 bp, Homo sapiens
tgactattttttaataaaa

SEQ ID NO: 4336242 - DNA, 17 bp, Homo sapiens
tgactgatggtttggaa

SEQ ID NO: 4336243 - DNA, 21 bp, Homo sapiens
tgactgatggtttggaaaata

SEQ ID NO: 4336244 - DNA, 14 bp, Homo sapiens
tgactggttgtcag

SEQ ID NO: 4336245 - DNA, 15 bp, Homo sapiens
tgactggttgtcaga

SEQ ID NO: 4336246 - DNA, 20 bp, Homo sapiens
tgactggttgtcagaatgga

SEQ ID NO: 4336247 - DNA, 23 bp, Homo sapiens
tgacttaggtaaaataaaagact

SEQ ID NO: 4336248 - DNA, 13 bp, Homo sapiens
tgacttctgtggt

SEQ ID NO: 4336249 - DNA, 20 bp, Homo sapiens
tgagaagcagaggaaggaga

SEQ ID NO: 4336250 - DNA, 17 bp, Homo sapiens
tgagaataattatttca

SEQ ID NO: 4336251 - DNA, 15 bp, Homo sapiens
tgagaatctgtgcag

SEQ ID NO: 4336252 - DNA, 15 bp, Homo sapiens
tgagaccagaagaaa

SEQ ID NO: 4336253 - DNA, 16 bp, Homo sapiens
tgagaccagaagaaaa

SEQ ID NO: 4336254 - DNA, 16 bp, Homo sapiens
tcgggcatgagtctgt

SEQ ID NO: 4336255 - DNA, 17 bp, Homo sapiens
tcgtatcataatttctt

SEQ ID NO: 4336256 - DNA, 15 bp, Homo sapiens
tcgttagaccgctct

SEQ ID NO: 4336257 - DNA, 23 bp, Homo sapiens
tcgttagaccgctctcttttctg

SEQ ID NO: 4336258 - DNA, 15 bp, Homo sapiens
tcgttcgatttaagc

SEQ ID NO: 4336259 - DNA, 20 bp, Homo sapiens
tctaaaatggacattttctt

SEQ ID NO: 4336260 - DNA, 13 bp, Homo sapiens
tctaaagctttat

SEQ ID NO: 4336261 - DNA, 19 bp, Homo sapiens
tctaaagctttatctttgt

SEQ ID NO: 4336262 - DNA, 22 bp, Homo sapiens
tctaacagctccatacttcttt

SEQ ID NO: 4336263 - DNA, 14 bp, Homo sapiens
tctaagaaaagaga

SEQ ID NO: 4336264 - DNA, 19 bp, Homo sapiens
tctaatatccccaaattag

SEQ ID NO: 4336265 - DNA, 20 bp, Homo sapiens
tctaatgagttgctggaaaa

SEQ ID NO: 4336266 - DNA, 22 bp, Homo sapiens
tctaatgagttgctggaaaatc

SEQ ID NO: 4336267 - DNA, 13 bp, Homo sapiens
tctacaaagcact

SEQ ID NO: 4336268 - DNA, 15 bp, Homo sapiens
tctacattattgctt

SEQ ID NO: 4336269 - DNA, 15 bp, Homo sapiens
tctacattcttggtt

SEQ ID NO: 4336270 - DNA, 12 bp, Homo sapiens
tctaccccacct

SEQ ID NO: 4336271 - DNA, 14 bp, Homo sapiens
tctaccccacctga

SEQ ID NO: 4336272 - DNA, 13 bp, Homo sapiens
tctacctctgact

SEQ ID NO: 4336273 - DNA, 22 bp, Homo sapiens
tctactcaaacacttattgttt

SEQ ID NO: 4336274 - DNA, 23 bp, Homo sapiens
tctactttttgtatttagtagtt

SEQ ID NO: 4336275 - DNA, 18 bp, Homo sapiens
tctagacactccttgaaa

SEQ ID NO: 4336276 - DNA, 18 bp, Homo sapiens
tctagcatttatttctct

SEQ ID NO: 4336277 - DNA, 12 bp, Homo sapiens
tctagggaaaaa

SEQ ID NO: 4336278 - DNA, 19 bp, Homo sapiens
tctagggaaaaaccagcgt

SEQ ID NO: 4336279 - DNA, 17 bp, Homo sapiens
tctagtttccctggtgc

SEQ ID NO: 4336280 - DNA, 18 bp, Homo sapiens
tctataaagaaacttttg

SEQ ID NO: 4336281 - DNA, 23 bp, Homo sapiens
tctataagtgttcagtgttgaca

SEQ ID NO: 4336282 - DNA, 15 bp, Homo sapiens
tctatcggaagaaca

SEQ ID NO: 4336283 - DNA, 20 bp, Homo sapiens
tctatcggaagaacatgaat

SEQ ID NO: 4336284 - DNA, 22 bp, Homo sapiens
tctatcggaagaacatgaatct

SEQ ID NO: 4336285 - DNA, 19 bp, Homo sapiens
tctatgatatatttatatc

SEQ ID NO: 4336286 - DNA, 18 bp, Homo sapiens
tctatggagactttgctg

SEQ ID NO: 4336287 - DNA, 21 bp, Homo sapiens
tctatggagcaaaacaaagct

SEQ ID NO: 4336288 - DNA, 15 bp, Homo sapiens
tctattattgaaata

SEQ ID NO: 4336289 - DNA, 16 bp, Homo sapiens
tctcaaaaaaagaaaa

SEQ ID NO: 4336290 - DNA, 13 bp, Homo sapiens
tctcaagacttct

SEQ ID NO: 4336291 - DNA, 22 bp, Homo sapiens
tctcacaggcagctctgagccg

SEQ ID NO: 4336292 - DNA, 20 bp, Homo sapiens
tctcactgccatgccagctt

SEQ ID NO: 4336293 - DNA, 13 bp, Homo sapiens
tctcagcccagaa

SEQ ID NO: 4336294 - DNA, 14 bp, Homo sapiens
tctcagcccagaag

SEQ ID NO: 4336295 - DNA, 20 bp, Homo sapiens
tctcagcccagaagaaaatt

SEQ ID NO: 4336296 - DNA, 15 bp, Homo sapiens
tctcagtacctcccc

SEQ ID NO: 4336297 - DNA, 16 bp, Homo sapiens
tctcagtacctcccct

SEQ ID NO: 4336298 - DNA, 20 bp, Homo sapiens
tctcagttgcagaaaatgaa

SEQ ID NO: 4336299 - DNA, 22 bp, Homo sapiens
tctcagttgcagaaaatgaact

SEQ ID NO: 4336300 - DNA, 20 bp, Homo sapiens
tctcatcacagtgggaagaa

SEQ ID NO: 4336301 - DNA, 15 bp, Homo sapiens
tctcatcttgtgaaa

SEQ ID NO: 4336302 - DNA, 23 bp, Homo sapiens
tctccacacggagctcctggcag

SEQ ID NO: 4336303 - DNA, 21 bp, Homo sapiens
tctccagcctggacccccagc

SEQ ID NO: 4336304 - DNA, 23 bp, Homo sapiens
tctccagcctggacccccagctt

SEQ ID NO: 4336305 - DNA, 12 bp, Homo sapiens
tctcccaaggct

SEQ ID NO: 4336306 - DNA, 19 bp, Homo sapiens
tctcccaaggctgcgtctg

SEQ ID NO: 4336307 - DNA, 14 bp, Homo sapiens
tctcccacccaagg

SEQ ID NO: 4336308 - DNA, 13 bp, Homo sapiens
tctcccagatcct

SEQ ID NO: 4336309 - DNA, 12 bp, Homo sapiens
tctcccaggcct

SEQ ID NO: 4336310 - DNA, 17 bp, Homo sapiens
tctcccaggcctctgcc

SEQ ID NO: 4336311 - DNA, 20 bp, Homo sapiens
tctcccaggcctctgcccca

SEQ ID NO: 4336312 - DNA, 12 bp, Homo sapiens
tctccccagaat

SEQ ID NO: 4336313 - DNA, 12 bp, Homo sapiens
tctccctagccc

SEQ ID NO: 4336314 - DNA, 14 bp, Homo sapiens
tctccctagccctt

SEQ ID NO: 4336315 - DNA, 22 bp, Homo sapiens
tctccctagcccttctacccca

SEQ ID NO: 4336316 - DNA, 23 bp, Homo sapiens
tctccctccccaaatggctgctt

SEQ ID NO: 4336317 - DNA, 14 bp, Homo sapiens
tctcctgtccccgg

SEQ ID NO: 4336318 - DNA, 12 bp, Homo sapiens
tctcctttgaaa

SEQ ID NO: 4336319 - DNA, 16 bp, Homo sapiens
tctccttttccttacc

SEQ ID NO: 4336320 - DNA, 15 bp, Homo sapiens
tctcgtttctgccca

SEQ ID NO: 4336321 - DNA, 22 bp, Homo sapiens
tctctaacagctccatacttct

SEQ ID NO: 4336322 - DNA, 14 bp, Homo sapiens
tctctaagaaaaga

SEQ ID NO: 4336323 - DNA, 16 bp, Homo sapiens
tctctaagaaaagaga

SEQ ID NO: 4336324 - DNA, 19 bp, Homo sapiens
tctctataagtgttcagtg

SEQ ID NO: 4336325 - DNA, 20 bp, Homo sapiens
tctctccctcccccagagcc

SEQ ID NO: 4336326 - DNA, 21 bp, Homo sapiens
tctctctaagtttagaagcgc

SEQ ID NO: 4336327 - DNA, 18 bp, Homo sapiens
tctctcttcagactctca

SEQ ID NO: 4336328 - DNA, 20 bp, Homo sapiens
tctctcttcagactctcagc

SEQ ID NO: 4336329 - DNA, 20 bp, Homo sapiens
tctctgcccccattgatttt

SEQ ID NO: 4336330 - DNA, 21 bp, Homo sapiens
tctctgcccccattgattttt

SEQ ID NO: 4336331 - DNA, 15 bp, Homo sapiens
tctctgtggctccaa

SEQ ID NO: 4336332 - DNA, 14 bp, Homo sapiens
tctcttgagagggt

SEQ ID NO: 4336333 - DNA, 17 bp, Homo sapiens
tctcttgagcctgggag

SEQ ID NO: 4336334 - DNA, 18 bp, Homo sapiens
tctcttgagcctgggagg

SEQ ID NO: 4336335 - DNA, 23 bp, Homo sapiens
tctctttgttctcagctccccct

SEQ ID NO: 4336336 - DNA, 15 bp, Homo sapiens
tctctttttcttttc

SEQ ID NO: 4336337 - DNA, 16 bp, Homo sapiens
tctgaaccccctttcc

SEQ ID NO: 4336338 - DNA, 20 bp, Homo sapiens
tctgaagtgtcctaaatatt

SEQ ID NO: 4336339 - DNA, 22 bp, Homo sapiens
tctgaatgctgagctgaagaaa

SEQ ID NO: 4336340 - DNA, 17 bp, Homo sapiens
tctgaattgagaaaaga

SEQ ID NO: 4336341 - DNA, 18 bp, Homo sapiens
tctgaattgagaaaagag

SEQ ID NO: 4336342 - DNA, 12 bp, Homo sapiens
tctgactgatgg

SEQ ID NO: 4336343 - DNA, 18 bp, Homo sapiens
tctgagttctctttctta

SEQ ID NO: 4336344 - DNA, 17 bp, Homo sapiens
tctgatatgctgagaaa

SEQ ID NO: 4336345 - DNA, 22 bp, Homo sapiens
tctgatctgtactttgtgttta

SEQ ID NO: 4336346 - DNA, 13 bp, Homo sapiens
tctgattccatat

SEQ ID NO: 4336347 - DNA, 12 bp, Homo sapiens
tctgcaagaggg

SEQ ID NO: 4336348 - DNA, 18 bp, Homo sapiens
tctgcaagagggggcatt

SEQ ID NO: 4336349 - DNA, 15 bp, Homo sapiens
tctgcagcaactccc

SEQ ID NO: 4336350 - DNA, 21 bp, Homo sapiens
tctgcagcaactcccacgact

SEQ ID NO: 4336351 - DNA, 18 bp, Homo sapiens
tctgcatctgactctctt

SEQ ID NO: 4336352 - DNA, 15 bp, Homo sapiens
tctgcccttacccca

SEQ ID NO: 4336353 - DNA, 12 bp, Homo sapiens
tctgcctggcaa

SEQ ID NO: 4336354 - DNA, 22 bp, Homo sapiens
tctgcctgggatgcccttcccc

SEQ ID NO: 4336355 - DNA, 19 bp, Homo sapiens
tctgctttctttgattctc

SEQ ID NO: 4336356 - DNA, 11 bp, Homo sapiens
tctggaagaaa

SEQ ID NO: 4336357 - DNA, 16 bp, Homo sapiens
tctggattcacagacc

SEQ ID NO: 4336358 - DNA, 19 bp, Homo sapiens
tctggcaaacttttctttc

SEQ ID NO: 4336359 - DNA, 18 bp, Homo sapiens
tctggcacgtggccagga

SEQ ID NO: 4336360 - DNA, 20 bp, Homo sapiens
tctggcacgtggccaggagc

SEQ ID NO: 4336361 - DNA, 23 bp, Homo sapiens
tctggcttttcgcttgcttctgc

SEQ ID NO: 4336362 - DNA, 21 bp, Homo sapiens
tctgggaagatttgaaaacaa

SEQ ID NO: 4336363 - DNA, 14 bp, Homo sapiens
tctgtacttcctga

SEQ ID NO: 4336364 - DNA, 13 bp, Homo sapiens
tctgtatccccag

SEQ ID NO: 4336365 - DNA, 15 bp, Homo sapiens
tctgtccagccgtgt

SEQ ID NO: 4336366 - DNA, 17 bp, Homo sapiens
tctgtctctctctcttt

SEQ ID NO: 4336367 - DNA, 16 bp, Homo sapiens
tctgtgcacactaaga

SEQ ID NO: 4336368 - DNA, 13 bp, Homo sapiens
tctgtgcatgtgc

SEQ ID NO: 4336369 - DNA, 20 bp, Homo sapiens
tctgtgcttccttggttcat

SEQ ID NO: 4336370 - DNA, 17 bp, Homo sapiens
tctgtggacaagacatg

SEQ ID NO: 4336371 - DNA, 13 bp, Homo sapiens
tctgtggccagga

SEQ ID NO: 4336372 - DNA, 14 bp, Homo sapiens
tctgtgtacataaa

SEQ ID NO: 4336373 - DNA, 13 bp, Homo sapiens
tctgtgttgcttc

SEQ ID NO: 4336374 - DNA, 13 bp, Homo sapiens
tctgtttcccaag

SEQ ID NO: 4336375 - DNA, 17 bp, Homo sapiens
tgagaccagaagaaaag

SEQ ID NO: 4336376 - DNA, 12 bp, Homo sapiens
tgagaccctgtc

SEQ ID NO: 4336377 - DNA, 22 bp, Homo sapiens
tgagacctggggtttagaaccc

SEQ ID NO: 4336378 - DNA, 13 bp, Homo sapiens
tgagactaagaga

SEQ ID NO: 4336379 - DNA, 18 bp, Homo sapiens
tgagactattatgaaatc

SEQ ID NO: 4336380 - DNA, 17 bp, Homo sapiens
tgagaggtttgcatcca

SEQ ID NO: 4336381 - DNA, 20 bp, Homo sapiens
tgagagttggggagaaactg

SEQ ID NO: 4336382 - DNA, 15 bp, Homo sapiens
tgagatcaaaacggt

SEQ ID NO: 4336383 - DNA, 15 bp, Homo sapiens
tgagatcagcctggg

SEQ ID NO: 4336384 - DNA, 14 bp, Homo sapiens
tgagattaggctga

SEQ ID NO: 4336385 - DNA, 18 bp, Homo sapiens
tgagattgccccaggtct

SEQ ID NO: 4336386 - DNA, 16 bp, Homo sapiens
tgagatttactgctct

SEQ ID NO: 4336387 - DNA, 21 bp, Homo sapiens
tgagatttactgctctagaaa

SEQ ID NO: 4336388 - DNA, 19 bp, Homo sapiens
tgagcagcatctagtttcc

SEQ ID NO: 4336389 - DNA, 17 bp, Homo sapiens
tgagccccagccccaat

SEQ ID NO: 4336390 - DNA, 11 bp, Homo sapiens
tgagcctggca

SEQ ID NO: 4336391 - DNA, 22 bp, Homo sapiens
tgagcctgggaggtcaaggctg

SEQ ID NO: 4336392 - DNA, 15 bp, Homo sapiens
tgagcgtgtccacag

SEQ ID NO: 4336393 - DNA, 16 bp, Homo sapiens
tgagcgtgtccacaga

SEQ ID NO: 4336394 - DNA, 17 bp, Homo sapiens
tgagctatagtgaagaa

SEQ ID NO: 4336395 - DNA, 20 bp, Homo sapiens
tgagctatagtgaagaatag

SEQ ID NO: 4336396 - DNA, 16 bp, Homo sapiens
tgagctgaagaaatta

SEQ ID NO: 4336397 - DNA, 19 bp, Homo sapiens
tgagctttctgtgcatgtg

SEQ ID NO: 4336398 - DNA, 15 bp, Homo sapiens
tgaggaactgtacag

SEQ ID NO: 4336399 - DNA, 17 bp, Homo sapiens
tgaggaactgtacagaa

SEQ ID NO: 4336400 - DNA, 14 bp, Homo sapiens
tgaggccccaactc

SEQ ID NO: 4336401 - DNA, 19 bp, Homo sapiens
tgaggctctctaagaaaag

SEQ ID NO: 4336402 - DNA, 14 bp, Homo sapiens
tgaggctgggcagg

SEQ ID NO: 4336403 - DNA, 12 bp, Homo sapiens
tgagggcaaatc

SEQ ID NO: 4336404 - DNA, 14 bp, Homo sapiens
tgaggggtttcttt

SEQ ID NO: 4336405 - DNA, 17 bp, Homo sapiens
tgagggttaatttctag

SEQ ID NO: 4336406 - DNA, 23 bp, Homo sapiens
tgagggtttccttcggggaccag

SEQ ID NO: 4336407 - DNA, 14 bp, Homo sapiens
tgagggtttctgat

SEQ ID NO: 4336408 - DNA, 20 bp, Homo sapiens
tgaggtcacatgttggtgct

SEQ ID NO: 4336409 - DNA, 19 bp, Homo sapiens
tgaggtttcaaacctccct

SEQ ID NO: 4336410 - DNA, 19 bp, Homo sapiens
tgagtccagaagtttgaga

SEQ ID NO: 4336411 - DNA, 16 bp, Homo sapiens
tgagtctcccaaggct

SEQ ID NO: 4336412 - DNA, 14 bp, Homo sapiens
tgagtctctggggc

SEQ ID NO: 4336413 - DNA, 20 bp, Homo sapiens
tgagtctgaaccaatagaaa

SEQ ID NO: 4336414 - DNA, 13 bp, Homo sapiens
tgagtctgtttcc

SEQ ID NO: 4336415 - DNA, 19 bp, Homo sapiens
tgagtctgtttcccaagct

SEQ ID NO: 4336416 - DNA, 21 bp, Homo sapiens
tgagtcttaactgtatttcag

SEQ ID NO: 4336417 - DNA, 23 bp, Homo sapiens
tgagtcttaactgtatttcagta

SEQ ID NO: 4336418 - DNA, 14 bp, Homo sapiens
tgagtggccaggga

SEQ ID NO: 4336419 - DNA, 15 bp, Homo sapiens
tgagtggccagggaa

SEQ ID NO: 4336420 - DNA, 17 bp, Homo sapiens
tgagtggccagggaatc

SEQ ID NO: 4336421 - DNA, 22 bp, Homo sapiens
tgagttacttagaatgccataa

SEQ ID NO: 4336422 - DNA, 21 bp, Homo sapiens
tgagttctctttcttagtccc

SEQ ID NO: 4336423 - DNA, 22 bp, Homo sapiens
tgagtttgcttatgtaatctca

SEQ ID NO: 4336424 - DNA, 19 bp, Homo sapiens
tgagttttactcttaaatc

SEQ ID NO: 4336425 - DNA, 18 bp, Homo sapiens
tgataaaacaacagctcg

SEQ ID NO: 4336426 - DNA, 17 bp, Homo sapiens
tgataataatattgttt

SEQ ID NO: 4336427 - DNA, 20 bp, Homo sapiens
tgatacccaacagtttattt

SEQ ID NO: 4336428 - DNA, 14 bp, Homo sapiens
tgatcaactgttca

SEQ ID NO: 4336429 - DNA, 17 bp, Homo sapiens
tgatcacatctaaagct

SEQ ID NO: 4336430 - DNA, 22 bp, Homo sapiens
tgatcccctctctgtggctcca

SEQ ID NO: 4336431 - DNA, 18 bp, Homo sapiens
tgatcccttctcctgccc

SEQ ID NO: 4336432 - DNA, 19 bp, Homo sapiens
tgatcccttctcctgccct

SEQ ID NO: 4336433 - DNA, 13 bp, Homo sapiens
tgatctgtacttt

SEQ ID NO: 4336434 - DNA, 14 bp, Homo sapiens
tgatctgtactttg

SEQ ID NO: 4336435 - DNA, 20 bp, Homo sapiens
tgatctgtactttgtgttta

SEQ ID NO: 4336436 - DNA, 19 bp, Homo sapiens
tgatctttgtttaaatgcc

SEQ ID NO: 4336437 - DNA, 13 bp, Homo sapiens
tgatgactgctga

SEQ ID NO: 4336438 - DNA, 14 bp, Homo sapiens
tgatgaggggaggg

SEQ ID NO: 4336439 - DNA, 15 bp, Homo sapiens
tgatgaggggagggg

SEQ ID NO: 4336440 - DNA, 21 bp, Homo sapiens
tgatgcaggcacttattgtaa

SEQ ID NO: 4336441 - DNA, 18 bp, Homo sapiens
tgatgccctgctccaggg

SEQ ID NO: 4336442 - DNA, 13 bp, Homo sapiens
tgatggtttggaa

SEQ ID NO: 4336443 - DNA, 16 bp, Homo sapiens
tgatggtttggaaaat

SEQ ID NO: 4336444 - DNA, 16 bp, Homo sapiens
tgatgttgtgttgtta

SEQ ID NO: 4336445 - DNA, 17 bp, Homo sapiens
tgatgttgtgttgttat

SEQ ID NO: 4336446 - DNA, 16 bp, Homo sapiens
tgattaccagtctgat

SEQ ID NO: 4336447 - DNA, 19 bp, Homo sapiens
tgattctccttttatgtgt

SEQ ID NO: 4336448 - DNA, 13 bp, Homo sapiens
tgattgaaagaaa

SEQ ID NO: 4336449 - DNA, 16 bp, Homo sapiens
tgattgaaagaaaaaa

SEQ ID NO: 4336450 - DNA, 17 bp, Homo sapiens
tgattggttcagttttt

SEQ ID NO: 4336451 - DNA, 20 bp, Homo sapiens
tgatttcccttttttcttcc

SEQ ID NO: 4336452 - DNA, 17 bp, Homo sapiens
tgatttcctcccaaagt

SEQ ID NO: 4336453 - DNA, 18 bp, Homo sapiens
tgatttgatctttgttta

SEQ ID NO: 4336454 - DNA, 21 bp, Homo sapiens
tgattttattacagaaatgtt

SEQ ID NO: 4336455 - DNA, 15 bp, Homo sapiens
tgcaaactctataaa

SEQ ID NO: 4336456 - DNA, 18 bp, Homo sapiens
tgcaaactctataaagaa

SEQ ID NO: 4336457 - DNA, 15 bp, Homo sapiens
tgcaaagtacaatgt

SEQ ID NO: 4336458 - DNA, 19 bp, Homo sapiens
tgcaaagtacaatgtgttt

SEQ ID NO: 4336459 - DNA, 23 bp, Homo sapiens
tgcaaagtacaatgtgtttttct

SEQ ID NO: 4336460 - DNA, 15 bp, Homo sapiens
tgcaaataaagcctt

SEQ ID NO: 4336461 - DNA, 19 bp, Homo sapiens
tgcaaatattggttagtat

SEQ ID NO: 4336462 - DNA, 18 bp, Homo sapiens
tgcaaattatttattact

SEQ ID NO: 4336463 - DNA, 19 bp, Homo sapiens
tgcaaattatttattactt

SEQ ID NO: 4336464 - DNA, 24 bp, Homo sapiens
tgcaaattatttattacttgtgca

SEQ ID NO: 4336465 - DNA, 21 bp, Homo sapiens
tgcaagaatttctggaagaaa

SEQ ID NO: 4336466 - DNA, 21 bp, Homo sapiens
tgcaagattttttttttaagt

SEQ ID NO: 4336467 - DNA, 22 bp, Homo sapiens
tgcaagcatttttccatctgtg

SEQ ID NO: 4336468 - DNA, 23 bp, Homo sapiens
tgcaagcatttttccatctgtgt

SEQ ID NO: 4336469 - DNA, 15 bp, Homo sapiens
tgcacaagctgcacc

SEQ ID NO: 4336470 - DNA, 21 bp, Homo sapiens
tgcacaagctgcaccctcagg

SEQ ID NO: 4336471 - DNA, 18 bp, Homo sapiens
tgcacaaggattgaaaat

SEQ ID NO: 4336472 - DNA, 18 bp, Homo sapiens
tgcacagatatactttgt

SEQ ID NO: 4336473 - DNA, 14 bp, Homo sapiens
tgcaccactgcact

SEQ ID NO: 4336474 - DNA, 21 bp, Homo sapiens
tgcaccactgcactccagcct

SEQ ID NO: 4336475 - DNA, 14 bp, Homo sapiens
tgcacctgagcctg

SEQ ID NO: 4336476 - DNA, 13 bp, Homo sapiens
tgcactaggaatt

SEQ ID NO: 4336477 - DNA, 15 bp, Homo sapiens
tgcactaggaattct

SEQ ID NO: 4336478 - DNA, 12 bp, Homo sapiens
tgcactgtccag

SEQ ID NO: 4336479 - DNA, 20 bp, Homo sapiens
tgcagaaaatgaactgcttt

SEQ ID NO: 4336480 - DNA, 17 bp, Homo sapiens
tgcagaacgtatttagc

SEQ ID NO: 4336481 - DNA, 19 bp, Homo sapiens
tgcagatatccaaacaaga

SEQ ID NO: 4336482 - DNA, 12 bp, Homo sapiens
tgcagcaactcc

SEQ ID NO: 4336483 - DNA, 19 bp, Homo sapiens
tgcagcaactcccacgact

SEQ ID NO: 4336484 - DNA, 13 bp, Homo sapiens
tgcagcttgtgct

SEQ ID NO: 4336485 - DNA, 19 bp, Homo sapiens
tgcagcttgtgctgagcct

SEQ ID NO: 4336486 - DNA, 21 bp, Homo sapiens
tgcagcttgtgctgagcctgc

SEQ ID NO: 4336487 - DNA, 15 bp, Homo sapiens
tgcaggacctcaggt

SEQ ID NO: 4336488 - DNA, 13 bp, Homo sapiens
tgcagggcctggc

SEQ ID NO: 4336489 - DNA, 15 bp, Homo sapiens
tgcagggcctggcat

SEQ ID NO: 4336490 - DNA, 22 bp, Homo sapiens
tgcagggcctggcatagagtag

SEQ ID NO: 4336491 - DNA, 19 bp, Homo sapiens
tgcaggtccggggaggagg

SEQ ID NO: 4336492 - DNA, 19 bp, Homo sapiens
tgcagtttcatgtatgtat

SEQ ID NO: 4336493 - DNA, 16 bp, Homo sapiens
tgcataaaattctaga

SEQ ID NO: 4336494 - DNA, 17 bp, Homo sapiens
tgcatatgctacacata

SEQ ID NO: 4336495 - DNA, 18 bp, Homo sapiens
tgtgcccctgccaaggcc

SEQ ID NO: 4336496 - DNA, 21 bp, Homo sapiens
tgtgcctcccttttctcctct

SEQ ID NO: 4336497 - DNA, 21 bp, Homo sapiens
tgtgcggatgataactactga

SEQ ID NO: 4336498 - DNA, 21 bp, Homo sapiens
tgtgctatatttttaaagaag

SEQ ID NO: 4336499 - DNA, 13 bp, Homo sapiens
tgtgctgagcctg

SEQ ID NO: 4336500 - DNA, 14 bp, Homo sapiens
tgtgctgagcctgc

SEQ ID NO: 4336501 - DNA, 16 bp, Homo sapiens
tgtgctgctgttctgt

SEQ ID NO: 4336502 - DNA, 19 bp, Homo sapiens
tgtgctgtaacctgaagtc

SEQ ID NO: 4336503 - DNA, 22 bp, Homo sapiens
tgtgcttccttggttcatgctt

SEQ ID NO: 4336504 - DNA, 13 bp, Homo sapiens
tgtgcttctcagt

SEQ ID NO: 4336505 - DNA, 21 bp, Homo sapiens
tgtgcttctcagttgcagaaa

SEQ ID NO: 4336506 - DNA, 15 bp, Homo sapiens
tgtgcttctccccag

SEQ ID NO: 4336507 - DNA, 23 bp, Homo sapiens
tgtgcttctcttctttattgcac

SEQ ID NO: 4336508 - DNA, 24 bp, Homo sapiens
tgtgcttctcttctttattgcact

SEQ ID NO: 4336509 - DNA, 22 bp, Homo sapiens
tgtggaaccaaagctggcccag

SEQ ID NO: 4336510 - DNA, 20 bp, Homo sapiens
tgtggaagggccaatggaga

SEQ ID NO: 4336511 - DNA, 15 bp, Homo sapiens
tgtggaccaattatt

SEQ ID NO: 4336512 - DNA, 17 bp, Homo sapiens
tgtggaccaattattga

SEQ ID NO: 4336513 - DNA, 12 bp, Homo sapiens
tgtggagaagcg

SEQ ID NO: 4336514 - DNA, 21 bp, Homo sapiens
tgtggaggagggagagccctg

SEQ ID NO: 4336515 - DNA, 22 bp, Homo sapiens
tgtggaggagggagagccctgt

SEQ ID NO: 4336516 - DNA, 12 bp, Homo sapiens
tgtggccaggag

SEQ ID NO: 4336517 - DNA, 13 bp, Homo sapiens
tgtggccaggagc

SEQ ID NO: 4336518 - DNA, 16 bp, Homo sapiens
tgtggccaggagccct

SEQ ID NO: 4336519 - DNA, 20 bp, Homo sapiens
tgtggccatatatgctgtat

SEQ ID NO: 4336520 - DNA, 20 bp, Homo sapiens
tgtggcccaagtcattccta

SEQ ID NO: 4336521 - DNA, 18 bp, Homo sapiens
tgtgggtgaagtgcctgc

SEQ ID NO: 4336522 - DNA, 10 bp, Homo sapiens
tgtggtttta

SEQ ID NO: 4336523 - DNA, 19 bp, Homo sapiens
tgtgtagttccctctgcct

SEQ ID NO: 4336524 - DNA, 19 bp, Homo sapiens
tgtgtgagcgtgtccacag

SEQ ID NO: 4336525 - DNA, 19 bp, Homo sapiens
tgtgtgatggagggaaggg

SEQ ID NO: 4336526 - DNA, 12 bp, Homo sapiens
tgtgtgcatgtg

SEQ ID NO: 4336527 - DNA, 18 bp, Homo sapiens
tgtgtgcatgtgccgagg

SEQ ID NO: 4336528 - DNA, 12 bp, Homo sapiens
tgtgtgtatttg

SEQ ID NO: 4336529 - DNA, 16 bp, Homo sapiens
tgtgtgtatttgtatt

SEQ ID NO: 4336530 - DNA, 13 bp, Homo sapiens
tgtgtgtgtctgt

SEQ ID NO: 4336531 - DNA, 15 bp, Homo sapiens
tgtgtgtgtgtctgt

SEQ ID NO: 4336532 - DNA, 14 bp, Homo sapiens
tgtgtgtgtgtgtc

SEQ ID NO: 4336533 - DNA, 16 bp, Homo sapiens
tgtgtgtgtgtgtctg

SEQ ID NO: 4336534 - DNA, 14 bp, Homo sapiens
tgtgttacattatt

SEQ ID NO: 4336535 - DNA, 13 bp, Homo sapiens
tgtgttctatcca

SEQ ID NO: 4336536 - DNA, 13 bp, Homo sapiens
tgtgttgcttcaa

SEQ ID NO: 4336537 - DNA, 14 bp, Homo sapiens
tgtgtttttctcca

SEQ ID NO: 4336538 - DNA, 12 bp, Homo sapiens
tgttaacttcta

SEQ ID NO: 4336539 - DNA, 14 bp, Homo sapiens
tgttacatctgtct

SEQ ID NO: 4336540 - DNA, 12 bp, Homo sapiens
tgttacattatt

SEQ ID NO: 4336541 - DNA, 14 bp, Homo sapiens
tgttacattattcc

SEQ ID NO: 4336542 - DNA, 15 bp, Homo sapiens
tgttactgcttctct

SEQ ID NO: 4336543 - DNA, 15 bp, Homo sapiens
tgttactgtcttcag

SEQ ID NO: 4336544 - DNA, 20 bp, Homo sapiens
tgttagccacggaaacatag

SEQ ID NO: 4336545 - DNA, 20 bp, Homo sapiens
tgttatagattgtcttaatg

SEQ ID NO: 4336546 - DNA, 21 bp, Homo sapiens
tgttatcatattggtgctgag

SEQ ID NO: 4336547 - DNA, 22 bp, Homo sapiens
tgttattgatcccttctcctgc

SEQ ID NO: 4336548 - DNA, 19 bp, Homo sapiens
tgttcagtgttgacatagc

SEQ ID NO: 4336549 - DNA, 12 bp, Homo sapiens
tgttccaaattt

SEQ ID NO: 4336550 - DNA, 15 bp, Homo sapiens
tgttccccccataga

SEQ ID NO: 4336551 - DNA, 13 bp, Homo sapiens
tgttctatccaaa

SEQ ID NO: 4336552 - DNA, 19 bp, Homo sapiens
tgttctatccaaacatgta

SEQ ID NO: 4336553 - DNA, 20 bp, Homo sapiens
tgttctcagctccccctgtc

SEQ ID NO: 4336554 - DNA, 15 bp, Homo sapiens
tgttctgtgtacata

SEQ ID NO: 4336555 - DNA, 16 bp, Homo sapiens
tgttctttctggagtc

SEQ ID NO: 4336556 - DNA, 18 bp, Homo sapiens
tgttgacatagcctttgt

SEQ ID NO: 4336557 - DNA, 11 bp, Homo sapiens
tgttgccaaag

SEQ ID NO: 4336558 - DNA, 14 bp, Homo sapiens
tgttgccaaagctg

SEQ ID NO: 4336559 - DNA, 19 bp, Homo sapiens
tgttgccaaagctggcttt

SEQ ID NO: 4336560 - DNA, 16 bp, Homo sapiens
tgttgccagtgctaag

SEQ ID NO: 4336561 - DNA, 21 bp, Homo sapiens
tgttgcccgccctccacccac

SEQ ID NO: 4336562 - DNA, 14 bp, Homo sapiens
tgttgcttcaaatt

SEQ ID NO: 4336563 - DNA, 23 bp, Homo sapiens
tgttggacagacactgttgcaaa

SEQ ID NO: 4336564 - DNA, 11 bp, Homo sapiens
tgttggctgcg

SEQ ID NO: 4336565 - DNA, 20 bp, Homo sapiens
tgttgggtttgagacagaca

SEQ ID NO: 4336566 - DNA, 20 bp, Homo sapiens
tgttgtcattgtccagctgg

SEQ ID NO: 4336567 - DNA, 15 bp, Homo sapiens
tgtttaaatgccaaa

SEQ ID NO: 4336568 - DNA, 12 bp, Homo sapiens
tgtttaatgaag

SEQ ID NO: 4336569 - DNA, 17 bp, Homo sapiens
tgtttacagggagcctc

SEQ ID NO: 4336570 - DNA, 20 bp, Homo sapiens
tgtttacagggagcctcctg

SEQ ID NO: 4336571 - DNA, 14 bp, Homo sapiens
tgtttaccattttt

SEQ ID NO: 4336572 - DNA, 19 bp, Homo sapiens
tgtttagtgtgctgctgtt

SEQ ID NO: 4336573 - DNA, 13 bp, Homo sapiens
tgtttcccaagct

SEQ ID NO: 4336574 - DNA, 17 bp, Homo sapiens
tgtttctccttctgaaa

SEQ ID NO: 4336575 - DNA, 17 bp, Homo sapiens
tgtttctttctgtctct

SEQ ID NO: 4336576 - DNA, 20 bp, Homo sapiens
tgtttctttctgtctctctc

SEQ ID NO: 4336577 - DNA, 12 bp, Homo sapiens
tgtttctttgtg

SEQ ID NO: 4336578 - DNA, 19 bp, Homo sapiens
tgtttgtctgtgtgctgta

SEQ ID NO: 4336579 - DNA, 12 bp, Homo sapiens
ttaaaaacttta

SEQ ID NO: 4336580 - DNA, 16 bp, Homo sapiens
ttaaaaactttaaaga

SEQ ID NO: 4336581 - DNA, 17 bp, Homo sapiens
ttaaaaagggtaacttg

SEQ ID NO: 4336582 - DNA, 20 bp, Homo sapiens
ttaaaaagggtaacttgttt

SEQ ID NO: 4336583 - DNA, 14 bp, Homo sapiens
ttaaaaatgaaaat

SEQ ID NO: 4336584 - DNA, 16 bp, Homo sapiens
ttaaaaccagttaccc

SEQ ID NO: 4336585 - DNA, 11 bp, Homo sapiens
ttaaaatgtga

SEQ ID NO: 4336586 - DNA, 17 bp, Homo sapiens
ttaaacaaaatttcaca

SEQ ID NO: 4336587 - DNA, 15 bp, Homo sapiens
ttaaactctgccaga

SEQ ID NO: 4336588 - DNA, 16 bp, Homo sapiens
ttaaactctgccagaa

SEQ ID NO: 4336589 - DNA, 17 bp, Homo sapiens
ttaaacttgtgaatgct

SEQ ID NO: 4336590 - DNA, 19 bp, Homo sapiens
ttaaagacccaacttgcca

SEQ ID NO: 4336591 - DNA, 21 bp, Homo sapiens
ttaaagccttaagcacaatta

SEQ ID NO: 4336592 - DNA, 20 bp, Homo sapiens
ttaaagcttatttttatgtg

SEQ ID NO: 4336593 - DNA, 22 bp, Homo sapiens
ttaaagcttatttttatgtggt

SEQ ID NO: 4336594 - DNA, 14 bp, Homo sapiens
ttaaagcttgattt

SEQ ID NO: 4336595 - DNA, 20 bp, Homo sapiens
ttaaagtaaacttgtgtatt

SEQ ID NO: 4336596 - DNA, 16 bp, Homo sapiens
ttaaataaactgtttt

SEQ ID NO: 4336597 - DNA, 12 bp, Homo sapiens
ttaaatcatttg

SEQ ID NO: 4336598 - DNA, 22 bp, Homo sapiens
ttaaatcatttggttaaatcat

SEQ ID NO: 4336599 - DNA, 14 bp, Homo sapiens
ttaaatgaactact

SEQ ID NO: 4336600 - DNA, 15 bp, Homo sapiens
ttaaatgaactactg

SEQ ID NO: 4336601 - DNA, 20 bp, Homo sapiens
ttaaatgccaaaatgtactt

SEQ ID NO: 4336602 - DNA, 22 bp, Homo sapiens
ttaaatgccaaaatgtacttaa

SEQ ID NO: 4336603 - DNA, 17 bp, Homo sapiens
ttaacaaagcaaccttt

SEQ ID NO: 4336604 - DNA, 17 bp, Homo sapiens
ttaaccacttgcctctt

SEQ ID NO: 4336605 - DNA, 16 bp, Homo sapiens
ttaactaaatgctcat

SEQ ID NO: 4336606 - DNA, 14 bp, Homo sapiens
ttaactgtatttca

SEQ ID NO: 4336607 - DNA, 13 bp, Homo sapiens
ttaagaactgaat

SEQ ID NO: 4336608 - DNA, 21 bp, Homo sapiens
ttaagcctgtaattatgtaac

SEQ ID NO: 4336609 - DNA, 17 bp, Homo sapiens
ttaagctgttactgtct

SEQ ID NO: 4336610 - DNA, 21 bp, Homo sapiens
ttaaggaagacaatgtgaaaa

SEQ ID NO: 4336611 - DNA, 19 bp, Homo sapiens
ttaagggtggaaaaatgcc

SEQ ID NO: 4336612 - DNA, 16 bp, Homo sapiens
ttaagtgtcatttctt

SEQ ID NO: 4336613 - DNA, 21 bp, Homo sapiens
ttaataaactttgaataaaag

SEQ ID NO: 4336614 - DNA, 11 bp, Homo sapiens
ttaataaagca

SEQ ID NO: 4336615 - DNA, 12 bp, Homo sapiens
ttaataaagcat

SEQ ID NO: 4336616 - DNA, 16 bp, Homo sapiens
ttaataaagcattctt

SEQ ID NO: 4336617 - DNA, 17 bp, Homo sapiens
tgcatatgttaaagctt

SEQ ID NO: 4336618 - DNA, 18 bp, Homo sapiens
tgcatatgttaaagctta

SEQ ID NO: 4336619 - DNA, 17 bp, Homo sapiens
tgcatcgtttcatcttc

SEQ ID NO: 4336620 - DNA, 14 bp, Homo sapiens
tgcatctgactctc

SEQ ID NO: 4336621 - DNA, 23 bp, Homo sapiens
tgcatctggcacgtggccaggag

SEQ ID NO: 4336622 - DNA, 14 bp, Homo sapiens
tgcatgcctggtct

SEQ ID NO: 4336623 - DNA, 23 bp, Homo sapiens
tgcatgctttgagaccagaagaa

SEQ ID NO: 4336624 - DNA, 18 bp, Homo sapiens
tgcattccagaacaaatt

SEQ ID NO: 4336625 - DNA, 14 bp, Homo sapiens
tgcattgagaagga

SEQ ID NO: 4336626 - DNA, 15 bp, Homo sapiens
tgcatttaaactctg

SEQ ID NO: 4336627 - DNA, 21 bp, Homo sapiens
tgcatttgctgttgtttctat

SEQ ID NO: 4336628 - DNA, 18 bp, Homo sapiens
tgcattttcttcagaatt

SEQ ID NO: 4336629 - DNA, 15 bp, Homo sapiens
tgccaaagcttgtgg

SEQ ID NO: 4336630 - DNA, 19 bp, Homo sapiens
tgccaagctaatctgcctg

SEQ ID NO: 4336631 - DNA, 13 bp, Homo sapiens
tgccacaggcctc

SEQ ID NO: 4336632 - DNA, 14 bp, Homo sapiens
tgccacaggcctcc

SEQ ID NO: 4336633 - DNA, 11 bp, Homo sapiens
tgccactaagt

SEQ ID NO: 4336634 - DNA, 14 bp, Homo sapiens
tgccaggcatggtg

SEQ ID NO: 4336635 - DNA, 23 bp, Homo sapiens
tgccaggcggacaaagttcagtg

SEQ ID NO: 4336636 - DNA, 13 bp, Homo sapiens
tgccaggtgctgg

SEQ ID NO: 4336637 - DNA, 22 bp, Homo sapiens
tgccataccttctcccaggcct

SEQ ID NO: 4336638 - DNA, 13 bp, Homo sapiens
tgccatgcttttt

SEQ ID NO: 4336639 - DNA, 16 bp, Homo sapiens
tgcccaacaccagccc

SEQ ID NO: 4336640 - DNA, 22 bp, Homo sapiens
tgcccaacaccagcccctgccc

SEQ ID NO: 4336641 - DNA, 23 bp, Homo sapiens
tgcccaccgaggagccccagccc

SEQ ID NO: 4336642 - DNA, 15 bp, Homo sapiens
tgcccagccctctgt

SEQ ID NO: 4336643 - DNA, 20 bp, Homo sapiens
tgcccagtcccccaacccca

SEQ ID NO: 4336644 - DNA, 23 bp, Homo sapiens
tgcccagtcccccaaccccagcc

SEQ ID NO: 4336645 - DNA, 21 bp, Homo sapiens
tgcccagttggaggagactgg

SEQ ID NO: 4336646 - DNA, 13 bp, Homo sapiens
tgccccaaggagg

SEQ ID NO: 4336647 - DNA, 13 bp, Homo sapiens
tgcccctgagttc

SEQ ID NO: 4336648 - DNA, 16 bp, Homo sapiens
tgcccgccctccaccc

SEQ ID NO: 4336649 - DNA, 23 bp, Homo sapiens
tgcccggtgcagggcctggcata

SEQ ID NO: 4336650 - DNA, 21 bp, Homo sapiens
tgccctcaggctccccagtgc

SEQ ID NO: 4336651 - DNA, 22 bp, Homo sapiens
tgccctcaggctccccagtgct

SEQ ID NO: 4336652 - DNA, 18 bp, Homo sapiens
tgccctgttgggggcttc

SEQ ID NO: 4336653 - DNA, 22 bp, Homo sapiens
tgcccttaaggatcaccccagc

SEQ ID NO: 4336654 - DNA, 17 bp, Homo sapiens
tgcccttaccccacaca

SEQ ID NO: 4336655 - DNA, 16 bp, Homo sapiens
tgcccttccctggagg

SEQ ID NO: 4336656 - DNA, 19 bp, Homo sapiens
tgcccttgcccttggagct

SEQ ID NO: 4336657 - DNA, 18 bp, Homo sapiens
tgccgaacattaggaatt

SEQ ID NO: 4336658 - DNA, 20 bp, Homo sapiens
tgccgaacattaggaattgt

SEQ ID NO: 4336659 - DNA, 18 bp, Homo sapiens
tgccgctttgtctgtcca

SEQ ID NO: 4336660 - DNA, 19 bp, Homo sapiens
tgccgggagactgccagtg

SEQ ID NO: 4336661 - DNA, 21 bp, Homo sapiens
tgccgggagactgccagtgga

SEQ ID NO: 4336662 - DNA, 12 bp, Homo sapiens
tgccgtgtccaa

SEQ ID NO: 4336663 - DNA, 14 bp, Homo sapiens
tgcctccaacccag

SEQ ID NO: 4336664 - DNA, 16 bp, Homo sapiens
tgcctcctgcctcccg

SEQ ID NO: 4336665 - DNA, 14 bp, Homo sapiens
tgcctgggatgccc

SEQ ID NO: 4336666 - DNA, 19 bp, Homo sapiens
tgcctgggatgcccttccc

SEQ ID NO: 4336667 - DNA, 15 bp, Homo sapiens
tgcctgtaattaaac

SEQ ID NO: 4336668 - DNA, 13 bp, Homo sapiens
tgccttttaagtt

SEQ ID NO: 4336669 - DNA, 17 bp, Homo sapiens
tgccttttaagtttgaa

SEQ ID NO: 4336670 - DNA, 17 bp, Homo sapiens
tgcgaaaacgttgaccc

SEQ ID NO: 4336671 - DNA, 19 bp, Homo sapiens
tgcgaagcaagaagaattg

SEQ ID NO: 4336672 - DNA, 20 bp, Homo sapiens
tgcgaagcaagaagaattga

SEQ ID NO: 4336673 - DNA, 19 bp, Homo sapiens
tgcgattttgcctgtgtct

SEQ ID NO: 4336674 - DNA, 17 bp, Homo sapiens
tgcgcacttacctgctt

SEQ ID NO: 4336675 - DNA, 19 bp, Homo sapiens
tgcggcctttggcttcacg

SEQ ID NO: 4336676 - DNA, 15 bp, Homo sapiens
tgcggggcagagcca

SEQ ID NO: 4336677 - DNA, 18 bp, Homo sapiens
tgcgtcccccgttgtgcc

SEQ ID NO: 4336678 - DNA, 21 bp, Homo sapiens
tgcgtctggaggggcccctgc

SEQ ID NO: 4336679 - DNA, 19 bp, Homo sapiens
tgcgtgactattttttaat

SEQ ID NO: 4336680 - DNA, 18 bp, Homo sapiens
tgcgtgtgagtgtgtgtg

SEQ ID NO: 4336681 - DNA, 18 bp, Homo sapiens
tgctaaagggagaaatgc

SEQ ID NO: 4336682 - DNA, 20 bp, Homo sapiens
tgctaaagggagaaatgcca

SEQ ID NO: 4336683 - DNA, 14 bp, Homo sapiens
tgctaaattataaa

SEQ ID NO: 4336684 - DNA, 18 bp, Homo sapiens
tgctaaattataaaattg

SEQ ID NO: 4336685 - DNA, 22 bp, Homo sapiens
tgctaactgggaagaacaaggc

SEQ ID NO: 4336686 - DNA, 16 bp, Homo sapiens
tgctaagctaaagaaa

SEQ ID NO: 4336687 - DNA, 17 bp, Homo sapiens
tgctaagctgccctgag

SEQ ID NO: 4336688 - DNA, 21 bp, Homo sapiens
tgctaatatactttttttgtt

SEQ ID NO: 4336689 - DNA, 13 bp, Homo sapiens
tgctacctgcacc

SEQ ID NO: 4336690 - DNA, 22 bp, Homo sapiens
tgctactgtacataaacaatga

SEQ ID NO: 4336691 - DNA, 20 bp, Homo sapiens
tgctatatttttaaagaagg

SEQ ID NO: 4336692 - DNA, 19 bp, Homo sapiens
tgctcatacacagttaaat

SEQ ID NO: 4336693 - DNA, 19 bp, Homo sapiens
tgctcatgtatatttagtt

SEQ ID NO: 4336694 - DNA, 16 bp, Homo sapiens
tgctcattaaactgat

SEQ ID NO: 4336695 - DNA, 21 bp, Homo sapiens
tgctccagctgttcagctggt

SEQ ID NO: 4336696 - DNA, 17 bp, Homo sapiens
tgctccaggcatcactg

SEQ ID NO: 4336697 - DNA, 22 bp, Homo sapiens
tgctcccagctctctctcctgg

SEQ ID NO: 4336698 - DNA, 23 bp, Homo sapiens
tgctcccagctctctctcctgga

SEQ ID NO: 4336699 - DNA, 13 bp, Homo sapiens
tgctcgaccttga

SEQ ID NO: 4336700 - DNA, 13 bp, Homo sapiens
tgctctagaaagt

SEQ ID NO: 4336701 - DNA, 22 bp, Homo sapiens
tgctctagggccctttcttgca

SEQ ID NO: 4336702 - DNA, 19 bp, Homo sapiens
tgctctgggagacttactg

SEQ ID NO: 4336703 - DNA, 20 bp, Homo sapiens
tgctctgtaggagctaccct

SEQ ID NO: 4336704 - DNA, 20 bp, Homo sapiens
tgctgaaggattatatgtat

SEQ ID NO: 4336705 - DNA, 18 bp, Homo sapiens
tgctgaagggcattcttt

SEQ ID NO: 4336706 - DNA, 21 bp, Homo sapiens
tgctgaagggcattctttccc

SEQ ID NO: 4336707 - DNA, 18 bp, Homo sapiens
tgctgaagtacagtccca

SEQ ID NO: 4336708 - DNA, 22 bp, Homo sapiens
tgctgaattgagaataagaatt

SEQ ID NO: 4336709 - DNA, 16 bp, Homo sapiens
tgctgactgttttctc

SEQ ID NO: 4336710 - DNA, 17 bp, Homo sapiens
tgctgagctgaagaaat

SEQ ID NO: 4336711 - DNA, 15 bp, Homo sapiens
tgctgagtctcccaa

SEQ ID NO: 4336712 - DNA, 14 bp, Homo sapiens
tgctgagtgctatg

SEQ ID NO: 4336713 - DNA, 19 bp, Homo sapiens
tgctgcataaaattctaga

SEQ ID NO: 4336714 - DNA, 19 bp, Homo sapiens
tgctgcattttacacatgt

SEQ ID NO: 4336715 - DNA, 23 bp, Homo sapiens
tgctgctaaagggagaaatgcca

SEQ ID NO: 4336716 - DNA, 14 bp, Homo sapiens
tgctgctgccccag

SEQ ID NO: 4336717 - DNA, 18 bp, Homo sapiens
tgctgctgccccagcgtc

SEQ ID NO: 4336718 - DNA, 11 bp, Homo sapiens
tgctgctgttc

SEQ ID NO: 4336719 - DNA, 19 bp, Homo sapiens
tgctgcttgaggcaactca

SEQ ID NO: 4336720 - DNA, 13 bp, Homo sapiens
tgctgggtgccag

SEQ ID NO: 4336721 - DNA, 14 bp, Homo sapiens
tgctgggtgccagg

SEQ ID NO: 4336722 - DNA, 16 bp, Homo sapiens
tgctgggtgccaggtg

SEQ ID NO: 4336723 - DNA, 13 bp, Homo sapiens
tgctggtgcctct

SEQ ID NO: 4336724 - DNA, 19 bp, Homo sapiens
tgctgtgtagttccctctg

SEQ ID NO: 4336725 - DNA, 20 bp, Homo sapiens
tgctgtgtagttccctctgc

SEQ ID NO: 4336726 - DNA, 21 bp, Homo sapiens
tgctgtgtagttccctctgcc

SEQ ID NO: 4336727 - DNA, 19 bp, Homo sapiens
tgctgttactgcttctctt

SEQ ID NO: 4336728 - DNA, 22 bp, Homo sapiens
tgctgttactgcttctctttgt

SEQ ID NO: 4336729 - DNA, 13 bp, Homo sapiens
tgctgttgtttct

SEQ ID NO: 4336730 - DNA, 21 bp, Homo sapiens
tgctgttgtttctataaatga

SEQ ID NO: 4336731 - DNA, 22 bp, Homo sapiens
tgcttacagtttattttctgtg

SEQ ID NO: 4336732 - DNA, 16 bp, Homo sapiens
tgcttagatgttccaa

SEQ ID NO: 4336733 - DNA, 13 bp, Homo sapiens
tgcttagtaaaat

SEQ ID NO: 4336734 - DNA, 13 bp, Homo sapiens
tgcttagtgaaaa

SEQ ID NO: 4336735 - DNA, 15 bp, Homo sapiens
tgcttagtgaaaata

SEQ ID NO: 4336736 - DNA, 16 bp, Homo sapiens
tgcttagtgaaaatac

SEQ ID NO: 4336737 - DNA, 14 bp, Homo sapiens
tgcttattgcttag

SEQ ID NO: 4336738 - DNA, 17 bp, Homo sapiens
tgcttattgcttagtaa

SEQ ID NO: 4336739 - DNA, 17 bp, Homo sapiens
tgcttcagagtttgtgt

SEQ ID NO: 4336740 - DNA, 19 bp, Homo sapiens
tgcttcagagtttgtgtgt

SEQ ID NO: 4336741 - DNA, 19 bp, Homo sapiens
tgcttccttggttcatgct

SEQ ID NO: 4336742 - DNA, 14 bp, Homo sapiens
tgcttctactgtga

SEQ ID NO: 4336743 - DNA, 18 bp, Homo sapiens
tgcttctactgtgacact

SEQ ID NO: 4336744 - DNA, 19 bp, Homo sapiens
tgcttctactgtgacactt

SEQ ID NO: 4336745 - DNA, 15 bp, Homo sapiens
tgcttctcttcttta

SEQ ID NO: 4336746 - DNA, 22 bp, Homo sapiens
tgcttctcttctttattgcact

SEQ ID NO: 4336747 - DNA, 23 bp, Homo sapiens
tgcttctcttctttattgcacta

SEQ ID NO: 4336748 - DNA, 15 bp, Homo sapiens
tgcttctctttgtgc

SEQ ID NO: 4336749 - DNA, 17 bp, Homo sapiens
tgcttctctttgtgcag

SEQ ID NO: 4336750 - DNA, 13 bp, Homo sapiens
tgcttctgcagca

SEQ ID NO: 4336751 - DNA, 16 bp, Homo sapiens
tgcttctgcagcaact

SEQ ID NO: 4336752 - DNA, 18 bp, Homo sapiens
tgcttctgcagcaactcc

SEQ ID NO: 4336753 - DNA, 19 bp, Homo sapiens
tgcttctgcagcaactccc

SEQ ID NO: 4336754 - DNA, 19 bp, Homo sapiens
tgcttgagctttctgtgca

SEQ ID NO: 4336755 - DNA, 15 bp, Homo sapiens
tgcttgctggtgcct

SEQ ID NO: 4336756 - DNA, 17 bp, Homo sapiens
tgcttggagtgccccaa

SEQ ID NO: 4336757 - DNA, 17 bp, Homo sapiens
tgcttgggtcctactcc

SEQ ID NO: 4336758 - DNA, 21 bp, Homo sapiens
tgcttgggtcctactcctgga

SEQ ID NO: 4336759 - DNA, 23 bp, Homo sapiens
tgctttgagaccagaagaaaaga

SEQ ID NO: 4336760 - DNA, 18 bp, Homo sapiens
tgctttggatacacacat

SEQ ID NO: 4336761 - DNA, 16 bp, Homo sapiens
tgctttgtgcatatgt

SEQ ID NO: 4336762 - DNA, 15 bp, Homo sapiens
tgcttttgaaaaaca

SEQ ID NO: 4336763 - DNA, 20 bp, Homo sapiens
tggaaaaatagcctgcctct

SEQ ID NO: 4336764 - DNA, 13 bp, Homo sapiens
tggaaaaatgccc

SEQ ID NO: 4336765 - DNA, 18 bp, Homo sapiens
tggaaacagacagggaga

SEQ ID NO: 4336766 - DNA, 22 bp, Homo sapiens
tggaaacagacagggagaagtt

SEQ ID NO: 4336767 - DNA, 12 bp, Homo sapiens
tggaaaccacag

SEQ ID NO: 4336768 - DNA, 23 bp, Homo sapiens
tggaaatattcatgcttcttcct

SEQ ID NO: 4336769 - DNA, 17 bp, Homo sapiens
tggaaatggatgcaaag

SEQ ID NO: 4336770 - DNA, 19 bp, Homo sapiens
tggaaatggatgcaaagta

SEQ ID NO: 4336771 - DNA, 17 bp, Homo sapiens
tggaaccaaagctggcc

SEQ ID NO: 4336772 - DNA, 15 bp, Homo sapiens
tggaagaagtttttt

SEQ ID NO: 4336773 - DNA, 22 bp, Homo sapiens
tggaagggccaatggagaaaat

SEQ ID NO: 4336774 - DNA, 15 bp, Homo sapiens
tggaatccatctgtc

SEQ ID NO: 4336775 - DNA, 15 bp, Homo sapiens
tggaatgttacatct

SEQ ID NO: 4336776 - DNA, 21 bp, Homo sapiens
tggaattaaaaggatagtatt

SEQ ID NO: 4336777 - DNA, 13 bp, Homo sapiens
tggacagacactg

SEQ ID NO: 4336778 - DNA, 21 bp, Homo sapiens
tggacattttcttttattatc

SEQ ID NO: 4336779 - DNA, 24 bp, Homo sapiens
tggacattttcttttattatcagt

SEQ ID NO: 4336780 - DNA, 21 bp, Homo sapiens
tggaccaattattgatatata

SEQ ID NO: 4336781 - DNA, 14 bp, Homo sapiens
tggactctgtgtga

SEQ ID NO: 4336782 - DNA, 19 bp, Homo sapiens
tggacttggatcttccctt

SEQ ID NO: 4336783 - DNA, 17 bp, Homo sapiens
tggagaaaatgaatgga

SEQ ID NO: 4336784 - DNA, 19 bp, Homo sapiens
tggagaattgctgaagggc

SEQ ID NO: 4336785 - DNA, 22 bp, Homo sapiens
tggagaattgctgaagggcatt

SEQ ID NO: 4336786 - DNA, 13 bp, Homo sapiens
tggagactgcaag

SEQ ID NO: 4336787 - DNA, 19 bp, Homo sapiens
tggagagagtggtaaaaaa

SEQ ID NO: 4336788 - DNA, 14 bp, Homo sapiens
tggagaggaagaaa

SEQ ID NO: 4336789 - DNA, 22 bp, Homo sapiens
tggagcactgtaaaaagagctg

SEQ ID NO: 4336790 - DNA, 17 bp, Homo sapiens
tggagcccagttggaaa

SEQ ID NO: 4336791 - DNA, 17 bp, Homo sapiens
tggaggaacacagagaa

SEQ ID NO: 4336792 - DNA, 13 bp, Homo sapiens
tggaggagactgg

SEQ ID NO: 4336793 - DNA, 14 bp, Homo sapiens
tggaggagactggg

SEQ ID NO: 4336794 - DNA, 18 bp, Homo sapiens
tggaggagggagagccct

SEQ ID NO: 4336795 - DNA, 21 bp, Homo sapiens
tggaggagggagagccctgtc

SEQ ID NO: 4336796 - DNA, 13 bp, Homo sapiens
tggaggcctacct

SEQ ID NO: 4336797 - DNA, 18 bp, Homo sapiens
tggaggtctctccctccc

SEQ ID NO: 4336798 - DNA, 14 bp, Homo sapiens
tggagtctgaagcc

SEQ ID NO: 4336799 - DNA, 18 bp, Homo sapiens
tggagtgccccaaggagg

SEQ ID NO: 4336800 - DNA, 15 bp, Homo sapiens
tggataataggaatt

SEQ ID NO: 4336801 - DNA, 14 bp, Homo sapiens
tggatagaaaaaaa

SEQ ID NO: 4336802 - DNA, 20 bp, Homo sapiens
tggatgaatctggacatttg

SEQ ID NO: 4336803 - DNA, 13 bp, Homo sapiens
tggatgcaaagta

SEQ ID NO: 4336804 - DNA, 20 bp, Homo sapiens
tggatgcaaagtacaatgtg

SEQ ID NO: 4336805 - DNA, 23 bp, Homo sapiens
tggatggagcccagttggaaaat

SEQ ID NO: 4336806 - DNA, 12 bp, Homo sapiens
tggcaaaaaggc

SEQ ID NO: 4336807 - DNA, 16 bp, Homo sapiens
tggcaaaaaggcagga

SEQ ID NO: 4336808 - DNA, 16 bp, Homo sapiens
tggcaccagcagcctg

SEQ ID NO: 4336809 - DNA, 19 bp, Homo sapiens
tggcacgtggccaggagcc

SEQ ID NO: 4336810 - DNA, 15 bp, Homo sapiens
tggcacttgcctgct

SEQ ID NO: 4336811 - DNA, 17 bp, Homo sapiens
tggcataatttgtctta

SEQ ID NO: 4336812 - DNA, 10 bp, Homo sapiens
tggccactgg

SEQ ID NO: 4336813 - DNA, 17 bp, Homo sapiens
tggccactggcacttgc

SEQ ID NO: 4336814 - DNA, 16 bp, Homo sapiens
tggccagactcccttg

SEQ ID NO: 4336815 - DNA, 11 bp, Homo sapiens
tggccaggagc

SEQ ID NO: 4336816 - DNA, 12 bp, Homo sapiens
tggccaggagcc

SEQ ID NO: 4336817 - DNA, 15 bp, Homo sapiens
tggccaggagccctg

SEQ ID NO: 4336818 - DNA, 16 bp, Homo sapiens
tggccaggagccctgg

SEQ ID NO: 4336819 - DNA, 20 bp, Homo sapiens
tggccatatatgctgtattt

SEQ ID NO: 4336820 - DNA, 23 bp, Homo sapiens
tggccatatatgctgtatttctt

SEQ ID NO: 4336821 - DNA, 16 bp, Homo sapiens
tggccatggtaccccc

SEQ ID NO: 4336822 - DNA, 17 bp, Homo sapiens
tggcccagttgtccatg

SEQ ID NO: 4336823 - DNA, 16 bp, Homo sapiens
tggccctcagctccct

SEQ ID NO: 4336824 - DNA, 17 bp, Homo sapiens
tggccctcagctccctg

SEQ ID NO: 4336825 - DNA, 19 bp, Homo sapiens
tggccctcagctccctgac

SEQ ID NO: 4336826 - DNA, 19 bp, Homo sapiens
tggcctgactggttgtcag

SEQ ID NO: 4336827 - DNA, 20 bp, Homo sapiens
tggcctgactggttgtcaga

SEQ ID NO: 4336828 - DNA, 18 bp, Homo sapiens
tggcggaggtggagtggc

SEQ ID NO: 4336829 - DNA, 16 bp, Homo sapiens
tggctcgcttttttct

SEQ ID NO: 4336830 - DNA, 17 bp, Homo sapiens
tggctgttaaccacccg

SEQ ID NO: 4336831 - DNA, 20 bp, Homo sapiens
tggcttcacggaagagcctt

SEQ ID NO: 4336832 - DNA, 22 bp, Homo sapiens
tggcttcacggaagagccttgc

SEQ ID NO: 4336833 - DNA, 12 bp, Homo sapiens
tggctttgcata

SEQ ID NO: 4336834 - DNA, 14 bp, Homo sapiens
tgggaaataaagaa

SEQ ID NO: 4336835 - DNA, 15 bp, Homo sapiens
tgggaaatgagccag

SEQ ID NO: 4336836 - DNA, 12 bp, Homo sapiens
tgggaagaacaa

SEQ ID NO: 4336837 - DNA, 23 bp, Homo sapiens
tgggaagaacaaggccctgaggg

SEQ ID NO: 4336838 - DNA, 15 bp, Homo sapiens
tgggaagctgagggc

SEQ ID NO: 4336839 - DNA, 20 bp, Homo sapiens
tgggaagctgagggcaaatc

SEQ ID NO: 4336840 - DNA, 21 bp, Homo sapiens
tgggaaggtgggtgaggctgg

SEQ ID NO: 4336841 - DNA, 21 bp, Homo sapiens
tgggacagacggaaatgaaat

SEQ ID NO: 4336842 - DNA, 21 bp, Homo sapiens
tgggacctaatgctggcctga

SEQ ID NO: 4336843 - DNA, 22 bp, Homo sapiens
tgggaggatctcttgagcctgg

SEQ ID NO: 4336844 - DNA, 14 bp, Homo sapiens
tgggagggaaaagg

SEQ ID NO: 4336845 - DNA, 16 bp, Homo sapiens
tgggagggggcacggg

SEQ ID NO: 4336846 - DNA, 16 bp, Homo sapiens
tgggatgcccttcccc

SEQ ID NO: 4336847 - DNA, 21 bp, Homo sapiens
tgggatgcggggcagagccac

SEQ ID NO: 4336848 - DNA, 21 bp, Homo sapiens
tgggcacaatcttggtcatgt

SEQ ID NO: 4336849 - DNA, 13 bp, Homo sapiens
tgggcacccctgc

SEQ ID NO: 4336850 - DNA, 21 bp, Homo sapiens
tgggcacccctgcctcctgcc

SEQ ID NO: 4336851 - DNA, 12 bp, Homo sapiens
tgggcagggaag

SEQ ID NO: 4336852 - DNA, 23 bp, Homo sapiens
tgggcagggaaggaatcctggtg

SEQ ID NO: 4336853 - DNA, 16 bp, Homo sapiens
tgggcagggcctggcg

SEQ ID NO: 4336854 - DNA, 16 bp, Homo sapiens
tgggcatctgttctgg

SEQ ID NO: 4336855 - DNA, 21 bp, Homo sapiens
tgggcatttcacgaactgttc

SEQ ID NO: 4336856 - DNA, 22 bp, Homo sapiens
tgggcatttcacgaactgttca

SEQ ID NO: 4336857 - DNA, 14 bp, Homo sapiens
tgggctcagcaggg

SEQ ID NO: 4336858 - DNA, 16 bp, Homo sapiens
tgggctcagcagggct

SEQ ID NO: 4336859 - DNA, 15 bp, Homo sapiens
tggggaaaaggatga

SEQ ID NO: 4336860 - DNA, 23 bp, Homo sapiens
tggggaaaaggatgatggaaaaa

SEQ ID NO: 4336861 - DNA, 20 bp, Homo sapiens
tggggaagaggttttattta

SEQ ID NO: 4336862 - DNA, 23 bp, Homo sapiens
tgggggcaagaagatcacgctcc

SEQ ID NO: 4336863 - DNA, 19 bp, Homo sapiens
tggggggctgaggtgggag

SEQ ID NO: 4336864 - DNA, 18 bp, Homo sapiens
tggggtggggaagggaag

SEQ ID NO: 4336865 - DNA, 16 bp, Homo sapiens
tgggtaactagggaag

SEQ ID NO: 4336866 - DNA, 14 bp, Homo sapiens
tgggtcccttgctg

SEQ ID NO: 4336867 - DNA, 20 bp, Homo sapiens
tgggtgaagtgcctgctggg

SEQ ID NO: 4336868 - DNA, 14 bp, Homo sapiens
tgggtgaggctggg

SEQ ID NO: 4336869 - DNA, 15 bp, Homo sapiens
tgggtgccaggtgct

SEQ ID NO: 4336870 - DNA, 21 bp, Homo sapiens
tgggtggcaccagcagcctgg

SEQ ID NO: 4336871 - DNA, 14 bp, Homo sapiens
tgggtgtcatttca

SEQ ID NO: 4336872 - DNA, 19 bp, Homo sapiens
tgggtgtcatttcattcca

SEQ ID NO: 4336873 - DNA, 16 bp, Homo sapiens
tggtaaaaaagaaatg

SEQ ID NO: 4336874 - DNA, 18 bp, Homo sapiens
tggtaaaaaagaaatgaa

SEQ ID NO: 4336875 - DNA, 19 bp, Homo sapiens
tggtaaaaaagaaatgaaa

SEQ ID NO: 4336876 - DNA, 20 bp, Homo sapiens
tggtaaaaaagaaatgaaat

SEQ ID NO: 4336877 - DNA, 10 bp, Homo sapiens
tggtaattat

SEQ ID NO: 4336878 - DNA, 21 bp, Homo sapiens
tggtagtatcaacttcccagt

SEQ ID NO: 4336879 - DNA, 19 bp, Homo sapiens
tggtatgtatattttcagt

SEQ ID NO: 4336880 - DNA, 16 bp, Homo sapiens
tggtcacctcccatcc

SEQ ID NO: 4336881 - DNA, 12 bp, Homo sapiens
tggtcctgactt

SEQ ID NO: 4336882 - DNA, 21 bp, Homo sapiens
tggtcttatgattttattaca

SEQ ID NO: 4336883 - DNA, 17 bp, Homo sapiens
tggtgcccttccctgga

SEQ ID NO: 4336884 - DNA, 20 bp, Homo sapiens
tggtgcccttccctggaggt

SEQ ID NO: 4336885 - DNA, 14 bp, Homo sapiens
tggtggccttgggc

SEQ ID NO: 4336886 - DNA, 16 bp, Homo sapiens
tggtgggggcctcggt

SEQ ID NO: 4336887 - DNA, 15 bp, Homo sapiens
tggttaaaatgtgat

SEQ ID NO: 4336888 - DNA, 14 bp, Homo sapiens
tggttgtcagaatg

SEQ ID NO: 4336889 - DNA, 14 bp, Homo sapiens
tggtttggaaaata

SEQ ID NO: 4336890 - DNA, 20 bp, Homo sapiens
tgtaatctaagtatatgtga

SEQ ID NO: 4336891 - DNA, 24 bp, Homo sapiens
tgtaatctaagtatatgtgagaaa

SEQ ID NO: 4336892 - DNA, 20 bp, Homo sapiens
tgtaatgccaatatgacaca

SEQ ID NO: 4336893 - DNA, 20 bp, Homo sapiens
tgtaatgtaggcacttttat

SEQ ID NO: 4336894 - DNA, 22 bp, Homo sapiens
tgtaatgtcagactttgctgca

SEQ ID NO: 4336895 - DNA, 19 bp, Homo sapiens
tgtaattaaactagtttaa

SEQ ID NO: 4336896 - DNA, 21 bp, Homo sapiens
tgtacagaaaagggcggcttc

SEQ ID NO: 4336897 - DNA, 14 bp, Homo sapiens
tgtaccccccaacc

SEQ ID NO: 4336898 - DNA, 20 bp, Homo sapiens
tgtaccccccaacccctgag

SEQ ID NO: 4336899 - DNA, 13 bp, Homo sapiens
tgtacttaaatga

SEQ ID NO: 4336900 - DNA, 19 bp, Homo sapiens
tgtacttaaatgagttact

SEQ ID NO: 4336901 - DNA, 11 bp, Homo sapiens
tgtacttcctg

SEQ ID NO: 4336902 - DNA, 12 bp, Homo sapiens
tgtacttcctga

SEQ ID NO: 4336903 - DNA, 17 bp, Homo sapiens
tgtacttcctgagtggc

SEQ ID NO: 4336904 - DNA, 20 bp, Homo sapiens
tgtaggagctacccttttcc

SEQ ID NO: 4336905 - DNA, 22 bp, Homo sapiens
tgtaggcacttttattttcatt

SEQ ID NO: 4336906 - DNA, 19 bp, Homo sapiens
tgtaggtaaaatgtatttt

SEQ ID NO: 4336907 - DNA, 23 bp, Homo sapiens
tgtagtaaatattatgattttat

SEQ ID NO: 4336908 - DNA, 13 bp, Homo sapiens
tgtagtgggaagt

SEQ ID NO: 4336909 - DNA, 17 bp, Homo sapiens
tgtagttccctctgcct

SEQ ID NO: 4336910 - DNA, 20 bp, Homo sapiens
tgtagttccctctgcctggg

SEQ ID NO: 4336911 - DNA, 22 bp, Homo sapiens
tgtagtttttaattaaaaactt

SEQ ID NO: 4336912 - DNA, 17 bp, Homo sapiens
tgtagtttttgctgaag

SEQ ID NO: 4336913 - DNA, 13 bp, Homo sapiens
tgtataaattaaa

SEQ ID NO: 4336914 - DNA, 19 bp, Homo sapiens
tgtataaattaaataaact

SEQ ID NO: 4336915 - DNA, 21 bp, Homo sapiens
tgtataaattaaataaactgt

SEQ ID NO: 4336916 - DNA, 23 bp, Homo sapiens
tgtataaattaaataaactgttt

SEQ ID NO: 4336917 - DNA, 19 bp, Homo sapiens
tgtatattttcagtgggtt

SEQ ID NO: 4336918 - DNA, 19 bp, Homo sapiens
tgtatgccttcgggaaaat

SEQ ID NO: 4336919 - DNA, 13 bp, Homo sapiens
tgtattaataaag

SEQ ID NO: 4336920 - DNA, 14 bp, Homo sapiens
tgtattaataaagc

SEQ ID NO: 4336921 - DNA, 16 bp, Homo sapiens
tgtattaataaagcat

SEQ ID NO: 4336922 - DNA, 18 bp, Homo sapiens
tgtattaataaagcattc

SEQ ID NO: 4336923 - DNA, 15 bp, Homo sapiens
tgtattgcttcctga

SEQ ID NO: 4336924 - DNA, 15 bp, Homo sapiens
tgtatttcagtattt

SEQ ID NO: 4336925 - DNA, 14 bp, Homo sapiens
tgtatttgtattaa

SEQ ID NO: 4336926 - DNA, 15 bp, Homo sapiens
tgtatttgtattaat

SEQ ID NO: 4336927 - DNA, 20 bp, Homo sapiens
tgtattttaaattctcagtc

SEQ ID NO: 4336928 - DNA, 15 bp, Homo sapiens
tgtcaaataaaatga

SEQ ID NO: 4336929 - DNA, 17 bp, Homo sapiens
tgtcaatcttaagagga

SEQ ID NO: 4336930 - DNA, 14 bp, Homo sapiens
tgtcacctccttcc

SEQ ID NO: 4336931 - DNA, 19 bp, Homo sapiens
tgtcacctccttccccagc

SEQ ID NO: 4336932 - DNA, 20 bp, Homo sapiens
tgtcacctccttccccagct

SEQ ID NO: 4336933 - DNA, 14 bp, Homo sapiens
tgtcagaagacact

SEQ ID NO: 4336934 - DNA, 21 bp, Homo sapiens
tgtcagaagacactaattcct

SEQ ID NO: 4336935 - DNA, 23 bp, Homo sapiens
tgtcagaatggaatccatctgtc

SEQ ID NO: 4336936 - DNA, 15 bp, Homo sapiens
tgtcagcatagaagt

SEQ ID NO: 4336937 - DNA, 19 bp, Homo sapiens
tgtcatgaattcttatgct

SEQ ID NO: 4336938 - DNA, 13 bp, Homo sapiens
tgtcattgtccag

SEQ ID NO: 4336939 - DNA, 14 bp, Homo sapiens
tgtcattgtccagc

SEQ ID NO: 4336940 - DNA, 17 bp, Homo sapiens
tgtcattgtccagctgg

SEQ ID NO: 4336941 - DNA, 20 bp, Homo sapiens
tgtcattgtccagctgggac

SEQ ID NO: 4336942 - DNA, 15 bp, Homo sapiens
tgtcatttcattcca

SEQ ID NO: 4336943 - DNA, 20 bp, Homo sapiens
tgtcatttcattccattgcc

SEQ ID NO: 4336944 - DNA, 16 bp, Homo sapiens
tgtccaatttctgctg

SEQ ID NO: 4336945 - DNA, 17 bp, Homo sapiens
tgtccaatttctgctgt

SEQ ID NO: 4336946 - DNA, 20 bp, Homo sapiens
tgtccacagagtttgtagta

SEQ ID NO: 4336947 - DNA, 18 bp, Homo sapiens
tgtccagccgtgtgtgca

SEQ ID NO: 4336948 - DNA, 20 bp, Homo sapiens
tgtccagccgtgtgtgcatg

SEQ ID NO: 4336949 - DNA, 21 bp, Homo sapiens
tgtccagccgtgtgtgcatgt

SEQ ID NO: 4336950 - DNA, 13 bp, Homo sapiens
tgtcccctcagct

SEQ ID NO: 4336951 - DNA, 19 bp, Homo sapiens
tgtccgtgcttgctggtgc

SEQ ID NO: 4336952 - DNA, 15 bp, Homo sapiens
tgtccttgtgtgttt

SEQ ID NO: 4336953 - DNA, 23 bp, Homo sapiens
tgtctccctccccaaatggctgc

SEQ ID NO: 4336954 - DNA, 18 bp, Homo sapiens
tgtctctcttcagactct

SEQ ID NO: 4336955 - DNA, 16 bp, Homo sapiens
tgtctcttggaaatgt

SEQ ID NO: 4336956 - DNA, 23 bp, Homo sapiens
tgtctcttggaaatgttaagaaa

SEQ ID NO: 4336957 - DNA, 18 bp, Homo sapiens
tgtctgaatcatgtctgt

SEQ ID NO: 4336958 - DNA, 16 bp, Homo sapiens
tgtctgaattgagaaa

SEQ ID NO: 4336959 - DNA, 18 bp, Homo sapiens
tgtctgaattgagaaaag

SEQ ID NO: 4336960 - DNA, 19 bp, Homo sapiens
tgtctgaattgagaaaaga

SEQ ID NO: 4336961 - DNA, 22 bp, Homo sapiens
tgtctggcaggctactctgccc

SEQ ID NO: 4336962 - DNA, 14 bp, Homo sapiens
tgtctgtcagaaga

SEQ ID NO: 4336963 - DNA, 21 bp, Homo sapiens
tgtctgtccagccgtgtgtgc

SEQ ID NO: 4336964 - DNA, 16 bp, Homo sapiens
tgtctgtgtgctgtaa

SEQ ID NO: 4336965 - DNA, 20 bp, Homo sapiens
tgtcttcacctcatttatag

SEQ ID NO: 4336966 - DNA, 23 bp, Homo sapiens
tgtctttggataataggaattca

SEQ ID NO: 4336967 - DNA, 15 bp, Homo sapiens
tgtgaactgggcatt

SEQ ID NO: 4336968 - DNA, 15 bp, Homo sapiens
tgtgaagccagatct

SEQ ID NO: 4336969 - DNA, 20 bp, Homo sapiens
tgtgaatgtttagtgtgctg

SEQ ID NO: 4336970 - DNA, 22 bp, Homo sapiens
tgtgaggggtttcttttggaaa

SEQ ID NO: 4336971 - DNA, 15 bp, Homo sapiens
tgtgagtgtgtgtgt

SEQ ID NO: 4336972 - DNA, 13 bp, Homo sapiens
tgtgatggaggga

SEQ ID NO: 4336973 - DNA, 18 bp, Homo sapiens
tgtgcacactaagaaatg

SEQ ID NO: 4336974 - DNA, 21 bp, Homo sapiens
tgtgcacactaagaaatggga

SEQ ID NO: 4336975 - DNA, 15 bp, Homo sapiens
tgtgcatgtgccgag

SEQ ID NO: 4336976 - DNA, 13 bp, Homo sapiens
tgtgcccctgcca

SEQ ID NO: 4336977 - DNA, 13 bp, Homo sapiens
tttcttttctatg

SEQ ID NO: 4336978 - DNA, 21 bp, Homo sapiens
tttcttttttaaagtaaactt

SEQ ID NO: 4336979 - DNA, 24 bp, Homo sapiens
tttgaaaaacttttaggttgttac

SEQ ID NO: 4336980 - DNA, 19 bp, Homo sapiens
tttgaaaacaaacttctcg

SEQ ID NO: 4336981 - DNA, 15 bp, Homo sapiens
tttgaaaactgacat

SEQ ID NO: 4336982 - DNA, 22 bp, Homo sapiens
tttgaaaactgacatcagattt

SEQ ID NO: 4336983 - DNA, 17 bp, Homo sapiens
tttgagatcagcctggg

SEQ ID NO: 4336984 - DNA, 20 bp, Homo sapiens
tttgagattgccccaggtct

SEQ ID NO: 4336985 - DNA, 16 bp, Homo sapiens
tttgaggactgaagct

SEQ ID NO: 4336986 - DNA, 17 bp, Homo sapiens
tttgaggtagaggaaaa

SEQ ID NO: 4336987 - DNA, 15 bp, Homo sapiens
tttgaggtctacatt

SEQ ID NO: 4336988 - DNA, 19 bp, Homo sapiens
tttgaggtctacattcttg

SEQ ID NO: 4336989 - DNA, 22 bp, Homo sapiens
tttgatctttgtttaaatgcca

SEQ ID NO: 4336990 - DNA, 12 bp, Homo sapiens
tttgattctcct

SEQ ID NO: 4336991 - DNA, 14 bp, Homo sapiens
tttgcaaattattt

SEQ ID NO: 4336992 - DNA, 16 bp, Homo sapiens
tttgcaaattatttat

SEQ ID NO: 4336993 - DNA, 15 bp, Homo sapiens
tttgcatagctttca

SEQ ID NO: 4336994 - DNA, 19 bp, Homo sapiens
tttgcattccttacttgca

SEQ ID NO: 4336995 - DNA, 16 bp, Homo sapiens
tttgcccaacaccagc

SEQ ID NO: 4336996 - DNA, 18 bp, Homo sapiens
tttgcccaacaccagccc

SEQ ID NO: 4336997 - DNA, 12 bp, Homo sapiens
tttgctccaggc

SEQ ID NO: 4336998 - DNA, 22 bp, Homo sapiens
tttgctgaaggattatatgtat

SEQ ID NO: 4336999 - DNA, 13 bp, Homo sapiens
tttgctgcatttt

SEQ ID NO: 4337000 - DNA, 17 bp, Homo sapiens
tttgctgttgtttctat

SEQ ID NO: 4337001 - DNA, 14 bp, Homo sapiens
tttggaaataaaaa

SEQ ID NO: 4337002 - DNA, 18 bp, Homo sapiens
tttggaagaagtttttta

SEQ ID NO: 4337003 - DNA, 20 bp, Homo sapiens
tttggataataggaattcaa

SEQ ID NO: 4337004 - DNA, 17 bp, Homo sapiens
tttggcatgggacagac

SEQ ID NO: 4337005 - DNA, 22 bp, Homo sapiens
tttgggctctgaaataaaaatt

SEQ ID NO: 4337006 - DNA, 19 bp, Homo sapiens
tttgtaccccccaacccct

SEQ ID NO: 4337007 - DNA, 16 bp, Homo sapiens
tttgtagaataaatgg

SEQ ID NO: 4337008 - DNA, 17 bp, Homo sapiens
tttgtagaataaatggt

SEQ ID NO: 4337009 - DNA, 18 bp, Homo sapiens
tttgtagaataaatggtt

SEQ ID NO: 4337010 - DNA, 14 bp, Homo sapiens
tttgtaggtaaaat

SEQ ID NO: 4337011 - DNA, 13 bp, Homo sapiens
tttgtattaataa

SEQ ID NO: 4337012 - DNA, 17 bp, Homo sapiens
tttgtattaataaagca

SEQ ID NO: 4337013 - DNA, 16 bp, Homo sapiens
tttgtattgcttcctg

SEQ ID NO: 4337014 - DNA, 21 bp, Homo sapiens
tttgtcatgaattcttatgct

SEQ ID NO: 4337015 - DNA, 13 bp, Homo sapiens
tttgtcttaaaaa

SEQ ID NO: 4337016 - DNA, 16 bp, Homo sapiens
tttgtggttttatgga

SEQ ID NO: 4337017 - DNA, 14 bp, Homo sapiens
tttgtgtgtatttg

SEQ ID NO: 4337018 - DNA, 13 bp, Homo sapiens
tttgttatagatt

SEQ ID NO: 4337019 - DNA, 20 bp, Homo sapiens
tttgttatagattgtcttaa

SEQ ID NO: 4337020 - DNA, 18 bp, Homo sapiens
tttgttcctttgaagaat

SEQ ID NO: 4337021 - DNA, 24 bp, Homo sapiens
tttgttcttgtattttaataaact

SEQ ID NO: 4337022 - DNA, 22 bp, Homo sapiens
tttgtttaaatgccaaaatgta

SEQ ID NO: 4337023 - DNA, 21 bp, Homo sapiens
ttttaaaaagttatataaagg

SEQ ID NO: 4337024 - DNA, 18 bp, Homo sapiens
ttttaaaatagacactat

SEQ ID NO: 4337025 - DNA, 17 bp, Homo sapiens
ttttaaacaaaatttca

SEQ ID NO: 4337026 - DNA, 19 bp, Homo sapiens
ttttaaacaaaatttcaca

SEQ ID NO: 4337027 - DNA, 14 bp, Homo sapiens
ttttaaagtaaact

SEQ ID NO: 4337028 - DNA, 17 bp, Homo sapiens
ttttaaagtaaacttgt

SEQ ID NO: 4337029 - DNA, 22 bp, Homo sapiens
ttttaaagtaaacttgtgtatt

SEQ ID NO: 4337030 - DNA, 22 bp, Homo sapiens
ttttaagtgacataattgtcca

SEQ ID NO: 4337031 - DNA, 18 bp, Homo sapiens
ttttaagtgcttcacatt

SEQ ID NO: 4337032 - DNA, 11 bp, Homo sapiens
ttttactttgg

SEQ ID NO: 4337033 - DNA, 12 bp, Homo sapiens
ttttactttggt

SEQ ID NO: 4337034 - DNA, 16 bp, Homo sapiens
ttttaggttgttacca

SEQ ID NO: 4337035 - DNA, 16 bp, Homo sapiens
ttttataaaaataaat

SEQ ID NO: 4337036 - DNA, 21 bp, Homo sapiens
ttttatatttaaaaaattaaa

SEQ ID NO: 4337037 - DNA, 13 bp, Homo sapiens
ttttatgatttct

SEQ ID NO: 4337038 - DNA, 19 bp, Homo sapiens
ttttatggagacctctcct

SEQ ID NO: 4337039 - DNA, 14 bp, Homo sapiens
ttttattacagaaa

SEQ ID NO: 4337040 - DNA, 15 bp, Homo sapiens
ttttattatgggtat

SEQ ID NO: 4337041 - DNA, 13 bp, Homo sapiens
ttttcaatttgga

SEQ ID NO: 4337042 - DNA, 16 bp, Homo sapiens
ttttcatttcagattt

SEQ ID NO: 4337043 - DNA, 17 bp, Homo sapiens
ttttccagccttatgtg

SEQ ID NO: 4337044 - DNA, 21 bp, Homo sapiens
ttttccagccttatgtgttac

SEQ ID NO: 4337045 - DNA, 19 bp, Homo sapiens
ttttcctccccattcctac

SEQ ID NO: 4337046 - DNA, 13 bp, Homo sapiens
ttttctccccgct

SEQ ID NO: 4337047 - DNA, 19 bp, Homo sapiens
ttttctctcaaatgataca

SEQ ID NO: 4337048 - DNA, 19 bp, Homo sapiens
ttttctggccttgacttat

SEQ ID NO: 4337049 - DNA, 17 bp, Homo sapiens
ttttctgtgtaaaatga

SEQ ID NO: 4337050 - DNA, 10 bp, Homo sapiens
ttttcttggt

SEQ ID NO: 4337051 - DNA, 14 bp, Homo sapiens
ttttcttttctatg

SEQ ID NO: 4337052 - DNA, 22 bp, Homo sapiens
ttttggtaaatatgagactatt

SEQ ID NO: 4337053 - DNA, 14 bp, Homo sapiens
ttttgtttgatgca

SEQ ID NO: 4337054 - DNA, 12 bp, Homo sapiens
ttttgttttaat

SEQ ID NO: 4337055 - DNA, 16 bp, Homo sapiens
ttttgtttttgtctta

SEQ ID NO: 4337056 - DNA, 19 bp, Homo sapiens
tttttaaagtaaacttgtg

SEQ ID NO: 4337057 - DNA, 22 bp, Homo sapiens
tttttaaagtaaacttgtgtat

SEQ ID NO: 4337058 - DNA, 18 bp, Homo sapiens
tttttaaatcaaaaactt

SEQ ID NO: 4337059 - DNA, 17 bp, Homo sapiens
tttttaattaaaaactt

SEQ ID NO: 4337060 - DNA, 10 bp, Homo sapiens
tttttattca

SEQ ID NO: 4337061 - DNA, 14 bp, Homo sapiens
tttttccaactgtg

SEQ ID NO: 4337062 - DNA, 23 bp, Homo sapiens
tttttgaaaggcatgttcctctg

SEQ ID NO: 4337063 - DNA, 13 bp, Homo sapiens
tttttgctgtgta

SEQ ID NO: 4337064 - DNA, 14 bp, Homo sapiens
tttttgctgttagt

SEQ ID NO: 4337065 - DNA, 20 bp, Homo sapiens
tttttgtgaaaatgtcaaag

SEQ ID NO: 4337066 - DNA, 12 bp, Homo sapiens
ttttttaagtga

SEQ ID NO: 4337067 - DNA, 12 bp, Homo sapiens
ttttttactttg

SEQ ID NO: 4337068 - DNA, 12 bp, Homo sapiens
ttttttcttggt

SEQ ID NO: 4337069 - DNA, 14 bp, Homo sapiens
ttttttggtaatta

SEQ ID NO: 4337070 - DNA, 16 bp, Homo sapiens
ttttttgtttgtttct

SEQ ID NO: 4337071 - DNA, 14 bp, Homo sapiens
ttgcttctgcagca

SEQ ID NO: 4337072 - DNA, 24 bp, Homo sapiens
ttgcttctgcagcaactcccacga

SEQ ID NO: 4337073 - DNA, 13 bp, Homo sapiens
ttggaagtttcat

SEQ ID NO: 4337074 - DNA, 14 bp, Homo sapiens
ttggacagacactg

SEQ ID NO: 4337075 - DNA, 12 bp, Homo sapiens
ttggatcagagg

SEQ ID NO: 4337076 - DNA, 14 bp, Homo sapiens
ttggatttgctgtg

SEQ ID NO: 4337077 - DNA, 17 bp, Homo sapiens
ttggcaaaaaggcagga

SEQ ID NO: 4337078 - DNA, 20 bp, Homo sapiens
ttggctgcgtactccactgg

SEQ ID NO: 4337079 - DNA, 17 bp, Homo sapiens
ttggcttactgaaagac

SEQ ID NO: 4337080 - DNA, 23 bp, Homo sapiens
ttggcttcacggaagagccttgc

SEQ ID NO: 4337081 - DNA, 22 bp, Homo sapiens
ttggctttgggttgcaggacct

SEQ ID NO: 4337082 - DNA, 11 bp, Homo sapiens
ttgggggcttc

SEQ ID NO: 4337083 - DNA, 16 bp, Homo sapiens
ttggttaaaatgtgat

SEQ ID NO: 4337084 - DNA, 14 bp, Homo sapiens
ttggttcagttttt

SEQ ID NO: 4337085 - DNA, 15 bp, Homo sapiens
ttggttcagtttttt

SEQ ID NO: 4337086 - DNA, 17 bp, Homo sapiens
ttgtaccctctccaggc

SEQ ID NO: 4337087 - DNA, 18 bp, Homo sapiens
ttgtagaataaatggttt

SEQ ID NO: 4337088 - DNA, 13 bp, Homo sapiens
ttgtaggtaaaat

SEQ ID NO: 4337089 - DNA, 15 bp, Homo sapiens
ttgtaggtaaaatgt

SEQ ID NO: 4337090 - DNA, 22 bp, Homo sapiens
ttgtataaattaaataaactgt

SEQ ID NO: 4337091 - DNA, 19 bp, Homo sapiens
ttgtatgtgtgtagactgt

SEQ ID NO: 4337092 - DNA, 12 bp, Homo sapiens
ttgtattaataa

SEQ ID NO: 4337093 - DNA, 21 bp, Homo sapiens
ttgtattaataaagcattctt

SEQ ID NO: 4337094 - DNA, 12 bp, Homo sapiens
ttgtattgcttc

SEQ ID NO: 4337095 - DNA, 17 bp, Homo sapiens
ttgtatttaaaggtaca

SEQ ID NO: 4337096 - DNA, 18 bp, Homo sapiens
ttgtatttagtagttatt

SEQ ID NO: 4337097 - DNA, 17 bp, Homo sapiens
ttgtcattgtccagctg

SEQ ID NO: 4337098 - DNA, 15 bp, Homo sapiens
ttgtccttgcacctg

SEQ ID NO: 4337099 - DNA, 22 bp, Homo sapiens
ttgtctgtccagccgtgtgtgc

SEQ ID NO: 4337100 - DNA, 15 bp, Homo sapiens
ttgtctgtgtgctgt

SEQ ID NO: 4337101 - DNA, 15 bp, Homo sapiens
ttgtgaatgcttctc

SEQ ID NO: 4337102 - DNA, 23 bp, Homo sapiens
ttgtgagataaaactctcctttt

SEQ ID NO: 4337103 - DNA, 23 bp, Homo sapiens
ttgtgcacttagtagtttttaca

SEQ ID NO: 4337104 - DNA, 14 bp, Homo sapiens
ttgtgcatatgtta

SEQ ID NO: 4337105 - DNA, 12 bp, Homo sapiens
ttgtgcttctcc

SEQ ID NO: 4337106 - DNA, 19 bp, Homo sapiens
ttgtgcttctccccagaat

SEQ ID NO: 4337107 - DNA, 21 bp, Homo sapiens
ttgtgtaatctaagtatatgt

SEQ ID NO: 4337108 - DNA, 14 bp, Homo sapiens
ttgttatcatttaa

SEQ ID NO: 4337109 - DNA, 18 bp, Homo sapiens
ttgttattaatgtttctt

SEQ ID NO: 4337110 - DNA, 18 bp, Homo sapiens
ttgttgaaaaatgttgct

SEQ ID NO: 4337111 - DNA, 19 bp, Homo sapiens
ttgtttattgagtttgtag

SEQ ID NO: 4337112 - DNA, 24 bp, Homo sapiens
ttgtttattgagtttgtaggtaaa

SEQ ID NO: 4337113 - DNA, 13 bp, Homo sapiens
ttgtttgaaagac

SEQ ID NO: 4337114 - DNA, 21 bp, Homo sapiens
ttgttttaatctactttttgt

SEQ ID NO: 4337115 - DNA, 15 bp, Homo sapiens
ttgtttttctttcta

SEQ ID NO: 4337116 - DNA, 21 bp, Homo sapiens
tttaaaaaatatatatataaa

SEQ ID NO: 4337117 - DNA, 12 bp, Homo sapiens
tttaaaaaatta

SEQ ID NO: 4337118 - DNA, 20 bp, Homo sapiens
tttaaaaaattaaaaatgaa

SEQ ID NO: 4337119 - DNA, 14 bp, Homo sapiens
tttaaactctgcca

SEQ ID NO: 4337120 - DNA, 18 bp, Homo sapiens
tttaaatcaaaaactttt

SEQ ID NO: 4337121 - DNA, 19 bp, Homo sapiens
tttaaatcaaaaacttttc

SEQ ID NO: 4337122 - DNA, 12 bp, Homo sapiens
tttaagtgacat

SEQ ID NO: 4337123 - DNA, 21 bp, Homo sapiens
tttaagtgacataattgtcca

SEQ ID NO: 4337124 - DNA, 13 bp, Homo sapiens
tttaataaaagta

SEQ ID NO: 4337125 - DNA, 22 bp, Homo sapiens
tttaatctactttttgtattta

SEQ ID NO: 4337126 - DNA, 23 bp, Homo sapiens
tttacaatgatgccgaacattag

SEQ ID NO: 4337127 - DNA, 18 bp, Homo sapiens
tttacagggagcctcctg

SEQ ID NO: 4337128 - DNA, 20 bp, Homo sapiens
tttacagggagcctcctgcc

SEQ ID NO: 4337129 - DNA, 22 bp, Homo sapiens
tttacagggagcctcctgccca

SEQ ID NO: 4337130 - DNA, 23 bp, Homo sapiens
tttacagggagcctcctgcccag

SEQ ID NO: 4337131 - DNA, 14 bp, Homo sapiens
tttacccctgctga

SEQ ID NO: 4337132 - DNA, 15 bp, Homo sapiens
tttactcttaaatca

SEQ ID NO: 4337133 - DNA, 16 bp, Homo sapiens
tttactgcagctttgt

SEQ ID NO: 4337134 - DNA, 11 bp, Homo sapiens
tttacttaaac

SEQ ID NO: 4337135 - DNA, 20 bp, Homo sapiens
tttagaagcaaagatttcag

SEQ ID NO: 4337136 - DNA, 12 bp, Homo sapiens
tttagctacctt

SEQ ID NO: 4337137 - DNA, 20 bp, Homo sapiens
tttagctacctttttatatt

SEQ ID NO: 4337138 - DNA, 14 bp, Homo sapiens
tttagggtgggtaa

SEQ ID NO: 4337139 - DNA, 18 bp, Homo sapiens
tttagggtgggtaagaaa

SEQ ID NO: 4337140 - DNA, 14 bp, Homo sapiens
tttagtgtgctgct

SEQ ID NO: 4337141 - DNA, 22 bp, Homo sapiens
tttataaaaataaatagaaaag

SEQ ID NO: 4337142 - DNA, 14 bp, Homo sapiens
tttatatattgaaa

SEQ ID NO: 4337143 - DNA, 21 bp, Homo sapiens
tttatatattgaaagttgctt

SEQ ID NO: 4337144 - DNA, 13 bp, Homo sapiens
tttatctttgtgt

SEQ ID NO: 4337145 - DNA, 20 bp, Homo sapiens
tttatgtaatgaagtaaagc

SEQ ID NO: 4337146 - DNA, 20 bp, Homo sapiens
tttatgtggtcttatgattt

SEQ ID NO: 4337147 - DNA, 14 bp, Homo sapiens
tttattacagaaat

SEQ ID NO: 4337148 - DNA, 24 bp, Homo sapiens
tttattgcttagtgaaaatactag

SEQ ID NO: 4337149 - DNA, 19 bp, Homo sapiens
tttatttagttccttgagt

SEQ ID NO: 4337150 - DNA, 16 bp, Homo sapiens
tttattttctgtgtaa

SEQ ID NO: 4337151 - DNA, 18 bp, Homo sapiens
tttcaattgcagatgcca

SEQ ID NO: 4337152 - DNA, 15 bp, Homo sapiens
tttcacgaactgttc

SEQ ID NO: 4337153 - DNA, 14 bp, Homo sapiens
tttcagattttaaa

SEQ ID NO: 4337154 - DNA, 18 bp, Homo sapiens
tttcagtagaattttagt

SEQ ID NO: 4337155 - DNA, 24 bp, Homo sapiens
tttcagtagtgagcagcatctagt

SEQ ID NO: 4337156 - DNA, 23 bp, Homo sapiens
tttcatagatttgaaaaactttt

SEQ ID NO: 4337157 - DNA, 23 bp, Homo sapiens
tttcatagtgtcaagaaggaaga

SEQ ID NO: 4337158 - DNA, 19 bp, Homo sapiens
tttcattatctaatgagtt

SEQ ID NO: 4337159 - DNA, 17 bp, Homo sapiens
tttcattccattgccta

SEQ ID NO: 4337160 - DNA, 22 bp, Homo sapiens
tttcattgctgggcttgtctgt

SEQ ID NO: 4337161 - DNA, 20 bp, Homo sapiens
tttcattgtgatttatatat

SEQ ID NO: 4337162 - DNA, 13 bp, Homo sapiens
tttcatttcagat

SEQ ID NO: 4337163 - DNA, 14 bp, Homo sapiens
tttcatttcagatt

SEQ ID NO: 4337164 - DNA, 16 bp, Homo sapiens
tttccaaactgactca

SEQ ID NO: 4337165 - DNA, 17 bp, Homo sapiens
tttccagccttatgtgt

SEQ ID NO: 4337166 - DNA, 19 bp, Homo sapiens
tttccaggtttaagctgtt

SEQ ID NO: 4337167 - DNA, 19 bp, Homo sapiens
tttcccccaccccagagtt

SEQ ID NO: 4337168 - DNA, 16 bp, Homo sapiens
tttccctattagagaa

SEQ ID NO: 4337169 - DNA, 23 bp, Homo sapiens
tttcctccccattcctacaattt

SEQ ID NO: 4337170 - DNA, 13 bp, Homo sapiens
tttcctctctatc

SEQ ID NO: 4337171 - DNA, 19 bp, Homo sapiens
tttcctctctttgttctca

SEQ ID NO: 4337172 - DNA, 22 bp, Homo sapiens
tttccttaccataccactttga

SEQ ID NO: 4337173 - DNA, 12 bp, Homo sapiens
tttcgcttgctt

SEQ ID NO: 4337174 - DNA, 15 bp, Homo sapiens
tttctataaatgact

SEQ ID NO: 4337175 - DNA, 12 bp, Homo sapiens
tttctccccgct

SEQ ID NO: 4337176 - DNA, 17 bp, Homo sapiens
tttctccctaaactgta

SEQ ID NO: 4337177 - DNA, 16 bp, Homo sapiens
tttctctggcaaactt

SEQ ID NO: 4337178 - DNA, 19 bp, Homo sapiens
tttctgatctgtactttgt

SEQ ID NO: 4337179 - DNA, 21 bp, Homo sapiens
tttctgcccagccctctgtgg

SEQ ID NO: 4337180 - DNA, 14 bp, Homo sapiens
tttctggaagaaag

SEQ ID NO: 4337181 - DNA, 11 bp, Homo sapiens
tttctgtactt

SEQ ID NO: 4337182 - DNA, 14 bp, Homo sapiens
tttctgtctctctc

SEQ ID NO: 4337183 - DNA, 23 bp, Homo sapiens
tttctgtctctctctctttttct

SEQ ID NO: 4337184 - DNA, 13 bp, Homo sapiens
tttcttaatgtct

SEQ ID NO: 4337185 - DNA, 21 bp, Homo sapiens
tttcttagtccctaatcatgt

SEQ ID NO: 4337186 - DNA, 16 bp, Homo sapiens
tttcttagtgcctgtg

SEQ ID NO: 4337187 - DNA, 21 bp, Homo sapiens
tttcttagtgcttcagagttt

SEQ ID NO: 4337188 - DNA, 17 bp, Homo sapiens
tttcttcaggtaacact

SEQ ID NO: 4337189 - DNA, 20 bp, Homo sapiens
tttcttcccccgctaattca

SEQ ID NO: 4337190 - DNA, 12 bp, Homo sapiens
tttcttgtttat

SEQ ID NO: 4337191 - DNA, 15 bp, Homo sapiens
tttcttttattatca

SEQ ID NO: 4337192 - DNA, 22 bp, Homo sapiens
ttcccaggtaatttaaattggt

SEQ ID NO: 4337193 - DNA, 17 bp, Homo sapiens
ttcccaggttacaatgg

SEQ ID NO: 4337194 - DNA, 23 bp, Homo sapiens
ttcccccgccgcttttctcctct

SEQ ID NO: 4337195 - DNA, 19 bp, Homo sapiens
ttccccctttctctgcctg

SEQ ID NO: 4337196 - DNA, 13 bp, Homo sapiens
ttccctctgcctg

SEQ ID NO: 4337197 - DNA, 16 bp, Homo sapiens
ttccctctgcctggga

SEQ ID NO: 4337198 - DNA, 15 bp, Homo sapiens
ttcctaactgtgatt

SEQ ID NO: 4337199 - DNA, 17 bp, Homo sapiens
ttcctacagcactactg

SEQ ID NO: 4337200 - DNA, 20 bp, Homo sapiens
ttcctcccttctttgcttct

SEQ ID NO: 4337201 - DNA, 14 bp, Homo sapiens
ttcctcctctcctg

SEQ ID NO: 4337202 - DNA, 14 bp, Homo sapiens
ttcctctctatctt

SEQ ID NO: 4337203 - DNA, 22 bp, Homo sapiens
ttcctctctttgttctcagctc

SEQ ID NO: 4337204 - DNA, 21 bp, Homo sapiens
ttcctctgtttctccttctga

SEQ ID NO: 4337205 - DNA, 17 bp, Homo sapiens
ttcctgccaggcatggt

SEQ ID NO: 4337206 - DNA, 13 bp, Homo sapiens
ttccttaaatgaa

SEQ ID NO: 4337207 - DNA, 16 bp, Homo sapiens
ttccttaaatgaacta

SEQ ID NO: 4337208 - DNA, 20 bp, Homo sapiens
ttcctttgtggttttatgga

SEQ ID NO: 4337209 - DNA, 18 bp, Homo sapiens
ttcgcttgcttctgcagc

SEQ ID NO: 4337210 - DNA, 20 bp, Homo sapiens
ttcgggaggtcgaggcagga

SEQ ID NO: 4337211 - DNA, 15 bp, Homo sapiens
ttcgggattccctgg

SEQ ID NO: 4337212 - DNA, 16 bp, Homo sapiens
ttcgggattccctggt

SEQ ID NO: 4337213 - DNA, 13 bp, Homo sapiens
ttcggggaccagc

SEQ ID NO: 4337214 - DNA, 13 bp, Homo sapiens
ttctaccccacct

SEQ ID NO: 4337215 - DNA, 13 bp, Homo sapiens
ttctacgccaggg

SEQ ID NO: 4337216 - DNA, 22 bp, Homo sapiens
ttctagagggcaggttagagac

SEQ ID NO: 4337217 - DNA, 20 bp, Homo sapiens
ttctatccaaacatgtattt

SEQ ID NO: 4337218 - DNA, 12 bp, Homo sapiens
ttctcagctccc

SEQ ID NO: 4337219 - DNA, 14 bp, Homo sapiens
ttctcagctccccc

SEQ ID NO: 4337220 - DNA, 21 bp, Homo sapiens
ttctcagttgcagaaaatgaa

SEQ ID NO: 4337221 - DNA, 17 bp, Homo sapiens
ttctcataattcctaca

SEQ ID NO: 4337222 - DNA, 20 bp, Homo sapiens
ttctcataattcctacagca

SEQ ID NO: 4337223 - DNA, 14 bp, Homo sapiens
ttctcattaaactc

SEQ ID NO: 4337224 - DNA, 13 bp, Homo sapiens
ttctcccaggcct

SEQ ID NO: 4337225 - DNA, 19 bp, Homo sapiens
ttctcccaggcctctgccc

SEQ ID NO: 4337226 - DNA, 12 bp, Homo sapiens
ttctccccagaa

SEQ ID NO: 4337227 - DNA, 11 bp, Homo sapiens
ttctccctagc

SEQ ID NO: 4337228 - DNA, 11 bp, Homo sapiens
ttctcctgccc

SEQ ID NO: 4337229 - DNA, 11 bp, Homo sapiens
ttctctgccaa

SEQ ID NO: 4337230 - DNA, 15 bp, Homo sapiens
ttctctgcctggcaa

SEQ ID NO: 4337231 - DNA, 17 bp, Homo sapiens
ttctctttgccttgatg

SEQ ID NO: 4337232 - DNA, 16 bp, Homo sapiens
ttctgaaatacttttg

SEQ ID NO: 4337233 - DNA, 14 bp, Homo sapiens
ttctgatctgtact

SEQ ID NO: 4337234 - DNA, 15 bp, Homo sapiens
ttctgatgcccaccg

SEQ ID NO: 4337235 - DNA, 14 bp, Homo sapiens
ttctgcagcaactc

SEQ ID NO: 4337236 - DNA, 20 bp, Homo sapiens
ttctgcagcaactcccacga

SEQ ID NO: 4337237 - DNA, 21 bp, Homo sapiens
ttctgcagcaactcccacgac

SEQ ID NO: 4337238 - DNA, 18 bp, Homo sapiens
ttctgcattgagaaggaa

SEQ ID NO: 4337239 - DNA, 23 bp, Homo sapiens
ttctgcccagccctctgtggcca

SEQ ID NO: 4337240 - DNA, 20 bp, Homo sapiens
ttctggcttccttctctcaa

SEQ ID NO: 4337241 - DNA, 17 bp, Homo sapiens
ttctgtacttcctgagt

SEQ ID NO: 4337242 - DNA, 18 bp, Homo sapiens
ttctgtattttgtttttg

SEQ ID NO: 4337243 - DNA, 13 bp, Homo sapiens
ttctgtctctctc

SEQ ID NO: 4337244 - DNA, 17 bp, Homo sapiens
ttctgtctctctctctt

SEQ ID NO: 4337245 - DNA, 19 bp, Homo sapiens
ttcttacaagcttaaagct

SEQ ID NO: 4337246 - DNA, 17 bp, Homo sapiens
ttcttaccctctctttc

SEQ ID NO: 4337247 - DNA, 19 bp, Homo sapiens
ttcttagtgcttcagagtt

SEQ ID NO: 4337248 - DNA, 20 bp, Homo sapiens
ttcttagtgcttcagagttt

SEQ ID NO: 4337249 - DNA, 22 bp, Homo sapiens
ttcttcagaattatccattacg

SEQ ID NO: 4337250 - DNA, 20 bp, Homo sapiens
ttcttcaggtaacactacag

SEQ ID NO: 4337251 - DNA, 14 bp, Homo sapiens
ttctttattgcact

SEQ ID NO: 4337252 - DNA, 21 bp, Homo sapiens
ttctttattgcactaggaatt

SEQ ID NO: 4337253 - DNA, 21 bp, Homo sapiens
ttctttgtagaataaatggtt

SEQ ID NO: 4337254 - DNA, 20 bp, Homo sapiens
ttcttttagatgtttacctt

SEQ ID NO: 4337255 - DNA, 13 bp, Homo sapiens
ttcttttggaaat

SEQ ID NO: 4337256 - DNA, 16 bp, Homo sapiens
ttctttttcttaccct

SEQ ID NO: 4337257 - DNA, 19 bp, Homo sapiens
ttcttttttaaagtaaact

SEQ ID NO: 4337258 - DNA, 21 bp, Homo sapiens
ttgaaaaaggaaaaatgtaga

SEQ ID NO: 4337259 - DNA, 10 bp, Homo sapiens
ttgaaaacac

SEQ ID NO: 4337260 - DNA, 18 bp, Homo sapiens
ttgaaaatacattcttaa

SEQ ID NO: 4337261 - DNA, 16 bp, Homo sapiens
ttgaaacctgctctgt

SEQ ID NO: 4337262 - DNA, 22 bp, Homo sapiens
ttgaacgcacatagctcaatca

SEQ ID NO: 4337263 - DNA, 13 bp, Homo sapiens
ttgaagatacaca

SEQ ID NO: 4337264 - DNA, 13 bp, Homo sapiens
ttgaagcctgccc

SEQ ID NO: 4337265 - DNA, 16 bp, Homo sapiens
ttgaataataaatcga

SEQ ID NO: 4337266 - DNA, 23 bp, Homo sapiens
ttgaataataaatcgatccatgt

SEQ ID NO: 4337267 - DNA, 23 bp, Homo sapiens
ttgaatattactcctatttttgt

SEQ ID NO: 4337268 - DNA, 19 bp, Homo sapiens
ttgacaagctaggaaagag

SEQ ID NO: 4337269 - DNA, 21 bp, Homo sapiens
ttgacaagctaggaaagagga

SEQ ID NO: 4337270 - DNA, 12 bp, Homo sapiens
ttgacatagcct

SEQ ID NO: 4337271 - DNA, 13 bp, Homo sapiens
ttgacatagcctt

SEQ ID NO: 4337272 - DNA, 14 bp, Homo sapiens
ttgacatagccttt

SEQ ID NO: 4337273 - DNA, 16 bp, Homo sapiens
ttgacatagcctttgt

SEQ ID NO: 4337274 - DNA, 18 bp, Homo sapiens
ttgacatagcctttgtgc

SEQ ID NO: 4337275 - DNA, 15 bp, Homo sapiens
ttgagaccagaagaa

SEQ ID NO: 4337276 - DNA, 15 bp, Homo sapiens
ttgagatcagcctgg

SEQ ID NO: 4337277 - DNA, 14 bp, Homo sapiens
ttgagcaggtatca

SEQ ID NO: 4337278 - DNA, 14 bp, Homo sapiens
ttgagcctgggagg

SEQ ID NO: 4337279 - DNA, 20 bp, Homo sapiens
ttgagcgtacgatggaggcc

SEQ ID NO: 4337280 - DNA, 23 bp, Homo sapiens
ttgagtcttaactgtatttcagt

SEQ ID NO: 4337281 - DNA, 23 bp, Homo sapiens
ttgatcccctctctgtggctcca

SEQ ID NO: 4337282 - DNA, 12 bp, Homo sapiens
ttgatctttgtt

SEQ ID NO: 4337283 - DNA, 21 bp, Homo sapiens
ttgatctttgtttaaatgcca

SEQ ID NO: 4337284 - DNA, 18 bp, Homo sapiens
ttgatgcaggcacttatt

SEQ ID NO: 4337285 - DNA, 16 bp, Homo sapiens
ttgattcagctctgca

SEQ ID NO: 4337286 - DNA, 23 bp, Homo sapiens
ttgattctccttttatgtgtagt

SEQ ID NO: 4337287 - DNA, 20 bp, Homo sapiens
ttgcaaactctataaagaaa

SEQ ID NO: 4337288 - DNA, 16 bp, Homo sapiens
ttgcaccactgcactc

SEQ ID NO: 4337289 - DNA, 12 bp, Homo sapiens
ttgcagaaaatg

SEQ ID NO: 4337290 - DNA, 22 bp, Homo sapiens
ttgcagcttgtgctgagcctgc

SEQ ID NO: 4337291 - DNA, 19 bp, Homo sapiens
ttgcataatactaatttat

SEQ ID NO: 4337292 - DNA, 21 bp, Homo sapiens
ttgcatttgctgttgtttcta

SEQ ID NO: 4337293 - DNA, 20 bp, Homo sapiens
ttgccaaaatgttggctgcg

SEQ ID NO: 4337294 - DNA, 13 bp, Homo sapiens
ttgccaaagctgg

SEQ ID NO: 4337295 - DNA, 19 bp, Homo sapiens
ttgccaagctaatctgcct

SEQ ID NO: 4337296 - DNA, 16 bp, Homo sapiens
ttgccacaggcctccc

SEQ ID NO: 4337297 - DNA, 19 bp, Homo sapiens
ttgccacaggcctccctgt

SEQ ID NO: 4337298 - DNA, 13 bp, Homo sapiens
ttgcccaacacca

SEQ ID NO: 4337299 - DNA, 16 bp, Homo sapiens
ttgcccgccctccacc

SEQ ID NO: 4337300 - DNA, 17 bp, Homo sapiens
ttgcctctttctccagc

SEQ ID NO: 4337301 - DNA, 23 bp, Homo sapiens
ttgcctgctgcttggagtgcccc

SEQ ID NO: 4337302 - DNA, 15 bp, Homo sapiens
ttgctaaattataaa

SEQ ID NO: 4337303 - DNA, 20 bp, Homo sapiens
ttgctaaattataaaattga

SEQ ID NO: 4337304 - DNA, 19 bp, Homo sapiens
ttgctgaagggcattcttt

SEQ ID NO: 4337305 - DNA, 19 bp, Homo sapiens
ttgctgaatacagaggcaa

SEQ ID NO: 4337306 - DNA, 17 bp, Homo sapiens
ttgctggaaaatcatat

SEQ ID NO: 4337307 - DNA, 17 bp, Homo sapiens
ttgctgtgtagttccct

SEQ ID NO: 4337308 - DNA, 22 bp, Homo sapiens
ttgctgtgtagttccctctgcc

SEQ ID NO: 4337309 - DNA, 19 bp, Homo sapiens
ttgctgttagttataaaac

SEQ ID NO: 4337310 - DNA, 23 bp, Homo sapiens
ttgctgttgtttctataaatgac

SEQ ID NO: 4337311 - DNA, 14 bp, Homo sapiens
ttgctgtttactcc

SEQ ID NO: 4337312 - DNA, 12 bp, Homo sapiens
ttgcttagtaaa

SEQ ID NO: 4337313 - DNA, 12 bp, Homo sapiens
ttaataactgaa

SEQ ID NO: 4337314 - DNA, 15 bp, Homo sapiens
ttaatagaatatact

SEQ ID NO: 4337315 - DNA, 20 bp, Homo sapiens
ttaatcagcaatattgcctg

SEQ ID NO: 4337316 - DNA, 13 bp, Homo sapiens
ttaattaaaaact

SEQ ID NO: 4337317 - DNA, 14 bp, Homo sapiens
ttaattaaaaactt

SEQ ID NO: 4337318 - DNA, 22 bp, Homo sapiens
ttaattaaagccttaagcacaa

SEQ ID NO: 4337319 - DNA, 12 bp, Homo sapiens
ttaattttaaag

SEQ ID NO: 4337320 - DNA, 16 bp, Homo sapiens
ttacaaaactgctttg

SEQ ID NO: 4337321 - DNA, 16 bp, Homo sapiens
ttacaaccaagaacat

SEQ ID NO: 4337322 - DNA, 18 bp, Homo sapiens
ttacaagcttaaagcttg

SEQ ID NO: 4337323 - DNA, 16 bp, Homo sapiens
ttacacgtgcgtgtga

SEQ ID NO: 4337324 - DNA, 22 bp, Homo sapiens
ttacagaaatgtttttaacact

SEQ ID NO: 4337325 - DNA, 20 bp, Homo sapiens
ttacagggagcctcctgccc

SEQ ID NO: 4337326 - DNA, 21 bp, Homo sapiens
ttacagggagcctcctgccca

SEQ ID NO: 4337327 - DNA, 18 bp, Homo sapiens
ttacagtttattttctgt

SEQ ID NO: 4337328 - DNA, 21 bp, Homo sapiens
ttacagtttattttctgtgta

SEQ ID NO: 4337329 - DNA, 22 bp, Homo sapiens
ttacagtttattttctgtgtaa

SEQ ID NO: 4337330 - DNA, 19 bp, Homo sapiens
ttacattattccaatgata

SEQ ID NO: 4337331 - DNA, 13 bp, Homo sapiens
ttaccctctcttt

SEQ ID NO: 4337332 - DNA, 12 bp, Homo sapiens
ttacgtgcattt

SEQ ID NO: 4337333 - DNA, 14 bp, Homo sapiens
ttactcacctctct

SEQ ID NO: 4337334 - DNA, 17 bp, Homo sapiens
ttactcccttctgtagt

SEQ ID NO: 4337335 - DNA, 22 bp, Homo sapiens
ttactcctatttttgtaaactg

SEQ ID NO: 4337336 - DNA, 16 bp, Homo sapiens
ttactcttaattttaa

SEQ ID NO: 4337337 - DNA, 18 bp, Homo sapiens
ttactgagacttcgaaga

SEQ ID NO: 4337338 - DNA, 18 bp, Homo sapiens
ttactggggcctggggct

SEQ ID NO: 4337339 - DNA, 21 bp, Homo sapiens
ttacttaaaccgccaaggctg

SEQ ID NO: 4337340 - DNA, 23 bp, Homo sapiens
ttacttagaatgccataaaattg

SEQ ID NO: 4337341 - DNA, 18 bp, Homo sapiens
ttacttaggtgtggggga

SEQ ID NO: 4337342 - DNA, 21 bp, Homo sapiens
ttagaatgccataaaattgca

SEQ ID NO: 4337343 - DNA, 18 bp, Homo sapiens
ttagaccgctctcttttc

SEQ ID NO: 4337344 - DNA, 15 bp, Homo sapiens
ttagactgtggccat

SEQ ID NO: 4337345 - DNA, 21 bp, Homo sapiens
ttagatattatcataacatct

SEQ ID NO: 4337346 - DNA, 18 bp, Homo sapiens
ttagcaaattctgttttt

SEQ ID NO: 4337347 - DNA, 17 bp, Homo sapiens
ttagcccaatggagaaa

SEQ ID NO: 4337348 - DNA, 14 bp, Homo sapiens
ttaggcaaaacctt

SEQ ID NO: 4337349 - DNA, 20 bp, Homo sapiens
ttaggcagcaacagcagagc

SEQ ID NO: 4337350 - DNA, 15 bp, Homo sapiens
ttagggtgggtaaga

SEQ ID NO: 4337351 - DNA, 19 bp, Homo sapiens
ttaggtatataataacttt

SEQ ID NO: 4337352 - DNA, 19 bp, Homo sapiens
ttaggtgtgggggaagcac

SEQ ID NO: 4337353 - DNA, 18 bp, Homo sapiens
ttaggttggcaaaaaggc

SEQ ID NO: 4337354 - DNA, 14 bp, Homo sapiens
ttagtattcttgag

SEQ ID NO: 4337355 - DNA, 22 bp, Homo sapiens
ttagtcccacagggaaatgtgt

SEQ ID NO: 4337356 - DNA, 20 bp, Homo sapiens
ttagtcgggcatgagtctgt

SEQ ID NO: 4337357 - DNA, 14 bp, Homo sapiens
ttagtgaaaatact

SEQ ID NO: 4337358 - DNA, 17 bp, Homo sapiens
ttagtgtgctgctgttc

SEQ ID NO: 4337359 - DNA, 14 bp, Homo sapiens
ttagttccttgagt

SEQ ID NO: 4337360 - DNA, 17 bp, Homo sapiens
ttataaaaataaataga

SEQ ID NO: 4337361 - DNA, 17 bp, Homo sapiens
ttataaatatatataaa

SEQ ID NO: 4337362 - DNA, 15 bp, Homo sapiens
ttataagagagctta

SEQ ID NO: 4337363 - DNA, 21 bp, Homo sapiens
ttataagagagcttattgttt

SEQ ID NO: 4337364 - DNA, 20 bp, Homo sapiens
ttataagcgtatttagactg

SEQ ID NO: 4337365 - DNA, 15 bp, Homo sapiens
ttatacacaactttg

SEQ ID NO: 4337366 - DNA, 17 bp, Homo sapiens
ttatacacaactttgca

SEQ ID NO: 4337367 - DNA, 19 bp, Homo sapiens
ttataccatgtgtgctaat

SEQ ID NO: 4337368 - DNA, 15 bp, Homo sapiens
ttatagattgtctta

SEQ ID NO: 4337369 - DNA, 20 bp, Homo sapiens
ttatagttgtgggtgggaga

SEQ ID NO: 4337370 - DNA, 18 bp, Homo sapiens
ttatataaaggcaaggaa

SEQ ID NO: 4337371 - DNA, 15 bp, Homo sapiens
ttatatattgaaagt

SEQ ID NO: 4337372 - DNA, 23 bp, Homo sapiens
ttatatattgaaagttgctttta

SEQ ID NO: 4337373 - DNA, 17 bp, Homo sapiens
ttatcagtagaaagagt

SEQ ID NO: 4337374 - DNA, 19 bp, Homo sapiens
ttatccagctagtgccaaa

SEQ ID NO: 4337375 - DNA, 17 bp, Homo sapiens
ttatccatgacaggcct

SEQ ID NO: 4337376 - DNA, 18 bp, Homo sapiens
ttatcgcaacatgaattt

SEQ ID NO: 4337377 - DNA, 15 bp, Homo sapiens
ttatgagtttgctta

SEQ ID NO: 4337378 - DNA, 14 bp, Homo sapiens
ttatggagacctct

SEQ ID NO: 4337379 - DNA, 22 bp, Homo sapiens
ttatgggtatgtgttgccaaag

SEQ ID NO: 4337380 - DNA, 12 bp, Homo sapiens
ttatgtgttaca

SEQ ID NO: 4337381 - DNA, 15 bp, Homo sapiens
ttattaatgtttctt

SEQ ID NO: 4337382 - DNA, 16 bp, Homo sapiens
ttattcagctagaatt

SEQ ID NO: 4337383 - DNA, 14 bp, Homo sapiens
ttattgaaatagtt

SEQ ID NO: 4337384 - DNA, 14 bp, Homo sapiens
ttattgagtttgta

SEQ ID NO: 4337385 - DNA, 11 bp, Homo sapiens
ttattgcacta

SEQ ID NO: 4337386 - DNA, 17 bp, Homo sapiens
ttattgcatttgctgtt

SEQ ID NO: 4337387 - DNA, 17 bp, Homo sapiens
ttattgccgtcctggac

SEQ ID NO: 4337388 - DNA, 15 bp, Homo sapiens
ttattgcttagtaaa

SEQ ID NO: 4337389 - DNA, 16 bp, Homo sapiens
ttattggtatatttgt

SEQ ID NO: 4337390 - DNA, 20 bp, Homo sapiens
ttattggtatatttgtagat

SEQ ID NO: 4337391 - DNA, 12 bp, Homo sapiens
ttattgtaaatt

SEQ ID NO: 4337392 - DNA, 15 bp, Homo sapiens
ttattgtttgaaaga

SEQ ID NO: 4337393 - DNA, 16 bp, Homo sapiens
ttattgtttgaaagac

SEQ ID NO: 4337394 - DNA, 18 bp, Homo sapiens
ttattgtttgaaagactt

SEQ ID NO: 4337395 - DNA, 14 bp, Homo sapiens
ttatttaaactatt

SEQ ID NO: 4337396 - DNA, 16 bp, Homo sapiens
ttcaaattggtctgaa

SEQ ID NO: 4337397 - DNA, 17 bp, Homo sapiens
ttcaaattggtctgaaa

SEQ ID NO: 4337398 - DNA, 16 bp, Homo sapiens
ttcaagcttttccttt

SEQ ID NO: 4337399 - DNA, 13 bp, Homo sapiens
ttcaaggctttaa

SEQ ID NO: 4337400 - DNA, 15 bp, Homo sapiens
ttcaagtaacacttt

SEQ ID NO: 4337401 - DNA, 13 bp, Homo sapiens
ttcaattctcaaa

SEQ ID NO: 4337402 - DNA, 15 bp, Homo sapiens
ttcacagttctgtaa

SEQ ID NO: 4337403 - DNA, 14 bp, Homo sapiens
ttcaccctgggcag

SEQ ID NO: 4337404 - DNA, 20 bp, Homo sapiens
ttcactcatgcaaactgctt

SEQ ID NO: 4337405 - DNA, 21 bp, Homo sapiens
ttcactcatgcaaactgcttt

SEQ ID NO: 4337406 - DNA, 15 bp, Homo sapiens
ttcactctaaaaata

SEQ ID NO: 4337407 - DNA, 21 bp, Homo sapiens
ttcactggggcatgagatttt

SEQ ID NO: 4337408 - DNA, 15 bp, Homo sapiens
ttcagagtttgtgtg

SEQ ID NO: 4337409 - DNA, 13 bp, Homo sapiens
ttcaggagcccta

SEQ ID NO: 4337410 - DNA, 13 bp, Homo sapiens
ttcaggtctctgt

SEQ ID NO: 4337411 - DNA, 16 bp, Homo sapiens
ttcagtattttccagc

SEQ ID NO: 4337412 - DNA, 19 bp, Homo sapiens
ttcagtgttgacatagcct

SEQ ID NO: 4337413 - DNA, 21 bp, Homo sapiens
ttcagtgttgacatagccttt

SEQ ID NO: 4337414 - DNA, 18 bp, Homo sapiens
ttcataccccagaaatta

SEQ ID NO: 4337415 - DNA, 14 bp, Homo sapiens
ttcatacctccctc

SEQ ID NO: 4337416 - DNA, 16 bp, Homo sapiens
ttcatacctccctcct

SEQ ID NO: 4337417 - DNA, 21 bp, Homo sapiens
ttcatagatttgaaaaacttt

SEQ ID NO: 4337418 - DNA, 23 bp, Homo sapiens
ttcatatgcagaacgtatttagc

SEQ ID NO: 4337419 - DNA, 16 bp, Homo sapiens
ttcatctcccagatcc

SEQ ID NO: 4337420 - DNA, 21 bp, Homo sapiens
ttcatgcttctactgtgacac

SEQ ID NO: 4337421 - DNA, 18 bp, Homo sapiens
ttcattctcataattcct

SEQ ID NO: 4337422 - DNA, 14 bp, Homo sapiens
ttcattctgagccc

SEQ ID NO: 4337423 - DNA, 23 bp, Homo sapiens
ttccaaaataatctatattaaat

SEQ ID NO: 4337424 - DNA, 17 bp, Homo sapiens
ttccagaacaaattgtt

SEQ ID NO: 4337425 - DNA, 17 bp, Homo sapiens
ttccagccttatgtgtt

SEQ ID NO: 4337426 - DNA, 18 bp, Homo sapiens
ttccagccttatgtgtta

SEQ ID NO: 4337427 - DNA, 21 bp, Homo sapiens
ttccagccttatgtgttacat

SEQ ID NO: 4337428 - DNA, 17 bp, Homo sapiens
ttccaggtttaagctgt

SEQ ID NO: 4337429 - DNA, 18 bp, Homo sapiens
ttccaggtttaagctgtt

SEQ ID NO: 4337430 - DNA, 22 bp, Homo sapiens
ttccattaataactgaataaaa

SEQ ID NO: 4337431 - DNA, 18 bp, Homo sapiens
ttccattgcaaaatagaa

SEQ ID NO: 4337432 - DNA, 20 bp, Homo sapiens
ttcccaagctagactgtgtc

SEQ ID NO: 4337433 - DNA, 20 bp, Homo sapiens
ttcccaggtaatttaaattg

SEQ ID NO: 4337434 - DNA, 13 bp, Homo sapiens
aaaaaaaattccc

SEQ ID NO: 4337435 - DNA, 13 bp, Homo sapiens
aaaaaatatatat

SEQ ID NO: 4337436 - DNA, 21 bp, Homo sapiens
aaaaaccacccacaaagaaac

SEQ ID NO: 4337437 - DNA, 14 bp, Homo sapiens
aaaaactttgctcc

SEQ ID NO: 4337438 - DNA, 15 bp, Homo sapiens
aaaaacttttcattt

SEQ ID NO: 4337439 - DNA, 20 bp, Homo sapiens
aaaaacttttcatttcagat

SEQ ID NO: 4337440 - DNA, 11 bp, Homo sapiens
aaaaagaagaa

SEQ ID NO: 4337441 - DNA, 16 bp, Homo sapiens
aaaaagaccttctccc

SEQ ID NO: 4337442 - DNA, 14 bp, Homo sapiens
aaaaagcacaagaa

SEQ ID NO: 4337443 - DNA, 15 bp, Homo sapiens
aaaaagcacaagaag

SEQ ID NO: 4337444 - DNA, 22 bp, Homo sapiens
aaaaagccaacaggtaaacaca

SEQ ID NO: 4337445 - DNA, 14 bp, Homo sapiens
aaaaagggtaactt

SEQ ID NO: 4337446 - DNA, 16 bp, Homo sapiens
aaaaataactattttg

SEQ ID NO: 4337447 - DNA, 17 bp, Homo sapiens
aaaaataactattttgt

SEQ ID NO: 4337448 - DNA, 17 bp, Homo sapiens
aaaaatacttaaatatt

SEQ ID NO: 4337449 - DNA, 20 bp, Homo sapiens
aaaaatatatatataaaata

SEQ ID NO: 4337450 - DNA, 13 bp, Homo sapiens
aaaactatgtgtt

SEQ ID NO: 4337451 - DNA, 23 bp, Homo sapiens
aaaactatgtgttcaatgaaata

SEQ ID NO: 4337452 - DNA, 18 bp, Homo sapiens
aaaactgacatcagattt

SEQ ID NO: 4337453 - DNA, 21 bp, Homo sapiens
aaaactgacatcagatttctt

SEQ ID NO: 4337454 - DNA, 23 bp, Homo sapiens
aaaactgacatcagatttcttaa

SEQ ID NO: 4337455 - DNA, 22 bp, Homo sapiens
aaaactgctgactgttttctct

SEQ ID NO: 4337456 - DNA, 14 bp, Homo sapiens
aaaactttaaagat

SEQ ID NO: 4337457 - DNA, 19 bp, Homo sapiens
aaaactttaaagataagtc

SEQ ID NO: 4337458 - DNA, 16 bp, Homo sapiens
aaaacttttcatttca

SEQ ID NO: 4337459 - DNA, 22 bp, Homo sapiens
aaaacttttcatttcagatttt

SEQ ID NO: 4337460 - DNA, 14 bp, Homo sapiens
aaaagaaatgaaat

SEQ ID NO: 4337461 - DNA, 17 bp, Homo sapiens
aaaagaacactagagtc

SEQ ID NO: 4337462 - DNA, 13 bp, Homo sapiens
aaaagaagaagga

SEQ ID NO: 4337463 - DNA, 21 bp, Homo sapiens
aaaagaatggaccaaccactt

SEQ ID NO: 4337464 - DNA, 12 bp, Homo sapiens
aaaagagaggat

SEQ ID NO: 4337465 - DNA, 13 bp, Homo sapiens
aaaagatgcttct

SEQ ID NO: 4337466 - DNA, 22 bp, Homo sapiens
aaaagtcagagttaaaatatat

SEQ ID NO: 4337467 - DNA, 15 bp, Homo sapiens
aaaagtcgttttcca

SEQ ID NO: 4337468 - DNA, 22 bp, Homo sapiens
aaaagtcgttttccaaactgac

SEQ ID NO: 4337469 - DNA, 18 bp, Homo sapiens
aaaagtgtacatgaagaa

SEQ ID NO: 4337470 - DNA, 19 bp, Homo sapiens
aaaagtgtacatgaagaat

SEQ ID NO: 4337471 - DNA, 15 bp, Homo sapiens
aaaataaatagaaaa

SEQ ID NO: 4337472 - DNA, 13 bp, Homo sapiens
aaaataactattt

SEQ ID NO: 4337473 - DNA, 22 bp, Homo sapiens
aaaataatctatattaaatgag

SEQ ID NO: 4337474 - DNA, 19 bp, Homo sapiens
aaaatagaatccaaaccca

SEQ ID NO: 4337475 - DNA, 16 bp, Homo sapiens
aaaatattttcctgcc

SEQ ID NO: 4337476 - DNA, 13 bp, Homo sapiens
aaaatcaatgctt

SEQ ID NO: 4337477 - DNA, 15 bp, Homo sapiens
aaaatcaatgcttta

SEQ ID NO: 4337478 - DNA, 16 bp, Homo sapiens
aaaatcacattttaag

SEQ ID NO: 4337479 - DNA, 16 bp, Homo sapiens
aaaatctgattagaag

SEQ ID NO: 4337480 - DNA, 15 bp, Homo sapiens
aaaatgacttttatt

SEQ ID NO: 4337481 - DNA, 20 bp, Homo sapiens
aaaatgagaatctgtgcagt

SEQ ID NO: 4337482 - DNA, 14 bp, Homo sapiens
aaaatgagcctggc

SEQ ID NO: 4337483 - DNA, 14 bp, Homo sapiens
aaaatgcattttct

SEQ ID NO: 4337484 - DNA, 17 bp, Homo sapiens
aaaatggatgacaaaga

SEQ ID NO: 4337485 - DNA, 21 bp, Homo sapiens
aaaatggatgacaaagaaaat

SEQ ID NO: 4337486 - DNA, 18 bp, Homo sapiens
aaaatgtacttaaatgag

SEQ ID NO: 4337487 - DNA, 21 bp, Homo sapiens
aaaatgtagactctgacttcc

SEQ ID NO: 4337488 - DNA, 12 bp, Homo sapiens
aaaatgtatttt

SEQ ID NO: 4337489 - DNA, 16 bp, Homo sapiens
aaaatgtgatttttct

SEQ ID NO: 4337490 - DNA, 13 bp, Homo sapiens
aaaatgttggctg

SEQ ID NO: 4337491 - DNA, 15 bp, Homo sapiens
aaaatgttggctgcg

SEQ ID NO: 4337492 - DNA, 13 bp, Homo sapiens
aaaattcacagag

SEQ ID NO: 4337493 - DNA, 14 bp, Homo sapiens
aaaattcacagagt

SEQ ID NO: 4337494 - DNA, 19 bp, Homo sapiens
aaaattcccaaatattaca

SEQ ID NO: 4337495 - DNA, 20 bp, Homo sapiens
aaaattcgcccgagctgttt

SEQ ID NO: 4337496 - DNA, 14 bp, Homo sapiens
aaacaatttgcata

SEQ ID NO: 4337497 - DNA, 19 bp, Homo sapiens
aaacacaaacgggctcagc

SEQ ID NO: 4337498 - DNA, 13 bp, Homo sapiens
aaacactaacaaa

SEQ ID NO: 4337499 - DNA, 12 bp, Homo sapiens
aaacatagaaac

SEQ ID NO: 4337500 - DNA, 14 bp, Homo sapiens
aaacatagaaacat

SEQ ID NO: 4337501 - DNA, 15 bp, Homo sapiens
aaacatagaaacata

SEQ ID NO: 4337502 - DNA, 19 bp, Homo sapiens
aaacatagaaacatacaca

SEQ ID NO: 4337503 - DNA, 20 bp, Homo sapiens
ttctgtggtccctctgtgtc

SEQ ID NO: 4337504 - DNA, 16 bp, Homo sapiens
ttctgtgtaaaatgag

SEQ ID NO: 4337505 - DNA, 20 bp, Homo sapiens
ttctgtttttctaggcctgg

SEQ ID NO: 4337506 - DNA, 14 bp, Homo sapiens
ttcttaatgtctgt

SEQ ID NO: 4337507 - DNA, 20 bp, Homo sapiens
ttcttacaagcttaaagctt

SEQ ID NO: 4337508 - DNA, 15 bp, Homo sapiens
ttcttaccctctctt

SEQ ID NO: 4337509 - DNA, 20 bp, Homo sapiens
ttcttaccctctctttcaat

SEQ ID NO: 4337510 - DNA, 13 bp, Homo sapiens
ttcttagtaaaaa

SEQ ID NO: 4337511 - DNA, 23 bp, Homo sapiens
ttcttagtgcttcagagtttgtg

SEQ ID NO: 4337512 - DNA, 19 bp, Homo sapiens
ttcttcagaattatccatt

SEQ ID NO: 4337513 - DNA, 19 bp, Homo sapiens
ttcttcaggtaacactaca

SEQ ID NO: 4337514 - DNA, 17 bp, Homo sapiens
ttcttggtcaagttttt

SEQ ID NO: 4337515 - DNA, 15 bp, Homo sapiens
ttcttgtttattgag

SEQ ID NO: 4337516 - DNA, 16 bp, Homo sapiens
ttctttattgcactag

SEQ ID NO: 4337517 - DNA, 20 bp, Homo sapiens
ttctttgtagaataaatggt

SEQ ID NO: 4337518 - DNA, 14 bp, Homo sapiens
ttctttttaaaata

SEQ ID NO: 4337519 - DNA, 13 bp, Homo sapiens
ttgaaaaaggaaa

SEQ ID NO: 4337520 - DNA, 20 bp, Homo sapiens
ttgaaaaaggaaaaatgtag

SEQ ID NO: 4337521 - DNA, 16 bp, Homo sapiens
ttgaaaacaaacttct

SEQ ID NO: 4337522 - DNA, 15 bp, Homo sapiens
ttgaaaacactaaca

SEQ ID NO: 4337523 - DNA, 16 bp, Homo sapiens
ttgaaaacactaacaa

SEQ ID NO: 4337524 - DNA, 21 bp, Homo sapiens
ttgaaaacactaacaaaattt

SEQ ID NO: 4337525 - DNA, 14 bp, Homo sapiens
ttgaaaactgacat

SEQ ID NO: 4337526 - DNA, 22 bp, Homo sapiens
ttgaaaactgacatcagatttc

SEQ ID NO: 4337527 - DNA, 13 bp, Homo sapiens
ttgaaaatacatt

SEQ ID NO: 4337528 - DNA, 14 bp, Homo sapiens
ttgaagatacacaa

SEQ ID NO: 4337529 - DNA, 21 bp, Homo sapiens
ttgaagcctgcccttgtctga

SEQ ID NO: 4337530 - DNA, 17 bp, Homo sapiens
ttgacaagctaggaaag

SEQ ID NO: 4337531 - DNA, 19 bp, Homo sapiens
ttgacccctttcccccacc

SEQ ID NO: 4337532 - DNA, 20 bp, Homo sapiens
ttgacccctttcccccaccc

SEQ ID NO: 4337533 - DNA, 23 bp, Homo sapiens
ttgacgttgttgtcattgtccag

SEQ ID NO: 4337534 - DNA, 19 bp, Homo sapiens
ttgagaataagaatttgag

SEQ ID NO: 4337535 - DNA, 17 bp, Homo sapiens
ttgagattgccccaggt

SEQ ID NO: 4337536 - DNA, 17 bp, Homo sapiens
ttgagctttctgtgcat

SEQ ID NO: 4337537 - DNA, 21 bp, Homo sapiens
ttgagctttctgtgcatgtgc

SEQ ID NO: 4337538 - DNA, 15 bp, Homo sapiens
ttgaggaactgtaca

SEQ ID NO: 4337539 - DNA, 15 bp, Homo sapiens
ttgaggtagaggaaa

SEQ ID NO: 4337540 - DNA, 20 bp, Homo sapiens
ttgagttgattcagctctgc

SEQ ID NO: 4337541 - DNA, 21 bp, Homo sapiens
ttgatcccttctcctgccctt

SEQ ID NO: 4337542 - DNA, 20 bp, Homo sapiens
ttgatttgatctttgtttaa

SEQ ID NO: 4337543 - DNA, 23 bp, Homo sapiens
ttgcaaaatagaagaagaggaag

SEQ ID NO: 4337544 - DNA, 18 bp, Homo sapiens
ttgcaaactctataaaga

SEQ ID NO: 4337545 - DNA, 20 bp, Homo sapiens
ttgcaaattatttattactt

SEQ ID NO: 4337546 - DNA, 18 bp, Homo sapiens
ttgcaccactgcactcca

SEQ ID NO: 4337547 - DNA, 21 bp, Homo sapiens
ttgcaccactgcactccagcc

SEQ ID NO: 4337548 - DNA, 13 bp, Homo sapiens
ttgcacctgagcc

SEQ ID NO: 4337549 - DNA, 15 bp, Homo sapiens
ttgcacctgagcctg

SEQ ID NO: 4337550 - DNA, 14 bp, Homo sapiens
ttgcactaggaatt

SEQ ID NO: 4337551 - DNA, 15 bp, Homo sapiens
ttgcactaggaattc

SEQ ID NO: 4337552 - DNA, 21 bp, Homo sapiens
ttgcactaggaattctttgca

SEQ ID NO: 4337553 - DNA, 21 bp, Homo sapiens
ttgcagtttcatgtatgtata

SEQ ID NO: 4337554 - DNA, 14 bp, Homo sapiens
ttgcatcacattgt

SEQ ID NO: 4337555 - DNA, 15 bp, Homo sapiens
ttgcatttgctgttg

SEQ ID NO: 4337556 - DNA, 18 bp, Homo sapiens
ttgccacaggcctccctg

SEQ ID NO: 4337557 - DNA, 18 bp, Homo sapiens
ttgcccaacaccagcccc

SEQ ID NO: 4337558 - DNA, 20 bp, Homo sapiens
ttgcccaacaccagcccctg

SEQ ID NO: 4337559 - DNA, 14 bp, Homo sapiens
ttgcccttggagct

SEQ ID NO: 4337560 - DNA, 11 bp, Homo sapiens
ttgcctgctgc

SEQ ID NO: 4337561 - DNA, 17 bp, Homo sapiens
ttgccttgatgttgtgt

SEQ ID NO: 4337562 - DNA, 22 bp, Homo sapiens
ttgcgccatctgtgcacactaa

SEQ ID NO: 4337563 - DNA, 12 bp, Homo sapiens
ttgctaaattat

SEQ ID NO: 4337564 - DNA, 16 bp, Homo sapiens
ttgctaaattataaaa

SEQ ID NO: 4337565 - DNA, 21 bp, Homo sapiens
ttgctaaattataaaattgaa

SEQ ID NO: 4337566 - DNA, 14 bp, Homo sapiens
ttgctaactgggaa

SEQ ID NO: 4337567 - DNA, 19 bp, Homo sapiens
ttgctaactgggaagaaca

SEQ ID NO: 4337568 - DNA, 15 bp, Homo sapiens
ttgctccaggcatca

SEQ ID NO: 4337569 - DNA, 17 bp, Homo sapiens
ttgctgcataaaattct

SEQ ID NO: 4337570 - DNA, 22 bp, Homo sapiens
tttctaggcaggtggagagagt

SEQ ID NO: 4337571 - DNA, 21 bp, Homo sapiens
tttctataaatgactattgta

SEQ ID NO: 4337572 - DNA, 13 bp, Homo sapiens
tttctcctctccc

SEQ ID NO: 4337573 - DNA, 16 bp, Homo sapiens
tttctctgcctggcaa

SEQ ID NO: 4337574 - DNA, 23 bp, Homo sapiens
tttctgagtgagttttactctta

SEQ ID NO: 4337575 - DNA, 22 bp, Homo sapiens
tttctgctttctttgattctcc

SEQ ID NO: 4337576 - DNA, 13 bp, Homo sapiens
tttctggaagaaa

SEQ ID NO: 4337577 - DNA, 11 bp, Homo sapiens
tttctggagtc

SEQ ID NO: 4337578 - DNA, 17 bp, Homo sapiens
tttctgtggaaaacaat

SEQ ID NO: 4337579 - DNA, 18 bp, Homo sapiens
tttctgtggaaaacaatt

SEQ ID NO: 4337580 - DNA, 18 bp, Homo sapiens
tttcttcagaattatcca

SEQ ID NO: 4337581 - DNA, 9 bp, Homo sapiens
tttcttggt

SEQ ID NO: 4337582 - DNA, 13 bp, Homo sapiens
tttcttgtttatt

SEQ ID NO: 4337583 - DNA, 14 bp, Homo sapiens
tttcttttattatc

SEQ ID NO: 4337584 - DNA, 12 bp, Homo sapiens
tttcttttggaa

SEQ ID NO: 4337585 - DNA, 14 bp, Homo sapiens
tttcttttggaaat

SEQ ID NO: 4337586 - DNA, 13 bp, Homo sapiens
tttctttttggta

SEQ ID NO: 4337587 - DNA, 15 bp, Homo sapiens
tttcttttttaaagt

SEQ ID NO: 4337588 - DNA, 18 bp, Homo sapiens
tttcttttttaaagtaaa

SEQ ID NO: 4337589 - DNA, 23 bp, Homo sapiens
tttgaaaaagtgtacatgaagaa

SEQ ID NO: 4337590 - DNA, 12 bp, Homo sapiens
tttgaaaacaaa

SEQ ID NO: 4337591 - DNA, 17 bp, Homo sapiens
tttgaaaacaaacttct

SEQ ID NO: 4337592 - DNA, 13 bp, Homo sapiens
tttgaaaactgac

SEQ ID NO: 4337593 - DNA, 19 bp, Homo sapiens
tttgaaaactgacatcaga

SEQ ID NO: 4337594 - DNA, 19 bp, Homo sapiens
tttgaaatgccacgtgcca

SEQ ID NO: 4337595 - DNA, 22 bp, Homo sapiens
tttgaagcctgcccttgtctga

SEQ ID NO: 4337596 - DNA, 16 bp, Homo sapiens
tttgagatcagcctgg

SEQ ID NO: 4337597 - DNA, 15 bp, Homo sapiens
tttgagcaattttcg

SEQ ID NO: 4337598 - DNA, 15 bp, Homo sapiens
tttgaggtaaagata

SEQ ID NO: 4337599 - DNA, 19 bp, Homo sapiens
tttgaggtagaggaaaatc

SEQ ID NO: 4337600 - DNA, 13 bp, Homo sapiens
tttgatctttgtt

SEQ ID NO: 4337601 - DNA, 19 bp, Homo sapiens
tttgcaaattatttattac

SEQ ID NO: 4337602 - DNA, 20 bp, Homo sapiens
tttgcatccacttcaggagc

SEQ ID NO: 4337603 - DNA, 20 bp, Homo sapiens
tttgccaagctaatctgcct

SEQ ID NO: 4337604 - DNA, 14 bp, Homo sapiens
tttgcccaacacca

SEQ ID NO: 4337605 - DNA, 23 bp, Homo sapiens
tttgcccaacaccagcccctgcc

SEQ ID NO: 4337606 - DNA, 14 bp, Homo sapiens
tttgctgcatttta

SEQ ID NO: 4337607 - DNA, 18 bp, Homo sapiens
tttgctgtgtagttccct

SEQ ID NO: 4337608 - DNA, 16 bp, Homo sapiens
tttgctgttactgctt

SEQ ID NO: 4337609 - DNA, 15 bp, Homo sapiens
tttgcttctttttct

SEQ ID NO: 4337610 - DNA, 21 bp, Homo sapiens
tttggaagaagttttttactt

SEQ ID NO: 4337611 - DNA, 14 bp, Homo sapiens
tttggggctgcgaa

SEQ ID NO: 4337612 - DNA, 16 bp, Homo sapiens
tttgtaaactggaatt

SEQ ID NO: 4337613 - DNA, 23 bp, Homo sapiens
tttgtataaattaaataaactgt

SEQ ID NO: 4337614 - DNA, 11 bp, Homo sapiens
tttgtattaat

SEQ ID NO: 4337615 - DNA, 18 bp, Homo sapiens
tttgtattaataaagcat

SEQ ID NO: 4337616 - DNA, 22 bp, Homo sapiens
tttgtattgcttcctgattacc

SEQ ID NO: 4337617 - DNA, 12 bp, Homo sapiens
tttgtatttagt

SEQ ID NO: 4337618 - DNA, 12 bp, Homo sapiens
tttgtctgtcca

SEQ ID NO: 4337619 - DNA, 23 bp, Homo sapiens
tttgtcttaaaaagtggaaaaat

SEQ ID NO: 4337620 - DNA, 13 bp, Homo sapiens
tttgtttgatgca

SEQ ID NO: 4337621 - DNA, 16 bp, Homo sapiens
tttgtttttttccaac

SEQ ID NO: 4337622 - DNA, 18 bp, Homo sapiens
ttttaaaaaactgctgac

SEQ ID NO: 4337623 - DNA, 14 bp, Homo sapiens
ttttaaaaagggta

SEQ ID NO: 4337624 - DNA, 18 bp, Homo sapiens
ttttaaaaagggtaactt

SEQ ID NO: 4337625 - DNA, 20 bp, Homo sapiens
ttttaaacaaaatttcacag

SEQ ID NO: 4337626 - DNA, 21 bp, Homo sapiens
ttttaaagacccaacttgcca

SEQ ID NO: 4337627 - DNA, 22 bp, Homo sapiens
ttttaaagacccaacttgccaa

SEQ ID NO: 4337628 - DNA, 9 bp, Homo sapiens
ttttaaagt

SEQ ID NO: 4337629 - DNA, 12 bp, Homo sapiens
ttttaaatcatc

SEQ ID NO: 4337630 - DNA, 23 bp, Homo sapiens
ttttaagtgacataattgtccag

SEQ ID NO: 4337631 - DNA, 23 bp, Homo sapiens
ttttaatcagcaatattgcctgt

SEQ ID NO: 4337632 - DNA, 15 bp, Homo sapiens
ttttaattaaaaact

SEQ ID NO: 4337633 - DNA, 22 bp, Homo sapiens
ttttactttggtttagtctttt

SEQ ID NO: 4337634 - DNA, 21 bp, Homo sapiens
ttttagaccctattgctgctt

SEQ ID NO: 4337635 - DNA, 16 bp, Homo sapiens
ttttataggttgttct

SEQ ID NO: 4337636 - DNA, 12 bp, Homo sapiens
ttttatgtgtat

SEQ ID NO: 4337637 - DNA, 18 bp, Homo sapiens
ttttattacagaaatgtt

SEQ ID NO: 4337638 - DNA, 15 bp, Homo sapiens
ttttattatcagtta

SEQ ID NO: 4337639 - DNA, 20 bp, Homo sapiens
ttttattcagctagaatttc

SEQ ID NO: 4337640 - DNA, 21 bp, Homo sapiens
ttttattgcatttgctgttgt

SEQ ID NO: 4337641 - DNA, 11 bp, Homo sapiens
ttttatttaca

SEQ ID NO: 4337642 - DNA, 13 bp, Homo sapiens
ttttatttacatt

SEQ ID NO: 4337643 - DNA, 13 bp, Homo sapiens
ttttcagaacatc

SEQ ID NO: 4337644 - DNA, 19 bp, Homo sapiens
ttttccttcctttttattc

SEQ ID NO: 4337645 - DNA, 23 bp, Homo sapiens
ttttcgaacattctttgcctggt

SEQ ID NO: 4337646 - DNA, 20 bp, Homo sapiens
ttttcgcttgcttctgcagc

SEQ ID NO: 4337647 - DNA, 17 bp, Homo sapiens
ttttctatttacctcct

SEQ ID NO: 4337648 - DNA, 16 bp, Homo sapiens
ttttctggccttgact

SEQ ID NO: 4337649 - DNA, 16 bp, Homo sapiens
ttttcttaccctctct

SEQ ID NO: 4337650 - DNA, 21 bp, Homo sapiens
ttttcttaccctctctttcaa

SEQ ID NO: 4337651 - DNA, 11 bp, Homo sapiens
ttttcttggtg

SEQ ID NO: 4337652 - DNA, 22 bp, Homo sapiens
ttttcttttttaaagtaaactt

SEQ ID NO: 4337653 - DNA, 22 bp, Homo sapiens
ttttgaaaaagtgtacatgaag

SEQ ID NO: 4337654 - DNA, 23 bp, Homo sapiens
ttttgaggtaaagatatggagaa

SEQ ID NO: 4337655 - DNA, 18 bp, Homo sapiens
ttttgataataatattgt

SEQ ID NO: 4337656 - DNA, 18 bp, Homo sapiens
ttttgtgaaaatgtcaaa

SEQ ID NO: 4337657 - DNA, 14 bp, Homo sapiens
ttttgtttgtttct

SEQ ID NO: 4337658 - DNA, 12 bp, Homo sapiens
tttttaataaaa

SEQ ID NO: 4337659 - DNA, 13 bp, Homo sapiens
tttttaattaaaa

SEQ ID NO: 4337660 - DNA, 13 bp, Homo sapiens
tttttacaaaact

SEQ ID NO: 4337661 - DNA, 19 bp, Homo sapiens
tttttacaaaactgctttg

SEQ ID NO: 4337662 - DNA, 23 bp, Homo sapiens
tttttacaaaactgctttgtgca

SEQ ID NO: 4337663 - DNA, 14 bp, Homo sapiens
tttttattgcattt

SEQ ID NO: 4337664 - DNA, 17 bp, Homo sapiens
tttttattgcatttgct

SEQ ID NO: 4337665 - DNA, 16 bp, Homo sapiens
tttttggtaaatatga

SEQ ID NO: 4337666 - DNA, 14 bp, Homo sapiens
tttttggtaattat

SEQ ID NO: 4337667 - DNA, 17 bp, Homo sapiens
tttttgtcaaataaaat

SEQ ID NO: 4337668 - DNA, 15 bp, Homo sapiens
tttttgtttgtttct

SEQ ID NO: 4337669 - DNA, 12 bp, Homo sapiens
ttttttcagttc

SEQ ID NO: 4337670 - DNA, 10 bp, Homo sapiens
tttttttcca

SEQ ID NO: 4337671 - DNA, 16 bp, Homo sapiens
tgcaaataaagccttt

SEQ ID NO: 4337672 - DNA, 15 bp, Homo sapiens
tgcaaattatttatt

SEQ ID NO: 4337673 - DNA, 22 bp, Homo sapiens
tgcaactaactgactctgttat

SEQ ID NO: 4337674 - DNA, 22 bp, Homo sapiens
tgcaagattttttttttaagtg

SEQ ID NO: 4337675 - DNA, 19 bp, Homo sapiens
tgcaagtgaacttgggagg

SEQ ID NO: 4337676 - DNA, 15 bp, Homo sapiens
tgcacaaggattgaa

SEQ ID NO: 4337677 - DNA, 15 bp, Homo sapiens
tgcaccactgcactc

SEQ ID NO: 4337678 - DNA, 17 bp, Homo sapiens
tgcaccctcaggcaggt

SEQ ID NO: 4337679 - DNA, 14 bp, Homo sapiens
tgcactccagcctg

SEQ ID NO: 4337680 - DNA, 16 bp, Homo sapiens
tgcactccagcctggg

SEQ ID NO: 4337681 - DNA, 14 bp, Homo sapiens
tgcacttagtagtt

SEQ ID NO: 4337682 - DNA, 19 bp, Homo sapiens
tgcagaacgtatttagcca

SEQ ID NO: 4337683 - DNA, 14 bp, Homo sapiens
tgcagacaattctc

SEQ ID NO: 4337684 - DNA, 18 bp, Homo sapiens
tgcagatatccaaacaag

SEQ ID NO: 4337685 - DNA, 20 bp, Homo sapiens
tgcagatatccaaacaagac

SEQ ID NO: 4337686 - DNA, 14 bp, Homo sapiens
tgcagcaactccca

SEQ ID NO: 4337687 - DNA, 17 bp, Homo sapiens
tgcagcccctctcacag

SEQ ID NO: 4337688 - DNA, 19 bp, Homo sapiens
tgcagcccctctcacaggc

SEQ ID NO: 4337689 - DNA, 18 bp, Homo sapiens
tgcaggacctcaggtgag

SEQ ID NO: 4337690 - DNA, 17 bp, Homo sapiens
tgcagggcctggcatag

SEQ ID NO: 4337691 - DNA, 14 bp, Homo sapiens
tgcagtgagccgag

SEQ ID NO: 4337692 - DNA, 14 bp, Homo sapiens
tgcagtttcatgta

SEQ ID NO: 4337693 - DNA, 13 bp, Homo sapiens
tgcataaaattct

SEQ ID NO: 4337694 - DNA, 14 bp, Homo sapiens
tgcataaaattcta

SEQ ID NO: 4337695 - DNA, 15 bp, Homo sapiens
tgcataatactaatt

SEQ ID NO: 4337696 - DNA, 19 bp, Homo sapiens
tgcataatactaatttatt

SEQ ID NO: 4337697 - DNA, 22 bp, Homo sapiens
tgcataatactaatttattgcc

SEQ ID NO: 4337698 - DNA, 20 bp, Homo sapiens
tgcatatgttaaagcttatt

SEQ ID NO: 4337699 - DNA, 16 bp, Homo sapiens
tgcatccacttcagga

SEQ ID NO: 4337700 - DNA, 12 bp, Homo sapiens
tgcatctggcac

SEQ ID NO: 4337701 - DNA, 16 bp, Homo sapiens
tgcattcattctgagc

SEQ ID NO: 4337702 - DNA, 17 bp, Homo sapiens
tgcattcattctgagcc

SEQ ID NO: 4337703 - DNA, 19 bp, Homo sapiens
tgcattcattctgagcccc

SEQ ID NO: 4337704 - DNA, 20 bp, Homo sapiens
tgcattccagaacaaattgt

SEQ ID NO: 4337705 - DNA, 17 bp, Homo sapiens
tgcattccttacttgca

SEQ ID NO: 4337706 - DNA, 20 bp, Homo sapiens
tgcattccttacttgcactg

SEQ ID NO: 4337707 - DNA, 13 bp, Homo sapiens
tgcatttgctgtt

SEQ ID NO: 4337708 - DNA, 16 bp, Homo sapiens
tgcatttgctgttgtt

SEQ ID NO: 4337709 - DNA, 13 bp, Homo sapiens
tgcattttacaca

SEQ ID NO: 4337710 - DNA, 16 bp, Homo sapiens
tgcattttacacatgt

SEQ ID NO: 4337711 - DNA, 20 bp, Homo sapiens
tgcattttcttcagaattat

SEQ ID NO: 4337712 - DNA, 19 bp, Homo sapiens
tgccaaaatgttggctgcg

SEQ ID NO: 4337713 - DNA, 23 bp, Homo sapiens
tgccaaaatgttggctgcgtact

SEQ ID NO: 4337714 - DNA, 19 bp, Homo sapiens
tgccaacagacactacatt

SEQ ID NO: 4337715 - DNA, 23 bp, Homo sapiens
tgccaaggccggagacccacagc

SEQ ID NO: 4337716 - DNA, 13 bp, Homo sapiens
tgccaatatgaca

SEQ ID NO: 4337717 - DNA, 19 bp, Homo sapiens
tgccaatatgacacagctt

SEQ ID NO: 4337718 - DNA, 17 bp, Homo sapiens
tgccacaggcctccctg

SEQ ID NO: 4337719 - DNA, 22 bp, Homo sapiens
tgccacaggcctccctgtttga

SEQ ID NO: 4337720 - DNA, 18 bp, Homo sapiens
tgccactcattcctgtag

SEQ ID NO: 4337721 - DNA, 21 bp, Homo sapiens
tgccagaaaaaaataactatt

SEQ ID NO: 4337722 - DNA, 18 bp, Homo sapiens
tgccagcttatctcaggg

SEQ ID NO: 4337723 - DNA, 10 bp, Homo sapiens
tgccaggcat

SEQ ID NO: 4337724 - DNA, 22 bp, Homo sapiens
tgccagtgctaagctgccctga

SEQ ID NO: 4337725 - DNA, 23 bp, Homo sapiens
tgccagtgctaagctgccctgag

SEQ ID NO: 4337726 - DNA, 21 bp, Homo sapiens
tgccataaaattgcagtttca

SEQ ID NO: 4337727 - DNA, 18 bp, Homo sapiens
tgccataccttctcccag

SEQ ID NO: 4337728 - DNA, 19 bp, Homo sapiens
tgccataccttctcccagg

SEQ ID NO: 4337729 - DNA, 19 bp, Homo sapiens
tgccatgctttttggtgag

SEQ ID NO: 4337730 - DNA, 16 bp, Homo sapiens
tgccattgtctttcct

SEQ ID NO: 4337731 - DNA, 14 bp, Homo sapiens
tgcccaacaccagc

SEQ ID NO: 4337732 - DNA, 18 bp, Homo sapiens
tgcccaacaccagcccct

SEQ ID NO: 4337733 - DNA, 19 bp, Homo sapiens
tgcccaacaccagcccctg

SEQ ID NO: 4337734 - DNA, 21 bp, Homo sapiens
tgcccaacaccagcccctgcc

SEQ ID NO: 4337735 - DNA, 21 bp, Homo sapiens
tgcccaccgaggagccccagc

SEQ ID NO: 4337736 - DNA, 22 bp, Homo sapiens
tgcccaccgaggagccccagcc

SEQ ID NO: 4337737 - DNA, 18 bp, Homo sapiens
tgccccaaggaggtggct

SEQ ID NO: 4337738 - DNA, 22 bp, Homo sapiens
tgcccctgagttctgacactgt

SEQ ID NO: 4337739 - DNA, 13 bp, Homo sapiens
tgcccgccctcca

SEQ ID NO: 4337740 - DNA, 20 bp, Homo sapiens
tgcccggtgcagggcctggc

SEQ ID NO: 4337741 - DNA, 20 bp, Homo sapiens
tgccctgttgggggcttcag

SEQ ID NO: 4337742 - DNA, 23 bp, Homo sapiens
tgcccttaaggatcaccccagcc

SEQ ID NO: 4337743 - DNA, 22 bp, Homo sapiens
tgcccttacacgtgcgtgtgag

SEQ ID NO: 4337744 - DNA, 18 bp, Homo sapiens
tgttggacagacactgtt

SEQ ID NO: 4337745 - DNA, 19 bp, Homo sapiens
tgttgggtttgagacagac

SEQ ID NO: 4337746 - DNA, 14 bp, Homo sapiens
tgttgtcattgtcc

SEQ ID NO: 4337747 - DNA, 21 bp, Homo sapiens
tgttgtttctataaatgacta

SEQ ID NO: 4337748 - DNA, 11 bp, Homo sapiens
tgttgtttgcc

SEQ ID NO: 4337749 - DNA, 13 bp, Homo sapiens
tgtttaaatgcca

SEQ ID NO: 4337750 - DNA, 16 bp, Homo sapiens
tgtttaaatgccaaaa

SEQ ID NO: 4337751 - DNA, 21 bp, Homo sapiens
tgtttacagggagcctcctgc

SEQ ID NO: 4337752 - DNA, 21 bp, Homo sapiens
tgtttactcccttctgtagtt

SEQ ID NO: 4337753 - DNA, 21 bp, Homo sapiens
tgtttatacacaactttgcaa

SEQ ID NO: 4337754 - DNA, 18 bp, Homo sapiens
tgtttccaacctggagta

SEQ ID NO: 4337755 - DNA, 14 bp, Homo sapiens
tgtttcccaagcta

SEQ ID NO: 4337756 - DNA, 16 bp, Homo sapiens
tgtttctataaatgac

SEQ ID NO: 4337757 - DNA, 17 bp, Homo sapiens
tgtttcttgtttattga

SEQ ID NO: 4337758 - DNA, 14 bp, Homo sapiens
tgtttctttgtgtt

SEQ ID NO: 4337759 - DNA, 12 bp, Homo sapiens
tgtttgaaaact

SEQ ID NO: 4337760 - DNA, 15 bp, Homo sapiens
tgtttgaaaactgac

SEQ ID NO: 4337761 - DNA, 12 bp, Homo sapiens
tgtttgatgcag

SEQ ID NO: 4337762 - DNA, 16 bp, Homo sapiens
tgtttgttgtcagctg

SEQ ID NO: 4337763 - DNA, 13 bp, Homo sapiens
tgtttgtttcttt

SEQ ID NO: 4337764 - DNA, 15 bp, Homo sapiens
tgtttgtttctttgt

SEQ ID NO: 4337765 - DNA, 21 bp, Homo sapiens
tgttttgaatattactcctat

SEQ ID NO: 4337766 - DNA, 21 bp, Homo sapiens
tgtttttattgcatttgctgt

SEQ ID NO: 4337767 - DNA, 12 bp, Homo sapiens
tgtttttctcca

SEQ ID NO: 4337768 - DNA, 13 bp, Homo sapiens
tgtttttgtctta

SEQ ID NO: 4337769 - DNA, 18 bp, Homo sapiens
ttaaaaactttaaagata

SEQ ID NO: 4337770 - DNA, 16 bp, Homo sapiens
ttaaaaatgaaaatta

SEQ ID NO: 4337771 - DNA, 15 bp, Homo sapiens
ttaaaaggatagtat

SEQ ID NO: 4337772 - DNA, 20 bp, Homo sapiens
ttaaaatcacattttaagtg

SEQ ID NO: 4337773 - DNA, 14 bp, Homo sapiens
ttaaaatgtgattt

SEQ ID NO: 4337774 - DNA, 15 bp, Homo sapiens
ttaaacaaaatttca

SEQ ID NO: 4337775 - DNA, 19 bp, Homo sapiens
ttaaacaaaatttcacagt

SEQ ID NO: 4337776 - DNA, 14 bp, Homo sapiens
ttaaacaatgatca

SEQ ID NO: 4337777 - DNA, 17 bp, Homo sapiens
ttaaaccgccaaggctg

SEQ ID NO: 4337778 - DNA, 16 bp, Homo sapiens
ttaaactagtttaagg

SEQ ID NO: 4337779 - DNA, 13 bp, Homo sapiens
ttaaactctgcca

SEQ ID NO: 4337780 - DNA, 17 bp, Homo sapiens
ttaaactctgccagaaa

SEQ ID NO: 4337781 - DNA, 19 bp, Homo sapiens
ttaaactctgccagaaaaa

SEQ ID NO: 4337782 - DNA, 12 bp, Homo sapiens
ttaaagaaggag

SEQ ID NO: 4337783 - DNA, 18 bp, Homo sapiens
ttaaagataagtctacat

SEQ ID NO: 4337784 - DNA, 22 bp, Homo sapiens
ttaaagataagtctacattaaa

SEQ ID NO: 4337785 - DNA, 13 bp, Homo sapiens
ttaaagcttattt

SEQ ID NO: 4337786 - DNA, 18 bp, Homo sapiens
ttaaagcttatttttatg

SEQ ID NO: 4337787 - DNA, 21 bp, Homo sapiens
ttaaaggtacaatcaaaggat

SEQ ID NO: 4337788 - DNA, 14 bp, Homo sapiens
ttaaagtaaacttg

SEQ ID NO: 4337789 - DNA, 12 bp, Homo sapiens
ttaaataaactg

SEQ ID NO: 4337790 - DNA, 15 bp, Homo sapiens
ttaaataaactgttt

SEQ ID NO: 4337791 - DNA, 21 bp, Homo sapiens
ttaaataaactgttttcaagt

SEQ ID NO: 4337792 - DNA, 12 bp, Homo sapiens
ttaaatcaaaaa

SEQ ID NO: 4337793 - DNA, 18 bp, Homo sapiens
ttaaatgaactactgcta

SEQ ID NO: 4337794 - DNA, 15 bp, Homo sapiens
ttaaatgagttactt

SEQ ID NO: 4337795 - DNA, 15 bp, Homo sapiens
ttaacactatactct

SEQ ID NO: 4337796 - DNA, 19 bp, Homo sapiens
ttaaccattgtcttgttct

SEQ ID NO: 4337797 - DNA, 17 bp, Homo sapiens
ttaactacatctgcctc

SEQ ID NO: 4337798 - DNA, 20 bp, Homo sapiens
ttaacttacatgactttctt

SEQ ID NO: 4337799 - DNA, 16 bp, Homo sapiens
ttaagcttctagacac

SEQ ID NO: 4337800 - DNA, 21 bp, Homo sapiens
ttaaggatcaccccagccccc

SEQ ID NO: 4337801 - DNA, 19 bp, Homo sapiens
ttaagtgcttcacatttgt

SEQ ID NO: 4337802 - DNA, 19 bp, Homo sapiens
ttaataactgaataaaaaa

SEQ ID NO: 4337803 - DNA, 19 bp, Homo sapiens
ttaatctactttttgtatt

SEQ ID NO: 4337804 - DNA, 21 bp, Homo sapiens
ttaattaaagccttaagcaca

SEQ ID NO: 4337805 - DNA, 20 bp, Homo sapiens
ttaatttagagcgtttggtt

SEQ ID NO: 4337806 - DNA, 20 bp, Homo sapiens
tgaaagttgcttttattgca

SEQ ID NO: 4337807 - DNA, 22 bp, Homo sapiens
tgaaatagtttccaagaaattt

SEQ ID NO: 4337808 - DNA, 19 bp, Homo sapiens
tgaaattaacaagaactca

SEQ ID NO: 4337809 - DNA, 20 bp, Homo sapiens
tgaaattaacaagaactcat

SEQ ID NO: 4337810 - DNA, 23 bp, Homo sapiens
tgaaattaacaagaactcattat

SEQ ID NO: 4337811 - DNA, 23 bp, Homo sapiens
tgaaattgacaagctaggaaaga

SEQ ID NO: 4337812 - DNA, 17 bp, Homo sapiens
tgaaattttaaactata

SEQ ID NO: 4337813 - DNA, 18 bp, Homo sapiens
tgaacagcaggatgccct

SEQ ID NO: 4337814 - DNA, 19 bp, Homo sapiens
tgaaccaatagaaagcaaa

SEQ ID NO: 4337815 - DNA, 17 bp, Homo sapiens
tgaaccctttgtttctt

SEQ ID NO: 4337816 - DNA, 16 bp, Homo sapiens
tgaactactgctattt

SEQ ID NO: 4337817 - DNA, 15 bp, Homo sapiens
tgaactgggcatttc

SEQ ID NO: 4337818 - DNA, 13 bp, Homo sapiens
tgaactggttcat

SEQ ID NO: 4337819 - DNA, 20 bp, Homo sapiens
tgaagaaattatacgtacat

SEQ ID NO: 4337820 - DNA, 22 bp, Homo sapiens
tgaagaataggtgcaaacaaac

SEQ ID NO: 4337821 - DNA, 10 bp, Homo sapiens
tgaagaattg

SEQ ID NO: 4337822 - DNA, 17 bp, Homo sapiens
tgaagatacacaagagg

SEQ ID NO: 4337823 - DNA, 13 bp, Homo sapiens
tgaagcctgccct

SEQ ID NO: 4337824 - DNA, 15 bp, Homo sapiens
tgaagctggggcttg

SEQ ID NO: 4337825 - DNA, 14 bp, Homo sapiens
tgaaggacatgaga

SEQ ID NO: 4337826 - DNA, 18 bp, Homo sapiens
tgaagtacagtcccagca

SEQ ID NO: 4337827 - DNA, 14 bp, Homo sapiens
tgaagtataaatct

SEQ ID NO: 4337828 - DNA, 16 bp, Homo sapiens
tgaagtcactattttg

SEQ ID NO: 4337829 - DNA, 12 bp, Homo sapiens
tgaataaaagaa

SEQ ID NO: 4337830 - DNA, 13 bp, Homo sapiens
tgaataaaagaat

SEQ ID NO: 4337831 - DNA, 13 bp, Homo sapiens
tgaataatacagt

SEQ ID NO: 4337832 - DNA, 19 bp, Homo sapiens
tgaataattactacattag

SEQ ID NO: 4337833 - DNA, 15 bp, Homo sapiens
tgaatattactccta

SEQ ID NO: 4337834 - DNA, 19 bp, Homo sapiens
tgaatattactcctatttt

SEQ ID NO: 4337835 - DNA, 17 bp, Homo sapiens
tgaatgctgagctgaag

SEQ ID NO: 4337836 - DNA, 19 bp, Homo sapiens
tgaatgctgagctgaagaa

SEQ ID NO: 4337837 - DNA, 21 bp, Homo sapiens
tgaatgggcatgaatggagat

SEQ ID NO: 4337838 - DNA, 19 bp, Homo sapiens
tgaatgtttattccttgat

SEQ ID NO: 4337839 - DNA, 23 bp, Homo sapiens
tgaattaccatagagtaatgatg

SEQ ID NO: 4337840 - DNA, 17 bp, Homo sapiens
tgaattcttatgcttat

SEQ ID NO: 4337841 - DNA, 13 bp, Homo sapiens
tgaattgagaaaa

SEQ ID NO: 4337842 - DNA, 15 bp, Homo sapiens
tgaattgagaaaaga

SEQ ID NO: 4337843 - DNA, 13 bp, Homo sapiens
tgaattgagaata

SEQ ID NO: 4337844 - DNA, 15 bp, Homo sapiens
tgaatttatgagatt

SEQ ID NO: 4337845 - DNA, 19 bp, Homo sapiens
tctcttctttattgcacta

SEQ ID NO: 4337846 - DNA, 13 bp, Homo sapiens
tctcttgagcctg

SEQ ID NO: 4337847 - DNA, 13 bp, Homo sapiens
tctctttcttagt

SEQ ID NO: 4337848 - DNA, 17 bp, Homo sapiens
tctctttgttctcagct

SEQ ID NO: 4337849 - DNA, 19 bp, Homo sapiens
tctctttgttctcagctcc

SEQ ID NO: 4337850 - DNA, 20 bp, Homo sapiens
tctcttttgaggtccctgta

SEQ ID NO: 4337851 - DNA, 19 bp, Homo sapiens
tctgaaccaatagaaagca

SEQ ID NO: 4337852 - DNA, 20 bp, Homo sapiens
tctgaaccaatagaaagcaa

SEQ ID NO: 4337853 - DNA, 21 bp, Homo sapiens
tctgaaccaatagaaagcaaa

SEQ ID NO: 4337854 - DNA, 15 bp, Homo sapiens
tctgaagcctgcagg

SEQ ID NO: 4337855 - DNA, 15 bp, Homo sapiens
tctgaatcatgtctg

SEQ ID NO: 4337856 - DNA, 17 bp, Homo sapiens
tctgaatcatgtctgta

SEQ ID NO: 4337857 - DNA, 14 bp, Homo sapiens
tctgaattgagaaa

SEQ ID NO: 4337858 - DNA, 16 bp, Homo sapiens
tctgagaagtacttta

SEQ ID NO: 4337859 - DNA, 12 bp, Homo sapiens
tctgagccccag

SEQ ID NO: 4337860 - DNA, 14 bp, Homo sapiens
tctgagccccagcc

SEQ ID NO: 4337861 - DNA, 15 bp, Homo sapiens
tctgagccccagccc

SEQ ID NO: 4337862 - DNA, 20 bp, Homo sapiens
tctgagttctctttcttagt

SEQ ID NO: 4337863 - DNA, 21 bp, Homo sapiens
tctgagttctctttcttagtc

SEQ ID NO: 4337864 - DNA, 18 bp, Homo sapiens
tctgatctgtactttgtg

SEQ ID NO: 4337865 - DNA, 14 bp, Homo sapiens
tctgatgcccaccg

SEQ ID NO: 4337866 - DNA, 21 bp, Homo sapiens
tctgatgttccagcttctagc

SEQ ID NO: 4337867 - DNA, 13 bp, Homo sapiens
tctgattagaagt

SEQ ID NO: 4337868 - DNA, 21 bp, Homo sapiens
tctgattataccatgtgtgct

SEQ ID NO: 4337869 - DNA, 14 bp, Homo sapiens
tctgcacaagctgc

SEQ ID NO: 4337870 - DNA, 19 bp, Homo sapiens
tctgcacaagctgcaccct

SEQ ID NO: 4337871 - DNA, 16 bp, Homo sapiens
tctgcagcaactccca

SEQ ID NO: 4337872 - DNA, 19 bp, Homo sapiens
tctgcagcaactcccacga

SEQ ID NO: 4337873 - DNA, 24 bp, Homo sapiens
tctgcattgagaaggaactgatac

SEQ ID NO: 4337874 - DNA, 12 bp, Homo sapiens
tctgcccagccc

SEQ ID NO: 4337875 - DNA, 23 bp, Homo sapiens
tctgcccagccctctgtggccag

SEQ ID NO: 4337876 - DNA, 10 bp, Homo sapiens
tctgcctggc

SEQ ID NO: 4337877 - DNA, 14 bp, Homo sapiens
tctgcctgggatgc

SEQ ID NO: 4337878 - DNA, 19 bp, Homo sapiens
tctgcctgggatgcccttc

SEQ ID NO: 4337879 - DNA, 21 bp, Homo sapiens
tctgcctggttttatttatat

SEQ ID NO: 4337880 - DNA, 17 bp, Homo sapiens
tccaggtttaagctgtt

SEQ ID NO: 4337881 - DNA, 20 bp, Homo sapiens
tccaggtttaagctgttact

SEQ ID NO: 4337882 - DNA, 14 bp, Homo sapiens
tccatgcttcactc

SEQ ID NO: 4337883 - DNA, 23 bp, Homo sapiens
tccatgcttctcatcttgtgaaa

SEQ ID NO: 4337884 - DNA, 22 bp, Homo sapiens
tccattgcaaaatagaagaaga

SEQ ID NO: 4337885 - DNA, 19 bp, Homo sapiens
tcccaagatggagaggaag

SEQ ID NO: 4337886 - DNA, 22 bp, Homo sapiens
tcccaagatggagaggaagaaa

SEQ ID NO: 4337887 - DNA, 17 bp, Homo sapiens
tcccaagctagactgtg

SEQ ID NO: 4337888 - DNA, 21 bp, Homo sapiens
tcccaagctagactgtgtctg

SEQ ID NO: 4337889 - DNA, 20 bp, Homo sapiens
tcccaaggctgcgtctggag

SEQ ID NO: 4337890 - DNA, 15 bp, Homo sapiens
tcccacacccacctc

SEQ ID NO: 4337891 - DNA, 17 bp, Homo sapiens
tcccacacccacctctg

SEQ ID NO: 4337892 - DNA, 14 bp, Homo sapiens
tcccacccaaggag

SEQ ID NO: 4337893 - DNA, 24 bp, Homo sapiens
tcccacgactgttgtacaagctca

SEQ ID NO: 4337894 - DNA, 16 bp, Homo sapiens
tcccactcagcagtga

SEQ ID NO: 4337895 - DNA, 11 bp, Homo sapiens
tcccagaggcc

SEQ ID NO: 4337896 - DNA, 12 bp, Homo sapiens
tcccagaggccg

SEQ ID NO: 4337897 - DNA, 17 bp, Homo sapiens
tcccagaggccgctgcc

SEQ ID NO: 4337898 - DNA, 21 bp, Homo sapiens
tcccagaggccgctgcccctg

SEQ ID NO: 4337899 - DNA, 18 bp, Homo sapiens
tcccagatacttgggggg

SEQ ID NO: 4337900 - DNA, 15 bp, Homo sapiens
tcccagatcctggaa

SEQ ID NO: 4337901 - DNA, 20 bp, Homo sapiens
tcccagcacctattgaatta

SEQ ID NO: 4337902 - DNA, 20 bp, Homo sapiens
tcccagctctctctcctgga

SEQ ID NO: 4337903 - DNA, 14 bp, Homo sapiens
tcccaggcctctgc

SEQ ID NO: 4337904 - DNA, 17 bp, Homo sapiens
tcccaggcctctgcccc

SEQ ID NO: 4337905 - DNA, 17 bp, Homo sapiens
tcccaggtaatttaaat

SEQ ID NO: 4337906 - DNA, 19 bp, Homo sapiens
tcccagtgagtctctgggg

SEQ ID NO: 4337907 - DNA, 19 bp, Homo sapiens
tcccagtgccgagaaggaa

SEQ ID NO: 4337908 - DNA, 16 bp, Homo sapiens
tccccaatccatgctt

SEQ ID NO: 4337909 - DNA, 17 bp, Homo sapiens
tccccaatccatgcttc

SEQ ID NO: 4337910 - DNA, 19 bp, Homo sapiens
tccccaatccatgcttcac

SEQ ID NO: 4337911 - DNA, 12 bp, Homo sapiens
tccccaccctga

SEQ ID NO: 4337912 - DNA, 21 bp, Homo sapiens
tccccacgggaaactcaagga

SEQ ID NO: 4337913 - DNA, 20 bp, Homo sapiens
tccccagctcccccaggcag

SEQ ID NO: 4337914 - DNA, 14 bp, Homo sapiens
tccccagtgcccgg

SEQ ID NO: 4337915 - DNA, 18 bp, Homo sapiens
tccccagtgctcctggcc

SEQ ID NO: 4337916 - DNA, 19 bp, Homo sapiens
tccccagttggcccttctg

SEQ ID NO: 4337917 - DNA, 13 bp, Homo sapiens
tcccccagagccc

SEQ ID NO: 4337918 - DNA, 13 bp, Homo sapiens
tccccccatagag

SEQ ID NO: 4337919 - DNA, 21 bp, Homo sapiens
tccccccatagagaccaggag

SEQ ID NO: 4337920 - DNA, 19 bp, Homo sapiens
tcccccgccgcttttctcc

SEQ ID NO: 4337921 - DNA, 17 bp, Homo sapiens
tcccccgttgtgcctgg

SEQ ID NO: 4337922 - DNA, 21 bp, Homo sapiens
tccccctttctctgcctggca

SEQ ID NO: 4337923 - DNA, 22 bp, Homo sapiens
tccccctttctctgcctggcaa

SEQ ID NO: 4337924 - DNA, 17 bp, Homo sapiens
tccccgccccctgaaac

SEQ ID NO: 4337925 - DNA, 13 bp, Homo sapiens
tccccgcctgttc

SEQ ID NO: 4337926 - DNA, 21 bp, Homo sapiens
tccccggcggggtgcctgctg

SEQ ID NO: 4337927 - DNA, 22 bp, Homo sapiens
tccccggcggggtgcctgctgt

SEQ ID NO: 4337928 - DNA, 20 bp, Homo sapiens
tcccctccccgccccctgaa

SEQ ID NO: 4337929 - DNA, 23 bp, Homo sapiens
tcccctccccgccccctgaaaca

SEQ ID NO: 4337930 - DNA, 15 bp, Homo sapiens
tcccctcctccctgg

SEQ ID NO: 4337931 - DNA, 20 bp, Homo sapiens
tcccctctctgtggctccaa

SEQ ID NO: 4337932 - DNA, 20 bp, Homo sapiens
tcccgcctcccgccaccctg

SEQ ID NO: 4337933 - DNA, 16 bp, Homo sapiens
tccctagatctttcta

SEQ ID NO: 4337934 - DNA, 14 bp, Homo sapiens
tccctcagtctgag

SEQ ID NO: 4337935 - DNA, 14 bp, Homo sapiens
tccctcccccagag

SEQ ID NO: 4337936 - DNA, 17 bp, Homo sapiens
tccctcccccagagccc

SEQ ID NO: 4337937 - DNA, 17 bp, Homo sapiens
tccctcctgatgttttt

SEQ ID NO: 4337938 - DNA, 20 bp, Homo sapiens
tccctcctgatgtttttccc

SEQ ID NO: 4337939 - DNA, 10 bp, Homo sapiens
tccctctgcc

SEQ ID NO: 4337940 - DNA, 13 bp, Homo sapiens
tccctctgcctgg

SEQ ID NO: 4337941 - DNA, 14 bp, Homo sapiens
tccctctgcctggg

SEQ ID NO: 4337942 - DNA, 16 bp, Homo sapiens
tccctctgcctgggat

SEQ ID NO: 4337943 - DNA, 15 bp, Homo sapiens
tccctgctcccagct

SEQ ID NO: 4337944 - DNA, 18 bp, Homo sapiens
tccctgctcccagctctc

SEQ ID NO: 4337945 - DNA, 19 bp, Homo sapiens
tccctgggatggacgctgc

SEQ ID NO: 4337946 - DNA, 22 bp, Homo sapiens
tccctgggatggacgctgccgg

SEQ ID NO: 4337947 - DNA, 22 bp, Homo sapiens
tccctggtgcccttccctggag

SEQ ID NO: 4337948 - DNA, 23 bp, Homo sapiens
tccctgtatgtctacctctgact

SEQ ID NO: 4337949 - DNA, 13 bp, Homo sapiens
tccctgtctctgc

SEQ ID NO: 4337950 - DNA, 19 bp, Homo sapiens
tccctgtttgaagcctgcc

SEQ ID NO: 4337951 - DNA, 20 bp, Homo sapiens
tccctgtttgaagcctgccc

SEQ ID NO: 4337952 - DNA, 15 bp, Homo sapiens
tcccttcctcctctc

SEQ ID NO: 4337953 - DNA, 13 bp, Homo sapiens
tcccttctgtagt

SEQ ID NO: 4337954 - DNA, 18 bp, Homo sapiens
tcccttggatcagaggtc

SEQ ID NO: 4337955 - DNA, 16 bp, Homo sapiens
tcccttttttcttccc

SEQ ID NO: 4337956 - DNA, 14 bp, Homo sapiens
tccgccctgcagca

SEQ ID NO: 4337957 - DNA, 17 bp, Homo sapiens
tcctacgctatgtagaa

SEQ ID NO: 4337958 - DNA, 16 bp, Homo sapiens
tcctagaaattcccca

SEQ ID NO: 4337959 - DNA, 20 bp, Homo sapiens
tcctagcactttgggaggcc

SEQ ID NO: 4337960 - DNA, 12 bp, Homo sapiens
tcctagccccac

SEQ ID NO: 4337961 - DNA, 13 bp, Homo sapiens
tcctagccccacc

SEQ ID NO: 4337962 - DNA, 13 bp, Homo sapiens
tcctaggcatttg

SEQ ID NO: 4337963 - DNA, 13 bp, Homo sapiens
tcctatttttgta

SEQ ID NO: 4337964 - DNA, 15 bp, Homo sapiens
tcctcagcaggccaa

SEQ ID NO: 4337965 - DNA, 17 bp, Homo sapiens
tcctcattagcattttg

SEQ ID NO: 4337966 - DNA, 16 bp, Homo sapiens
tcctcccttctttgct

SEQ ID NO: 4337967 - DNA, 15 bp, Homo sapiens
tcctcctccatctca

SEQ ID NO: 4337968 - DNA, 13 bp, Homo sapiens
tcctcctctcctg

SEQ ID NO: 4337969 - DNA, 14 bp, Homo sapiens
tcctctcctggaaa

SEQ ID NO: 4337970 - DNA, 17 bp, Homo sapiens
tcctctcctttgaaacc

SEQ ID NO: 4337971 - DNA, 21 bp, Homo sapiens
tcctctctttgttctcagctc

SEQ ID NO: 4337972 - DNA, 22 bp, Homo sapiens
tcctctgtttctccttctgaaa

SEQ ID NO: 4337973 - DNA, 21 bp, Homo sapiens
tcctgataaaacaacagctcg

SEQ ID NO: 4337974 - DNA, 17 bp, Homo sapiens
tcctgatgtttttccca

SEQ ID NO: 4337975 - DNA, 13 bp, Homo sapiens
tcctgcccagtcc

SEQ ID NO: 4337976 - DNA, 15 bp, Homo sapiens
tcctgcccagtcccc

SEQ ID NO: 4337977 - DNA, 14 bp, Homo sapiens
tcctggaaaccaca

SEQ ID NO: 4337978 - DNA, 17 bp, Homo sapiens
tcctggagtctgaagcc

SEQ ID NO: 4337979 - DNA, 22 bp, Homo sapiens
tcctgggcatgtttgtctgtgt

SEQ ID NO: 4337980 - DNA, 20 bp, Homo sapiens
tcctgggtaaatgtggtgag

SEQ ID NO: 4337981 - DNA, 14 bp, Homo sapiens
tcctgtccccaggg

SEQ ID NO: 4337982 - DNA, 12 bp, Homo sapiens
tcctgtctgttt

SEQ ID NO: 4337983 - DNA, 21 bp, Homo sapiens
tccttaaatgaactactgcta

SEQ ID NO: 4337984 - DNA, 22 bp, Homo sapiens
tccttaaatgaactactgctat

SEQ ID NO: 4337985 - DNA, 23 bp, Homo sapiens
tccttaaatgaactactgctatt

SEQ ID NO: 4337986 - DNA, 21 bp, Homo sapiens
tccttacttgcactgttactc

SEQ ID NO: 4337987 - DNA, 17 bp, Homo sapiens
tccttcactctaaaaat

SEQ ID NO: 4337988 - DNA, 14 bp, Homo sapiens
tccttccccagctc

SEQ ID NO: 4337989 - DNA, 18 bp, Homo sapiens
tccttcggggaccagccc

SEQ ID NO: 4337990 - DNA, 20 bp, Homo sapiens
tccttcggggaccagcccac

SEQ ID NO: 4337991 - DNA, 13 bp, Homo sapiens
tccttggttcatg

SEQ ID NO: 4337992 - DNA, 16 bp, Homo sapiens
tccttggttcatgctt

SEQ ID NO: 4337993 - DNA, 12 bp, Homo sapiens
tcctttcttttt

SEQ ID NO: 4337994 - DNA, 17 bp, Homo sapiens
tcctttcttttttttct

SEQ ID NO: 4337995 - DNA, 13 bp, Homo sapiens
tcctttttattca

SEQ ID NO: 4337996 - DNA, 18 bp, Homo sapiens
tcgacatcctagccccac

SEQ ID NO: 4337997 - DNA, 21 bp, Homo sapiens
tcgacatcctagccccaccca

SEQ ID NO: 4337998 - DNA, 16 bp, Homo sapiens
tcgacgtcccttggat

SEQ ID NO: 4337999 - DNA, 14 bp, Homo sapiens
tcgatccaaattgt

SEQ ID NO: 4338000 - DNA, 15 bp, Homo sapiens
tcgatccaaattgtg

SEQ ID NO: 4338001 - DNA, 17 bp, Homo sapiens
tcacggaagagccttgc

SEQ ID NO: 4338002 - DNA, 19 bp, Homo sapiens
tcactaatactaattcatt

SEQ ID NO: 4338003 - DNA, 19 bp, Homo sapiens
tcactcatgcaaactgctt

SEQ ID NO: 4338004 - DNA, 21 bp, Homo sapiens
tcactcatgcaaactgcttta

SEQ ID NO: 4338005 - DNA, 18 bp, Homo sapiens
tcactctaaaaatagaat

SEQ ID NO: 4338006 - DNA, 19 bp, Homo sapiens
tcactgattccctctccca

SEQ ID NO: 4338007 - DNA, 20 bp, Homo sapiens
tcactggggcatgagatttt

SEQ ID NO: 4338008 - DNA, 23 bp, Homo sapiens
tcacttaacttacatgactttct

SEQ ID NO: 4338009 - DNA, 22 bp, Homo sapiens
tcacttctcttaaacttgtgaa

SEQ ID NO: 4338010 - DNA, 22 bp, Homo sapiens
tcactttttttttttgtttgat

SEQ ID NO: 4338011 - DNA, 17 bp, Homo sapiens
tcagactctcagcccag

SEQ ID NO: 4338012 - DNA, 18 bp, Homo sapiens
tcagactctcagcccaga

SEQ ID NO: 4338013 - DNA, 21 bp, Homo sapiens
tcagactctcagcccagaaga

SEQ ID NO: 4338014 - DNA, 16 bp, Homo sapiens
tcagactgacactact

SEQ ID NO: 4338015 - DNA, 17 bp, Homo sapiens
tcagactgacactacta

SEQ ID NO: 4338016 - DNA, 15 bp, Homo sapiens
tcagacttaacagac

SEQ ID NO: 4338017 - DNA, 22 bp, Homo sapiens
tcagagtttgtgtgtatttgta

SEQ ID NO: 4338018 - DNA, 18 bp, Homo sapiens
tcagatttcttaatgtct

SEQ ID NO: 4338019 - DNA, 22 bp, Homo sapiens
tcagatttcttaatgtctgtca

SEQ ID NO: 4338020 - DNA, 23 bp, Homo sapiens
tcagatttcttaatgtctgtcag

SEQ ID NO: 4338021 - DNA, 15 bp, Homo sapiens
tcagattttaaaaag

SEQ ID NO: 4338022 - DNA, 17 bp, Homo sapiens
tcagcagggctggtcac

SEQ ID NO: 4338023 - DNA, 20 bp, Homo sapiens
tcagcagggctggtcacctc

SEQ ID NO: 4338024 - DNA, 21 bp, Homo sapiens
tcagcagggctggtcacctcc

SEQ ID NO: 4338025 - DNA, 16 bp, Homo sapiens
tcagcccagaagaaaa

SEQ ID NO: 4338026 - DNA, 16 bp, Homo sapiens
tcagcctgctccagct

SEQ ID NO: 4338027 - DNA, 18 bp, Homo sapiens
tcagcctgctccagctgt

SEQ ID NO: 4338028 - DNA, 19 bp, Homo sapiens
tcagcctgctccagctgtt

SEQ ID NO: 4338029 - DNA, 23 bp, Homo sapiens
tcagctccagacgtaggggaggg

SEQ ID NO: 4338030 - DNA, 15 bp, Homo sapiens
tcagctccccctgtc

SEQ ID NO: 4338031 - DNA, 18 bp, Homo sapiens
tcagctccccctgtcccc

SEQ ID NO: 4338032 - DNA, 15 bp, Homo sapiens
tcagctgaacctggg

SEQ ID NO: 4338033 - DNA, 16 bp, Homo sapiens
tcagctgaacctgggt

SEQ ID NO: 4338034 - DNA, 17 bp, Homo sapiens
tcagcttgcttagatgt

SEQ ID NO: 4338035 - DNA, 19 bp, Homo sapiens
tcaggaggcgaataaatgt

SEQ ID NO: 4338036 - DNA, 21 bp, Homo sapiens
tcaggaggcgaataaatgttc

SEQ ID NO: 4338037 - DNA, 17 bp, Homo sapiens
tcaggcaggtgggatgg

SEQ ID NO: 4338038 - DNA, 21 bp, Homo sapiens
tcaggggatgtacatctctcc

SEQ ID NO: 4338039 - DNA, 21 bp, Homo sapiens
tcagggttaagcctgtaatta

SEQ ID NO: 4338040 - DNA, 13 bp, Homo sapiens
tcagtattttcca

SEQ ID NO: 4338041 - DNA, 14 bp, Homo sapiens
tcagtattttccag

SEQ ID NO: 4338042 - DNA, 23 bp, Homo sapiens
tcagtattttccagccttatgtg

SEQ ID NO: 4338043 - DNA, 22 bp, Homo sapiens
tcagtctttcttagtgcctgtg

SEQ ID NO: 4338044 - DNA, 16 bp, Homo sapiens
tcagtggctttgcata

SEQ ID NO: 4338045 - DNA, 18 bp, Homo sapiens
tcagtgtcgggaattttc

SEQ ID NO: 4338046 - DNA, 14 bp, Homo sapiens
tcagtgttgacata

SEQ ID NO: 4338047 - DNA, 16 bp, Homo sapiens
tcagtgttgacatagc

SEQ ID NO: 4338048 - DNA, 17 bp, Homo sapiens
tcagtgttgacatagcc

SEQ ID NO: 4338049 - DNA, 19 bp, Homo sapiens
tcagttaaaatcacatttt

SEQ ID NO: 4338050 - DNA, 20 bp, Homo sapiens
tcagttaaaatcacatttta

SEQ ID NO: 4338051 - DNA, 16 bp, Homo sapiens
tcagttgcagaaaatg

SEQ ID NO: 4338052 - DNA, 17 bp, Homo sapiens
tcagttgttaacttcta

SEQ ID NO: 4338053 - DNA, 20 bp, Homo sapiens
tcataattcctacagcacta

SEQ ID NO: 4338054 - DNA, 13 bp, Homo sapiens
tcatacacagtta

SEQ ID NO: 4338055 - DNA, 18 bp, Homo sapiens
tcatacacagttaaataa

SEQ ID NO: 4338056 - DNA, 20 bp, Homo sapiens
tcatagatttgaaaaacttt

SEQ ID NO: 4338057 - DNA, 13 bp, Homo sapiens
tcatatatgcttc

SEQ ID NO: 4338058 - DNA, 18 bp, Homo sapiens
tcatatgaccattgaaaa

SEQ ID NO: 4338059 - DNA, 17 bp, Homo sapiens
tcatatgtgaagacaga

SEQ ID NO: 4338060 - DNA, 19 bp, Homo sapiens
tcatattggtgctgagtgc

SEQ ID NO: 4338061 - DNA, 23 bp, Homo sapiens
tcatcaacaaaagggagaacatg

SEQ ID NO: 4338062 - DNA, 22 bp, Homo sapiens
tcatcttgtgaaatggccagga

SEQ ID NO: 4338063 - DNA, 21 bp, Homo sapiens
tcatgaaggacactctgcagg

SEQ ID NO: 4338064 - DNA, 22 bp, Homo sapiens
tcatgaaggacactctgcaggg

SEQ ID NO: 4338065 - DNA, 20 bp, Homo sapiens
tcatgaattcttatgcttat

SEQ ID NO: 4338066 - DNA, 19 bp, Homo sapiens
tcatgcttctactgtgaca

SEQ ID NO: 4338067 - DNA, 19 bp, Homo sapiens
tcatggtagatttttttca

SEQ ID NO: 4338068 - DNA, 20 bp, Homo sapiens
tcatggtagatttttttcat

SEQ ID NO: 4338069 - DNA, 15 bp, Homo sapiens
tcatgtatgtatata

SEQ ID NO: 4338070 - DNA, 14 bp, Homo sapiens
tcatgtctgtatcc

SEQ ID NO: 4338071 - DNA, 21 bp, Homo sapiens
tcatgtctgtatccccagtgc

SEQ ID NO: 4338072 - DNA, 14 bp, Homo sapiens
tcatgtgtctcagc

SEQ ID NO: 4338073 - DNA, 16 bp, Homo sapiens
tcatgtgttttataag

SEQ ID NO: 4338074 - DNA, 13 bp, Homo sapiens
tcattaaactcta

SEQ ID NO: 4338075 - DNA, 17 bp, Homo sapiens
tcattaaactgattcca

SEQ ID NO: 4338076 - DNA, 20 bp, Homo sapiens
tcattccattgcctagctct

SEQ ID NO: 4338077 - DNA, 23 bp, Homo sapiens
tcattctcataattcctacagca

SEQ ID NO: 4338078 - DNA, 17 bp, Homo sapiens
tcattctgcattgagaa

SEQ ID NO: 4338079 - DNA, 14 bp, Homo sapiens
tcattgagtgactt

SEQ ID NO: 4338080 - DNA, 15 bp, Homo sapiens
tcattgagtgacttt

SEQ ID NO: 4338081 - DNA, 12 bp, Homo sapiens
tcattgtccagc

SEQ ID NO: 4338082 - DNA, 15 bp, Homo sapiens
tcattgtccagctgg

SEQ ID NO: 4338083 - DNA, 13 bp, Homo sapiens
tcattgttttgaa

SEQ ID NO: 4338084 - DNA, 17 bp, Homo sapiens
tcattgttttgaatatt

SEQ ID NO: 4338085 - DNA, 14 bp, Homo sapiens
tcatttcagatttt

SEQ ID NO: 4338086 - DNA, 15 bp, Homo sapiens
tcatttcagatttta

SEQ ID NO: 4338087 - DNA, 18 bp, Homo sapiens
tcatttcagattttaaaa

SEQ ID NO: 4338088 - DNA, 13 bp, Homo sapiens
tcatttcattcca

SEQ ID NO: 4338089 - DNA, 17 bp, Homo sapiens
tcattttctgatgccca

SEQ ID NO: 4338090 - DNA, 20 bp, Homo sapiens
tcattttctgatgcccaccg

SEQ ID NO: 4338091 - DNA, 21 bp, Homo sapiens
tccaaaataatctatattaaa

SEQ ID NO: 4338092 - DNA, 19 bp, Homo sapiens
tccaaacatgtatttatgt

SEQ ID NO: 4338093 - DNA, 22 bp, Homo sapiens
tccaaatgtgatcaactgttca

SEQ ID NO: 4338094 - DNA, 14 bp, Homo sapiens
tccaaattgtgctt

SEQ ID NO: 4338095 - DNA, 15 bp, Homo sapiens
ggagacccacagccc

SEQ ID NO: 4338096 - DNA, 19 bp, Homo sapiens
ggagactgggcacccctgc

SEQ ID NO: 4338097 - DNA, 15 bp, Homo sapiens
ggagagagggtctcc

SEQ ID NO: 4338098 - DNA, 20 bp, Homo sapiens
ggagagagtggtaaaaaaga

SEQ ID NO: 4338099 - DNA, 22 bp, Homo sapiens
ggagagagtggtaaaaaagaaa

SEQ ID NO: 4338100 - DNA, 15 bp, Homo sapiens
ggagagctagcagca

SEQ ID NO: 4338101 - DNA, 11 bp, Homo sapiens
ggagaggaaga

SEQ ID NO: 4338102 - DNA, 14 bp, Homo sapiens
ggagaggaagaaac

SEQ ID NO: 4338103 - DNA, 22 bp, Homo sapiens
ggagaggcctcggctgtctcct

SEQ ID NO: 4338104 - DNA, 23 bp, Homo sapiens
tatattgaaagttgcttttattg

SEQ ID NO: 4338105 - DNA, 18 bp, Homo sapiens
tatatttgggagtgactg

SEQ ID NO: 4338106 - DNA, 20 bp, Homo sapiens
tatcaaacagaattttaaag

SEQ ID NO: 4338107 - DNA, 23 bp, Homo sapiens
tatcaggggatgtacatctctcc

SEQ ID NO: 4338108 - DNA, 20 bp, Homo sapiens
tatcagttaaaatcacattt

SEQ ID NO: 4338109 - DNA, 22 bp, Homo sapiens
tatcagttaaaatcacatttta

SEQ ID NO: 4338110 - DNA, 18 bp, Homo sapiens
tatcataacatctgggtc

SEQ ID NO: 4338111 - DNA, 19 bp, Homo sapiens
tatccagctagtgccaaat

SEQ ID NO: 4338112 - DNA, 22 bp, Homo sapiens
tatcctgctgaaagtcctgctt

SEQ ID NO: 4338113 - DNA, 18 bp, Homo sapiens
tatcctgtaataaagctc

SEQ ID NO: 4338114 - DNA, 13 bp, Homo sapiens
tatctaatgagtt

SEQ ID NO: 4338115 - DNA, 21 bp, Homo sapiens
tatctaatgagttgctggaaa

SEQ ID NO: 4338116 - DNA, 15 bp, Homo sapiens
tatctatacctgcct

SEQ ID NO: 4338117 - DNA, 14 bp, Homo sapiens
tatctatcggaaga

SEQ ID NO: 4338118 - DNA, 13 bp, Homo sapiens
tatctcagggcct

SEQ ID NO: 4338119 - DNA, 15 bp, Homo sapiens
tatctcagggcctgg

SEQ ID NO: 4338120 - DNA, 20 bp, Homo sapiens
tatctgatatgctgagaaat

SEQ ID NO: 4338121 - DNA, 12 bp, Homo sapiens
gctctagaaagt

SEQ ID NO: 4338122 - DNA, 14 bp, Homo sapiens
gctctcctcctcca

SEQ ID NO: 4338123 - DNA, 17 bp, Homo sapiens
gctctcttttctgtact

SEQ ID NO: 4338124 - DNA, 16 bp, Homo sapiens
gctctgaaataaaaat

SEQ ID NO: 4338125 - DNA, 23 bp, Homo sapiens
gctctgcaagaattgaagcagga

SEQ ID NO: 4338126 - DNA, 14 bp, Homo sapiens
gctctgtccccctg

SEQ ID NO: 4338127 - DNA, 21 bp, Homo sapiens
gctcttttttgtttgtttctt

SEQ ID NO: 4338128 - DNA, 22 bp, Homo sapiens
gctcttttttgtttgtttcttt

SEQ ID NO: 4338129 - DNA, 16 bp, Homo sapiens
gctgaaggattatatg

SEQ ID NO: 4338130 - DNA, 22 bp, Homo sapiens
gctgactgttttctcttgagag

SEQ ID NO: 4338131 - DNA, 16 bp, Homo sapiens
gctgagctgaagaaat

SEQ ID NO: 4338132 - DNA, 14 bp, Homo sapiens
gctgagtctcccaa

SEQ ID NO: 4338133 - DNA, 17 bp, Homo sapiens
gctgagtctcccaaggc

SEQ ID NO: 4338134 - DNA, 16 bp, Homo sapiens
gctgagtgctatgtgt

SEQ ID NO: 4338135 - DNA, 18 bp, Homo sapiens
gctgcaccctcaggcagg

SEQ ID NO: 4338136 - DNA, 13 bp, Homo sapiens
gctgcccctgagt

SEQ ID NO: 4338137 - DNA, 21 bp, Homo sapiens
gctgctaagctaaagaaactg

SEQ ID NO: 4338138 - DNA, 18 bp, Homo sapiens
gctgcttggagtgcccca

SEQ ID NO: 4338139 - DNA, 14 bp, Homo sapiens
gctgctttgacaag

SEQ ID NO: 4338140 - DNA, 13 bp, Homo sapiens
gctggaaaatcat

SEQ ID NO: 4338141 - DNA, 21 bp, Homo sapiens
gctggcctgactggttgtcag

SEQ ID NO: 4338142 - DNA, 18 bp, Homo sapiens
gctggggcttggggattg

SEQ ID NO: 4338143 - DNA, 22 bp, Homo sapiens
gctgggtcattacttctgagcc

SEQ ID NO: 4338144 - DNA, 23 bp, Homo sapiens
gctgggtggcaccagcagcctgg

SEQ ID NO: 4338145 - DNA, 15 bp, Homo sapiens
gctggtggccttggg

SEQ ID NO: 4338146 - DNA, 16 bp, Homo sapiens
gctgtatttctttgta

SEQ ID NO: 4338147 - DNA, 14 bp, Homo sapiens
gctgtctcctgtcc

SEQ ID NO: 4338148 - DNA, 15 bp, Homo sapiens
gctgtgtagttccct

SEQ ID NO: 4338149 - DNA, 20 bp, Homo sapiens
gctgtgtagttccctctgcc

SEQ ID NO: 4338150 - DNA, 21 bp, Homo sapiens
gctgttaaccacccgccccgc

SEQ ID NO: 4338151 - DNA, 13 bp, Homo sapiens
gctgttactgctt

SEQ ID NO: 4338152 - DNA, 22 bp, Homo sapiens
gctgttactgcttctctttgtg

SEQ ID NO: 4338153 - DNA, 14 bp, Homo sapiens
gctgttcagctggt

SEQ ID NO: 4338154 - DNA, 13 bp, Homo sapiens
gctgttctgtgta

SEQ ID NO: 4338155 - DNA, 22 bp, Homo sapiens
gctgttgatcccctctctgtgg

SEQ ID NO: 4338156 - DNA, 14 bp, Homo sapiens
gctgttgtttctat

SEQ ID NO: 4338157 - DNA, 13 bp, Homo sapiens
gcttactgaaaga

SEQ ID NO: 4338158 - DNA, 16 bp, Homo sapiens
gcttagtaaaatttat

SEQ ID NO: 4338159 - DNA, 15 bp, Homo sapiens
gcttagtgaaaatac

SEQ ID NO: 4338160 - DNA, 13 bp, Homo sapiens
gcttatctcaggg

SEQ ID NO: 4338161 - DNA, 19 bp, Homo sapiens
gcttatctcaggggtgtgc

SEQ ID NO: 4338162 - DNA, 19 bp, Homo sapiens
gcttcaaggatatactgca

SEQ ID NO: 4338163 - DNA, 18 bp, Homo sapiens
gcttcacggaagagcctt

SEQ ID NO: 4338164 - DNA, 19 bp, Homo sapiens
gcttcacggaagagccttg

SEQ ID NO: 4338165 - DNA, 20 bp, Homo sapiens
gcttcacggaagagccttgc

SEQ ID NO: 4338166 - DNA, 24 bp, Homo sapiens
gcttcctgtctgtttatatattga

SEQ ID NO: 4338167 - DNA, 15 bp, Homo sapiens
gcttccttggttcat

SEQ ID NO: 4338168 - DNA, 22 bp, Homo sapiens
gcttctcactgccatgccagct

SEQ ID NO: 4338169 - DNA, 18 bp, Homo sapiens
gcttctcatcttgtgaaa

SEQ ID NO: 4338170 - DNA, 17 bp, Homo sapiens
gcttctccagcctggac

SEQ ID NO: 4338171 - DNA, 15 bp, Homo sapiens
gcttctccccagaat

SEQ ID NO: 4338172 - DNA, 15 bp, Homo sapiens
gcttctgcagcaact

SEQ ID NO: 4338173 - DNA, 17 bp, Homo sapiens
gcttctgcagcaactcc

SEQ ID NO: 4338174 - DNA, 19 bp, Homo sapiens
gcttctgcagcaactccca

SEQ ID NO: 4338175 - DNA, 20 bp, Homo sapiens
gcttctgcagcaactcccac

SEQ ID NO: 4338176 - DNA, 14 bp, Homo sapiens
gcttgagctcagga

SEQ ID NO: 4338177 - DNA, 16 bp, Homo sapiens
gcttgagctttctgtg

SEQ ID NO: 4338178 - DNA, 22 bp, Homo sapiens
gcttgagctttctgtgcatgtg

SEQ ID NO: 4338179 - DNA, 14 bp, Homo sapiens
gcttgcttctgcag

SEQ ID NO: 4338180 - DNA, 15 bp, Homo sapiens
gcttgcttctgcagc

SEQ ID NO: 4338181 - DNA, 16 bp, Homo sapiens
gcttgcttctgcagca

SEQ ID NO: 4338182 - DNA, 17 bp, Homo sapiens
gcttggagtgccccaag

SEQ ID NO: 4338183 - DNA, 22 bp, Homo sapiens
gcttggagtgccccaaggaggt

SEQ ID NO: 4338184 - DNA, 17 bp, Homo sapiens
gcttgggaggggccgga

SEQ ID NO: 4338185 - DNA, 19 bp, Homo sapiens
gcttgggaggggccggagg

SEQ ID NO: 4338186 - DNA, 17 bp, Homo sapiens
gcttggggattgccact

SEQ ID NO: 4338187 - DNA, 21 bp, Homo sapiens
gcttgggtcctactcctggag

SEQ ID NO: 4338188 - DNA, 15 bp, Homo sapiens
gcttgtgaatgttta

SEQ ID NO: 4338189 - DNA, 16 bp, Homo sapiens
gcttgtgctgagcctg

SEQ ID NO: 4338190 - DNA, 17 bp, Homo sapiens
gcttgtgctgagcctgc

SEQ ID NO: 4338191 - DNA, 23 bp, Homo sapiens
gcttgtggaggagggagagccct

SEQ ID NO: 4338192 - DNA, 20 bp, Homo sapiens
gctttaaaagtcattattcc

SEQ ID NO: 4338193 - DNA, 21 bp, Homo sapiens
gctttaaaagtcattattcct

SEQ ID NO: 4338194 - DNA, 15 bp, Homo sapiens
gctttatctttgtgt

SEQ ID NO: 4338195 - DNA, 17 bp, Homo sapiens
gctttatctttgtgtaa

SEQ ID NO: 4338196 - DNA, 22 bp, Homo sapiens
gctttcccctcctccctgggat

SEQ ID NO: 4338197 - DNA, 18 bp, Homo sapiens
gctttcctatctagcatt

SEQ ID NO: 4338198 - DNA, 13 bp, Homo sapiens
gctttctgtgcat

SEQ ID NO: 4338199 - DNA, 17 bp, Homo sapiens
gctttctgtgcatgtgc

SEQ ID NO: 4338200 - DNA, 19 bp, Homo sapiens
gctttctgtgcatgtgcag

SEQ ID NO: 4338201 - DNA, 17 bp, Homo sapiens
gctttctttgattctcc

SEQ ID NO: 4338202 - DNA, 19 bp, Homo sapiens
gctttgagaccagaagaaa

SEQ ID NO: 4338203 - DNA, 20 bp, Homo sapiens
gctttgagaccagaagaaaa

SEQ ID NO: 4338204 - DNA, 14 bp, Homo sapiens
gcttttacttaaac

SEQ ID NO: 4338205 - DNA, 21 bp, Homo sapiens
gcttttattgcaccattttca

SEQ ID NO: 4338206 - DNA, 22 bp, Homo sapiens
gcttttattgcaccattttcaa

SEQ ID NO: 4338207 - DNA, 13 bp, Homo sapiens
gcttttctcctct

SEQ ID NO: 4338208 - DNA, 21 bp, Homo sapiens
ggaaaaacagaggatgctgaa

SEQ ID NO: 4338209 - DNA, 23 bp, Homo sapiens
ggaaaaacagaggatgctgaagt

SEQ ID NO: 4338210 - DNA, 15 bp, Homo sapiens
ggaaaaatagcctgc

SEQ ID NO: 4338211 - DNA, 16 bp, Homo sapiens
ggaaaaccagtgggtc

SEQ ID NO: 4338212 - DNA, 17 bp, Homo sapiens
ggaaacagacagggaga

SEQ ID NO: 4338213 - DNA, 17 bp, Homo sapiens
ggaaacatagaaagaca

SEQ ID NO: 4338214 - DNA, 15 bp, Homo sapiens
ggaaactcaaggagg

SEQ ID NO: 4338215 - DNA, 14 bp, Homo sapiens
ggaaatgaaattgt

SEQ ID NO: 4338216 - DNA, 14 bp, Homo sapiens
ggaaatgttaagaa

SEQ ID NO: 4338217 - DNA, 22 bp, Homo sapiens
ggaaattaagaactgaatccat

SEQ ID NO: 4338218 - DNA, 14 bp, Homo sapiens
ggaacagcctgagc

SEQ ID NO: 4338219 - DNA, 19 bp, Homo sapiens
ggaaccaaagctggcccag

SEQ ID NO: 4338220 - DNA, 14 bp, Homo sapiens
ggaagacaatgtga

SEQ ID NO: 4338221 - DNA, 22 bp, Homo sapiens
ggaagacaatgtgaaaagaaaa

SEQ ID NO: 4338222 - DNA, 15 bp, Homo sapiens
ggaagagaaaaaata

SEQ ID NO: 4338223 - DNA, 13 bp, Homo sapiens
ggaagagccttgc

SEQ ID NO: 4338224 - DNA, 21 bp, Homo sapiens
ggaagggccaatggagaaaat

SEQ ID NO: 4338225 - DNA, 17 bp, Homo sapiens
ggaagggcgggcaagga

SEQ ID NO: 4338226 - DNA, 18 bp, Homo sapiens
ggaagtagtccttggcat

SEQ ID NO: 4338227 - DNA, 22 bp, Homo sapiens
ggaagtgaatccttaaccctaa

SEQ ID NO: 4338228 - DNA, 21 bp, Homo sapiens
ggaatcctacgctatgtagaa

SEQ ID NO: 4338229 - DNA, 16 bp, Homo sapiens
ggaattgtttatacac

SEQ ID NO: 4338230 - DNA, 14 bp, Homo sapiens
ggacactaggagac

SEQ ID NO: 4338231 - DNA, 15 bp, Homo sapiens
ggacactaggagact

SEQ ID NO: 4338232 - DNA, 22 bp, Homo sapiens
ggacactcaaaagctgggcagg

SEQ ID NO: 4338233 - DNA, 14 bp, Homo sapiens
ggacagacactgtt

SEQ ID NO: 4338234 - DNA, 14 bp, Homo sapiens
ggactctgaactgg

SEQ ID NO: 4338235 - DNA, 11 bp, Homo sapiens
ggactctgtgt

SEQ ID NO: 4338236 - DNA, 14 bp, Homo sapiens
ggactggtttgaga

SEQ ID NO: 4338237 - DNA, 14 bp, Homo sapiens
ggactgtatttctg

SEQ ID NO: 4338238 - DNA, 12 bp, Homo sapiens
ggagaaaatgaa

SEQ ID NO: 4338239 - DNA, 19 bp, Homo sapiens
ggagaagagttgaggaact

SEQ ID NO: 4338240 - DNA, 17 bp, Homo sapiens
ggagaagcggctggcag

SEQ ID NO: 4338241 - DNA, 14 bp, Homo sapiens
ggagacagagatgt

SEQ ID NO: 4338242 - DNA, 14 bp, Homo sapiens
gatgatcctaggca

SEQ ID NO: 4338243 - DNA, 18 bp, Homo sapiens
gatgcaaagtacaatgtg

SEQ ID NO: 4338244 - DNA, 23 bp, Homo sapiens
gatgcccgcacagtaatgtagaa

SEQ ID NO: 4338245 - DNA, 19 bp, Homo sapiens
gatgccgaacattaggaat

SEQ ID NO: 4338246 - DNA, 20 bp, Homo sapiens
gatgccgaacattaggaatt

SEQ ID NO: 4338247 - DNA, 10 bp, Homo sapiens
gatgctgaag

SEQ ID NO: 4338248 - DNA, 23 bp, Homo sapiens
gatgcttctcactgccatgccag

SEQ ID NO: 4338249 - DNA, 18 bp, Homo sapiens
gatggaaaaatcacccag

SEQ ID NO: 4338250 - DNA, 15 bp, Homo sapiens
gatggagacacgggg

SEQ ID NO: 4338251 - DNA, 14 bp, Homo sapiens
gatggagaggaaga

SEQ ID NO: 4338252 - DNA, 20 bp, Homo sapiens
gatggagcccagttggaaaa

SEQ ID NO: 4338253 - DNA, 17 bp, Homo sapiens
gatgggaaataaagaaa

SEQ ID NO: 4338254 - DNA, 19 bp, Homo sapiens
gatgggaaataaagaaaat

SEQ ID NO: 4338255 - DNA, 21 bp, Homo sapiens
gatgggagagctagaaagttg

SEQ ID NO: 4338256 - DNA, 15 bp, Homo sapiens
gatggtttggaaaat

SEQ ID NO: 4338257 - DNA, 16 bp, Homo sapiens
gatggtttggaaaata

SEQ ID NO: 4338258 - DNA, 17 bp, Homo sapiens
gatggtttggaaaataa

SEQ ID NO: 4338259 - DNA, 22 bp, Homo sapiens
gatgtaacagtgcaagattttt

SEQ ID NO: 4338260 - DNA, 12 bp, Homo sapiens
gatgtattcttt

SEQ ID NO: 4338261 - DNA, 17 bp, Homo sapiens
gatgttcaatagaacat

SEQ ID NO: 4338262 - DNA, 18 bp, Homo sapiens
gattaaccacttcagctg

SEQ ID NO: 4338263 - DNA, 21 bp, Homo sapiens
gattaaccacttcagctgact

SEQ ID NO: 4338264 - DNA, 16 bp, Homo sapiens
gattaccagtctgatt

SEQ ID NO: 4338265 - DNA, 20 bp, Homo sapiens
gattacccaaatataaccat

SEQ ID NO: 4338266 - DNA, 16 bp, Homo sapiens
gattagggaaaatgga

SEQ ID NO: 4338267 - DNA, 20 bp, Homo sapiens
gattatagctcccaaaagaa

SEQ ID NO: 4338268 - DNA, 18 bp, Homo sapiens
gattatcagtagaaagag

SEQ ID NO: 4338269 - DNA, 21 bp, Homo sapiens
gattatttgggagggaaaagg

SEQ ID NO: 4338270 - DNA, 13 bp, Homo sapiens
gattcacagacca

SEQ ID NO: 4338271 - DNA, 20 bp, Homo sapiens
gattcattctcataattcct

SEQ ID NO: 4338272 - DNA, 13 bp, Homo sapiens
gattgaaagaaaa

SEQ ID NO: 4338273 - DNA, 22 bp, Homo sapiens
gattgaaagaaaaaaaaatact

SEQ ID NO: 4338274 - DNA, 22 bp, Homo sapiens
gattgcaaatattggttagtat

SEQ ID NO: 4338275 - DNA, 16 bp, Homo sapiens
gattgcaccactgcac

SEQ ID NO: 4338276 - DNA, 23 bp, Homo sapiens
gattgcaccactgcactccagcc

SEQ ID NO: 4338277 - DNA, 21 bp, Homo sapiens
gattgctcagagaaatatgca

SEQ ID NO: 4338278 - DNA, 15 bp, Homo sapiens
gattggatttgctgt

SEQ ID NO: 4338279 - DNA, 18 bp, Homo sapiens
gattggttaaaatgtgat

SEQ ID NO: 4338280 - DNA, 14 bp, Homo sapiens
gatttcagtagaat

SEQ ID NO: 4338281 - DNA, 13 bp, Homo sapiens
gatttgaaaaact

SEQ ID NO: 4338282 - DNA, 21 bp, Homo sapiens
gatttgaaaacaaacttctcg

SEQ ID NO: 4338283 - DNA, 13 bp, Homo sapiens
gatttgatctttg

SEQ ID NO: 4338284 - DNA, 20 bp, Homo sapiens
gatttggcatgggacagacg

SEQ ID NO: 4338285 - DNA, 12 bp, Homo sapiens
gattttattaca

SEQ ID NO: 4338286 - DNA, 22 bp, Homo sapiens
gattttattacagaaatgtttt

SEQ ID NO: 4338287 - DNA, 17 bp, Homo sapiens
gattttatttaaactat

SEQ ID NO: 4338288 - DNA, 17 bp, Homo sapiens
gattttgaggtaaagat

SEQ ID NO: 4338289 - DNA, 22 bp, Homo sapiens
gatttttcttcaggtaacacta

SEQ ID NO: 4338290 - DNA, 17 bp, Homo sapiens
gattttttttttaagtg

SEQ ID NO: 4338291 - DNA, 21 bp, Homo sapiens
gattttttttttaagtgacat

SEQ ID NO: 4338292 - DNA, 13 bp, Homo sapiens
gcaaaatagaaga

SEQ ID NO: 4338293 - DNA, 15 bp, Homo sapiens
gcaaaatagaagaag

SEQ ID NO: 4338294 - DNA, 17 bp, Homo sapiens
gcaaacccatgaagctg

SEQ ID NO: 4338295 - DNA, 17 bp, Homo sapiens
gcaaactctataaagaa

SEQ ID NO: 4338296 - DNA, 19 bp, Homo sapiens
gcaaactctataaagaaac

SEQ ID NO: 4338297 - DNA, 14 bp, Homo sapiens
gcaaagatttcagt

SEQ ID NO: 4338298 - DNA, 12 bp, Homo sapiens
gcaaagtacaat

SEQ ID NO: 4338299 - DNA, 14 bp, Homo sapiens
gcaaataaagcctt

SEQ ID NO: 4338300 - DNA, 16 bp, Homo sapiens
gcaaattatttattac

SEQ ID NO: 4338301 - DNA, 17 bp, Homo sapiens
gcaaattatttattact

SEQ ID NO: 4338302 - DNA, 21 bp, Homo sapiens
gcaaatttcattatctaatga

SEQ ID NO: 4338303 - DNA, 12 bp, Homo sapiens
gcaacagcagag

SEQ ID NO: 4338304 - DNA, 17 bp, Homo sapiens
gcaactcccacgactgt

SEQ ID NO: 4338305 - DNA, 21 bp, Homo sapiens
gcaagaagatcacgctccccg

SEQ ID NO: 4338306 - DNA, 22 bp, Homo sapiens
gcaagaatttctggaagaaagg

SEQ ID NO: 4338307 - DNA, 17 bp, Homo sapiens
gcacaagaagcgtgaga

SEQ ID NO: 4338308 - DNA, 15 bp, Homo sapiens
gcacaaggattgaaa

SEQ ID NO: 4338309 - DNA, 18 bp, Homo sapiens
gcacaaggattgaaaatt

SEQ ID NO: 4338310 - DNA, 14 bp, Homo sapiens
gcacactaagaaat

SEQ ID NO: 4338311 - DNA, 17 bp, Homo sapiens
gcacagatatactttgt

SEQ ID NO: 4338312 - DNA, 20 bp, Homo sapiens
gcacagatgtgaaggacatg

SEQ ID NO: 4338313 - DNA, 14 bp, Homo sapiens
gcacagctctcctc

SEQ ID NO: 4338314 - DNA, 20 bp, Homo sapiens
gcacagctctcctcctccat

SEQ ID NO: 4338315 - DNA, 19 bp, Homo sapiens
gcacatgctgagtctccca

SEQ ID NO: 4338316 - DNA, 20 bp, Homo sapiens
gcaccactgcactccagcct

SEQ ID NO: 4338317 - DNA, 22 bp, Homo sapiens
gcaccactgcactccagcctgg

SEQ ID NO: 4338318 - DNA, 13 bp, Homo sapiens
gcaccagcagcct

SEQ ID NO: 4338319 - DNA, 13 bp, Homo sapiens
gcaccagggagag

SEQ ID NO: 4338320 - DNA, 12 bp, Homo sapiens
gcacccctgcct

SEQ ID NO: 4338321 - DNA, 17 bp, Homo sapiens
gcacccctgcctcctgc

SEQ ID NO: 4338322 - DNA, 18 bp, Homo sapiens
gcacccctgcctcctgcc

SEQ ID NO: 4338323 - DNA, 16 bp, Homo sapiens
gcaccctcaggcaggt

SEQ ID NO: 4338324 - DNA, 14 bp, Homo sapiens
gcacctattgaatt

SEQ ID NO: 4338325 - DNA, 14 bp, Homo sapiens
gcacctgagcctgt

SEQ ID NO: 4338326 - DNA, 16 bp, Homo sapiens
gcacgtggccaggagc

SEQ ID NO: 4338327 - DNA, 18 bp, Homo sapiens
gcacgtggccaggagcca

SEQ ID NO: 4338328 - DNA, 14 bp, Homo sapiens
gcactactgggtgt

SEQ ID NO: 4338329 - DNA, 17 bp, Homo sapiens
gcactactgggtgtcat

SEQ ID NO: 4338330 - DNA, 18 bp, Homo sapiens
gcactagagaatgcacag

SEQ ID NO: 4338331 - DNA, 12 bp, Homo sapiens
gcactaggaatt

SEQ ID NO: 4338332 - DNA, 14 bp, Homo sapiens
gcactaggaattct

SEQ ID NO: 4338333 - DNA, 14 bp, Homo sapiens
gcacttacctgctt

SEQ ID NO: 4338334 - DNA, 14 bp, Homo sapiens
gcacttattgtaaa

SEQ ID NO: 4338335 - DNA, 12 bp, Homo sapiens
gcacttttattt

SEQ ID NO: 4338336 - DNA, 17 bp, Homo sapiens
gcagaaagatttggaaa

SEQ ID NO: 4338337 - DNA, 18 bp, Homo sapiens
gcagaaatagttgtctgt

SEQ ID NO: 4338338 - DNA, 14 bp, Homo sapiens
gcagatgtttaatg

SEQ ID NO: 4338339 - DNA, 17 bp, Homo sapiens
gcagatgtttaatgaag

SEQ ID NO: 4338340 - DNA, 11 bp, Homo sapiens
gcagcaactcc

SEQ ID NO: 4338341 - DNA, 19 bp, Homo sapiens
gcagcagggagggcttctg

SEQ ID NO: 4338342 - DNA, 20 bp, Homo sapiens
gcagcagggagggcttctgc

SEQ ID NO: 4338343 - DNA, 18 bp, Homo sapiens
gcagccacaccgctggct

SEQ ID NO: 4338344 - DNA, 19 bp, Homo sapiens
gcagccacaccgctggctc

SEQ ID NO: 4338345 - DNA, 20 bp, Homo sapiens
gcagccacaccgctggctcc

SEQ ID NO: 4338346 - DNA, 18 bp, Homo sapiens
gcagcccacccctcaaca

SEQ ID NO: 4338347 - DNA, 11 bp, Homo sapiens
gcagctaccac

SEQ ID NO: 4338348 - DNA, 13 bp, Homo sapiens
gcagctctgagcc

SEQ ID NO: 4338349 - DNA, 19 bp, Homo sapiens
gcagcttgtgctgagcctg

SEQ ID NO: 4338350 - DNA, 15 bp, Homo sapiens
gcaggaggtgcctga

SEQ ID NO: 4338351 - DNA, 20 bp, Homo sapiens
gcaggaggttctgggcctct

SEQ ID NO: 4338352 - DNA, 21 bp, Homo sapiens
gcaggaggttctgggcctctg

SEQ ID NO: 4338353 - DNA, 22 bp, Homo sapiens
gcaggaggttctgggcctctga

SEQ ID NO: 4338354 - DNA, 21 bp, Homo sapiens
gcaggatcaaagacacacagg

SEQ ID NO: 4338355 - DNA, 14 bp, Homo sapiens
gcaggatgccctgt

SEQ ID NO: 4338356 - DNA, 17 bp, Homo sapiens
gcaggctactctgccca

SEQ ID NO: 4338357 - DNA, 18 bp, Homo sapiens
gcagggcctggcggaggt

SEQ ID NO: 4338358 - DNA, 19 bp, Homo sapiens
gcaggtccggggaggaggt

SEQ ID NO: 4338359 - DNA, 18 bp, Homo sapiens
gcagtgagagttcctctt

SEQ ID NO: 4338360 - DNA, 14 bp, Homo sapiens
gcagtgagtgccat

SEQ ID NO: 4338361 - DNA, 14 bp, Homo sapiens
gaataaatgttcaa

SEQ ID NO: 4338362 - DNA, 21 bp, Homo sapiens
gaataataaatcgatccatgt

SEQ ID NO: 4338363 - DNA, 17 bp, Homo sapiens
gaataatacagtatctc

SEQ ID NO: 4338364 - DNA, 20 bp, Homo sapiens
gaatacacatataaaaacaa

SEQ ID NO: 4338365 - DNA, 18 bp, Homo sapiens
gaatatactgtcttgtct

SEQ ID NO: 4338366 - DNA, 13 bp, Homo sapiens
gaatatattactg

SEQ ID NO: 4338367 - DNA, 18 bp, Homo sapiens
gaatatattactgattta

SEQ ID NO: 4338368 - DNA, 23 bp, Homo sapiens
gaatcctacgctatgtagaatgt

SEQ ID NO: 4338369 - DNA, 21 bp, Homo sapiens
gaatctgccgctttgtctgtc

SEQ ID NO: 4338370 - DNA, 13 bp, Homo sapiens
gaatctgtgcagt

SEQ ID NO: 4338371 - DNA, 23 bp, Homo sapiens
gaatctgtgcagtcatcaacaaa

SEQ ID NO: 4338372 - DNA, 15 bp, Homo sapiens
gaatgatcatctgta

SEQ ID NO: 4338373 - DNA, 16 bp, Homo sapiens
gaatgatcatctgtaa

SEQ ID NO: 4338374 - DNA, 21 bp, Homo sapiens
gaatgatccctcagtctgaga

SEQ ID NO: 4338375 - DNA, 19 bp, Homo sapiens
gaatgattggttaaaatgt

SEQ ID NO: 4338376 - DNA, 23 bp, Homo sapiens
gaatgattggttaaaatgtgatt

SEQ ID NO: 4338377 - DNA, 20 bp, Homo sapiens
gaatgctgagctgaagaaat

SEQ ID NO: 4338378 - DNA, 19 bp, Homo sapiens
gaattaaaaggatagtatt

SEQ ID NO: 4338379 - DNA, 21 bp, Homo sapiens
gaattaaaaggatagtatttt

SEQ ID NO: 4338380 - DNA, 13 bp, Homo sapiens
gaattagaagaaa

SEQ ID NO: 4338381 - DNA, 22 bp, Homo sapiens
gaattatccattacgtgcattt

SEQ ID NO: 4338382 - DNA, 15 bp, Homo sapiens
gaattctttgcattc

SEQ ID NO: 4338383 - DNA, 21 bp, Homo sapiens
gaattctttgcattccttact

SEQ ID NO: 4338384 - DNA, 13 bp, Homo sapiens
gaattgactgatt

SEQ ID NO: 4338385 - DNA, 15 bp, Homo sapiens
gaattgagaaaagag

SEQ ID NO: 4338386 - DNA, 16 bp, Homo sapiens
gaattgagaaaagagt

SEQ ID NO: 4338387 - DNA, 19 bp, Homo sapiens
gaattgagaataagaattt

SEQ ID NO: 4338388 - DNA, 17 bp, Homo sapiens
gaattgtagttcttagt

SEQ ID NO: 4338389 - DNA, 17 bp, Homo sapiens
gaatttccattgacatt

SEQ ID NO: 4338390 - DNA, 18 bp, Homo sapiens
gacaaagaaaatgagaat

SEQ ID NO: 4338391 - DNA, 14 bp, Homo sapiens
gacaagctaggaaa

SEQ ID NO: 4338392 - DNA, 19 bp, Homo sapiens
gacaagctaggaaagagga

SEQ ID NO: 4338393 - DNA, 16 bp, Homo sapiens
gacacagcttgtgaat

SEQ ID NO: 4338394 - DNA, 20 bp, Homo sapiens
gacaccaccgaatatattac

SEQ ID NO: 4338395 - DNA, 22 bp, Homo sapiens
gacaccaccgaatatattactg

SEQ ID NO: 4338396 - DNA, 23 bp, Homo sapiens
gacactaattccttaaatgaact

SEQ ID NO: 4338397 - DNA, 15 bp, Homo sapiens
gacactaggagactg

SEQ ID NO: 4338398 - DNA, 17 bp, Homo sapiens
gacactaggagactggt

SEQ ID NO: 4338399 - DNA, 19 bp, Homo sapiens
gacagacggaaatgaaatt

SEQ ID NO: 4338400 - DNA, 21 bp, Homo sapiens
gacagacggaaatgaaattgt

SEQ ID NO: 4338401 - DNA, 12 bp, Homo sapiens
gacagagcccgg

SEQ ID NO: 4338402 - DNA, 16 bp, Homo sapiens
gacagagcccgggaga

SEQ ID NO: 4338403 - DNA, 23 bp, Homo sapiens
gacagatttgaggactgaagctg

SEQ ID NO: 4338404 - DNA, 14 bp, Homo sapiens
gacagcacagatgt

SEQ ID NO: 4338405 - DNA, 15 bp, Homo sapiens
gacataattgtccag

SEQ ID NO: 4338406 - DNA, 14 bp, Homo sapiens
gacatcagatttct

SEQ ID NO: 4338407 - DNA, 14 bp, Homo sapiens
gacatcctagcccc

SEQ ID NO: 4338408 - DNA, 18 bp, Homo sapiens
gacatcctagccccaccc

SEQ ID NO: 4338409 - DNA, 20 bp, Homo sapiens
gacatcctagccccacccag

SEQ ID NO: 4338410 - DNA, 16 bp, Homo sapiens
gacatctgcctgtaat

SEQ ID NO: 4338411 - DNA, 12 bp, Homo sapiens
gacatttgaatt

SEQ ID NO: 4338412 - DNA, 18 bp, Homo sapiens
gacattttcttttattat

SEQ ID NO: 4338413 - DNA, 18 bp, Homo sapiens
gaccaagtccaagcccgt

SEQ ID NO: 4338414 - DNA, 16 bp, Homo sapiens
gaccaattattgatat

SEQ ID NO: 4338415 - DNA, 18 bp, Homo sapiens
gaccaattattgatatat

SEQ ID NO: 4338416 - DNA, 13 bp, Homo sapiens
gaccaggagggag

SEQ ID NO: 4338417 - DNA, 21 bp, Homo sapiens
gaccaggagggagagcctctg

SEQ ID NO: 4338418 - DNA, 22 bp, Homo sapiens
gaccaggagggagagcctctgt

SEQ ID NO: 4338419 - DNA, 14 bp, Homo sapiens
gacccaacttgcca

SEQ ID NO: 4338420 - DNA, 14 bp, Homo sapiens
gacccacagccctg

SEQ ID NO: 4338421 - DNA, 16 bp, Homo sapiens
gacccacagccctgaa

SEQ ID NO: 4338422 - DNA, 13 bp, Homo sapiens
gacccctttcccc

SEQ ID NO: 4338423 - DNA, 14 bp, Homo sapiens
gacccctttccccc

SEQ ID NO: 4338424 - DNA, 16 bp, Homo sapiens
gacccctttcccccac

SEQ ID NO: 4338425 - DNA, 17 bp, Homo sapiens
gacccctttcccccacc

SEQ ID NO: 4338426 - DNA, 12 bp, Homo sapiens
gaccctgtctca

SEQ ID NO: 4338427 - DNA, 15 bp, Homo sapiens
gaccttctccctagc

SEQ ID NO: 4338428 - DNA, 19 bp, Homo sapiens
gaccttctccctagccctt

SEQ ID NO: 4338429 - DNA, 14 bp, Homo sapiens
gacgccaccattcc

SEQ ID NO: 4338430 - DNA, 14 bp, Homo sapiens
gacgctgccgggag

SEQ ID NO: 4338431 - DNA, 14 bp, Homo sapiens
gacggaaatgaaat

SEQ ID NO: 4338432 - DNA, 16 bp, Homo sapiens
gactattttttaataa

SEQ ID NO: 4338433 - DNA, 17 bp, Homo sapiens
gactattttttaataaa

SEQ ID NO: 4338434 - DNA, 14 bp, Homo sapiens
gactcagtgtattt

SEQ ID NO: 4338435 - DNA, 18 bp, Homo sapiens
gactcagtgtattttaaa

SEQ ID NO: 4338436 - DNA, 20 bp, Homo sapiens
gactcattccctagatcttt

SEQ ID NO: 4338437 - DNA, 12 bp, Homo sapiens
gactcccttgct

SEQ ID NO: 4338438 - DNA, 20 bp, Homo sapiens
gactcctcttcccagagtca

SEQ ID NO: 4338439 - DNA, 17 bp, Homo sapiens
gactctcagcccagaag

SEQ ID NO: 4338440 - DNA, 19 bp, Homo sapiens
gactctcagcccagaagaa

SEQ ID NO: 4338441 - DNA, 13 bp, Homo sapiens
gactgaagctggg

SEQ ID NO: 4338442 - DNA, 16 bp, Homo sapiens
gactgaagctggggct

SEQ ID NO: 4338443 - DNA, 17 bp, Homo sapiens
gactgatggtttggaaa

SEQ ID NO: 4338444 - DNA, 18 bp, Homo sapiens
gactgatggtttggaaaa

SEQ ID NO: 4338445 - DNA, 19 bp, Homo sapiens
gactgatggtttggaaaat

SEQ ID NO: 4338446 - DNA, 19 bp, Homo sapiens
gactgcaagcatttttcca

SEQ ID NO: 4338447 - DNA, 20 bp, Homo sapiens
gactggaggaacacagagaa

SEQ ID NO: 4338448 - DNA, 16 bp, Homo sapiens
gactgggcacccctgc

SEQ ID NO: 4338449 - DNA, 21 bp, Homo sapiens
gactgggcacccctgcctcct

SEQ ID NO: 4338450 - DNA, 13 bp, Homo sapiens
gactgtaactttt

SEQ ID NO: 4338451 - DNA, 15 bp, Homo sapiens
gactgtatttctgtg

SEQ ID NO: 4338452 - DNA, 16 bp, Homo sapiens
gactgtatttctgtgg

SEQ ID NO: 4338453 - DNA, 17 bp, Homo sapiens
atacagaggcaactgca

SEQ ID NO: 4338454 - DNA, 18 bp, Homo sapiens
atacagctattaaaatgt

SEQ ID NO: 4338455 - DNA, 15 bp, Homo sapiens
atacagtcaggacac

SEQ ID NO: 4338456 - DNA, 14 bp, Homo sapiens
atacatacatacaa

SEQ ID NO: 4338457 - DNA, 23 bp, Homo sapiens
atacattcttaaactagttgtct

SEQ ID NO: 4338458 - DNA, 21 bp, Homo sapiens
ataccactttgacacgcttca

SEQ ID NO: 4338459 - DNA, 15 bp, Homo sapiens
ataccccagaaatta

SEQ ID NO: 4338460 - DNA, 12 bp, Homo sapiens
ataccttctccc

SEQ ID NO: 4338461 - DNA, 18 bp, Homo sapiens
ataccttctcccaggcct

SEQ ID NO: 4338462 - DNA, 22 bp, Homo sapiens
ataccttctcccaggcctctgc

SEQ ID NO: 4338463 - DNA, 24 bp, Homo sapiens
atactttgtggaccaattattgat

SEQ ID NO: 4338464 - DNA, 15 bp, Homo sapiens
ctcctccctgggatg

SEQ ID NO: 4338465 - DNA, 24 bp, Homo sapiens
ctcctctccccaatccatgcttca

SEQ ID NO: 4338466 - DNA, 15 bp, Homo sapiens
ctcctcttcccagag

SEQ ID NO: 4338467 - DNA, 17 bp, Homo sapiens
ctcctcttcccagagtc

SEQ ID NO: 4338468 - DNA, 17 bp, Homo sapiens
ctcctctttcctctctt

SEQ ID NO: 4338469 - DNA, 22 bp, Homo sapiens
ctcctctttcctctctttgttc

SEQ ID NO: 4338470 - DNA, 17 bp, Homo sapiens
ctcctgatgtttttccc

SEQ ID NO: 4338471 - DNA, 11 bp, Homo sapiens
ctcctgcccag

SEQ ID NO: 4338472 - DNA, 20 bp, Homo sapiens
ctcctggaaacagacaggga

SEQ ID NO: 4338473 - DNA, 14 bp, Homo sapiens
ctcctggcccttct

SEQ ID NO: 4338474 - DNA, 17 bp, Homo sapiens
ctcctgtgcctcccttt

SEQ ID NO: 4338475 - DNA, 14 bp, Homo sapiens
ctcgatccaaattg

SEQ ID NO: 4338476 - DNA, 15 bp, Homo sapiens
ctcgatccaaattgt

SEQ ID NO: 4338477 - DNA, 15 bp, Homo sapiens
ctcgatgactgtgaa

SEQ ID NO: 4338478 - DNA, 12 bp, Homo sapiens
ctcggaggcccc

SEQ ID NO: 4338479 - DNA, 13 bp, Homo sapiens
ctcggaggcccca

SEQ ID NO: 4338480 - DNA, 12 bp, Homo sapiens
ctcggctgtctc

SEQ ID NO: 4338481 - DNA, 13 bp, Homo sapiens
ctcggctgtctcc

SEQ ID NO: 4338482 - DNA, 11 bp, Homo sapiens
ctcggtgcctt

SEQ ID NO: 4338483 - DNA, 17 bp, Homo sapiens
ctcgtttctgcccagcc

SEQ ID NO: 4338484 - DNA, 17 bp, Homo sapiens
ctctaaaatggacattt

SEQ ID NO: 4338485 - DNA, 14 bp, Homo sapiens
ctctaagaaaagag

SEQ ID NO: 4338486 - DNA, 20 bp, Homo sapiens
ctctaccatcccctgtagag

SEQ ID NO: 4338487 - DNA, 23 bp, Homo sapiens
ctctagaaagtatagatggccaa

SEQ ID NO: 4338488 - DNA, 17 bp, Homo sapiens
ctctataaagaaacttt

SEQ ID NO: 4338489 - DNA, 17 bp, Homo sapiens
ctctataagtgttcagt

SEQ ID NO: 4338490 - DNA, 21 bp, Homo sapiens
ctctataagtgttcagtgttg

SEQ ID NO: 4338491 - DNA, 19 bp, Homo sapiens
ctctatgtacgataaagta

SEQ ID NO: 4338492 - DNA, 16 bp, Homo sapiens
ctctcaagacttctcc

SEQ ID NO: 4338493 - DNA, 15 bp, Homo sapiens
ctctcagcccagaag

SEQ ID NO: 4338494 - DNA, 18 bp, Homo sapiens
ctctcagcccagaagaaa

SEQ ID NO: 4338495 - DNA, 22 bp, Homo sapiens
ctctcatcacagtgggaagaat

SEQ ID NO: 4338496 - DNA, 13 bp, Homo sapiens
ctctcccacccaa

SEQ ID NO: 4338497 - DNA, 19 bp, Homo sapiens
ctctccccaatccatgctt

SEQ ID NO: 4338498 - DNA, 20 bp, Homo sapiens
ctctccctcccccagagccc

SEQ ID NO: 4338499 - DNA, 13 bp, Homo sapiens
ctctcctttgaaa

SEQ ID NO: 4338500 - DNA, 21 bp, Homo sapiens
ctctcctttgaaacctgctct

SEQ ID NO: 4338501 - DNA, 18 bp, Homo sapiens
ctctctataagtgttcag

SEQ ID NO: 4338502 - DNA, 21 bp, Homo sapiens
ctctctataagtgttcagtgt

SEQ ID NO: 4338503 - DNA, 22 bp, Homo sapiens
ctctctataagtgttcagtgtt

SEQ ID NO: 4338504 - DNA, 23 bp, Homo sapiens
ctctctataagtgttcagtgttg

SEQ ID NO: 4338505 - DNA, 14 bp, Homo sapiens
ctctctatcttttt

SEQ ID NO: 4338506 - DNA, 14 bp, Homo sapiens
ctctctcctggagt

SEQ ID NO: 4338507 - DNA, 14 bp, Homo sapiens
ctctctctcttttt

SEQ ID NO: 4338508 - DNA, 22 bp, Homo sapiens
ctctctttgttctcagctcccc

SEQ ID NO: 4338509 - DNA, 14 bp, Homo sapiens
ctctcttttctgta

SEQ ID NO: 4338510 - DNA, 15 bp, Homo sapiens
ctctgaaataaaaat

SEQ ID NO: 4338511 - DNA, 17 bp, Homo sapiens
ctctgcaagagggggca

SEQ ID NO: 4338512 - DNA, 17 bp, Homo sapiens
ctctgcacaagctgcac

SEQ ID NO: 4338513 - DNA, 18 bp, Homo sapiens
ctctgcagggtgaagcac

SEQ ID NO: 4338514 - DNA, 12 bp, Homo sapiens
ctctgcatctga

SEQ ID NO: 4338515 - DNA, 19 bp, Homo sapiens
ctctgcatctgactctctt

SEQ ID NO: 4338516 - DNA, 19 bp, Homo sapiens
ctctgccaaagcttgtgga

SEQ ID NO: 4338517 - DNA, 22 bp, Homo sapiens
ctctgccccaagagcaggaggt

SEQ ID NO: 4338518 - DNA, 21 bp, Homo sapiens
ctctgcctccaacccagcagt

SEQ ID NO: 4338519 - DNA, 13 bp, Homo sapiens
ctctgcctgggat

SEQ ID NO: 4338520 - DNA, 14 bp, Homo sapiens
ctctgcctgggatg

SEQ ID NO: 4338521 - DNA, 15 bp, Homo sapiens
ctctgcctgggatgc

SEQ ID NO: 4338522 - DNA, 23 bp, Homo sapiens
ctctgcctgggatgcccttcccc

SEQ ID NO: 4338523 - DNA, 16 bp, Homo sapiens
ctctggaggagcaagg

SEQ ID NO: 4338524 - DNA, 17 bp, Homo sapiens
ctctgggatctgccaac

SEQ ID NO: 4338525 - DNA, 17 bp, Homo sapiens
ctctggtcctgtgtctt

SEQ ID NO: 4338526 - DNA, 15 bp, Homo sapiens
ctctgtggccaggag

SEQ ID NO: 4338527 - DNA, 23 bp, Homo sapiens
ctctgtggccaggagccctggcc

SEQ ID NO: 4338528 - DNA, 13 bp, Homo sapiens
ctctgtggctcca

SEQ ID NO: 4338529 - DNA, 15 bp, Homo sapiens
ctctgtgtctggcag

SEQ ID NO: 4338530 - DNA, 16 bp, Homo sapiens
ctctgtttctccttct

SEQ ID NO: 4338531 - DNA, 14 bp, Homo sapiens
ctcttaaatcattt

SEQ ID NO: 4338532 - DNA, 15 bp, Homo sapiens
ctcttagaaaaacca

SEQ ID NO: 4338533 - DNA, 17 bp, Homo sapiens
ctcttcagactctcagc

SEQ ID NO: 4338534 - DNA, 18 bp, Homo sapiens
ctcttccacctctgggga

SEQ ID NO: 4338535 - DNA, 18 bp, Homo sapiens
ctcttctttattgcacta

SEQ ID NO: 4338536 - DNA, 21 bp, Homo sapiens
ctcttctttattgcactagga

SEQ ID NO: 4338537 - DNA, 14 bp, Homo sapiens
ctcttgagcctggg

SEQ ID NO: 4338538 - DNA, 18 bp, Homo sapiens
ctcttggaaatgttaaga

SEQ ID NO: 4338539 - DNA, 14 bp, Homo sapiens
ctctttgccctgag

SEQ ID NO: 4338540 - DNA, 17 bp, Homo sapiens
ctctttgccctgaggct

SEQ ID NO: 4338541 - DNA, 15 bp, Homo sapiens
ctcttttctgtactt

SEQ ID NO: 4338542 - DNA, 21 bp, Homo sapiens
ctcttttttgtttgtttcttt

SEQ ID NO: 4338543 - DNA, 13 bp, Homo sapiens
ctgaaacatgtgc

SEQ ID NO: 4338544 - DNA, 17 bp, Homo sapiens
ctgaaacatgtgcccct

SEQ ID NO: 4338545 - DNA, 19 bp, Homo sapiens
ctgaaacatgtgcccctgc

SEQ ID NO: 4338546 - DNA, 15 bp, Homo sapiens
ctgaaacgagaagtg

SEQ ID NO: 4338547 - DNA, 20 bp, Homo sapiens
ctgaaacgagaagtgccctt

SEQ ID NO: 4338548 - DNA, 17 bp, Homo sapiens
ctgaaagccctgagctt

SEQ ID NO: 4338549 - DNA, 18 bp, Homo sapiens
ctgaaagccctgagcttt

SEQ ID NO: 4338550 - DNA, 19 bp, Homo sapiens
ctgaaagccctgagctttc

SEQ ID NO: 4338551 - DNA, 15 bp, Homo sapiens
ctgaaagctgggagc

SEQ ID NO: 4338552 - DNA, 16 bp, Homo sapiens
ctgaaagtcctgcttt

SEQ ID NO: 4338553 - DNA, 19 bp, Homo sapiens
ctgaaagtcctgctttcct

SEQ ID NO: 4338554 - DNA, 16 bp, Homo sapiens
ctgaaccaatagaaag

SEQ ID NO: 4338555 - DNA, 16 bp, Homo sapiens
ctgaagctggggcttg

SEQ ID NO: 4338556 - DNA, 20 bp, Homo sapiens
ctgaagctggggcttgggga

SEQ ID NO: 4338557 - DNA, 22 bp, Homo sapiens
ctgaaggctgctgcaagtcatt

SEQ ID NO: 4338558 - DNA, 17 bp, Homo sapiens
ctgaagtacagtcccag

SEQ ID NO: 4338559 - DNA, 13 bp, Homo sapiens
ctgaataaaaaat

SEQ ID NO: 4338560 - DNA, 23 bp, Homo sapiens
ctgaataaaaaataaataaaatg

SEQ ID NO: 4338561 - DNA, 15 bp, Homo sapiens
ctgaatcatgtctgt

SEQ ID NO: 4338562 - DNA, 18 bp, Homo sapiens
ctgaatgtttattccttg

SEQ ID NO: 4338563 - DNA, 14 bp, Homo sapiens
ctgaattgagaaaa

SEQ ID NO: 4338564 - DNA, 16 bp, Homo sapiens
ctgaattgagaaaaga

SEQ ID NO: 4338565 - DNA, 16 bp, Homo sapiens
ctgaattgagaataag

SEQ ID NO: 4338566 - DNA, 21 bp, Homo sapiens
ctgaattgagaataagaattt

SEQ ID NO: 4338567 - DNA, 22 bp, Homo sapiens
ctgacacagtgctcgaccttga

SEQ ID NO: 4338568 - DNA, 20 bp, Homo sapiens
ctgacatcagatttcttaat

SEQ ID NO: 4338569 - DNA, 18 bp, Homo sapiens
ctgacgcaatgaaaagtc

SEQ ID NO: 4338570 - DNA, 16 bp, Homo sapiens
ctgactctgttattga

SEQ ID NO: 4338571 - DNA, 23 bp, Homo sapiens
ctgactgatggtttggaaaataa

SEQ ID NO: 4338572 - DNA, 15 bp, Homo sapiens
ctgagaataagaaag

SEQ ID NO: 4338573 - DNA, 20 bp, Homo sapiens
ctgagagcgaattgtgtgga

SEQ ID NO: 4338574 - DNA, 16 bp, Homo sapiens
ctgagaggttagaatg

SEQ ID NO: 4338575 - DNA, 16 bp, Homo sapiens
ctgagcccagagaagc

SEQ ID NO: 4338576 - DNA, 23 bp, Homo sapiens
ctgagccgaacatgttatttaac

SEQ ID NO: 4338577 - DNA, 23 bp, Homo sapiens
ctgagccgcgctttcccctcctc

SEQ ID NO: 4338578 - DNA, 16 bp, Homo sapiens
ctgagctgaagaaatt

SEQ ID NO: 4338579 - DNA, 15 bp, Homo sapiens
ctgaggctctctaag

SEQ ID NO: 4338580 - DNA, 19 bp, Homo sapiens
ctgagggcaaatccagtcc

SEQ ID NO: 4338581 - DNA, 17 bp, Homo sapiens
ctgagggttaatttcta

SEQ ID NO: 4338582 - DNA, 16 bp, Homo sapiens
cttcctcctctcctgg

SEQ ID NO: 4338583 - DNA, 21 bp, Homo sapiens
cttcgcgcaccttctcacctt

SEQ ID NO: 4338584 - DNA, 13 bp, Homo sapiens
cttcgggaaaatt

SEQ ID NO: 4338585 - DNA, 15 bp, Homo sapiens
cttcggggaccagcc

SEQ ID NO: 4338586 - DNA, 16 bp, Homo sapiens
cttcggggaccagccc

SEQ ID NO: 4338587 - DNA, 14 bp, Homo sapiens
cttctaccccacct

SEQ ID NO: 4338588 - DNA, 20 bp, Homo sapiens
cttctaccccacctgacctc

SEQ ID NO: 4338589 - DNA, 19 bp, Homo sapiens
cttctagacactccttgaa

SEQ ID NO: 4338590 - DNA, 13 bp, Homo sapiens
cttctcacttttt

SEQ ID NO: 4338591 - DNA, 23 bp, Homo sapiens
cttctcagttgcagaaaatgaac

SEQ ID NO: 4338592 - DNA, 18 bp, Homo sapiens
cttctccaattctgaaat

SEQ ID NO: 4338593 - DNA, 12 bp, Homo sapiens
cttctccagcct

SEQ ID NO: 4338594 - DNA, 12 bp, Homo sapiens
cttctcccaggc

SEQ ID NO: 4338595 - DNA, 17 bp, Homo sapiens
cttctcccaggcctctg

SEQ ID NO: 4338596 - DNA, 21 bp, Homo sapiens
cttctcccaggcctctgcccc

SEQ ID NO: 4338597 - DNA, 16 bp, Homo sapiens
cttctcttaaacttgt

SEQ ID NO: 4338598 - DNA, 19 bp, Homo sapiens
cttctcttaaacttgtgaa

SEQ ID NO: 4338599 - DNA, 20 bp, Homo sapiens
cttctcttaaacttgtgaat

SEQ ID NO: 4338600 - DNA, 12 bp, Homo sapiens
cttctctttgtg

SEQ ID NO: 4338601 - DNA, 15 bp, Homo sapiens
cttctgagccccagc

SEQ ID NO: 4338602 - DNA, 14 bp, Homo sapiens
cttctgcagcaact

SEQ ID NO: 4338603 - DNA, 20 bp, Homo sapiens
cttctgcagcaactcccacg

SEQ ID NO: 4338604 - DNA, 22 bp, Homo sapiens
cttctgcagcaactcccacgac

SEQ ID NO: 4338605 - DNA, 20 bp, Homo sapiens
cttctggcttccttctctca

SEQ ID NO: 4338606 - DNA, 19 bp, Homo sapiens
cttctgggcatctgttctg

SEQ ID NO: 4338607 - DNA, 14 bp, Homo sapiens
cttcttagtaaaaa

SEQ ID NO: 4338608 - DNA, 16 bp, Homo sapiens
cttcttagtaaaaagc

SEQ ID NO: 4338609 - DNA, 14 bp, Homo sapiens
cttgagctttctgt

SEQ ID NO: 4338610 - DNA, 17 bp, Homo sapiens
cttgagtggtttttgct

SEQ ID NO: 4338611 - DNA, 22 bp, Homo sapiens
cttgatactaaaagttcttctc

SEQ ID NO: 4338612 - DNA, 23 bp, Homo sapiens
cttgatactaaaagttcttctcc

SEQ ID NO: 4338613 - DNA, 18 bp, Homo sapiens
cttgatgactgctgattt

SEQ ID NO: 4338614 - DNA, 17 bp, Homo sapiens
cttgatttgatctttgt

SEQ ID NO: 4338615 - DNA, 23 bp, Homo sapiens
cttgcaaactctataaagaaact

SEQ ID NO: 4338616 - DNA, 13 bp, Homo sapiens
cttgcacctgagc

SEQ ID NO: 4338617 - DNA, 14 bp, Homo sapiens
cttgcacctgagcc

SEQ ID NO: 4338618 - DNA, 16 bp, Homo sapiens
cttgcacctgagcctg

SEQ ID NO: 4338619 - DNA, 12 bp, Homo sapiens
cttgcccttgga

SEQ ID NO: 4338620 - DNA, 23 bp, Homo sapiens
cttgctgcaaacccatgaagctg

SEQ ID NO: 4338621 - DNA, 13 bp, Homo sapiens
cttgctggtgcct

SEQ ID NO: 4338622 - DNA, 15 bp, Homo sapiens
cttgctggtgcctct

SEQ ID NO: 4338623 - DNA, 15 bp, Homo sapiens
cttgcttctgcagca

SEQ ID NO: 4338624 - DNA, 17 bp, Homo sapiens
cttgctttttgctgtgt

SEQ ID NO: 4338625 - DNA, 13 bp, Homo sapiens
cttggagtgcccc

SEQ ID NO: 4338626 - DNA, 19 bp, Homo sapiens
cttggagtgccccaaggag

SEQ ID NO: 4338627 - DNA, 18 bp, Homo sapiens
cttgggaggggccggagg

SEQ ID NO: 4338628 - DNA, 14 bp, Homo sapiens
cttgggccactgtg

SEQ ID NO: 4338629 - DNA, 15 bp, Homo sapiens
cttggggggctgagg

SEQ ID NO: 4338630 - DNA, 22 bp, Homo sapiens
cttggggggctgaggtgggagg

SEQ ID NO: 4338631 - DNA, 13 bp, Homo sapiens
cttggttcatgct

SEQ ID NO: 4338632 - DNA, 15 bp, Homo sapiens
cttggttgttaattt

SEQ ID NO: 4338633 - DNA, 16 bp, Homo sapiens
cttgtgaatgcttctc

SEQ ID NO: 4338634 - DNA, 12 bp, Homo sapiens
cttgtgcactta

SEQ ID NO: 4338635 - DNA, 15 bp, Homo sapiens
cttgtgctgagcctg

SEQ ID NO: 4338636 - DNA, 20 bp, Homo sapiens
cttgtgctgagcctgcccag

SEQ ID NO: 4338637 - DNA, 12 bp, Homo sapiens
cttgttattaat

SEQ ID NO: 4338638 - DNA, 12 bp, Homo sapiens
cttgtttattga

SEQ ID NO: 4338639 - DNA, 23 bp, Homo sapiens
cttgtttattgagtttgtaggta

SEQ ID NO: 4338640 - DNA, 19 bp, Homo sapiens
ctttaaaagtcattattcc

SEQ ID NO: 4338641 - DNA, 19 bp, Homo sapiens
ctttaacctccctcaacaa

SEQ ID NO: 4338642 - DNA, 21 bp, Homo sapiens
ctttaggatgagcaaaacatt

SEQ ID NO: 4338643 - DNA, 22 bp, Homo sapiens
ctttatccagctagtgccaaat

SEQ ID NO: 4338644 - DNA, 13 bp, Homo sapiens
ctttattgcacta

SEQ ID NO: 4338645 - DNA, 19 bp, Homo sapiens
ctttattgcactaggaatt

SEQ ID NO: 4338646 - DNA, 20 bp, Homo sapiens
ctttattgcactaggaattc

SEQ ID NO: 4338647 - DNA, 20 bp, Homo sapiens
ctttatttattgcttagtga

SEQ ID NO: 4338648 - DNA, 18 bp, Homo sapiens
ctttcatctcccagatcc

SEQ ID NO: 4338649 - DNA, 22 bp, Homo sapiens
ctttccaaatgcccagcttaaa

SEQ ID NO: 4338650 - DNA, 13 bp, Homo sapiens
ctttcctcccttc

SEQ ID NO: 4338651 - DNA, 14 bp, Homo sapiens
ctttcctcccttct

SEQ ID NO: 4338652 - DNA, 16 bp, Homo sapiens
ctttcctcccttcttt

SEQ ID NO: 4338653 - DNA, 18 bp, Homo sapiens
ctttcctcccttctttgc

SEQ ID NO: 4338654 - DNA, 15 bp, Homo sapiens
ctttctattccaaag

SEQ ID NO: 4338655 - DNA, 12 bp, Homo sapiens
ctttctctgcct

SEQ ID NO: 4338656 - DNA, 19 bp, Homo sapiens
ctttctgagtgagttttac

SEQ ID NO: 4338657 - DNA, 15 bp, Homo sapiens
ctttctgtctctctc

SEQ ID NO: 4338658 - DNA, 15 bp, Homo sapiens
ctttctgtgcatgtg

SEQ ID NO: 4338659 - DNA, 14 bp, Homo sapiens
ctttcttgcactgt

SEQ ID NO: 4338660 - DNA, 17 bp, Homo sapiens
ctttgaaacctgctctg

SEQ ID NO: 4338661 - DNA, 17 bp, Homo sapiens
ctttgagaccagaagaa

SEQ ID NO: 4338662 - DNA, 17 bp, Homo sapiens
ctttgaggccccaactc

SEQ ID NO: 4338663 - DNA, 22 bp, Homo sapiens
ctttgattctccttttatgtgt

SEQ ID NO: 4338664 - DNA, 21 bp, Homo sapiens
ctttgcaaattatttattact

SEQ ID NO: 4338665 - DNA, 21 bp, Homo sapiens
ctttgcattccttacttgcac

SEQ ID NO: 4338666 - DNA, 16 bp, Homo sapiens
ctttgcccaacaccag

SEQ ID NO: 4338667 - DNA, 18 bp, Homo sapiens
ctttgcccaacaccagcc

SEQ ID NO: 4338668 - DNA, 16 bp, Homo sapiens
ctaaagcagtaaaata

SEQ ID NO: 4338669 - DNA, 18 bp, Homo sapiens
ctaaagcagtaaaataaa

SEQ ID NO: 4338670 - DNA, 19 bp, Homo sapiens
ctaaagcagtaaaataaaa

SEQ ID NO: 4338671 - DNA, 20 bp, Homo sapiens
ctaaagcagtaaaataaaaa

SEQ ID NO: 4338672 - DNA, 14 bp, Homo sapiens
ctaaagctttatct

SEQ ID NO: 4338673 - DNA, 22 bp, Homo sapiens
ctaaagctttatctttgtgtaa

SEQ ID NO: 4338674 - DNA, 14 bp, Homo sapiens
ctaaagggagaaat

SEQ ID NO: 4338675 - DNA, 19 bp, Homo sapiens
ctaaagggagaaatgccag

SEQ ID NO: 4338676 - DNA, 18 bp, Homo sapiens
ctaaagtccctatagtat

SEQ ID NO: 4338677 - DNA, 15 bp, Homo sapiens
ctaaagttgaaaata

SEQ ID NO: 4338678 - DNA, 16 bp, Homo sapiens
ctaaagttgaaaatac

SEQ ID NO: 4338679 - DNA, 21 bp, Homo sapiens
ctaaatatgaaccctttgttt

SEQ ID NO: 4338680 - DNA, 15 bp, Homo sapiens
ctaaatgctcataca

SEQ ID NO: 4338681 - DNA, 19 bp, Homo sapiens
ctaaattataaaattgaaa

SEQ ID NO: 4338682 - DNA, 15 bp, Homo sapiens
ctaaattctataaaa

SEQ ID NO: 4338683 - DNA, 13 bp, Homo sapiens
ctaactgtgattt

SEQ ID NO: 4338684 - DNA, 23 bp, Homo sapiens
ctaactgtgatttgtagatttac

SEQ ID NO: 4338685 - DNA, 13 bp, Homo sapiens
ctaagaaaagaga

SEQ ID NO: 4338686 - DNA, 19 bp, Homo sapiens
ctaagagtcctgggtaaat

SEQ ID NO: 4338687 - DNA, 15 bp, Homo sapiens
ctaagtacccttggg

SEQ ID NO: 4338688 - DNA, 18 bp, Homo sapiens
ctaagtttagaagcgctc

SEQ ID NO: 4338689 - DNA, 12 bp, Homo sapiens
ctaatatacttt

SEQ ID NO: 4338690 - DNA, 22 bp, Homo sapiens
ctaatatccccaaattagggca

SEQ ID NO: 4338691 - DNA, 12 bp, Homo sapiens
ctaatctgcctg

SEQ ID NO: 4338692 - DNA, 20 bp, Homo sapiens
ctaatgagttgctggaaaat

SEQ ID NO: 4338693 - DNA, 16 bp, Homo sapiens
ctaatgccctatgtgt

SEQ ID NO: 4338694 - DNA, 17 bp, Homo sapiens
ctaatgccctatgtgta

SEQ ID NO: 4338695 - DNA, 19 bp, Homo sapiens
ctaatgccctatgtgtata

SEQ ID NO: 4338696 - DNA, 20 bp, Homo sapiens
ctaatgctggcctgactggt

SEQ ID NO: 4338697 - DNA, 19 bp, Homo sapiens
ctaatggcatggagactct

SEQ ID NO: 4338698 - DNA, 18 bp, Homo sapiens
ctaatgttctaaattcta

SEQ ID NO: 4338699 - DNA, 22 bp, Homo sapiens
ctaatgttggacagacactgtt

SEQ ID NO: 4338700 - DNA, 20 bp, Homo sapiens
ctacaaagcactagagaatg

SEQ ID NO: 4338701 - DNA, 17 bp, Homo sapiens
ctacacatatgtgcttc

SEQ ID NO: 4338702 - DNA, 21 bp, Homo sapiens
ctacagcactactgggtgtca

SEQ ID NO: 4338703 - DNA, 19 bp, Homo sapiens
ctacagttgaaaaacagct

SEQ ID NO: 4338704 - DNA, 21 bp, Homo sapiens
ctacattcttggttgttaatt

SEQ ID NO: 4338705 - DNA, 18 bp, Homo sapiens
ctaccacgggtctgccat

SEQ ID NO: 4338706 - DNA, 19 bp, Homo sapiens
ctaccacgggtctgccatg

SEQ ID NO: 4338707 - DNA, 15 bp, Homo sapiens
ctaccccacctgacc

SEQ ID NO: 4338708 - DNA, 18 bp, Homo sapiens
ctacctctcgtttctgcc

SEQ ID NO: 4338709 - DNA, 20 bp, Homo sapiens
ctacctctcgtttctgccca

SEQ ID NO: 4338710 - DNA, 21 bp, Homo sapiens
ctacctctcgtttctgcccag

SEQ ID NO: 4338711 - DNA, 15 bp, Homo sapiens
ctacctgcacctctg

SEQ ID NO: 4338712 - DNA, 14 bp, Homo sapiens
ctacctttttatat

SEQ ID NO: 4338713 - DNA, 20 bp, Homo sapiens
ctacctttttatatttaaaa

SEQ ID NO: 4338714 - DNA, 20 bp, Homo sapiens
ctacggggaaaatgcatttt

SEQ ID NO: 4338715 - DNA, 13 bp, Homo sapiens
ctactgctatttt

SEQ ID NO: 4338716 - DNA, 20 bp, Homo sapiens
ctactgtacataaacaatga

SEQ ID NO: 4338717 - DNA, 16 bp, Homo sapiens
ctactttttgtattta

SEQ ID NO: 4338718 - DNA, 19 bp, Homo sapiens
ctactttttgtatttagta

SEQ ID NO: 4338719 - DNA, 13 bp, Homo sapiens
ctagactgtgtct

SEQ ID NO: 4338720 - DNA, 15 bp, Homo sapiens
ctagaggacactagg

SEQ ID NO: 4338721 - DNA, 20 bp, Homo sapiens
ctagaggacactaggagact

SEQ ID NO: 4338722 - DNA, 17 bp, Homo sapiens
ctagcactttgggaggc

SEQ ID NO: 4338723 - DNA, 12 bp, Homo sapiens
ctagcagcaggg

SEQ ID NO: 4338724 - DNA, 13 bp, Homo sapiens
ctagcccactccc

SEQ ID NO: 4338725 - DNA, 18 bp, Homo sapiens
ctagcccttctaccccac

SEQ ID NO: 4338726 - DNA, 13 bp, Homo sapiens
ctaggaaagagga

SEQ ID NO: 4338727 - DNA, 21 bp, Homo sapiens
ctaggaaagaggaggcagaaa

SEQ ID NO: 4338728 - DNA, 19 bp, Homo sapiens
ctaggaattctttgcattc

SEQ ID NO: 4338729 - DNA, 13 bp, Homo sapiens
ctaggagaagagt

SEQ ID NO: 4338730 - DNA, 22 bp, Homo sapiens
ctaggatgggagagctagaaag

SEQ ID NO: 4338731 - DNA, 21 bp, Homo sapiens
ctaggcatttgctgaatacag

SEQ ID NO: 4338732 - DNA, 12 bp, Homo sapiens
ctaggcctgggg

SEQ ID NO: 4338733 - DNA, 13 bp, Homo sapiens
ctaggcctgggga

SEQ ID NO: 4338734 - DNA, 14 bp, Homo sapiens
ctagggaagataat

SEQ ID NO: 4338735 - DNA, 17 bp, Homo sapiens
ctagttccattcttggt

SEQ ID NO: 4338736 - DNA, 18 bp, Homo sapiens
ctagtttccctggtgccc

SEQ ID NO: 4338737 - DNA, 10 bp, Homo sapiens
ctataaatga

SEQ ID NO: 4338738 - DNA, 12 bp, Homo sapiens
ctataaatgact

SEQ ID NO: 4338739 - DNA, 14 bp, Homo sapiens
ctataagtgttcag

SEQ ID NO: 4338740 - DNA, 19 bp, Homo sapiens
ctataagtgttcagtgttg

SEQ ID NO: 4338741 - DNA, 20 bp, Homo sapiens
ctataagtgttcagtgttga

SEQ ID NO: 4338742 - DNA, 13 bp, Homo sapiens
ctatacctgcctt

SEQ ID NO: 4338743 - DNA, 14 bp, Homo sapiens
ctatcagggaggaa

SEQ ID NO: 4338744 - DNA, 14 bp, Homo sapiens
ctatcctgctgaaa

SEQ ID NO: 4338745 - DNA, 19 bp, Homo sapiens
ctatcggtttagcctttta

SEQ ID NO: 4338746 - DNA, 13 bp, Homo sapiens
ctatgatatattt

SEQ ID NO: 4338747 - DNA, 22 bp, Homo sapiens
ctatgatatatttatatcatat

SEQ ID NO: 4338748 - DNA, 18 bp, Homo sapiens
ctatgtgcgaagcaagaa

SEQ ID NO: 4338749 - DNA, 15 bp, Homo sapiens
ctattagagaagaga

SEQ ID NO: 4338750 - DNA, 21 bp, Homo sapiens
ctattggcttactgaaagaca

SEQ ID NO: 4338751 - DNA, 15 bp, Homo sapiens
ctattgtaatgccaa

SEQ ID NO: 4338752 - DNA, 13 bp, Homo sapiens
ctatttacctcct

SEQ ID NO: 4338753 - DNA, 13 bp, Homo sapiens
ctatttatatatc

SEQ ID NO: 4338754 - DNA, 21 bp, Homo sapiens
ctatttgggctctgaaataaa

SEQ ID NO: 4338755 - DNA, 14 bp, Homo sapiens
ctattttttaataa

SEQ ID NO: 4338756 - DNA, 16 bp, Homo sapiens
ctattttttaataaaa

SEQ ID NO: 4338757 - DNA, 23 bp, Homo sapiens
ctattttttttaaatcaaaaact

SEQ ID NO: 4338758 - DNA, 17 bp, Homo sapiens
ctcaaaaaaagaaaaag

SEQ ID NO: 4338759 - DNA, 20 bp, Homo sapiens
ctcaaaccctccacttctcc

SEQ ID NO: 4338760 - DNA, 20 bp, Homo sapiens
ctcaaggaggtggtgaattt

SEQ ID NO: 4338761 - DNA, 13 bp, Homo sapiens
ctcaagtgtcacc

SEQ ID NO: 4338762 - DNA, 14 bp, Homo sapiens
ctcaagtgtcacct

SEQ ID NO: 4338763 - DNA, 20 bp, Homo sapiens
ctcaagtgtcacctccttcc

SEQ ID NO: 4338764 - DNA, 21 bp, Homo sapiens
ctcaagtgtcacctccttccc

SEQ ID NO: 4338765 - DNA, 14 bp, Homo sapiens
ctcaatcacactgg

SEQ ID NO: 4338766 - DNA, 23 bp, Homo sapiens
ctcacacggacactcaaaagctg

SEQ ID NO: 4338767 - DNA, 21 bp, Homo sapiens
ctcactgttttataattagtc

SEQ ID NO: 4338768 - DNA, 21 bp, Homo sapiens
ctcagagaaatatgcagaagg

SEQ ID NO: 4338769 - DNA, 19 bp, Homo sapiens
ctcagcaaaagatgcttct

SEQ ID NO: 4338770 - DNA, 22 bp, Homo sapiens
ctcagcaggccaaacatggcca

SEQ ID NO: 4338771 - DNA, 17 bp, Homo sapiens
ctcagcagggctggtca

SEQ ID NO: 4338772 - DNA, 22 bp, Homo sapiens
ctcagctccagacgtaggggag

SEQ ID NO: 4338773 - DNA, 16 bp, Homo sapiens
ctcagctccccctgtc

SEQ ID NO: 4338774 - DNA, 17 bp, Homo sapiens
ctcagctccccctgtcc

SEQ ID NO: 4338775 - DNA, 16 bp, Homo sapiens
ctcagctccctgaccc

SEQ ID NO: 4338776 - DNA, 19 bp, Homo sapiens
ctcaggaggcgaataaatg

SEQ ID NO: 4338777 - DNA, 23 bp, Homo sapiens
ctcaggaggcgaataaatgttca

SEQ ID NO: 4338778 - DNA, 18 bp, Homo sapiens
ctcaggcaggtgggatgg

SEQ ID NO: 4338779 - DNA, 18 bp, Homo sapiens
ctcaggctccccagtgct

SEQ ID NO: 4338780 - DNA, 23 bp, Homo sapiens
ctcaggctccccagtgctcctgg

SEQ ID NO: 4338781 - DNA, 20 bp, Homo sapiens
ctcagtacctcccctccccg

SEQ ID NO: 4338782 - DNA, 19 bp, Homo sapiens
ctcagttgcagaaaatgaa

SEQ ID NO: 4338783 - DNA, 12 bp, Homo sapiens
ctcataattcct

SEQ ID NO: 4338784 - DNA, 16 bp, Homo sapiens
ctcatagattgcaaat

SEQ ID NO: 4338785 - DNA, 15 bp, Homo sapiens
ctcatccattcctct

SEQ ID NO: 4338786 - DNA, 17 bp, Homo sapiens
ctcatgcaaactgcttt

SEQ ID NO: 4338787 - DNA, 19 bp, Homo sapiens
ctcatgcaaactgctttat

SEQ ID NO: 4338788 - DNA, 16 bp, Homo sapiens
cctagccccacccaga

SEQ ID NO: 4338789 - DNA, 17 bp, Homo sapiens
cctagccccacccagag

SEQ ID NO: 4338790 - DNA, 18 bp, Homo sapiens
cctagccccacccagagg

SEQ ID NO: 4338791 - DNA, 19 bp, Homo sapiens
cctagccccacccagaggt

SEQ ID NO: 4338792 - DNA, 15 bp, Homo sapiens
cctaggtcatgaagg

SEQ ID NO: 4338793 - DNA, 17 bp, Homo sapiens
cctatgtgcgaagcaag

SEQ ID NO: 4338794 - DNA, 18 bp, Homo sapiens
cctatgtgcgaagcaaga

SEQ ID NO: 4338795 - DNA, 16 bp, Homo sapiens
cctattagagaagaga

SEQ ID NO: 4338796 - DNA, 20 bp, Homo sapiens
cctattggcttactgaaaga

SEQ ID NO: 4338797 - DNA, 14 bp, Homo sapiens
cctatttttgtaaa

SEQ ID NO: 4338798 - DNA, 14 bp, Homo sapiens
cctcaaatcactgc

SEQ ID NO: 4338799 - DNA, 20 bp, Homo sapiens
cctcaacaaggtatacctca

SEQ ID NO: 4338800 - DNA, 11 bp, Homo sapiens
cctcaggcagg

SEQ ID NO: 4338801 - DNA, 20 bp, Homo sapiens
cctcaggtgagaagcagagg

SEQ ID NO: 4338802 - DNA, 14 bp, Homo sapiens
cctcatgccacagt

SEQ ID NO: 4338803 - DNA, 18 bp, Homo sapiens
cctcattagcattttgct

SEQ ID NO: 4338804 - DNA, 19 bp, Homo sapiens
cctccccgccccctgaaac

SEQ ID NO: 4338805 - DNA, 14 bp, Homo sapiens
cctccctcaacaag

SEQ ID NO: 4338806 - DNA, 18 bp, Homo sapiens
cctccctgtctctgcatc

SEQ ID NO: 4338807 - DNA, 20 bp, Homo sapiens
cctccctgtctctgcatctg

SEQ ID NO: 4338808 - DNA, 14 bp, Homo sapiens
cctccctgtttgaa

SEQ ID NO: 4338809 - DNA, 13 bp, Homo sapiens
cctccttccccag

SEQ ID NO: 4338810 - DNA, 13 bp, Homo sapiens
cctcggctgtctc

SEQ ID NO: 4338811 - DNA, 14 bp, Homo sapiens
cctcggctgtctcc

SEQ ID NO: 4338812 - DNA, 18 bp, Homo sapiens
cctcggctgtctcctgtc

SEQ ID NO: 4338813 - DNA, 21 bp, Homo sapiens
cctcggctgtctcctgtcccc

SEQ ID NO: 4338814 - DNA, 13 bp, Homo sapiens
cctctcccaccca

SEQ ID NO: 4338815 - DNA, 14 bp, Homo sapiens
cctctcccacccaa

SEQ ID NO: 4338816 - DNA, 13 bp, Homo sapiens
cctctcctggaaa

SEQ ID NO: 4338817 - DNA, 13 bp, Homo sapiens
cctctctctaagt

SEQ ID NO: 4338818 - DNA, 18 bp, Homo sapiens
cctctctttgttctcagc

SEQ ID NO: 4338819 - DNA, 20 bp, Homo sapiens
cctctctttgttctcagctc

SEQ ID NO: 4338820 - DNA, 23 bp, Homo sapiens
cctctctttgttctcagctcccc

SEQ ID NO: 4338821 - DNA, 20 bp, Homo sapiens
cctctgcacaagctgcaccc

SEQ ID NO: 4338822 - DNA, 17 bp, Homo sapiens
cctctgccccaagagca

SEQ ID NO: 4338823 - DNA, 14 bp, Homo sapiens
cctctgcctgggat

SEQ ID NO: 4338824 - DNA, 15 bp, Homo sapiens
cctctgcctgggatg

SEQ ID NO: 4338825 - DNA, 16 bp, Homo sapiens
cctctgcctgggatgc

SEQ ID NO: 4338826 - DNA, 13 bp, Homo sapiens
cctctgtggccag

SEQ ID NO: 4338827 - DNA, 14 bp, Homo sapiens
cctctgtggccagg

SEQ ID NO: 4338828 - DNA, 16 bp, Homo sapiens
cctctgtggccaggag

SEQ ID NO: 4338829 - DNA, 17 bp, Homo sapiens
cctctgtggccaggagc

SEQ ID NO: 4338830 - DNA, 20 bp, Homo sapiens
cctctgtggccaggagccct

SEQ ID NO: 4338831 - DNA, 22 bp, Homo sapiens
cctctgtggccaggagccctgg

SEQ ID NO: 4338832 - DNA, 14 bp, Homo sapiens
cctctgtgtctgct

SEQ ID NO: 4338833 - DNA, 16 bp, Homo sapiens
cctctgtgtctgctct

SEQ ID NO: 4338834 - DNA, 17 bp, Homo sapiens
cctctgtgtctgctctc

SEQ ID NO: 4338835 - DNA, 14 bp, Homo sapiens
cctctttctccagc

SEQ ID NO: 4338836 - DNA, 21 bp, Homo sapiens
cctgaaacatgtgcccctgcc

SEQ ID NO: 4338837 - DNA, 20 bp, Homo sapiens
cctgaaacgagaagtgccct

SEQ ID NO: 4338838 - DNA, 13 bp, Homo sapiens
cctgaaagccctg

SEQ ID NO: 4338839 - DNA, 14 bp, Homo sapiens
cctgaaagctggga

SEQ ID NO: 4338840 - DNA, 15 bp, Homo sapiens
cctgaaagctgggag

SEQ ID NO: 4338841 - DNA, 16 bp, Homo sapiens
cctgaaagctgggagc

SEQ ID NO: 4338842 - DNA, 18 bp, Homo sapiens
cctgactggttgtcagaa

SEQ ID NO: 4338843 - DNA, 19 bp, Homo sapiens
cctgagcctgttcccactc

SEQ ID NO: 4338844 - DNA, 23 bp, Homo sapiens
cctgaggttagcccaatggagaa

SEQ ID NO: 4338845 - DNA, 16 bp, Homo sapiens
cctgagttctgacact

SEQ ID NO: 4338846 - DNA, 20 bp, Homo sapiens
cctgagttctgacactgtgt

SEQ ID NO: 4338847 - DNA, 20 bp, Homo sapiens
cctgattaccagtctgatta

SEQ ID NO: 4338848 - DNA, 13 bp, Homo sapiens
cctgcacctctgg

SEQ ID NO: 4338849 - DNA, 22 bp, Homo sapiens
cctgcaggtccggggaggaggt

SEQ ID NO: 4338850 - DNA, 23 bp, Homo sapiens
cctgccaaggccggagacccaca

SEQ ID NO: 4338851 - DNA, 18 bp, Homo sapiens
cattctcataattcctac

SEQ ID NO: 4338852 - DNA, 21 bp, Homo sapiens
cattctcataattcctacagc

SEQ ID NO: 4338853 - DNA, 21 bp, Homo sapiens
cattcttggtcaagtttttct

SEQ ID NO: 4338854 - DNA, 19 bp, Homo sapiens
cattcttggttgttaattt

SEQ ID NO: 4338855 - DNA, 15 bp, Homo sapiens
cattgaaaaaggaaa

SEQ ID NO: 4338856 - DNA, 16 bp, Homo sapiens
cattgaaaaaggaaaa

SEQ ID NO: 4338857 - DNA, 18 bp, Homo sapiens
cattgaaaaaggaaaaat

SEQ ID NO: 4338858 - DNA, 18 bp, Homo sapiens
cattgcaaaatagaagaa

SEQ ID NO: 4338859 - DNA, 15 bp, Homo sapiens
cattggcccctgagc

SEQ ID NO: 4338860 - DNA, 13 bp, Homo sapiens
cattgtcttgttc

SEQ ID NO: 4338861 - DNA, 15 bp, Homo sapiens
cattgtcttgttctg

SEQ ID NO: 4338862 - DNA, 18 bp, Homo sapiens
cattgttttgaatattac

SEQ ID NO: 4338863 - DNA, 21 bp, Homo sapiens
catttagcttgttccactgca

SEQ ID NO: 4338864 - DNA, 12 bp, Homo sapiens
catttatttctc

SEQ ID NO: 4338865 - DNA, 18 bp, Homo sapiens
catttcattccattgcct

SEQ ID NO: 4338866 - DNA, 14 bp, Homo sapiens
catttggcttgctg

SEQ ID NO: 4338867 - DNA, 15 bp, Homo sapiens
catttggcttgctgt

SEQ ID NO: 4338868 - DNA, 20 bp, Homo sapiens
catttggcttgctgtttact

SEQ ID NO: 4338869 - DNA, 14 bp, Homo sapiens
cattttaagtgctt

SEQ ID NO: 4338870 - DNA, 21 bp, Homo sapiens
cattttaagtgcttcacattt

SEQ ID NO: 4338871 - DNA, 11 bp, Homo sapiens
cattttacaca

SEQ ID NO: 4338872 - DNA, 12 bp, Homo sapiens
cattttacacat

SEQ ID NO: 4338873 - DNA, 20 bp, Homo sapiens
cattttacacatgtgctgat

SEQ ID NO: 4338874 - DNA, 14 bp, Homo sapiens
cattttcttcagaa

SEQ ID NO: 4338875 - DNA, 15 bp, Homo sapiens
cattttcttcagaat

SEQ ID NO: 4338876 - DNA, 19 bp, Homo sapiens
catttttgctaattatcaa

SEQ ID NO: 4338877 - DNA, 18 bp, Homo sapiens
ccaaacatgtatttatgt

SEQ ID NO: 4338878 - DNA, 17 bp, Homo sapiens
ccaaagcctcctccagc

SEQ ID NO: 4338879 - DNA, 15 bp, Homo sapiens
ccaaagctggcccag

SEQ ID NO: 4338880 - DNA, 17 bp, Homo sapiens
ccaaagctggcccagtt

SEQ ID NO: 4338881 - DNA, 23 bp, Homo sapiens
ccaaagctggcccagttgtccat

SEQ ID NO: 4338882 - DNA, 22 bp, Homo sapiens
ccaaagtaggtgagctatagtg

SEQ ID NO: 4338883 - DNA, 17 bp, Homo sapiens
ccaaatattacaacaag

SEQ ID NO: 4338884 - DNA, 13 bp, Homo sapiens
ccaaatggctgct

SEQ ID NO: 4338885 - DNA, 21 bp, Homo sapiens
ccaaatgtgatcaactgttca

SEQ ID NO: 4338886 - DNA, 20 bp, Homo sapiens
ccaaattgtgcttctcccca

SEQ ID NO: 4338887 - DNA, 15 bp, Homo sapiens
ccaaatttaattaaa

SEQ ID NO: 4338888 - DNA, 11 bp, Homo sapiens
ccaaatttaga

SEQ ID NO: 4338889 - DNA, 13 bp, Homo sapiens
ccaacaccagccc

SEQ ID NO: 4338890 - DNA, 16 bp, Homo sapiens
ccaacaccagcccctg

SEQ ID NO: 4338891 - DNA, 17 bp, Homo sapiens
ccaacaccagcccctgc

SEQ ID NO: 4338892 - DNA, 22 bp, Homo sapiens
ccaacaccagcccctgccccag

SEQ ID NO: 4338893 - DNA, 13 bp, Homo sapiens
ccaacagtttatt

SEQ ID NO: 4338894 - DNA, 13 bp, Homo sapiens
ccaaccccagccg

SEQ ID NO: 4338895 - DNA, 22 bp, Homo sapiens
ccaactcaagtgtcacctcctt

SEQ ID NO: 4338896 - DNA, 13 bp, Homo sapiens
ccaacttgccaaa

SEQ ID NO: 4338897 - DNA, 17 bp, Homo sapiens
ccaagctagactgtgtc

SEQ ID NO: 4338898 - DNA, 16 bp, Homo sapiens
ccaaggccggagaccc

SEQ ID NO: 4338899 - DNA, 18 bp, Homo sapiens
ccaaggccggagacccac

SEQ ID NO: 4338900 - DNA, 21 bp, Homo sapiens
ccaaggccggagacccacagc

SEQ ID NO: 4338901 - DNA, 12 bp, Homo sapiens
ccaagggccgtg

SEQ ID NO: 4338902 - DNA, 14 bp, Homo sapiens
ccaagtccaaatgt

SEQ ID NO: 4338903 - DNA, 16 bp, Homo sapiens
ccaagtccaagcccgt

SEQ ID NO: 4338904 - DNA, 22 bp, Homo sapiens
ccaatattggagcatatcaaaa

SEQ ID NO: 4338905 - DNA, 18 bp, Homo sapiens
ccaatatttctgctttct

SEQ ID NO: 4338906 - DNA, 19 bp, Homo sapiens
ccaatatttctgctttctt

SEQ ID NO: 4338907 - DNA, 16 bp, Homo sapiens
ccaatccatgcttcac

SEQ ID NO: 4338908 - DNA, 18 bp, Homo sapiens
ccaatggagaaaatgaat

SEQ ID NO: 4338909 - DNA, 15 bp, Homo sapiens
ccaattattgatata

SEQ ID NO: 4338910 - DNA, 21 bp, Homo sapiens
ccaattattgatatatattat

SEQ ID NO: 4338911 - DNA, 18 bp, Homo sapiens
ccacaagccttactcacc

SEQ ID NO: 4338912 - DNA, 18 bp, Homo sapiens
ccacacacagtccaactc

SEQ ID NO: 4338913 - DNA, 15 bp, Homo sapiens
ccacaccgctggctc

SEQ ID NO: 4338914 - DNA, 17 bp, Homo sapiens
ccacaccgctggctccg

SEQ ID NO: 4338915 - DNA, 20 bp, Homo sapiens
ccacacctccccctgctgct

SEQ ID NO: 4338916 - DNA, 22 bp, Homo sapiens
ccacagagtttgtagtaaatat

SEQ ID NO: 4338917 - DNA, 12 bp, Homo sapiens
ccacaggcctcc

SEQ ID NO: 4338918 - DNA, 16 bp, Homo sapiens
ccacaggcctccctgt

SEQ ID NO: 4338919 - DNA, 17 bp, Homo sapiens
ccacagggaaatgtgta

SEQ ID NO: 4338920 - DNA, 13 bp, Homo sapiens
ccaccagggcact

SEQ ID NO: 4338921 - DNA, 14 bp, Homo sapiens
ccaccattcctgga

SEQ ID NO: 4338922 - DNA, 15 bp, Homo sapiens
ccaccattcctggaa

SEQ ID NO: 4338923 - DNA, 13 bp, Homo sapiens
ccaccccagagtt

SEQ ID NO: 4338924 - DNA, 18 bp, Homo sapiens
ccacccgccccgccccct

SEQ ID NO: 4338925 - DNA, 21 bp, Homo sapiens
cccagaggtggccctcccagg

SEQ ID NO: 4338926 - DNA, 17 bp, Homo sapiens
cccagcagttctctgcc

SEQ ID NO: 4338927 - DNA, 15 bp, Homo sapiens
cccagcatcagcaca

SEQ ID NO: 4338928 - DNA, 12 bp, Homo sapiens
cccagcccaagt

SEQ ID NO: 4338929 - DNA, 13 bp, Homo sapiens
cccagcccaagtc

SEQ ID NO: 4338930 - DNA, 14 bp, Homo sapiens
cccagcccccacag

SEQ ID NO: 4338931 - DNA, 16 bp, Homo sapiens
cccagcccccacagcc

SEQ ID NO: 4338932 - DNA, 20 bp, Homo sapiens
cccagcccccacagccctgg

SEQ ID NO: 4338933 - DNA, 19 bp, Homo sapiens
cccagccccgtcccagagg

SEQ ID NO: 4338934 - DNA, 22 bp, Homo sapiens
cccagccccgtcccagaggccg

SEQ ID NO: 4338935 - DNA, 21 bp, Homo sapiens
cccagccctctgtggccagga

SEQ ID NO: 4338936 - DNA, 14 bp, Homo sapiens
cccagctcccccag

SEQ ID NO: 4338937 - DNA, 18 bp, Homo sapiens
cccagctcccccaggcag

SEQ ID NO: 4338938 - DNA, 21 bp, Homo sapiens
cccagctcccccaggcagaaa

SEQ ID NO: 4338939 - DNA, 23 bp, Homo sapiens
cccaggcagaaatagttgtctgt

SEQ ID NO: 4338940 - DNA, 13 bp, Homo sapiens
cccaggcctctgc

SEQ ID NO: 4338941 - DNA, 14 bp, Homo sapiens
cccaggcctctgcc

SEQ ID NO: 4338942 - DNA, 14 bp, Homo sapiens
cccagtcccccaac

SEQ ID NO: 4338943 - DNA, 22 bp, Homo sapiens
cccagtcccccaaccccagccg

SEQ ID NO: 4338944 - DNA, 22 bp, Homo sapiens
cccagtgcccggtgcagggcct

SEQ ID NO: 4338945 - DNA, 17 bp, Homo sapiens
cccagtgccgagaagga

SEQ ID NO: 4338946 - DNA, 15 bp, Homo sapiens
cccagttggaggaga

SEQ ID NO: 4338947 - DNA, 21 bp, Homo sapiens
cccagttggaggagactgggc

SEQ ID NO: 4338948 - DNA, 17 bp, Homo sapiens
cccatagagaccaggag

SEQ ID NO: 4338949 - DNA, 22 bp, Homo sapiens
cccatcccgtaagaccaccttc

SEQ ID NO: 4338950 - DNA, 19 bp, Homo sapiens
cccatctctacaaaaagca

SEQ ID NO: 4338951 - DNA, 19 bp, Homo sapiens
cccatgaagctggccctca

SEQ ID NO: 4338952 - DNA, 22 bp, Homo sapiens
cccatgttgggtttgagacaga

SEQ ID NO: 4338953 - DNA, 17 bp, Homo sapiens
cccatttttgctaatta

SEQ ID NO: 4338954 - DNA, 22 bp, Homo sapiens
cccatttttgctaattatcaat

SEQ ID NO: 4338955 - DNA, 19 bp, Homo sapiens
ccccaaaggaaaaagcaca

SEQ ID NO: 4338956 - DNA, 13 bp, Homo sapiens
ccccaaccccagc

SEQ ID NO: 4338957 - DNA, 14 bp, Homo sapiens
ccccaacccctgag

SEQ ID NO: 4338958 - DNA, 15 bp, Homo sapiens
ccccaatccagagaa

SEQ ID NO: 4338959 - DNA, 13 bp, Homo sapiens
ccccacagccctg

SEQ ID NO: 4338960 - DNA, 13 bp, Homo sapiens
ccccacctgacct

SEQ ID NO: 4338961 - DNA, 18 bp, Homo sapiens
ccccacctgacctctgca

SEQ ID NO: 4338962 - DNA, 15 bp, Homo sapiens
ccccagaaattattg

SEQ ID NO: 4338963 - DNA, 11 bp, Homo sapiens
ccccagccccc

SEQ ID NO: 4338964 - DNA, 13 bp, Homo sapiens
ccccagcccccac

SEQ ID NO: 4338965 - DNA, 19 bp, Homo sapiens
ccccagcccccacagccct

SEQ ID NO: 4338966 - DNA, 15 bp, Homo sapiens
ccccagcgtcttgac

SEQ ID NO: 4338967 - DNA, 17 bp, Homo sapiens
ccccagctcccccaggc

SEQ ID NO: 4338968 - DNA, 22 bp, Homo sapiens
ccccaggtggttatggagaggg

SEQ ID NO: 4338969 - DNA, 12 bp, Homo sapiens
ccccagtgcccg

SEQ ID NO: 4338970 - DNA, 18 bp, Homo sapiens
ccccagtgcccggtgcag

SEQ ID NO: 4338971 - DNA, 19 bp, Homo sapiens
ccccagttggcccttctgc

SEQ ID NO: 4338972 - DNA, 20 bp, Homo sapiens
ccccatagagaccaggaggg

SEQ ID NO: 4338973 - DNA, 11 bp, Homo sapiens
ccccattccta

SEQ ID NO: 4338974 - DNA, 15 bp, Homo sapiens
cccccaccccagagt

SEQ ID NO: 4338975 - DNA, 22 bp, Homo sapiens
ccccctgaaacatgtgcccctg

SEQ ID NO: 4338976 - DNA, 12 bp, Homo sapiens
attggaaatgga

SEQ ID NO: 4338977 - DNA, 19 bp, Homo sapiens
attggatttgctgtgacta

SEQ ID NO: 4338978 - DNA, 17 bp, Homo sapiens
attggtcatggtagatt

SEQ ID NO: 4338979 - DNA, 17 bp, Homo sapiens
attggttaaaatgtgat

SEQ ID NO: 4338980 - DNA, 15 bp, Homo sapiens
attggttagtattta

SEQ ID NO: 4338981 - DNA, 15 bp, Homo sapiens
attgtaaattttaga

SEQ ID NO: 4338982 - DNA, 14 bp, Homo sapiens
attgtagttcttag

SEQ ID NO: 4338983 - DNA, 23 bp, Homo sapiens
attgtccagctgggacctaatgc

SEQ ID NO: 4338984 - DNA, 22 bp, Homo sapiens
attgtctttcattttgcctgag

SEQ ID NO: 4338985 - DNA, 17 bp, Homo sapiens
attgtgcttctccccag

SEQ ID NO: 4338986 - DNA, 19 bp, Homo sapiens
attgtgcttctccccagaa

SEQ ID NO: 4338987 - DNA, 22 bp, Homo sapiens
attgtttatacacaactttgca

SEQ ID NO: 4338988 - DNA, 14 bp, Homo sapiens
attgtttgaaagac

SEQ ID NO: 4338989 - DNA, 16 bp, Homo sapiens
attgtttgaaagactt

SEQ ID NO: 4338990 - DNA, 14 bp, Homo sapiens
attgttttgaatat

SEQ ID NO: 4338991 - DNA, 11 bp, Homo sapiens
attgtttttct

SEQ ID NO: 4338992 - DNA, 19 bp, Homo sapiens
attgtttttctttctacaa

SEQ ID NO: 4338993 - DNA, 14 bp, Homo sapiens
atttaaaaaaaatc

SEQ ID NO: 4338994 - DNA, 13 bp, Homo sapiens
atttaaaaaatta

SEQ ID NO: 4338995 - DNA, 17 bp, Homo sapiens
atttaaaaaattaaaaa

SEQ ID NO: 4338996 - DNA, 19 bp, Homo sapiens
atttaaactctgccagaaa

SEQ ID NO: 4338997 - DNA, 18 bp, Homo sapiens
atttaaaggtacaatcaa

SEQ ID NO: 4338998 - DNA, 17 bp, Homo sapiens
atttacaggacttctct

SEQ ID NO: 4338999 - DNA, 20 bp, Homo sapiens
atttagagcgtttggttaaa

SEQ ID NO: 4339000 - DNA, 22 bp, Homo sapiens
atttagagcgtttggttaaagt

SEQ ID NO: 4339001 - DNA, 16 bp, Homo sapiens
atttagccattaccca

SEQ ID NO: 4339002 - DNA, 13 bp, Homo sapiens
atttatatcttgt

SEQ ID NO: 4339003 - DNA, 12 bp, Homo sapiens
atttatgagatt

SEQ ID NO: 4339004 - DNA, 18 bp, Homo sapiens
atttatgagatttactgc

SEQ ID NO: 4339005 - DNA, 20 bp, Homo sapiens
atttattgcttagtgaaaat

SEQ ID NO: 4339006 - DNA, 14 bp, Homo sapiens
atttatttctctgg

SEQ ID NO: 4339007 - DNA, 14 bp, Homo sapiens
atttcaattctcaa

SEQ ID NO: 4339008 - DNA, 10 bp, Homo sapiens
atttcacagt

SEQ ID NO: 4339009 - DNA, 20 bp, Homo sapiens
atttcagattttaaaaaggg

SEQ ID NO: 4339010 - DNA, 17 bp, Homo sapiens
atttcagtagaatttta

SEQ ID NO: 4339011 - DNA, 17 bp, Homo sapiens
atttcattccattgcct

SEQ ID NO: 4339012 - DNA, 22 bp, Homo sapiens
atttccaaaataatctatatta

SEQ ID NO: 4339013 - DNA, 17 bp, Homo sapiens
atttccagccaaagcct

SEQ ID NO: 4339014 - DNA, 18 bp, Homo sapiens
atttcccttttttcttcc

SEQ ID NO: 4339015 - DNA, 19 bp, Homo sapiens
atttctctggcaaactttt

SEQ ID NO: 4339016 - DNA, 16 bp, Homo sapiens
atttctgctttctttg

SEQ ID NO: 4339017 - DNA, 19 bp, Homo sapiens
atttctgtggaaaacaatt

SEQ ID NO: 4339018 - DNA, 23 bp, Homo sapiens
atttctgtggaaaacaatttgca

SEQ ID NO: 4339019 - DNA, 15 bp, Homo sapiens
atttcttaatgtctg

SEQ ID NO: 4339020 - DNA, 20 bp, Homo sapiens
atttcttaatgtctgtcaga

SEQ ID NO: 4339021 - DNA, 22 bp, Homo sapiens
atttcttagtgcttcagagttt

SEQ ID NO: 4339022 - DNA, 18 bp, Homo sapiens
atttcttgtgatgtattc

SEQ ID NO: 4339023 - DNA, 15 bp, Homo sapiens
atttctttgtagaat

SEQ ID NO: 4339024 - DNA, 15 bp, Homo sapiens
atttgaaaaactttt

SEQ ID NO: 4339025 - DNA, 18 bp, Homo sapiens
atttgaaaataattgttc

SEQ ID NO: 4339026 - DNA, 18 bp, Homo sapiens
atttgaataataaatcga

SEQ ID NO: 4339027 - DNA, 19 bp, Homo sapiens
atttgaggactgaagctgg

SEQ ID NO: 4339028 - DNA, 14 bp, Homo sapiens
atttgatctttgtt

SEQ ID NO: 4339029 - DNA, 21 bp, Homo sapiens
atttgatctttgtttaaatgc

SEQ ID NO: 4339030 - DNA, 23 bp, Homo sapiens
atttggagcattaactaaatgct

SEQ ID NO: 4339031 - DNA, 18 bp, Homo sapiens
atttggcaaaacaaaatg

SEQ ID NO: 4339032 - DNA, 13 bp, Homo sapiens
atttggcttgctg

SEQ ID NO: 4339033 - DNA, 15 bp, Homo sapiens
atttggcttgctgtt

SEQ ID NO: 4339034 - DNA, 21 bp, Homo sapiens
atttgggagggaaaagggaag

SEQ ID NO: 4339035 - DNA, 21 bp, Homo sapiens
atttgtagataccgagaatga

SEQ ID NO: 4339036 - DNA, 23 bp, Homo sapiens
atttgtataaattaaataaactg

SEQ ID NO: 4339037 - DNA, 17 bp, Homo sapiens
atttgtattaataaagc

SEQ ID NO: 4339038 - DNA, 22 bp, Homo sapiens
atttgttagccacggaaacata

SEQ ID NO: 4339039 - DNA, 22 bp, Homo sapiens
atttgttccacccgacctctga

SEQ ID NO: 4339040 - DNA, 17 bp, Homo sapiens
attttaaaaaatatata

SEQ ID NO: 4339041 - DNA, 21 bp, Homo sapiens
attttaaaaagggtaacttgt

SEQ ID NO: 4339042 - DNA, 15 bp, Homo sapiens
attttaaagacccaa

SEQ ID NO: 4339043 - DNA, 18 bp, Homo sapiens
attttaaagacccaactt

SEQ ID NO: 4339044 - DNA, 13 bp, Homo sapiens
attttaagtgctt

SEQ ID NO: 4339045 - DNA, 15 bp, Homo sapiens
attttactatttggg

SEQ ID NO: 4339046 - DNA, 15 bp, Homo sapiens
attttattgggaggg

SEQ ID NO: 4339047 - DNA, 15 bp, Homo sapiens
attttattttttaaa

SEQ ID NO: 4339048 - DNA, 16 bp, Homo sapiens
attttcattgtgattt

SEQ ID NO: 4339049 - DNA, 15 bp, Homo sapiens
attttccagccttat

SEQ ID NO: 4339050 - DNA, 17 bp, Homo sapiens
attttccagccttatgt

SEQ ID NO: 4339051 - DNA, 21 bp, Homo sapiens
attttctgtgtaaaatgagta

SEQ ID NO: 4339052 - DNA, 21 bp, Homo sapiens
attttgataataatattgttt

SEQ ID NO: 4339053 - DNA, 15 bp, Homo sapiens
attttgcctgagtgt

SEQ ID NO: 4339054 - DNA, 13 bp, Homo sapiens
attttgcctgtgt

SEQ ID NO: 4339055 - DNA, 20 bp, Homo sapiens
attttgctaaatgtgaatga

SEQ ID NO: 4339056 - DNA, 18 bp, Homo sapiens
attttgttttaatctact

SEQ ID NO: 4339057 - DNA, 22 bp, Homo sapiens
attttgttttaatctacttttt

SEQ ID NO: 4339058 - DNA, 13 bp, Homo sapiens
atttttaaagaag

SEQ ID NO: 4339059 - DNA, 17 bp, Homo sapiens
atttttatgtggtctta

SEQ ID NO: 4339060 - DNA, 13 bp, Homo sapiens
atttttgaagact

SEQ ID NO: 4339061 - DNA, 21 bp, Homo sapiens
caaaaactgactttatttatt

SEQ ID NO: 4339062 - DNA, 16 bp, Homo sapiens
caaaaacttttcattt

SEQ ID NO: 4339063 - DNA, 20 bp, Homo sapiens
caaaaacttttcatttcaga

SEQ ID NO: 4339064 - DNA, 21 bp, Homo sapiens
caaaaacttttcatttcagat

SEQ ID NO: 4339065 - DNA, 13 bp, Homo sapiens
caaaaaggcagga

SEQ ID NO: 4339066 - DNA, 13 bp, Homo sapiens
caaaacaaagctg

SEQ ID NO: 4339067 - DNA, 17 bp, Homo sapiens
caaaacaaagctgattt

SEQ ID NO: 4339068 - DNA, 13 bp, Homo sapiens
caaaactgctttg

SEQ ID NO: 4339069 - DNA, 18 bp, Homo sapiens
caaaactgctttgtgcat

SEQ ID NO: 4339070 - DNA, 15 bp, Homo sapiens
atgtgcgaagcaaga

SEQ ID NO: 4339071 - DNA, 16 bp, Homo sapiens
atgtgcgaagcaagaa

SEQ ID NO: 4339072 - DNA, 23 bp, Homo sapiens
atgtgcgaagcaagaagaattga

SEQ ID NO: 4339073 - DNA, 22 bp, Homo sapiens
atgtgctgatgtttacaatgat

SEQ ID NO: 4339074 - DNA, 22 bp, Homo sapiens
atgtggtcttatgattttatta

SEQ ID NO: 4339075 - DNA, 13 bp, Homo sapiens
atgtggtgagaat

SEQ ID NO: 4339076 - DNA, 15 bp, Homo sapiens
atgtggttcttcaaa

SEQ ID NO: 4339077 - DNA, 22 bp, Homo sapiens
atgtgtagttgtctctcttcag

SEQ ID NO: 4339078 - DNA, 17 bp, Homo sapiens
atgtgtatctatttata

SEQ ID NO: 4339079 - DNA, 23 bp, Homo sapiens
atgtgtctgtgttgcttcaaatt

SEQ ID NO: 4339080 - DNA, 17 bp, Homo sapiens
atgtgtgcttatacaat

SEQ ID NO: 4339081 - DNA, 15 bp, Homo sapiens
atgtgtttttctcca

SEQ ID NO: 4339082 - DNA, 12 bp, Homo sapiens
atgttaaagctt

SEQ ID NO: 4339083 - DNA, 16 bp, Homo sapiens
atgttaagcatggatt

SEQ ID NO: 4339084 - DNA, 13 bp, Homo sapiens
atgttagagtcat

SEQ ID NO: 4339085 - DNA, 16 bp, Homo sapiens
atgttctaaattctat

SEQ ID NO: 4339086 - DNA, 22 bp, Homo sapiens
atgttctaaattctataaaaac

SEQ ID NO: 4339087 - DNA, 17 bp, Homo sapiens
atgttctctcttctcca

SEQ ID NO: 4339088 - DNA, 23 bp, Homo sapiens
atgttgctctgggagacttactg

SEQ ID NO: 4339089 - DNA, 22 bp, Homo sapiens
atgttggacagacactgttgca

SEQ ID NO: 4339090 - DNA, 12 bp, Homo sapiens
atgttggctgcg

SEQ ID NO: 4339091 - DNA, 20 bp, Homo sapiens
atgttggctgcgtactccac

SEQ ID NO: 4339092 - DNA, 21 bp, Homo sapiens
atgtttaatgaagtcactatt

SEQ ID NO: 4339093 - DNA, 15 bp, Homo sapiens
atgtttacaatgatg

SEQ ID NO: 4339094 - DNA, 20 bp, Homo sapiens
atgtttcatacagctattaa

SEQ ID NO: 4339095 - DNA, 15 bp, Homo sapiens
atgtttcttctccaa

SEQ ID NO: 4339096 - DNA, 19 bp, Homo sapiens
atgtttgtctgtgtgctgt

SEQ ID NO: 4339097 - DNA, 14 bp, Homo sapiens
attaaataaactgt

SEQ ID NO: 4339098 - DNA, 15 bp, Homo sapiens
attaaataaactgtt

SEQ ID NO: 4339099 - DNA, 22 bp, Homo sapiens
attaaataaactgttttcaagt

SEQ ID NO: 4339100 - DNA, 12 bp, Homo sapiens
attaaatgatat

SEQ ID NO: 4339101 - DNA, 17 bp, Homo sapiens
attaaccacttcagctg

SEQ ID NO: 4339102 - DNA, 13 bp, Homo sapiens
attaactaaatgc

SEQ ID NO: 4339103 - DNA, 14 bp, Homo sapiens
attaagaactgaat

SEQ ID NO: 4339104 - DNA, 13 bp, Homo sapiens
attaaggaagaca

SEQ ID NO: 4339105 - DNA, 20 bp, Homo sapiens
attaagtcagtggctttgca

SEQ ID NO: 4339106 - DNA, 12 bp, Homo sapiens
attaataaagca

SEQ ID NO: 4339107 - DNA, 16 bp, Homo sapiens
attaataaagcattct

SEQ ID NO: 4339108 - DNA, 18 bp, Homo sapiens
attacaaggtgtcctcag

SEQ ID NO: 4339109 - DNA, 19 bp, Homo sapiens
attaccatagagtaatgat

SEQ ID NO: 4339110 - DNA, 22 bp, Homo sapiens
attaccatagagtaatgatgta

SEQ ID NO: 4339111 - DNA, 14 bp, Homo sapiens
attactcctatttt

SEQ ID NO: 4339112 - DNA, 21 bp, Homo sapiens
attactcctatttttgtaaac

SEQ ID NO: 4339113 - DNA, 16 bp, Homo sapiens
attacttgtgcactta

SEQ ID NO: 4339114 - DNA, 13 bp, Homo sapiens
attactttaacct

SEQ ID NO: 4339115 - DNA, 23 bp, Homo sapiens
attagggaaaatggatatagaaa

SEQ ID NO: 4339116 - DNA, 18 bp, Homo sapiens
attagggcaattggaaca

SEQ ID NO: 4339117 - DNA, 23 bp, Homo sapiens
attagggcaattggaacaaagtg

SEQ ID NO: 4339118 - DNA, 16 bp, Homo sapiens
attagtccaaatgtga

SEQ ID NO: 4339119 - DNA, 23 bp, Homo sapiens
attagtccaaatgtgatcaactg

SEQ ID NO: 4339120 - DNA, 21 bp, Homo sapiens
attagtcgggcatgagtctgt

SEQ ID NO: 4339121 - DNA, 18 bp, Homo sapiens
attataaaattgaaaaca

SEQ ID NO: 4339122 - DNA, 20 bp, Homo sapiens
attataagagagcttattgt

SEQ ID NO: 4339123 - DNA, 22 bp, Homo sapiens
attataccccatgatacctatt

SEQ ID NO: 4339124 - DNA, 17 bp, Homo sapiens
attatcagtagaaagag

SEQ ID NO: 4339125 - DNA, 21 bp, Homo sapiens
attatcagtagaaagagtgtt

SEQ ID NO: 4339126 - DNA, 15 bp, Homo sapiens
attatgaaatatggt

SEQ ID NO: 4339127 - DNA, 16 bp, Homo sapiens
attatgcactaaatat

SEQ ID NO: 4339128 - DNA, 18 bp, Homo sapiens
attatgcactaaatatga

SEQ ID NO: 4339129 - DNA, 17 bp, Homo sapiens
attatgggtatgtgttg

SEQ ID NO: 4339130 - DNA, 23 bp, Homo sapiens
attatgggtatgtgttgccaaag

SEQ ID NO: 4339131 - DNA, 16 bp, Homo sapiens
attattagattgccaa

SEQ ID NO: 4339132 - DNA, 13 bp, Homo sapiens
attattgaaatag

SEQ ID NO: 4339133 - DNA, 15 bp, Homo sapiens
attattgatatatat

SEQ ID NO: 4339134 - DNA, 19 bp, Homo sapiens
attattgcttattgcttag

SEQ ID NO: 4339135 - DNA, 23 bp, Homo sapiens
attatttattacttgtgcactta

SEQ ID NO: 4339136 - DNA, 23 bp, Homo sapiens
attattttgaggtagaggaaaat

SEQ ID NO: 4339137 - DNA, 20 bp, Homo sapiens
attcaaaggtggattacaag

SEQ ID NO: 4339138 - DNA, 18 bp, Homo sapiens
attcaagtaacactttaa

SEQ ID NO: 4339139 - DNA, 20 bp, Homo sapiens
attcaatatttactgagact

SEQ ID NO: 4339140 - DNA, 14 bp, Homo sapiens
attcaatttggcaa

SEQ ID NO: 4339141 - DNA, 21 bp, Homo sapiens
attcagaggaaaaacagagga

SEQ ID NO: 4339142 - DNA, 18 bp, Homo sapiens
attcagctagaatttctg

SEQ ID NO: 4339143 - DNA, 20 bp, Homo sapiens
attcattctcataattccta

SEQ ID NO: 4339144 - DNA, 14 bp, Homo sapiens
attcattctgagcc

SEQ ID NO: 4339145 - DNA, 15 bp, Homo sapiens
attcattctgagccc

SEQ ID NO: 4339146 - DNA, 19 bp, Homo sapiens
attccaacttcctccttca

SEQ ID NO: 4339147 - DNA, 19 bp, Homo sapiens
attccattgcctagctctt

SEQ ID NO: 4339148 - DNA, 20 bp, Homo sapiens
attccattgcctagctcttt

SEQ ID NO: 4339149 - DNA, 17 bp, Homo sapiens
attcctacagcactact

SEQ ID NO: 4339150 - DNA, 23 bp, Homo sapiens
attcctacagcactactgggtgt

SEQ ID NO: 4339151 - DNA, 22 bp, Homo sapiens
attcctcagttgttaacttcta

SEQ ID NO: 4339152 - DNA, 18 bp, Homo sapiens
attcctggaaaccacagt

SEQ ID NO: 4339153 - DNA, 14 bp, Homo sapiens
attcctgttctctt

SEQ ID NO: 4339154 - DNA, 17 bp, Homo sapiens
attccttacttgcactg

SEQ ID NO: 4339155 - DNA, 19 bp, Homo sapiens
attcgcccgagctgtttat

SEQ ID NO: 4339156 - DNA, 16 bp, Homo sapiens
attctcataattccta

SEQ ID NO: 4339157 - DNA, 17 bp, Homo sapiens
attctcataattcctac

SEQ ID NO: 4339158 - DNA, 18 bp, Homo sapiens
attctcataattcctaca

SEQ ID NO: 4339159 - DNA, 16 bp, Homo sapiens
attctccttttatgtg

SEQ ID NO: 4339160 - DNA, 17 bp, Homo sapiens
attctccttttatgtgt

SEQ ID NO: 4339161 - DNA, 19 bp, Homo sapiens
attctctcaagacttctcc

SEQ ID NO: 4339162 - DNA, 14 bp, Homo sapiens
attctgaaatactt

SEQ ID NO: 4339163 - DNA, 16 bp, Homo sapiens
attctgaaatactttt

SEQ ID NO: 4339164 - DNA, 16 bp, Homo sapiens
attctgcattgagaag

SEQ ID NO: 4339165 - DNA, 22 bp, Homo sapiens
attcttggtcaagtttttctct

SEQ ID NO: 4339166 - DNA, 13 bp, Homo sapiens
attctttgcattc

SEQ ID NO: 4339167 - DNA, 15 bp, Homo sapiens
attgaaaaaggaaaa

SEQ ID NO: 4339168 - DNA, 15 bp, Homo sapiens
attgaaagttgcttt

SEQ ID NO: 4339169 - DNA, 16 bp, Homo sapiens
attgaaagttgctttt

SEQ ID NO: 4339170 - DNA, 19 bp, Homo sapiens
attgaaagttgcttttatt

SEQ ID NO: 4339171 - DNA, 23 bp, Homo sapiens
attgaaatagtttccaagaaatt

SEQ ID NO: 4339172 - DNA, 16 bp, Homo sapiens
attgaatgtttccaac

SEQ ID NO: 4339173 - DNA, 13 bp, Homo sapiens
attgagaaaagag

SEQ ID NO: 4339174 - DNA, 16 bp, Homo sapiens
attgagaataattatt

SEQ ID NO: 4339175 - DNA, 21 bp, Homo sapiens
attgagaataattatttcaga

SEQ ID NO: 4339176 - DNA, 15 bp, Homo sapiens
attgagtcttaactg

SEQ ID NO: 4339177 - DNA, 14 bp, Homo sapiens
attgagtttgtagg

SEQ ID NO: 4339178 - DNA, 16 bp, Homo sapiens
attgatcccttctcct

SEQ ID NO: 4339179 - DNA, 12 bp, Homo sapiens
attgcaccactg

SEQ ID NO: 4339180 - DNA, 15 bp, Homo sapiens
attgcaccattttca

SEQ ID NO: 4339181 - DNA, 17 bp, Homo sapiens
attgcactaggaattct

SEQ ID NO: 4339182 - DNA, 18 bp, Homo sapiens
attgcatttgctgttgtt

SEQ ID NO: 4339183 - DNA, 19 bp, Homo sapiens
attgcatttgctgttgttt

SEQ ID NO: 4339184 - DNA, 20 bp, Homo sapiens
attgccgtcctggactctgt

SEQ ID NO: 4339185 - DNA, 21 bp, Homo sapiens
attgctcagagaaatatgcag

SEQ ID NO: 4339186 - DNA, 22 bp, Homo sapiens
attgctgaagggcattctttcc

SEQ ID NO: 4339187 - DNA, 15 bp, Homo sapiens
attgcttagtaaaat

SEQ ID NO: 4339188 - DNA, 22 bp, Homo sapiens
attgcttagtaaaatttatttc

SEQ ID NO: 4339189 - DNA, 20 bp, Homo sapiens
attgcttagtgaaaatacta

SEQ ID NO: 4339190 - DNA, 21 bp, Homo sapiens
atctcctctgctcattaaact

SEQ ID NO: 4339191 - DNA, 23 bp, Homo sapiens
atctctgcctccaacccagcagt

SEQ ID NO: 4339192 - DNA, 18 bp, Homo sapiens
atctgagggttaatttct

SEQ ID NO: 4339193 - DNA, 19 bp, Homo sapiens
atctgagggttaatttcta

SEQ ID NO: 4339194 - DNA, 20 bp, Homo sapiens
atctgagggttaatttctag

SEQ ID NO: 4339195 - DNA, 19 bp, Homo sapiens
atctgatatgctgagaaat

SEQ ID NO: 4339196 - DNA, 13 bp, Homo sapiens
atctgattagaag

SEQ ID NO: 4339197 - DNA, 23 bp, Homo sapiens
atctgcctcctgtgcctcccttt

SEQ ID NO: 4339198 - DNA, 23 bp, Homo sapiens
atctgggaagatttgaaaacaaa

SEQ ID NO: 4339199 - DNA, 22 bp, Homo sapiens
atctgggcattaagtcagtggc

SEQ ID NO: 4339200 - DNA, 15 bp, Homo sapiens
atctgtgcacactaa

SEQ ID NO: 4339201 - DNA, 20 bp, Homo sapiens
atcttgtgaaatggccagga

SEQ ID NO: 4339202 - DNA, 21 bp, Homo sapiens
atcttttttttaggcaaaacc

SEQ ID NO: 4339203 - DNA, 21 bp, Homo sapiens
atgaaatcatagtatatgatt

SEQ ID NO: 4339204 - DNA, 16 bp, Homo sapiens
atgaaattaacaagaa

SEQ ID NO: 4339205 - DNA, 11 bp, Homo sapiens
atgaagaatgt

SEQ ID NO: 4339206 - DNA, 19 bp, Homo sapiens
atgaagcagaggaaggaaa

SEQ ID NO: 4339207 - DNA, 22 bp, Homo sapiens
atgaagtaaagccattaaatga

SEQ ID NO: 4339208 - DNA, 18 bp, Homo sapiens
atgaagtttgaacttcat

SEQ ID NO: 4339209 - DNA, 14 bp, Homo sapiens
atgaatattttgat

SEQ ID NO: 4339210 - DNA, 17 bp, Homo sapiens
atgaattcttatgctta

SEQ ID NO: 4339211 - DNA, 20 bp, Homo sapiens
atgacacagcttgtgaatgt

SEQ ID NO: 4339212 - DNA, 16 bp, Homo sapiens
atgactattgtaatgc

SEQ ID NO: 4339213 - DNA, 18 bp, Homo sapiens
atgactattgtaatgcca

SEQ ID NO: 4339214 - DNA, 14 bp, Homo sapiens
atgactgctgattt

SEQ ID NO: 4339215 - DNA, 21 bp, Homo sapiens
atgagaaaaatattcaagtaa

SEQ ID NO: 4339216 - DNA, 19 bp, Homo sapiens
atgagaatctgtgcagtca

SEQ ID NO: 4339217 - DNA, 15 bp, Homo sapiens
atgagactaagagaa

SEQ ID NO: 4339218 - DNA, 19 bp, Homo sapiens
atgagattttggaagaagt

SEQ ID NO: 4339219 - DNA, 14 bp, Homo sapiens
atgagcctggcaag

SEQ ID NO: 4339220 - DNA, 14 bp, Homo sapiens
atgagcctgtccaa

SEQ ID NO: 4339221 - DNA, 18 bp, Homo sapiens
atgagtctgtttcccaag

SEQ ID NO: 4339222 - DNA, 20 bp, Homo sapiens
atgagttgctggaaaatcat

SEQ ID NO: 4339223 - DNA, 15 bp, Homo sapiens
atgataaaacacaaa

SEQ ID NO: 4339224 - DNA, 15 bp, Homo sapiens
atgatacagtcagga

SEQ ID NO: 4339225 - DNA, 17 bp, Homo sapiens
atgatacccaacagttt

SEQ ID NO: 4339226 - DNA, 19 bp, Homo sapiens
atgatacccaacagtttat

SEQ ID NO: 4339227 - DNA, 13 bp, Homo sapiens
atgatatatttat

SEQ ID NO: 4339228 - DNA, 22 bp, Homo sapiens
atgatcatctgtaatctgaggg

SEQ ID NO: 4339229 - DNA, 16 bp, Homo sapiens
atgatcctaggcattt

SEQ ID NO: 4339230 - DNA, 13 bp, Homo sapiens
atgatggaaaaat

SEQ ID NO: 4339231 - DNA, 15 bp, Homo sapiens
atgatggaaaaatca

SEQ ID NO: 4339232 - DNA, 19 bp, Homo sapiens
atgatggaacttagactcc

SEQ ID NO: 4339233 - DNA, 20 bp, Homo sapiens
atgattaaccacttcagctg

SEQ ID NO: 4339234 - DNA, 21 bp, Homo sapiens
atgattaaccacttcagctga

SEQ ID NO: 4339235 - DNA, 18 bp, Homo sapiens
atgattataagagagctt

SEQ ID NO: 4339236 - DNA, 20 bp, Homo sapiens
atgattggttaaaatgtgat

SEQ ID NO: 4339237 - DNA, 16 bp, Homo sapiens
atgattggttcagttt

SEQ ID NO: 4339238 - DNA, 15 bp, Homo sapiens
atgcaaactgcttta

SEQ ID NO: 4339239 - DNA, 18 bp, Homo sapiens
atgcaaagtacaatgtgt

SEQ ID NO: 4339240 - DNA, 19 bp, Homo sapiens
atgcaaagtacaatgtgtt

SEQ ID NO: 4339241 - DNA, 22 bp, Homo sapiens
atgcaagaatttctggaagaaa

SEQ ID NO: 4339242 - DNA, 18 bp, Homo sapiens
atgcacagatatactttg

SEQ ID NO: 4339243 - DNA, 17 bp, Homo sapiens
atgcagaacgtatttag

SEQ ID NO: 4339244 - DNA, 22 bp, Homo sapiens
atgcagaacgtatttagccatt

SEQ ID NO: 4339245 - DNA, 22 bp, Homo sapiens
atgcaggcacttattgtaaatt

SEQ ID NO: 4339246 - DNA, 19 bp, Homo sapiens
atgcattttcttcagaatt

SEQ ID NO: 4339247 - DNA, 19 bp, Homo sapiens
atgccaggcggacaaagtt

SEQ ID NO: 4339248 - DNA, 22 bp, Homo sapiens
atgcccaccgaggagccccagc

SEQ ID NO: 4339249 - DNA, 23 bp, Homo sapiens
atgcccttccccctttctctgcc

SEQ ID NO: 4339250 - DNA, 18 bp, Homo sapiens
atgcctggtctttcctct

SEQ ID NO: 4339251 - DNA, 17 bp, Homo sapiens
atgccttcgggaaaatt

SEQ ID NO: 4339252 - DNA, 14 bp, Homo sapiens
atgctaatggaatt

SEQ ID NO: 4339253 - DNA, 22 bp, Homo sapiens
atgctattttaaaaaatatata

SEQ ID NO: 4339254 - DNA, 12 bp, Homo sapiens
atgctctaacaa

SEQ ID NO: 4339255 - DNA, 14 bp, Homo sapiens
atgctgagaaatta

SEQ ID NO: 4339256 - DNA, 20 bp, Homo sapiens
atgctgagctgaagaaatta

SEQ ID NO: 4339257 - DNA, 22 bp, Homo sapiens
atgctgctaaagggagaaatgc

SEQ ID NO: 4339258 - DNA, 15 bp, Homo sapiens
atgctggcctgactg

SEQ ID NO: 4339259 - DNA, 17 bp, Homo sapiens
atgctgtatttctttgt

SEQ ID NO: 4339260 - DNA, 16 bp, Homo sapiens
atgcttccagaatggg

SEQ ID NO: 4339261 - DNA, 16 bp, Homo sapiens
atgcttctcactgcca

SEQ ID NO: 4339262 - DNA, 20 bp, Homo sapiens
atgcttctcatcttgtgaaa

SEQ ID NO: 4339263 - DNA, 21 bp, Homo sapiens
atgcttctcatcttgtgaaat

SEQ ID NO: 4339264 - DNA, 14 bp, Homo sapiens
atggaacttagact

SEQ ID NO: 4339265 - DNA, 15 bp, Homo sapiens
atggactggtttgag

SEQ ID NO: 4339266 - DNA, 17 bp, Homo sapiens
atggactggtttgagat

SEQ ID NO: 4339267 - DNA, 22 bp, Homo sapiens
atggagaaaatgaatggacaaa

SEQ ID NO: 4339268 - DNA, 12 bp, Homo sapiens
atggagactctg

SEQ ID NO: 4339269 - DNA, 15 bp, Homo sapiens
atggagactctgaga

SEQ ID NO: 4339270 - DNA, 16 bp, Homo sapiens
atggagactctgagag

SEQ ID NO: 4339271 - DNA, 12 bp, Homo sapiens
atggagaggaag

SEQ ID NO: 4339272 - DNA, 21 bp, Homo sapiens
atggagcaaaacaaagctgat

SEQ ID NO: 4339273 - DNA, 15 bp, Homo sapiens
atggagtgtttgaaa

SEQ ID NO: 4339274 - DNA, 17 bp, Homo sapiens
atggagtgtttgaaaac

SEQ ID NO: 4339275 - DNA, 20 bp, Homo sapiens
atggagtgtttgaaaactga

SEQ ID NO: 4339276 - DNA, 15 bp, Homo sapiens
atggatgacaaagaa

SEQ ID NO: 4339277 - DNA, 16 bp, Homo sapiens
atggatgacaaagaaa

SEQ ID NO: 4339278 - DNA, 17 bp, Homo sapiens
atggatgacaaagaaaa

SEQ ID NO: 4339279 - DNA, 13 bp, Homo sapiens
atggatgcaaagt

SEQ ID NO: 4339280 - DNA, 21 bp, Homo sapiens
atggccgggcgcggtggctca

SEQ ID NO: 4339281 - DNA, 19 bp, Homo sapiens
atgggaaataaagaaaatt

SEQ ID NO: 4339282 - DNA, 16 bp, Homo sapiens
atgggaaatgagccag

SEQ ID NO: 4339283 - DNA, 18 bp, Homo sapiens
atgggactctgaactgga

SEQ ID NO: 4339284 - DNA, 14 bp, Homo sapiens
atgggcagggaagg

SEQ ID NO: 4339285 - DNA, 12 bp, Homo sapiens
atgggccaccgc

SEQ ID NO: 4339286 - DNA, 11 bp, Homo sapiens
atgtaattgtt

SEQ ID NO: 4339287 - DNA, 12 bp, Homo sapiens
atgtacatctct

SEQ ID NO: 4339288 - DNA, 15 bp, Homo sapiens
atgtacttaaatgag

SEQ ID NO: 4339289 - DNA, 19 bp, Homo sapiens
atgtagccttagagcatct

SEQ ID NO: 4339290 - DNA, 16 bp, Homo sapiens
atgtatatatattctc

SEQ ID NO: 4339291 - DNA, 14 bp, Homo sapiens
atgtatttatattt

SEQ ID NO: 4339292 - DNA, 16 bp, Homo sapiens
atgtatttttctacat

SEQ ID NO: 4339293 - DNA, 23 bp, Homo sapiens
atgtatttttctacattattgct

SEQ ID NO: 4339294 - DNA, 20 bp, Homo sapiens
atgtcaaagagaaaacttat

SEQ ID NO: 4339295 - DNA, 14 bp, Homo sapiens
atgtcaatcttaag

SEQ ID NO: 4339296 - DNA, 14 bp, Homo sapiens
atgtcagactttgc

SEQ ID NO: 4339297 - DNA, 15 bp, Homo sapiens
atgtcagactttgct

SEQ ID NO: 4339298 - DNA, 21 bp, Homo sapiens
atgtcagactttgctgcattt

SEQ ID NO: 4339299 - DNA, 16 bp, Homo sapiens
atgtctgtatccccag

SEQ ID NO: 4339300 - DNA, 21 bp, Homo sapiens
atgtctgtatccccagtgccc

SEQ ID NO: 4339301 - DNA, 15 bp, Homo sapiens
atgtctgtcagaaga

SEQ ID NO: 4339302 - DNA, 18 bp, Homo sapiens
atgtctgtcagaagacac

SEQ ID NO: 4339303 - DNA, 12 bp, Homo sapiens
atgtgaaaagat

SEQ ID NO: 4339304 - DNA, 15 bp, Homo sapiens
atgtgaagaaataag

SEQ ID NO: 4339305 - DNA, 23 bp, Homo sapiens
atgtgaagacagagcagatcagt

SEQ ID NO: 4339306 - DNA, 20 bp, Homo sapiens
atgtgcagatatccaaacaa

SEQ ID NO: 4339307 - DNA, 13 bp, Homo sapiens
atgtgcccctgcc

SEQ ID NO: 4339308 - DNA, 14 bp, Homo sapiens
atgtgcccctgcca

SEQ ID NO: 4339309 - DNA, 17 bp, Homo sapiens
atgtgcccctgccaagg

SEQ ID NO: 4339310 - DNA, 16 bp, Homo sapiens
atagaaacatacacaa

SEQ ID NO: 4339311 - DNA, 14 bp, Homo sapiens
atagaaagacatgg

SEQ ID NO: 4339312 - DNA, 14 bp, Homo sapiens
atagagaccaggag

SEQ ID NO: 4339313 - DNA, 19 bp, Homo sapiens
atagatttgaaaaactttt

SEQ ID NO: 4339314 - DNA, 15 bp, Homo sapiens
atagcagtgttctct

SEQ ID NO: 4339315 - DNA, 17 bp, Homo sapiens
atagcagtgttctctct

SEQ ID NO: 4339316 - DNA, 17 bp, Homo sapiens
atagcatggggcccctg

SEQ ID NO: 4339317 - DNA, 20 bp, Homo sapiens
atagcatggggcccctggcc

SEQ ID NO: 4339318 - DNA, 16 bp, Homo sapiens
atagctcccaaaagaa

SEQ ID NO: 4339319 - DNA, 11 bp, Homo sapiens
ataggaattca

SEQ ID NO: 4339320 - DNA, 15 bp, Homo sapiens
atagggagaaaccaa

SEQ ID NO: 4339321 - DNA, 15 bp, Homo sapiens
ataggtgcaaacaaa

SEQ ID NO: 4339322 - DNA, 17 bp, Homo sapiens
atagtagaaagacatct

SEQ ID NO: 4339323 - DNA, 14 bp, Homo sapiens
atagtcatatgtga

SEQ ID NO: 4339324 - DNA, 14 bp, Homo sapiens
atagttagattcca

SEQ ID NO: 4339325 - DNA, 13 bp, Homo sapiens
atagttgtctgtg

SEQ ID NO: 4339326 - DNA, 18 bp, Homo sapiens
atagttgtgggtgggaga

SEQ ID NO: 4339327 - DNA, 13 bp, Homo sapiens
atataaagaatat

SEQ ID NO: 4339328 - DNA, 14 bp, Homo sapiens
atataaagaatata

SEQ ID NO: 4339329 - DNA, 23 bp, Homo sapiens
atataatcatgctcatgtatatt

SEQ ID NO: 4339330 - DNA, 21 bp, Homo sapiens
atatactttgtggaccaatta

SEQ ID NO: 4339331 - DNA, 16 bp, Homo sapiens
atatataaagaatata

SEQ ID NO: 4339332 - DNA, 19 bp, Homo sapiens
atatataaagaatatatat

SEQ ID NO: 4339333 - DNA, 11 bp, Homo sapiens
atatatataaa

SEQ ID NO: 4339334 - DNA, 14 bp, Homo sapiens
atatatataaaata

SEQ ID NO: 4339335 - DNA, 12 bp, Homo sapiens
atatatataaag

SEQ ID NO: 4339336 - DNA, 14 bp, Homo sapiens
atatatatatataa

SEQ ID NO: 4339337 - DNA, 15 bp, Homo sapiens
atatatattctcagc

SEQ ID NO: 4339338 - DNA, 12 bp, Homo sapiens
atatatgctgta

SEQ ID NO: 4339339 - DNA, 18 bp, Homo sapiens
atatatgctgtatttctt

SEQ ID NO: 4339340 - DNA, 20 bp, Homo sapiens
atatattgaaagttgctttt

SEQ ID NO: 4339341 - DNA, 16 bp, Homo sapiens
atatatttatatcata

SEQ ID NO: 4339342 - DNA, 19 bp, Homo sapiens
atatcacctctcttcttag

SEQ ID NO: 4339343 - DNA, 19 bp, Homo sapiens
atatcagtcgtgtcaccag

SEQ ID NO: 4339344 - DNA, 15 bp, Homo sapiens
atatcttgttattaa

SEQ ID NO: 4339345 - DNA, 21 bp, Homo sapiens
atatcttgttattaatgtttc

SEQ ID NO: 4339346 - DNA, 18 bp, Homo sapiens
atatgaaccctttgtttc

SEQ ID NO: 4339347 - DNA, 22 bp, Homo sapiens
atatgaccattgaaaaaggaaa

SEQ ID NO: 4339348 - DNA, 23 bp, Homo sapiens
atatgaccattgaaaaaggaaaa

SEQ ID NO: 4339349 - DNA, 17 bp, Homo sapiens
atatgcagaacgtattt

SEQ ID NO: 4339350 - DNA, 19 bp, Homo sapiens
atatgcgggacatgatgct

SEQ ID NO: 4339351 - DNA, 15 bp, Homo sapiens
atatgctacacatat

SEQ ID NO: 4339352 - DNA, 18 bp, Homo sapiens
atatgctcctagagagga

SEQ ID NO: 4339353 - DNA, 19 bp, Homo sapiens
atatgctcctagagaggag

SEQ ID NO: 4339354 - DNA, 16 bp, Homo sapiens
atatgctgagaaatta

SEQ ID NO: 4339355 - DNA, 18 bp, Homo sapiens
atatgcttccagaatggg

SEQ ID NO: 4339356 - DNA, 21 bp, Homo sapiens
atattactacttaccatttgc

SEQ ID NO: 4339357 - DNA, 16 bp, Homo sapiens
atattactgatttaga

SEQ ID NO: 4339358 - DNA, 14 bp, Homo sapiens
atattcaaggcttt

SEQ ID NO: 4339359 - DNA, 15 bp, Homo sapiens
atattcaaggcttta

SEQ ID NO: 4339360 - DNA, 17 bp, Homo sapiens
atattcaagtaacactt

SEQ ID NO: 4339361 - DNA, 19 bp, Homo sapiens
atattgaaagttgctttta

SEQ ID NO: 4339362 - DNA, 18 bp, Homo sapiens
atattgaatgtttccaac

SEQ ID NO: 4339363 - DNA, 16 bp, Homo sapiens
atattgagaataatta

SEQ ID NO: 4339364 - DNA, 17 bp, Homo sapiens
atatttaaaaaattaaa

SEQ ID NO: 4339365 - DNA, 22 bp, Homo sapiens
atatttaaaaaattaaaaatga

SEQ ID NO: 4339366 - DNA, 22 bp, Homo sapiens
atatttagttacgtataatgct

SEQ ID NO: 4339367 - DNA, 23 bp, Homo sapiens
atatttagttacgtataatgctt

SEQ ID NO: 4339368 - DNA, 22 bp, Homo sapiens
atatttatatcatatataaaag

SEQ ID NO: 4339369 - DNA, 14 bp, Homo sapiens
atattttgataata

SEQ ID NO: 4339370 - DNA, 19 bp, Homo sapiens
atatttttttctttttaaa

SEQ ID NO: 4339371 - DNA, 13 bp, Homo sapiens
atcaaaaactgac

SEQ ID NO: 4339372 - DNA, 21 bp, Homo sapiens
atcaaaataaaaattaaatgt

SEQ ID NO: 4339373 - DNA, 15 bp, Homo sapiens
atcaaagacacacag

SEQ ID NO: 4339374 - DNA, 20 bp, Homo sapiens
atcaaagaggttttaaaaaa

SEQ ID NO: 4339375 - DNA, 17 bp, Homo sapiens
atcaacaatgattttct

SEQ ID NO: 4339376 - DNA, 22 bp, Homo sapiens
atcaatgggatatgattggttc

SEQ ID NO: 4339377 - DNA, 12 bp, Homo sapiens
atcacgctcccc

SEQ ID NO: 4339378 - DNA, 16 bp, Homo sapiens
atcagatttcttaatg

SEQ ID NO: 4339379 - DNA, 18 bp, Homo sapiens
atcagcctgctccagctg

SEQ ID NO: 4339380 - DNA, 20 bp, Homo sapiens
atcagcctgctccagctgtt

SEQ ID NO: 4339381 - DNA, 20 bp, Homo sapiens
atcagcctgggcaatgtgat

SEQ ID NO: 4339382 - DNA, 21 bp, Homo sapiens
atcagcctgggcaatgtgata

SEQ ID NO: 4339383 - DNA, 21 bp, Homo sapiens
atcagctttctaatgttctaa

SEQ ID NO: 4339384 - DNA, 14 bp, Homo sapiens
atcagtagaaagag

SEQ ID NO: 4339385 - DNA, 15 bp, Homo sapiens
atcagtagaaagagt

SEQ ID NO: 4339386 - DNA, 22 bp, Homo sapiens
atcagtctttgtcaatgctcta

SEQ ID NO: 4339387 - DNA, 23 bp, Homo sapiens
atcagtctttgtcaatgctctaa

SEQ ID NO: 4339388 - DNA, 19 bp, Homo sapiens
atcagttaaaatcacattt

SEQ ID NO: 4339389 - DNA, 21 bp, Homo sapiens
atcagttaaaatcacatttta

SEQ ID NO: 4339390 - DNA, 18 bp, Homo sapiens
atcataggtatttcaaaa

SEQ ID NO: 4339391 - DNA, 17 bp, Homo sapiens
atcatagtataaatcta

SEQ ID NO: 4339392 - DNA, 16 bp, Homo sapiens
atcatagtatatgatt

SEQ ID NO: 4339393 - DNA, 13 bp, Homo sapiens
atcatattgagaa

SEQ ID NO: 4339394 - DNA, 14 bp, Homo sapiens
atcatattgagaat

SEQ ID NO: 4339395 - DNA, 17 bp, Homo sapiens
atcatattgagaataat

SEQ ID NO: 4339396 - DNA, 16 bp, Homo sapiens
atcatcctcagcagca

SEQ ID NO: 4339397 - DNA, 23 bp, Homo sapiens
atcatcctcagcagcatcgagga

SEQ ID NO: 4339398 - DNA, 17 bp, Homo sapiens
atcatgctcatgtatat

SEQ ID NO: 4339399 - DNA, 15 bp, Homo sapiens
atcatggaatttcca

SEQ ID NO: 4339400 - DNA, 13 bp, Homo sapiens
atcatgtctgtat

SEQ ID NO: 4339401 - DNA, 14 bp, Homo sapiens
atcatgtctgtatc

SEQ ID NO: 4339402 - DNA, 22 bp, Homo sapiens
atcatgtctgtatccccagtgc

SEQ ID NO: 4339403 - DNA, 20 bp, Homo sapiens
atccaaattgtgcttctccc

SEQ ID NO: 4339404 - DNA, 14 bp, Homo sapiens
atccagagaagcgc

SEQ ID NO: 4339405 - DNA, 22 bp, Homo sapiens
atccatgacaggcctgaagata

SEQ ID NO: 4339406 - DNA, 19 bp, Homo sapiens
atccattacgtgcatttaa

SEQ ID NO: 4339407 - DNA, 20 bp, Homo sapiens
atcccaagatggagaggaag

SEQ ID NO: 4339408 - DNA, 15 bp, Homo sapiens
atcccatttaaaaaa

SEQ ID NO: 4339409 - DNA, 12 bp, Homo sapiens
atccccagtgcc

SEQ ID NO: 4339410 - DNA, 13 bp, Homo sapiens
atccccagtgccc

SEQ ID NO: 4339411 - DNA, 21 bp, Homo sapiens
atcccctctctgtggctccaa

SEQ ID NO: 4339412 - DNA, 13 bp, Homo sapiens
atcccttcctcct

SEQ ID NO: 4339413 - DNA, 23 bp, Homo sapiens
atcccttcctcctctcctggaaa

SEQ ID NO: 4339414 - DNA, 17 bp, Homo sapiens
atcccttctcctgccct

SEQ ID NO: 4339415 - DNA, 17 bp, Homo sapiens
atcctacagtacaatca

SEQ ID NO: 4339416 - DNA, 15 bp, Homo sapiens
agtgttcagtgttga

SEQ ID NO: 4339417 - DNA, 19 bp, Homo sapiens
agtgttcagtgttgacata

SEQ ID NO: 4339418 - DNA, 19 bp, Homo sapiens
agtgttctctctgaatgct

SEQ ID NO: 4339419 - DNA, 14 bp, Homo sapiens
agtgttgacatagc

SEQ ID NO: 4339420 - DNA, 20 bp, Homo sapiens
agtgttgacatagcctttgt

SEQ ID NO: 4339421 - DNA, 12 bp, Homo sapiens
agtgtttgaaaa

SEQ ID NO: 4339422 - DNA, 14 bp, Homo sapiens
agtgtttgaaaact

SEQ ID NO: 4339423 - DNA, 14 bp, Homo sapiens
agatgttcaataga

SEQ ID NO: 4339424 - DNA, 15 bp, Homo sapiens
agatgttcaatagaa

SEQ ID NO: 4339425 - DNA, 17 bp, Homo sapiens
agatgttcaatagaaca

SEQ ID NO: 4339426 - DNA, 16 bp, Homo sapiens
agatgttccaaattta

SEQ ID NO: 4339427 - DNA, 19 bp, Homo sapiens
agggcattctttcccagtg

SEQ ID NO: 4339428 - DNA, 16 bp, Homo sapiens
agggccaatggagaaa

SEQ ID NO: 4339429 - DNA, 22 bp, Homo sapiens
agggccgtgcccttgcccttgg

SEQ ID NO: 4339430 - DNA, 21 bp, Homo sapiens
agaactgaatccatatttcaa

SEQ ID NO: 4339431 - DNA, 13 bp, Homo sapiens
agaagaaaagact

SEQ ID NO: 4339432 - DNA, 15 bp, Homo sapiens
agaagaagaggaagt

SEQ ID NO: 4339433 - DNA, 11 bp, Homo sapiens
agaagacacta

SEQ ID NO: 4339434 - DNA, 12 bp, Homo sapiens
agaagacactaa

SEQ ID NO: 4339435 - DNA, 12 bp, Homo sapiens
agaagaggaagt

SEQ ID NO: 4339436 - DNA, 23 bp, Homo sapiens
agaagagttgaggaactgtacag

SEQ ID NO: 4339437 - DNA, 19 bp, Homo sapiens
agaagatcacgctccccgc

SEQ ID NO: 4339438 - DNA, 14 bp, Homo sapiens
accagggagaggcc

SEQ ID NO: 4339439 - DNA, 17 bp, Homo sapiens
accatagggcatgatta

SEQ ID NO: 4339440 - DNA, 22 bp, Homo sapiens
accatgattaaccacttcagct

SEQ ID NO: 4339441 - DNA, 15 bp, Homo sapiens
accatgtatgtggta

SEQ ID NO: 4339442 - DNA, 20 bp, Homo sapiens
accatgtatgtggtatgtat

SEQ ID NO: 4339443 - DNA, 13 bp, Homo sapiens
accattgaaaaag

SEQ ID NO: 4339444 - DNA, 22 bp, Homo sapiens
accattgaaaaaggaaaaatgt

SEQ ID NO: 4339445 - DNA, 16 bp, Homo sapiens
accatttgctactgta

SEQ ID NO: 4339446 - DNA, 15 bp, Homo sapiens
acccaacagtttatt

SEQ ID NO: 4339447 - DNA, 12 bp, Homo sapiens
acccaaggagaa

SEQ ID NO: 4339448 - DNA, 14 bp, Homo sapiens
acccaaggagaacg

SEQ ID NO: 4339449 - DNA, 13 bp, Homo sapiens
acccacaaagaaa

SEQ ID NO: 4339450 - DNA, 12 bp, Homo sapiens
acccacagccct

SEQ ID NO: 4339451 - DNA, 15 bp, Homo sapiens
acccacagccctgaa

SEQ ID NO: 4339452 - DNA, 15 bp, Homo sapiens
acccacctctgccac

SEQ ID NO: 4339453 - DNA, 18 bp, Homo sapiens
acccagaggtggccctcc

SEQ ID NO: 4339454 - DNA, 22 bp, Homo sapiens
acccagaggtggccctcccagg

SEQ ID NO: 4339455 - DNA, 19 bp, Homo sapiens
actccactggtctgtcttt

SEQ ID NO: 4339456 - DNA, 17 bp, Homo sapiens
actcctatttttgtaaa

SEQ ID NO: 4339457 - DNA, 20 bp, Homo sapiens
actcctatttttgtaaactg

SEQ ID NO: 4339458 - DNA, 15 bp, Homo sapiens
actctaaaaatagaa

SEQ ID NO: 4339459 - DNA, 19 bp, Homo sapiens
actctaaaatggacatttt

SEQ ID NO: 4339460 - DNA, 20 bp, Homo sapiens
actctaaagcttctataaaa

SEQ ID NO: 4339461 - DNA, 13 bp, Homo sapiens
actctaccctctt

SEQ ID NO: 4339462 - DNA, 18 bp, Homo sapiens
actctaccctcttagaaa

SEQ ID NO: 4339463 - DNA, 17 bp, Homo sapiens
actctagggaaaaacca

SEQ ID NO: 4339464 - DNA, 19 bp, Homo sapiens
actctataaagaaactttt

SEQ ID NO: 4339465 - DNA, 21 bp, Homo sapiens
actctataaagaaacttttga

SEQ ID NO: 4339466 - DNA, 23 bp, Homo sapiens
actctataaagaaacttttgaaa

SEQ ID NO: 4339467 - DNA, 15 bp, Homo sapiens
actctcagcccagaa

SEQ ID NO: 4339468 - DNA, 21 bp, Homo sapiens
actctcagcccagaagaaaat

SEQ ID NO: 4339469 - DNA, 23 bp, Homo sapiens
actctcttttgaggtccctgtat

SEQ ID NO: 4339470 - DNA, 20 bp, Homo sapiens
actctgcccaccccagcatc

SEQ ID NO: 4339471 - DNA, 11 bp, Homo sapiens
actcttaaaac

SEQ ID NO: 4339472 - DNA, 17 bp, Homo sapiens
actcttcatatatgctt

SEQ ID NO: 4339473 - DNA, 20 bp, Homo sapiens
actgaagctggggcttgggg

SEQ ID NO: 4339474 - DNA, 23 bp, Homo sapiens
actgaagggaacagcctgagccg

SEQ ID NO: 4339475 - DNA, 21 bp, Homo sapiens
actgaatccatatttcaacag

SEQ ID NO: 4339476 - DNA, 14 bp, Homo sapiens
actgactctgttat

SEQ ID NO: 4339477 - DNA, 21 bp, Homo sapiens
actgactggattcattctcat

SEQ ID NO: 4339478 - DNA, 17 bp, Homo sapiens
actgattccctctccca

SEQ ID NO: 4339479 - DNA, 20 bp, Homo sapiens
actgatttagaagcaaagat

SEQ ID NO: 4339480 - DNA, 19 bp, Homo sapiens
actgcaagcatttttccat

SEQ ID NO: 4339481 - DNA, 22 bp, Homo sapiens
actgcaagcatttttccatctg

SEQ ID NO: 4339482 - DNA, 17 bp, Homo sapiens
actgcactccagcctgg

SEQ ID NO: 4339483 - DNA, 19 bp, Homo sapiens
actgctattttttttaaat

SEQ ID NO: 4339484 - DNA, 16 bp, Homo sapiens
actgcttctctttgtg

SEQ ID NO: 4339485 - DNA, 17 bp, Homo sapiens
actgcttctctttgtgc

SEQ ID NO: 4339486 - DNA, 21 bp, Homo sapiens
actgcttctctttgtgcagtg

SEQ ID NO: 4339487 - DNA, 15 bp, Homo sapiens
actgctttattttcc

SEQ ID NO: 4339488 - DNA, 16 bp, Homo sapiens
actgctttgtgcatat

SEQ ID NO: 4339489 - DNA, 14 bp, Homo sapiens
actggactgtctga

SEQ ID NO: 4339490 - DNA, 18 bp, Homo sapiens
actggcacttgcctgctg

SEQ ID NO: 4339491 - DNA, 20 bp, Homo sapiens
actggcacttgcctgctgct

SEQ ID NO: 4339492 - DNA, 13 bp, Homo sapiens
actgggaagaaca

SEQ ID NO: 4339493 - DNA, 13 bp, Homo sapiens
actggggaaaagg

SEQ ID NO: 4339494 - DNA, 19 bp, Homo sapiens
actggggaaaaggatgatg

SEQ ID NO: 4339495 - DNA, 20 bp, Homo sapiens
actgggggcggggcctgggc

SEQ ID NO: 4339496 - DNA, 17 bp, Homo sapiens
actgggtgtcatttcat

SEQ ID NO: 4339497 - DNA, 21 bp, Homo sapiens
actgggtgtcatttcattcca

SEQ ID NO: 4339498 - DNA, 21 bp, Homo sapiens
actgtaagactcattccctag

SEQ ID NO: 4339499 - DNA, 14 bp, Homo sapiens
actgtatttcagta

SEQ ID NO: 4339500 - DNA, 15 bp, Homo sapiens
actgtatttcagtat

SEQ ID NO: 4339501 - DNA, 21 bp, Homo sapiens
actgtatttcagtattttcca

SEQ ID NO: 4339502 - DNA, 22 bp, Homo sapiens
actgtatttcagtattttccag

SEQ ID NO: 4339503 - DNA, 11 bp, Homo sapiens
actgtatttct

SEQ ID NO: 4339504 - DNA, 21 bp, Homo sapiens
actgtgaactgggcatttcac

SEQ ID NO: 4339505 - DNA, 24 bp, Homo sapiens
actgtggaaccaaagctggcccag

SEQ ID NO: 4339506 - DNA, 22 bp, Homo sapiens
actgtggccatatatgctgtat

SEQ ID NO: 4339507 - DNA, 22 bp, Homo sapiens
actgtgtctgaatcatgtctgt

SEQ ID NO: 4339508 - DNA, 14 bp, Homo sapiens
actgtgttcattag

SEQ ID NO: 4339509 - DNA, 14 bp, Homo sapiens
acttacatgacttt

SEQ ID NO: 4339510 - DNA, 14 bp, Homo sapiens
acttacctgcttga

SEQ ID NO: 4339511 - DNA, 22 bp, Homo sapiens
acttacggttttaaatgtgttg

SEQ ID NO: 4339512 - DNA, 19 bp, Homo sapiens
acttaggtaaaataaaaga

SEQ ID NO: 4339513 - DNA, 16 bp, Homo sapiens
acttattgtttgaaag

SEQ ID NO: 4339514 - DNA, 20 bp, Homo sapiens
acttctcttaaacttgtgaa

SEQ ID NO: 4339515 - DNA, 14 bp, Homo sapiens
acttctgagcccca

SEQ ID NO: 4339516 - DNA, 17 bp, Homo sapiens
acttgccaaaatgttgg

SEQ ID NO: 4339517 - DNA, 22 bp, Homo sapiens
acttgccaaaatgttggctgcg

SEQ ID NO: 4339518 - DNA, 16 bp, Homo sapiens
acttggtttttaaaaa

SEQ ID NO: 4339519 - DNA, 19 bp, Homo sapiens
acttgtcctttgaggcccc

SEQ ID NO: 4339520 - DNA, 17 bp, Homo sapiens
acttgtgaatgcttctc

SEQ ID NO: 4339521 - DNA, 14 bp, Homo sapiens
acttgtttctttct

SEQ ID NO: 4339522 - DNA, 19 bp, Homo sapiens
actttataaccaaagcaat

SEQ ID NO: 4339523 - DNA, 20 bp, Homo sapiens
actttataaccaaagcaatt

SEQ ID NO: 4339524 - DNA, 14 bp, Homo sapiens
actttgcaaattat

SEQ ID NO: 4339525 - DNA, 18 bp, Homo sapiens
actttgcaaattatttat

SEQ ID NO: 4339526 - DNA, 21 bp, Homo sapiens
actttgcaaattatttattac

SEQ ID NO: 4339527 - DNA, 23 bp, Homo sapiens
actttgcaaattatttattactt

SEQ ID NO: 4339528 - DNA, 14 bp, Homo sapiens
actttgctccaggc

SEQ ID NO: 4339529 - DNA, 15 bp, Homo sapiens
actttgctgttactg

SEQ ID NO: 4339530 - DNA, 21 bp, Homo sapiens
actttgctgttactgcttctc

SEQ ID NO: 4339531 - DNA, 20 bp, Homo sapiens
actttgtggaccaattattg

SEQ ID NO: 4339532 - DNA, 11 bp, Homo sapiens
actttgtgttt

SEQ ID NO: 4339533 - DNA, 12 bp, Homo sapiens
acttttcatttc

SEQ ID NO: 4339534 - DNA, 17 bp, Homo sapiens
acttttcatttcagatt

SEQ ID NO: 4339535 - DNA, 20 bp, Homo sapiens
acttttcatttcagatttta

SEQ ID NO: 4339536 - DNA, 12 bp, Homo sapiens
acttttgaaaaa

SEQ ID NO: 4339537 - DNA, 23 bp, Homo sapiens
actttttgctgttagttataaaa

SEQ ID NO: 4339538 - DNA, 18 bp, Homo sapiens
actttttgtatttagtag

SEQ ID NO: 4339539 - DNA, 17 bp, Homo sapiens
agaaaaaaaaatactta

SEQ ID NO: 4339540 - DNA, 19 bp, Homo sapiens
agaaaaaatattttcccta

SEQ ID NO: 4339541 - DNA, 19 bp, Homo sapiens
agaaaagacttacctgaat

SEQ ID NO: 4339542 - DNA, 14 bp, Homo sapiens
agaaaagtagacaa

SEQ ID NO: 4339543 - DNA, 19 bp, Homo sapiens
agaaaagtagacaatcatt

SEQ ID NO: 4339544 - DNA, 23 bp, Homo sapiens
agaaaagtagacaatcattgttt

SEQ ID NO: 4339545 - DNA, 22 bp, Homo sapiens
agaaaatggatgacaaagaaaa

SEQ ID NO: 4339546 - DNA, 23 bp, Homo sapiens
agaaaatggatgacaaagaaaat

SEQ ID NO: 4339547 - DNA, 14 bp, Homo sapiens
agaaaattctctca

SEQ ID NO: 4339548 - DNA, 19 bp, Homo sapiens
agaaacaaagcaaatttca

SEQ ID NO: 4339549 - DNA, 17 bp, Homo sapiens
agaaacccacagaaggg

SEQ ID NO: 4339550 - DNA, 18 bp, Homo sapiens
agaaactgcttacagttt

SEQ ID NO: 4339551 - DNA, 14 bp, Homo sapiens
agaaacttttgaaa

SEQ ID NO: 4339552 - DNA, 11 bp, Homo sapiens
agaaagaatgc

SEQ ID NO: 4339553 - DNA, 15 bp, Homo sapiens
agaaagatttggaaa

SEQ ID NO: 4339554 - DNA, 17 bp, Homo sapiens
agaaagatttggaaaat

SEQ ID NO: 4339555 - DNA, 15 bp, Homo sapiens
agaaagcaaacatgt

SEQ ID NO: 4339556 - DNA, 16 bp, Homo sapiens
agaaagccaccttgtt

SEQ ID NO: 4339557 - DNA, 22 bp, Homo sapiens
agaaaggggtgattgaaagaaa

SEQ ID NO: 4339558 - DNA, 15 bp, Homo sapiens
agaaatagttgtctg

SEQ ID NO: 4339559 - DNA, 17 bp, Homo sapiens
agaaatagttgtctgtg

SEQ ID NO: 4339560 - DNA, 20 bp, Homo sapiens
agaaatagttgtctgtgctt

SEQ ID NO: 4339561 - DNA, 14 bp, Homo sapiens
agaaatatgcagaa

SEQ ID NO: 4339562 - DNA, 13 bp, Homo sapiens
agaaatgaaattg

SEQ ID NO: 4339563 - DNA, 18 bp, Homo sapiens
agaaatgaaattgacaag

SEQ ID NO: 4339564 - DNA, 15 bp, Homo sapiens
agaaatgaagcagag

SEQ ID NO: 4339565 - DNA, 17 bp, Homo sapiens
agaaatgaagcagagga

SEQ ID NO: 4339566 - DNA, 19 bp, Homo sapiens
agaaatgaagcagaggaag

SEQ ID NO: 4339567 - DNA, 22 bp, Homo sapiens
agaaatgaagcagaggaaggaa

SEQ ID NO: 4339568 - DNA, 20 bp, Homo sapiens
agaaatgtttttaacactat

SEQ ID NO: 4339569 - DNA, 14 bp, Homo sapiens
agaaattattagat

SEQ ID NO: 4339570 - DNA, 13 bp, Homo sapiens
agaaattattggt

SEQ ID NO: 4339571 - DNA, 18 bp, Homo sapiens
agaaccaaaagttttcct

SEQ ID NO: 4339572 - DNA, 22 bp, Homo sapiens
agaacgtatttagccattaccc

SEQ ID NO: 4339573 - DNA, 22 bp, Homo sapiens
agaactaggtgtgcaagaacca

SEQ ID NO: 4339574 - DNA, 13 bp, Homo sapiens
agaactgaatcca

SEQ ID NO: 4339575 - DNA, 21 bp, Homo sapiens
acaactttgcaaattatttat

SEQ ID NO: 4339576 - DNA, 17 bp, Homo sapiens
acaagagggactgtatt

SEQ ID NO: 4339577 - DNA, 21 bp, Homo sapiens
acaagccttactcacctctct

SEQ ID NO: 4339578 - DNA, 23 bp, Homo sapiens
acaagctcaggaggcgaataaat

SEQ ID NO: 4339579 - DNA, 21 bp, Homo sapiens
acaagctgcaccctcaggcag

SEQ ID NO: 4339580 - DNA, 17 bp, Homo sapiens
acaagcttaaagcttga

SEQ ID NO: 4339581 - DNA, 15 bp, Homo sapiens
acaaggattgaaaat

SEQ ID NO: 4339582 - DNA, 17 bp, Homo sapiens
acaaggccagaaaaaga

SEQ ID NO: 4339583 - DNA, 16 bp, Homo sapiens
acaagtagcctctggg

SEQ ID NO: 4339584 - DNA, 16 bp, Homo sapiens
acaatcattgttttga

SEQ ID NO: 4339585 - DNA, 17 bp, Homo sapiens
acaatcattgttttgaa

SEQ ID NO: 4339586 - DNA, 21 bp, Homo sapiens
acaatcattgttttgaatatt

SEQ ID NO: 4339587 - DNA, 20 bp, Homo sapiens
acaatgatgccctgctccag

SEQ ID NO: 4339588 - DNA, 20 bp, Homo sapiens
acaatgatgccgaacattag

SEQ ID NO: 4339589 - DNA, 17 bp, Homo sapiens
acaatgtgaaaagaaaa

SEQ ID NO: 4339590 - DNA, 19 bp, Homo sapiens
acaatgtgaaaagaaaaat

SEQ ID NO: 4339591 - DNA, 18 bp, Homo sapiens
acaatgtgtttttctcca

SEQ ID NO: 4339592 - DNA, 17 bp, Homo sapiens
acaatttgcataatact

SEQ ID NO: 4339593 - DNA, 20 bp, Homo sapiens
acaatttgcataatactaat

SEQ ID NO: 4339594 - DNA, 15 bp, Homo sapiens
acacaactttgcaaa

SEQ ID NO: 4339595 - DNA, 19 bp, Homo sapiens
acacaactttgcaaattat

SEQ ID NO: 4339596 - DNA, 14 bp, Homo sapiens
aatcatattgagaa

SEQ ID NO: 4339597 - DNA, 12 bp, Homo sapiens
aatcatgtctgt

SEQ ID NO: 4339598 - DNA, 18 bp, Homo sapiens
aatcattgttttgaatat

SEQ ID NO: 4339599 - DNA, 22 bp, Homo sapiens
aatcattgttttgaatattact

SEQ ID NO: 4339600 - DNA, 17 bp, Homo sapiens
aatcatttggttaaatc

SEQ ID NO: 4339601 - DNA, 17 bp, Homo sapiens
aatcccatttaaaaaaa

SEQ ID NO: 4339602 - DNA, 12 bp, Homo sapiens
aatctacttttt

SEQ ID NO: 4339603 - DNA, 22 bp, Homo sapiens
aatctatattaaatgagggttt

SEQ ID NO: 4339604 - DNA, 21 bp, Homo sapiens
aatcttagtatagtagaaaga

SEQ ID NO: 4339605 - DNA, 23 bp, Homo sapiens
aatcttagtatagtagaaagaca

SEQ ID NO: 4339606 - DNA, 22 bp, Homo sapiens
aatctttcttttgattcttcct

SEQ ID NO: 4339607 - DNA, 16 bp, Homo sapiens
aatgaaagaaacccac

SEQ ID NO: 4339608 - DNA, 16 bp, Homo sapiens
aatgaagcagaggaag

SEQ ID NO: 4339609 - DNA, 17 bp, Homo sapiens
aatgaatattttgataa

SEQ ID NO: 4339610 - DNA, 16 bp, Homo sapiens
aatgactattgtaatg

SEQ ID NO: 4339611 - DNA, 19 bp, Homo sapiens
aatgactattgtaatgcca

SEQ ID NO: 4339612 - DNA, 13 bp, Homo sapiens
aatgagcctgtcc

SEQ ID NO: 4339613 - DNA, 17 bp, Homo sapiens
aatgagttgctggaaaa

SEQ ID NO: 4339614 - DNA, 19 bp, Homo sapiens
aatgagttgctggaaaatc

SEQ ID NO: 4339615 - DNA, 17 bp, Homo sapiens
aatgatcacatctaaag

SEQ ID NO: 4339616 - DNA, 20 bp, Homo sapiens
aatgatcacatctaaagctt

SEQ ID NO: 4339617 - DNA, 18 bp, Homo sapiens
aatgatgccctgctccag

SEQ ID NO: 4339618 - DNA, 23 bp, Homo sapiens
aatgatgccgaacattaggaatt

SEQ ID NO: 4339619 - DNA, 20 bp, Homo sapiens
aatgattggttaaaatgtga

SEQ ID NO: 4339620 - DNA, 18 bp, Homo sapiens
aatgcacagatatacttt

SEQ ID NO: 4339621 - DNA, 12 bp, Homo sapiens
aaacatagaaag

SEQ ID NO: 4339622 - DNA, 14 bp, Homo sapiens
aaacatagaaagac

SEQ ID NO: 4339623 - DNA, 20 bp, Homo sapiens
aaacccactcttcatatatg

SEQ ID NO: 4339624 - DNA, 15 bp, Homo sapiens
aaacccccttttccc

SEQ ID NO: 4339625 - DNA, 17 bp, Homo sapiens
aaacccccttttccctt

SEQ ID NO: 4339626 - DNA, 13 bp, Homo sapiens
aaacgttgacccc

SEQ ID NO: 4339627 - DNA, 17 bp, Homo sapiens
aaactaaagttgaaaat

SEQ ID NO: 4339628 - DNA, 17 bp, Homo sapiens
aaactattcagaggaaa

SEQ ID NO: 4339629 - DNA, 12 bp, Homo sapiens
aaactctataaa

SEQ ID NO: 4339630 - DNA, 16 bp, Homo sapiens
aaactctataaagaaa

SEQ ID NO: 4339631 - DNA, 20 bp, Homo sapiens
aaactctataaagaaacttt

SEQ ID NO: 4339632 - DNA, 23 bp, Homo sapiens
aaactcttaaaacccaagtgcct

SEQ ID NO: 4339633 - DNA, 16 bp, Homo sapiens
aaactgacatcagatt

SEQ ID NO: 4339634 - DNA, 18 bp, Homo sapiens
aaactgacatcagatttc

SEQ ID NO: 4339635 - DNA, 19 bp, Homo sapiens
aaactgacatcagatttct

SEQ ID NO: 4339636 - DNA, 21 bp, Homo sapiens
aaactgacatcagatttctta

SEQ ID NO: 4339637 - DNA, 12 bp, Homo sapiens
aaactgctttat

SEQ ID NO: 4339638 - DNA, 16 bp, Homo sapiens
aaactgctttgtgcat

SEQ ID NO: 4339639 - DNA, 13 bp, Homo sapiens
aaacttgtgaatg

SEQ ID NO: 4339640 - DNA, 18 bp, Homo sapiens
aaactttgaataaaagaa

SEQ ID NO: 4339641 - DNA, 13 bp, Homo sapiens
aaactttgctcca

SEQ ID NO: 4339642 - DNA, 19 bp, Homo sapiens
aaacttttaggttgttacc

SEQ ID NO: 4339643 - DNA, 14 bp, Homo sapiens
aaacttttcatttc

SEQ ID NO: 4339644 - DNA, 18 bp, Homo sapiens
aaacttttcatttcagat

SEQ ID NO: 4339645 - DNA, 20 bp, Homo sapiens
aaacttttctttcttttctt

SEQ ID NO: 4339646 - DNA, 16 bp, Homo sapiens
aaacttttgaaaaagt

SEQ ID NO: 4339647 - DNA, 12 bp, Homo sapiens
aaagaaactttt

SEQ ID NO: 4339648 - DNA, 14 bp, Homo sapiens
aaagaaacttttga

SEQ ID NO: 4339649 - DNA, 19 bp, Homo sapiens
aaagaagaccctttgttga

SEQ ID NO: 4339650 - DNA, 12 bp, Homo sapiens
aaagaaggaggt

SEQ ID NO: 4339651 - DNA, 22 bp, Homo sapiens
aaagaatgagaaggagtcagaa

SEQ ID NO: 4339652 - DNA, 13 bp, Homo sapiens
aaagaccttctcc

SEQ ID NO: 4339653 - DNA, 21 bp, Homo sapiens
aaagacttacctgaataatta

SEQ ID NO: 4339654 - DNA, 17 bp, Homo sapiens
aaagagaggatctagga

SEQ ID NO: 4339655 - DNA, 20 bp, Homo sapiens
aaagaggaggcagaaagatt

SEQ ID NO: 4339656 - DNA, 13 bp, Homo sapiens
aaagaggcttcca

SEQ ID NO: 4339657 - DNA, 22 bp, Homo sapiens
aaagatttcagtagaattttag

SEQ ID NO: 4339658 - DNA, 13 bp, Homo sapiens
aaagatttggaaa

SEQ ID NO: 4339659 - DNA, 16 bp, Homo sapiens
aaagatttggaaaatt

SEQ ID NO: 4339660 - DNA, 19 bp, Homo sapiens
aaagatttggaaaattcac

SEQ ID NO: 4339661 - DNA, 12 bp, Homo sapiens
aaaaaaaaatac

SEQ ID NO: 4339662 - DNA, 13 bp, Homo sapiens
aaaaaagaaatga

SEQ ID NO: 4339663 - DNA, 14 bp, Homo sapiens
aaaaaagaaatgaa

SEQ ID NO: 4339664 - DNA, 15 bp, Homo sapiens
aaaaaatattttcct

SEQ ID NO: 4339665 - DNA, 14 bp, Homo sapiens
aaaaacaatatatt

SEQ ID NO: 4339666 - DNA, 20 bp, Homo sapiens
aaaaacttttaggttgttac

SEQ ID NO: 4339667 - DNA, 17 bp, Homo sapiens
aaaaacttttcatttca

SEQ ID NO: 4339668 - DNA, 22 bp, Homo sapiens
aaaaacttttcatttcagattt

SEQ ID NO: 4339669 - DNA, 23 bp, Homo sapiens
aaaaacttttcatttcagatttt

SEQ ID NO: 4339670 - DNA, 11 bp, Homo sapiens
aaaaagaaatg

SEQ ID NO: 4339671 - DNA, 13 bp, Homo sapiens
aaaaagcacaaga

SEQ ID NO: 4339672 - DNA, 22 bp, Homo sapiens
aaaaagccctatgtgaaaagat

SEQ ID NO: 4339673 - DNA, 14 bp, Homo sapiens
aaaaaggaggaaga

SEQ ID NO: 4339674 - DNA, 22 bp, Homo sapiens
aaaaatatatatataaaatatt

SEQ ID NO: 4339675 - DNA, 16 bp, Homo sapiens
aaaacaaagctgattt

SEQ ID NO: 4339676 - DNA, 18 bp, Homo sapiens
aaaacaaagctgatttcc

SEQ ID NO: 4339677 - DNA, 19 bp, Homo sapiens
aaaacagaggatgctgaag

SEQ ID NO: 4339678 - DNA, 15 bp, Homo sapiens
aaaaccaatgttctc

SEQ ID NO: 4339679 - DNA, 21 bp, Homo sapiens
aaaaccaatgttctctcttct

SEQ ID NO: 4339680 - DNA, 13 bp, Homo sapiens
aaaaccagttacc

SEQ ID NO: 4339681 - DNA, 19 bp, Homo sapiens
aaaacgttgacccctttcc

SEQ ID NO: 4339682 - DNA, 21 bp, Homo sapiens
aaaacgttgacccctttcccc

SEQ ID NO: 4339683 - DNA, 21 bp, Homo sapiens
aaaactaaagttgaaaataca

SEQ ID NO: 4339684 - DNA, 21 bp, Homo sapiens
aaaactatgtgttcaatgaaa

SEQ ID NO: 4339685 - DNA, 15 bp, Homo sapiens
aaaactgacatcaga

SEQ ID NO: 4339686 - DNA, 19 bp, Homo sapiens
aaaactgctttgtgcatat

SEQ ID NO: 4339687 - DNA, 17 bp, Homo sapiens
aaaactttgctccaggc

SEQ ID NO: 4339688 - DNA, 18 bp, Homo sapiens
aaaacttttcatttcaga

SEQ ID NO: 4339689 - DNA, 21 bp, Homo sapiens
aaaacttttcatttcagattt

SEQ ID NO: 4339690 - DNA, 11 bp, Homo sapiens
aaaagaaaaag

SEQ ID NO: 4339691 - DNA, 22 bp, Homo sapiens
aaaagccaacaggtaaacacat

SEQ ID NO: 4339692 - DNA, 21 bp, Homo sapiens
aaaagccctatgtgaaaagat

SEQ ID NO: 4339693 - DNA, 20 bp, Homo sapiens
aaaagctcttacactacatt

SEQ ID NO: 4339694 - DNA, 14 bp, Homo sapiens
aaaagctgggcagg

SEQ ID NO: 4339695 - DNA, 16 bp, Homo sapiens
aaaaggatagtatttt

SEQ ID NO: 4339696 - DNA, 17 bp, Homo sapiens
aaaaggatagtattttt

SEQ ID NO: 4339697 - DNA, 22 bp, Homo sapiens
aaaaggatagtatttttatcca

SEQ ID NO: 4339698 - DNA, 19 bp, Homo sapiens
aaaaggatgatggaaaaat

SEQ ID NO: 4339699 - DNA, 11 bp, Homo sapiens
aaaaggcagga

SEQ ID NO: 4339700 - DNA, 16 bp, Homo sapiens
aaaagtcattattcct

SEQ ID NO: 4339701 - DNA, 20 bp, Homo sapiens
aaaagtgaaacgtaattgta

SEQ ID NO: 4339702 - DNA, 12 bp, Homo sapiens
aaaagttatata

SEQ ID NO: 4339703 - DNA, 21 bp, Homo sapiens
aaaataatctatattaaatga

SEQ ID NO: 4339704 - DNA, 13 bp, Homo sapiens
aaaatacattctt

SEQ ID NO: 4339705 - DNA, 13 bp, Homo sapiens
aaaatagaagaag

SEQ ID NO: 4339706 - DNA, 15 bp, Homo sapiens
aaaatagaagaagag

SEQ ID NO: 4339707 - DNA, 13 bp, Homo sapiens
aaaatcagcctgc

SEQ ID NO: 4339708 - DNA, 24 bp, Homo sapiens
aaaatcatattgagaataattatt

SEQ ID NO: 4339709 - DNA, 13 bp, Homo sapiens
aaaatgaaaatta

SEQ ID NO: 4339710 - DNA, 19 bp, Homo sapiens
aaaatgagaatctgtgcag

SEQ ID NO: 4339711 - DNA, 21 bp, Homo sapiens
aaaatgagtaggatgtctctt

SEQ ID NO: 4339712 - DNA, 12 bp, Homo sapiens
aaaatgcatttt

SEQ ID NO: 4339713 - DNA, 20 bp, Homo sapiens
aaaatgcccatttttgctaa

SEQ ID NO: 4339714 - DNA, 13 bp, Homo sapiens
aaaatggatagaa

SEQ ID NO: 4339715 - DNA, 17 bp, Homo sapiens
aaaatggatagaaaaaa

SEQ ID NO: 4339716 - DNA, 18 bp, Homo sapiens
aaaatggatgacaaagaa

SEQ ID NO: 4339717 - DNA, 14 bp, Homo sapiens
aaaatgtacttaaa

SEQ ID NO: 4339718 - DNA, 16 bp, Homo sapiens
aaaatgtatttttcta

SEQ ID NO: 4339719 - DNA, 22 bp, Homo sapiens
aaaatgtcaaagagaaaactta

SEQ ID NO: 4339720 - DNA, 22 bp, Homo sapiens
aaaattacgttcttacaagctt

SEQ ID NO: 4339721 - DNA, 17 bp, Homo sapiens
aaaattatgaaatatgg

SEQ ID NO: 4339722 - DNA, 22 bp, Homo sapiens
aaaattccccttttttctctat

SEQ ID NO: 4339723 - DNA, 22 bp, Homo sapiens
aaaattcgcccgagctgtttat

SEQ ID NO: 4339724 - DNA, 13 bp, Homo sapiens
aaaattgaaaaca

SEQ ID NO: 4339725 - DNA, 23 bp, Homo sapiens
aaaattgaaaacactaacaaaat

SEQ ID NO: 4339726 - DNA, 15 bp, Homo sapiens
aaacaaagctgattt

SEQ ID NO: 4339727 - DNA, 17 bp, Homo sapiens
aaacaaagctgatttcc

SEQ ID NO: 4339728 - DNA, 21 bp, Homo sapiens
aaacaatttgcataatactaa

SEQ ID NO: 4339729 - DNA, 15 bp, Homo sapiens
aaacacataaatgaa

SEQ ID NO: 4339730 - DNA, 18 bp, Homo sapiens
aaacacataaatgaaaga

SEQ ID NO: 4339731 - DNA, 19 bp, Homo sapiens
aaacacataaatgaaagaa

SEQ ID NO: 4339732 - DNA, 18 bp, Homo sapiens
aaacacatctttcctgtc

SEQ ID NO: 4339733 - DNA, 21 bp, Homo sapiens
aaacaggagcaaatggcgttt

SEQ ID NO: 4339734 - DNA, 15 bp, Homo sapiens
aaacatgtatttatg

SEQ ID NO: 4339735 - DNA, 15 bp, Homo sapiens
aaacatgtgcccctg

SEQ ID NO: 4339736 - DNA, 18 bp, Homo sapiens
aaacatgtgcccctgcca

SEQ ID NO: 4339737 - DNA, 15 bp, Homo sapiens
aaacccatgaagctg

SEQ ID NO: 4339738 - DNA, 18 bp, Homo sapiens
aaacccccttttcccttc

SEQ ID NO: 4339739 - DNA, 21 bp, Homo sapiens
aaacccccttttcccttcagc

SEQ ID NO: 4339740 - DNA, 22 bp, Homo sapiens
aaacccccttttcccttcagct

SEQ ID NO: 4339741 - DNA, 16 bp, Homo sapiens
aaaccctccacttctc

SEQ ID NO: 4339742 - DNA, 21 bp, Homo sapiens
aaacgttgacccctttccccc

SEQ ID NO: 4339743 - DNA, 24 bp, Homo sapiens
aaactaaagttgaaaatacattct

SEQ ID NO: 4339744 - DNA, 19 bp, Homo sapiens
aaactctataaagaaactt

SEQ ID NO: 4339745 - DNA, 21 bp, Homo sapiens
aaactctataaagaaactttt

SEQ ID NO: 4339746 - DNA, 20 bp, Homo sapiens
aaactctccttttccttacc

SEQ ID NO: 4339747 - DNA, 17 bp, Homo sapiens
aaactctgccagaaaaa

SEQ ID NO: 4339748 - DNA, 17 bp, Homo sapiens
aaactgacatcagattt

SEQ ID NO: 4339749 - DNA, 20 bp, Homo sapiens
aaactgacatcagatttctt

SEQ ID NO: 4339750 - DNA, 22 bp, Homo sapiens
aaactgacatcagatttcttaa

SEQ ID NO: 4339751 - DNA, 23 bp, Homo sapiens
aaactgacatcagatttcttaat

SEQ ID NO: 4339752 - DNA, 13 bp, Homo sapiens
aaactgctttatt

SEQ ID NO: 4339753 - DNA, 19 bp, Homo sapiens
aaactgctttgtgcatatg

SEQ ID NO: 4339754 - DNA, 19 bp, Homo sapiens
aaacttctcgcaactgaag

SEQ ID NO: 4339755 - DNA, 16 bp, Homo sapiens
aaacttttaggttgtt

SEQ ID NO: 4339756 - DNA, 17 bp, Homo sapiens
aaacttttcatttcaga

SEQ ID NO: 4339757 - DNA, 20 bp, Homo sapiens
aaacttttcatttcagattt

SEQ ID NO: 4339758 - DNA, 22 bp, Homo sapiens
aaacttttcatttcagatttta

SEQ ID NO: 4339759 - DNA, 17 bp, Homo sapiens
aaacttttgaaaaagtg

SEQ ID NO: 4339760 - DNA, 13 bp, Homo sapiens
aaagaaaattctc

SEQ ID NO: 4339761 - DNA, 12 bp, Homo sapiens
aaagaaatgaaa

SEQ ID NO: 4339762 - DNA, 12 bp, Homo sapiens
aaagaagaagga

SEQ ID NO: 4339763 - DNA, 14 bp, Homo sapiens
aaagacatctgcct

SEQ ID NO: 4339764 - DNA, 16 bp, Homo sapiens
aaagacatctgcctgt

SEQ ID NO: 4339765 - DNA, 20 bp, Homo sapiens
aaagacatctgcctgtaatt

SEQ ID NO: 4339766 - DNA, 16 bp, Homo sapiens
aaagaccttctcccta

SEQ ID NO: 4339767 - DNA, 22 bp, Homo sapiens
aaagaccttctccctagccctt

SEQ ID NO: 4339768 - DNA, 15 bp, Homo sapiens
aaagagatctgggca

SEQ ID NO: 4339769 - DNA, 18 bp, Homo sapiens
aaagaggaggcagaaaga

SEQ ID NO: 4339770 - DNA, 14 bp, Homo sapiens
aaagaggcttccaa

SEQ ID NO: 4339771 - DNA, 20 bp, Homo sapiens
aaagaggcttccaagcatta

SEQ ID NO: 4339772 - DNA, 11 bp, Homo sapiens
aaagaggtttt

SEQ ID NO: 4339773 - DNA, 15 bp, Homo sapiens
aaagagtgagaacta

SEQ ID NO: 4339774 - DNA, 14 bp, Homo sapiens
aaagatatggagaa

SEQ ID NO: 4339775 - DNA, 19 bp, Homo sapiens
aaagatatggagaattgct

SEQ ID NO: 4339776 - DNA, 17 bp, Homo sapiens
aaagatgcttctcactg

SEQ ID NO: 4339777 - DNA, 23 bp, Homo sapiens
aaagattatagctcccaaaagaa

SEQ ID NO: 4339778 - DNA, 18 bp, Homo sapiens
aaagatttcagtagaatt

SEQ ID NO: 4339779 - DNA, 14 bp, Homo sapiens
aaagatttggaaaa

SEQ ID NO: 4339780 - DNA, 16 bp, Homo sapiens
aaagcaattaaatgat

SEQ ID NO: 4339781 - DNA, 22 bp, Homo sapiens
aaagcactagagaatgcacaga

SEQ ID NO: 4339782 - DNA, 16 bp, Homo sapiens
aaagcctcctccagcc

SEQ ID NO: 4339783 - DNA, 20 bp, Homo sapiens
aaagctgatttccctttttt

SEQ ID NO: 4339784 - DNA, 16 bp, Homo sapiens
aaaggaaaaagcacaa

SEQ ID NO: 4339785 - DNA, 19 bp, Homo sapiens
aaaggaaaaagcacaagaa

SEQ ID NO: 4339786 - DNA, 14 bp, Homo sapiens
aaaggaaaaatgta

SEQ ID NO: 4339787 - DNA, 22 bp, Homo sapiens
aaaggaccgttttgtattgctt

SEQ ID NO: 4339788 - DNA, 17 bp, Homo sapiens
aaaggatgatggaaaaa

SEQ ID NO: 4339789 - DNA, 21 bp, Homo sapiens
aaaggatgatggaaaaatcac

SEQ ID NO: 4339790 - DNA, 13 bp, Homo sapiens
aaaggcaaggaaa

SEQ ID NO: 4339791 - DNA, 23 bp, Homo sapiens
aaaggcaaggaaattaagaactg

SEQ ID NO: 4339792 - DNA, 12 bp, Homo sapiens
aaaggcagcctt

SEQ ID NO: 4339793 - DNA, 21 bp, Homo sapiens
aaaggggtgattgaaagaaaa

SEQ ID NO: 4339794 - DNA, 17 bp, Homo sapiens
aaagtaaacttgtgtat

SEQ ID NO: 4339795 - DNA, 16 bp, Homo sapiens
aaagtacaatgtgttt

SEQ ID NO: 4339796 - DNA, 17 bp, Homo sapiens
aaagtacaatgtgtttt

SEQ ID NO: 4339797 - DNA, 20 bp, Homo sapiens
aaagtagacaatcattgttt

SEQ ID NO: 4339798 - DNA, 19 bp, Homo sapiens
aaagtcagagttaaaatat

SEQ ID NO: 4339799 - DNA, 20 bp, Homo sapiens
aaagtcagagttaaaatata

SEQ ID NO: 4339800 - DNA, 15 bp, Homo sapiens
aaagtcctgctttcc

SEQ ID NO: 4339801 - DNA, 21 bp, Homo sapiens
aaagttgctaactgggaagaa

SEQ ID NO: 4339802 - DNA, 13 bp, Homo sapiens
aaataaactgttt

SEQ ID NO: 4339803 - DNA, 16 bp, Homo sapiens
aaataaactgttttca

SEQ ID NO: 4339804 - DNA, 17 bp, Homo sapiens
aaataaactgttttcaa

SEQ ID NO: 4339805 - DNA, 15 bp, Homo sapiens
aaataattacttttg

SEQ ID NO: 4339806 - DNA, 15 bp, Homo sapiens
aaatacttaaatatt

SEQ ID NO: 4339807 - DNA, 15 bp, Homo sapiens
aaatagaagaagagg

SEQ ID NO: 4339808 - DNA, 16 bp, Homo sapiens
aaatagaagaagagga

SEQ ID NO: 4339809 - DNA, 12 bp, Homo sapiens
aaatagaatcca

SEQ ID NO: 4339810 - DNA, 16 bp, Homo sapiens
aaatagttgtctgtgc

SEQ ID NO: 4339811 - DNA, 18 bp, Homo sapiens
aaatagttgtctgtgctt

SEQ ID NO: 4339812 - DNA, 13 bp, Homo sapiens
aaatagtttccaa

SEQ ID NO: 4339813 - DNA, 22 bp, Homo sapiens
aaatatatatagttagattcca

SEQ ID NO: 4339814 - DNA, 19 bp, Homo sapiens
aaatatatatataaaatat

SEQ ID NO: 4339815 - DNA, 15 bp, Homo sapiens
aaatatatgtatata

SEQ ID NO: 4339816 - DNA, 20 bp, Homo sapiens
aaatatatgtatatatattc

SEQ ID NO: 4339817 - DNA, 21 bp, Homo sapiens
aaatatatgtatatatattct

SEQ ID NO: 4339818 - DNA, 21 bp, Homo sapiens
aaatatgaaccctttgtttct

SEQ ID NO: 4339819 - DNA, 15 bp, Homo sapiens
aaatattacaacaag

SEQ ID NO: 4339820 - DNA, 15 bp, Homo sapiens
aaatattatgatttt

SEQ ID NO: 4339821 - DNA, 17 bp, Homo sapiens
aaatattatgattttat

SEQ ID NO: 4339822 - DNA, 14 bp, Homo sapiens
aaatattcaagtaa

SEQ ID NO: 4339823 - DNA, 14 bp, Homo sapiens
aaatcaaggatctt

SEQ ID NO: 4339824 - DNA, 19 bp, Homo sapiens
aaatcaatgctttatctga

SEQ ID NO: 4339825 - DNA, 16 bp, Homo sapiens
aaatcacattttaagt

SEQ ID NO: 4339826 - DNA, 15 bp, Homo sapiens
aaatcattatgtttc

SEQ ID NO: 4339827 - DNA, 14 bp, Homo sapiens
aaatctgattagaa

SEQ ID NO: 4339828 - DNA, 22 bp, Homo sapiens
aaatctggggaagaggttttat

SEQ ID NO: 4339829 - DNA, 23 bp, Homo sapiens
aaatcttagtatagtagaaagac

SEQ ID NO: 4339830 - DNA, 19 bp, Homo sapiens
aaatgaagcagaggaagga

SEQ ID NO: 4339831 - DNA, 13 bp, Homo sapiens
aaatgaatacgaa

SEQ ID NO: 4339832 - DNA, 14 bp, Homo sapiens
aaatgaatattttg

SEQ ID NO: 4339833 - DNA, 14 bp, Homo sapiens
aaatgactattgta

SEQ ID NO: 4339834 - DNA, 20 bp, Homo sapiens
aaatgactattgtaatgcca

SEQ ID NO: 4339835 - DNA, 17 bp, Homo sapiens
aaatgacttttattatg

SEQ ID NO: 4339836 - DNA, 19 bp, Homo sapiens
aaatgagcctggcaagaat

SEQ ID NO: 4339837 - DNA, 19 bp, Homo sapiens
aaatgagtaggatgtctct

SEQ ID NO: 4339838 - DNA, 20 bp, Homo sapiens
aaatgagtaggatgtctctt

SEQ ID NO: 4339839 - DNA, 19 bp, Homo sapiens
aaatgcattttcttcagaa

SEQ ID NO: 4339840 - DNA, 21 bp, Homo sapiens
aaatgccaaaatgtacttaaa

SEQ ID NO: 4339841 - DNA, 23 bp, Homo sapiens
aaatggacattttcttttattat

SEQ ID NO: 4339842 - DNA, 18 bp, Homo sapiens
aaatggcattgggctgag

SEQ ID NO: 4339843 - DNA, 15 bp, Homo sapiens
aaatgtacttaaatg

SEQ ID NO: 4339844 - DNA, 16 bp, Homo sapiens
aaatgtacttaaatga

SEQ ID NO: 4339845 - DNA, 14 bp, Homo sapiens
aaatgtatttttct

SEQ ID NO: 4339846 - DNA, 13 bp, Homo sapiens
aaatgtgtatcta

SEQ ID NO: 4339847 - DNA, 19 bp, Homo sapiens
aaatgtgtatctatttata

SEQ ID NO: 4339848 - DNA, 23 bp, Homo sapiens
aaatgttgctctgggagacttac

SEQ ID NO: 4339849 - DNA, 21 bp, Homo sapiens
aaatgtttacagggagcctcc

SEQ ID NO: 4339850 - DNA, 14 bp, Homo sapiens
aaattaaataaact

SEQ ID NO: 4339851 - DNA, 21 bp, Homo sapiens
aaattaaataaactgttttca

SEQ ID NO: 4339852 - DNA, 19 bp, Homo sapiens
aaattaagaactgaatcca

SEQ ID NO: 4339853 - DNA, 14 bp, Homo sapiens
aaattataaaattg

SEQ ID NO: 4339854 - DNA, 16 bp, Homo sapiens
aaattatttattactt

SEQ ID NO: 4339855 - DNA, 16 bp, Homo sapiens
aaattctataaaaacc

SEQ ID NO: 4339856 - DNA, 16 bp, Homo sapiens
aaattctctcaagact

SEQ ID NO: 4339857 - DNA, 17 bp, Homo sapiens
aaattgaaaacactaac

SEQ ID NO: 4339858 - DNA, 20 bp, Homo sapiens
aaattgaaaacactaacaaa

SEQ ID NO: 4339859 - DNA, 21 bp, Homo sapiens
aaattgaaaacactaacaaaa

SEQ ID NO: 4339860 - DNA, 15 bp, Homo sapiens
aaattgcagtttcat

SEQ ID NO: 4339861 - DNA, 18 bp, Homo sapiens
aaattgcagtttcatgta

SEQ ID NO: 4339862 - DNA, 21 bp, Homo sapiens
aaattgcagtttcatgtatgt

SEQ ID NO: 4339863 - DNA, 22 bp, Homo sapiens
aaattgctcctaagcttcaaat

SEQ ID NO: 4339864 - DNA, 15 bp, Homo sapiens
aaattggtctgaaag

SEQ ID NO: 4339865 - DNA, 17 bp, Homo sapiens
aaattgtgcttctcccc

SEQ ID NO: 4339866 - DNA, 21 bp, Homo sapiens
aaattgtgcttctccccagaa

SEQ ID NO: 4339867 - DNA, 21 bp, Homo sapiens
aaatttcattatctaatgagt

SEQ ID NO: 4339868 - DNA, 18 bp, Homo sapiens
aacaaggtatacctcagt

SEQ ID NO: 4339869 - DNA, 14 bp, Homo sapiens
aacacataaatgaa

SEQ ID NO: 4339870 - DNA, 19 bp, Homo sapiens
aacacataaatgaaagaaa

SEQ ID NO: 4339871 - DNA, 17 bp, Homo sapiens
aacaccagcccctgccc

SEQ ID NO: 4339872 - DNA, 23 bp, Homo sapiens
aacaccagcccctgccccagccc

SEQ ID NO: 4339873 - DNA, 14 bp, Homo sapiens
aacactaacaaaat

SEQ ID NO: 4339874 - DNA, 23 bp, Homo sapiens
aacacttattgtttgaaagactt

SEQ ID NO: 4339875 - DNA, 17 bp, Homo sapiens
aacagacccagctctgt

SEQ ID NO: 4339876 - DNA, 13 bp, Homo sapiens
aacagcctgagcc

SEQ ID NO: 4339877 - DNA, 14 bp, Homo sapiens
aacagcctgagccg

SEQ ID NO: 4339878 - DNA, 14 bp, Homo sapiens
aacagtatgtcaga

SEQ ID NO: 4339879 - DNA, 20 bp, Homo sapiens
aacagtttatttttattatt

SEQ ID NO: 4339880 - DNA, 16 bp, Homo sapiens
aacatagaaagacatg

SEQ ID NO: 4339881 - DNA, 19 bp, Homo sapiens
aacatcagctttctaatgt

SEQ ID NO: 4339882 - DNA, 22 bp, Homo sapiens
aacatgcaagaatttctggaag

SEQ ID NO: 4339883 - DNA, 21 bp, Homo sapiens
aacatggccaatagtcatatg

SEQ ID NO: 4339884 - DNA, 22 bp, Homo sapiens
aacatggccaatagtcatatgt

SEQ ID NO: 4339885 - DNA, 21 bp, Homo sapiens
aacatgtatttatgtaatgaa

SEQ ID NO: 4339886 - DNA, 15 bp, Homo sapiens
aacatgtgcccctgc

SEQ ID NO: 4339887 - DNA, 16 bp, Homo sapiens
aacatgtgcccctgcc

SEQ ID NO: 4339888 - DNA, 17 bp, Homo sapiens
aacatgtgcccctgcca

SEQ ID NO: 4339889 - DNA, 17 bp, Homo sapiens
aacattaggaattgttt

SEQ ID NO: 4339890 - DNA, 18 bp, Homo sapiens
aacattaggaattgttta

SEQ ID NO: 4339891 - DNA, 14 bp, Homo sapiens
aaccaaagcaatta

SEQ ID NO: 4339892 - DNA, 19 bp, Homo sapiens
aaccacccacaaagaaaca

SEQ ID NO: 4339893 - DNA, 20 bp, Homo sapiens
aaccacccgccccgccccct

SEQ ID NO: 4339894 - DNA, 22 bp, Homo sapiens
aaccagaagtgcagcccctctc

SEQ ID NO: 4339895 - DNA, 19 bp, Homo sapiens
aacccagcagttctctgcc

SEQ ID NO: 4339896 - DNA, 22 bp, Homo sapiens
aacccatgaagctggccctcag

SEQ ID NO: 4339897 - DNA, 11 bp, Homo sapiens
aaccccagccg

SEQ ID NO: 4339898 - DNA, 15 bp, Homo sapiens
aacccccaaatttaa

SEQ ID NO: 4339899 - DNA, 16 bp, Homo sapiens
aacccccaaatttaat

SEQ ID NO: 4339900 - DNA, 16 bp, Homo sapiens
aacccggtgcatctgg

SEQ ID NO: 4339901 - DNA, 20 bp, Homo sapiens
aaccctaaagcagtaaaata

SEQ ID NO: 4339902 - DNA, 22 bp, Homo sapiens
aacctatttatcgcaacatgaa

SEQ ID NO: 4339903 - DNA, 21 bp, Homo sapiens
aacctccctcaacaaggtata

SEQ ID NO: 4339904 - DNA, 20 bp, Homo sapiens
aaccttaagataatggataa

SEQ ID NO: 4339905 - DNA, 19 bp, Homo sapiens
aacgtatttagccattacc

SEQ ID NO: 4339906 - DNA, 12 bp, Homo sapiens
aacgttgacccc

SEQ ID NO: 4339907 - DNA, 20 bp, Homo sapiens
aacgttgacccctttccccc

SEQ ID NO: 4339908 - DNA, 15 bp, Homo sapiens
aactaactgactctg

SEQ ID NO: 4339909 - DNA, 14 bp, Homo sapiens
aactactgctattt

SEQ ID NO: 4339910 - DNA, 17 bp, Homo sapiens
aactactgctatttttt

SEQ ID NO: 4339911 - DNA, 15 bp, Homo sapiens
aactaggggaggaga

SEQ ID NO: 4339912 - DNA, 22 bp, Homo sapiens
aactaggtgtgcaagaaccaaa

SEQ ID NO: 4339913 - DNA, 22 bp, Homo sapiens
aactagttgtctgaattgagaa

SEQ ID NO: 4339914 - DNA, 13 bp, Homo sapiens
aactatattttct

SEQ ID NO: 4339915 - DNA, 12 bp, Homo sapiens
aactatgtgttc

SEQ ID NO: 4339916 - DNA, 15 bp, Homo sapiens
aactattttgtttta

SEQ ID NO: 4339917 - DNA, 19 bp, Homo sapiens
aactattttgttttaatct

SEQ ID NO: 4339918 - DNA, 20 bp, Homo sapiens
aactattttgttttaatcta

SEQ ID NO: 4339919 - DNA, 22 bp, Homo sapiens
aactattttgttttaatctact

SEQ ID NO: 4339920 - DNA, 17 bp, Homo sapiens
aactcaaactcttaaaa

SEQ ID NO: 4339921 - DNA, 18 bp, Homo sapiens
aactcaagtgtcacctcc

SEQ ID NO: 4339922 - DNA, 15 bp, Homo sapiens
aactctataaagaaa

SEQ ID NO: 4339923 - DNA, 19 bp, Homo sapiens
aactctataaagaaacttt

SEQ ID NO: 4339924 - DNA, 20 bp, Homo sapiens
aactctccttttccttacca

SEQ ID NO: 4339925 - DNA, 18 bp, Homo sapiens
aactcttccacctctggg

SEQ ID NO: 4339926 - DNA, 13 bp, Homo sapiens
aactgaaggaagg

SEQ ID NO: 4339927 - DNA, 16 bp, Homo sapiens
aactgaaggaaggctg

SEQ ID NO: 4339928 - DNA, 17 bp, Homo sapiens
aactgaataaaaaataa

SEQ ID NO: 4339929 - DNA, 15 bp, Homo sapiens
aactgacatcagatt

SEQ ID NO: 4339930 - DNA, 17 bp, Homo sapiens
aactgacatcagatttc

SEQ ID NO: 4339931 - DNA, 16 bp, Homo sapiens
aactgactctgttatt

SEQ ID NO: 4339932 - DNA, 22 bp, Homo sapiens
aactgactttatttattgctta

SEQ ID NO: 4339933 - DNA, 15 bp, Homo sapiens
aactgctttgtgcat

SEQ ID NO: 4339934 - DNA, 16 bp, Homo sapiens
aactgctttgtgcata

SEQ ID NO: 4339935 - DNA, 17 bp, Homo sapiens
aactgctttgtgcatat

SEQ ID NO: 4339936 - DNA, 18 bp, Homo sapiens
aactgctttgtgcatatg

SEQ ID NO: 4339937 - DNA, 12 bp, Homo sapiens
aactgggaagaa

SEQ ID NO: 4339938 - DNA, 13 bp, Homo sapiens
aactgggaagaac

SEQ ID NO: 4339939 - DNA, 10 bp, Homo sapiens
aactgtattt

SEQ ID NO: 4339940 - DNA, 15 bp, Homo sapiens
aactgtatttcagta

SEQ ID NO: 4339941 - DNA, 19 bp, Homo sapiens
aactgtatttttgaagact

SEQ ID NO: 4339942 - DNA, 17 bp, Homo sapiens
aactgtgttcattagaa

SEQ ID NO: 4339943 - DNA, 21 bp, Homo sapiens
aacttagactcctcttcccag

SEQ ID NO: 4339944 - DNA, 20 bp, Homo sapiens
aacttatatactatttccct

SEQ ID NO: 4339945 - DNA, 23 bp, Homo sapiens
aacttgccaaaatgttggctgcg

SEQ ID NO: 4339946 - DNA, 16 bp, Homo sapiens
aacttgtttttattgc

SEQ ID NO: 4339947 - DNA, 13 bp, Homo sapiens
aactttgaagcca

SEQ ID NO: 4339948 - DNA, 14 bp, Homo sapiens
aactttgaagccat

SEQ ID NO: 4339949 - DNA, 22 bp, Homo sapiens
aactttgcaaattatttattac

SEQ ID NO: 4339950 - DNA, 15 bp, Homo sapiens
aactttgctccaggc

SEQ ID NO: 4339951 - DNA, 12 bp, Homo sapiens
aacttttcattt

SEQ ID NO: 4339952 - DNA, 17 bp, Homo sapiens
aacttttcatttcagat

SEQ ID NO: 4339953 - DNA, 21 bp, Homo sapiens
aacttttcatttcagatttta

SEQ ID NO: 4339954 - DNA, 14 bp, Homo sapiens
aactttttttcagt

SEQ ID NO: 4339955 - DNA, 15 bp, Homo sapiens
aactttttttcagtt

SEQ ID NO: 4339956 - DNA, 19 bp, Homo sapiens
aagaaaaaatattttccct

SEQ ID NO: 4339957 - DNA, 18 bp, Homo sapiens
aagaaaaagaaaaagaaa

SEQ ID NO: 4339958 - DNA, 12 bp, Homo sapiens
aagaaaattctc

SEQ ID NO: 4339959 - DNA, 15 bp, Homo sapiens
aagaaaattctctca

SEQ ID NO: 4339960 - DNA, 17 bp, Homo sapiens
aagaaacttttgaaaaa

SEQ ID NO: 4339961 - DNA, 19 bp, Homo sapiens
aagaaagccaccttgttac

SEQ ID NO: 4339962 - DNA, 18 bp, Homo sapiens
aagaaaggctgtggaagg

SEQ ID NO: 4339963 - DNA, 17 bp, Homo sapiens
aagaaatgggactctga

SEQ ID NO: 4339964 - DNA, 14 bp, Homo sapiens
aagaactcattatt

SEQ ID NO: 4339965 - DNA, 20 bp, Homo sapiens
aagaactgaatccatatttc

SEQ ID NO: 4339966 - DNA, 12 bp, Homo sapiens
aagaagaaggag

SEQ ID NO: 4339967 - DNA, 24 bp, Homo sapiens
aagaagaccctttgttgaaaaatg

SEQ ID NO: 4339968 - DNA, 22 bp, Homo sapiens
aagaagatcacgctccccgcct

SEQ ID NO: 4339969 - DNA, 14 bp, Homo sapiens
aagaagctctctcc

SEQ ID NO: 4339970 - DNA, 17 bp, Homo sapiens
aagaagttttttacttt

SEQ ID NO: 4339971 - DNA, 18 bp, Homo sapiens
aagaatagcctattgtct

SEQ ID NO: 4339972 - DNA, 19 bp, Homo sapiens
aagaataggtgcaaacaaa

SEQ ID NO: 4339973 - DNA, 19 bp, Homo sapiens
aagaatttctggaagaaag

SEQ ID NO: 4339974 - DNA, 20 bp, Homo sapiens
aagaatttctggaagaaagg

SEQ ID NO: 4339975 - DNA, 21 bp, Homo sapiens
aagaatttctggaagaaaggc

SEQ ID NO: 4339976 - DNA, 20 bp, Homo sapiens
aagaatttgaggtctacatt

SEQ ID NO: 4339977 - DNA, 20 bp, Homo sapiens
aagacaatgtgaaaagaaaa

SEQ ID NO: 4339978 - DNA, 22 bp, Homo sapiens
aagacactaattccttaaatga

SEQ ID NO: 4339979 - DNA, 15 bp, Homo sapiens
aagacagtatgagaa

SEQ ID NO: 4339980 - DNA, 20 bp, Homo sapiens
aagacatctgcctgtaatta

SEQ ID NO: 4339981 - DNA, 14 bp, Homo sapiens
aagactatttttct

SEQ ID NO: 4339982 - DNA, 13 bp, Homo sapiens
aagagaaaaaata

SEQ ID NO: 4339983 - DNA, 23 bp, Homo sapiens
aagagaaaccttgcaaactctat

SEQ ID NO: 4339984 - DNA, 17 bp, Homo sapiens
aagagagcttattgttt

SEQ ID NO: 4339985 - DNA, 16 bp, Homo sapiens
aagagattgtggtttc

SEQ ID NO: 4339986 - DNA, 17 bp, Homo sapiens
aagaggaagttagagat

SEQ ID NO: 4339987 - DNA, 18 bp, Homo sapiens
aagaggaggcagaaagat

SEQ ID NO: 4339988 - DNA, 14 bp, Homo sapiens
aagagggacagagc

SEQ ID NO: 4339989 - DNA, 17 bp, Homo sapiens
aagagggacagagcccg

SEQ ID NO: 4339990 - DNA, 23 bp, Homo sapiens
aagagggactgtatttctgtgga

SEQ ID NO: 4339991 - DNA, 21 bp, Homo sapiens
aagagtgttatcatattggtg

SEQ ID NO: 4339992 - DNA, 23 bp, Homo sapiens
aagataagacttgtttctttctg

SEQ ID NO: 4339993 - DNA, 16 bp, Homo sapiens
aagataagtctacatt

SEQ ID NO: 4339994 - DNA, 13 bp, Homo sapiens
aagatatggagaa

SEQ ID NO: 4339995 - DNA, 13 bp, Homo sapiens
aagatggagagga

SEQ ID NO: 4339996 - DNA, 14 bp, Homo sapiens
aagatggagaggaa

SEQ ID NO: 4339997 - DNA, 22 bp, Homo sapiens
aagattatagctcccaaaagaa

SEQ ID NO: 4339998 - DNA, 23 bp, Homo sapiens
aagattatagctcccaaaagaat

SEQ ID NO: 4339999 - DNA, 12 bp, Homo sapiens
aagatttcagta

SEQ ID NO: 4340000 - DNA, 15 bp, Homo sapiens
aagatttcagtagaa

SEQ ID NO: 4340001 - DNA, 16 bp, Homo sapiens
aagatttgaaaacaaa

SEQ ID NO: 4340002 - DNA, 20 bp, Homo sapiens
aagatttgacgttgttgtca

SEQ ID NO: 4340003 - DNA, 23 bp, Homo sapiens
aagattttttttttaagtgacat

SEQ ID NO: 4340004 - DNA, 15 bp, Homo sapiens
aagcaagaagaattg

SEQ ID NO: 4340005 - DNA, 14 bp, Homo sapiens
aagcaattaaatga

SEQ ID NO: 4340006 - DNA, 15 bp, Homo sapiens
aagcaccagggagag

SEQ ID NO: 4340007 - DNA, 13 bp, Homo sapiens
aagcactagagaa

SEQ ID NO: 4340008 - DNA, 20 bp, Homo sapiens
aagcactagagaatgcacag

SEQ ID NO: 4340009 - DNA, 14 bp, Homo sapiens
aagcagaggaagga

SEQ ID NO: 4340010 - DNA, 20 bp, Homo sapiens
aagcagaggaaggaaacata

SEQ ID NO: 4340011 - DNA, 14 bp, Homo sapiens
aagcagtaaaataa

SEQ ID NO: 4340012 - DNA, 13 bp, Homo sapiens
aagcattacttta

SEQ ID NO: 4340013 - DNA, 15 bp, Homo sapiens
aagcattactttaac

SEQ ID NO: 4340014 - DNA, 18 bp, Homo sapiens
aagcattactttaacctc

SEQ ID NO: 4340015 - DNA, 20 bp, Homo sapiens
aagccaacaggtaaacacat

SEQ ID NO: 4340016 - DNA, 19 bp, Homo sapiens
aagccaccttgttacaaat

SEQ ID NO: 4340017 - DNA, 22 bp, Homo sapiens
aagccattaaatgaatattttg

SEQ ID NO: 4340018 - DNA, 19 bp, Homo sapiens
aagccctatgtgaaaagat

SEQ ID NO: 4340019 - DNA, 15 bp, Homo sapiens
aagcctgcccttgtc

SEQ ID NO: 4340020 - DNA, 18 bp, Homo sapiens
aagcctgcccttgtctga

SEQ ID NO: 4340021 - DNA, 15 bp, Homo sapiens
aagccttactcacct

SEQ ID NO: 4340022 - DNA, 15 bp, Homo sapiens
aagccttttaaatca

SEQ ID NO: 4340023 - DNA, 13 bp, Homo sapiens
aagcgctcatctg

SEQ ID NO: 4340024 - DNA, 14 bp, Homo sapiens
aagcggctggcagc

SEQ ID NO: 4340025 - DNA, 17 bp, Homo sapiens
aagcgtgagacgccacc

SEQ ID NO: 4340026 - DNA, 16 bp, Homo sapiens
aagctagactgtgtct

SEQ ID NO: 4340027 - DNA, 15 bp, Homo sapiens
aagctcccacaccca

SEQ ID NO: 4340028 - DNA, 23 bp, Homo sapiens
aagctcccacacccacctctgcc

SEQ ID NO: 4340029 - DNA, 11 bp, Homo sapiens
aagctgatttc

SEQ ID NO: 4340030 - DNA, 22 bp, Homo sapiens
aagctggccctcagctccctga

SEQ ID NO: 4340031 - DNA, 11 bp, Homo sapiens
aagctgggcag

SEQ ID NO: 4340032 - DNA, 15 bp, Homo sapiens
aagctgggcaggttg

SEQ ID NO: 4340033 - DNA, 18 bp, Homo sapiens
aagctgttactgtcttca

SEQ ID NO: 4340034 - DNA, 15 bp, Homo sapiens
aagcttctataaaat

SEQ ID NO: 4340035 - DNA, 13 bp, Homo sapiens
aagctttatcttt

SEQ ID NO: 4340036 - DNA, 15 bp, Homo sapiens
aagctttatctttgt

SEQ ID NO: 4340037 - DNA, 17 bp, Homo sapiens
aagcttttcctttcttt

SEQ ID NO: 4340038 - DNA, 16 bp, Homo sapiens
aaggaaaaagcacaag

SEQ ID NO: 4340039 - DNA, 19 bp, Homo sapiens
aaggaaaaagcacaagaag

SEQ ID NO: 4340040 - DNA, 18 bp, Homo sapiens
aaggaactgatacatctg

SEQ ID NO: 4340041 - DNA, 11 bp, Homo sapiens
aaggagagcta

SEQ ID NO: 4340042 - DNA, 17 bp, Homo sapiens
aaggatcaccccagccc

SEQ ID NO: 4340043 - DNA, 13 bp, Homo sapiens
aaggattgaaaat

SEQ ID NO: 4340044 - DNA, 16 bp, Homo sapiens
aaggcatgttcctctg

SEQ ID NO: 4340045 - DNA, 14 bp, Homo sapiens
aaggccagaaaaag

SEQ ID NO: 4340046 - DNA, 20 bp, Homo sapiens
aaggccggagacccacagcc

SEQ ID NO: 4340047 - DNA, 15 bp, Homo sapiens
aaggctcagaggagc

SEQ ID NO: 4340048 - DNA, 14 bp, Homo sapiens
aaggctgggggaag

SEQ ID NO: 4340049 - DNA, 22 bp, Homo sapiens
aaggctgggggaagaagctctc

SEQ ID NO: 4340050 - DNA, 13 bp, Homo sapiens
aaggcttatctct

SEQ ID NO: 4340051 - DNA, 13 bp, Homo sapiens
aagggagaaatgc

SEQ ID NO: 4340052 - DNA, 22 bp, Homo sapiens
aagggccaatggagaaaatgaa

SEQ ID NO: 4340053 - DNA, 14 bp, Homo sapiens
aaggggatgggaaa

SEQ ID NO: 4340054 - DNA, 22 bp, Homo sapiens
aaggggatgggaaataaagaaa

SEQ ID NO: 4340055 - DNA, 20 bp, Homo sapiens
aaggggtgattgaaagaaaa

SEQ ID NO: 4340056 - DNA, 22 bp, Homo sapiens
aaggggtgattgaaagaaaaaa

SEQ ID NO: 4340057 - DNA, 15 bp, Homo sapiens
aagggtaacttgttt

SEQ ID NO: 4340058 - DNA, 11 bp, Homo sapiens
aaggtgggagg

SEQ ID NO: 4340059 - DNA, 21 bp, Homo sapiens
aagtaaagccattaaatgaat

SEQ ID NO: 4340060 - DNA, 16 bp, Homo sapiens
aagtaacagtatgtca

SEQ ID NO: 4340061 - DNA, 21 bp, Homo sapiens
aagtaatcgggcgcccgaaga

SEQ ID NO: 4340062 - DNA, 23 bp, Homo sapiens
aagtacagctgacggtttctccc

SEQ ID NO: 4340063 - DNA, 23 bp, Homo sapiens
aagtacagtcccagcacatttcc

SEQ ID NO: 4340064 - DNA, 20 bp, Homo sapiens
aagtactgtttaccattttt

SEQ ID NO: 4340065 - DNA, 18 bp, Homo sapiens
aagtagacaatcattgtt

SEQ ID NO: 4340066 - DNA, 14 bp, Homo sapiens
aagtataaggtgct

SEQ ID NO: 4340067 - DNA, 12 bp, Homo sapiens
aagtatagagag

SEQ ID NO: 4340068 - DNA, 19 bp, Homo sapiens
aagtcagagttaaaatata

SEQ ID NO: 4340069 - DNA, 21 bp, Homo sapiens
aagtcagagttaaaatatata

SEQ ID NO: 4340070 - DNA, 16 bp, Homo sapiens
aagtcatcaaagtggg

SEQ ID NO: 4340071 - DNA, 13 bp, Homo sapiens
aagtcattcctaa

SEQ ID NO: 4340072 - DNA, 21 bp, Homo sapiens
aagtcattcctaatcttggtc

SEQ ID NO: 4340073 - DNA, 19 bp, Homo sapiens
aagtcgttttccaaactga

SEQ ID NO: 4340074 - DNA, 14 bp, Homo sapiens
aagtgcctgctggg

SEQ ID NO: 4340075 - DNA, 20 bp, Homo sapiens
aagtgcttattctctcatca

SEQ ID NO: 4340076 - DNA, 23 bp, Homo sapiens
aagtgtcacctccttccccagct

SEQ ID NO: 4340077 - DNA, 15 bp, Homo sapiens
aagtgttagatagaa

SEQ ID NO: 4340078 - DNA, 12 bp, Homo sapiens
aagtgttcagtg

SEQ ID NO: 4340079 - DNA, 15 bp, Homo sapiens
aagtgttcagtgttg

SEQ ID NO: 4340080 - DNA, 16 bp, Homo sapiens
aagtgttcagtgttga

SEQ ID NO: 4340081 - DNA, 19 bp, Homo sapiens
aagtgttcagtgttgacat

SEQ ID NO: 4340082 - DNA, 23 bp, Homo sapiens
aagtgttcagtgttgacatagcc

SEQ ID NO: 4340083 - DNA, 23 bp, Homo sapiens
aagtgttttgttctttctggagt

SEQ ID NO: 4340084 - DNA, 22 bp, Homo sapiens
aagttatataaaggcaaggaaa

SEQ ID NO: 4340085 - DNA, 23 bp, Homo sapiens
aagttatataaaggcaaggaaat

SEQ ID NO: 4340086 - DNA, 18 bp, Homo sapiens
aagttgaaaatacattct

SEQ ID NO: 4340087 - DNA, 14 bp, Homo sapiens
aagtttttctctca

SEQ ID NO: 4340088 - DNA, 12 bp, Homo sapiens
aataaaaaacct

SEQ ID NO: 4340089 - DNA, 17 bp, Homo sapiens
aataaaaattatgaaat

SEQ ID NO: 4340090 - DNA, 17 bp, Homo sapiens
aataaaatggatagaaa

SEQ ID NO: 4340091 - DNA, 18 bp, Homo sapiens
aataaactttgaataaaa

SEQ ID NO: 4340092 - DNA, 21 bp, Homo sapiens
aataaactttgaataaaagaa

SEQ ID NO: 4340093 - DNA, 19 bp, Homo sapiens
aataaagaaaattctctca

SEQ ID NO: 4340094 - DNA, 20 bp, Homo sapiens
aataaagcattctttaacag

SEQ ID NO: 4340095 - DNA, 21 bp, Homo sapiens
aataaagccttttaaatcatc

SEQ ID NO: 4340096 - DNA, 14 bp, Homo sapiens
aataaatagaaaga

SEQ ID NO: 4340097 - DNA, 13 bp, Homo sapiens
aataaatgttcaa

SEQ ID NO: 4340098 - DNA, 15 bp, Homo sapiens
aataactgaataaaa

SEQ ID NO: 4340099 - DNA, 13 bp, Homo sapiens
aataatattgttt

SEQ ID NO: 4340100 - DNA, 16 bp, Homo sapiens
aataatattgtttttc

SEQ ID NO: 4340101 - DNA, 17 bp, Homo sapiens
aataatattgtttttct

SEQ ID NO: 4340102 - DNA, 22 bp, Homo sapiens
aataatattgtttttctttcta

SEQ ID NO: 4340103 - DNA, 15 bp, Homo sapiens
aataattatttcaga

SEQ ID NO: 4340104 - DNA, 20 bp, Homo sapiens
aatacagtatctcagggcct

SEQ ID NO: 4340105 - DNA, 20 bp, Homo sapiens
aatactctaccctcttagaa

SEQ ID NO: 4340106 - DNA, 17 bp, Homo sapiens
aatacttaaatatttgt

SEQ ID NO: 4340107 - DNA, 18 bp, Homo sapiens
aatagaaaagtagacaat

SEQ ID NO: 4340108 - DNA, 17 bp, Homo sapiens
aatagaatccaaaccca

SEQ ID NO: 4340109 - DNA, 11 bp, Homo sapiens
aataggaattc

SEQ ID NO: 4340110 - DNA, 15 bp, Homo sapiens
aataggtgcaaacaa

SEQ ID NO: 4340111 - DNA, 19 bp, Homo sapiens
aatatactgtcttgtctca

SEQ ID NO: 4340112 - DNA, 10 bp, Homo sapiens
aatatatata

SEQ ID NO: 4340113 - DNA, 13 bp, Homo sapiens
aatatatataaag

SEQ ID NO: 4340114 - DNA, 22 bp, Homo sapiens
aatatatataaagaatatatat

SEQ ID NO: 4340115 - DNA, 14 bp, Homo sapiens
aatatatgtatata

SEQ ID NO: 4340116 - DNA, 22 bp, Homo sapiens
aatatatgtatatatattctca

SEQ ID NO: 4340117 - DNA, 16 bp, Homo sapiens
aatatattactgattt

SEQ ID NO: 4340118 - DNA, 17 bp, Homo sapiens
aatatattactgattta

SEQ ID NO: 4340119 - DNA, 14 bp, Homo sapiens
aatatcctgtaata

SEQ ID NO: 4340120 - DNA, 14 bp, Homo sapiens
aatatgacacagct

SEQ ID NO: 4340121 - DNA, 20 bp, Homo sapiens
aatatgacacagcttgtgaa

SEQ ID NO: 4340122 - DNA, 20 bp, Homo sapiens
aatattactcctatttttgt

SEQ ID NO: 4340123 - DNA, 17 bp, Homo sapiens
aatattggttagtattt

SEQ ID NO: 4340124 - DNA, 18 bp, Homo sapiens
aatattgtttttctttct

SEQ ID NO: 4340125 - DNA, 14 bp, Homo sapiens
aatatttactgaga

SEQ ID NO: 4340126 - DNA, 15 bp, Homo sapiens
aatattttctgggtt

SEQ ID NO: 4340127 - DNA, 18 bp, Homo sapiens
aatattttgataataata

SEQ ID NO: 4340128 - DNA, 23 bp, Homo sapiens
aatcaaggatcttttggacctgg

SEQ ID NO: 4340129 - DNA, 21 bp, Homo sapiens
aatcacattttaagtgcttca

SEQ ID NO: 4340130 - DNA, 11 bp, Homo sapiens
aatcagcctgc

SEQ ID NO: 4340131 - DNA, 19 bp, Homo sapiens
aatcagcctgctccagctg

SEQ ID NO: 4340132 - DNA, 17 bp, Homo sapiens
aatcatattgagaataa

SEQ ID NO: 4340133 - DNA, 21 bp, Homo sapiens
aatcatattgagaataattat

SEQ ID NO: 4340134 - DNA, 15 bp, Homo sapiens
aatcatgtctgtatc

SEQ ID NO: 4340135 - DNA, 16 bp, Homo sapiens
aatcattgttttgaat

SEQ ID NO: 4340136 - DNA, 19 bp, Homo sapiens
aatcattgttttgaatatt

SEQ ID NO: 4340137 - DNA, 20 bp, Homo sapiens
aatcattgttttgaatatta

SEQ ID NO: 4340138 - DNA, 14 bp, Homo sapiens
aatcatttggttaa

SEQ ID NO: 4340139 - DNA, 13 bp, Homo sapiens
aatcattttggag

SEQ ID NO: 4340140 - DNA, 13 bp, Homo sapiens
aatccaaacccac

SEQ ID NO: 4340141 - DNA, 17 bp, Homo sapiens
aatccatatttcaacag

SEQ ID NO: 4340142 - DNA, 11 bp, Homo sapiens
aatccatgctt

SEQ ID NO: 4340143 - DNA, 15 bp, Homo sapiens
aatccatgcttcact

SEQ ID NO: 4340144 - DNA, 16 bp, Homo sapiens
aatcgatccatgtttt

SEQ ID NO: 4340145 - DNA, 20 bp, Homo sapiens
aatctaagtatatgtgagaa

SEQ ID NO: 4340146 - DNA, 18 bp, Homo sapiens
aatctaatatccccaaat

SEQ ID NO: 4340147 - DNA, 16 bp, Homo sapiens
aatctatattaaatga

SEQ ID NO: 4340148 - DNA, 19 bp, Homo sapiens
aatctggacatttgttcca

SEQ ID NO: 4340149 - DNA, 19 bp, Homo sapiens
aatctgggaagatttgaaa

SEQ ID NO: 4340150 - DNA, 18 bp, Homo sapiens
aatctggggaagaggttt

SEQ ID NO: 4340151 - DNA, 14 bp, Homo sapiens
aatcttaagaggat

SEQ ID NO: 4340152 - DNA, 21 bp, Homo sapiens
aatcttggtcatgtcctgagg

SEQ ID NO: 4340153 - DNA, 15 bp, Homo sapiens
aatgaagtcactatt

SEQ ID NO: 4340154 - DNA, 18 bp, Homo sapiens
aatgaatattttgataat

SEQ ID NO: 4340155 - DNA, 17 bp, Homo sapiens
aatgactattgtaatgc

SEQ ID NO: 4340156 - DNA, 18 bp, Homo sapiens
aatgagaatctgtgcagt

SEQ ID NO: 4340157 - DNA, 11 bp, Homo sapiens
aatgagcctgg

SEQ ID NO: 4340158 - DNA, 12 bp, Homo sapiens
aatgagcctggc

SEQ ID NO: 4340159 - DNA, 13 bp, Homo sapiens
aatgagcctggca

SEQ ID NO: 4340160 - DNA, 14 bp, Homo sapiens
aatgagcctggcaa

SEQ ID NO: 4340161 - DNA, 23 bp, Homo sapiens
aatgagtaggatgtctcttggaa

SEQ ID NO: 4340162 - DNA, 18 bp, Homo sapiens
aatgagttgctggaaaat

SEQ ID NO: 4340163 - DNA, 15 bp, Homo sapiens
aatgatacagtcagg

SEQ ID NO: 4340164 - DNA, 19 bp, Homo sapiens
aatgatcacatctaaagct

SEQ ID NO: 4340165 - DNA, 19 bp, Homo sapiens
aatgatccctcagtctgag

SEQ ID NO: 4340166 - DNA, 20 bp, Homo sapiens
aatgatccctcagtctgaga

SEQ ID NO: 4340167 - DNA, 21 bp, Homo sapiens
aatgattggttaaaatgtgat

SEQ ID NO: 4340168 - DNA, 22 bp, Homo sapiens
aatgcaagtgaacttgggaggg

SEQ ID NO: 4340169 - DNA, 19 bp, Homo sapiens
aatgcattttcttcagaat

SEQ ID NO: 4340170 - DNA, 20 bp, Homo sapiens
aatgccaatatgacacagct

SEQ ID NO: 4340171 - DNA, 23 bp, Homo sapiens
aatgccacgtgccattgtctttc

SEQ ID NO: 4340172 - DNA, 21 bp, Homo sapiens
aatgctattttaaaaaatata

SEQ ID NO: 4340173 - DNA, 16 bp, Homo sapiens
aatgctcatacacagt

SEQ ID NO: 4340174 - DNA, 16 bp, Homo sapiens
aatgctgagctgaaga

SEQ ID NO: 4340175 - DNA, 23 bp, Homo sapiens
aatgctgagctgaagaaattata

SEQ ID NO: 4340176 - DNA, 13 bp, Homo sapiens
aatggacattttc

SEQ ID NO: 4340177 - DNA, 16 bp, Homo sapiens
aatggagaaaatgaat

SEQ ID NO: 4340178 - DNA, 21 bp, Homo sapiens
aatggagaaaatgaatggaca

SEQ ID NO: 4340179 - DNA, 15 bp, Homo sapiens
aatggagaaatgaag

SEQ ID NO: 4340180 - DNA, 13 bp, Homo sapiens
aatggagtgtttg

SEQ ID NO: 4340181 - DNA, 15 bp, Homo sapiens
aatggagtgtttgaa

SEQ ID NO: 4340182 - DNA, 15 bp, Homo sapiens
aatggatagaaaaaa

SEQ ID NO: 4340183 - DNA, 18 bp, Homo sapiens
aatggatagaaaaaaact

SEQ ID NO: 4340184 - DNA, 16 bp, Homo sapiens
aatggatgacaaagaa

SEQ ID NO: 4340185 - DNA, 10 bp, Homo sapiens
aatggctgct

SEQ ID NO: 4340186 - DNA, 12 bp, Homo sapiens
aatgggtaatat

SEQ ID NO: 4340187 - DNA, 22 bp, Homo sapiens
aatggtttctcattaaactcta

SEQ ID NO: 4340188 - DNA, 15 bp, Homo sapiens
aatgtaatgtcagac

SEQ ID NO: 4340189 - DNA, 17 bp, Homo sapiens
aatgtaatgtcagactt

SEQ ID NO: 4340190 - DNA, 16 bp, Homo sapiens
aatgtacttaaatgag

SEQ ID NO: 4340191 - DNA, 22 bp, Homo sapiens
aatgtacttaaatgagttactt

SEQ ID NO: 4340192 - DNA, 16 bp, Homo sapiens
aatgtagactctgact

SEQ ID NO: 4340193 - DNA, 23 bp, Homo sapiens
aatgtagccctctccaaatcaag

SEQ ID NO: 4340194 - DNA, 20 bp, Homo sapiens
aatgtaggcacttttatttt

SEQ ID NO: 4340195 - DNA, 16 bp, Homo sapiens
aatgtcagactttgct

SEQ ID NO: 4340196 - DNA, 20 bp, Homo sapiens
aatgtctgtcagaagacact

SEQ ID NO: 4340197 - DNA, 22 bp, Homo sapiens
aatgtctgtcagaagacactaa

SEQ ID NO: 4340198 - DNA, 15 bp, Homo sapiens
aatgtgaaaagaaaa

SEQ ID NO: 4340199 - DNA, 14 bp, Homo sapiens
aatgtgatcaactg

SEQ ID NO: 4340200 - DNA, 18 bp, Homo sapiens
aatgtgatcaactgttca

SEQ ID NO: 4340201 - DNA, 19 bp, Homo sapiens
aatgtgggtgaagtgcctg

SEQ ID NO: 4340202 - DNA, 18 bp, Homo sapiens
aatgtgtctgtgttgctt

SEQ ID NO: 4340203 - DNA, 14 bp, Homo sapiens
aatgttacatctgt

SEQ ID NO: 4340204 - DNA, 22 bp, Homo sapiens
aatgtttacagggagcctcctg

SEQ ID NO: 4340205 - DNA, 20 bp, Homo sapiens
aatgtttccaacctggagta

SEQ ID NO: 4340206 - DNA, 15 bp, Homo sapiens
aattaaaaactttaa

SEQ ID NO: 4340207 - DNA, 13 bp, Homo sapiens
aattaaagcctta

SEQ ID NO: 4340208 - DNA, 14 bp, Homo sapiens
aattaaataaactg

SEQ ID NO: 4340209 - DNA, 16 bp, Homo sapiens
aattaaataaactgtt

SEQ ID NO: 4340210 - DNA, 15 bp, Homo sapiens
aattaagaactgaat

SEQ ID NO: 4340211 - DNA, 22 bp, Homo sapiens
aattaccatagagtaatgatgt

SEQ ID NO: 4340212 - DNA, 15 bp, Homo sapiens
aattagccaagtgtg

SEQ ID NO: 4340213 - DNA, 23 bp, Homo sapiens
aattagtcgggcatgagtctgtt

SEQ ID NO: 4340214 - DNA, 14 bp, Homo sapiens
aattataaaattga

SEQ ID NO: 4340215 - DNA, 15 bp, Homo sapiens
aattataaaattgaa

SEQ ID NO: 4340216 - DNA, 23 bp, Homo sapiens
aattataaaattgaaaacactaa

SEQ ID NO: 4340217 - DNA, 18 bp, Homo sapiens
aattatacgtacatacac

SEQ ID NO: 4340218 - DNA, 17 bp, Homo sapiens
aattatccattacgtgc

SEQ ID NO: 4340219 - DNA, 18 bp, Homo sapiens
aattatgcactaaatatg

SEQ ID NO: 4340220 - DNA, 19 bp, Homo sapiens
aattatgtaacctatttat

SEQ ID NO: 4340221 - DNA, 14 bp, Homo sapiens
aattattgatatat

SEQ ID NO: 4340222 - DNA, 15 bp, Homo sapiens
aattattggtatatt

SEQ ID NO: 4340223 - DNA, 22 bp, Homo sapiens
aattattggtatatttgtagat

SEQ ID NO: 4340224 - DNA, 14 bp, Homo sapiens
aattccccaccctg

SEQ ID NO: 4340225 - DNA, 18 bp, Homo sapiens
aattcctacagcactact

SEQ ID NO: 4340226 - DNA, 23 bp, Homo sapiens
aattcgcccgagctgtttatgtt

SEQ ID NO: 4340227 - DNA, 13 bp, Homo sapiens
aattctataaaaa

SEQ ID NO: 4340228 - DNA, 20 bp, Homo sapiens
aattctcagtcatgcactca

SEQ ID NO: 4340229 - DNA, 18 bp, Homo sapiens
aattctctcaagacttct

SEQ ID NO: 4340230 - DNA, 14 bp, Homo sapiens
aattctgtttttct

SEQ ID NO: 4340231 - DNA, 15 bp, Homo sapiens
aattcttatgcttat

SEQ ID NO: 4340232 - DNA, 14 bp, Homo sapiens
aattgaaaacacta

SEQ ID NO: 4340233 - DNA, 20 bp, Homo sapiens
aattgacaagctaggaaaga

SEQ ID NO: 4340234 - DNA, 15 bp, Homo sapiens
aattgatcagatgct

SEQ ID NO: 4340235 - DNA, 17 bp, Homo sapiens
aattggaacaaagtgaa

SEQ ID NO: 4340236 - DNA, 16 bp, Homo sapiens
aattggcataatttgt

SEQ ID NO: 4340237 - DNA, 20 bp, Homo sapiens
aattggtcatggtagatttt

SEQ ID NO: 4340238 - DNA, 16 bp, Homo sapiens
aattgtagttcttagt

SEQ ID NO: 4340239 - DNA, 20 bp, Homo sapiens
aattgtgcttctccccagaa

SEQ ID NO: 4340240 - DNA, 23 bp, Homo sapiens
aattgtgtggagaactcagtgcc

SEQ ID NO: 4340241 - DNA, 14 bp, Homo sapiens
aattgtttatacac

SEQ ID NO: 4340242 - DNA, 16 bp, Homo sapiens
aatttagaaagcttaa

SEQ ID NO: 4340243 - DNA, 13 bp, Homo sapiens
aatttagagcgtt

SEQ ID NO: 4340244 - DNA, 18 bp, Homo sapiens
aatttccaaaataatcta

SEQ ID NO: 4340245 - DNA, 16 bp, Homo sapiens
aatttctggaagaaag

SEQ ID NO: 4340246 - DNA, 18 bp, Homo sapiens
aatttctggaagaaaggc

SEQ ID NO: 4340247 - DNA, 23 bp, Homo sapiens
aatttgaaaacataatctgcaaa

SEQ ID NO: 4340248 - DNA, 19 bp, Homo sapiens
aatttgaaaataattgttc

SEQ ID NO: 4340249 - DNA, 22 bp, Homo sapiens
aatttgaggtctacattcttgg

SEQ ID NO: 4340250 - DNA, 15 bp, Homo sapiens
aatttggagcattaa

SEQ ID NO: 4340251 - DNA, 14 bp, Homo sapiens
aattttttaatttc

SEQ ID NO: 4340252 - DNA, 22 bp, Homo sapiens
acaaaatttgaataataaatcg

SEQ ID NO: 4340253 - DNA, 15 bp, Homo sapiens
acaaacgggctcagc

SEQ ID NO: 4340254 - DNA, 20 bp, Homo sapiens
acaaacttctcgcaactgaa

SEQ ID NO: 4340255 - DNA, 10 bp, Homo sapiens
acaaagaaaa

SEQ ID NO: 4340256 - DNA, 16 bp, Homo sapiens
acaaagaaaatgagaa

SEQ ID NO: 4340257 - DNA, 14 bp, Homo sapiens
acaaagagaccagg

SEQ ID NO: 4340258 - DNA, 22 bp, Homo sapiens
acaaagataagacttgtttctt

SEQ ID NO: 4340259 - DNA, 17 bp, Homo sapiens
acaaagcaaatttcatt

SEQ ID NO: 4340260 - DNA, 15 bp, Homo sapiens
acaaagcactagaga

SEQ ID NO: 4340261 - DNA, 17 bp, Homo sapiens
acaaagcactagagaat

SEQ ID NO: 4340262 - DNA, 20 bp, Homo sapiens
acaaagctcaggaatcctac

SEQ ID NO: 4340263 - DNA, 14 bp, Homo sapiens
acaaatatatgtat

SEQ ID NO: 4340264 - DNA, 18 bp, Homo sapiens
acaaattctactttaata

SEQ ID NO: 4340265 - DNA, 18 bp, Homo sapiens
acaacagctcgatccaaa

SEQ ID NO: 4340266 - DNA, 20 bp, Homo sapiens
acaacagctcgatccaaatt

SEQ ID NO: 4340267 - DNA, 22 bp, Homo sapiens
acaacagctcgatccaaattgt

SEQ ID NO: 4340268 - DNA, 23 bp, Homo sapiens
acaactttgcaaattatttatta

SEQ ID NO: 4340269 - DNA, 22 bp, Homo sapiens
acaagagggactgtatttctgt

SEQ ID NO: 4340270 - DNA, 22 bp, Homo sapiens
acaagctgcaccctcaggcagg

SEQ ID NO: 4340271 - DNA, 21 bp, Homo sapiens
acaaggccagaaaaagaagaa

SEQ ID NO: 4340272 - DNA, 18 bp, Homo sapiens
acaatgatgccgaacatt

SEQ ID NO: 4340273 - DNA, 14 bp, Homo sapiens
acaatgattttctt

SEQ ID NO: 4340274 - DNA, 15 bp, Homo sapiens
acaatgtgtttttct

SEQ ID NO: 4340275 - DNA, 19 bp, Homo sapiens
acaatgtgtttttctccag

SEQ ID NO: 4340276 - DNA, 21 bp, Homo sapiens
acaatttgttcttgtatttta

SEQ ID NO: 4340277 - DNA, 14 bp, Homo sapiens
acacagcttgtgaa

SEQ ID NO: 4340278 - DNA, 23 bp, Homo sapiens
acacagttaaataaatagaaaga

SEQ ID NO: 4340279 - DNA, 17 bp, Homo sapiens
acacatagtttcttttt

SEQ ID NO: 4340280 - DNA, 17 bp, Homo sapiens
acacatataaaaacaat

SEQ ID NO: 4340281 - DNA, 13 bp, Homo sapiens
acacatctttcct

SEQ ID NO: 4340282 - DNA, 20 bp, Homo sapiens
acacatgtgctgatgtttac

SEQ ID NO: 4340283 - DNA, 15 bp, Homo sapiens
acaccagcccctgcc

SEQ ID NO: 4340284 - DNA, 21 bp, Homo sapiens
acaccagcccctgccccagcc

SEQ ID NO: 4340285 - DNA, 22 bp, Homo sapiens
acaccagcccctgccccagccc

SEQ ID NO: 4340286 - DNA, 14 bp, Homo sapiens
acaccatcttttgt

SEQ ID NO: 4340287 - DNA, 13 bp, Homo sapiens
acaccgctggctc

SEQ ID NO: 4340288 - DNA, 15 bp, Homo sapiens
acacggacactcaaa

SEQ ID NO: 4340289 - DNA, 13 bp, Homo sapiens
acacggggcagga

SEQ ID NO: 4340290 - DNA, 22 bp, Homo sapiens
acacgtgcgtgtgagtgtgtgt

SEQ ID NO: 4340291 - DNA, 12 bp, Homo sapiens
acactaattcct

SEQ ID NO: 4340292 - DNA, 20 bp, Homo sapiens
acactaattccttaaatgaa

SEQ ID NO: 4340293 - DNA, 14 bp, Homo sapiens
acactccccacggg

SEQ ID NO: 4340294 - DNA, 14 bp, Homo sapiens
acactccttgaaat

SEQ ID NO: 4340295 - DNA, 20 bp, Homo sapiens
acactctcttgggccagccc

SEQ ID NO: 4340296 - DNA, 22 bp, Homo sapiens
acactgcagagactaatgttgg

SEQ ID NO: 4340297 - DNA, 20 bp, Homo sapiens
acactgtgtgtttgggaagg

SEQ ID NO: 4340298 - DNA, 13 bp, Homo sapiens
acactttacctct

SEQ ID NO: 4340299 - DNA, 14 bp, Homo sapiens
acagaaatgttttt

SEQ ID NO: 4340300 - DNA, 16 bp, Homo sapiens
acagacggaaatgaaa

SEQ ID NO: 4340301 - DNA, 20 bp, Homo sapiens
acagagcccgggagagactc

SEQ ID NO: 4340302 - DNA, 17 bp, Homo sapiens
acagaggatgctgaagt

SEQ ID NO: 4340303 - DNA, 15 bp, Homo sapiens
acagatgtgaaggac

SEQ ID NO: 4340304 - DNA, 17 bp, Homo sapiens
acagatgtgaaggacat

SEQ ID NO: 4340305 - DNA, 22 bp, Homo sapiens
acagatgtgaaggacatgagac

SEQ ID NO: 4340306 - DNA, 23 bp, Homo sapiens
acagatgtgaaggacatgagact

SEQ ID NO: 4340307 - DNA, 16 bp, Homo sapiens
acagatttgaggactg

SEQ ID NO: 4340308 - DNA, 21 bp, Homo sapiens
acagcactactgggtgtcatt

SEQ ID NO: 4340309 - DNA, 22 bp, Homo sapiens
acagcactactgggtgtcattt

SEQ ID NO: 4340310 - DNA, 13 bp, Homo sapiens
acagcctgagccg

SEQ ID NO: 4340311 - DNA, 23 bp, Homo sapiens
acagctgacggtttctccccgga

SEQ ID NO: 4340312 - DNA, 20 bp, Homo sapiens
acaggcctgaagatattact

SEQ ID NO: 4340313 - DNA, 13 bp, Homo sapiens
acagggagcctcc

SEQ ID NO: 4340314 - DNA, 22 bp, Homo sapiens
acaggtaaacacataaatgaaa

SEQ ID NO: 4340315 - DNA, 14 bp, Homo sapiens
acagtaaagaggct

SEQ ID NO: 4340316 - DNA, 19 bp, Homo sapiens
acagtaaagaggcttccaa

SEQ ID NO: 4340317 - DNA, 16 bp, Homo sapiens
acagtaatgtagaaat

SEQ ID NO: 4340318 - DNA, 10 bp, Homo sapiens
acagtgcaag

SEQ ID NO: 4340319 - DNA, 20 bp, Homo sapiens
acagtggatgcccatctaaa

SEQ ID NO: 4340320 - DNA, 18 bp, Homo sapiens
acagtggtactctgtgtc

SEQ ID NO: 4340321 - DNA, 13 bp, Homo sapiens
acagttaaataaa

SEQ ID NO: 4340322 - DNA, 15 bp, Homo sapiens
acagttctgtaatgt

SEQ ID NO: 4340323 - DNA, 14 bp, Homo sapiens
acagtttattttct

SEQ ID NO: 4340324 - DNA, 18 bp, Homo sapiens
acatacaaatatatgtat

SEQ ID NO: 4340325 - DNA, 22 bp, Homo sapiens
acatacacaaggccagaaaaag

SEQ ID NO: 4340326 - DNA, 15 bp, Homo sapiens
acatacatacaaata

SEQ ID NO: 4340327 - DNA, 16 bp, Homo sapiens
acatacatacaaatat

SEQ ID NO: 4340328 - DNA, 16 bp, Homo sapiens
acatacatacatacaa

SEQ ID NO: 4340329 - DNA, 16 bp, Homo sapiens
acatagaaacatacac

SEQ ID NO: 4340330 - DNA, 14 bp, Homo sapiens
acatagaggtatat

SEQ ID NO: 4340331 - DNA, 20 bp, Homo sapiens
acatagaggtatattggaag

SEQ ID NO: 4340332 - DNA, 15 bp, Homo sapiens
acatagcctttgtgc

SEQ ID NO: 4340333 - DNA, 18 bp, Homo sapiens
acatatgtgcttctcagt

SEQ ID NO: 4340334 - DNA, 13 bp, Homo sapiens
acatcagatttct

SEQ ID NO: 4340335 - DNA, 14 bp, Homo sapiens
acatcagatttctt

SEQ ID NO: 4340336 - DNA, 17 bp, Homo sapiens
acatcagatttcttaat

SEQ ID NO: 4340337 - DNA, 22 bp, Homo sapiens
acatcctagccccacccagagg

SEQ ID NO: 4340338 - DNA, 13 bp, Homo sapiens
acatctaaagctt

SEQ ID NO: 4340339 - DNA, 15 bp, Homo sapiens
acatctaaagcttta

SEQ ID NO: 4340340 - DNA, 16 bp, Homo sapiens
acatctaaagctttat

SEQ ID NO: 4340341 - DNA, 17 bp, Homo sapiens
acatctaaagctttatc

SEQ ID NO: 4340342 - DNA, 20 bp, Homo sapiens
acatctaaagctttatcttt

SEQ ID NO: 4340343 - DNA, 22 bp, Homo sapiens
acatctaaagctttatctttgt

SEQ ID NO: 4340344 - DNA, 18 bp, Homo sapiens
acatctgatgcatgcttt

SEQ ID NO: 4340345 - DNA, 21 bp, Homo sapiens
acatctgcctgtaattaaact

SEQ ID NO: 4340346 - DNA, 23 bp, Homo sapiens
acatctgggtctactcaaacact

SEQ ID NO: 4340347 - DNA, 22 bp, Homo sapiens
acatctgtctttcatctcccag

SEQ ID NO: 4340348 - DNA, 13 bp, Homo sapiens
acatgactttctt

SEQ ID NO: 4340349 - DNA, 15 bp, Homo sapiens
acatgagactaagag

SEQ ID NO: 4340350 - DNA, 14 bp, Homo sapiens
acatgcaagaattt

SEQ ID NO: 4340351 - DNA, 21 bp, Homo sapiens
acatgctgagtctcccaaggc

SEQ ID NO: 4340352 - DNA, 21 bp, Homo sapiens
acatggccaatagtcatatgt

SEQ ID NO: 4340353 - DNA, 18 bp, Homo sapiens
acattaaacaatgatcac

SEQ ID NO: 4340354 - DNA, 12 bp, Homo sapiens
acattagtttgc

SEQ ID NO: 4340355 - DNA, 15 bp, Homo sapiens
acattattgcttatt

SEQ ID NO: 4340356 - DNA, 21 bp, Homo sapiens
acattcaaggcttatctctgc

SEQ ID NO: 4340357 - DNA, 19 bp, Homo sapiens
acattcttggttgttaatt

SEQ ID NO: 4340358 - DNA, 18 bp, Homo sapiens
acatttcctctctatctt

SEQ ID NO: 4340359 - DNA, 16 bp, Homo sapiens
accaaagctggcccag

SEQ ID NO: 4340360 - DNA, 15 bp, Homo sapiens
accaatctgggaaga

SEQ ID NO: 4340361 - DNA, 23 bp, Homo sapiens
accaattattgatatatattata

SEQ ID NO: 4340362 - DNA, 19 bp, Homo sapiens
accaccgaatatattactg

SEQ ID NO: 4340363 - DNA, 21 bp, Homo sapiens
accaccgaatatattactgat

SEQ ID NO: 4340364 - DNA, 13 bp, Homo sapiens
accacttcagctg

SEQ ID NO: 4340365 - DNA, 14 bp, Homo sapiens
accacttcagctga

SEQ ID NO: 4340366 - DNA, 11 bp, Homo sapiens
accagaagaaa

SEQ ID NO: 4340367 - DNA, 11 bp, Homo sapiens
accagacaggt

SEQ ID NO: 4340368 - DNA, 11 bp, Homo sapiens
accagcccctg

SEQ ID NO: 4340369 - DNA, 12 bp, Homo sapiens
accagcccctgc

SEQ ID NO: 4340370 - DNA, 16 bp, Homo sapiens
accagctggtatattg

SEQ ID NO: 4340371 - DNA, 20 bp, Homo sapiens
accaggagggagagcctctg

SEQ ID NO: 4340372 - DNA, 19 bp, Homo sapiens
accagggcactgtctgcgt

SEQ ID NO: 4340373 - DNA, 20 bp, Homo sapiens
accagggcactgtctgcgtg

SEQ ID NO: 4340374 - DNA, 21 bp, Homo sapiens
accatatcacctctcttctta

SEQ ID NO: 4340375 - DNA, 13 bp, Homo sapiens
accatctctgtga

SEQ ID NO: 4340376 - DNA, 16 bp, Homo sapiens
accatgtatgtggtat

SEQ ID NO: 4340377 - DNA, 14 bp, Homo sapiens
accattgtcttgtt

SEQ ID NO: 4340378 - DNA, 21 bp, Homo sapiens
accattgtcttgttctgtgat

SEQ ID NO: 4340379 - DNA, 20 bp, Homo sapiens
accatttaaagaaagaatgc

SEQ ID NO: 4340380 - DNA, 19 bp, Homo sapiens
accatttgctactgtacat

SEQ ID NO: 4340381 - DNA, 12 bp, Homo sapiens
acccaacagttt

SEQ ID NO: 4340382 - DNA, 13 bp, Homo sapiens
acccaacagttta

SEQ ID NO: 4340383 - DNA, 23 bp, Homo sapiens
acccaacagtttatttttattat

SEQ ID NO: 4340384 - DNA, 13 bp, Homo sapiens
acccacagccctg

SEQ ID NO: 4340385 - DNA, 16 bp, Homo sapiens
acccacagccctgaaa

SEQ ID NO: 4340386 - DNA, 17 bp, Homo sapiens
acccagcagatgtttaa

SEQ ID NO: 4340387 - DNA, 15 bp, Homo sapiens
acccagccatgtgtt

SEQ ID NO: 4340388 - DNA, 15 bp, Homo sapiens
acccataagtaatat

SEQ ID NO: 4340389 - DNA, 14 bp, Homo sapiens
acccatgaagctgg

SEQ ID NO: 4340390 - DNA, 11 bp, Homo sapiens
accccagagtt

SEQ ID NO: 4340391 - DNA, 12 bp, Homo sapiens
accccagagttg

SEQ ID NO: 4340392 - DNA, 17 bp, Homo sapiens
accccagcccccacagc

SEQ ID NO: 4340393 - DNA, 18 bp, Homo sapiens
accccagcccccacagcc

SEQ ID NO: 4340394 - DNA, 16 bp, Homo sapiens
accccaggtgagacct

SEQ ID NO: 4340395 - DNA, 18 bp, Homo sapiens
accccatctctacaaaaa

SEQ ID NO: 4340396 - DNA, 18 bp, Homo sapiens
acccccaaatttaattaa

SEQ ID NO: 4340397 - DNA, 15 bp, Homo sapiens
acccccttctgggca

SEQ ID NO: 4340398 - DNA, 17 bp, Homo sapiens
acccccttttcccttca

SEQ ID NO: 4340399 - DNA, 20 bp, Homo sapiens
acccctcaacacctctgcac

SEQ ID NO: 4340400 - DNA, 13 bp, Homo sapiens
acccctctgtagc

SEQ ID NO: 4340401 - DNA, 19 bp, Homo sapiens
acccctgaggaagatgggg

SEQ ID NO: 4340402 - DNA, 14 bp, Homo sapiens
acccctgcctcctg

SEQ ID NO: 4340403 - DNA, 17 bp, Homo sapiens
acccctgcctcctgcct

SEQ ID NO: 4340404 - DNA, 17 bp, Homo sapiens
acccctttcccccaccc

SEQ ID NO: 4340405 - DNA, 23 bp, Homo sapiens
acccctttcccccaccccagagt

SEQ ID NO: 4340406 - DNA, 16 bp, Homo sapiens
acccgccccgccccct

SEQ ID NO: 4340407 - DNA, 15 bp, Homo sapiens
acccggtgcatctgg

SEQ ID NO: 4340408 - DNA, 16 bp, Homo sapiens
acccggtgcatctggc

SEQ ID NO: 4340409 - DNA, 18 bp, Homo sapiens
acccgttgggtcccttgc

SEQ ID NO: 4340410 - DNA, 14 bp, Homo sapiens
accctattgctgct

SEQ ID NO: 4340411 - DNA, 13 bp, Homo sapiens
accctcaggcagg

SEQ ID NO: 4340412 - DNA, 15 bp, Homo sapiens
accctcaggcaggtg

SEQ ID NO: 4340413 - DNA, 15 bp, Homo sapiens
accctccacttctcc

SEQ ID NO: 4340414 - DNA, 11 bp, Homo sapiens
accctctcttt

SEQ ID NO: 4340415 - DNA, 12 bp, Homo sapiens
accctctctttc

SEQ ID NO: 4340416 - DNA, 14 bp, Homo sapiens
accctcttagaaaa

SEQ ID NO: 4340417 - DNA, 16 bp, Homo sapiens
accctgaaagccctga

SEQ ID NO: 4340418 - DNA, 14 bp, Homo sapiens
accctggaaatgga

SEQ ID NO: 4340419 - DNA, 23 bp, Homo sapiens
accctggaaatggactggtttga

SEQ ID NO: 4340420 - DNA, 19 bp, Homo sapiens
acccttggggtggtgctgg

SEQ ID NO: 4340421 - DNA, 18 bp, Homo sapiens
accctttgttgaaaaatg

SEQ ID NO: 4340422 - DNA, 20 bp, Homo sapiens
accctttgttgaaaaatgtt

SEQ ID NO: 4340423 - DNA, 14 bp, Homo sapiens
accctttgtttctt

SEQ ID NO: 4340424 - DNA, 19 bp, Homo sapiens
acccttttcctttgtggtt

SEQ ID NO: 4340425 - DNA, 17 bp, Homo sapiens
accgccaaggctggggg

SEQ ID NO: 4340426 - DNA, 16 bp, Homo sapiens
accgctctcttttctg

SEQ ID NO: 4340427 - DNA, 15 bp, Homo sapiens
acctaatgctggcct

SEQ ID NO: 4340428 - DNA, 15 bp, Homo sapiens
acctattaaaggaaa

SEQ ID NO: 4340429 - DNA, 22 bp, Homo sapiens
acctcccacctatccgccctgc

SEQ ID NO: 4340430 - DNA, 20 bp, Homo sapiens
acctcccctccccgccccct

SEQ ID NO: 4340431 - DNA, 21 bp, Homo sapiens
acctcccctccccgccccctg

SEQ ID NO: 4340432 - DNA, 17 bp, Homo sapiens
acctcctaatggcatgg

SEQ ID NO: 4340433 - DNA, 22 bp, Homo sapiens
acctcctaatggcatggagact

SEQ ID NO: 4340434 - DNA, 16 bp, Homo sapiens
acctctcgtttctgcc

SEQ ID NO: 4340435 - DNA, 21 bp, Homo sapiens
acctctcgtttctgcccagcc

SEQ ID NO: 4340436 - DNA, 18 bp, Homo sapiens
acctctgcaagagggggc

SEQ ID NO: 4340437 - DNA, 22 bp, Homo sapiens
acctgaaagacagtatgagaaa

SEQ ID NO: 4340438 - DNA, 17 bp, Homo sapiens
acctgaataattactac

SEQ ID NO: 4340439 - DNA, 14 bp, Homo sapiens
acctgacctctgca

SEQ ID NO: 4340440 - DNA, 14 bp, Homo sapiens
acctgcacctctgg

SEQ ID NO: 4340441 - DNA, 13 bp, Homo sapiens
acctgcttgagct

SEQ ID NO: 4340442 - DNA, 21 bp, Homo sapiens
accttcccttcctcagcaggc

SEQ ID NO: 4340443 - DNA, 22 bp, Homo sapiens
accttcccttcctcagcaggcc

SEQ ID NO: 4340444 - DNA, 14 bp, Homo sapiens
accttctcccaggc

SEQ ID NO: 4340445 - DNA, 15 bp, Homo sapiens
accttctcccaggcc

SEQ ID NO: 4340446 - DNA, 20 bp, Homo sapiens
accttctcccaggcctctgc

SEQ ID NO: 4340447 - DNA, 18 bp, Homo sapiens
accttctccctagccctt

SEQ ID NO: 4340448 - DNA, 19 bp, Homo sapiens
accttctccctagcccttc

SEQ ID NO: 4340449 - DNA, 21 bp, Homo sapiens
acctttttataggttgttctt

SEQ ID NO: 4340450 - DNA, 18 bp, Homo sapiens
acgattttaaaatgactt

SEQ ID NO: 4340451 - DNA, 23 bp, Homo sapiens
acgcaatgaaaagtcgttttcca

SEQ ID NO: 4340452 - DNA, 18 bp, Homo sapiens
acgccaccattcctggaa

SEQ ID NO: 4340453 - DNA, 22 bp, Homo sapiens
acgctacggggaaaatgcattt

SEQ ID NO: 4340454 - DNA, 17 bp, Homo sapiens
acgctgccgggagactg

SEQ ID NO: 4340455 - DNA, 22 bp, Homo sapiens
acgctgccgggagactgccagt

SEQ ID NO: 4340456 - DNA, 14 bp, Homo sapiens
acggaaacatagaa

SEQ ID NO: 4340457 - DNA, 16 bp, Homo sapiens
acggaagagccttgcg

SEQ ID NO: 4340458 - DNA, 14 bp, Homo sapiens
acggagctcctggc

SEQ ID NO: 4340459 - DNA, 14 bp, Homo sapiens
acgtacatacacac

SEQ ID NO: 4340460 - DNA, 12 bp, Homo sapiens
acgtcccttgga

SEQ ID NO: 4340461 - DNA, 23 bp, Homo sapiens
acgtgacaccaccgaatatatta

SEQ ID NO: 4340462 - DNA, 22 bp, Homo sapiens
acgtgcatttaaactctgccag

SEQ ID NO: 4340463 - DNA, 21 bp, Homo sapiens
acgtgccattgtctttcctcc

SEQ ID NO: 4340464 - DNA, 20 bp, Homo sapiens
acgtggaaccctaaagcagt

SEQ ID NO: 4340465 - DNA, 15 bp, Homo sapiens
acgttaagataaagg

SEQ ID NO: 4340466 - DNA, 23 bp, Homo sapiens
acgttcttacaagcttaaagctt

SEQ ID NO: 4340467 - DNA, 16 bp, Homo sapiens
acgttgacccctttcc

SEQ ID NO: 4340468 - DNA, 17 bp, Homo sapiens
acgttgacccctttccc

SEQ ID NO: 4340469 - DNA, 21 bp, Homo sapiens
acgttgacccctttcccccac

SEQ ID NO: 4340470 - DNA, 22 bp, Homo sapiens
acgttgacccctttcccccacc

SEQ ID NO: 4340471 - DNA, 23 bp, Homo sapiens
acgttgacccctttcccccaccc

SEQ ID NO: 4340472 - DNA, 13 bp, Homo sapiens
acgttgttgtcat

SEQ ID NO: 4340473 - DNA, 16 bp, Homo sapiens
actaaagttgaaaata

SEQ ID NO: 4340474 - DNA, 19 bp, Homo sapiens
actaaagttgaaaatacat

SEQ ID NO: 4340475 - DNA, 19 bp, Homo sapiens
actaacaaaatttgaataa

SEQ ID NO: 4340476 - DNA, 19 bp, Homo sapiens
actaagtacccttggggtg

SEQ ID NO: 4340477 - DNA, 16 bp, Homo sapiens
actactgctatttttt

SEQ ID NO: 4340478 - DNA, 21 bp, Homo sapiens
actactgctattttttttaaa

SEQ ID NO: 4340479 - DNA, 13 bp, Homo sapiens
actactgggtgtc

SEQ ID NO: 4340480 - DNA, 19 bp, Homo sapiens
actactgggtgtcatttca

SEQ ID NO: 4340481 - DNA, 20 bp, Homo sapiens
actactgggtgtcatttcat

SEQ ID NO: 4340482 - DNA, 15 bp, Homo sapiens
actagcccaagtaat

SEQ ID NO: 4340483 - DNA, 14 bp, Homo sapiens
actaggagactggt

SEQ ID NO: 4340484 - DNA, 19 bp, Homo sapiens
actaggggaggagagaggg

SEQ ID NO: 4340485 - DNA, 18 bp, Homo sapiens
actagtgggatcaacaat

SEQ ID NO: 4340486 - DNA, 23 bp, Homo sapiens
actagttgtctgaattgagaaaa

SEQ ID NO: 4340487 - DNA, 16 bp, Homo sapiens
actattatgaaatcat

SEQ ID NO: 4340488 - DNA, 13 bp, Homo sapiens
actattttctatt

SEQ ID NO: 4340489 - DNA, 20 bp, Homo sapiens
actcaactgggctctgtccc

SEQ ID NO: 4340490 - DNA, 22 bp, Homo sapiens
actcaaggaggtggtgaatttt

SEQ ID NO: 4340491 - DNA, 17 bp, Homo sapiens
actcaagtgtcacctcc

SEQ ID NO: 4340492 - DNA, 15 bp, Homo sapiens
actcacctctctcta

SEQ ID NO: 4340493 - DNA, 17 bp, Homo sapiens
actcacctctctctaag

SEQ ID NO: 4340494 - DNA, 14 bp, Homo sapiens
actcagtgccacac

SEQ ID NO: 4340495 - DNA, 13 bp, Homo sapiens
actcagtgtattt

SEQ ID NO: 4340496 - DNA, 17 bp, Homo sapiens
actcagtgtattttaaa

SEQ ID NO: 4340497 - DNA, 23 bp, Homo sapiens
actcatgtgcgtttcatgtgttt

SEQ ID NO: 4340498 - DNA, 13 bp, Homo sapiens
actcattcctgta

SEQ ID NO: 4340499 - DNA, 12 bp, Homo sapiens
actcccaagcca

SEQ ID NO: 4340500 - DNA, 22 bp, Homo sapiens
actcccatgttgggtttgagac

SEQ ID NO: 4340501 - DNA, 19 bp, Homo sapiens
actccccagttggcccttc

SEQ ID NO: 4340502 - DNA, 16 bp, Homo sapiens
actcccttctgtagtt

SEQ ID NO: 4340503 - DNA, 16 bp, Homo sapiens
actcctatttttgtaa

SEQ ID NO: 4340504 - DNA, 13 bp, Homo sapiens
actcctcttccca

SEQ ID NO: 4340505 - DNA, 17 bp, Homo sapiens
actcctcttcccagagt

SEQ ID NO: 4340506 - DNA, 12 bp, Homo sapiens
actcctggagca

SEQ ID NO: 4340507 - DNA, 15 bp, Homo sapiens
actcctggagcactg

SEQ ID NO: 4340508 - DNA, 20 bp, Homo sapiens
actctaaaatggacattttc

SEQ ID NO: 4340509 - DNA, 23 bp, Homo sapiens
actctaaaatggacattttcttt

SEQ ID NO: 4340510 - DNA, 15 bp, Homo sapiens
actctagggaaaaac

SEQ ID NO: 4340511 - DNA, 13 bp, Homo sapiens
actctataaagaa

SEQ ID NO: 4340512 - DNA, 16 bp, Homo sapiens
actctataaagaaact

SEQ ID NO: 4340513 - DNA, 16 bp, Homo sapiens
actctcagcccagaag

SEQ ID NO: 4340514 - DNA, 21 bp, Homo sapiens
actctctataagtgttcagtg

SEQ ID NO: 4340515 - DNA, 15 bp, Homo sapiens
actctgaactggagc

SEQ ID NO: 4340516 - DNA, 12 bp, Homo sapiens
actctgccagaa

SEQ ID NO: 4340517 - DNA, 24 bp, Homo sapiens
actctgtgtgagcgtgtccacaga

SEQ ID NO: 4340518 - DNA, 17 bp, Homo sapiens
actcttaaatcatttgg

SEQ ID NO: 4340519 - DNA, 15 bp, Homo sapiens
actcttaattttaaa

SEQ ID NO: 4340520 - DNA, 17 bp, Homo sapiens
actcttccacctctggg

SEQ ID NO: 4340521 - DNA, 13 bp, Homo sapiens
actgaaagacagg

SEQ ID NO: 4340522 - DNA, 16 bp, Homo sapiens
actgaagctggggctt

SEQ ID NO: 4340523 - DNA, 13 bp, Homo sapiens
actgaataaaaaa

SEQ ID NO: 4340524 - DNA, 19 bp, Homo sapiens
actgaataaaaaataaata

SEQ ID NO: 4340525 - DNA, 22 bp, Homo sapiens
actgaataaaaaataaataaaa

SEQ ID NO: 4340526 - DNA, 19 bp, Homo sapiens
actgaatgtttattccttg

SEQ ID NO: 4340527 - DNA, 12 bp, Homo sapiens
actgacatcaga

SEQ ID NO: 4340528 - DNA, 14 bp, Homo sapiens
actgacgaaagagt

SEQ ID NO: 4340529 - DNA, 19 bp, Homo sapiens
actgatggtttggaaaata

SEQ ID NO: 4340530 - DNA, 20 bp, Homo sapiens
actgatggtttggaaaataa

SEQ ID NO: 4340531 - DNA, 21 bp, Homo sapiens
actgatttacaggacttctct

SEQ ID NO: 4340532 - DNA, 17 bp, Homo sapiens
actgcaaataaagcctt

SEQ ID NO: 4340533 - DNA, 17 bp, Homo sapiens
actgcaagcatttttcc

SEQ ID NO: 4340534 - DNA, 18 bp, Homo sapiens
actgcaagcatttttcca

SEQ ID NO: 4340535 - DNA, 14 bp, Homo sapiens
actgcactccagcc

SEQ ID NO: 4340536 - DNA, 19 bp, Homo sapiens
actgcactccagcctgggt

SEQ ID NO: 4340537 - DNA, 12 bp, Homo sapiens
actgcagagact

SEQ ID NO: 4340538 - DNA, 20 bp, Homo sapiens
actgcagagactaatgttgg

SEQ ID NO: 4340539 - DNA, 18 bp, Homo sapiens
actgcattcattctgagc

SEQ ID NO: 4340540 - DNA, 14 bp, Homo sapiens
actgccatgccagc

SEQ ID NO: 4340541 - DNA, 15 bp, Homo sapiens
actgcccggcagggt

SEQ ID NO: 4340542 - DNA, 22 bp, Homo sapiens
actgcccggcagggtcctagaa

SEQ ID NO: 4340543 - DNA, 15 bp, Homo sapiens
actgctctagaaagt

SEQ ID NO: 4340544 - DNA, 13 bp, Homo sapiens
actgcttacagtt

SEQ ID NO: 4340545 - DNA, 21 bp, Homo sapiens
actggaaatgtttgtccttgc

SEQ ID NO: 4340546 - DNA, 15 bp, Homo sapiens
actggagctgctaag

SEQ ID NO: 4340547 - DNA, 23 bp, Homo sapiens
actggagctgctaagctaaagaa

SEQ ID NO: 4340548 - DNA, 14 bp, Homo sapiens
actggcacttgcct

SEQ ID NO: 4340549 - DNA, 19 bp, Homo sapiens
actggcacttgcctgctgc

SEQ ID NO: 4340550 - DNA, 12 bp, Homo sapiens
actgggaagaac

SEQ ID NO: 4340551 - DNA, 19 bp, Homo sapiens
actgggcacccctgcctcc

SEQ ID NO: 4340552 - DNA, 20 bp, Homo sapiens
actgggcacccctgcctcct

SEQ ID NO: 4340553 - DNA, 21 bp, Homo sapiens
actgggcacccctgcctcctg

SEQ ID NO: 4340554 - DNA, 15 bp, Homo sapiens
actggttgtcagaat

SEQ ID NO: 4340555 - DNA, 19 bp, Homo sapiens
actgtaactttttttcagt

SEQ ID NO: 4340556 - DNA, 20 bp, Homo sapiens
actgtaactttttttcagtt

SEQ ID NO: 4340557 - DNA, 15 bp, Homo sapiens
actgtacataaacaa

SEQ ID NO: 4340558 - DNA, 16 bp, Homo sapiens
actgtatttctgtgga

SEQ ID NO: 4340559 - DNA, 20 bp, Homo sapiens
actgtatttttgaagactat

SEQ ID NO: 4340560 - DNA, 18 bp, Homo sapiens
actgtctacgttaagata

SEQ ID NO: 4340561 - DNA, 15 bp, Homo sapiens
actgtcttgtctcac

SEQ ID NO: 4340562 - DNA, 16 bp, Homo sapiens
actgtgaactgggcat

SEQ ID NO: 4340563 - DNA, 23 bp, Homo sapiens
actgtgtctgaatcatgtctgta

SEQ ID NO: 4340564 - DNA, 14 bp, Homo sapiens
actgttttcaagtc

SEQ ID NO: 4340565 - DNA, 23 bp, Homo sapiens
acttacggttttaaatgtgttgc

SEQ ID NO: 4340566 - DNA, 13 bp, Homo sapiens
acttagaatgcca

SEQ ID NO: 4340567 - DNA, 17 bp, Homo sapiens
acttagaatgccataaa

SEQ ID NO: 4340568 - DNA, 21 bp, Homo sapiens
acttagaatgccataaaattg

SEQ ID NO: 4340569 - DNA, 22 bp, Homo sapiens
acttaggtaaaataaaagacta

SEQ ID NO: 4340570 - DNA, 15 bp, Homo sapiens
acttaggtgtggggg

SEQ ID NO: 4340571 - DNA, 18 bp, Homo sapiens
acttatctcactgtttta

SEQ ID NO: 4340572 - DNA, 12 bp, Homo sapiens
acttatgtcttg

SEQ ID NO: 4340573 - DNA, 18 bp, Homo sapiens
acttattgtttgaaagac

SEQ ID NO: 4340574 - DNA, 11 bp, Homo sapiens
acttcagctga

SEQ ID NO: 4340575 - DNA, 15 bp, Homo sapiens
acttcaggagcccta

SEQ ID NO: 4340576 - DNA, 21 bp, Homo sapiens
acttcgaagacccagcagatg

SEQ ID NO: 4340577 - DNA, 22 bp, Homo sapiens
acttcgcgcaccttctcacctt

SEQ ID NO: 4340578 - DNA, 22 bp, Homo sapiens
acttcgggaggtcgaggcagga

SEQ ID NO: 4340579 - DNA, 19 bp, Homo sapiens
acttctcttaaacttgtga

SEQ ID NO: 4340580 - DNA, 15 bp, Homo sapiens
acttgaaaagaaaac

SEQ ID NO: 4340581 - DNA, 21 bp, Homo sapiens
acttgccaaaatgttggctgc

SEQ ID NO: 4340582 - DNA, 23 bp, Homo sapiens
acttggggggctgaggtgggagg

SEQ ID NO: 4340583 - DNA, 10 bp, Homo sapiens
acttgtgaat

SEQ ID NO: 4340584 - DNA, 13 bp, Homo sapiens
acttgtgcactta

SEQ ID NO: 4340585 - DNA, 12 bp, Homo sapiens
actttacctctt

SEQ ID NO: 4340586 - DNA, 20 bp, Homo sapiens
actttaggatgagcaaaaca

SEQ ID NO: 4340587 - DNA, 22 bp, Homo sapiens
actttgctgttactgcttctct

SEQ ID NO: 4340588 - DNA, 18 bp, Homo sapiens
acttttaggttgttacca

SEQ ID NO: 4340589 - DNA, 16 bp, Homo sapiens
acttttcatttcagat

SEQ ID NO: 4340590 - DNA, 15 bp, Homo sapiens
actttttgtatttag

SEQ ID NO: 4340591 - DNA, 15 bp, Homo sapiens
actttttttgttata

SEQ ID NO: 4340592 - DNA, 15 bp, Homo sapiens
agaaaaaaaaatact

SEQ ID NO: 4340593 - DNA, 20 bp, Homo sapiens
agaaaaaaaaatacttaaat

SEQ ID NO: 4340594 - DNA, 14 bp, Homo sapiens
agaaaaaaataact

SEQ ID NO: 4340595 - DNA, 22 bp, Homo sapiens
agaaaaaaataactattttgtt

SEQ ID NO: 4340596 - DNA, 11 bp, Homo sapiens
agaaaaagaag

SEQ ID NO: 4340597 - DNA, 15 bp, Homo sapiens
agaaaaagaagaagg

SEQ ID NO: 4340598 - DNA, 16 bp, Homo sapiens
agaaaaagaagaagga

SEQ ID NO: 4340599 - DNA, 17 bp, Homo sapiens
agaaaaatgagcctggc

SEQ ID NO: 4340600 - DNA, 18 bp, Homo sapiens
agaaaattctctcaagac

SEQ ID NO: 4340601 - DNA, 13 bp, Homo sapiens
agaaacaaagcaa

SEQ ID NO: 4340602 - DNA, 14 bp, Homo sapiens
agaaacaaagcaaa

SEQ ID NO: 4340603 - DNA, 16 bp, Homo sapiens
agaaacttttgaaaaa

SEQ ID NO: 4340604 - DNA, 19 bp, Homo sapiens
agaaagccaccttgttaca

SEQ ID NO: 4340605 - DNA, 19 bp, Homo sapiens
agaaaggggtgattgaaag

SEQ ID NO: 4340606 - DNA, 20 bp, Homo sapiens
agaaaggggtgattgaaaga

SEQ ID NO: 4340607 - DNA, 21 bp, Homo sapiens
agaaagttgctaactgggaag

SEQ ID NO: 4340608 - DNA, 15 bp, Homo sapiens
agaaataagtatcca

SEQ ID NO: 4340609 - DNA, 16 bp, Homo sapiens
agaaatgaaattgaca

SEQ ID NO: 4340610 - DNA, 21 bp, Homo sapiens
agaaatgaagcagaggaagga

SEQ ID NO: 4340611 - DNA, 11 bp, Homo sapiens
agaaatgccag

SEQ ID NO: 4340612 - DNA, 15 bp, Homo sapiens
agaaatgggactctg

SEQ ID NO: 4340613 - DNA, 16 bp, Homo sapiens
agaaatgtttcataca

SEQ ID NO: 4340614 - DNA, 18 bp, Homo sapiens
agaacatgaatctctaac

SEQ ID NO: 4340615 - DNA, 16 bp, Homo sapiens
agaacatgcaagaatt

SEQ ID NO: 4340616 - DNA, 18 bp, Homo sapiens
agaactcagtgccacacc

SEQ ID NO: 4340617 - DNA, 14 bp, Homo sapiens
agaagaaaagactt

SEQ ID NO: 4340618 - DNA, 22 bp, Homo sapiens
agaagaccctttgttgaaaaat

SEQ ID NO: 4340619 - DNA, 11 bp, Homo sapiens
agaagaggaag

SEQ ID NO: 4340620 - DNA, 16 bp, Homo sapiens
agaagagttgaggaac

SEQ ID NO: 4340621 - DNA, 20 bp, Homo sapiens
agaagcaaggtctcagactt

SEQ ID NO: 4340622 - DNA, 13 bp, Homo sapiens
agaaggaactgat

SEQ ID NO: 4340623 - DNA, 15 bp, Homo sapiens
agaagttttttactt

SEQ ID NO: 4340624 - DNA, 15 bp, Homo sapiens
agaatacacatataa

SEQ ID NO: 4340625 - DNA, 17 bp, Homo sapiens
agaataggtgcaaacaa

SEQ ID NO: 4340626 - DNA, 20 bp, Homo sapiens
agaatgatccctcagtctga

SEQ ID NO: 4340627 - DNA, 21 bp, Homo sapiens
agaatgtgtttaaacttggtt

SEQ ID NO: 4340628 - DNA, 17 bp, Homo sapiens
agaattatccattacgt

SEQ ID NO: 4340629 - DNA, 18 bp, Homo sapiens
agaattggcataatttgt

SEQ ID NO: 4340630 - DNA, 16 bp, Homo sapiens
agaattgtagttctta

SEQ ID NO: 4340631 - DNA, 14 bp, Homo sapiens
agaatttctggtgg

SEQ ID NO: 4340632 - DNA, 12 bp, Homo sapiens
agacaattctcc

SEQ ID NO: 4340633 - DNA, 13 bp, Homo sapiens
agacacacaggag

SEQ ID NO: 4340634 - DNA, 19 bp, Homo sapiens
agacacggggcaggacctt

SEQ ID NO: 4340635 - DNA, 17 bp, Homo sapiens
agacactaattccttaa

SEQ ID NO: 4340636 - DNA, 23 bp, Homo sapiens
agacactaattccttaaatgaac

SEQ ID NO: 4340637 - DNA, 18 bp, Homo sapiens
agacactgttgcaaaggt

SEQ ID NO: 4340638 - DNA, 15 bp, Homo sapiens
agacagggagaagtt

SEQ ID NO: 4340639 - DNA, 14 bp, Homo sapiens
agacatctgcctgt

SEQ ID NO: 4340640 - DNA, 15 bp, Homo sapiens
agacatctgcctgta

SEQ ID NO: 4340641 - DNA, 18 bp, Homo sapiens
agacatctgcctgtaatt

SEQ ID NO: 4340642 - DNA, 23 bp, Homo sapiens
agacatgggctatcagggaggaa

SEQ ID NO: 4340643 - DNA, 21 bp, Homo sapiens
agaccaccttcccttcctcag

SEQ ID NO: 4340644 - DNA, 13 bp, Homo sapiens
agaccagaagaaa

SEQ ID NO: 4340645 - DNA, 14 bp, Homo sapiens
agaccagaagaaaa

SEQ ID NO: 4340646 - DNA, 13 bp, Homo sapiens
agacccacagccc

SEQ ID NO: 4340647 - DNA, 18 bp, Homo sapiens
agacccacagccctgaaa

SEQ ID NO: 4340648 - DNA, 14 bp, Homo sapiens
agaccttctcccta

SEQ ID NO: 4340649 - DNA, 16 bp, Homo sapiens
agaccttctccctagc

SEQ ID NO: 4340650 - DNA, 17 bp, Homo sapiens
agacgccaccattcctg

SEQ ID NO: 4340651 - DNA, 17 bp, Homo sapiens
agactaagagaaacctt

SEQ ID NO: 4340652 - DNA, 13 bp, Homo sapiens
agactattttcta

SEQ ID NO: 4340653 - DNA, 11 bp, Homo sapiens
agactctcagc

SEQ ID NO: 4340654 - DNA, 22 bp, Homo sapiens
agactgggcacccctgcctcct

SEQ ID NO: 4340655 - DNA, 22 bp, Homo sapiens
agactgtaactttttttcagtt

SEQ ID NO: 4340656 - DNA, 23 bp, Homo sapiens
agactgtggccatatatgctgta

SEQ ID NO: 4340657 - DNA, 13 bp, Homo sapiens
agacttactgcat

SEQ ID NO: 4340658 - DNA, 15 bp, Homo sapiens
agacttgtttctttc

SEQ ID NO: 4340659 - DNA, 16 bp, Homo sapiens
agactttgctgcattt

SEQ ID NO: 4340660 - DNA, 17 bp, Homo sapiens
agactttgctgcatttt

SEQ ID NO: 4340661 - DNA, 23 bp, Homo sapiens
agactttgctgcattttacacat

SEQ ID NO: 4340662 - DNA, 17 bp, Homo sapiens
agactttgctgttactg

SEQ ID NO: 4340663 - DNA, 20 bp, Homo sapiens
agactttgctgttactgctt

SEQ ID NO: 4340664 - DNA, 22 bp, Homo sapiens
agagaaaaaatattttcctgcc

SEQ ID NO: 4340665 - DNA, 14 bp, Homo sapiens
agagaatacacata

SEQ ID NO: 4340666 - DNA, 15 bp, Homo sapiens
agagaatacacatat

SEQ ID NO: 4340667 - DNA, 20 bp, Homo sapiens
agagaatacacatataaaaa

SEQ ID NO: 4340668 - DNA, 14 bp, Homo sapiens
agagaatgcacaga

SEQ ID NO: 4340669 - DNA, 19 bp, Homo sapiens
agagaatgcacagatatac

SEQ ID NO: 4340670 - DNA, 13 bp, Homo sapiens
agagacagtatgt

SEQ ID NO: 4340671 - DNA, 17 bp, Homo sapiens
agagactaatgttggac

SEQ ID NO: 4340672 - DNA, 22 bp, Homo sapiens
agagagtggtaaaaaagaaatg

SEQ ID NO: 4340673 - DNA, 15 bp, Homo sapiens
agagatctgggcatt

SEQ ID NO: 4340674 - DNA, 21 bp, Homo sapiens
agagcaatgcccgtaatgctt

SEQ ID NO: 4340675 - DNA, 14 bp, Homo sapiens
agagcatctctgcc

SEQ ID NO: 4340676 - DNA, 21 bp, Homo sapiens
agagccaccagggcactgtct

SEQ ID NO: 4340677 - DNA, 13 bp, Homo sapiens
agaggaaaatcaa

SEQ ID NO: 4340678 - DNA, 20 bp, Homo sapiens
agaggaaggaaacatagaaa

SEQ ID NO: 4340679 - DNA, 23 bp, Homo sapiens
agaggaaggaaacatagaaagac

SEQ ID NO: 4340680 - DNA, 16 bp, Homo sapiens
agaggacactaggaga

SEQ ID NO: 4340681 - DNA, 16 bp, Homo sapiens
agaggaggcagaaaga

SEQ ID NO: 4340682 - DNA, 13 bp, Homo sapiens
agaggcagagcct

SEQ ID NO: 4340683 - DNA, 17 bp, Homo sapiens
agaggccgctgcccctg

SEQ ID NO: 4340684 - DNA, 15 bp, Homo sapiens
agaggcttccaagca

SEQ ID NO: 4340685 - DNA, 16 bp, Homo sapiens
agagggacagagcccg

SEQ ID NO: 4340686 - DNA, 21 bp, Homo sapiens
agagggacagagcccgggaga

SEQ ID NO: 4340687 - DNA, 14 bp, Homo sapiens
agagggagacagag

SEQ ID NO: 4340688 - DNA, 19 bp, Homo sapiens
agaggggctattgggccct

SEQ ID NO: 4340689 - DNA, 20 bp, Homo sapiens
agagtcacaagtagcctctg

SEQ ID NO: 4340690 - DNA, 14 bp, Homo sapiens
agagtcatttctga

SEQ ID NO: 4340691 - DNA, 11 bp, Homo sapiens
agagtgggagc

SEQ ID NO: 4340692 - DNA, 15 bp, Homo sapiens
agagtggtaaaaaag

SEQ ID NO: 4340693 - DNA, 16 bp, Homo sapiens
agagtggtaaaaaaga

SEQ ID NO: 4340694 - DNA, 18 bp, Homo sapiens
agagtggtaaaaaagaaa

SEQ ID NO: 4340695 - DNA, 22 bp, Homo sapiens
agagtggtaaaaaagaaatgaa

SEQ ID NO: 4340696 - DNA, 23 bp, Homo sapiens
agagtgttatcatattggtgctg

SEQ ID NO: 4340697 - DNA, 18 bp, Homo sapiens
agagttaaaatatatata

SEQ ID NO: 4340698 - DNA, 23 bp, Homo sapiens
agagttggggagaaactgaagcc

SEQ ID NO: 4340699 - DNA, 19 bp, Homo sapiens
agagttgttgtttgccaag

SEQ ID NO: 4340700 - DNA, 20 bp, Homo sapiens
agagttgttgtttgccaagc

SEQ ID NO: 4340701 - DNA, 23 bp, Homo sapiens
agagtttgtagtaaatattatga

SEQ ID NO: 4340702 - DNA, 17 bp, Homo sapiens
agagtttgtgtgtattt

SEQ ID NO: 4340703 - DNA, 21 bp, Homo sapiens
agataagtctacattaaacaa

SEQ ID NO: 4340704 - DNA, 21 bp, Homo sapiens
agataattctgatcaatcatt

SEQ ID NO: 4340705 - DNA, 22 bp, Homo sapiens
agatacttggggggctgaggtg

SEQ ID NO: 4340706 - DNA, 16 bp, Homo sapiens
agatagaatttccaat

SEQ ID NO: 4340707 - DNA, 17 bp, Homo sapiens
agatatactttgtggac

SEQ ID NO: 4340708 - DNA, 12 bp, Homo sapiens
agatatccaaac

SEQ ID NO: 4340709 - DNA, 15 bp, Homo sapiens
agatatccaaacaag

SEQ ID NO: 4340710 - DNA, 16 bp, Homo sapiens
agatatccaaacaaga

SEQ ID NO: 4340711 - DNA, 20 bp, Homo sapiens
agatatgttaagcatggatt

SEQ ID NO: 4340712 - DNA, 15 bp, Homo sapiens
agatcacgctccccg

SEQ ID NO: 4340713 - DNA, 22 bp, Homo sapiens
agatcacgctccccgcctgttc

SEQ ID NO: 4340714 - DNA, 23 bp, Homo sapiens
agatcacgctccccgcctgttcc

SEQ ID NO: 4340715 - DNA, 15 bp, Homo sapiens
agatcagcctgggca

SEQ ID NO: 4340716 - DNA, 21 bp, Homo sapiens
agatcccaagatggagaggaa

SEQ ID NO: 4340717 - DNA, 13 bp, Homo sapiens
agatctgggcatt

SEQ ID NO: 4340718 - DNA, 15 bp, Homo sapiens
agatgcttctcactg

SEQ ID NO: 4340719 - DNA, 18 bp, Homo sapiens
agatgcttctcactgcca

SEQ ID NO: 4340720 - DNA, 19 bp, Homo sapiens
agatggagaggaagaaacg

SEQ ID NO: 4340721 - DNA, 15 bp, Homo sapiens
agatggagcaaatgt

SEQ ID NO: 4340722 - DNA, 17 bp, Homo sapiens
agatgggggcaagaaga

SEQ ID NO: 4340723 - DNA, 19 bp, Homo sapiens
agatgtgaaggacatgaga

SEQ ID NO: 4340724 - DNA, 21 bp, Homo sapiens
agatgtgaaggacatgagact

SEQ ID NO: 4340725 - DNA, 18 bp, Homo sapiens
agatgttcaatagaacat

SEQ ID NO: 4340726 - DNA, 15 bp, Homo sapiens
agatgttccaaattt

SEQ ID NO: 4340727 - DNA, 21 bp, Homo sapiens
agattagtaactgttcctact

SEQ ID NO: 4340728 - DNA, 15 bp, Homo sapiens
agattatcagtagaa

SEQ ID NO: 4340729 - DNA, 18 bp, Homo sapiens
agattatcagtagaaaga

SEQ ID NO: 4340730 - DNA, 15 bp, Homo sapiens
agattggatttgctg

SEQ ID NO: 4340731 - DNA, 16 bp, Homo sapiens
agatttcagtagaatt

SEQ ID NO: 4340732 - DNA, 17 bp, Homo sapiens
agatttcagtagaattt

SEQ ID NO: 4340733 - DNA, 23 bp, Homo sapiens
agatttcagtagaattttagtcc

SEQ ID NO: 4340734 - DNA, 21 bp, Homo sapiens
agatttgaaaacaaacttctc

SEQ ID NO: 4340735 - DNA, 14 bp, Homo sapiens
agatttgacgttgt

SEQ ID NO: 4340736 - DNA, 13 bp, Homo sapiens
agatttggaaaat

SEQ ID NO: 4340737 - DNA, 15 bp, Homo sapiens
agatttggaaaattc

SEQ ID NO: 4340738 - DNA, 20 bp, Homo sapiens
agatttggaaaattcacaga

SEQ ID NO: 4340739 - DNA, 22 bp, Homo sapiens
agcaaagatttcagtagaattt

SEQ ID NO: 4340740 - DNA, 13 bp, Homo sapiens
agcaaatggcgtt

SEQ ID NO: 4340741 - DNA, 18 bp, Homo sapiens
agcaaatttcattatcta

SEQ ID NO: 4340742 - DNA, 11 bp, Homo sapiens
agcaactccca

SEQ ID NO: 4340743 - DNA, 12 bp, Homo sapiens
agcaagaagaat

SEQ ID NO: 4340744 - DNA, 23 bp, Homo sapiens
agcaaggtctcagacttaacaga

SEQ ID NO: 4340745 - DNA, 16 bp, Homo sapiens
agcaagtgagaccctg

SEQ ID NO: 4340746 - DNA, 20 bp, Homo sapiens
agcaatattgcctgtgcttc

SEQ ID NO: 4340747 - DNA, 21 bp, Homo sapiens
agcaatattgcctgtgcttct

SEQ ID NO: 4340748 - DNA, 17 bp, Homo sapiens
agcaattaaatgatatt

SEQ ID NO: 4340749 - DNA, 21 bp, Homo sapiens
agcaattaaatgatattgggt

SEQ ID NO: 4340750 - DNA, 11 bp, Homo sapiens
agcacaagaag

SEQ ID NO: 4340751 - DNA, 15 bp, Homo sapiens
agcacaattaattaa

SEQ ID NO: 4340752 - DNA, 13 bp, Homo sapiens
agcacatttcctc

SEQ ID NO: 4340753 - DNA, 15 bp, Homo sapiens
agcacatttcctctc

SEQ ID NO: 4340754 - DNA, 13 bp, Homo sapiens
agcaccagggaga

SEQ ID NO: 4340755 - DNA, 19 bp, Homo sapiens
agcaccagggagaggcctc

SEQ ID NO: 4340756 - DNA, 15 bp, Homo sapiens
agcactactgggtgt

SEQ ID NO: 4340757 - DNA, 20 bp, Homo sapiens
agcactactgggtgtcattt

SEQ ID NO: 4340758 - DNA, 23 bp, Homo sapiens
agcactactgggtgtcatttcat

SEQ ID NO: 4340759 - DNA, 20 bp, Homo sapiens
agcactagagaatgcacaga

SEQ ID NO: 4340760 - DNA, 12 bp, Homo sapiens
agcagaggaagg

SEQ ID NO: 4340761 - DNA, 17 bp, Homo sapiens
agcagaggaaggaaaca

SEQ ID NO: 4340762 - DNA, 22 bp, Homo sapiens
agcagaggaaggaaacatagaa

SEQ ID NO: 4340763 - DNA, 15 bp, Homo sapiens
agcagatgtttaatg

SEQ ID NO: 4340764 - DNA, 15 bp, Homo sapiens
agcattctttaacag

SEQ ID NO: 4340765 - DNA, 16 bp, Homo sapiens
agcattggcccctgag

SEQ ID NO: 4340766 - DNA, 14 bp, Homo sapiens
agcatttagagctt

SEQ ID NO: 4340767 - DNA, 13 bp, Homo sapiens
agcatttatttct

SEQ ID NO: 4340768 - DNA, 22 bp, Homo sapiens
agcattttgctaaatgtgaatg

SEQ ID NO: 4340769 - DNA, 18 bp, Homo sapiens
agcatttttccatctgtg

SEQ ID NO: 4340770 - DNA, 23 bp, Homo sapiens
agccaacaggtaaacacataaat

SEQ ID NO: 4340771 - DNA, 14 bp, Homo sapiens
agccacggaaacat

SEQ ID NO: 4340772 - DNA, 19 bp, Homo sapiens
agccactagcccactcccc

SEQ ID NO: 4340773 - DNA, 18 bp, Homo sapiens
agccatagcttgattgct

SEQ ID NO: 4340774 - DNA, 21 bp, Homo sapiens
agccatagcttgattgctcag

SEQ ID NO: 4340775 - DNA, 17 bp, Homo sapiens
agccattaaatgaatat

SEQ ID NO: 4340776 - DNA, 21 bp, Homo sapiens
agccattaaatgaatattttg

SEQ ID NO: 4340777 - DNA, 17 bp, Homo sapiens
agccattacccacgtga

SEQ ID NO: 4340778 - DNA, 16 bp, Homo sapiens
agccattcctgttctc

SEQ ID NO: 4340779 - DNA, 22 bp, Homo sapiens
agccattcctgttctctttgcc

SEQ ID NO: 4340780 - DNA, 17 bp, Homo sapiens
agcccaagtccaaatgt

SEQ ID NO: 4340781 - DNA, 16 bp, Homo sapiens
agcccaatggagaaat

SEQ ID NO: 4340782 - DNA, 15 bp, Homo sapiens
agcccacccctcaac

SEQ ID NO: 4340783 - DNA, 14 bp, Homo sapiens
agcccagagaagct

SEQ ID NO: 4340784 - DNA, 17 bp, Homo sapiens
agcccagttggaaaatt

SEQ ID NO: 4340785 - DNA, 16 bp, Homo sapiens
agccccaatccagaga

SEQ ID NO: 4340786 - DNA, 14 bp, Homo sapiens
agccccacccagag

SEQ ID NO: 4340787 - DNA, 23 bp, Homo sapiens
agccccacccagaggtggccctc

SEQ ID NO: 4340788 - DNA, 15 bp, Homo sapiens
agccccagccccaat

SEQ ID NO: 4340789 - DNA, 12 bp, Homo sapiens
agcccccacagc

SEQ ID NO: 4340790 - DNA, 16 bp, Homo sapiens
agcccccacagccctg

SEQ ID NO: 4340791 - DNA, 18 bp, Homo sapiens
agcccccacagccctgga

SEQ ID NO: 4340792 - DNA, 18 bp, Homo sapiens
agccccgtcccagaggcc

SEQ ID NO: 4340793 - DNA, 23 bp, Homo sapiens
agccccgtcccagaggccgctgc

SEQ ID NO: 4340794 - DNA, 12 bp, Homo sapiens
agcccctgcccc

SEQ ID NO: 4340795 - DNA, 15 bp, Homo sapiens
agcccctgccccagc

SEQ ID NO: 4340796 - DNA, 16 bp, Homo sapiens
agcccctgccccagcc

SEQ ID NO: 4340797 - DNA, 15 bp, Homo sapiens
agccctctgtggcca

SEQ ID NO: 4340798 - DNA, 20 bp, Homo sapiens
agccctctgtggccaggagc

SEQ ID NO: 4340799 - DNA, 22 bp, Homo sapiens
agccctctgtggccaggagccc

SEQ ID NO: 4340800 - DNA, 17 bp, Homo sapiens
agcccttcctccctgtc

SEQ ID NO: 4340801 - DNA, 19 bp, Homo sapiens
agcccttctaccccacctg

SEQ ID NO: 4340802 - DNA, 19 bp, Homo sapiens
agccgagattgcaccactg

SEQ ID NO: 4340803 - DNA, 15 bp, Homo sapiens
agccgtgtgtgcatg

SEQ ID NO: 4340804 - DNA, 17 bp, Homo sapiens
agccgtgtgtgcatgtg

SEQ ID NO: 4340805 - DNA, 18 bp, Homo sapiens
agccgtgtgtgcatgtgc

SEQ ID NO: 4340806 - DNA, 14 bp, Homo sapiens
agcctcctccagcc

SEQ ID NO: 4340807 - DNA, 22 bp, Homo sapiens
agcctgcaggtccggggaggag

SEQ ID NO: 4340808 - DNA, 13 bp, Homo sapiens
agcctgcccttgt

SEQ ID NO: 4340809 - DNA, 17 bp, Homo sapiens
agcctgcccttgtctga

SEQ ID NO: 4340810 - DNA, 23 bp, Homo sapiens
agcctgcccttgtctgagatgct

SEQ ID NO: 4340811 - DNA, 16 bp, Homo sapiens
agcctgcctcttctct

SEQ ID NO: 4340812 - DNA, 19 bp, Homo sapiens
agcctgcctcttctctact

SEQ ID NO: 4340813 - DNA, 19 bp, Homo sapiens
agcctgctccagctgttca

SEQ ID NO: 4340814 - DNA, 22 bp, Homo sapiens
agcctgctccagctgttcagct

SEQ ID NO: 4340815 - DNA, 15 bp, Homo sapiens
agcctggacccccag

SEQ ID NO: 4340816 - DNA, 18 bp, Homo sapiens
agcctgggcaatgtgata

SEQ ID NO: 4340817 - DNA, 16 bp, Homo sapiens
agcctgtaattatgta

SEQ ID NO: 4340818 - DNA, 11 bp, Homo sapiens
agcctgtccaa

SEQ ID NO: 4340819 - DNA, 16 bp, Homo sapiens
agcctgttcccactca

SEQ ID NO: 4340820 - DNA, 18 bp, Homo sapiens
agccttatgtgttacatt

SEQ ID NO: 4340821 - DNA, 15 bp, Homo sapiens
agcgctgttgatccc

SEQ ID NO: 4340822 - DNA, 20 bp, Homo sapiens
agcgctgttgatcccctctc

SEQ ID NO: 4340823 - DNA, 19 bp, Homo sapiens
agcgctgttgcccgccctc

SEQ ID NO: 4340824 - DNA, 20 bp, Homo sapiens
agcgctgttgcccgccctcc

SEQ ID NO: 4340825 - DNA, 15 bp, Homo sapiens
agcgtgggctcagca

SEQ ID NO: 4340826 - DNA, 17 bp, Homo sapiens
agctaaagaaactgctt

SEQ ID NO: 4340827 - DNA, 14 bp, Homo sapiens
agctaatctgcctg

SEQ ID NO: 4340828 - DNA, 19 bp, Homo sapiens
agctacccttttcctttgt

SEQ ID NO: 4340829 - DNA, 13 bp, Homo sapiens
agctagaatttct

SEQ ID NO: 4340830 - DNA, 15 bp, Homo sapiens
agctagaatttctgg

SEQ ID NO: 4340831 - DNA, 12 bp, Homo sapiens
agctagactgtg

SEQ ID NO: 4340832 - DNA, 13 bp, Homo sapiens
agctagtgccaaa

SEQ ID NO: 4340833 - DNA, 15 bp, Homo sapiens
agctattaaaatgta

SEQ ID NO: 4340834 - DNA, 20 bp, Homo sapiens
agctcaagcaggaagttcaa

SEQ ID NO: 4340835 - DNA, 22 bp, Homo sapiens
agctcaggaggcgaataaatgt

SEQ ID NO: 4340836 - DNA, 20 bp, Homo sapiens
agctccagggagcttattca

SEQ ID NO: 4340837 - DNA, 14 bp, Homo sapiens
agctcccaaaagaa

SEQ ID NO: 4340838 - DNA, 18 bp, Homo sapiens
agctcccacacccacctc

SEQ ID NO: 4340839 - DNA, 13 bp, Homo sapiens
agctccccctgtc

SEQ ID NO: 4340840 - DNA, 19 bp, Homo sapiens
agctccccctgtcccctca

SEQ ID NO: 4340841 - DNA, 21 bp, Homo sapiens
agctccccctgtcccctcagc

SEQ ID NO: 4340842 - DNA, 18 bp, Homo sapiens
agctccctgaccccctgt

SEQ ID NO: 4340843 - DNA, 19 bp, Homo sapiens
agctccctgaccccctgtc

SEQ ID NO: 4340844 - DNA, 13 bp, Homo sapiens
agctcctggcagc

SEQ ID NO: 4340845 - DNA, 16 bp, Homo sapiens
agctcctttcatgctc

SEQ ID NO: 4340846 - DNA, 16 bp, Homo sapiens
agctctcctcctccat

SEQ ID NO: 4340847 - DNA, 16 bp, Homo sapiens
agctctctcctccctt

SEQ ID NO: 4340848 - DNA, 22 bp, Homo sapiens
agctcttttttgtttgtttctt

SEQ ID NO: 4340849 - DNA, 16 bp, Homo sapiens
agctgaagaaattata

SEQ ID NO: 4340850 - DNA, 22 bp, Homo sapiens
agctgactccagtataatctcc

SEQ ID NO: 4340851 - DNA, 18 bp, Homo sapiens
agctgattccagaacaaa

SEQ ID NO: 4340852 - DNA, 19 bp, Homo sapiens
agctgattccagaacaaat

SEQ ID NO: 4340853 - DNA, 18 bp, Homo sapiens
agctgatttccctttttt

SEQ ID NO: 4340854 - DNA, 18 bp, Homo sapiens
agctgcaccctcaggcag

SEQ ID NO: 4340855 - DNA, 18 bp, Homo sapiens
agctgctaagctaaagaa

SEQ ID NO: 4340856 - DNA, 23 bp, Homo sapiens
agctgctatgctaaacctcctgc

SEQ ID NO: 4340857 - DNA, 17 bp, Homo sapiens
agctggccctcagctcc

SEQ ID NO: 4340858 - DNA, 22 bp, Homo sapiens
agctgggacctaatgctggcct

SEQ ID NO: 4340859 - DNA, 23 bp, Homo sapiens
agctgggacctaatgctggcctg

SEQ ID NO: 4340860 - DNA, 16 bp, Homo sapiens
agctggttgaggtttc

SEQ ID NO: 4340861 - DNA, 22 bp, Homo sapiens
agctggttgtaccctctccagg

SEQ ID NO: 4340862 - DNA, 12 bp, Homo sapiens
agcttaaagctt

SEQ ID NO: 4340863 - DNA, 18 bp, Homo sapiens
agcttaaagcttgatttg

SEQ ID NO: 4340864 - DNA, 20 bp, Homo sapiens
agcttaaaggggctagagtg

SEQ ID NO: 4340865 - DNA, 16 bp, Homo sapiens
agcttcctgtctgttt

SEQ ID NO: 4340866 - DNA, 19 bp, Homo sapiens
agcttctagacactccttg

SEQ ID NO: 4340867 - DNA, 17 bp, Homo sapiens
agcttgtgctgagcctg

SEQ ID NO: 4340868 - DNA, 17 bp, Homo sapiens
agctttatctttgtgta

SEQ ID NO: 4340869 - DNA, 17 bp, Homo sapiens
agctttctaatgttcta

SEQ ID NO: 4340870 - DNA, 14 bp, Homo sapiens
agctttctgtgcat

SEQ ID NO: 4340871 - DNA, 16 bp, Homo sapiens
agctttctgtgcatgt

SEQ ID NO: 4340872 - DNA, 16 bp, Homo sapiens
agctttgaaaattcag

SEQ ID NO: 4340873 - DNA, 18 bp, Homo sapiens
agctttgaaaattcagtg

SEQ ID NO: 4340874 - DNA, 22 bp, Homo sapiens
agctttgcccaacaccagcccc

SEQ ID NO: 4340875 - DNA, 22 bp, Homo sapiens
agctttgtttgttgtcagctga

SEQ ID NO: 4340876 - DNA, 14 bp, Homo sapiens
aggaaaaatgtaga

SEQ ID NO: 4340877 - DNA, 14 bp, Homo sapiens
aggaaacatagaaa

SEQ ID NO: 4340878 - DNA, 19 bp, Homo sapiens
aggaaacatagaaagacat

SEQ ID NO: 4340879 - DNA, 13 bp, Homo sapiens
aggaactgtacag

SEQ ID NO: 4340880 - DNA, 15 bp, Homo sapiens
aggaactgtacagaa

SEQ ID NO: 4340881 - DNA, 18 bp, Homo sapiens
aggaagatgggggcaaga

SEQ ID NO: 4340882 - DNA, 19 bp, Homo sapiens
aggaagatgggggcaagaa

SEQ ID NO: 4340883 - DNA, 14 bp, Homo sapiens
aggaagatgttcaa

SEQ ID NO: 4340884 - DNA, 24 bp, Homo sapiens
aggaaggaaacatagaaagacatg

SEQ ID NO: 4340885 - DNA, 20 bp, Homo sapiens
aggaattcaatttggcaaaa

SEQ ID NO: 4340886 - DNA, 14 bp, Homo sapiens
aggaattgtttata

SEQ ID NO: 4340887 - DNA, 16 bp, Homo sapiens
aggaattgtttataca

SEQ ID NO: 4340888 - DNA, 22 bp, Homo sapiens
aggacatagaggtatattggaa

SEQ ID NO: 4340889 - DNA, 14 bp, Homo sapiens
aggacctcaggtga

SEQ ID NO: 4340890 - DNA, 20 bp, Homo sapiens
aggacctcaggtgagaagca

SEQ ID NO: 4340891 - DNA, 14 bp, Homo sapiens
aggagactgggcac

SEQ ID NO: 4340892 - DNA, 19 bp, Homo sapiens
aggagactgggcacccctg

SEQ ID NO: 4340893 - DNA, 21 bp, Homo sapiens
aggagactgggcacccctgcc

SEQ ID NO: 4340894 - DNA, 15 bp, Homo sapiens
aggagagctagcagc

SEQ ID NO: 4340895 - DNA, 16 bp, Homo sapiens
aggagaggggcacagg

SEQ ID NO: 4340896 - DNA, 18 bp, Homo sapiens
aggagaggggcacagggt

SEQ ID NO: 4340897 - DNA, 16 bp, Homo sapiens
aggagccccagccccg

SEQ ID NO: 4340898 - DNA, 14 bp, Homo sapiens
aggagccctggccc

SEQ ID NO: 4340899 - DNA, 23 bp, Homo sapiens
aggaggtcgtttatgtgtgcaga

SEQ ID NO: 4340900 - DNA, 20 bp, Homo sapiens
aggaggttcgggattccctg

SEQ ID NO: 4340901 - DNA, 22 bp, Homo sapiens
aggaggttcgggattccctggt

SEQ ID NO: 4340902 - DNA, 20 bp, Homo sapiens
aggaggttctgggcctctga

SEQ ID NO: 4340903 - DNA, 22 bp, Homo sapiens
aggagtgccataccttctccca

SEQ ID NO: 4340904 - DNA, 18 bp, Homo sapiens
aggatatactgcagcttt

SEQ ID NO: 4340905 - DNA, 19 bp, Homo sapiens
aggatcaaagacacacagg

SEQ ID NO: 4340906 - DNA, 14 bp, Homo sapiens
aggatcaccccagc

SEQ ID NO: 4340907 - DNA, 15 bp, Homo sapiens
aggatcaccccagcc

SEQ ID NO: 4340908 - DNA, 22 bp, Homo sapiens
aggatctaggatgggagagcta

SEQ ID NO: 4340909 - DNA, 14 bp, Homo sapiens
aggattaatgaaaa

SEQ ID NO: 4340910 - DNA, 15 bp, Homo sapiens
aggattgggggatgt

SEQ ID NO: 4340911 - DNA, 22 bp, Homo sapiens
aggcaacccccggtatatcatg

SEQ ID NO: 4340912 - DNA, 17 bp, Homo sapiens
aggcaactcatcttagg

SEQ ID NO: 4340913 - DNA, 22 bp, Homo sapiens
aggcaaggaaattaagaactga

SEQ ID NO: 4340914 - DNA, 16 bp, Homo sapiens
aggcacttattgtaaa

SEQ ID NO: 4340915 - DNA, 17 bp, Homo sapiens
aggcacttattgtaaat

SEQ ID NO: 4340916 - DNA, 17 bp, Homo sapiens
aggcacttttattttca

SEQ ID NO: 4340917 - DNA, 12 bp, Homo sapiens
aggcagaaagat

SEQ ID NO: 4340918 - DNA, 20 bp, Homo sapiens
aggcagaaagatttggaaaa

SEQ ID NO: 4340919 - DNA, 19 bp, Homo sapiens
aggcagaaatagttgtctg

SEQ ID NO: 4340920 - DNA, 21 bp, Homo sapiens
aggcagaaatagttgtctgtg

SEQ ID NO: 4340921 - DNA, 22 bp, Homo sapiens
aggcagaaatagttgtctgtgc

SEQ ID NO: 4340922 - DNA, 13 bp, Homo sapiens
aggcagctctgag

SEQ ID NO: 4340923 - DNA, 16 bp, Homo sapiens
aggcagctctgagccg

SEQ ID NO: 4340924 - DNA, 17 bp, Homo sapiens
aggcaggtgggatggat

SEQ ID NO: 4340925 - DNA, 14 bp, Homo sapiens
aggcatcactgatt

SEQ ID NO: 4340926 - DNA, 21 bp, Homo sapiens
aggcatcactgattccctctc

SEQ ID NO: 4340927 - DNA, 10 bp, Homo sapiens
aggcatctgc

SEQ ID NO: 4340928 - DNA, 11 bp, Homo sapiens
aggcatctgca

SEQ ID NO: 4340929 - DNA, 15 bp, Homo sapiens
aggcatggtggccca

SEQ ID NO: 4340930 - DNA, 15 bp, Homo sapiens
aggccagaaaaagaa

SEQ ID NO: 4340931 - DNA, 19 bp, Homo sapiens
aggccagaaaaagaagaag

SEQ ID NO: 4340932 - DNA, 20 bp, Homo sapiens
aggccagaaaaagaagaagg

SEQ ID NO: 4340933 - DNA, 13 bp, Homo sapiens
aggccccaaagga

SEQ ID NO: 4340934 - DNA, 22 bp, Homo sapiens
aggccccaactcaagtgtcacc

SEQ ID NO: 4340935 - DNA, 22 bp, Homo sapiens
aggccgatggggaaggagaagg

SEQ ID NO: 4340936 - DNA, 16 bp, Homo sapiens
aggccgctgcccctga

SEQ ID NO: 4340937 - DNA, 13 bp, Homo sapiens
aggcctacctctc

SEQ ID NO: 4340938 - DNA, 12 bp, Homo sapiens
aggcgaataaat

SEQ ID NO: 4340939 - DNA, 18 bp, Homo sapiens
aggcgaataaatgttcaa

SEQ ID NO: 4340940 - DNA, 21 bp, Homo sapiens
aggcgaataaatgttcaaact

SEQ ID NO: 4340941 - DNA, 18 bp, Homo sapiens
aggctaaccctgatccat

SEQ ID NO: 4340942 - DNA, 13 bp, Homo sapiens
aggctactctgcc

SEQ ID NO: 4340943 - DNA, 15 bp, Homo sapiens
aggctactctgccca

SEQ ID NO: 4340944 - DNA, 16 bp, Homo sapiens
aggctactctgcccac

SEQ ID NO: 4340945 - DNA, 18 bp, Homo sapiens
aggctcaaggctgtgcag

SEQ ID NO: 4340946 - DNA, 14 bp, Homo sapiens
aggctctctaagaa

SEQ ID NO: 4340947 - DNA, 15 bp, Homo sapiens
aggctctctaagaaa

SEQ ID NO: 4340948 - DNA, 22 bp, Homo sapiens
aggctctctaagaaaagagagg

SEQ ID NO: 4340949 - DNA, 17 bp, Homo sapiens
aggctgcagtgagccga

SEQ ID NO: 4340950 - DNA, 17 bp, Homo sapiens
aggctgcgtctggaggg

SEQ ID NO: 4340951 - DNA, 15 bp, Homo sapiens
aggctgggcagggcc

SEQ ID NO: 4340952 - DNA, 21 bp, Homo sapiens
aggctggtatttatctgcaag

SEQ ID NO: 4340953 - DNA, 15 bp, Homo sapiens
aggctggtggccttg

SEQ ID NO: 4340954 - DNA, 16 bp, Homo sapiens
aggctggtggccttgg

SEQ ID NO: 4340955 - DNA, 21 bp, Homo sapiens
aggctggtggccttgggcctt

SEQ ID NO: 4340956 - DNA, 14 bp, Homo sapiens
aggcttatctctgc

SEQ ID NO: 4340957 - DNA, 19 bp, Homo sapiens
aggcttccaagcattactt

SEQ ID NO: 4340958 - DNA, 10 bp, Homo sapiens
agggaaaagg

SEQ ID NO: 4340959 - DNA, 21 bp, Homo sapiens
agggaaaatggatatagaaaa

SEQ ID NO: 4340960 - DNA, 14 bp, Homo sapiens
agggaaatgtgtat

SEQ ID NO: 4340961 - DNA, 15 bp, Homo sapiens
agggaaggggacaga

SEQ ID NO: 4340962 - DNA, 14 bp, Homo sapiens
agggacagagcccg

SEQ ID NO: 4340963 - DNA, 14 bp, Homo sapiens
agggactgtatttc

SEQ ID NO: 4340964 - DNA, 20 bp, Homo sapiens
agggactgtatttctgtgga

SEQ ID NO: 4340965 - DNA, 13 bp, Homo sapiens
agggagagccctg

SEQ ID NO: 4340966 - DNA, 14 bp, Homo sapiens
agggagagccctgt

SEQ ID NO: 4340967 - DNA, 14 bp, Homo sapiens
agggagattttgag

SEQ ID NO: 4340968 - DNA, 13 bp, Homo sapiens
agggagcctcctg

SEQ ID NO: 4340969 - DNA, 16 bp, Homo sapiens
agggagcctcctgccc

SEQ ID NO: 4340970 - DNA, 14 bp, Homo sapiens
agggcaattggaac

SEQ ID NO: 4340971 - DNA, 21 bp, Homo sapiens
agggcatcatcctcagcagca

SEQ ID NO: 4340972 - DNA, 19 bp, Homo sapiens
agggccaatggagaaaatg

SEQ ID NO: 4340973 - DNA, 22 bp, Homo sapiens
agggccgaggaatgtgaagcca

SEQ ID NO: 4340974 - DNA, 19 bp, Homo sapiens
agggctggtcacctcccat

SEQ ID NO: 4340975 - DNA, 13 bp, Homo sapiens
aggggcccctgct

SEQ ID NO: 4340976 - DNA, 16 bp, Homo sapiens
aggggcccctgcttct

SEQ ID NO: 4340977 - DNA, 20 bp, Homo sapiens
aggggcgggtgatgagacct

SEQ ID NO: 4340978 - DNA, 16 bp, Homo sapiens
agggggcacgggcctg

SEQ ID NO: 4340979 - DNA, 23 bp, Homo sapiens
aggggttgccacaggcctccctg

SEQ ID NO: 4340980 - DNA, 14 bp, Homo sapiens
agggtataatgtgt

SEQ ID NO: 4340981 - DNA, 13 bp, Homo sapiens
agggtattccaga

SEQ ID NO: 4340982 - DNA, 12 bp, Homo sapiens
agggtctccagt

SEQ ID NO: 4340983 - DNA, 14 bp, Homo sapiens
aggtaaaatgtatt

SEQ ID NO: 4340984 - DNA, 20 bp, Homo sapiens
aggtaaacacataaatgaaa

SEQ ID NO: 4340985 - DNA, 14 bp, Homo sapiens
aggtaacactacag

SEQ ID NO: 4340986 - DNA, 15 bp, Homo sapiens
aggtagaggaaaatc

SEQ ID NO: 4340987 - DNA, 21 bp, Homo sapiens
aggtcaaggctgcagtgagcc

SEQ ID NO: 4340988 - DNA, 17 bp, Homo sapiens
aggtcatcccttcctcc

SEQ ID NO: 4340989 - DNA, 14 bp, Homo sapiens
aggtctctgtgggt

SEQ ID NO: 4340990 - DNA, 21 bp, Homo sapiens
aggtgaacagcaggatgccct

SEQ ID NO: 4340991 - DNA, 16 bp, Homo sapiens
aggtgagaagcagagg

SEQ ID NO: 4340992 - DNA, 23 bp, Homo sapiens
aggtgagtctgaaccaatagaaa

SEQ ID NO: 4340993 - DNA, 13 bp, Homo sapiens
aggtgatgctgct

SEQ ID NO: 4340994 - DNA, 20 bp, Homo sapiens
aggtgcctgaaagctgggag

SEQ ID NO: 4340995 - DNA, 14 bp, Homo sapiens
aggtggccctccca

SEQ ID NO: 4340996 - DNA, 12 bp, Homo sapiens
aggtgggaggat

SEQ ID NO: 4340997 - DNA, 21 bp, Homo sapiens
aggtgggtgaggctgggcagg

SEQ ID NO: 4340998 - DNA, 17 bp, Homo sapiens
aggtggttatggagagg

SEQ ID NO: 4340999 - DNA, 22 bp, Homo sapiens
aggtgtattgtgtatgtagcct

SEQ ID NO: 4341000 - DNA, 16 bp, Homo sapiens
aggtgtgcaagaacca

SEQ ID NO: 4341001 - DNA, 13 bp, Homo sapiens
aggtgttgccagt

SEQ ID NO: 4341002 - DNA, 20 bp, Homo sapiens
aggttagcccaatggagaaa

SEQ ID NO: 4341003 - DNA, 22 bp, Homo sapiens
aggttagcccaatggagaaatg

SEQ ID NO: 4341004 - DNA, 15 bp, Homo sapiens
aggttctgggcctct

SEQ ID NO: 4341005 - DNA, 16 bp, Homo sapiens
aggttctgggcctctg

SEQ ID NO: 4341006 - DNA, 20 bp, Homo sapiens
aggttggcaaaaaggcagga

SEQ ID NO: 4341007 - DNA, 19 bp, Homo sapiens
aggtttagtaatctaaagt

SEQ ID NO: 4341008 - DNA, 23 bp, Homo sapiens
aggtttgttcctttgaagaattg

SEQ ID NO: 4341009 - DNA, 21 bp, Homo sapiens
agtaaaaagccctatgtgaaa

SEQ ID NO: 4341010 - DNA, 13 bp, Homo sapiens
agtaaaataaaaa

SEQ ID NO: 4341011 - DNA, 17 bp, Homo sapiens
agtaaaatttatttcat

SEQ ID NO: 4341012 - DNA, 16 bp, Homo sapiens
agtaaagaggcttcca

SEQ ID NO: 4341013 - DNA, 20 bp, Homo sapiens
agtaaagccattaaatgaat

SEQ ID NO: 4341014 - DNA, 20 bp, Homo sapiens
agtaaatattatgattttat

SEQ ID NO: 4341015 - DNA, 11 bp, Homo sapiens
agtaacacttt

SEQ ID NO: 4341016 - DNA, 21 bp, Homo sapiens
agtaacactttaaaaccagtt

SEQ ID NO: 4341017 - DNA, 17 bp, Homo sapiens
agtaacttacttaggtg

SEQ ID NO: 4341018 - DNA, 18 bp, Homo sapiens
agtaatgtagaaatgttt

SEQ ID NO: 4341019 - DNA, 19 bp, Homo sapiens
agtaattatgcactaaata

SEQ ID NO: 4341020 - DNA, 21 bp, Homo sapiens
agtaattatgcactaaatatg

SEQ ID NO: 4341021 - DNA, 12 bp, Homo sapiens
agtacaatcagc

SEQ ID NO: 4341022 - DNA, 23 bp, Homo sapiens
agtacagtcccagcacatttcct

SEQ ID NO: 4341023 - DNA, 17 bp, Homo sapiens
agtactgtttaccattt

SEQ ID NO: 4341024 - DNA, 22 bp, Homo sapiens
agtactttataaccaaagcaat

SEQ ID NO: 4341025 - DNA, 12 bp, Homo sapiens
agtagaatttta

SEQ ID NO: 4341026 - DNA, 15 bp, Homo sapiens
agtagaattttagtc

SEQ ID NO: 4341027 - DNA, 19 bp, Homo sapiens
agtagacaatcattgtttt

SEQ ID NO: 4341028 - DNA, 20 bp, Homo sapiens
agtataatctcctctgctca

SEQ ID NO: 4341029 - DNA, 15 bp, Homo sapiens
agtatattatgtatt

SEQ ID NO: 4341030 - DNA, 18 bp, Homo sapiens
agtatgtccttcagctga

SEQ ID NO: 4341031 - DNA, 21 bp, Homo sapiens
agtattttccagccttatgtg

SEQ ID NO: 4341032 - DNA, 14 bp, Homo sapiens
agtcaactggggaa

SEQ ID NO: 4341033 - DNA, 19 bp, Homo sapiens
agtcaactggggaaaagga

SEQ ID NO: 4341034 - DNA, 20 bp, Homo sapiens
agtcaagaggtttttctccc

SEQ ID NO: 4341035 - DNA, 21 bp, Homo sapiens
agtcactattttggctcaaac

SEQ ID NO: 4341036 - DNA, 17 bp, Homo sapiens
agtcagagttaaaatat

SEQ ID NO: 4341037 - DNA, 14 bp, Homo sapiens
agtcatatgtgaag

SEQ ID NO: 4341038 - DNA, 15 bp, Homo sapiens
agtcatatgtgaaga

SEQ ID NO: 4341039 - DNA, 16 bp, Homo sapiens
agtcatatgtgaagac

SEQ ID NO: 4341040 - DNA, 22 bp, Homo sapiens
agtccaactcttccacctctgg

SEQ ID NO: 4341041 - DNA, 14 bp, Homo sapiens
agtcccagcacatt

SEQ ID NO: 4341042 - DNA, 17 bp, Homo sapiens
agtcccagcacatttcc

SEQ ID NO: 4341043 - DNA, 15 bp, Homo sapiens
agtccttgaacccag

SEQ ID NO: 4341044 - DNA, 22 bp, Homo sapiens
agtcctttcttttgaaatgcca

SEQ ID NO: 4341045 - DNA, 17 bp, Homo sapiens
agtcgggcatgagtctg

SEQ ID NO: 4341046 - DNA, 14 bp, Homo sapiens
agtcgttttccaaa

SEQ ID NO: 4341047 - DNA, 16 bp, Homo sapiens
agtctctggggcaggc

SEQ ID NO: 4341048 - DNA, 21 bp, Homo sapiens
agtctctggggcaggctgctt

SEQ ID NO: 4341049 - DNA, 17 bp, Homo sapiens
agtctgaaccaatagaa

SEQ ID NO: 4341050 - DNA, 19 bp, Homo sapiens
agtctgagaggttagaatg

SEQ ID NO: 4341051 - DNA, 20 bp, Homo sapiens
agtctgagaggttagaatga

SEQ ID NO: 4341052 - DNA, 15 bp, Homo sapiens
agtctgattatacca

SEQ ID NO: 4341053 - DNA, 22 bp, Homo sapiens
agtctgattataccatgtgtgc

SEQ ID NO: 4341054 - DNA, 15 bp, Homo sapiens
agtcttaactgtatt

SEQ ID NO: 4341055 - DNA, 19 bp, Homo sapiens
agtctttccttagttaaaa

SEQ ID NO: 4341056 - DNA, 11 bp, Homo sapiens
agtgaaaaagg

SEQ ID NO: 4341057 - DNA, 20 bp, Homo sapiens
agtgaaaaaggaggaagaga

SEQ ID NO: 4341058 - DNA, 12 bp, Homo sapiens
agtgaaaatact

SEQ ID NO: 4341059 - DNA, 16 bp, Homo sapiens
agtgaacttgggccac

SEQ ID NO: 4341060 - DNA, 22 bp, Homo sapiens
agtgaagaataggtgcaaacaa

SEQ ID NO: 4341061 - DNA, 20 bp, Homo sapiens
agtgagttttactcttaaat

SEQ ID NO: 4341062 - DNA, 22 bp, Homo sapiens
agtgagttttactcttaaatca

SEQ ID NO: 4341063 - DNA, 15 bp, Homo sapiens
agtgcagcccctctc

SEQ ID NO: 4341064 - DNA, 14 bp, Homo sapiens
agtgccaaataatt

SEQ ID NO: 4341065 - DNA, 21 bp, Homo sapiens
agtgccataccttctcccagg

SEQ ID NO: 4341066 - DNA, 22 bp, Homo sapiens
agtgccataccttctcccaggc

SEQ ID NO: 4341067 - DNA, 12 bp, Homo sapiens
agtgccatgctt

SEQ ID NO: 4341068 - DNA, 13 bp, Homo sapiens
agtgccccaagga

SEQ ID NO: 4341069 - DNA, 22 bp, Homo sapiens
agtgcccggtgcagggcctggc

SEQ ID NO: 4341070 - DNA, 21 bp, Homo sapiens
agtgcccttaaggatcacccc

SEQ ID NO: 4341071 - DNA, 13 bp, Homo sapiens
agtgcctgctggg

SEQ ID NO: 4341072 - DNA, 18 bp, Homo sapiens
agtgctaagctgccctga

SEQ ID NO: 4341073 - DNA, 21 bp, Homo sapiens
agtgctacctgcacctctgga

SEQ ID NO: 4341074 - DNA, 22 bp, Homo sapiens
agtgctgtccatgcttctcatc

SEQ ID NO: 4341075 - DNA, 13 bp, Homo sapiens
agtgcttcacatt

SEQ ID NO: 4341076 - DNA, 16 bp, Homo sapiens
agtgcttcacatttgt

SEQ ID NO: 4341077 - DNA, 11 bp, Homo sapiens
agtgcttcaga

SEQ ID NO: 4341078 - DNA, 15 bp, Homo sapiens
agtgcttcagagttt

SEQ ID NO: 4341079 - DNA, 11 bp, Homo sapiens
agtggaaaaat

SEQ ID NO: 4341080 - DNA, 14 bp, Homo sapiens
agtggcatagagaa

SEQ ID NO: 4341081 - DNA, 16 bp, Homo sapiens
agtggcatagagaata

SEQ ID NO: 4341082 - DNA, 13 bp, Homo sapiens
agtggccactggc

SEQ ID NO: 4341083 - DNA, 22 bp, Homo sapiens
agtggccactggcacttgcctg

SEQ ID NO: 4341084 - DNA, 12 bp, Homo sapiens
agtgggaagaat

SEQ ID NO: 4341085 - DNA, 18 bp, Homo sapiens
agtgggggatcacagcct

SEQ ID NO: 4341086 - DNA, 18 bp, Homo sapiens
agtgggtgaataatacag

SEQ ID NO: 4341087 - DNA, 18 bp, Homo sapiens
agtggtaaaaaagaaatg

SEQ ID NO: 4341088 - DNA, 19 bp, Homo sapiens
agtggtaaaaaagaaatga

SEQ ID NO: 4341089 - DNA, 22 bp, Homo sapiens
agtggtctccttcacatcagaa

SEQ ID NO: 4341090 - DNA, 23 bp, Homo sapiens
agtggtttttgctctagggccct

SEQ ID NO: 4341091 - DNA, 12 bp, Homo sapiens
agtgtacatgaa

SEQ ID NO: 4341092 - DNA, 15 bp, Homo sapiens
agtgtacatgaagaa

SEQ ID NO: 4341093 - DNA, 17 bp, Homo sapiens
agtgtcacctccttccc

SEQ ID NO: 4341094 - DNA, 19 bp, Homo sapiens
agtgtcacctccttcccca

SEQ ID NO: 4341095 - DNA, 23 bp, Homo sapiens
agtgtcacctccttccccagctc

SEQ ID NO: 4341096 - DNA, 13 bp, Homo sapiens
agtgtcatttctt

SEQ ID NO: 4341097 - DNA, 17 bp, Homo sapiens
agtgtcatttcttttag

SEQ ID NO: 4341098 - DNA, 21 bp, Homo sapiens
agtgtgcctgaagtcccagat

SEQ ID NO: 4341099 - DNA, 20 bp, Homo sapiens
agtgtgctgctgttctgtgt

SEQ ID NO: 4341100 - DNA, 21 bp, Homo sapiens
agtgtgctgctgttctgtgta

SEQ ID NO: 4341101 - DNA, 22 bp, Homo sapiens
agtgtgtgtgtgtgtctgtagg

SEQ ID NO: 4341102 - DNA, 23 bp, Homo sapiens
agtgttatcatattggtgctgag

SEQ ID NO: 4341103 - DNA, 17 bp, Homo sapiens
agtgttcagtgttgaca

SEQ ID NO: 4341104 - DNA, 20 bp, Homo sapiens
agtgttcagtgttgacatag

SEQ ID NO: 4341105 - DNA, 22 bp, Homo sapiens
agtgttcagtgttgacatagcc

SEQ ID NO: 4341106 - DNA, 17 bp, Homo sapiens
agtgttgacatagcctt

SEQ ID NO: 4341107 - DNA, 19 bp, Homo sapiens
agtgttgacatagcctttg

SEQ ID NO: 4341108 - DNA, 22 bp, Homo sapiens
agtgttgacatagcctttgtgc

SEQ ID NO: 4341109 - DNA, 20 bp, Homo sapiens
agttaaaatcacattttaag

SEQ ID NO: 4341110 - DNA, 21 bp, Homo sapiens
agttacgtataatgctttctg

SEQ ID NO: 4341111 - DNA, 15 bp, Homo sapiens
agttagagataattc

SEQ ID NO: 4341112 - DNA, 18 bp, Homo sapiens
agttatttgtataaatta

SEQ ID NO: 4341113 - DNA, 19 bp, Homo sapiens
agttatttgtataaattaa

SEQ ID NO: 4341114 - DNA, 17 bp, Homo sapiens
agttcctctttgccctg

SEQ ID NO: 4341115 - DNA, 18 bp, Homo sapiens
agttctatggagactttg

SEQ ID NO: 4341116 - DNA, 12 bp, Homo sapiens
agttctctgcca

SEQ ID NO: 4341117 - DNA, 13 bp, Homo sapiens
agttgaaaataca

SEQ ID NO: 4341118 - DNA, 22 bp, Homo sapiens
agttgacaaaaagctcttacac

SEQ ID NO: 4341119 - DNA, 18 bp, Homo sapiens
agttgaggaactgtacag

SEQ ID NO: 4341120 - DNA, 13 bp, Homo sapiens
agttgcagaaaat

SEQ ID NO: 4341121 - DNA, 17 bp, Homo sapiens
agttgcagaaaatgaac

SEQ ID NO: 4341122 - DNA, 14 bp, Homo sapiens
agttggaaaattcc

SEQ ID NO: 4341123 - DNA, 23 bp, Homo sapiens
agttggaaaattcccaaatatta

SEQ ID NO: 4341124 - DNA, 14 bp, Homo sapiens
agttggaaatattc

SEQ ID NO: 4341125 - DNA, 12 bp, Homo sapiens
agttggaggaga

SEQ ID NO: 4341126 - DNA, 17 bp, Homo sapiens
agttggaggagactggg

SEQ ID NO: 4341127 - DNA, 15 bp, Homo sapiens
agttggggagaaact

SEQ ID NO: 4341128 - DNA, 19 bp, Homo sapiens
agttgtctgaattgagaaa

SEQ ID NO: 4341129 - DNA, 22 bp, Homo sapiens
agttgtgctatatttttaaaga

SEQ ID NO: 4341130 - DNA, 16 bp, Homo sapiens
agtttagaagcgctca

SEQ ID NO: 4341131 - DNA, 20 bp, Homo sapiens
agtttagaagcgctcatctg

SEQ ID NO: 4341132 - DNA, 15 bp, Homo sapiens
agtttattttctgtg

SEQ ID NO: 4341133 - DNA, 16 bp, Homo sapiens
agtttattttctgtgt

SEQ ID NO: 4341134 - DNA, 15 bp, Homo sapiens
agtttgaacttcata

SEQ ID NO: 4341135 - DNA, 15 bp, Homo sapiens
agtttgtagtttttg

SEQ ID NO: 4341136 - DNA, 20 bp, Homo sapiens
agtttgtgtgtatttgtatt

SEQ ID NO: 4341137 - DNA, 23 bp, Homo sapiens
agttttactcttaaatcatttgg

SEQ ID NO: 4341138 - DNA, 19 bp, Homo sapiens
agtttttacaaaactgctt

SEQ ID NO: 4341139 - DNA, 14 bp, Homo sapiens
agtttttgctgaag

SEQ ID NO: 4341140 - DNA, 15 bp, Homo sapiens
agtttttgctgaagg

SEQ ID NO: 4341141 - DNA, 16 bp, Homo sapiens
ataaaaacaatatatt

SEQ ID NO: 4341142 - DNA, 21 bp, Homo sapiens
ataaaaaccacccacaaagaa

SEQ ID NO: 4341143 - DNA, 22 bp, Homo sapiens
ataaaaaccacccacaaagaaa

SEQ ID NO: 4341144 - DNA, 16 bp, Homo sapiens
ataaaaagagatgaaa

SEQ ID NO: 4341145 - DNA, 15 bp, Homo sapiens
ataaaaataaataga

SEQ ID NO: 4341146 - DNA, 19 bp, Homo sapiens
ataaaagtctgagttctct

SEQ ID NO: 4341147 - DNA, 20 bp, Homo sapiens
ataaaattgcagtttcatgt

SEQ ID NO: 4341148 - DNA, 14 bp, Homo sapiens
ataaactttgaata

SEQ ID NO: 4341149 - DNA, 19 bp, Homo sapiens
ataaactttgaataaaaga

SEQ ID NO: 4341150 - DNA, 21 bp, Homo sapiens
ataaactttgaataaaagaat

SEQ ID NO: 4341151 - DNA, 16 bp, Homo sapiens
ataaagaaaattctct

SEQ ID NO: 4341152 - DNA, 14 bp, Homo sapiens
ataaagaaactttt

SEQ ID NO: 4341153 - DNA, 15 bp, Homo sapiens
ataaagaaacttttg

SEQ ID NO: 4341154 - DNA, 17 bp, Homo sapiens
ataaagaaacttttgaa

SEQ ID NO: 4341155 - DNA, 12 bp, Homo sapiens
ataaagaatata

SEQ ID NO: 4341156 - DNA, 13 bp, Homo sapiens
ataaagagttaga

SEQ ID NO: 4341157 - DNA, 15 bp, Homo sapiens
ataaaggcaaggaaa

SEQ ID NO: 4341158 - DNA, 20 bp, Homo sapiens
ataaaggcaaggaaattaag

SEQ ID NO: 4341159 - DNA, 15 bp, Homo sapiens
ataaataaaatggat

SEQ ID NO: 4341160 - DNA, 14 bp, Homo sapiens
ataaatatatataa

SEQ ID NO: 4341161 - DNA, 16 bp, Homo sapiens
ataaatatatataaag

SEQ ID NO: 4341162 - DNA, 17 bp, Homo sapiens
ataaatatatataaaga

SEQ ID NO: 4341163 - DNA, 21 bp, Homo sapiens
ataaatatatataaagaatat

SEQ ID NO: 4341164 - DNA, 15 bp, Homo sapiens
ataaatgactattgt

SEQ ID NO: 4341165 - DNA, 10 bp, Homo sapiens
ataaatgttc

SEQ ID NO: 4341166 - DNA, 14 bp, Homo sapiens
ataaccaaagcaat

SEQ ID NO: 4341167 - DNA, 15 bp, Homo sapiens
ataaccaaagcaatt

SEQ ID NO: 4341168 - DNA, 22 bp, Homo sapiens
ataactactgacgaaagagtca

SEQ ID NO: 4341169 - DNA, 19 bp, Homo sapiens
ataactgaataaaaaataa

SEQ ID NO: 4341170 - DNA, 19 bp, Homo sapiens
ataagacttgtttctttct

SEQ ID NO: 4341171 - DNA, 23 bp, Homo sapiens
ataaggcaacccccggtatatca

SEQ ID NO: 4341172 - DNA, 16 bp, Homo sapiens
ataagtaatatttaaa

SEQ ID NO: 4341173 - DNA, 20 bp, Homo sapiens
ataagtctacattaaacaat

SEQ ID NO: 4341174 - DNA, 21 bp, Homo sapiens
ataagtgtgtggtcccaagtt

SEQ ID NO: 4341175 - DNA, 17 bp, Homo sapiens
ataagtgttcagtgttg

SEQ ID NO: 4341176 - DNA, 14 bp, Homo sapiens
ataagttcctatac

SEQ ID NO: 4341177 - DNA, 15 bp, Homo sapiens
ataataatattgttt

SEQ ID NO: 4341178 - DNA, 15 bp, Homo sapiens
ataatactaatttat

SEQ ID NO: 4341179 - DNA, 15 bp, Homo sapiens
ataataggaattcaa

SEQ ID NO: 4341180 - DNA, 17 bp, Homo sapiens
ataatctatattaaatg

SEQ ID NO: 4341181 - DNA, 18 bp, Homo sapiens
ataatctatattaaatga

SEQ ID NO: 4341182 - DNA, 19 bp, Homo sapiens
ataatctatattaaatgag

SEQ ID NO: 4341183 - DNA, 13 bp, Homo sapiens
ataatgctttctg

SEQ ID NO: 4341184 - DNA, 15 bp, Homo sapiens
ataatgctttctgag

SEQ ID NO: 4341185 - DNA, 23 bp, Homo sapiens
ataatgtgtctgtgttgcttcaa

SEQ ID NO: 4341186 - DNA, 21 bp, Homo sapiens
ataattatttcagattcctca

SEQ ID NO: 4341187 - DNA, 21 bp, Homo sapiens
ataatttctttttggtaaata

SEQ ID NO: 4341188 - DNA, 13 bp, Homo sapiens
ataatttgtctta

SEQ ID NO: 4341189 - DNA, 15 bp, Homo sapiens
ataatttgtcttagt

SEQ ID NO: 4341190 - DNA, 23 bp, Homo sapiens
atacaatttgttcttgtatttta

SEQ ID NO: 4341191 - DNA, 18 bp, Homo sapiens
atacacaactttgcaaat

SEQ ID NO: 4341192 - DNA, 22 bp, Homo sapiens
atacacaaggccagaaaaagaa

SEQ ID NO: 4341193 - DNA, 16 bp, Homo sapiens
atacacatataaaaac

SEQ ID NO: 4341194 - DNA, 16 bp, Homo sapiens
atacagaggcaactgc

SEQ ID NO: 4341195 - DNA, 19 bp, Homo sapiens
atacagatggagcaaatgt

SEQ ID NO: 4341196 - DNA, 15 bp, Homo sapiens
atacatacaaatata

SEQ ID NO: 4341197 - DNA, 22 bp, Homo sapiens
atacatacaaatatatgtatat

SEQ ID NO: 4341198 - DNA, 20 bp, Homo sapiens
ataccaatgcttttatcaaa

SEQ ID NO: 4341199 - DNA, 14 bp, Homo sapiens
ataccccagaaatt

SEQ ID NO: 4341200 - DNA, 16 bp, Homo sapiens
atacctattaaaggaa

SEQ ID NO: 4341201 - DNA, 18 bp, Homo sapiens
atacctattaaaggaaaa

SEQ ID NO: 4341202 - DNA, 13 bp, Homo sapiens
atacctgcctttt

SEQ ID NO: 4341203 - DNA, 13 bp, Homo sapiens
ataccttctccca

SEQ ID NO: 4341204 - DNA, 15 bp, Homo sapiens
ataccttctcccagg

SEQ ID NO: 4341205 - DNA, 16 bp, Homo sapiens
ataccttctcccaggc

SEQ ID NO: 4341206 - DNA, 23 bp, Homo sapiens
ataccttctcccaggcctctgcc

SEQ ID NO: 4341207 - DNA, 13 bp, Homo sapiens
atacgtacataca

SEQ ID NO: 4341208 - DNA, 21 bp, Homo sapiens
atactaaaagttcttctccaa

SEQ ID NO: 4341209 - DNA, 22 bp, Homo sapiens
atacttttgagtatggctatct

SEQ ID NO: 4341210 - DNA, 21 bp, Homo sapiens
atagaaaagtagacaatcatt

SEQ ID NO: 4341211 - DNA, 17 bp, Homo sapiens
atagaaaatcttagtat

SEQ ID NO: 4341212 - DNA, 10 bp, Homo sapiens
atagaaagac

SEQ ID NO: 4341213 - DNA, 17 bp, Homo sapiens
atagaaagcaaacatgt

SEQ ID NO: 4341214 - DNA, 14 bp, Homo sapiens
atagaagaagagga

SEQ ID NO: 4341215 - DNA, 15 bp, Homo sapiens
atagaagaagaggaa

SEQ ID NO: 4341216 - DNA, 16 bp, Homo sapiens
atagagaatacacata

SEQ ID NO: 4341217 - DNA, 18 bp, Homo sapiens
atagaggtgatgctgcta

SEQ ID NO: 4341218 - DNA, 21 bp, Homo sapiens
atagattgcaaatattggtta

SEQ ID NO: 4341219 - DNA, 16 bp, Homo sapiens
atagattgtcttaatg

SEQ ID NO: 4341220 - DNA, 22 bp, Homo sapiens
atagcatggggcccctggccca

SEQ ID NO: 4341221 - DNA, 21 bp, Homo sapiens
atagcgctgttgatcccctct

SEQ ID NO: 4341222 - DNA, 18 bp, Homo sapiens
atagctcccaaaagaatg

SEQ ID NO: 4341223 - DNA, 17 bp, Homo sapiens
atagtataaatctatga

SEQ ID NO: 4341224 - DNA, 16 bp, Homo sapiens
atagtcatatgtgaag

SEQ ID NO: 4341225 - DNA, 12 bp, Homo sapiens
atagtgaagaat

SEQ ID NO: 4341226 - DNA, 15 bp, Homo sapiens
atagttagattccaa

SEQ ID NO: 4341227 - DNA, 17 bp, Homo sapiens
atagtttccaagaaatt

SEQ ID NO: 4341228 - DNA, 15 bp, Homo sapiens
atagttttacccata

SEQ ID NO: 4341229 - DNA, 20 bp, Homo sapiens
atagttttacccataagtaa

SEQ ID NO: 4341230 - DNA, 13 bp, Homo sapiens
atataaaaacaat

SEQ ID NO: 4341231 - DNA, 19 bp, Homo sapiens
atataaaagtctgagttct

SEQ ID NO: 4341232 - DNA, 18 bp, Homo sapiens
atataaagaatatatata

SEQ ID NO: 4341233 - DNA, 20 bp, Homo sapiens
atataaaggcaaggaaatta

SEQ ID NO: 4341234 - DNA, 13 bp, Homo sapiens
atatactgcagct

SEQ ID NO: 4341235 - DNA, 15 bp, Homo sapiens
atatactgcagcttt

SEQ ID NO: 4341236 - DNA, 14 bp, Homo sapiens
atatactttgtgga

SEQ ID NO: 4341237 - DNA, 13 bp, Homo sapiens
atatataaaatat

SEQ ID NO: 4341238 - DNA, 13 bp, Homo sapiens
atatataaagtat

SEQ ID NO: 4341239 - DNA, 13 bp, Homo sapiens
atatatataaaat

SEQ ID NO: 4341240 - DNA, 16 bp, Homo sapiens
atatatatatatataa

SEQ ID NO: 4341241 - DNA, 19 bp, Homo sapiens
atatatattataaatatat

SEQ ID NO: 4341242 - DNA, 13 bp, Homo sapiens
atatatgctgtat

SEQ ID NO: 4341243 - DNA, 15 bp, Homo sapiens
atatatgctgtattt

SEQ ID NO: 4341244 - DNA, 17 bp, Homo sapiens
atatattataaatatat

SEQ ID NO: 4341245 - DNA, 21 bp, Homo sapiens
atatattgaaagttgctttta

SEQ ID NO: 4341246 - DNA, 16 bp, Homo sapiens
atatcatagtataaat

SEQ ID NO: 4341247 - DNA, 17 bp, Homo sapiens
atatcatggaatttcca

SEQ ID NO: 4341248 - DNA, 13 bp, Homo sapiens
atatcttgttatt

SEQ ID NO: 4341249 - DNA, 14 bp, Homo sapiens
atatcttgttatta

SEQ ID NO: 4341250 - DNA, 21 bp, Homo sapiens
atatgacacagcttgtgaatg

SEQ ID NO: 4341251 - DNA, 16 bp, Homo sapiens
atatgaccattgaaaa

SEQ ID NO: 4341252 - DNA, 14 bp, Homo sapiens
atatgagactatta

SEQ ID NO: 4341253 - DNA, 13 bp, Homo sapiens
atatgcaagtaag

SEQ ID NO: 4341254 - DNA, 14 bp, Homo sapiens
atatgctacacata

SEQ ID NO: 4341255 - DNA, 20 bp, Homo sapiens
atatgctgtatttctttgta

SEQ ID NO: 4341256 - DNA, 21 bp, Homo sapiens
atatggagaattgctgaaggg

SEQ ID NO: 4341257 - DNA, 14 bp, Homo sapiens
atatgtatatatat

SEQ ID NO: 4341258 - DNA, 16 bp, Homo sapiens
atatgtattaatactt

SEQ ID NO: 4341259 - DNA, 20 bp, Homo sapiens
atattaaatgagggtttctg

SEQ ID NO: 4341260 - DNA, 22 bp, Homo sapiens
atattaaatgagggtttctgat

SEQ ID NO: 4341261 - DNA, 21 bp, Homo sapiens
atattactcctatttttgtaa

SEQ ID NO: 4341262 - DNA, 22 bp, Homo sapiens
atattactcctatttttgtaaa

SEQ ID NO: 4341263 - DNA, 21 bp, Homo sapiens
atattactgatttagaagcaa

SEQ ID NO: 4341264 - DNA, 15 bp, Homo sapiens
atattatcataacat

SEQ ID NO: 4341265 - DNA, 13 bp, Homo sapiens
atattatgatttt

SEQ ID NO: 4341266 - DNA, 14 bp, Homo sapiens
atattatgatttta

SEQ ID NO: 4341267 - DNA, 15 bp, Homo sapiens
atattatgattttat

SEQ ID NO: 4341268 - DNA, 12 bp, Homo sapiens
atattcaagtaa

SEQ ID NO: 4341269 - DNA, 14 bp, Homo sapiens
atattcaagtaaca

SEQ ID NO: 4341270 - DNA, 15 bp, Homo sapiens
atattcaagtaacac

SEQ ID NO: 4341271 - DNA, 16 bp, Homo sapiens
atattgaaagttgctt

SEQ ID NO: 4341272 - DNA, 17 bp, Homo sapiens
atattgcctgtgcttct

SEQ ID NO: 4341273 - DNA, 13 bp, Homo sapiens
atattgtttttct

SEQ ID NO: 4341274 - DNA, 15 bp, Homo sapiens
atatttatatcatat

SEQ ID NO: 4341275 - DNA, 20 bp, Homo sapiens
atatttctgctttctttgat

SEQ ID NO: 4341276 - DNA, 17 bp, Homo sapiens
atattttgataataata

SEQ ID NO: 4341277 - DNA, 18 bp, Homo sapiens
atattttgataataatat

SEQ ID NO: 4341278 - DNA, 13 bp, Homo sapiens
atatttttaaaga

SEQ ID NO: 4341279 - DNA, 15 bp, Homo sapiens
atatttttaaagaag

SEQ ID NO: 4341280 - DNA, 17 bp, Homo sapiens
atatttttaaagaagga

SEQ ID NO: 4341281 - DNA, 22 bp, Homo sapiens
atatttttttctttttaaaata

SEQ ID NO: 4341282 - DNA, 19 bp, Homo sapiens
atcaaaaactgactttatt

SEQ ID NO: 4341283 - DNA, 17 bp, Homo sapiens
atcaaagtggggtacag

SEQ ID NO: 4341284 - DNA, 21 bp, Homo sapiens
atcaacaaaagggagaacatg

SEQ ID NO: 4341285 - DNA, 12 bp, Homo sapiens
atcaacaatgat

SEQ ID NO: 4341286 - DNA, 21 bp, Homo sapiens
atcacagcctctgaaaaccaa

SEQ ID NO: 4341287 - DNA, 18 bp, Homo sapiens
atcacatctaaagcttta

SEQ ID NO: 4341288 - DNA, 20 bp, Homo sapiens
atcacatctaaagctttatc

SEQ ID NO: 4341289 - DNA, 15 bp, Homo sapiens
atcacattttaagtg

SEQ ID NO: 4341290 - DNA, 19 bp, Homo sapiens
atcacattttaagtgcttc

SEQ ID NO: 4341291 - DNA, 20 bp, Homo sapiens
atcaccccagcccccacagc

SEQ ID NO: 4341292 - DNA, 23 bp, Homo sapiens
atcagaggtcatcccttcctcct

SEQ ID NO: 4341293 - DNA, 13 bp, Homo sapiens
atcagatttctta

SEQ ID NO: 4341294 - DNA, 15 bp, Homo sapiens
atcagatttcttaat

SEQ ID NO: 4341295 - DNA, 19 bp, Homo sapiens
atcagatttcttaatgtct

SEQ ID NO: 4341296 - DNA, 21 bp, Homo sapiens
atcagatttcttaatgtctgt

SEQ ID NO: 4341297 - DNA, 22 bp, Homo sapiens
atcagcacagctctcctcctcc

SEQ ID NO: 4341298 - DNA, 17 bp, Homo sapiens
atcagcctgctccagct

SEQ ID NO: 4341299 - DNA, 16 bp, Homo sapiens
atcagcttaatttaag

SEQ ID NO: 4341300 - DNA, 13 bp, Homo sapiens
atcagtagaaaga

SEQ ID NO: 4341301 - DNA, 15 bp, Homo sapiens
atcagttaaaatcac

SEQ ID NO: 4341302 - DNA, 13 bp, Homo sapiens
atcataatttctt

SEQ ID NO: 4341303 - DNA, 14 bp, Homo sapiens
atcataatttcttt

SEQ ID NO: 4341304 - DNA, 16 bp, Homo sapiens
atcataggtatttcaa

SEQ ID NO: 4341305 - DNA, 15 bp, Homo sapiens
atcatatataaaagt

SEQ ID NO: 4341306 - DNA, 20 bp, Homo sapiens
atcatatgaccattgaaaaa

SEQ ID NO: 4341307 - DNA, 21 bp, Homo sapiens
atcatatgaccattgaaaaag

SEQ ID NO: 4341308 - DNA, 12 bp, Homo sapiens
atcatattgaga

SEQ ID NO: 4341309 - DNA, 12 bp, Homo sapiens
atcatgtctgta

SEQ ID NO: 4341310 - DNA, 18 bp, Homo sapiens
atcattgttttgaatatt

SEQ ID NO: 4341311 - DNA, 17 bp, Homo sapiens
atcatttggttaaatca

SEQ ID NO: 4341312 - DNA, 20 bp, Homo sapiens
atcattttggaggctttgtt

SEQ ID NO: 4341313 - DNA, 23 bp, Homo sapiens
atccaaacaagactgctcatgca

SEQ ID NO: 4341314 - DNA, 16 bp, Homo sapiens
atccacttcaggagcc

SEQ ID NO: 4341315 - DNA, 17 bp, Homo sapiens
atccacttcaggagccc

SEQ ID NO: 4341316 - DNA, 17 bp, Homo sapiens
atccattacgtgcattt

SEQ ID NO: 4341317 - DNA, 21 bp, Homo sapiens
atcccaagatggagaggaaga

SEQ ID NO: 4341318 - DNA, 22 bp, Homo sapiens
atcccaagatggagaggaagaa

SEQ ID NO: 4341319 - DNA, 16 bp, Homo sapiens
atccccagtgcccggt

SEQ ID NO: 4341320 - DNA, 22 bp, Homo sapiens
atcccgggtttggctgagcctg

SEQ ID NO: 4341321 - DNA, 22 bp, Homo sapiens
atcccgtaagaccaccttccct

SEQ ID NO: 4341322 - DNA, 22 bp, Homo sapiens
atcctaaaagagatctgggcat

SEQ ID NO: 4341323 - DNA, 14 bp, Homo sapiens
atcctacagtacaa

SEQ ID NO: 4341324 - DNA, 19 bp, Homo sapiens
atcctacgctatgtagaat

SEQ ID NO: 4341325 - DNA, 13 bp, Homo sapiens
atcctagccccac

SEQ ID NO: 4341326 - DNA, 15 bp, Homo sapiens
atcctctcctttgaa

SEQ ID NO: 4341327 - DNA, 19 bp, Homo sapiens
atcgacatcctagccccac

SEQ ID NO: 4341328 - DNA, 13 bp, Homo sapiens
atcgcaacatgaa

SEQ ID NO: 4341329 - DNA, 16 bp, Homo sapiens
atcgctcgtgtgttct

SEQ ID NO: 4341330 - DNA, 14 bp, Homo sapiens
atcggaagaacatg

SEQ ID NO: 4341331 - DNA, 17 bp, Homo sapiens
atctaaaagttaagtgt

SEQ ID NO: 4341332 - DNA, 17 bp, Homo sapiens
atctaaagctttatctt

SEQ ID NO: 4341333 - DNA, 19 bp, Homo sapiens
atctaaagctttatctttg

SEQ ID NO: 4341334 - DNA, 23 bp, Homo sapiens
atctaatgagttgctggaaaatc

SEQ ID NO: 4341335 - DNA, 20 bp, Homo sapiens
atctactttttgtatttagt

SEQ ID NO: 4341336 - DNA, 21 bp, Homo sapiens
atctactttttgtatttagta

SEQ ID NO: 4341337 - DNA, 16 bp, Homo sapiens
atctagcatttatttc

SEQ ID NO: 4341338 - DNA, 14 bp, Homo sapiens
atctatacctgcct

SEQ ID NO: 4341339 - DNA, 22 bp, Homo sapiens
atctatacctgccttttaagtt

SEQ ID NO: 4341340 - DNA, 14 bp, Homo sapiens
atctatattaaatg

SEQ ID NO: 4341341 - DNA, 15 bp, Homo sapiens
atctatcggaagaac

SEQ ID NO: 4341342 - DNA, 20 bp, Homo sapiens
atctatcggaagaacatgaa

SEQ ID NO: 4341343 - DNA, 17 bp, Homo sapiens
atctatgatatatttat

SEQ ID NO: 4341344 - DNA, 21 bp, Homo sapiens
atctgatatgctgagaaatta

SEQ ID NO: 4341345 - DNA, 16 bp, Homo sapiens
atctgatgcatgcttt

SEQ ID NO: 4341346 - DNA, 21 bp, Homo sapiens
atctgccgctttgtctgtcca

SEQ ID NO: 4341347 - DNA, 17 bp, Homo sapiens
atctggcacgtggccag

SEQ ID NO: 4341348 - DNA, 21 bp, Homo sapiens
atctggcacgtggccaggagc

SEQ ID NO: 4341349 - DNA, 21 bp, Homo sapiens
atctgtactttgtgtttagct

SEQ ID NO: 4341350 - DNA, 16 bp, Homo sapiens
atctgtgcacactaag

SEQ ID NO: 4341351 - DNA, 18 bp, Homo sapiens
atctgtgcacactaagaa

SEQ ID NO: 4341352 - DNA, 20 bp, Homo sapiens
atctgtgcacactaagaaat

SEQ ID NO: 4341353 - DNA, 21 bp, Homo sapiens
atctgtgcagtcatcaacaaa

SEQ ID NO: 4341354 - DNA, 22 bp, Homo sapiens
atcttaagaggatggatgaatc

SEQ ID NO: 4341355 - DNA, 11 bp, Homo sapiens
atctttcctgt

SEQ ID NO: 4341356 - DNA, 12 bp, Homo sapiens
atctttgtgtaa

SEQ ID NO: 4341357 - DNA, 16 bp, Homo sapiens
atctttgtttaaatgc

SEQ ID NO: 4341358 - DNA, 17 bp, Homo sapiens
atcttttggacctggct

SEQ ID NO: 4341359 - DNA, 14 bp, Homo sapiens
atcttttgtgagat

SEQ ID NO: 4341360 - DNA, 23 bp, Homo sapiens
atcttttgtgagatgtaattgtt

SEQ ID NO: 4341361 - DNA, 12 bp, Homo sapiens
atgaaaactcat

SEQ ID NO: 4341362 - DNA, 12 bp, Homo sapiens
atgaaagaaacc

SEQ ID NO: 4341363 - DNA, 14 bp, Homo sapiens
atgaaatcatagta

SEQ ID NO: 4341364 - DNA, 16 bp, Homo sapiens
atgaaatcatagtata

SEQ ID NO: 4341365 - DNA, 24 bp, Homo sapiens
atgaaattgacaagctaggaaaga

SEQ ID NO: 4341366 - DNA, 17 bp, Homo sapiens
atgaaccctttgtttct

SEQ ID NO: 4341367 - DNA, 16 bp, Homo sapiens
atgaagcagaggaagg

SEQ ID NO: 4341368 - DNA, 22 bp, Homo sapiens
atgaagcagaggaaggaaacat

SEQ ID NO: 4341369 - DNA, 15 bp, Homo sapiens
atgaagtataaatct

SEQ ID NO: 4341370 - DNA, 16 bp, Homo sapiens
atgaagtataaatctg

SEQ ID NO: 4341371 - DNA, 15 bp, Homo sapiens
atgaagtgttagata

SEQ ID NO: 4341372 - DNA, 18 bp, Homo sapiens
atgaagtgttagatagaa

SEQ ID NO: 4341373 - DNA, 19 bp, Homo sapiens
atgaagtttgaacttcata

SEQ ID NO: 4341374 - DNA, 19 bp, Homo sapiens
atgaatattttgataataa

SEQ ID NO: 4341375 - DNA, 20 bp, Homo sapiens
atgaatattttgataataat

SEQ ID NO: 4341376 - DNA, 22 bp, Homo sapiens
atgaatattttgataataatat

SEQ ID NO: 4341377 - DNA, 20 bp, Homo sapiens
atgaattagaagaaaatgga

SEQ ID NO: 4341378 - DNA, 17 bp, Homo sapiens
atgaatttcatgtgaat

SEQ ID NO: 4341379 - DNA, 14 bp, Homo sapiens
atgacaaagaaaat

SEQ ID NO: 4341380 - DNA, 17 bp, Homo sapiens
atgacaggcctgaagat

SEQ ID NO: 4341381 - DNA, 23 bp, Homo sapiens
atgacaggcctgaagatattact

SEQ ID NO: 4341382 - DNA, 20 bp, Homo sapiens
atgaccattgaaaaaggaaa

SEQ ID NO: 4341383 - DNA, 22 bp, Homo sapiens
atgaccattgaaaaaggaaaaa

SEQ ID NO: 4341384 - DNA, 19 bp, Homo sapiens
atgactgtgaactgggcat

SEQ ID NO: 4341385 - DNA, 20 bp, Homo sapiens
atgactgtgaactgggcatt

SEQ ID NO: 4341386 - DNA, 22 bp, Homo sapiens
atgagactattatgaaatcata

SEQ ID NO: 4341387 - DNA, 17 bp, Homo sapiens
atgagtctgtttcccaa

SEQ ID NO: 4341388 - DNA, 19 bp, Homo sapiens
atgagtctgtttcccaagc

SEQ ID NO: 4341389 - DNA, 20 bp, Homo sapiens
atgagtctgtttcccaagct

SEQ ID NO: 4341390 - DNA, 16 bp, Homo sapiens
atgagttgctggaaaa

SEQ ID NO: 4341391 - DNA, 17 bp, Homo sapiens
atgagttgctggaaaat

SEQ ID NO: 4341392 - DNA, 16 bp, Homo sapiens
atgatacccaacagtt

SEQ ID NO: 4341393 - DNA, 19 bp, Homo sapiens
atgatacctattaaaggaa

SEQ ID NO: 4341394 - DNA, 15 bp, Homo sapiens
atgatcacatctaaa

SEQ ID NO: 4341395 - DNA, 15 bp, Homo sapiens
atgatgatcctaggc

SEQ ID NO: 4341396 - DNA, 17 bp, Homo sapiens
atgatgctaagagtcct

SEQ ID NO: 4341397 - DNA, 19 bp, Homo sapiens
atgattataatgctatttt

SEQ ID NO: 4341398 - DNA, 20 bp, Homo sapiens
atgattataatgctatttta

SEQ ID NO: 4341399 - DNA, 21 bp, Homo sapiens
atgattggttaaaatgtgatt

SEQ ID NO: 4341400 - DNA, 13 bp, Homo sapiens
atgattggttcag

SEQ ID NO: 4341401 - DNA, 17 bp, Homo sapiens
atgcaaactgctttatt

SEQ ID NO: 4341402 - DNA, 22 bp, Homo sapiens
atgcaaactgctttattttccc

SEQ ID NO: 4341403 - DNA, 13 bp, Homo sapiens
atgcacagatata

SEQ ID NO: 4341404 - DNA, 22 bp, Homo sapiens
atgcacagatatactttgtgga

SEQ ID NO: 4341405 - DNA, 15 bp, Homo sapiens
atgcagaacgtattt

SEQ ID NO: 4341406 - DNA, 19 bp, Homo sapiens
atgcagaacgtatttagcc

SEQ ID NO: 4341407 - DNA, 17 bp, Homo sapiens
atgcattccagaacaaa

SEQ ID NO: 4341408 - DNA, 21 bp, Homo sapiens
atgcattccagaacaaattgt

SEQ ID NO: 4341409 - DNA, 19 bp, Homo sapiens
atgccaacagacactacat

SEQ ID NO: 4341410 - DNA, 21 bp, Homo sapiens
atgccaatatgacacagcttg

SEQ ID NO: 4341411 - DNA, 21 bp, Homo sapiens
atgcccaccgaggagccccag

SEQ ID NO: 4341412 - DNA, 22 bp, Homo sapiens
atgcccttacacgtgcgtgtga

SEQ ID NO: 4341413 - DNA, 11 bp, Homo sapiens
atgcccttccc

SEQ ID NO: 4341414 - DNA, 12 bp, Homo sapiens
atgcccttcccc

SEQ ID NO: 4341415 - DNA, 13 bp, Homo sapiens
atgcccttccccc

SEQ ID NO: 4341416 - DNA, 19 bp, Homo sapiens
atgccgaacattaggaatt

SEQ ID NO: 4341417 - DNA, 16 bp, Homo sapiens
atgcggggcagagcca

SEQ ID NO: 4341418 - DNA, 21 bp, Homo sapiens
atgctacacatatgtgcttct

SEQ ID NO: 4341419 - DNA, 17 bp, Homo sapiens
atgctcaagaatgtagt

SEQ ID NO: 4341420 - DNA, 12 bp, Homo sapiens
atgctcatgtat

SEQ ID NO: 4341421 - DNA, 21 bp, Homo sapiens
atgctgaagtacagtcccagc

SEQ ID NO: 4341422 - DNA, 14 bp, Homo sapiens
atgctgagtctccc

SEQ ID NO: 4341423 - DNA, 14 bp, Homo sapiens
atgctgtatttctt

SEQ ID NO: 4341424 - DNA, 14 bp, Homo sapiens
atgctgtccgtgct

SEQ ID NO: 4341425 - DNA, 17 bp, Homo sapiens
atgcttctactgtgaca

SEQ ID NO: 4341426 - DNA, 19 bp, Homo sapiens
atggaacttagactcctct

SEQ ID NO: 4341427 - DNA, 12 bp, Homo sapiens
atggacattttc

SEQ ID NO: 4341428 - DNA, 18 bp, Homo sapiens
atggacgctgccgggaga

SEQ ID NO: 4341429 - DNA, 12 bp, Homo sapiens
atggagaaatga

SEQ ID NO: 4341430 - DNA, 21 bp, Homo sapiens
atggagcccagttggaaaatt

SEQ ID NO: 4341431 - DNA, 14 bp, Homo sapiens
atggataatcttcg

SEQ ID NO: 4341432 - DNA, 18 bp, Homo sapiens
atggatatagaaaatctt

SEQ ID NO: 4341433 - DNA, 19 bp, Homo sapiens
atggatgcaaagtacaatg

SEQ ID NO: 4341434 - DNA, 22 bp, Homo sapiens
atggatggagcccagttggaaa

SEQ ID NO: 4341435 - DNA, 15 bp, Homo sapiens
atggatttccagcca

SEQ ID NO: 4341436 - DNA, 17 bp, Homo sapiens
atggcatggagactctg

SEQ ID NO: 4341437 - DNA, 20 bp, Homo sapiens
atggcatggagactctgaga

SEQ ID NO: 4341438 - DNA, 14 bp, Homo sapiens
atggccaatagtca

SEQ ID NO: 4341439 - DNA, 18 bp, Homo sapiens
atggccagactcccttgc

SEQ ID NO: 4341440 - DNA, 18 bp, Homo sapiens
atggccaggatcctctcc

SEQ ID NO: 4341441 - DNA, 15 bp, Homo sapiens
atggccatggtaccc

SEQ ID NO: 4341442 - DNA, 22 bp, Homo sapiens
atggctatctatacctgccttt

SEQ ID NO: 4341443 - DNA, 16 bp, Homo sapiens
atgggaaataaagaaa

SEQ ID NO: 4341444 - DNA, 18 bp, Homo sapiens
atgggaaataaagaaaat

SEQ ID NO: 4341445 - DNA, 14 bp, Homo sapiens
atgggaaatgagcc

SEQ ID NO: 4341446 - DNA, 14 bp, Homo sapiens
atgggagcaacata

SEQ ID NO: 4341447 - DNA, 20 bp, Homo sapiens
atgggatatgattggttcag

SEQ ID NO: 4341448 - DNA, 15 bp, Homo sapiens
atgggcatgaatgga

SEQ ID NO: 4341449 - DNA, 21 bp, Homo sapiens
atgggctatcagggaggaaga

SEQ ID NO: 4341450 - DNA, 14 bp, Homo sapiens
atgtaatgtcagac

SEQ ID NO: 4341451 - DNA, 14 bp, Homo sapiens
atgtacttaaatga

SEQ ID NO: 4341452 - DNA, 20 bp, Homo sapiens
atgtagaaatgtttcataca

SEQ ID NO: 4341453 - DNA, 22 bp, Homo sapiens
atgtagccctctccaaatcaag

SEQ ID NO: 4341454 - DNA, 21 bp, Homo sapiens
atgtatataatcatgctcatg

SEQ ID NO: 4341455 - DNA, 13 bp, Homo sapiens
atgtatatatatt

SEQ ID NO: 4341456 - DNA, 18 bp, Homo sapiens
atgtatatatattctcag

SEQ ID NO: 4341457 - DNA, 19 bp, Homo sapiens
atgtatatatattctcagc

SEQ ID NO: 4341458 - DNA, 23 bp, Homo sapiens
atgtatgccttcgggaaaattca

SEQ ID NO: 4341459 - DNA, 19 bp, Homo sapiens
atgtcaatcttaagaggat

SEQ ID NO: 4341460 - DNA, 23 bp, Homo sapiens
atgtcagactttgctgcatttta

SEQ ID NO: 4341461 - DNA, 23 bp, Homo sapiens
atgtcctgaggctctctaagaaa

SEQ ID NO: 4341462 - DNA, 17 bp, Homo sapiens
atgtctgtatccccagt

SEQ ID NO: 4341463 - DNA, 20 bp, Homo sapiens
atgtctgtcagaagacacta

SEQ ID NO: 4341464 - DNA, 17 bp, Homo sapiens
atgtgaagaaataagta

SEQ ID NO: 4341465 - DNA, 19 bp, Homo sapiens
atgtgaaggacatgagact

SEQ ID NO: 4341466 - DNA, 12 bp, Homo sapiens
atgtgagaaatc

SEQ ID NO: 4341467 - DNA, 19 bp, Homo sapiens
atgtgagaaatcagaattg

SEQ ID NO: 4341468 - DNA, 22 bp, Homo sapiens
atgtgcgaagcaagaagaattg

SEQ ID NO: 4341469 - DNA, 13 bp, Homo sapiens
atgtgcttctcag

SEQ ID NO: 4341470 - DNA, 19 bp, Homo sapiens
atgtgggtgaagtgcctgc

SEQ ID NO: 4341471 - DNA, 19 bp, Homo sapiens
atgtggtcttatgatttta

SEQ ID NO: 4341472 - DNA, 23 bp, Homo sapiens
atgtgtagttgtctctcttcaga

SEQ ID NO: 4341473 - DNA, 16 bp, Homo sapiens
atgtgtgcagacaatt

SEQ ID NO: 4341474 - DNA, 20 bp, Homo sapiens
atgtgtgcagacaattctcc

SEQ ID NO: 4341475 - DNA, 15 bp, Homo sapiens
atgtgtgtagactgt

SEQ ID NO: 4341476 - DNA, 15 bp, Homo sapiens
atgtgttacattatt

SEQ ID NO: 4341477 - DNA, 13 bp, Homo sapiens
atgtgtttttctc

SEQ ID NO: 4341478 - DNA, 12 bp, Homo sapiens
atgttaagaaag

SEQ ID NO: 4341479 - DNA, 19 bp, Homo sapiens
atgttagagtcatttctga

SEQ ID NO: 4341480 - DNA, 17 bp, Homo sapiens
atgttcaatagaacatg

SEQ ID NO: 4341481 - DNA, 23 bp, Homo sapiens
atgttcaatagaacatgcaagaa

SEQ ID NO: 4341482 - DNA, 16 bp, Homo sapiens
atgttccaaatttaga

SEQ ID NO: 4341483 - DNA, 14 bp, Homo sapiens
atgttctaaattct

SEQ ID NO: 4341484 - DNA, 15 bp, Homo sapiens
atgttctaaattcta

SEQ ID NO: 4341485 - DNA, 16 bp, Homo sapiens
atgttctctcttctcc

SEQ ID NO: 4341486 - DNA, 17 bp, Homo sapiens
atgttggacagacactg

SEQ ID NO: 4341487 - DNA, 20 bp, Homo sapiens
atgttggacagacactgttg

SEQ ID NO: 4341488 - DNA, 12 bp, Homo sapiens
atgttggtgctg

SEQ ID NO: 4341489 - DNA, 21 bp, Homo sapiens
atgtttagtgtgctgctgttc

SEQ ID NO: 4341490 - DNA, 18 bp, Homo sapiens
atgtttcatacagctatt

SEQ ID NO: 4341491 - DNA, 15 bp, Homo sapiens
atgtttttaacacta

SEQ ID NO: 4341492 - DNA, 17 bp, Homo sapiens
attaaaaactttaaaga

SEQ ID NO: 4341493 - DNA, 16 bp, Homo sapiens
attaaaaggatagtat

SEQ ID NO: 4341494 - DNA, 18 bp, Homo sapiens
attaaagccttaagcaca

SEQ ID NO: 4341495 - DNA, 13 bp, Homo sapiens
attaaatgaatat

SEQ ID NO: 4341496 - DNA, 18 bp, Homo sapiens
attaaatgaatattttga

SEQ ID NO: 4341497 - DNA, 19 bp, Homo sapiens
attaaatgaatattttgat

SEQ ID NO: 4341498 - DNA, 14 bp, Homo sapiens
attaacaagaactc

SEQ ID NO: 4341499 - DNA, 14 bp, Homo sapiens
attaactaaatgct

SEQ ID NO: 4341500 - DNA, 13 bp, Homo sapiens
attaataaagcat

SEQ ID NO: 4341501 - DNA, 22 bp, Homo sapiens
attaatacttacggttttaaat

SEQ ID NO: 4341502 - DNA, 13 bp, Homo sapiens
attaccagtctga

SEQ ID NO: 4341503 - DNA, 19 bp, Homo sapiens
attacccacgtgacaccac

SEQ ID NO: 4341504 - DNA, 19 bp, Homo sapiens
attacgtgcatttaaactc

SEQ ID NO: 4341505 - DNA, 20 bp, Homo sapiens
attacgtgcatttaaactct

SEQ ID NO: 4341506 - DNA, 16 bp, Homo sapiens
attactcctatttttg

SEQ ID NO: 4341507 - DNA, 22 bp, Homo sapiens
attactgatttagaagcaaaga

SEQ ID NO: 4341508 - DNA, 18 bp, Homo sapiens
attacttgtgcacttagt

SEQ ID NO: 4341509 - DNA, 19 bp, Homo sapiens
attagaagtataaggtgct

SEQ ID NO: 4341510 - DNA, 23 bp, Homo sapiens
attaggaattgtttatacacaac

SEQ ID NO: 4341511 - DNA, 18 bp, Homo sapiens
attagtcgggcatgagtc

SEQ ID NO: 4341512 - DNA, 13 bp, Homo sapiens
attataaaattga

SEQ ID NO: 4341513 - DNA, 17 bp, Homo sapiens
attataaaattgaaaac

SEQ ID NO: 4341514 - DNA, 22 bp, Homo sapiens
attataaaattgaaaacactaa

SEQ ID NO: 4341515 - DNA, 19 bp, Homo sapiens
attataaatatatataaag

SEQ ID NO: 4341516 - DNA, 20 bp, Homo sapiens
attataccatgtgtgctaat

SEQ ID NO: 4341517 - DNA, 20 bp, Homo sapiens
attataccccatgataccta

SEQ ID NO: 4341518 - DNA, 16 bp, Homo sapiens
attatacgtacataca

SEQ ID NO: 4341519 - DNA, 23 bp, Homo sapiens
attatagctcccaaaagaatgga

SEQ ID NO: 4341520 - DNA, 13 bp, Homo sapiens
attatatgtatta

SEQ ID NO: 4341521 - DNA, 16 bp, Homo sapiens
attatcagtagaaaga

SEQ ID NO: 4341522 - DNA, 21 bp, Homo sapiens
attatcagttaaaatcacatt

SEQ ID NO: 4341523 - DNA, 22 bp, Homo sapiens
attatcagttaaaatcacattt

SEQ ID NO: 4341524 - DNA, 18 bp, Homo sapiens
attatctaatgagttgct

SEQ ID NO: 4341525 - DNA, 18 bp, Homo sapiens
attatgggtatgtgttgc

SEQ ID NO: 4341526 - DNA, 11 bp, Homo sapiens
attattgctta

SEQ ID NO: 4341527 - DNA, 15 bp, Homo sapiens
attattgcttattgc

SEQ ID NO: 4341528 - DNA, 20 bp, Homo sapiens
attatttcagattcctcagt

SEQ ID NO: 4341529 - DNA, 20 bp, Homo sapiens
attatttgggagggaaaagg

SEQ ID NO: 4341530 - DNA, 21 bp, Homo sapiens
attatttgggagggaaaaggg

SEQ ID NO: 4341531 - DNA, 21 bp, Homo sapiens
attattttgaggtagaggaaa

SEQ ID NO: 4341532 - DNA, 10 bp, Homo sapiens
attcaagtaa

SEQ ID NO: 4341533 - DNA, 15 bp, Homo sapiens
attcaagtaacactt

SEQ ID NO: 4341534 - DNA, 18 bp, Homo sapiens
attcagctctgcaagaat

SEQ ID NO: 4341535 - DNA, 15 bp, Homo sapiens
attccagaacaaatt

SEQ ID NO: 4341536 - DNA, 16 bp, Homo sapiens
attccagaacaaattg

SEQ ID NO: 4341537 - DNA, 18 bp, Homo sapiens
attccagaacaaattgtt

SEQ ID NO: 4341538 - DNA, 22 bp, Homo sapiens
attcccaagctctagtgggaag

SEQ ID NO: 4341539 - DNA, 17 bp, Homo sapiens
attccctagatctttct

SEQ ID NO: 4341540 - DNA, 14 bp, Homo sapiens
attccctctcccac

SEQ ID NO: 4341541 - DNA, 21 bp, Homo sapiens
attccctctcccacccaagga

SEQ ID NO: 4341542 - DNA, 23 bp, Homo sapiens
attccctctcccacccaaggaga

SEQ ID NO: 4341543 - DNA, 19 bp, Homo sapiens
attccgattagacctttat

SEQ ID NO: 4341544 - DNA, 16 bp, Homo sapiens
attcctacagcactac

SEQ ID NO: 4341545 - DNA, 13 bp, Homo sapiens
attcctgttctct

SEQ ID NO: 4341546 - DNA, 16 bp, Homo sapiens
attccttaaatgaact

SEQ ID NO: 4341547 - DNA, 22 bp, Homo sapiens
attccttaaatgaactactgct

SEQ ID NO: 4341548 - DNA, 23 bp, Homo sapiens
attccttaaatgaactactgcta

SEQ ID NO: 4341549 - DNA, 15 bp, Homo sapiens
attctgaaatacttt

SEQ ID NO: 4341550 - DNA, 21 bp, Homo sapiens
attctgaaatacttttgagta

SEQ ID NO: 4341551 - DNA, 22 bp, Homo sapiens
attctgagcccccttcctgtcc

SEQ ID NO: 4341552 - DNA, 13 bp, Homo sapiens
attcttggttgtt

SEQ ID NO: 4341553 - DNA, 20 bp, Homo sapiens
attctttcccagtgagtctc

SEQ ID NO: 4341554 - DNA, 14 bp, Homo sapiens
attgaaaaaggaaa

SEQ ID NO: 4341555 - DNA, 16 bp, Homo sapiens
attgaaaaaggaaaaa

SEQ ID NO: 4341556 - DNA, 15 bp, Homo sapiens
attgaaaacactaac

SEQ ID NO: 4341557 - DNA, 15 bp, Homo sapiens
attgaaagaaaaaaa

SEQ ID NO: 4341558 - DNA, 21 bp, Homo sapiens
attgaaagaaaaaaaaatact

SEQ ID NO: 4341559 - DNA, 23 bp, Homo sapiens
attgaaagaaaaaaaaatactta

SEQ ID NO: 4341560 - DNA, 14 bp, Homo sapiens
attgaaagttgctt

SEQ ID NO: 4341561 - DNA, 22 bp, Homo sapiens
attgaaagttgcttttattgca

SEQ ID NO: 4341562 - DNA, 21 bp, Homo sapiens
attgaaatagtttccaagaaa

SEQ ID NO: 4341563 - DNA, 15 bp, Homo sapiens
attgaagatacacaa

SEQ ID NO: 4341564 - DNA, 17 bp, Homo sapiens
attgagaataagaattt

SEQ ID NO: 4341565 - DNA, 20 bp, Homo sapiens
attgagaataattatttcag

SEQ ID NO: 4341566 - DNA, 19 bp, Homo sapiens
attgagtcttaactgtatt

SEQ ID NO: 4341567 - DNA, 16 bp, Homo sapiens
attgagtttgtaggta

SEQ ID NO: 4341568 - DNA, 20 bp, Homo sapiens
attgagtttgtaggtaaaat

SEQ ID NO: 4341569 - DNA, 21 bp, Homo sapiens
attgagtttgtaggtaaaatg

SEQ ID NO: 4341570 - DNA, 22 bp, Homo sapiens
attgatcccttctcctgccctt

SEQ ID NO: 4341571 - DNA, 19 bp, Homo sapiens
attgcaaaatagaagaaga

SEQ ID NO: 4341572 - DNA, 20 bp, Homo sapiens
attgcaaaatagaagaagag

SEQ ID NO: 4341573 - DNA, 14 bp, Homo sapiens
attgcactaggaat

SEQ ID NO: 4341574 - DNA, 16 bp, Homo sapiens
attgcactaggaattc

SEQ ID NO: 4341575 - DNA, 22 bp, Homo sapiens
attgcactaggaattctttgca

SEQ ID NO: 4341576 - DNA, 16 bp, Homo sapiens
attgcagatgccaaaa

SEQ ID NO: 4341577 - DNA, 23 bp, Homo sapiens
attgcagtttcatgtatgtatat

SEQ ID NO: 4341578 - DNA, 15 bp, Homo sapiens
attgcatttgctgtt

SEQ ID NO: 4341579 - DNA, 16 bp, Homo sapiens
attgcatttgctgttg

SEQ ID NO: 4341580 - DNA, 21 bp, Homo sapiens
attgcatttgctgttgtttct

SEQ ID NO: 4341581 - DNA, 18 bp, Homo sapiens
attgccgacagcacagat

SEQ ID NO: 4341582 - DNA, 16 bp, Homo sapiens
attgcttagtaaaatt

SEQ ID NO: 4341583 - DNA, 17 bp, Homo sapiens
attgcttagtgaaaata

SEQ ID NO: 4341584 - DNA, 18 bp, Homo sapiens
attggcttactgaaagac

SEQ ID NO: 4341585 - DNA, 20 bp, Homo sapiens
attggcttactgaaagacag

SEQ ID NO: 4341586 - DNA, 15 bp, Homo sapiens
attggttaaaatgtg

SEQ ID NO: 4341587 - DNA, 14 bp, Homo sapiens
attggttagtattt

SEQ ID NO: 4341588 - DNA, 21 bp, Homo sapiens
attgtaatgccaatatgacac

SEQ ID NO: 4341589 - DNA, 22 bp, Homo sapiens
attgtaatgccaatatgacaca

SEQ ID NO: 4341590 - DNA, 21 bp, Homo sapiens
attgtacaagcagttaatcac

SEQ ID NO: 4341591 - DNA, 13 bp, Homo sapiens
attgtccagctgg

SEQ ID NO: 4341592 - DNA, 14 bp, Homo sapiens
attgtcttgttctg

SEQ ID NO: 4341593 - DNA, 23 bp, Homo sapiens
attgtctttcattttgcctgagt

SEQ ID NO: 4341594 - DNA, 20 bp, Homo sapiens
attgtgcttctccccagaat

SEQ ID NO: 4341595 - DNA, 16 bp, Homo sapiens
attgtgtggagaactc

SEQ ID NO: 4341596 - DNA, 20 bp, Homo sapiens
attgtgttgtgcagcattaa

SEQ ID NO: 4341597 - DNA, 21 bp, Homo sapiens
attgtttaccatagaaagatg

SEQ ID NO: 4341598 - DNA, 15 bp, Homo sapiens
attgtttttctttct

SEQ ID NO: 4341599 - DNA, 18 bp, Homo sapiens
atttaaaaaattaaaaat

SEQ ID NO: 4341600 - DNA, 13 bp, Homo sapiens
atttaaactctgc

SEQ ID NO: 4341601 - DNA, 15 bp, Homo sapiens
atttaaactctgcca

SEQ ID NO: 4341602 - DNA, 15 bp, Homo sapiens
atttactgagacttc

SEQ ID NO: 4341603 - DNA, 13 bp, Homo sapiens
atttactgctcta

SEQ ID NO: 4341604 - DNA, 19 bp, Homo sapiens
atttactgctctagaaagt

SEQ ID NO: 4341605 - DNA, 19 bp, Homo sapiens
atttagagcgtttggttaa

SEQ ID NO: 4341606 - DNA, 22 bp, Homo sapiens
atttatatatcatagtataaat

SEQ ID NO: 4341607 - DNA, 18 bp, Homo sapiens
atttatatcttgttatta

SEQ ID NO: 4341608 - DNA, 17 bp, Homo sapiens
atttatcgcaacatgaa

SEQ ID NO: 4341609 - DNA, 18 bp, Homo sapiens
atttatgtaatgaagtaa

SEQ ID NO: 4341610 - DNA, 21 bp, Homo sapiens
atttatgtaatgaagtaaagc

SEQ ID NO: 4341611 - DNA, 13 bp, Homo sapiens
atttatttctctg

SEQ ID NO: 4341612 - DNA, 15 bp, Homo sapiens
atttcaattctcaaa

SEQ ID NO: 4341613 - DNA, 16 bp, Homo sapiens
atttcacagttctgta

SEQ ID NO: 4341614 - DNA, 13 bp, Homo sapiens
atttcagatttta

SEQ ID NO: 4341615 - DNA, 14 bp, Homo sapiens
atttcagtagaatt

SEQ ID NO: 4341616 - DNA, 22 bp, Homo sapiens
atttcagtagaattttagtcct

SEQ ID NO: 4341617 - DNA, 13 bp, Homo sapiens
atttcagtatttt

SEQ ID NO: 4341618 - DNA, 15 bp, Homo sapiens
atttcagtattttcc

SEQ ID NO: 4341619 - DNA, 17 bp, Homo sapiens
atttcagtattttccag

SEQ ID NO: 4341620 - DNA, 18 bp, Homo sapiens
atttcagtattttccagc

SEQ ID NO: 4341621 - DNA, 12 bp, Homo sapiens
atttcattccat

SEQ ID NO: 4341622 - DNA, 13 bp, Homo sapiens
atttcattccatt

SEQ ID NO: 4341623 - DNA, 13 bp, Homo sapiens
atttccctttttt

SEQ ID NO: 4341624 - DNA, 22 bp, Homo sapiens
atttctgatgttccagcttcta

SEQ ID NO: 4341625 - DNA, 15 bp, Homo sapiens
atttctggaagaaag

SEQ ID NO: 4341626 - DNA, 23 bp, Homo sapiens
atttcttagtgcttcagagtttg

SEQ ID NO: 4341627 - DNA, 17 bp, Homo sapiens
atttcttgtgatgtatt

SEQ ID NO: 4341628 - DNA, 22 bp, Homo sapiens
atttctttgtagaataaatggt

SEQ ID NO: 4341629 - DNA, 17 bp, Homo sapiens
atttctttttggtaaat

SEQ ID NO: 4341630 - DNA, 19 bp, Homo sapiens
atttgaataataaatcgat

SEQ ID NO: 4341631 - DNA, 19 bp, Homo sapiens
atttgacgttgttgtcatt

SEQ ID NO: 4341632 - DNA, 17 bp, Homo sapiens
atttgaggactgaagct

SEQ ID NO: 4341633 - DNA, 21 bp, Homo sapiens
atttgaggtctacattcttgg

SEQ ID NO: 4341634 - DNA, 17 bp, Homo sapiens
atttgatctttgtttaa

SEQ ID NO: 4341635 - DNA, 15 bp, Homo sapiens
atttgctactgtaca

SEQ ID NO: 4341636 - DNA, 16 bp, Homo sapiens
atttgctactgtacat

SEQ ID NO: 4341637 - DNA, 14 bp, Homo sapiens
atttgctgtgacta

SEQ ID NO: 4341638 - DNA, 11 bp, Homo sapiens
atttgctgttg

SEQ ID NO: 4341639 - DNA, 21 bp, Homo sapiens
atttgctgttgtttctataaa

SEQ ID NO: 4341640 - DNA, 10 bp, Homo sapiens
atttggaaaa

SEQ ID NO: 4341641 - DNA, 21 bp, Homo sapiens
atttggagcattaactaaatg

SEQ ID NO: 4341642 - DNA, 14 bp, Homo sapiens
atttggcaaaacaa

SEQ ID NO: 4341643 - DNA, 17 bp, Homo sapiens
atttggcaaaacaaaat

SEQ ID NO: 4341644 - DNA, 20 bp, Homo sapiens
atttggcaaaacaaaatgta

SEQ ID NO: 4341645 - DNA, 14 bp, Homo sapiens
atttggttaaatca

SEQ ID NO: 4341646 - DNA, 19 bp, Homo sapiens
atttgtattaataaagcat

SEQ ID NO: 4341647 - DNA, 21 bp, Homo sapiens
atttgttagccacggaaacat

SEQ ID NO: 4341648 - DNA, 14 bp, Homo sapiens
attttaaaaagggt

SEQ ID NO: 4341649 - DNA, 21 bp, Homo sapiens
attttaaagacccaacttgcc

SEQ ID NO: 4341650 - DNA, 11 bp, Homo sapiens
attttaagtgc

SEQ ID NO: 4341651 - DNA, 22 bp, Homo sapiens
attttagggtgggtaagaaagc

SEQ ID NO: 4341652 - DNA, 19 bp, Homo sapiens
attttattacagaaatgtt

SEQ ID NO: 4341653 - DNA, 12 bp, Homo sapiens
attttcattgtg

SEQ ID NO: 4341654 - DNA, 21 bp, Homo sapiens
attttccagccttatgtgtta

SEQ ID NO: 4341655 - DNA, 22 bp, Homo sapiens
attttccagccttatgtgttac

SEQ ID NO: 4341656 - DNA, 23 bp, Homo sapiens
attttccccgtgacattcactgg

SEQ ID NO: 4341657 - DNA, 16 bp, Homo sapiens
attttcctgccaggca

SEQ ID NO: 4341658 - DNA, 16 bp, Homo sapiens
attttctgtgtaaaat

SEQ ID NO: 4341659 - DNA, 22 bp, Homo sapiens
attttgaggtagaggaaaatca

SEQ ID NO: 4341660 - DNA, 18 bp, Homo sapiens
attttgagtggcaaaata

SEQ ID NO: 4341661 - DNA, 21 bp, Homo sapiens
attttgttttaatctactttt

SEQ ID NO: 4341662 - DNA, 12 bp, Homo sapiens
atttttaaagaa

SEQ ID NO: 4341663 - DNA, 21 bp, Homo sapiens
atttttcttcaggtaacacta

SEQ ID NO: 4341664 - DNA, 14 bp, Homo sapiens
atttttttaaacaa

SEQ ID NO: 4341665 - DNA, 22 bp, Homo sapiens
atttttttctttttaaaataga

SEQ ID NO: 4341666 - DNA, 19 bp, Homo sapiens
attttttttaaatcaaaaa

SEQ ID NO: 4341667 - DNA, 22 bp, Homo sapiens
attttttttttttggtaattat

SEQ ID NO: 4341668 - DNA, 13 bp, Homo sapiens
caaaaactgactt

SEQ ID NO: 4341669 - DNA, 20 bp, Homo sapiens
caaaaactgactttatttat

SEQ ID NO: 4341670 - DNA, 17 bp, Homo sapiens
caaaaagaccttctccc

SEQ ID NO: 4341671 - DNA, 22 bp, Homo sapiens
caaaaagctcttacactacatt

SEQ ID NO: 4341672 - DNA, 21 bp, Homo sapiens
caaaacggttttactgcagct

SEQ ID NO: 4341673 - DNA, 19 bp, Homo sapiens
caaaactgctttgtgcata

SEQ ID NO: 4341674 - DNA, 18 bp, Homo sapiens
caaaagatgcttctcact

SEQ ID NO: 4341675 - DNA, 15 bp, Homo sapiens
caaaagggagaacat

SEQ ID NO: 4341676 - DNA, 23 bp, Homo sapiens
caaaagggagaacatggccaata

SEQ ID NO: 4341677 - DNA, 15 bp, Homo sapiens
caaaagttttcctga

SEQ ID NO: 4341678 - DNA, 20 bp, Homo sapiens
caaaataaagaatagcaatt

SEQ ID NO: 4341679 - DNA, 19 bp, Homo sapiens
caaaataatctatattaaa

SEQ ID NO: 4341680 - DNA, 21 bp, Homo sapiens
caaaataatctatattaaatg

SEQ ID NO: 4341681 - DNA, 14 bp, Homo sapiens
caaaatagaagaag

SEQ ID NO: 4341682 - DNA, 16 bp, Homo sapiens
caaaatagaagaagag

SEQ ID NO: 4341683 - DNA, 17 bp, Homo sapiens
caaaatagaagaagagg

SEQ ID NO: 4341684 - DNA, 18 bp, Homo sapiens
caaaatgtaatgtcagac

SEQ ID NO: 4341685 - DNA, 16 bp, Homo sapiens
caaaatgtacttaaat

SEQ ID NO: 4341686 - DNA, 19 bp, Homo sapiens
caaaatgtacttaaatgag

SEQ ID NO: 4341687 - DNA, 13 bp, Homo sapiens
caaaattgtttac

SEQ ID NO: 4341688 - DNA, 14 bp, Homo sapiens
caaaatttcacagt

SEQ ID NO: 4341689 - DNA, 13 bp, Homo sapiens
caaacatgtattt

SEQ ID NO: 4341690 - DNA, 14 bp, Homo sapiens
caaacatgtattta

SEQ ID NO: 4341691 - DNA, 16 bp, Homo sapiens
caaacatgtatttatg

SEQ ID NO: 4341692 - DNA, 20 bp, Homo sapiens
caaaccctccacttctcccc

SEQ ID NO: 4341693 - DNA, 19 bp, Homo sapiens
caaactctataaagaaact

SEQ ID NO: 4341694 - DNA, 17 bp, Homo sapiens
caaactgactcaacagt

SEQ ID NO: 4341695 - DNA, 14 bp, Homo sapiens
caaactgctttatt

SEQ ID NO: 4341696 - DNA, 15 bp, Homo sapiens
caaactgctttattt

SEQ ID NO: 4341697 - DNA, 22 bp, Homo sapiens
caaagataagacttgtttcttt

SEQ ID NO: 4341698 - DNA, 18 bp, Homo sapiens
caaagcaattaaatgata

SEQ ID NO: 4341699 - DNA, 21 bp, Homo sapiens
caaagctgatttccctttttt

SEQ ID NO: 4341700 - DNA, 13 bp, Homo sapiens
caaagctggccca

SEQ ID NO: 4341701 - DNA, 15 bp, Homo sapiens
caaagcttgtggagg

SEQ ID NO: 4341702 - DNA, 18 bp, Homo sapiens
caaaggaaaaagcacaag

SEQ ID NO: 4341703 - DNA, 17 bp, Homo sapiens
caaaggtggattacaag

SEQ ID NO: 4341704 - DNA, 17 bp, Homo sapiens
caaataaagccttttaa

SEQ ID NO: 4341705 - DNA, 18 bp, Homo sapiens
caaatataaccatttaaa

SEQ ID NO: 4341706 - DNA, 12 bp, Homo sapiens
caaatatatgta

SEQ ID NO: 4341707 - DNA, 14 bp, Homo sapiens
caaatattacaaca

SEQ ID NO: 4341708 - DNA, 15 bp, Homo sapiens
caaatattacaacaa

SEQ ID NO: 4341709 - DNA, 14 bp, Homo sapiens
caaatcaaggatct

SEQ ID NO: 4341710 - DNA, 16 bp, Homo sapiens
caaatcattatgtttc

SEQ ID NO: 4341711 - DNA, 19 bp, Homo sapiens
caaatgaatttcatgtgaa

SEQ ID NO: 4341712 - DNA, 22 bp, Homo sapiens
caaatggcattgggctgagtaa

SEQ ID NO: 4341713 - DNA, 20 bp, Homo sapiens
caaatgtttacagggagcct

SEQ ID NO: 4341714 - DNA, 22 bp, Homo sapiens
caaatgtttacagggagcctcc

SEQ ID NO: 4341715 - DNA, 15 bp, Homo sapiens
caaattagggcaatt

SEQ ID NO: 4341716 - DNA, 23 bp, Homo sapiens
caaattccgattagacctttatc

SEQ ID NO: 4341717 - DNA, 15 bp, Homo sapiens
caaattctactttaa

SEQ ID NO: 4341718 - DNA, 21 bp, Homo sapiens
caaattgtgcttctccccaga

SEQ ID NO: 4341719 - DNA, 22 bp, Homo sapiens
caaattgtgcttctccccagaa

SEQ ID NO: 4341720 - DNA, 14 bp, Homo sapiens
caaatttaattaaa

SEQ ID NO: 4341721 - DNA, 20 bp, Homo sapiens
caaatttcattatctaatga

SEQ ID NO: 4341722 - DNA, 16 bp, Homo sapiens
caacaaatgtgggtga

SEQ ID NO: 4341723 - DNA, 15 bp, Homo sapiens
caacaaggtatacct

SEQ ID NO: 4341724 - DNA, 17 bp, Homo sapiens
caacaaggtatacctca

SEQ ID NO: 4341725 - DNA, 17 bp, Homo sapiens
caacaccagcccctgcc

SEQ ID NO: 4341726 - DNA, 20 bp, Homo sapiens
caacacctctgcacaagctg

SEQ ID NO: 4341727 - DNA, 17 bp, Homo sapiens
caacatgaatttttatg

SEQ ID NO: 4341728 - DNA, 14 bp, Homo sapiens
caaccccagccgct

SEQ ID NO: 4341729 - DNA, 16 bp, Homo sapiens
caactggggaaaagga

SEQ ID NO: 4341730 - DNA, 19 bp, Homo sapiens
caactggggaaaaggatga

SEQ ID NO: 4341731 - DNA, 16 bp, Homo sapiens
caactgtgttcattag

SEQ ID NO: 4341732 - DNA, 16 bp, Homo sapiens
caacttgccaaaatgt

SEQ ID NO: 4341733 - DNA, 13 bp, Homo sapiens
caactttgcaaat

SEQ ID NO: 4341734 - DNA, 12 bp, Homo sapiens
caagaaggaaga

SEQ ID NO: 4341735 - DNA, 12 bp, Homo sapiens
caagaatttctg

SEQ ID NO: 4341736 - DNA, 17 bp, Homo sapiens
caagaatttctggaaga

SEQ ID NO: 4341737 - DNA, 18 bp, Homo sapiens
caagaatttctggaagaa

SEQ ID NO: 4341738 - DNA, 13 bp, Homo sapiens
caagagcaggagg

SEQ ID NO: 4341739 - DNA, 17 bp, Homo sapiens
caagagcaggaggtgcc

SEQ ID NO: 4341740 - DNA, 14 bp, Homo sapiens
caagagggactgta

SEQ ID NO: 4341741 - DNA, 19 bp, Homo sapiens
caagagggactgtatttct

SEQ ID NO: 4341742 - DNA, 20 bp, Homo sapiens
caagagggactgtatttctg

SEQ ID NO: 4341743 - DNA, 21 bp, Homo sapiens
caagagggactgtatttctgt

SEQ ID NO: 4341744 - DNA, 23 bp, Homo sapiens
caagagggactgtatttctgtgg

SEQ ID NO: 4341745 - DNA, 19 bp, Homo sapiens
caagaggtttttctccccg

SEQ ID NO: 4341746 - DNA, 14 bp, Homo sapiens
caagatggagagga

SEQ ID NO: 4341747 - DNA, 18 bp, Homo sapiens
caagatggagaggaagaa

SEQ ID NO: 4341748 - DNA, 16 bp, Homo sapiens
caagcaggaagttcaa

SEQ ID NO: 4341749 - DNA, 16 bp, Homo sapiens
caagccttactcacct

SEQ ID NO: 4341750 - DNA, 15 bp, Homo sapiens
caagctagactgtgt

SEQ ID NO: 4341751 - DNA, 15 bp, Homo sapiens
caagctaggaaagag

SEQ ID NO: 4341752 - DNA, 17 bp, Homo sapiens
caagctaggaaagagga

SEQ ID NO: 4341753 - DNA, 17 bp, Homo sapiens
caagctctagtgggaag

SEQ ID NO: 4341754 - DNA, 13 bp, Homo sapiens
caagctgcaccct

SEQ ID NO: 4341755 - DNA, 15 bp, Homo sapiens
caaggaggtggctgt

SEQ ID NO: 4341756 - DNA, 16 bp, Homo sapiens
caaggatatactgcag

SEQ ID NO: 4341757 - DNA, 14 bp, Homo sapiens
caaggattgaaaat

SEQ ID NO: 4341758 - DNA, 18 bp, Homo sapiens
caaggccagaaaaagaag

SEQ ID NO: 4341759 - DNA, 23 bp, Homo sapiens
caaggccagaaaaagaagaagga

SEQ ID NO: 4341760 - DNA, 21 bp, Homo sapiens
caaggccggagacccacagcc

SEQ ID NO: 4341761 - DNA, 17 bp, Homo sapiens
caaggctgcagtgagcc

SEQ ID NO: 4341762 - DNA, 18 bp, Homo sapiens
caaggctgggggaagaag

SEQ ID NO: 4341763 - DNA, 22 bp, Homo sapiens
caagggcatcatcctcagcagc

SEQ ID NO: 4341764 - DNA, 23 bp, Homo sapiens
caagggcatcatcctcagcagca

SEQ ID NO: 4341765 - DNA, 23 bp, Homo sapiens
caaggtgggaggattgcttgagc

SEQ ID NO: 4341766 - DNA, 20 bp, Homo sapiens
caagtaaggcttttaatttt

SEQ ID NO: 4341767 - DNA, 15 bp, Homo sapiens
caagtagcctctggg

SEQ ID NO: 4341768 - DNA, 21 bp, Homo sapiens
caagtatgaagtataaatctg

SEQ ID NO: 4341769 - DNA, 13 bp, Homo sapiens
caagtcaagtgaa

SEQ ID NO: 4341770 - DNA, 17 bp, Homo sapiens
caagtcaagtgaaaaag

SEQ ID NO: 4341771 - DNA, 15 bp, Homo sapiens
caagtccaaatgttt

SEQ ID NO: 4341772 - DNA, 17 bp, Homo sapiens
caagtgaacttgggagg

SEQ ID NO: 4341773 - DNA, 14 bp, Homo sapiens
caagtgagaccctg

SEQ ID NO: 4341774 - DNA, 15 bp, Homo sapiens
caagtgagaccctgt

SEQ ID NO: 4341775 - DNA, 19 bp, Homo sapiens
caagtgagaccctgtctca

SEQ ID NO: 4341776 - DNA, 19 bp, Homo sapiens
caagtgtcacctccttccc

SEQ ID NO: 4341777 - DNA, 20 bp, Homo sapiens
caagtgtcacctccttcccc

SEQ ID NO: 4341778 - DNA, 21 bp, Homo sapiens
caagtgtcacctccttcccca

SEQ ID NO: 4341779 - DNA, 22 bp, Homo sapiens
caagtgtcacctccttccccag

SEQ ID NO: 4341780 - DNA, 22 bp, Homo sapiens
caagtgtggtagagtgtgcctg

SEQ ID NO: 4341781 - DNA, 11 bp, Homo sapiens
caatagaaagc

SEQ ID NO: 4341782 - DNA, 15 bp, Homo sapiens
caatagaaagcaaac

SEQ ID NO: 4341783 - DNA, 23 bp, Homo sapiens
caatatgacacagcttgtgaatg

SEQ ID NO: 4341784 - DNA, 12 bp, Homo sapiens
caatatgcttac

SEQ ID NO: 4341785 - DNA, 16 bp, Homo sapiens
caatattgcctgtgct

SEQ ID NO: 4341786 - DNA, 21 bp, Homo sapiens
caatatttctgctttctttga

SEQ ID NO: 4341787 - DNA, 19 bp, Homo sapiens
caatcattgttttgaatat

SEQ ID NO: 4341788 - DNA, 22 bp, Homo sapiens
caatcattttggaggctttgtt

SEQ ID NO: 4341789 - DNA, 16 bp, Homo sapiens
caatccatgcttcact

SEQ ID NO: 4341790 - DNA, 18 bp, Homo sapiens
caatcgacatcctagccc

SEQ ID NO: 4341791 - DNA, 23 bp, Homo sapiens
caatcgacatcctagccccaccc

SEQ ID NO: 4341792 - DNA, 13 bp, Homo sapiens
caatggagaaatg

SEQ ID NO: 4341793 - DNA, 16 bp, Homo sapiens
caatggagaaatgaag

SEQ ID NO: 4341794 - DNA, 18 bp, Homo sapiens
caatggagaaatgaagca

SEQ ID NO: 4341795 - DNA, 15 bp, Homo sapiens
caatgtgataaaacc

SEQ ID NO: 4341796 - DNA, 17 bp, Homo sapiens
caatgtgataaaacccc

SEQ ID NO: 4341797 - DNA, 15 bp, Homo sapiens
caattaattaaaagt

SEQ ID NO: 4341798 - DNA, 14 bp, Homo sapiens
caattattgatata

SEQ ID NO: 4341799 - DNA, 18 bp, Homo sapiens
caattattgatatatatt

SEQ ID NO: 4341800 - DNA, 22 bp, Homo sapiens
caattattgatatatattataa

SEQ ID NO: 4341801 - DNA, 18 bp, Homo sapiens
caattctgaaatactttt

SEQ ID NO: 4341802 - DNA, 15 bp, Homo sapiens
caatttactggccac

SEQ ID NO: 4341803 - DNA, 23 bp, Homo sapiens
caatttgcataatactaatttat

SEQ ID NO: 4341804 - DNA, 11 bp, Homo sapiens
caatttttcca

SEQ ID NO: 4341805 - DNA, 11 bp, Homo sapiens
cacaaagaaac

SEQ ID NO: 4341806 - DNA, 12 bp, Homo sapiens
cacaaagaaaca

SEQ ID NO: 4341807 - DNA, 17 bp, Homo sapiens
cacaaagagaccagggg

SEQ ID NO: 4341808 - DNA, 18 bp, Homo sapiens
cacaactttgcaaattat

SEQ ID NO: 4341809 - DNA, 22 bp, Homo sapiens
cacaagagggactgtatttctg

SEQ ID NO: 4341810 - DNA, 18 bp, Homo sapiens
cacaagccttactcacct

SEQ ID NO: 4341811 - DNA, 19 bp, Homo sapiens
cacaagccttactcacctc

SEQ ID NO: 4341812 - DNA, 18 bp, Homo sapiens
cacaagtagcctctggga

SEQ ID NO: 4341813 - DNA, 17 bp, Homo sapiens
cacacaggagtcctttc

SEQ ID NO: 4341814 - DNA, 18 bp, Homo sapiens
cacacaggagtcctttct

SEQ ID NO: 4341815 - DNA, 19 bp, Homo sapiens
cacacaggagtcctttctt

SEQ ID NO: 4341816 - DNA, 21 bp, Homo sapiens
cacacaggagtcctttctttt

SEQ ID NO: 4341817 - DNA, 15 bp, Homo sapiens
cacacctccccctgc

SEQ ID NO: 4341818 - DNA, 17 bp, Homo sapiens
cacacggagctcctggc

SEQ ID NO: 4341819 - DNA, 19 bp, Homo sapiens
cacacggagctcctggcag

SEQ ID NO: 4341820 - DNA, 21 bp, Homo sapiens
cacacgtccactcccaagcca

SEQ ID NO: 4341821 - DNA, 12 bp, Homo sapiens
cacagaagggga

SEQ ID NO: 4341822 - DNA, 22 bp, Homo sapiens
cacagaccaagtccaagcccgt

SEQ ID NO: 4341823 - DNA, 13 bp, Homo sapiens
cacagatgtgaag

SEQ ID NO: 4341824 - DNA, 22 bp, Homo sapiens
cacagccctgaaacgagaagtg

SEQ ID NO: 4341825 - DNA, 14 bp, Homo sapiens
cacaggcagctctg

SEQ ID NO: 4341826 - DNA, 19 bp, Homo sapiens
cacaggcagctctgagccg

SEQ ID NO: 4341827 - DNA, 11 bp, Homo sapiens
cacaggcctcc

SEQ ID NO: 4341828 - DNA, 16 bp, Homo sapiens
cacagggaaatgtgta

SEQ ID NO: 4341829 - DNA, 23 bp, Homo sapiens
cacagtggtactctgtgtctggc

SEQ ID NO: 4341830 - DNA, 22 bp, Homo sapiens
cacagttaaataaatagaaaga

SEQ ID NO: 4341831 - DNA, 18 bp, Homo sapiens
cacataaatgaaagaaac

SEQ ID NO: 4341832 - DNA, 19 bp, Homo sapiens
cacataggctggtggcctt

SEQ ID NO: 4341833 - DNA, 20 bp, Homo sapiens
cacataggctggtggccttg

SEQ ID NO: 4341834 - DNA, 16 bp, Homo sapiens
cacatagtttcttttt

SEQ ID NO: 4341835 - DNA, 14 bp, Homo sapiens
cacatataaaaaca

SEQ ID NO: 4341836 - DNA, 16 bp, Homo sapiens
cacatgctgagtctcc

SEQ ID NO: 4341837 - DNA, 17 bp, Homo sapiens
cacatgtccttgtgtgt

SEQ ID NO: 4341838 - DNA, 20 bp, Homo sapiens
cacatgtgctgatgtttaca

SEQ ID NO: 4341839 - DNA, 21 bp, Homo sapiens
cacatgtgctgatgtttacaa

SEQ ID NO: 4341840 - DNA, 12 bp, Homo sapiens
cacatttcctct

SEQ ID NO: 4341841 - DNA, 20 bp, Homo sapiens
cacatttgtatgtgtgtaga

SEQ ID NO: 4341842 - DNA, 12 bp, Homo sapiens
caccagcagcct

SEQ ID NO: 4341843 - DNA, 14 bp, Homo sapiens
caccagcagcctgg

SEQ ID NO: 4341844 - DNA, 19 bp, Homo sapiens
caccagcccctgccccagc

SEQ ID NO: 4341845 - DNA, 14 bp, Homo sapiens
cacccacaaagaaa

SEQ ID NO: 4341846 - DNA, 20 bp, Homo sapiens
cacccaccatagggcatgat

SEQ ID NO: 4341847 - DNA, 11 bp, Homo sapiens
caccccagagt

SEQ ID NO: 4341848 - DNA, 13 bp, Homo sapiens
caccccagagttg

SEQ ID NO: 4341849 - DNA, 23 bp, Homo sapiens
caccccagagttgggatgcgggg

SEQ ID NO: 4341850 - DNA, 12 bp, Homo sapiens
caccccagcccc

SEQ ID NO: 4341851 - DNA, 20 bp, Homo sapiens
cacccgacctctgactgatg

SEQ ID NO: 4341852 - DNA, 18 bp, Homo sapiens
cacccgccccgccccctc

SEQ ID NO: 4341853 - DNA, 22 bp, Homo sapiens
caccctgggcagtgagtgccat

SEQ ID NO: 4341854 - DNA, 18 bp, Homo sapiens
caccgaatatattactga

SEQ ID NO: 4341855 - DNA, 21 bp, Homo sapiens
caccgaggagccccagccccg

SEQ ID NO: 4341856 - DNA, 14 bp, Homo sapiens
caccgctggctccg

SEQ ID NO: 4341857 - DNA, 15 bp, Homo sapiens
cacctccttccccag

SEQ ID NO: 4341858 - DNA, 18 bp, Homo sapiens
cacctccttccccagctc

SEQ ID NO: 4341859 - DNA, 19 bp, Homo sapiens
cacctccttccccagctcc

SEQ ID NO: 4341860 - DNA, 18 bp, Homo sapiens
cacctctgcacaagctgc

SEQ ID NO: 4341861 - DNA, 13 bp, Homo sapiens
cacctctgccact

SEQ ID NO: 4341862 - DNA, 14 bp, Homo sapiens
cacctctgccactc

SEQ ID NO: 4341863 - DNA, 13 bp, Homo sapiens
cacctgagcctgt

SEQ ID NO: 4341864 - DNA, 14 bp, Homo sapiens
cacctgctcttcta

SEQ ID NO: 4341865 - DNA, 15 bp, Homo sapiens
caccttcccttcctc

SEQ ID NO: 4341866 - DNA, 16 bp, Homo sapiens
caccttcccttcctca

SEQ ID NO: 4341867 - DNA, 19 bp, Homo sapiens
caccttcccttcctcagca

SEQ ID NO: 4341868 - DNA, 18 bp, Homo sapiens
caccttttgtcaacggca

SEQ ID NO: 4341869 - DNA, 17 bp, Homo sapiens
cacgactgcccggcagg

SEQ ID NO: 4341870 - DNA, 21 bp, Homo sapiens
cacgcctctccctaggagaag

SEQ ID NO: 4341871 - DNA, 20 bp, Homo sapiens
cacgcctgtaatcctagcac

SEQ ID NO: 4341872 - DNA, 16 bp, Homo sapiens
cacgctccccgcctgt

SEQ ID NO: 4341873 - DNA, 21 bp, Homo sapiens
cacgctccccgcctgttcccc

SEQ ID NO: 4341874 - DNA, 15 bp, Homo sapiens
cacggagctcctggc

SEQ ID NO: 4341875 - DNA, 17 bp, Homo sapiens
cacggagctcctggcag

SEQ ID NO: 4341876 - DNA, 22 bp, Homo sapiens
cacggagctcctggcagcgaga

SEQ ID NO: 4341877 - DNA, 22 bp, Homo sapiens
cacggttgctaaattataaaat

SEQ ID NO: 4341878 - DNA, 23 bp, Homo sapiens
cacgtgccattgtctttcctccc

SEQ ID NO: 4341879 - DNA, 14 bp, Homo sapiens
cacgtggccaggag

SEQ ID NO: 4341880 - DNA, 16 bp, Homo sapiens
cactaacaaaatttga

SEQ ID NO: 4341881 - DNA, 13 bp, Homo sapiens
cactactgggtgt

SEQ ID NO: 4341882 - DNA, 15 bp, Homo sapiens
cactactgggtgtca

SEQ ID NO: 4341883 - DNA, 22 bp, Homo sapiens
cactactgggtgtcatttcatt

SEQ ID NO: 4341884 - DNA, 16 bp, Homo sapiens
cactagagaatgcaca

SEQ ID NO: 4341885 - DNA, 13 bp, Homo sapiens
cactaggaattct

SEQ ID NO: 4341886 - DNA, 23 bp, Homo sapiens
cactaggtgaacagcaggatgcc

SEQ ID NO: 4341887 - DNA, 17 bp, Homo sapiens
cactagtaagtaattat

SEQ ID NO: 4341888 - DNA, 23 bp, Homo sapiens
cactatactctaaaatggacatt

SEQ ID NO: 4341889 - DNA, 13 bp, Homo sapiens
cactccagcctgg

SEQ ID NO: 4341890 - DNA, 21 bp, Homo sapiens
cactcgcctactaagtaccct

SEQ ID NO: 4341891 - DNA, 19 bp, Homo sapiens
cactgaagaaaccttcaga

SEQ ID NO: 4341892 - DNA, 21 bp, Homo sapiens
cactggcatcgcagcttcctg

SEQ ID NO: 4341893 - DNA, 22 bp, Homo sapiens
cactggcatcgcagcttcctgt

SEQ ID NO: 4341894 - DNA, 22 bp, Homo sapiens
cactgtctgcgtgactattttt

SEQ ID NO: 4341895 - DNA, 13 bp, Homo sapiens
cactgtgaagaga

SEQ ID NO: 4341896 - DNA, 12 bp, Homo sapiens
cactgttgcaaa

SEQ ID NO: 4341897 - DNA, 19 bp, Homo sapiens
cactgttttataattagtc

SEQ ID NO: 4341898 - DNA, 17 bp, Homo sapiens
cacttacctgcttgagc

SEQ ID NO: 4341899 - DNA, 16 bp, Homo sapiens
cacttattgtaaattt

SEQ ID NO: 4341900 - DNA, 20 bp, Homo sapiens
cacttcaggagccctactga

SEQ ID NO: 4341901 - DNA, 23 bp, Homo sapiens
cacttcgggaggtcgaggcagga

SEQ ID NO: 4341902 - DNA, 12 bp, Homo sapiens
cactttgggagg

SEQ ID NO: 4341903 - DNA, 13 bp, Homo sapiens
cactttgggaggc

SEQ ID NO: 4341904 - DNA, 16 bp, Homo sapiens
cactttgggaggccaa

SEQ ID NO: 4341905 - DNA, 14 bp, Homo sapiens
cacttttattttca

SEQ ID NO: 4341906 - DNA, 18 bp, Homo sapiens
cagaaaaaaataactatt

SEQ ID NO: 4341907 - DNA, 19 bp, Homo sapiens
cagaaaaaaataactattt

SEQ ID NO: 4341908 - DNA, 13 bp, Homo sapiens
cagaaaaagaaga

SEQ ID NO: 4341909 - DNA, 15 bp, Homo sapiens
cagaaaaagaagaag

SEQ ID NO: 4341910 - DNA, 9 bp, Homo sapiens
cagaaagat

SEQ ID NO: 4341911 - DNA, 21 bp, Homo sapiens
cagaaagatttggaaaattca

SEQ ID NO: 4341912 - DNA, 17 bp, Homo sapiens
cagaaattattggtata

SEQ ID NO: 4341913 - DNA, 17 bp, Homo sapiens
cagaacgtatttagcca

SEQ ID NO: 4341914 - DNA, 19 bp, Homo sapiens
cagaacgtatttagccatt

SEQ ID NO: 4341915 - DNA, 14 bp, Homo sapiens
cagaagacactaat

SEQ ID NO: 4341916 - DNA, 15 bp, Homo sapiens
cagaagacactaatt

SEQ ID NO: 4341917 - DNA, 17 bp, Homo sapiens
cagaaggggatgggaaa

SEQ ID NO: 4341918 - DNA, 22 bp, Homo sapiens
cagaagtttgagatcagcctgg

SEQ ID NO: 4341919 - DNA, 23 bp, Homo sapiens
cagaagtttgagatcagcctggg

SEQ ID NO: 4341920 - DNA, 19 bp, Homo sapiens
cagaatggaatccatctgt

SEQ ID NO: 4341921 - DNA, 12 bp, Homo sapiens
cagacagggaga

SEQ ID NO: 4341922 - DNA, 16 bp, Homo sapiens
cagacagggagaagtt

SEQ ID NO: 4341923 - DNA, 20 bp, Homo sapiens
cagaccacaaaacttttcta

SEQ ID NO: 4341924 - DNA, 19 bp, Homo sapiens
cagaggaaaaacagaggat

SEQ ID NO: 4341925 - DNA, 24 bp, Homo sapiens
cagaggaaaaacagaggatgctga

SEQ ID NO: 4341926 - DNA, 22 bp, Homo sapiens
cagaggaaggaaacatagaaag

SEQ ID NO: 4341927 - DNA, 20 bp, Homo sapiens
cagaggccgctgcccctgag

SEQ ID NO: 4341928 - DNA, 23 bp, Homo sapiens
cagaggccgctgcccctgagttc

SEQ ID NO: 4341929 - DNA, 21 bp, Homo sapiens
cagaggtcatcccttcctcct

SEQ ID NO: 4341930 - DNA, 20 bp, Homo sapiens
cagaggtggccctcccaggc

SEQ ID NO: 4341931 - DNA, 23 bp, Homo sapiens
cagaggtggccctcccaggctgg

SEQ ID NO: 4341932 - DNA, 22 bp, Homo sapiens
cagagtcagccattcctgttct

SEQ ID NO: 4341933 - DNA, 16 bp, Homo sapiens
cagagttgggatgcgg

SEQ ID NO: 4341934 - DNA, 22 bp, Homo sapiens
cagagttgggatgcggggcaga

SEQ ID NO: 4341935 - DNA, 21 bp, Homo sapiens
cagagttgttgtttgccaagc

SEQ ID NO: 4341936 - DNA, 13 bp, Homo sapiens
cagagtttgtgtg

SEQ ID NO: 4341937 - DNA, 15 bp, Homo sapiens
cagatatactttgtg

SEQ ID NO: 4341938 - DNA, 12 bp, Homo sapiens
cagatcctggaa

SEQ ID NO: 4341939 - DNA, 15 bp, Homo sapiens
cagatctcgggactc

SEQ ID NO: 4341940 - DNA, 21 bp, Homo sapiens
cagatgctgaattgagaataa

SEQ ID NO: 4341941 - DNA, 18 bp, Homo sapiens
cagatggagcaaatgtcc

SEQ ID NO: 4341942 - DNA, 16 bp, Homo sapiens
cagatgtttaatgaag

SEQ ID NO: 4341943 - DNA, 15 bp, Homo sapiens
cagatttgaggactg

SEQ ID NO: 4341944 - DNA, 21 bp, Homo sapiens
cagcaatattgcctgtgcttc

SEQ ID NO: 4341945 - DNA, 22 bp, Homo sapiens
cagcaatattgcctgtgcttct

SEQ ID NO: 4341946 - DNA, 15 bp, Homo sapiens
cagcacatttcctct

SEQ ID NO: 4341947 - DNA, 19 bp, Homo sapiens
cagcacctattgaattacc

SEQ ID NO: 4341948 - DNA, 20 bp, Homo sapiens
cagcactactgggtgtcatt

SEQ ID NO: 4341949 - DNA, 15 bp, Homo sapiens
cagcagaaccttggc

SEQ ID NO: 4341950 - DNA, 16 bp, Homo sapiens
cagcagatgtttaatg

SEQ ID NO: 4341951 - DNA, 18 bp, Homo sapiens
cagcagcctggaccctgt

SEQ ID NO: 4341952 - DNA, 14 bp, Homo sapiens
cagcaggatgccct

SEQ ID NO: 4341953 - DNA, 15 bp, Homo sapiens
cagcagttctctgcc

SEQ ID NO: 4341954 - DNA, 21 bp, Homo sapiens
cagccaaagcctcctccagcc

SEQ ID NO: 4341955 - DNA, 20 bp, Homo sapiens
cagccattcctgttctcttt

SEQ ID NO: 4341956 - DNA, 15 bp, Homo sapiens
cagcccacccctcaa

SEQ ID NO: 4341957 - DNA, 18 bp, Homo sapiens
cagccccaatccagagaa

SEQ ID NO: 4341958 - DNA, 13 bp, Homo sapiens
cagcccccacagc

SEQ ID NO: 4341959 - DNA, 14 bp, Homo sapiens
cagcccccacagcc

SEQ ID NO: 4341960 - DNA, 11 bp, Homo sapiens
cagcccctgcc

SEQ ID NO: 4341961 - DNA, 16 bp, Homo sapiens
cagccctctgtggcca

SEQ ID NO: 4341962 - DNA, 19 bp, Homo sapiens
cagccctctgtggccagga

SEQ ID NO: 4341963 - DNA, 22 bp, Homo sapiens
cagcccttcctccctgtctctg

SEQ ID NO: 4341964 - DNA, 23 bp, Homo sapiens
cagccgccatgctcctggcccac

SEQ ID NO: 4341965 - DNA, 23 bp, Homo sapiens
cagccgctcggaggccccaaagg

SEQ ID NO: 4341966 - DNA, 21 bp, Homo sapiens
cagccgtgtaaccatggaccc

SEQ ID NO: 4341967 - DNA, 17 bp, Homo sapiens
cagccgtgtgtgcatgt

SEQ ID NO: 4341968 - DNA, 13 bp, Homo sapiens
cagcctggacccc

SEQ ID NO: 4341969 - DNA, 16 bp, Homo sapiens
cagcctggacccccag

SEQ ID NO: 4341970 - DNA, 18 bp, Homo sapiens
cagcctggacccccagct

SEQ ID NO: 4341971 - DNA, 15 bp, Homo sapiens
cagcctggaccctgt

SEQ ID NO: 4341972 - DNA, 16 bp, Homo sapiens
cagcctgggcaatgtg

SEQ ID NO: 4341973 - DNA, 15 bp, Homo sapiens
cagccttatgtgtta

SEQ ID NO: 4341974 - DNA, 21 bp, Homo sapiens
cagcctttttctggccttgac

SEQ ID NO: 4341975 - DNA, 20 bp, Homo sapiens
cagcggggcctggcgggatg

SEQ ID NO: 4341976 - DNA, 23 bp, Homo sapiens
cagcggggcctggcgggatgggc

SEQ ID NO: 4341977 - DNA, 16 bp, Homo sapiens
cagcgtggtttttatg

SEQ ID NO: 4341978 - DNA, 15 bp, Homo sapiens
cagctagaatttctg

SEQ ID NO: 4341979 - DNA, 16 bp, Homo sapiens
cagctattaaaatgta

SEQ ID NO: 4341980 - DNA, 10 bp, Homo sapiens
cagctccccc

SEQ ID NO: 4341981 - DNA, 13 bp, Homo sapiens
cagctcccccagg

SEQ ID NO: 4341982 - DNA, 15 bp, Homo sapiens
cagctcccccaggca

SEQ ID NO: 4341983 - DNA, 15 bp, Homo sapiens
cagctccccctgtcc

SEQ ID NO: 4341984 - DNA, 14 bp, Homo sapiens
cagctccctgaccc

SEQ ID NO: 4341985 - DNA, 22 bp, Homo sapiens
cagctccctgaccccctgtcct

SEQ ID NO: 4341986 - DNA, 18 bp, Homo sapiens
cagctcgatccaaattgt

SEQ ID NO: 4341987 - DNA, 20 bp, Homo sapiens
cagctcgatccaaattgtgc

SEQ ID NO: 4341988 - DNA, 13 bp, Homo sapiens
cagctctctctcc

SEQ ID NO: 4341989 - DNA, 15 bp, Homo sapiens
cagctctgcaagaat

SEQ ID NO: 4341990 - DNA, 16 bp, Homo sapiens
cagctgggacctaatg

SEQ ID NO: 4341991 - DNA, 22 bp, Homo sapiens
cagctgggacctaatgctggcc

SEQ ID NO: 4341992 - DNA, 19 bp, Homo sapiens
cagctgttcagctggttga

SEQ ID NO: 4341993 - DNA, 16 bp, Homo sapiens
cagcttgtgctgagcc

SEQ ID NO: 4341994 - DNA, 18 bp, Homo sapiens
cagcttgtgctgagcctg

SEQ ID NO: 4341995 - DNA, 22 bp, Homo sapiens
cagctttactgccttcctcctt

SEQ ID NO: 4341996 - DNA, 22 bp, Homo sapiens
cagctttgcccaacaccagccc

SEQ ID NO: 4341997 - DNA, 15 bp, Homo sapiens
caggagattggattt

SEQ ID NO: 4341998 - DNA, 21 bp, Homo sapiens
caggagccctggcccgcaaga

SEQ ID NO: 4341999 - DNA, 17 bp, Homo sapiens
caggaggttctgggcct

SEQ ID NO: 4342000 - DNA, 18 bp, Homo sapiens
caggaggttctgggcctc

SEQ ID NO: 4342001 - DNA, 23 bp, Homo sapiens
caggaggttctgggcctctgaac

SEQ ID NO: 4342002 - DNA, 23 bp, Homo sapiens
caggagtttatctatcggaagaa

SEQ ID NO: 4342003 - DNA, 23 bp, Homo sapiens
caggagtttgagaccaacctggg

SEQ ID NO: 4342004 - DNA, 20 bp, Homo sapiens
caggatcctctcctttgaaa

SEQ ID NO: 4342005 - DNA, 23 bp, Homo sapiens
caggatggccgggcgcggtggct

SEQ ID NO: 4342006 - DNA, 22 bp, Homo sapiens
caggcagaaatagttgtctgtg

SEQ ID NO: 4342007 - DNA, 23 bp, Homo sapiens
caggcagaaatagttgtctgtgc

SEQ ID NO: 4342008 - DNA, 22 bp, Homo sapiens
caggcatcactgattccctctc

SEQ ID NO: 4342009 - DNA, 17 bp, Homo sapiens
caggcatggtggcccac

SEQ ID NO: 4342010 - DNA, 14 bp, Homo sapiens
caggcctccctgtt

SEQ ID NO: 4342011 - DNA, 23 bp, Homo sapiens
caggcctctgccccaagagcagg

SEQ ID NO: 4342012 - DNA, 16 bp, Homo sapiens
caggctactctgccca

SEQ ID NO: 4342013 - DNA, 20 bp, Homo sapiens
cagggaaatgtgtatctatt

SEQ ID NO: 4342014 - DNA, 19 bp, Homo sapiens
cagggagaagttgagcagg

SEQ ID NO: 4342015 - DNA, 21 bp, Homo sapiens
cagggagaggcctcggctgtc

SEQ ID NO: 4342016 - DNA, 15 bp, Homo sapiens
cagggagcctcctgc

SEQ ID NO: 4342017 - DNA, 16 bp, Homo sapiens
cagggagcctcctgcc

SEQ ID NO: 4342018 - DNA, 18 bp, Homo sapiens
cagggagcctcctgccca

SEQ ID NO: 4342019 - DNA, 16 bp, Homo sapiens
cagggagggcttctgc

SEQ ID NO: 4342020 - DNA, 14 bp, Homo sapiens
cagggcctggcata

SEQ ID NO: 4342021 - DNA, 20 bp, Homo sapiens
caggggaaaatcagcctgct

SEQ ID NO: 4342022 - DNA, 21 bp, Homo sapiens
cagggtattccagagtgggga

SEQ ID NO: 4342023 - DNA, 19 bp, Homo sapiens
cagggtgaagcaccaggga

SEQ ID NO: 4342024 - DNA, 23 bp, Homo sapiens
cagggtgaagcaccagggagagg

SEQ ID NO: 4342025 - DNA, 23 bp, Homo sapiens
cagggtggagggaaggtgagagg

SEQ ID NO: 4342026 - DNA, 16 bp, Homo sapiens
cagggttaagcctgta

SEQ ID NO: 4342027 - DNA, 16 bp, Homo sapiens
caggtaaacacataaa

SEQ ID NO: 4342028 - DNA, 21 bp, Homo sapiens
caggtaaacacataaatgaaa

SEQ ID NO: 4342029 - DNA, 16 bp, Homo sapiens
caggtaatttaaattg

SEQ ID NO: 4342030 - DNA, 16 bp, Homo sapiens
caggtccggggaggag

SEQ ID NO: 4342031 - DNA, 17 bp, Homo sapiens
caggtccggggaggagg

SEQ ID NO: 4342032 - DNA, 14 bp, Homo sapiens
caggtgcagccctt

SEQ ID NO: 4342033 - DNA, 21 bp, Homo sapiens
caggtgcagcccttcctccct

SEQ ID NO: 4342034 - DNA, 14 bp, Homo sapiens
caggtgcgaaagga

SEQ ID NO: 4342035 - DNA, 20 bp, Homo sapiens
caggtggttatggagagggt

SEQ ID NO: 4342036 - DNA, 16 bp, Homo sapiens
caggtttaagctgtta

SEQ ID NO: 4342037 - DNA, 18 bp, Homo sapiens
caggtttaagctgttact

SEQ ID NO: 4342038 - DNA, 15 bp, Homo sapiens
cagtaaaataaaaaa

SEQ ID NO: 4342039 - DNA, 12 bp, Homo sapiens
cagtaatgtaga

SEQ ID NO: 4342040 - DNA, 22 bp, Homo sapiens
cagtactttataaccaaagcaa

SEQ ID NO: 4342041 - DNA, 17 bp, Homo sapiens
cagtagaaagagtgtta

SEQ ID NO: 4342042 - DNA, 19 bp, Homo sapiens
cagtagaaagagtgttatc

SEQ ID NO: 4342043 - DNA, 15 bp, Homo sapiens
cagtagaattttagt

SEQ ID NO: 4342044 - DNA, 17 bp, Homo sapiens
cagtagaattttagtcc

SEQ ID NO: 4342045 - DNA, 12 bp, Homo sapiens
cagtattttcca

SEQ ID NO: 4342046 - DNA, 13 bp, Homo sapiens
cagtcccagcaca

SEQ ID NO: 4342047 - DNA, 24 bp, Homo sapiens
cagtgagccgagattgcaccactg

SEQ ID NO: 4342048 - DNA, 15 bp, Homo sapiens
cagtgccgagaagga

SEQ ID NO: 4342049 - DNA, 19 bp, Homo sapiens
cagtgctgtccatgcttct

SEQ ID NO: 4342050 - DNA, 16 bp, Homo sapiens
cagtgggttaattata

SEQ ID NO: 4342051 - DNA, 16 bp, Homo sapiens
cagtggtactctgtgt

SEQ ID NO: 4342052 - DNA, 17 bp, Homo sapiens
cagtgttagtattcacc

SEQ ID NO: 4342053 - DNA, 18 bp, Homo sapiens
cagtgttgacatagcctt

SEQ ID NO: 4342054 - DNA, 19 bp, Homo sapiens
cagtgttgacatagccttt

SEQ ID NO: 4342055 - DNA, 22 bp, Homo sapiens
cagttaaaatcacattttaagt

SEQ ID NO: 4342056 - DNA, 15 bp, Homo sapiens
cagttcatatgcaga

SEQ ID NO: 4342057 - DNA, 22 bp, Homo sapiens
cagttccacggttgctaaatta

SEQ ID NO: 4342058 - DNA, 12 bp, Homo sapiens
cagttgaaaaac

SEQ ID NO: 4342059 - DNA, 19 bp, Homo sapiens
cagttggaggagactgggc

SEQ ID NO: 4342060 - DNA, 21 bp, Homo sapiens
cataaaaattagccaagtgtg

SEQ ID NO: 4342061 - DNA, 17 bp, Homo sapiens
cataaaattgcagtttc

SEQ ID NO: 4342062 - DNA, 21 bp, Homo sapiens
cataaaattgcagtttcatgt

SEQ ID NO: 4342063 - DNA, 15 bp, Homo sapiens
cataaagtcatcaaa

SEQ ID NO: 4342064 - DNA, 19 bp, Homo sapiens
cataacttttaactggagt

SEQ ID NO: 4342065 - DNA, 13 bp, Homo sapiens
cataagtaatatt

SEQ ID NO: 4342066 - DNA, 16 bp, Homo sapiens
cataatactaatttat

SEQ ID NO: 4342067 - DNA, 11 bp, Homo sapiens
cataattccta

SEQ ID NO: 4342068 - DNA, 16 bp, Homo sapiens
cataattcctacagca

SEQ ID NO: 4342069 - DNA, 14 bp, Homo sapiens
cataatttgtctta

SEQ ID NO: 4342070 - DNA, 18 bp, Homo sapiens
catacaaagcgtgcacaa

SEQ ID NO: 4342071 - DNA, 19 bp, Homo sapiens
catacacaaggccagaaaa

SEQ ID NO: 4342072 - DNA, 18 bp, Homo sapiens
catacatacatacataca

SEQ ID NO: 4342073 - DNA, 14 bp, Homo sapiens
cataccttctccca

SEQ ID NO: 4342074 - DNA, 16 bp, Homo sapiens
cataccttctcccagg

SEQ ID NO: 4342075 - DNA, 19 bp, Homo sapiens
cataccttctcccaggcct

SEQ ID NO: 4342076 - DNA, 12 bp, Homo sapiens
catagcctttgt

SEQ ID NO: 4342077 - DNA, 18 bp, Homo sapiens
cataggctggtggccttg

SEQ ID NO: 4342078 - DNA, 21 bp, Homo sapiens
cataggctggtggccttgggc

SEQ ID NO: 4342079 - DNA, 17 bp, Homo sapiens
catagtgtcaagaagga

SEQ ID NO: 4342080 - DNA, 19 bp, Homo sapiens
catataaaaacaatatatt

SEQ ID NO: 4342081 - DNA, 16 bp, Homo sapiens
catatatgctgtattt

SEQ ID NO: 4342082 - DNA, 20 bp, Homo sapiens
catatgctacacatatgtgc

SEQ ID NO: 4342083 - DNA, 21 bp, Homo sapiens
catatgctacacatatgtgct

SEQ ID NO: 4342084 - DNA, 12 bp, Homo sapiens
catattgagaat

SEQ ID NO: 4342085 - DNA, 18 bp, Homo sapiens
catattgagaataattat

SEQ ID NO: 4342086 - DNA, 22 bp, Homo sapiens
catcaaagtggggtacagtaaa

SEQ ID NO: 4342087 - DNA, 17 bp, Homo sapiens
catcacagtgggaagaa

SEQ ID NO: 4342088 - DNA, 15 bp, Homo sapiens
catcactgattccct

SEQ ID NO: 4342089 - DNA, 12 bp, Homo sapiens
catcagatttct

SEQ ID NO: 4342090 - DNA, 15 bp, Homo sapiens
catcagatttcttaa

SEQ ID NO: 4342091 - DNA, 16 bp, Homo sapiens
catcagctttctaatg

SEQ ID NO: 4342092 - DNA, 21 bp, Homo sapiens
catcccctgtagagtgggagc

SEQ ID NO: 4342093 - DNA, 16 bp, Homo sapiens
catcccttcctcctct

SEQ ID NO: 4342094 - DNA, 21 bp, Homo sapiens
catcccttcctcctctcctgg

SEQ ID NO: 4342095 - DNA, 13 bp, Homo sapiens
catcgcagcttcc

SEQ ID NO: 4342096 - DNA, 18 bp, Homo sapiens
catcgcagcttcctgtct

SEQ ID NO: 4342097 - DNA, 16 bp, Homo sapiens
catcgctcgtgtgttc

SEQ ID NO: 4342098 - DNA, 23 bp, Homo sapiens
catctaaagctttatctttgtgt

SEQ ID NO: 4342099 - DNA, 22 bp, Homo sapiens
catctcccagatcctggaaaca

SEQ ID NO: 4342100 - DNA, 15 bp, Homo sapiens
catctgcctgtaatt

SEQ ID NO: 4342101 - DNA, 22 bp, Homo sapiens
catctgtctccctccccaaatg

SEQ ID NO: 4342102 - DNA, 21 bp, Homo sapiens
catctgtgcacactaagaaat

SEQ ID NO: 4342103 - DNA, 15 bp, Homo sapiens
catctgtggacaaga

SEQ ID NO: 4342104 - DNA, 12 bp, Homo sapiens
catctgttctgg

SEQ ID NO: 4342105 - DNA, 12 bp, Homo sapiens
catcttgtgaaa

SEQ ID NO: 4342106 - DNA, 13 bp, Homo sapiens
catctttcctgtc

SEQ ID NO: 4342107 - DNA, 12 bp, Homo sapiens
catgaagaatgt

SEQ ID NO: 4342108 - DNA, 15 bp, Homo sapiens
catgaagctggccct

SEQ ID NO: 4342109 - DNA, 20 bp, Homo sapiens
catgaagctggccctcagct

SEQ ID NO: 4342110 - DNA, 23 bp, Homo sapiens
catgaagctggccctcagctccc

SEQ ID NO: 4342111 - DNA, 18 bp, Homo sapiens
catgaattagaagaaaat

SEQ ID NO: 4342112 - DNA, 18 bp, Homo sapiens
catgacaggcctgaagat

SEQ ID NO: 4342113 - DNA, 18 bp, Homo sapiens
catgagtctgtttcccaa

SEQ ID NO: 4342114 - DNA, 22 bp, Homo sapiens
catgagtctgtttcccaagcta

SEQ ID NO: 4342115 - DNA, 17 bp, Homo sapiens
catgatacctattaaag

SEQ ID NO: 4342116 - DNA, 15 bp, Homo sapiens
catgcaagaatttct

SEQ ID NO: 4342117 - DNA, 17 bp, Homo sapiens
catgcactcacaaagat

SEQ ID NO: 4342118 - DNA, 19 bp, Homo sapiens
catgccagcttatctcagg

SEQ ID NO: 4342119 - DNA, 14 bp, Homo sapiens
catgctgagtctcc

SEQ ID NO: 4342120 - DNA, 15 bp, Homo sapiens
catgctgagtctccc

SEQ ID NO: 4342121 - DNA, 17 bp, Homo sapiens
catgctgagtctcccaa

SEQ ID NO: 4342122 - DNA, 21 bp, Homo sapiens
catgctgagtctcccaaggct

SEQ ID NO: 4342123 - DNA, 18 bp, Homo sapiens
catgcttctactgtgaca

SEQ ID NO: 4342124 - DNA, 21 bp, Homo sapiens
catgcttctactgtgacactt

SEQ ID NO: 4342125 - DNA, 21 bp, Homo sapiens
catgcttctcatcttgtgaaa

SEQ ID NO: 4342126 - DNA, 14 bp, Homo sapiens
catgcttcttcctt

SEQ ID NO: 4342127 - DNA, 15 bp, Homo sapiens
catgctttttggtga

SEQ ID NO: 4342128 - DNA, 18 bp, Homo sapiens
catggagactctgagagc

SEQ ID NO: 4342129 - DNA, 17 bp, Homo sapiens
catggccagactccctt

SEQ ID NO: 4342130 - DNA, 18 bp, Homo sapiens
catggccagactcccttg

SEQ ID NO: 4342131 - DNA, 15 bp, Homo sapiens
catggggcccctggc

SEQ ID NO: 4342132 - DNA, 18 bp, Homo sapiens
catggggcccctggccca

SEQ ID NO: 4342133 - DNA, 21 bp, Homo sapiens
catggggcccctggcccagag

SEQ ID NO: 4342134 - DNA, 19 bp, Homo sapiens
catggtacccccttctggg

SEQ ID NO: 4342135 - DNA, 19 bp, Homo sapiens
catgtatgtggtatgtata

SEQ ID NO: 4342136 - DNA, 15 bp, Homo sapiens
catgtgcccctgcca

SEQ ID NO: 4342137 - DNA, 20 bp, Homo sapiens
catgtgcccctgccaaggcc

SEQ ID NO: 4342138 - DNA, 14 bp, Homo sapiens
catgtgtctcagca

SEQ ID NO: 4342139 - DNA, 20 bp, Homo sapiens
catgtgttggggagacatca

SEQ ID NO: 4342140 - DNA, 21 bp, Homo sapiens
catgtgttggggagacatcaa

SEQ ID NO: 4342141 - DNA, 18 bp, Homo sapiens
catgttatttaacctgag

SEQ ID NO: 4342142 - DNA, 18 bp, Homo sapiens
catgttgggtttgagaca

SEQ ID NO: 4342143 - DNA, 20 bp, Homo sapiens
catgttgggtttgagacaga

SEQ ID NO: 4342144 - DNA, 11 bp, Homo sapiens
cattaaatgaa

SEQ ID NO: 4342145 - DNA, 14 bp, Homo sapiens
cattaaatgaatat

SEQ ID NO: 4342146 - DNA, 18 bp, Homo sapiens
cattaaatgaatattttg

SEQ ID NO: 4342147 - DNA, 21 bp, Homo sapiens
cattacgtgcatttaaactct

SEQ ID NO: 4342148 - DNA, 14 bp, Homo sapiens
cattattgcttatt

SEQ ID NO: 4342149 - DNA, 16 bp, Homo sapiens
cattattgcttattgc

SEQ ID NO: 4342150 - DNA, 20 bp, Homo sapiens
cattattttgaggtagagga

SEQ ID NO: 4342151 - DNA, 22 bp, Homo sapiens
cattattttgaggtagaggaaa

SEQ ID NO: 4342152 - DNA, 18 bp, Homo sapiens
cattcaaggcttatctct

SEQ ID NO: 4342153 - DNA, 20 bp, Homo sapiens
cattccattaataactgaat

SEQ ID NO: 4342154 - DNA, 17 bp, Homo sapiens
cattcctggaaaccaca

SEQ ID NO: 4342155 - DNA, 21 bp, Homo sapiens
cattcctggaaaccacagtcc

SEQ ID NO: 4342156 - DNA, 14 bp, Homo sapiens
cattcctgttctct

SEQ ID NO: 4342157 - DNA, 16 bp, Homo sapiens
cattctcataattcct

SEQ ID NO: 4342158 - DNA, 20 bp, Homo sapiens
cattctgagcccccttcctg

SEQ ID NO: 4342159 - DNA, 21 bp, Homo sapiens
cattctgagcccccttcctgt

SEQ ID NO: 4342160 - DNA, 22 bp, Homo sapiens
cattctgcattgagaaggaact

SEQ ID NO: 4342161 - DNA, 16 bp, Homo sapiens
cattcttggttgttaa

SEQ ID NO: 4342162 - DNA, 14 bp, Homo sapiens
cattgaaaaaggaa

SEQ ID NO: 4342163 - DNA, 17 bp, Homo sapiens
cattgacatttgaattt

SEQ ID NO: 4342164 - DNA, 21 bp, Homo sapiens
cattgcaaaatagaagaagag

SEQ ID NO: 4342165 - DNA, 22 bp, Homo sapiens
cattgcaaaatagaagaagagg

SEQ ID NO: 4342166 - DNA, 21 bp, Homo sapiens
cattggcccctgagcccagag

SEQ ID NO: 4342167 - DNA, 23 bp, Homo sapiens
cattgggttgtagccaaaggttc

SEQ ID NO: 4342168 - DNA, 14 bp, Homo sapiens
cattgtctttcctc

SEQ ID NO: 4342169 - DNA, 12 bp, Homo sapiens
cattgttttgaa

SEQ ID NO: 4342170 - DNA, 13 bp, Homo sapiens
cattgttttgaat

SEQ ID NO: 4342171 - DNA, 19 bp, Homo sapiens
cattgttttgaatattact

SEQ ID NO: 4342172 - DNA, 22 bp, Homo sapiens
cattgttttgaatattactcct

SEQ ID NO: 4342173 - DNA, 15 bp, Homo sapiens
catttaaaaaaaatc

SEQ ID NO: 4342174 - DNA, 16 bp, Homo sapiens
catttaaactctgcca

SEQ ID NO: 4342175 - DNA, 19 bp, Homo sapiens
catttaaactctgccagaa

SEQ ID NO: 4342176 - DNA, 22 bp, Homo sapiens
catttaaactctgccagaaaaa

SEQ ID NO: 4342177 - DNA, 16 bp, Homo sapiens
catttcaattctcaaa

SEQ ID NO: 4342178 - DNA, 16 bp, Homo sapiens
catttcacgaactgtt

SEQ ID NO: 4342179 - DNA, 14 bp, Homo sapiens
catttcagatttta

SEQ ID NO: 4342180 - DNA, 19 bp, Homo sapiens
catttcattccattgccta

SEQ ID NO: 4342181 - DNA, 19 bp, Homo sapiens
catttcctctctatctttt

SEQ ID NO: 4342182 - DNA, 17 bp, Homo sapiens
catttggttaaatcatt

SEQ ID NO: 4342183 - DNA, 20 bp, Homo sapiens
catttgttagccacggaaac

SEQ ID NO: 4342184 - DNA, 14 bp, Homo sapiens
cattttacacatgt

SEQ ID NO: 4342185 - DNA, 19 bp, Homo sapiens
cattttctgatgcccaccg

SEQ ID NO: 4342186 - DNA, 18 bp, Homo sapiens
cattttgctaaatgtgaa

SEQ ID NO: 4342187 - DNA, 15 bp, Homo sapiens
catttttaaccactt

SEQ ID NO: 4342188 - DNA, 23 bp, Homo sapiens
ccaaaataatctatattaaatga

SEQ ID NO: 4342189 - DNA, 12 bp, Homo sapiens
ccaaacatgtat

SEQ ID NO: 4342190 - DNA, 14 bp, Homo sapiens
ccaaacatgtattt

SEQ ID NO: 4342191 - DNA, 14 bp, Homo sapiens
ccaaagctggccca

SEQ ID NO: 4342192 - DNA, 17 bp, Homo sapiens
ccaaaggaaaaagcaca

SEQ ID NO: 4342193 - DNA, 16 bp, Homo sapiens
ccaaatggctgctttg

SEQ ID NO: 4342194 - DNA, 18 bp, Homo sapiens
ccaaatgtttacagggag

SEQ ID NO: 4342195 - DNA, 19 bp, Homo sapiens
ccaaatgtttacagggagc

SEQ ID NO: 4342196 - DNA, 14 bp, Homo sapiens
ccaaattgtgcttc

SEQ ID NO: 4342197 - DNA, 16 bp, Homo sapiens
ccaaattgtgcttctc

SEQ ID NO: 4342198 - DNA, 11 bp, Homo sapiens
ccaaatttaat

SEQ ID NO: 4342199 - DNA, 24 bp, Homo sapiens
ccaacaggtaaacacataaatgaa

SEQ ID NO: 4342200 - DNA, 16 bp, Homo sapiens
ccaacagtttattttt

SEQ ID NO: 4342201 - DNA, 18 bp, Homo sapiens
ccaacccctgaggaagat

SEQ ID NO: 4342202 - DNA, 20 bp, Homo sapiens
ccaactcaagtgtcacctcc

SEQ ID NO: 4342203 - DNA, 19 bp, Homo sapiens
ccaactcttccacctctgg

SEQ ID NO: 4342204 - DNA, 20 bp, Homo sapiens
ccaacttgccaaaatgttgg

SEQ ID NO: 4342205 - DNA, 11 bp, Homo sapiens
ccaagaaattt

SEQ ID NO: 4342206 - DNA, 13 bp, Homo sapiens
ccaagaaatttta

SEQ ID NO: 4342207 - DNA, 16 bp, Homo sapiens
ccaagagcaggaggtg

SEQ ID NO: 4342208 - DNA, 16 bp, Homo sapiens
ccaagatggagaggaa

SEQ ID NO: 4342209 - DNA, 18 bp, Homo sapiens
ccaagatggagaggaaga

SEQ ID NO: 4342210 - DNA, 14 bp, Homo sapiens
ccaagcattacttt

SEQ ID NO: 4342211 - DNA, 17 bp, Homo sapiens
ccaagctaatctgcctg

SEQ ID NO: 4342212 - DNA, 16 bp, Homo sapiens
ccaagctagactgtgt

SEQ ID NO: 4342213 - DNA, 22 bp, Homo sapiens
ccaaggccggagacccacagcc

SEQ ID NO: 4342214 - DNA, 23 bp, Homo sapiens
ccaaggccggagacccacagccc

SEQ ID NO: 4342215 - DNA, 18 bp, Homo sapiens
ccaaggctgcgtctggag

SEQ ID NO: 4342216 - DNA, 20 bp, Homo sapiens
ccaagtcaagtgaaaaagga

SEQ ID NO: 4342217 - DNA, 12 bp, Homo sapiens
ccaatagtcata

SEQ ID NO: 4342218 - DNA, 17 bp, Homo sapiens
ccaatatttaccagacc

SEQ ID NO: 4342219 - DNA, 12 bp, Homo sapiens
ccaatccagaga

SEQ ID NO: 4342220 - DNA, 22 bp, Homo sapiens
ccaatccagagaagcgctgttg

SEQ ID NO: 4342221 - DNA, 13 bp, Homo sapiens
ccaatctgggaag

SEQ ID NO: 4342222 - DNA, 20 bp, Homo sapiens
ccaatgttctctcttctcca

SEQ ID NO: 4342223 - DNA, 18 bp, Homo sapiens
ccaattattgatatatat

SEQ ID NO: 4342224 - DNA, 16 bp, Homo sapiens
ccaatttactggccac

SEQ ID NO: 4342225 - DNA, 14 bp, Homo sapiens
ccaatttatgcaga

SEQ ID NO: 4342226 - DNA, 15 bp, Homo sapiens
ccacaaagagaccag

SEQ ID NO: 4342227 - DNA, 22 bp, Homo sapiens
ccacaagccttactcacctctc

SEQ ID NO: 4342228 - DNA, 15 bp, Homo sapiens
ccacacggagctcct

SEQ ID NO: 4342229 - DNA, 17 bp, Homo sapiens
ccacacggagctcctgg

SEQ ID NO: 4342230 - DNA, 21 bp, Homo sapiens
ccacacggagctcctggcagc

SEQ ID NO: 4342231 - DNA, 14 bp, Homo sapiens
ccacagccctgaaa

SEQ ID NO: 4342232 - DNA, 15 bp, Homo sapiens
ccacagccctgaaac

SEQ ID NO: 4342233 - DNA, 23 bp, Homo sapiens
ccacagccctgaaacgagaagtg

SEQ ID NO: 4342234 - DNA, 14 bp, Homo sapiens
ccacagccctggaa

SEQ ID NO: 4342235 - DNA, 15 bp, Homo sapiens
ccacagccctggaat

SEQ ID NO: 4342236 - DNA, 15 bp, Homo sapiens
ccacaggcctccctg

SEQ ID NO: 4342237 - DNA, 16 bp, Homo sapiens
ccacataggaaaatgc

SEQ ID NO: 4342238 - DNA, 18 bp, Homo sapiens
ccaccatcaccagacagg

SEQ ID NO: 4342239 - DNA, 21 bp, Homo sapiens
ccaccattcctggaaaccaca

SEQ ID NO: 4342240 - DNA, 16 bp, Homo sapiens
ccacccaaggagaacg

SEQ ID NO: 4342241 - DNA, 16 bp, Homo sapiens
ccacccacaaagaaac

SEQ ID NO: 4342242 - DNA, 14 bp, Homo sapiens
ccaccccagagttg

SEQ ID NO: 4342243 - DNA, 22 bp, Homo sapiens
ccaccccagagttgggatgcgg

SEQ ID NO: 4342244 - DNA, 14 bp, Homo sapiens
ccaccgaggagccc

SEQ ID NO: 4342245 - DNA, 16 bp, Homo sapiens
ccaccgaggagcccca

SEQ ID NO: 4342246 - DNA, 22 bp, Homo sapiens
ccaccgaggagccccagccccg

SEQ ID NO: 4342247 - DNA, 17 bp, Homo sapiens
ccacctcccacaaagga

SEQ ID NO: 4342248 - DNA, 14 bp, Homo sapiens
ccacctgacctctg

SEQ ID NO: 4342249 - DNA, 15 bp, Homo sapiens
ccaccttcccttcct

SEQ ID NO: 4342250 - DNA, 19 bp, Homo sapiens
ccaccttcccttcctcagc

SEQ ID NO: 4342251 - DNA, 18 bp, Homo sapiens
ccacgactgttgtacaag

SEQ ID NO: 4342252 - DNA, 12 bp, Homo sapiens
ccacggccttgt

SEQ ID NO: 4342253 - DNA, 21 bp, Homo sapiens
ccacgtgccattgtctttcct

SEQ ID NO: 4342254 - DNA, 20 bp, Homo sapiens
ccactaggtgaacagcagga

SEQ ID NO: 4342255 - DNA, 23 bp, Homo sapiens
ccactagtaagtaattatgcact

SEQ ID NO: 4342256 - DNA, 13 bp, Homo sapiens
ccactcccaagcc

SEQ ID NO: 4342257 - DNA, 16 bp, Homo sapiens
ccactcttcatatatg

SEQ ID NO: 4342258 - DNA, 20 bp, Homo sapiens
ccactgcaaataaagccttt

SEQ ID NO: 4342259 - DNA, 19 bp, Homo sapiens
ccactgcactccagcctgg

SEQ ID NO: 4342260 - DNA, 20 bp, Homo sapiens
ccactgcactccagcctggg

SEQ ID NO: 4342261 - DNA, 14 bp, Homo sapiens
ccacttcagctgac

SEQ ID NO: 4342262 - DNA, 12 bp, Homo sapiens
ccacttcctaat

SEQ ID NO: 4342263 - DNA, 17 bp, Homo sapiens
ccagacgtaggggaggg

SEQ ID NO: 4342264 - DNA, 15 bp, Homo sapiens
ccagactcccttgct

SEQ ID NO: 4342265 - DNA, 10 bp, Homo sapiens
ccagagcccc

SEQ ID NO: 4342266 - DNA, 18 bp, Homo sapiens
ccagagcccctcatgcca

SEQ ID NO: 4342267 - DNA, 16 bp, Homo sapiens
ccagaggccgctgccc

SEQ ID NO: 4342268 - DNA, 14 bp, Homo sapiens
ccagaggtggccct

SEQ ID NO: 4342269 - DNA, 21 bp, Homo sapiens
ccagaggtggccctcccaggc

SEQ ID NO: 4342270 - DNA, 21 bp, Homo sapiens
ccagagtcacaagtagcctct

SEQ ID NO: 4342271 - DNA, 16 bp, Homo sapiens
ccagagttgctgtgcc

SEQ ID NO: 4342272 - DNA, 13 bp, Homo sapiens
ccagatcctggaa

SEQ ID NO: 4342273 - DNA, 16 bp, Homo sapiens
ccagcacatttcctct

SEQ ID NO: 4342274 - DNA, 13 bp, Homo sapiens
ccagcagcctgga

SEQ ID NO: 4342275 - DNA, 20 bp, Homo sapiens
ccagcagcctggaccctgtg

SEQ ID NO: 4342276 - DNA, 23 bp, Homo sapiens
ccagcaggaggttctgggcctct

SEQ ID NO: 4342277 - DNA, 16 bp, Homo sapiens
ccagcagttctctgcc

SEQ ID NO: 4342278 - DNA, 16 bp, Homo sapiens
ccagcatcagcacagc

SEQ ID NO: 4342279 - DNA, 15 bp, Homo sapiens
ccagccaaagcctcc

SEQ ID NO: 4342280 - DNA, 18 bp, Homo sapiens
ccagcccccacagccctg

SEQ ID NO: 4342281 - DNA, 19 bp, Homo sapiens
ccagcccccacagccctgg

SEQ ID NO: 4342282 - DNA, 17 bp, Homo sapiens
ccagccccgtcccagag

SEQ ID NO: 4342283 - DNA, 18 bp, Homo sapiens
ccagccccgtcccagagg

SEQ ID NO: 4342284 - DNA, 18 bp, Homo sapiens
ccagcccctgccccagcc

SEQ ID NO: 4342285 - DNA, 20 bp, Homo sapiens
ccagcccctgccccagccca

SEQ ID NO: 4342286 - DNA, 19 bp, Homo sapiens
ccagccgtgtgtgcatgtg

SEQ ID NO: 4342287 - DNA, 15 bp, Homo sapiens
ccagctaccctgtgt

SEQ ID NO: 4342288 - DNA, 16 bp, Homo sapiens
ccagctcccccaggca

SEQ ID NO: 4342289 - DNA, 16 bp, Homo sapiens
ccagctctctctcctg

SEQ ID NO: 4342290 - DNA, 17 bp, Homo sapiens
ccagctctctctcctgg

SEQ ID NO: 4342291 - DNA, 20 bp, Homo sapiens
ccagctgggacctaatgctg

SEQ ID NO: 4342292 - DNA, 17 bp, Homo sapiens
ccagctgttcagctggt

SEQ ID NO: 4342293 - DNA, 19 bp, Homo sapiens
ccagcttaaaggggctaga

SEQ ID NO: 4342294 - DNA, 22 bp, Homo sapiens
ccagctttgcccaacaccagcc

SEQ ID NO: 4342295 - DNA, 16 bp, Homo sapiens
ccaggagggagagcct

SEQ ID NO: 4342296 - DNA, 21 bp, Homo sapiens
ccaggagggagagcctctgtt

SEQ ID NO: 4342297 - DNA, 17 bp, Homo sapiens
ccaggcagaaatagttg

SEQ ID NO: 4342298 - DNA, 20 bp, Homo sapiens
ccaggcatcactgattccct

SEQ ID NO: 4342299 - DNA, 15 bp, Homo sapiens
ccagggagaggcctc

SEQ ID NO: 4342300 - DNA, 21 bp, Homo sapiens
ccagggagaggcctcggctgt

SEQ ID NO: 4342301 - DNA, 15 bp, Homo sapiens
ccagggcactgtctg

SEQ ID NO: 4342302 - DNA, 23 bp, Homo sapiens
ccaggtctgggaagctgagggca

SEQ ID NO: 4342303 - DNA, 23 bp, Homo sapiens
ccagtcccccaaccccagccgct

SEQ ID NO: 4342304 - DNA, 22 bp, Homo sapiens
ccagtgctgtccatgcttctca

SEQ ID NO: 4342305 - DNA, 21 bp, Homo sapiens
ccagtgggtctggtggtgctg

SEQ ID NO: 4342306 - DNA, 23 bp, Homo sapiens
ccataagtaatatttaaagatta

SEQ ID NO: 4342307 - DNA, 17 bp, Homo sapiens
ccatagagaccaggagg

SEQ ID NO: 4342308 - DNA, 16 bp, Homo sapiens
ccataggctgtgttta

SEQ ID NO: 4342309 - DNA, 14 bp, Homo sapiens
ccatatatgctgta

SEQ ID NO: 4342310 - DNA, 15 bp, Homo sapiens
ccatctgtgcacact

SEQ ID NO: 4342311 - DNA, 16 bp, Homo sapiens
ccatgaagctggccct

SEQ ID NO: 4342312 - DNA, 21 bp, Homo sapiens
ccatgaagctggccctcagct

SEQ ID NO: 4342313 - DNA, 19 bp, Homo sapiens
ccatgattaaccacttcag

SEQ ID NO: 4342314 - DNA, 21 bp, Homo sapiens
ccatgattaaccacttcagct

SEQ ID NO: 4342315 - DNA, 13 bp, Homo sapiens
ccatgctcctggc

SEQ ID NO: 4342316 - DNA, 18 bp, Homo sapiens
ccatgggaaatgagccag

SEQ ID NO: 4342317 - DNA, 14 bp, Homo sapiens
ccatgtgtgctaat

SEQ ID NO: 4342318 - DNA, 15 bp, Homo sapiens
ccattacgtgcattt

SEQ ID NO: 4342319 - DNA, 15 bp, Homo sapiens
ccattcctgttctct

SEQ ID NO: 4342320 - DNA, 23 bp, Homo sapiens
ccattgaaaaaggaaaaatgtag

SEQ ID NO: 4342321 - DNA, 19 bp, Homo sapiens
ccattgcaaaatagaagaa

SEQ ID NO: 4342322 - DNA, 17 bp, Homo sapiens
ccattgcctagctcttt

SEQ ID NO: 4342323 - DNA, 17 bp, Homo sapiens
ccattgtcttgttctgt

SEQ ID NO: 4342324 - DNA, 16 bp, Homo sapiens
ccatttttaaccactt

SEQ ID NO: 4342325 - DNA, 14 bp, Homo sapiens
ccatttttgctaat

SEQ ID NO: 4342326 - DNA, 17 bp, Homo sapiens
cccaacaccagcccctg

SEQ ID NO: 4342327 - DNA, 12 bp, Homo sapiens
cccaacagttta

SEQ ID NO: 4342328 - DNA, 15 bp, Homo sapiens
cccaacccctgagga

SEQ ID NO: 4342329 - DNA, 12 bp, Homo sapiens
cccaacttgcca

SEQ ID NO: 4342330 - DNA, 23 bp, Homo sapiens
cccaagagcaggaggtgcctgaa

SEQ ID NO: 4342331 - DNA, 12 bp, Homo sapiens
cccaaggagaac

SEQ ID NO: 4342332 - DNA, 20 bp, Homo sapiens
cccaagggcatcatcctcag

SEQ ID NO: 4342333 - DNA, 16 bp, Homo sapiens
cccaagtcattcctaa

SEQ ID NO: 4342334 - DNA, 16 bp, Homo sapiens
cccaatccatgcttca

SEQ ID NO: 4342335 - DNA, 12 bp, Homo sapiens
cccaatggagaa

SEQ ID NO: 4342336 - DNA, 14 bp, Homo sapiens
cccacagccctgaa

SEQ ID NO: 4342337 - DNA, 13 bp, Homo sapiens
cccacagccctgg

SEQ ID NO: 4342338 - DNA, 12 bp, Homo sapiens
cccacccagagg

SEQ ID NO: 4342339 - DNA, 13 bp, Homo sapiens
cccacccagaggt

SEQ ID NO: 4342340 - DNA, 22 bp, Homo sapiens
cccacccagaggtggccctccc

SEQ ID NO: 4342341 - DNA, 22 bp, Homo sapiens
cccacctatccgccctgcagca

SEQ ID NO: 4342342 - DNA, 13 bp, Homo sapiens
cccacctgacctc

SEQ ID NO: 4342343 - DNA, 20 bp, Homo sapiens
cccacgactgttgtacaagc

SEQ ID NO: 4342344 - DNA, 20 bp, Homo sapiens
cccagaggccgctgcccctg

SEQ ID NO: 4342345 - DNA, 22 bp, Homo sapiens
cccagaggccgctgcccctgag

SEQ ID NO: 4342346 - DNA, 18 bp, Homo sapiens
cccagcagttctctgcca

SEQ ID NO: 4342347 - DNA, 13 bp, Homo sapiens
cccagccatgtgt

SEQ ID NO: 4342348 - DNA, 14 bp, Homo sapiens
cccagcccaagtcc

SEQ ID NO: 4342349 - DNA, 12 bp, Homo sapiens
cccagccccaat

SEQ ID NO: 4342350 - DNA, 18 bp, Homo sapiens
cccagccccaatccagag

SEQ ID NO: 4342351 - DNA, 20 bp, Homo sapiens
cccagccccaatccagagaa

SEQ ID NO: 4342352 - DNA, 19 bp, Homo sapiens
cccagcccccacagccctg

SEQ ID NO: 4342353 - DNA, 19 bp, Homo sapiens
cccagctcccccaggcaga

SEQ ID NO: 4342354 - DNA, 22 bp, Homo sapiens
cccagcttaaaggggctagagt

SEQ ID NO: 4342355 - DNA, 13 bp, Homo sapiens
cccagctttgccc

SEQ ID NO: 4342356 - DNA, 18 bp, Homo sapiens
cccagctttgcccaacac

SEQ ID NO: 4342357 - DNA, 22 bp, Homo sapiens
cccagctttgcccaacaccagc

SEQ ID NO: 4342358 - DNA, 15 bp, Homo sapiens
cccaggcctctgccc

SEQ ID NO: 4342359 - DNA, 22 bp, Homo sapiens
cccaggcctctgccccaagagc

SEQ ID NO: 4342360 - DNA, 22 bp, Homo sapiens
cccaggggaggtgtattgtgta

SEQ ID NO: 4342361 - DNA, 18 bp, Homo sapiens
cccagtgccgagaaggaa

SEQ ID NO: 4342362 - DNA, 14 bp, Homo sapiens
cccagttagctctc

SEQ ID NO: 4342363 - DNA, 17 bp, Homo sapiens
cccagttggaggagact

SEQ ID NO: 4342364 - DNA, 23 bp, Homo sapiens
cccagttggaggagactgggcac

SEQ ID NO: 4342365 - DNA, 19 bp, Homo sapiens
cccagttggcccttctgcc

SEQ ID NO: 4342366 - DNA, 21 bp, Homo sapiens
cccagttggcccttctgccct

SEQ ID NO: 4342367 - DNA, 18 bp, Homo sapiens
cccatgaagctggccctc

SEQ ID NO: 4342368 - DNA, 23 bp, Homo sapiens
cccatgatacctattaaaggaaa

SEQ ID NO: 4342369 - DNA, 13 bp, Homo sapiens
ccccaacccctga

SEQ ID NO: 4342370 - DNA, 16 bp, Homo sapiens
ccccaacccctgagga

SEQ ID NO: 4342371 - DNA, 23 bp, Homo sapiens
ccccaactcaagtgtcacctcct

SEQ ID NO: 4342372 - DNA, 15 bp, Homo sapiens
ccccaatccatgctt

SEQ ID NO: 4342373 - DNA, 13 bp, Homo sapiens
ccccacccagagg

SEQ ID NO: 4342374 - DNA, 15 bp, Homo sapiens
ccccaccccagagtt

SEQ ID NO: 4342375 - DNA, 17 bp, Homo sapiens
ccccacctgacctctgc

SEQ ID NO: 4342376 - DNA, 11 bp, Homo sapiens
ccccagagccc

SEQ ID NO: 4342377 - DNA, 15 bp, Homo sapiens
ccccagcccccacag

SEQ ID NO: 4342378 - DNA, 17 bp, Homo sapiens
ccccagcccccacagcc

SEQ ID NO: 4342379 - DNA, 18 bp, Homo sapiens
ccccagcccccacagccc

SEQ ID NO: 4342380 - DNA, 19 bp, Homo sapiens
ccccagccccgtcccagag

SEQ ID NO: 4342381 - DNA, 20 bp, Homo sapiens
ccccagccccgtcccagagg

SEQ ID NO: 4342382 - DNA, 16 bp, Homo sapiens
ccccagccgctcggag

SEQ ID NO: 4342383 - DNA, 18 bp, Homo sapiens
ccccagctcccccaggca

SEQ ID NO: 4342384 - DNA, 13 bp, Homo sapiens
ccccagctttgcc

SEQ ID NO: 4342385 - DNA, 24 bp, Homo sapiens
ccccagctttgcccaacaccagcc

SEQ ID NO: 4342386 - DNA, 12 bp, Homo sapiens
ccccaggcagaa

SEQ ID NO: 4342387 - DNA, 11 bp, Homo sapiens
ccccagtgccc

SEQ ID NO: 4342388 - DNA, 22 bp, Homo sapiens
ccccagtgcccggtgcagggcc

SEQ ID NO: 4342389 - DNA, 13 bp, Homo sapiens
ccccagtgctcct

SEQ ID NO: 4342390 - DNA, 17 bp, Homo sapiens
ccccagttggcccttct

SEQ ID NO: 4342391 - DNA, 19 bp, Homo sapiens
ccccatagagaccaggagg

SEQ ID NO: 4342392 - DNA, 14 bp, Homo sapiens
cccccaaatttaat

SEQ ID NO: 4342393 - DNA, 18 bp, Homo sapiens
cccccaacccctgaggaa

SEQ ID NO: 4342394 - DNA, 15 bp, Homo sapiens
cccccacagccctgg

SEQ ID NO: 4342395 - DNA, 20 bp, Homo sapiens
ccccctgaaacatgtgcccc

SEQ ID NO: 4342396 - DNA, 12 bp, Homo sapiens
ccccctgtcccc

SEQ ID NO: 4342397 - DNA, 15 bp, Homo sapiens
ccccctgtcccctca

SEQ ID NO: 4342398 - DNA, 18 bp, Homo sapiens
ccccctgtcccctcagct

SEQ ID NO: 4342399 - DNA, 22 bp, Homo sapiens
cccccttctgggcatctgttct

SEQ ID NO: 4342400 - DNA, 23 bp, Homo sapiens
cccccttctgggcatctgttctg

SEQ ID NO: 4342401 - DNA, 19 bp, Homo sapiens
ccccctttctctgcctggc

SEQ ID NO: 4342402 - DNA, 20 bp, Homo sapiens
ccccctttctctgcctggca

SEQ ID NO: 4342403 - DNA, 15 bp, Homo sapiens
ccccgccccctgaaa

SEQ ID NO: 4342404 - DNA, 14 bp, Homo sapiens
ccccgtcccagagg

SEQ ID NO: 4342405 - DNA, 15 bp, Homo sapiens
cccctcaacacctct

SEQ ID NO: 4342406 - DNA, 16 bp, Homo sapiens
cccctcaacacctctg

SEQ ID NO: 4342407 - DNA, 12 bp, Homo sapiens
cccctcagctcc

SEQ ID NO: 4342408 - DNA, 15 bp, Homo sapiens
cccctccccgccccc

SEQ ID NO: 4342409 - DNA, 20 bp, Homo sapiens
cccctccccgccccctgaaa

SEQ ID NO: 4342410 - DNA, 10 bp, Homo sapiens
cccctgaaac

SEQ ID NO: 4342411 - DNA, 14 bp, Homo sapiens
cccctgcctcctgc

SEQ ID NO: 4342412 - DNA, 11 bp, Homo sapiens
cccctgcttct

SEQ ID NO: 4342413 - DNA, 15 bp, Homo sapiens
cccctgcttctccag

SEQ ID NO: 4342414 - DNA, 19 bp, Homo sapiens
cccctgcttctccagcctg

SEQ ID NO: 4342415 - DNA, 14 bp, Homo sapiens
cccctggcccagag

SEQ ID NO: 4342416 - DNA, 18 bp, Homo sapiens
cccgcaagagggacagag

SEQ ID NO: 4342417 - DNA, 20 bp, Homo sapiens
cccgcaagagggacagagcc

SEQ ID NO: 4342418 - DNA, 17 bp, Homo sapiens
cccgccaccctgtctca

SEQ ID NO: 4342419 - DNA, 20 bp, Homo sapiens
cccgccgcttttctcctctt

SEQ ID NO: 4342420 - DNA, 19 bp, Homo sapiens
cccggcggggtgcctgctg

SEQ ID NO: 4342421 - DNA, 15 bp, Homo sapiens
cccggtgcagggcct

SEQ ID NO: 4342422 - DNA, 16 bp, Homo sapiens
cccggtgcagggcctg

SEQ ID NO: 4342423 - DNA, 17 bp, Homo sapiens
cccggtgcagggcctgg

SEQ ID NO: 4342424 - DNA, 14 bp, Homo sapiens
cccgtaagaccacc

SEQ ID NO: 4342425 - DNA, 19 bp, Homo sapiens
cccgtaagaccaccttccc

SEQ ID NO: 4342426 - DNA, 14 bp, Homo sapiens
cccgtcccagaggc

SEQ ID NO: 4342427 - DNA, 20 bp, Homo sapiens
cccgttgggtcccttgctgc

SEQ ID NO: 4342428 - DNA, 21 bp, Homo sapiens
ccctaaagcagtaaaataaaa

SEQ ID NO: 4342429 - DNA, 18 bp, Homo sapiens
ccctattagagaagagat

SEQ ID NO: 4342430 - DNA, 22 bp, Homo sapiens
ccctattggcttactgaaagac

SEQ ID NO: 4342431 - DNA, 16 bp, Homo sapiens
ccctcaacacctctgc

SEQ ID NO: 4342432 - DNA, 11 bp, Homo sapiens
ccctcccaggc

SEQ ID NO: 4342433 - DNA, 19 bp, Homo sapiens
ccctccccaaatggctgct

SEQ ID NO: 4342434 - DNA, 14 bp, Homo sapiens
ccctctccaaatca

SEQ ID NO: 4342435 - DNA, 16 bp, Homo sapiens
ccctctccaaatcaag

SEQ ID NO: 4342436 - DNA, 13 bp, Homo sapiens
ccctctcccaccc

SEQ ID NO: 4342437 - DNA, 15 bp, Homo sapiens
ccctctcccacccaa

SEQ ID NO: 4342438 - DNA, 18 bp, Homo sapiens
ccctctctgtggctccaa

SEQ ID NO: 4342439 - DNA, 13 bp, Homo sapiens
ccctctgcctggg

SEQ ID NO: 4342440 - DNA, 15 bp, Homo sapiens
ccctctgcctgggat

SEQ ID NO: 4342441 - DNA, 17 bp, Homo sapiens
ccctctgcctgggatgc

SEQ ID NO: 4342442 - DNA, 17 bp, Homo sapiens
ccctctgtggccaggag

SEQ ID NO: 4342443 - DNA, 14 bp, Homo sapiens
ccctctgtgtctgc

SEQ ID NO: 4342444 - DNA, 18 bp, Homo sapiens
ccctgaaagccctgagct

SEQ ID NO: 4342445 - DNA, 16 bp, Homo sapiens
ccctgagttctgacac

SEQ ID NO: 4342446 - DNA, 17 bp, Homo sapiens
ccctgagttctgacact

SEQ ID NO: 4342447 - DNA, 14 bp, Homo sapiens
ccctgcctcctgcc

SEQ ID NO: 4342448 - DNA, 16 bp, Homo sapiens
ccctgcctcctgcctc

SEQ ID NO: 4342449 - DNA, 11 bp, Homo sapiens
ccctgcttctc

SEQ ID NO: 4342450 - DNA, 21 bp, Homo sapiens
ccctggaataaatttcgcaat

SEQ ID NO: 4342451 - DNA, 18 bp, Homo sapiens
ccctgtcccctcagctcc

SEQ ID NO: 4342452 - DNA, 23 bp, Homo sapiens
ccctgtctcaaaaaaagaaaaag

SEQ ID NO: 4342453 - DNA, 13 bp, Homo sapiens
ccctgtcttgtcc

SEQ ID NO: 4342454 - DNA, 20 bp, Homo sapiens
ccctgtttgaagcctgccct

SEQ ID NO: 4342455 - DNA, 19 bp, Homo sapiens
cccttccccctttctctgc

SEQ ID NO: 4342456 - DNA, 12 bp, Homo sapiens
cccttccctggt

SEQ ID NO: 4342457 - DNA, 18 bp, Homo sapiens
cccttcctcctctcctgg

SEQ ID NO: 4342458 - DNA, 19 bp, Homo sapiens
cccttcctcctctcctgga

SEQ ID NO: 4342459 - DNA, 22 bp, Homo sapiens
cccttcctcctctcctggaaac

SEQ ID NO: 4342460 - DNA, 20 bp, Homo sapiens
cccttctgggcatctgttct

SEQ ID NO: 4342461 - DNA, 21 bp, Homo sapiens
cccttctgggcatctgttctg

SEQ ID NO: 4342462 - DNA, 19 bp, Homo sapiens
cccttctttgcttcttttt

SEQ ID NO: 4342463 - DNA, 22 bp, Homo sapiens
cccttgctgcaaacccatgaag

SEQ ID NO: 4342464 - DNA, 16 bp, Homo sapiens
cccttggatcagaggt

SEQ ID NO: 4342465 - DNA, 20 bp, Homo sapiens
cccttggggtggtgctgggt

SEQ ID NO: 4342466 - DNA, 23 bp, Homo sapiens
cccttggggtggtgctgggtcat

SEQ ID NO: 4342467 - DNA, 12 bp, Homo sapiens
cccttgtctgag

SEQ ID NO: 4342468 - DNA, 13 bp, Homo sapiens
cccttgtctgaga

SEQ ID NO: 4342469 - DNA, 14 bp, Homo sapiens
cccttgtctgagat

SEQ ID NO: 4342470 - DNA, 12 bp, Homo sapiens
ccctttccccca

SEQ ID NO: 4342471 - DNA, 13 bp, Homo sapiens
ccctttcccccac

SEQ ID NO: 4342472 - DNA, 20 bp, Homo sapiens
ccctttcccccaccccagag

SEQ ID NO: 4342473 - DNA, 22 bp, Homo sapiens
ccctttcccccaccccagagtt

SEQ ID NO: 4342474 - DNA, 18 bp, Homo sapiens
ccctttctctgcctggca

SEQ ID NO: 4342475 - DNA, 16 bp, Homo sapiens
cccttttttcttcccc

SEQ ID NO: 4342476 - DNA, 16 bp, Homo sapiens
ccgaacattaggaatt

SEQ ID NO: 4342477 - DNA, 14 bp, Homo sapiens
ccgaatatattact

SEQ ID NO: 4342478 - DNA, 17 bp, Homo sapiens
ccgagaaggaagcctcc

SEQ ID NO: 4342479 - DNA, 15 bp, Homo sapiens
ccgagattgcaccac

SEQ ID NO: 4342480 - DNA, 19 bp, Homo sapiens
ccgagattgcaccactgca

SEQ ID NO: 4342481 - DNA, 21 bp, Homo sapiens
ccgagattgcaccactgcact

SEQ ID NO: 4342482 - DNA, 18 bp, Homo sapiens
ccgaggaatgtgaagcca

SEQ ID NO: 4342483 - DNA, 23 bp, Homo sapiens
ccgaggaatgtgaagccagatct

SEQ ID NO: 4342484 - DNA, 13 bp, Homo sapiens
ccgaggagcccca

SEQ ID NO: 4342485 - DNA, 16 bp, Homo sapiens
ccgaggagccccagcc

SEQ ID NO: 4342486 - DNA, 19 bp, Homo sapiens
ccgaggagccccagccccg

SEQ ID NO: 4342487 - DNA, 14 bp, Homo sapiens
ccgaggtgttgcca

SEQ ID NO: 4342488 - DNA, 12 bp, Homo sapiens
ccgcagccacac

SEQ ID NO: 4342489 - DNA, 14 bp, Homo sapiens
ccgcagccacaccg

SEQ ID NO: 4342490 - DNA, 21 bp, Homo sapiens
ccgcagccacaccgctggctc

SEQ ID NO: 4342491 - DNA, 12 bp, Homo sapiens
ccgccaccctgt

SEQ ID NO: 4342492 - DNA, 23 bp, Homo sapiens
ccgccctccacccactaggtgaa

SEQ ID NO: 4342493 - DNA, 13 bp, Homo sapiens
ccgccctgcagca

SEQ ID NO: 4342494 - DNA, 15 bp, Homo sapiens
ccgccgactttgtac

SEQ ID NO: 4342495 - DNA, 10 bp, Homo sapiens
ccgctaattc

SEQ ID NO: 4342496 - DNA, 15 bp, Homo sapiens
ccgctcggaggcccc

SEQ ID NO: 4342497 - DNA, 18 bp, Homo sapiens
ccgctcggaggccccaaa

SEQ ID NO: 4342498 - DNA, 21 bp, Homo sapiens
ccgctcggaggccccaaagga

SEQ ID NO: 4342499 - DNA, 12 bp, Homo sapiens
ccgctggctccg

SEQ ID NO: 4342500 - DNA, 22 bp, Homo sapiens
ccgctggctccgcatggttcat

SEQ ID NO: 4342501 - DNA, 16 bp, Homo sapiens
ccgctttgtctgtcca

SEQ ID NO: 4342502 - DNA, 17 bp, Homo sapiens
ccgctttgtctgtccag

SEQ ID NO: 4342503 - DNA, 18 bp, Homo sapiens
ccggagacccacagccct

SEQ ID NO: 4342504 - DNA, 20 bp, Homo sapiens
ccggcggggtgcctgctgtc

SEQ ID NO: 4342505 - DNA, 23 bp, Homo sapiens
ccgggagactgccagtggagacg

SEQ ID NO: 4342506 - DNA, 14 bp, Homo sapiens
ccgggagagactcg

SEQ ID NO: 4342507 - DNA, 15 bp, Homo sapiens
ccggggcctctgccc

SEQ ID NO: 4342508 - DNA, 19 bp, Homo sapiens
ccgggtttggctgagcctg

SEQ ID NO: 4342509 - DNA, 13 bp, Homo sapiens
ccggtgcagggcc

SEQ ID NO: 4342510 - DNA, 18 bp, Homo sapiens
ccggtgcagggcctggca

SEQ ID NO: 4342511 - DNA, 15 bp, Homo sapiens
ccggtgcatctggca

SEQ ID NO: 4342512 - DNA, 19 bp, Homo sapiens
ccggtgcatctggcacgtg

SEQ ID NO: 4342513 - DNA, 13 bp, Homo sapiens
ccgtcccagaggc

SEQ ID NO: 4342514 - DNA, 14 bp, Homo sapiens
ccgtcccagaggcc

SEQ ID NO: 4342515 - DNA, 19 bp, Homo sapiens
ccgtctttacccctgctga

SEQ ID NO: 4342516 - DNA, 14 bp, Homo sapiens
ccgtgcctgtgtcc

SEQ ID NO: 4342517 - DNA, 16 bp, Homo sapiens
ccgtgtgtgcatgtgc

SEQ ID NO: 4342518 - DNA, 15 bp, Homo sapiens
cctactcctggagca

SEQ ID NO: 4342519 - DNA, 21 bp, Homo sapiens
cctagaggacactaggagact

SEQ ID NO: 4342520 - DNA, 13 bp, Homo sapiens
cctagccccaccc

SEQ ID NO: 4342521 - DNA, 15 bp, Homo sapiens
cctagccccacccag

SEQ ID NO: 4342522 - DNA, 21 bp, Homo sapiens
cctagccccacccagaggtgg

SEQ ID NO: 4342523 - DNA, 22 bp, Homo sapiens
cctagccccacccagaggtggc

SEQ ID NO: 4342524 - DNA, 20 bp, Homo sapiens
cctagcccttctaccccacc

SEQ ID NO: 4342525 - DNA, 22 bp, Homo sapiens
cctagcccttctaccccacctg

SEQ ID NO: 4342526 - DNA, 23 bp, Homo sapiens
cctaggcatttgctgaatacaga

SEQ ID NO: 4342527 - DNA, 17 bp, Homo sapiens
cctatagtatatgatta

SEQ ID NO: 4342528 - DNA, 17 bp, Homo sapiens
cctattagagaagagat

SEQ ID NO: 4342529 - DNA, 12 bp, Homo sapiens
cctcagctccct

SEQ ID NO: 4342530 - DNA, 17 bp, Homo sapiens
cctcagctccctgaccc

SEQ ID NO: 4342531 - DNA, 20 bp, Homo sapiens
cctcagctccctgaccccct

SEQ ID NO: 4342532 - DNA, 12 bp, Homo sapiens
cctcaggcaggt

SEQ ID NO: 4342533 - DNA, 18 bp, Homo sapiens
cctcaggcaggtgggatg

SEQ ID NO: 4342534 - DNA, 17 bp, Homo sapiens
cctcaggtgagaagcag

SEQ ID NO: 4342535 - DNA, 22 bp, Homo sapiens
cctcaggtgagaagcagaggaa

SEQ ID NO: 4342536 - DNA, 13 bp, Homo sapiens
cctcatgccacag

SEQ ID NO: 4342537 - DNA, 15 bp, Homo sapiens
cctccaacccagcag

SEQ ID NO: 4342538 - DNA, 17 bp, Homo sapiens
cctccacaaagagacca

SEQ ID NO: 4342539 - DNA, 12 bp, Homo sapiens
cctccacccact

SEQ ID NO: 4342540 - DNA, 22 bp, Homo sapiens
cctcccatcccgtaagaccacc

SEQ ID NO: 4342541 - DNA, 14 bp, Homo sapiens
cctcccccagagcc

SEQ ID NO: 4342542 - DNA, 16 bp, Homo sapiens
cctcccccagagcccc

SEQ ID NO: 4342543 - DNA, 12 bp, Homo sapiens
cctccctgggat

SEQ ID NO: 4342544 - DNA, 13 bp, Homo sapiens
cctccctgggatg

SEQ ID NO: 4342545 - DNA, 15 bp, Homo sapiens
cctcctaatggcatg

SEQ ID NO: 4342546 - DNA, 21 bp, Homo sapiens
cctcctaatggcatggagact

SEQ ID NO: 4342547 - DNA, 17 bp, Homo sapiens
cctcctgatgtttttcc

SEQ ID NO: 4342548 - DNA, 19 bp, Homo sapiens
cctcctgtgcctccctttt

SEQ ID NO: 4342549 - DNA, 15 bp, Homo sapiens
cctcgacgtcccttg

SEQ ID NO: 4342550 - DNA, 15 bp, Homo sapiens
cctcggctgtctcct

SEQ ID NO: 4342551 - DNA, 17 bp, Homo sapiens
cctcggctgtctcctgt

SEQ ID NO: 4342552 - DNA, 16 bp, Homo sapiens
cctcggtgccttcctc

SEQ ID NO: 4342553 - DNA, 14 bp, Homo sapiens
cctcggtgtggaga

SEQ ID NO: 4342554 - DNA, 18 bp, Homo sapiens
cctcggtgtggagaagcg

SEQ ID NO: 4342555 - DNA, 18 bp, Homo sapiens
cctctccaaatcaaggat

SEQ ID NO: 4342556 - DNA, 16 bp, Homo sapiens
cctctcccacccaagg

SEQ ID NO: 4342557 - DNA, 21 bp, Homo sapiens
cctctccccaatccatgcttc

SEQ ID NO: 4342558 - DNA, 23 bp, Homo sapiens
cctctccccaatccatgcttcac

SEQ ID NO: 4342559 - DNA, 13 bp, Homo sapiens
cctctccttccta

SEQ ID NO: 4342560 - DNA, 19 bp, Homo sapiens
cctctcgtttctgcccagc

SEQ ID NO: 4342561 - DNA, 19 bp, Homo sapiens
cctctctctaagtttagaa

SEQ ID NO: 4342562 - DNA, 13 bp, Homo sapiens
cctctctgtggct

SEQ ID NO: 4342563 - DNA, 17 bp, Homo sapiens
cctctctgtggctccaa

SEQ ID NO: 4342564 - DNA, 18 bp, Homo sapiens
cctctctgtggctccaac

SEQ ID NO: 4342565 - DNA, 15 bp, Homo sapiens
cctctgcacaagctg

SEQ ID NO: 4342566 - DNA, 17 bp, Homo sapiens
cctctgcacaagctgca

SEQ ID NO: 4342567 - DNA, 19 bp, Homo sapiens
cctctgcacaagctgcacc

SEQ ID NO: 4342568 - DNA, 20 bp, Homo sapiens
cctctgctcattaaactgat

SEQ ID NO: 4342569 - DNA, 20 bp, Homo sapiens
cctctggggaagatggagca

SEQ ID NO: 4342570 - DNA, 16 bp, Homo sapiens
cctcttcccagagtca

SEQ ID NO: 4342571 - DNA, 19 bp, Homo sapiens
cctgaaagctgggagcgtg

SEQ ID NO: 4342572 - DNA, 13 bp, Homo sapiens
cctgaccccctgt

SEQ ID NO: 4342573 - DNA, 16 bp, Homo sapiens
cctgaccccctgtcct

SEQ ID NO: 4342574 - DNA, 13 bp, Homo sapiens
cctgacctctgca

SEQ ID NO: 4342575 - DNA, 22 bp, Homo sapiens
cctgacctctgcaagagggggc

SEQ ID NO: 4342576 - DNA, 19 bp, Homo sapiens
cctgaggctctctaagaaa

SEQ ID NO: 4342577 - DNA, 21 bp, Homo sapiens
cctgaggctctctaagaaaag

SEQ ID NO: 4342578 - DNA, 11 bp, Homo sapiens
cctgatggccc

SEQ ID NO: 4342579 - DNA, 22 bp, Homo sapiens
cctgattaccagtctgattata

SEQ ID NO: 4342580 - DNA, 20 bp, Homo sapiens
cctgcaggtccggggaggag

SEQ ID NO: 4342581 - DNA, 21 bp, Homo sapiens
cctgcaggtccggggaggagg

SEQ ID NO: 4342582 - DNA, 16 bp, Homo sapiens
cctgcccagtccccca

SEQ ID NO: 4342583 - DNA, 22 bp, Homo sapiens
cctgcccagtcccccaacccca

SEQ ID NO: 4342584 - DNA, 23 bp, Homo sapiens
cctgcccagtcccccaaccccag

SEQ ID NO: 4342585 - DNA, 14 bp, Homo sapiens
cctgcccagttgga

SEQ ID NO: 4342586 - DNA, 14 bp, Homo sapiens
cctgccccagccca

SEQ ID NO: 4342587 - DNA, 18 bp, Homo sapiens
cctgccccagcccaagtc

SEQ ID NO: 4342588 - DNA, 15 bp, Homo sapiens
cctgccctcaggctc

SEQ ID NO: 4342589 - DNA, 13 bp, Homo sapiens
cctgcccttgtct

SEQ ID NO: 4342590 - DNA, 23 bp, Homo sapiens
cctgcctcccgcctcccgccacc

SEQ ID NO: 4342591 - DNA, 14 bp, Homo sapiens
cctgcctcctgcct

SEQ ID NO: 4342592 - DNA, 18 bp, Homo sapiens
cctgcgattttgcctgtg

SEQ ID NO: 4342593 - DNA, 15 bp, Homo sapiens
cctgcggctgccggg

SEQ ID NO: 4342594 - DNA, 14 bp, Homo sapiens
cctgctccagctgt

SEQ ID NO: 4342595 - DNA, 22 bp, Homo sapiens
cctgctccagctgttcagctgg

SEQ ID NO: 4342596 - DNA, 13 bp, Homo sapiens
cctgctcccagct

SEQ ID NO: 4342597 - DNA, 16 bp, Homo sapiens
cctgctcccagctctc

SEQ ID NO: 4342598 - DNA, 22 bp, Homo sapiens
cctgctcccagctctctctcct

SEQ ID NO: 4342599 - DNA, 16 bp, Homo sapiens
cctgctgcttggagtg

SEQ ID NO: 4342600 - DNA, 20 bp, Homo sapiens
cctgctgcttggagtgcccc

SEQ ID NO: 4342601 - DNA, 21 bp, Homo sapiens
cctgctgcttggagtgcccca

SEQ ID NO: 4342602 - DNA, 16 bp, Homo sapiens
cctgcttctccagcct

SEQ ID NO: 4342603 - DNA, 17 bp, Homo sapiens
cctgcttctccagcctg

SEQ ID NO: 4342604 - DNA, 22 bp, Homo sapiens
cctgcttctccagcctggaccc

SEQ ID NO: 4342605 - DNA, 22 bp, Homo sapiens
cctgcttgagctttctgtgcat

SEQ ID NO: 4342606 - DNA, 24 bp, Homo sapiens
cctgcttgagctttctgtgcatgt

SEQ ID NO: 4342607 - DNA, 12 bp, Homo sapiens
cctggaccccca

SEQ ID NO: 4342608 - DNA, 15 bp, Homo sapiens
cctggacccccagct

SEQ ID NO: 4342609 - DNA, 14 bp, Homo sapiens
cctggactctgtgt

SEQ ID NO: 4342610 - DNA, 22 bp, Homo sapiens
cctggagtctgaagcctgcagg

SEQ ID NO: 4342611 - DNA, 24 bp, Homo sapiens
cctggagtctgaagcctgcaggtc

SEQ ID NO: 4342612 - DNA, 22 bp, Homo sapiens
cctggcaacatcttacttgtcc

SEQ ID NO: 4342613 - DNA, 13 bp, Homo sapiens
cctggcatagagt

SEQ ID NO: 4342614 - DNA, 19 bp, Homo sapiens
cctggcgggatgggccacc

SEQ ID NO: 4342615 - DNA, 21 bp, Homo sapiens
cctggcgggatgggccaccgc

SEQ ID NO: 4342616 - DNA, 20 bp, Homo sapiens
cctgggaggtcaaggctgca

SEQ ID NO: 4342617 - DNA, 18 bp, Homo sapiens
cctgggcggggccgcagc

SEQ ID NO: 4342618 - DNA, 23 bp, Homo sapiens
cctgggcggggccgcagccacac

SEQ ID NO: 4342619 - DNA, 17 bp, Homo sapiens
cctggttcgtgccatgc

SEQ ID NO: 4342620 - DNA, 19 bp, Homo sapiens
cctgtagagtgggagctga

SEQ ID NO: 4342621 - DNA, 14 bp, Homo sapiens
cctgtccccagggg

SEQ ID NO: 4342622 - DNA, 23 bp, Homo sapiens
cctgtccccggcggggtgcctgc

SEQ ID NO: 4342623 - DNA, 14 bp, Homo sapiens
cctgtcccctcagc

SEQ ID NO: 4342624 - DNA, 13 bp, Homo sapiens
cctgtctcctttc

SEQ ID NO: 4342625 - DNA, 15 bp, Homo sapiens
cctgtctgtttatat

SEQ ID NO: 4342626 - DNA, 17 bp, Homo sapiens
cctgttgggggcttcag

SEQ ID NO: 4342627 - DNA, 23 bp, Homo sapiens
cctgttgggggcttcaggtctct

SEQ ID NO: 4342628 - DNA, 23 bp, Homo sapiens
cctgtttgaagcctgcccttgtc

SEQ ID NO: 4342629 - DNA, 18 bp, Homo sapiens
ccttaagcacaattaatt

SEQ ID NO: 4342630 - DNA, 23 bp, Homo sapiens
ccttaagctgtagagagtgggtc

SEQ ID NO: 4342631 - DNA, 23 bp, Homo sapiens
ccttaaggatcaccccagccccc

SEQ ID NO: 4342632 - DNA, 19 bp, Homo sapiens
ccttaccataccactttga

SEQ ID NO: 4342633 - DNA, 12 bp, Homo sapiens
ccttactcacct

SEQ ID NO: 4342634 - DNA, 22 bp, Homo sapiens
ccttagagcatctctgcctcca

SEQ ID NO: 4342635 - DNA, 16 bp, Homo sapiens
ccttcagccatagctt

SEQ ID NO: 4342636 - DNA, 16 bp, Homo sapiens
ccttcctcagcaggcc

SEQ ID NO: 4342637 - DNA, 14 bp, Homo sapiens
ccttcctccctgtc

SEQ ID NO: 4342638 - DNA, 11 bp, Homo sapiens
ccttctgccct

SEQ ID NO: 4342639 - DNA, 20 bp, Homo sapiens
ccttctgggcatctgttctg

SEQ ID NO: 4342640 - DNA, 20 bp, Homo sapiens
ccttctttgcttctttttct

SEQ ID NO: 4342641 - DNA, 23 bp, Homo sapiens
ccttgagttgattcagctctgca

SEQ ID NO: 4342642 - DNA, 15 bp, Homo sapiens
ccttgcccttggagc

SEQ ID NO: 4342643 - DNA, 20 bp, Homo sapiens
ccttgctttttgctgtgtag

SEQ ID NO: 4342644 - DNA, 15 bp, Homo sapiens
ccttggatcagaggt

SEQ ID NO: 4342645 - DNA, 19 bp, Homo sapiens
ccttggatcagaggtcatc

SEQ ID NO: 4342646 - DNA, 17 bp, Homo sapiens
ccttggctctatttggc

SEQ ID NO: 4342647 - DNA, 13 bp, Homo sapiens
ccttgtctgagat

SEQ ID NO: 4342648 - DNA, 21 bp, Homo sapiens
ccttgtgactcagtgtatttt

SEQ ID NO: 4342649 - DNA, 16 bp, Homo sapiens
cctttctctgcctggc

SEQ ID NO: 4342650 - DNA, 16 bp, Homo sapiens
cctttcttgcactgtc

SEQ ID NO: 4342651 - DNA, 13 bp, Homo sapiens
cctttgaggcccc

SEQ ID NO: 4342652 - DNA, 15 bp, Homo sapiens
cctttgttgaaaaat

SEQ ID NO: 4342653 - DNA, 19 bp, Homo sapiens
cctttttatatttaaaaaa

SEQ ID NO: 4342654 - DNA, 13 bp, Homo sapiens
cctttttctggcc

SEQ ID NO: 4342655 - DNA, 19 bp, Homo sapiens
cgaaaacgttgaccccttt

SEQ ID NO: 4342656 - DNA, 20 bp, Homo sapiens
cgaaaacgttgacccctttc

SEQ ID NO: 4342657 - DNA, 22 bp, Homo sapiens
cgaaaacgttgacccctttccc

SEQ ID NO: 4342658 - DNA, 23 bp, Homo sapiens
cgaaacccccttttcccttcagc

SEQ ID NO: 4342659 - DNA, 18 bp, Homo sapiens
cgaaacccggtgcatctg

SEQ ID NO: 4342660 - DNA, 20 bp, Homo sapiens
cgaaaggatgaaagtgacca

SEQ ID NO: 4342661 - DNA, 15 bp, Homo sapiens
cgaacattaggaatt

SEQ ID NO: 4342662 - DNA, 23 bp, Homo sapiens
cgaacattaggaattgtttatac

SEQ ID NO: 4342663 - DNA, 15 bp, Homo sapiens
cgaataaatgttcaa

SEQ ID NO: 4342664 - DNA, 16 bp, Homo sapiens
cgaataaatgttcaaa

SEQ ID NO: 4342665 - DNA, 19 bp, Homo sapiens
cgaataaatgttcaaactg

SEQ ID NO: 4342666 - DNA, 14 bp, Homo sapiens
cgaatatattactg

SEQ ID NO: 4342667 - DNA, 16 bp, Homo sapiens
cgaatatattactgat

SEQ ID NO: 4342668 - DNA, 18 bp, Homo sapiens
cgaattgtgtggagaact

SEQ ID NO: 4342669 - DNA, 18 bp, Homo sapiens
cgacccttttgagcctag

SEQ ID NO: 4342670 - DNA, 17 bp, Homo sapiens
cgaggaatgtgaagcca

SEQ ID NO: 4342671 - DNA, 13 bp, Homo sapiens
cgaggagccccag

SEQ ID NO: 4342672 - DNA, 19 bp, Homo sapiens
cgaggagccccagccccgt

SEQ ID NO: 4342673 - DNA, 12 bp, Homo sapiens
cgatccatgttt

SEQ ID NO: 4342674 - DNA, 13 bp, Homo sapiens
cgcaactgaagga

SEQ ID NO: 4342675 - DNA, 14 bp, Homo sapiens
cgcaagagggacag

SEQ ID NO: 4342676 - DNA, 19 bp, Homo sapiens
cgcaagagggacagagccc

SEQ ID NO: 4342677 - DNA, 16 bp, Homo sapiens
cgcacttacctgcttg

SEQ ID NO: 4342678 - DNA, 21 bp, Homo sapiens
cgcagcttcctgtctgtttat

SEQ ID NO: 4342679 - DNA, 12 bp, Homo sapiens
cgccaaggctgg

SEQ ID NO: 4342680 - DNA, 22 bp, Homo sapiens
cgccatctgtgcacactaagaa

SEQ ID NO: 4342681 - DNA, 17 bp, Homo sapiens
cgccccctccctgctcc

SEQ ID NO: 4342682 - DNA, 18 bp, Homo sapiens
cgccccctccctgctccc

SEQ ID NO: 4342683 - DNA, 13 bp, Homo sapiens
cgccctccaccca

SEQ ID NO: 4342684 - DNA, 12 bp, Homo sapiens
cgccctgccctt

SEQ ID NO: 4342685 - DNA, 15 bp, Homo sapiens
cgccctgcccttccc

SEQ ID NO: 4342686 - DNA, 18 bp, Homo sapiens
cgccgactttgtaccccc

SEQ ID NO: 4342687 - DNA, 21 bp, Homo sapiens
cgcctactaagtacccttggg

SEQ ID NO: 4342688 - DNA, 14 bp, Homo sapiens
cgcctcccgccacc

SEQ ID NO: 4342689 - DNA, 19 bp, Homo sapiens
cgcggtggctcacgcctgt

SEQ ID NO: 4342690 - DNA, 22 bp, Homo sapiens
cgctaattcatacctccctcct

SEQ ID NO: 4342691 - DNA, 11 bp, Homo sapiens
cgctcatctgg

SEQ ID NO: 4342692 - DNA, 20 bp, Homo sapiens
cgctcggaggccccaaagga

SEQ ID NO: 4342693 - DNA, 19 bp, Homo sapiens
cgctctcttttctgtactt

SEQ ID NO: 4342694 - DNA, 12 bp, Homo sapiens
cgctgcccctga

SEQ ID NO: 4342695 - DNA, 21 bp, Homo sapiens
cgctgttgcccgccctccacc

SEQ ID NO: 4342696 - DNA, 23 bp, Homo sapiens
cgcttgcttctgcagcaactccc

SEQ ID NO: 4342697 - DNA, 22 bp, Homo sapiens
cgctttcatgttactgttgcag

SEQ ID NO: 4342698 - DNA, 15 bp, Homo sapiens
cgctttgtctgtcca

SEQ ID NO: 4342699 - DNA, 21 bp, Homo sapiens
cgctttgtctgtccagccgtg

SEQ ID NO: 4342700 - DNA, 22 bp, Homo sapiens
cggaagaaccagaagtgcagcc

SEQ ID NO: 4342701 - DNA, 13 bp, Homo sapiens
cggaagagccttg

SEQ ID NO: 4342702 - DNA, 21 bp, Homo sapiens
cggaatcactctgtccttgga

SEQ ID NO: 4342703 - DNA, 13 bp, Homo sapiens
cggagctcctggc

SEQ ID NO: 4342704 - DNA, 15 bp, Homo sapiens
cggagctcctggcag

SEQ ID NO: 4342705 - DNA, 22 bp, Homo sapiens
cggatgataactactgacgaaa

SEQ ID NO: 4342706 - DNA, 20 bp, Homo sapiens
cggcttcgttagaccgctct

SEQ ID NO: 4342707 - DNA, 20 bp, Homo sapiens
cggcttcttggaccttggcg

SEQ ID NO: 4342708 - DNA, 23 bp, Homo sapiens
cgggaaaaaactttgctccaggc

SEQ ID NO: 4342709 - DNA, 17 bp, Homo sapiens
cgggactgggggcggga

SEQ ID NO: 4342710 - DNA, 19 bp, Homo sapiens
cgggagcattggcccctga

SEQ ID NO: 4342711 - DNA, 13 bp, Homo sapiens
cgggattccctgg

SEQ ID NO: 4342712 - DNA, 10 bp, Homo sapiens
cggggaccag

SEQ ID NO: 4342713 - DNA, 15 bp, Homo sapiens
cggggcagagccacc

SEQ ID NO: 4342714 - DNA, 16 bp, Homo sapiens
cggggcaggtgcagcc

SEQ ID NO: 4342715 - DNA, 14 bp, Homo sapiens
cggggccgggactg

SEQ ID NO: 4342716 - DNA, 15 bp, Homo sapiens
cggggccgggactgg

SEQ ID NO: 4342717 - DNA, 22 bp, Homo sapiens
cggggcctggcgggatgggcca

SEQ ID NO: 4342718 - DNA, 20 bp, Homo sapiens
cggtggctcacgcctgtaat

SEQ ID NO: 4342719 - DNA, 19 bp, Homo sapiens
cggtggggggatgagatta

SEQ ID NO: 4342720 - DNA, 16 bp, Homo sapiens
cggttttactgcagct

SEQ ID NO: 4342721 - DNA, 17 bp, Homo sapiens
cgtaagaccaccttccc

SEQ ID NO: 4342722 - DNA, 22 bp, Homo sapiens
cgtaagaccaccttcccttcct

SEQ ID NO: 4342723 - DNA, 23 bp, Homo sapiens
cgtaggggaggggttgccacagg

SEQ ID NO: 4342724 - DNA, 17 bp, Homo sapiens
cgtataatgctttctga

SEQ ID NO: 4342725 - DNA, 17 bp, Homo sapiens
cgtatttagccattacc

SEQ ID NO: 4342726 - DNA, 16 bp, Homo sapiens
cgtccactcccaagcc

SEQ ID NO: 4342727 - DNA, 11 bp, Homo sapiens
cgtcccagagg

SEQ ID NO: 4342728 - DNA, 12 bp, Homo sapiens
cgtcccagaggc

SEQ ID NO: 4342729 - DNA, 13 bp, Homo sapiens
cgtcccagaggcc

SEQ ID NO: 4342730 - DNA, 21 bp, Homo sapiens
cgtcccttggatcagaggtca

SEQ ID NO: 4342731 - DNA, 20 bp, Homo sapiens
cgtctggaggggcccctgct

SEQ ID NO: 4342732 - DNA, 17 bp, Homo sapiens
cgtctttacccctgctg

SEQ ID NO: 4342733 - DNA, 16 bp, Homo sapiens
cgtgcttgctggtgcc

SEQ ID NO: 4342734 - DNA, 13 bp, Homo sapiens
cgtggccaggagc

SEQ ID NO: 4342735 - DNA, 14 bp, Homo sapiens
cgtggccaggagcc

SEQ ID NO: 4342736 - DNA, 15 bp, Homo sapiens
cgtgggctcagcagg

SEQ ID NO: 4342737 - DNA, 18 bp, Homo sapiens
cgtgggctcagcagggct

SEQ ID NO: 4342738 - DNA, 23 bp, Homo sapiens
cgtgtccacagagtttgtagtaa

SEQ ID NO: 4342739 - DNA, 15 bp, Homo sapiens
cgtgtgtgcatgtgc

SEQ ID NO: 4342740 - DNA, 18 bp, Homo sapiens
cgttgacccctttccccc

SEQ ID NO: 4342741 - DNA, 22 bp, Homo sapiens
cgttgacccctttcccccaccc

SEQ ID NO: 4342742 - DNA, 14 bp, Homo sapiens
cgttgggtcccttg

SEQ ID NO: 4342743 - DNA, 12 bp, Homo sapiens
cgttgtgcctgg

SEQ ID NO: 4342744 - DNA, 19 bp, Homo sapiens
cgttttccaaactgactca

SEQ ID NO: 4342745 - DNA, 18 bp, Homo sapiens
cgttttgtattgcttcct

SEQ ID NO: 4342746 - DNA, 19 bp, Homo sapiens
ctaaaagagatctgggcat

SEQ ID NO: 4342747 - DNA, 20 bp, Homo sapiens
ctaaaagttaagtgtcattt

SEQ ID NO: 4342748 - DNA, 18 bp, Homo sapiens
ctaaaatggacattttct

SEQ ID NO: 4342749 - DNA, 16 bp, Homo sapiens
ctaaagaaactgctta

SEQ ID NO: 4342750 - DNA, 18 bp, Homo sapiens
ctaaagactaacttgaaa

SEQ ID NO: 4342751 - DNA, 14 bp, Homo sapiens
ctaaagttgaaaat

SEQ ID NO: 4342752 - DNA, 23 bp, Homo sapiens
ctaaatggtatggccaaaagtca

SEQ ID NO: 4342753 - DNA, 14 bp, Homo sapiens
ctaaattataaaat

SEQ ID NO: 4342754 - DNA, 23 bp, Homo sapiens
ctaaattataaaattgaaaacac

SEQ ID NO: 4342755 - DNA, 17 bp, Homo sapiens
ctaaattctactctaaa

SEQ ID NO: 4342756 - DNA, 16 bp, Homo sapiens
ctaaattctataaaaa

SEQ ID NO: 4342757 - DNA, 19 bp, Homo sapiens
ctaaattctataaaaacca

SEQ ID NO: 4342758 - DNA, 18 bp, Homo sapiens
ctaactgggaagaacaag

SEQ ID NO: 4342759 - DNA, 12 bp, Homo sapiens
ctaactgtgatt

SEQ ID NO: 4342760 - DNA, 14 bp, Homo sapiens
ctaactgtgatttg

SEQ ID NO: 4342761 - DNA, 18 bp, Homo sapiens
ctaagagtcctgggtaaa

SEQ ID NO: 4342762 - DNA, 22 bp, Homo sapiens
ctaagagtcctgggtaaatgtg

SEQ ID NO: 4342763 - DNA, 16 bp, Homo sapiens
ctaagctaaagaaact

SEQ ID NO: 4342764 - DNA, 15 bp, Homo sapiens
ctaagctgccctgag

SEQ ID NO: 4342765 - DNA, 13 bp, Homo sapiens
ctaagtgagagtt

SEQ ID NO: 4342766 - DNA, 23 bp, Homo sapiens
ctaatatactttttttgttatag

SEQ ID NO: 4342767 - DNA, 18 bp, Homo sapiens
ctaatcatgtttctccca

SEQ ID NO: 4342768 - DNA, 22 bp, Homo sapiens
ctaatgagttgctggaaaatca

SEQ ID NO: 4342769 - DNA, 23 bp, Homo sapiens
ctaatggagtgtttgaaaactga

SEQ ID NO: 4342770 - DNA, 17 bp, Homo sapiens
ctaatggcatggagact

SEQ ID NO: 4342771 - DNA, 20 bp, Homo sapiens
ctaatgttctaaattctata

SEQ ID NO: 4342772 - DNA, 19 bp, Homo sapiens
ctaattatcaatgggatat

SEQ ID NO: 4342773 - DNA, 17 bp, Homo sapiens
ctaattcagcatgtgtt

SEQ ID NO: 4342774 - DNA, 12 bp, Homo sapiens
ctaattccttaa

SEQ ID NO: 4342775 - DNA, 17 bp, Homo sapiens
ctaattccttaaatgaa

SEQ ID NO: 4342776 - DNA, 19 bp, Homo sapiens
ctaattccttaaatgaact

SEQ ID NO: 4342777 - DNA, 22 bp, Homo sapiens
ctaatttattgccgtcctggac

SEQ ID NO: 4342778 - DNA, 12 bp, Homo sapiens
ctacaatttcta

SEQ ID NO: 4342779 - DNA, 19 bp, Homo sapiens
ctacagcactactgggtgt

SEQ ID NO: 4342780 - DNA, 22 bp, Homo sapiens
ctacagcactactgggtgtcat

SEQ ID NO: 4342781 - DNA, 12 bp, Homo sapiens
ctacagtacaat

SEQ ID NO: 4342782 - DNA, 13 bp, Homo sapiens
ctacatctgcctc

SEQ ID NO: 4342783 - DNA, 12 bp, Homo sapiens
ctacattaaaca

SEQ ID NO: 4342784 - DNA, 20 bp, Homo sapiens
ctacattaaacaatgatcac

SEQ ID NO: 4342785 - DNA, 13 bp, Homo sapiens
ctacattcttggt

SEQ ID NO: 4342786 - DNA, 19 bp, Homo sapiens
ctacattcttggttgttaa

SEQ ID NO: 4342787 - DNA, 22 bp, Homo sapiens
ctaccacgggtctgccatgctc

SEQ ID NO: 4342788 - DNA, 18 bp, Homo sapiens
ctaccatcccctgtagag

SEQ ID NO: 4342789 - DNA, 17 bp, Homo sapiens
ctaccctcttagaaaaa

SEQ ID NO: 4342790 - DNA, 14 bp, Homo sapiens
ctaccctgtgtata

SEQ ID NO: 4342791 - DNA, 20 bp, Homo sapiens
ctactcaaacacttattgtt

SEQ ID NO: 4342792 - DNA, 12 bp, Homo sapiens
ctactcctggag

SEQ ID NO: 4342793 - DNA, 14 bp, Homo sapiens
ctactcctggagca

SEQ ID NO: 4342794 - DNA, 13 bp, Homo sapiens
ctactctgcccac

SEQ ID NO: 4342795 - DNA, 23 bp, Homo sapiens
ctactgaagggaacagcctgagc

SEQ ID NO: 4342796 - DNA, 15 bp, Homo sapiens
ctactgacgaaagag

SEQ ID NO: 4342797 - DNA, 16 bp, Homo sapiens
ctactgggtgtcattt

SEQ ID NO: 4342798 - DNA, 18 bp, Homo sapiens
ctactgggtgtcatttca

SEQ ID NO: 4342799 - DNA, 19 bp, Homo sapiens
ctactgggtgtcatttcat

SEQ ID NO: 4342800 - DNA, 23 bp, Homo sapiens
ctactgggtgtcatttcattcca

SEQ ID NO: 4342801 - DNA, 15 bp, Homo sapiens
ctagagaatgcacag

SEQ ID NO: 4342802 - DNA, 21 bp, Homo sapiens
ctagagaatgcacagatatac

SEQ ID NO: 4342803 - DNA, 23 bp, Homo sapiens
ctagaggacactaggagactggt

SEQ ID NO: 4342804 - DNA, 23 bp, Homo sapiens
ctagcagcagggagggcttctgc

SEQ ID NO: 4342805 - DNA, 15 bp, Homo sapiens
ctagcatttatttct

SEQ ID NO: 4342806 - DNA, 19 bp, Homo sapiens
ctagcatttatttctctgg

SEQ ID NO: 4342807 - DNA, 20 bp, Homo sapiens
ctagcatttatttctctggc

SEQ ID NO: 4342808 - DNA, 18 bp, Homo sapiens
ctagccccacccagaggt

SEQ ID NO: 4342809 - DNA, 21 bp, Homo sapiens
ctagccccacccagaggtggc

SEQ ID NO: 4342810 - DNA, 17 bp, Homo sapiens
ctagcccttctacccca

SEQ ID NO: 4342811 - DNA, 17 bp, Homo sapiens
ctaggaattctttgcat

SEQ ID NO: 4342812 - DNA, 12 bp, Homo sapiens
ctaggagactgg

SEQ ID NO: 4342813 - DNA, 21 bp, Homo sapiens
ctaggatgggagagctagaaa

SEQ ID NO: 4342814 - DNA, 21 bp, Homo sapiens
ctagggaaaaaccagcgtgtg

SEQ ID NO: 4342815 - DNA, 16 bp, Homo sapiens
ctaggtgaacagcagg

SEQ ID NO: 4342816 - DNA, 20 bp, Homo sapiens
ctaggtgaacagcaggatgc

SEQ ID NO: 4342817 - DNA, 21 bp, Homo sapiens
ctagtaagtaattatgcacta

SEQ ID NO: 4342818 - DNA, 22 bp, Homo sapiens
ctagtcaactggggaaaaggat

SEQ ID NO: 4342819 - DNA, 17 bp, Homo sapiens
ctagtgccaaataattg

SEQ ID NO: 4342820 - DNA, 19 bp, Homo sapiens
ctagtgccaaataattgat

SEQ ID NO: 4342821 - DNA, 21 bp, Homo sapiens
ctagttgtctgaattgagaaa

SEQ ID NO: 4342822 - DNA, 16 bp, Homo sapiens
ctagtttccctggtgc

SEQ ID NO: 4342823 - DNA, 19 bp, Homo sapiens
ctataaagaaacttttgaa

SEQ ID NO: 4342824 - DNA, 21 bp, Homo sapiens
ctataaagaaacttttgaaaa

SEQ ID NO: 4342825 - DNA, 16 bp, Homo sapiens
ctataagtgttcagtg

SEQ ID NO: 4342826 - DNA, 22 bp, Homo sapiens
ctataagtgttcagtgttgaca

SEQ ID NO: 4342827 - DNA, 14 bp, Homo sapiens
ctatacctgccttt

SEQ ID NO: 4342828 - DNA, 19 bp, Homo sapiens
ctatacctgccttttaagt

SEQ ID NO: 4342829 - DNA, 16 bp, Homo sapiens
ctatagtgaagaatag

SEQ ID NO: 4342830 - DNA, 19 bp, Homo sapiens
ctatattaaatgagggttt

SEQ ID NO: 4342831 - DNA, 16 bp, Homo sapiens
ctatatttttaaagaa

SEQ ID NO: 4342832 - DNA, 17 bp, Homo sapiens
ctatatttttaaagaag

SEQ ID NO: 4342833 - DNA, 20 bp, Homo sapiens
ctatccaaacatgtatttat

SEQ ID NO: 4342834 - DNA, 13 bp, Homo sapiens
ctatcggaagaac

SEQ ID NO: 4342835 - DNA, 20 bp, Homo sapiens
ctatcggtttagccttttaa

SEQ ID NO: 4342836 - DNA, 17 bp, Homo sapiens
ctatctatacctgcctt

SEQ ID NO: 4342837 - DNA, 21 bp, Homo sapiens
ctatgctaaacctcctgcctc

SEQ ID NO: 4342838 - DNA, 19 bp, Homo sapiens
ctatggagactttgctgtt

SEQ ID NO: 4342839 - DNA, 23 bp, Homo sapiens
ctatggagactttgctgttactg

SEQ ID NO: 4342840 - DNA, 15 bp, Homo sapiens
ctatgtagaatgtct

SEQ ID NO: 4342841 - DNA, 16 bp, Homo sapiens
ctatgtagaatgtctt

SEQ ID NO: 4342842 - DNA, 22 bp, Homo sapiens
ctatgtgcgaagcaagaagaat

SEQ ID NO: 4342843 - DNA, 18 bp, Homo sapiens
ctatgtgtgcttatacaa

SEQ ID NO: 4342844 - DNA, 15 bp, Homo sapiens
ctattattgaaatag

SEQ ID NO: 4342845 - DNA, 20 bp, Homo sapiens
ctattgggccctagaggaca

SEQ ID NO: 4342846 - DNA, 16 bp, Homo sapiens
ctattgtctttcattt

SEQ ID NO: 4342847 - DNA, 24 bp, Homo sapiens
ctatttatatatcatagtataaat

SEQ ID NO: 4342848 - DNA, 17 bp, Homo sapiens
ctattttgttttaatct

SEQ ID NO: 4342849 - DNA, 21 bp, Homo sapiens
ctatttttgtaaactggaatt

SEQ ID NO: 4342850 - DNA, 17 bp, Homo sapiens
ctattttttaataaaag

SEQ ID NO: 4342851 - DNA, 18 bp, Homo sapiens
ctattttttttaaatcaa

SEQ ID NO: 4342852 - DNA, 18 bp, Homo sapiens
ctcaaaagctgggcaggt

SEQ ID NO: 4342853 - DNA, 17 bp, Homo sapiens
ctcaaacacttattgtt

SEQ ID NO: 4342854 - DNA, 23 bp, Homo sapiens
ctcaagtgtcacctccttcccca

SEQ ID NO: 4342855 - DNA, 21 bp, Homo sapiens
ctcacaggcagctctgagccg

SEQ ID NO: 4342856 - DNA, 22 bp, Homo sapiens
ctcactgccatgccagcttatc

SEQ ID NO: 4342857 - DNA, 21 bp, Homo sapiens
ctcagactgtggaaccaaagc

SEQ ID NO: 4342858 - DNA, 20 bp, Homo sapiens
ctcagcccagaagaaaattc

SEQ ID NO: 4342859 - DNA, 10 bp, Homo sapiens
ctcagctccc

SEQ ID NO: 4342860 - DNA, 11 bp, Homo sapiens
ctcagctcccc

SEQ ID NO: 4342861 - DNA, 20 bp, Homo sapiens
ctcagctccccctgtcccct

SEQ ID NO: 4342862 - DNA, 20 bp, Homo sapiens
ctcaggaggcgaataaatgt

SEQ ID NO: 4342863 - DNA, 15 bp, Homo sapiens
ctcaggcaggtggga

SEQ ID NO: 4342864 - DNA, 14 bp, Homo sapiens
ctcaggctccccag

SEQ ID NO: 4342865 - DNA, 15 bp, Homo sapiens
ctcaggctccccagt

SEQ ID NO: 4342866 - DNA, 15 bp, Homo sapiens
ctcagggcctggtcg

SEQ ID NO: 4342867 - DNA, 14 bp, Homo sapiens
ctcaggtgagaagc

SEQ ID NO: 4342868 - DNA, 19 bp, Homo sapiens
ctcaggtgagaagcagagg

SEQ ID NO: 4342869 - DNA, 20 bp, Homo sapiens
ctcaggtgagaagcagagga

SEQ ID NO: 4342870 - DNA, 15 bp, Homo sapiens
ctcagtgccacacct

SEQ ID NO: 4342871 - DNA, 15 bp, Homo sapiens
ctcagtgtattttaa

SEQ ID NO: 4342872 - DNA, 17 bp, Homo sapiens
ctcagttgcagaaaatg

SEQ ID NO: 4342873 - DNA, 20 bp, Homo sapiens
ctcagttgcagaaaatgaac

SEQ ID NO: 4342874 - DNA, 21 bp, Homo sapiens
ctcataattcctacagcacta

SEQ ID NO: 4342875 - DNA, 16 bp, Homo sapiens
ctcatcttgtgaaatg

SEQ ID NO: 4342876 - DNA, 21 bp, Homo sapiens
ctcatgtgcgtttcatgtgtt

SEQ ID NO: 4342877 - DNA, 21 bp, Homo sapiens
ctcattagcattttgctaaat

SEQ ID NO: 4342878 - DNA, 23 bp, Homo sapiens
ctcattattttgaggtagaggaa

SEQ ID NO: 4342879 - DNA, 13 bp, Homo sapiens
ctccaaatcaagg

SEQ ID NO: 4342880 - DNA, 18 bp, Homo sapiens
ctccaaatcaaggatctt

SEQ ID NO: 4342881 - DNA, 12 bp, Homo sapiens
ctccacccacta

SEQ ID NO: 4342882 - DNA, 19 bp, Homo sapiens
ctccagctgttcagctggt

SEQ ID NO: 4342883 - DNA, 15 bp, Homo sapiens
ctcccaaaagaatgg

SEQ ID NO: 4342884 - DNA, 13 bp, Homo sapiens
ctcccaagccact

SEQ ID NO: 4342885 - DNA, 13 bp, Homo sapiens
ctcccacccaagg

SEQ ID NO: 4342886 - DNA, 19 bp, Homo sapiens
ctcccagctctctctcctg

SEQ ID NO: 4342887 - DNA, 16 bp, Homo sapiens
ctcccaggcctctgcc

SEQ ID NO: 4342888 - DNA, 17 bp, Homo sapiens
ctcccaggcctctgccc

SEQ ID NO: 4342889 - DNA, 21 bp, Homo sapiens
ctccccagtgctcctggccct

SEQ ID NO: 4342890 - DNA, 12 bp, Homo sapiens
ctcccccaggca

SEQ ID NO: 4342891 - DNA, 13 bp, Homo sapiens
ctccccctgctgc

SEQ ID NO: 4342892 - DNA, 16 bp, Homo sapiens
ctccccgccccctgaa

SEQ ID NO: 4342893 - DNA, 17 bp, Homo sapiens
ctccccgccccctgaaa

SEQ ID NO: 4342894 - DNA, 19 bp, Homo sapiens
ctcccctccccgccccctg

SEQ ID NO: 4342895 - DNA, 13 bp, Homo sapiens
ctcccgccaccct

SEQ ID NO: 4342896 - DNA, 19 bp, Homo sapiens
ctcccgccaccctgtctca

SEQ ID NO: 4342897 - DNA, 22 bp, Homo sapiens
ctcccgcctcccgccaccctgt

SEQ ID NO: 4342898 - DNA, 14 bp, Homo sapiens
ctccctcaacaagg

SEQ ID NO: 4342899 - DNA, 13 bp, Homo sapiens
ctccctgctccca

SEQ ID NO: 4342900 - DNA, 15 bp, Homo sapiens
ctccctgctcccagc

SEQ ID NO: 4342901 - DNA, 17 bp, Homo sapiens
ctcccttctttgcttct

SEQ ID NO: 4342902 - DNA, 17 bp, Homo sapiens
ctccctttcttccctac

SEQ ID NO: 4342903 - DNA, 15 bp, Homo sapiens
ctcccttttctcctc

SEQ ID NO: 4342904 - DNA, 20 bp, Homo sapiens
ctcctaatggcatggagact

SEQ ID NO: 4342905 - DNA, 19 bp, Homo sapiens
ctcctatttttgtaaactg

SEQ ID NO: 4342906 - DNA, 13 bp, Homo sapiens
ctcctccctggga

SEQ ID NO: 4342907 - DNA, 21 bp, Homo sapiens
ctcctccctgggatggacgct

SEQ ID NO: 4342908 - DNA, 15 bp, Homo sapiens
ctcctctcctggaaa

SEQ ID NO: 4342909 - DNA, 15 bp, Homo sapiens
ctcctgcactgttta

SEQ ID NO: 4342910 - DNA, 18 bp, Homo sapiens
ctcctgcccagtccccca

SEQ ID NO: 4342911 - DNA, 17 bp, Homo sapiens
ctcctgccctttcccag

SEQ ID NO: 4342912 - DNA, 18 bp, Homo sapiens
ctcctggcccactgcatc

SEQ ID NO: 4342913 - DNA, 16 bp, Homo sapiens
ctccttccccagctcc

SEQ ID NO: 4342914 - DNA, 16 bp, Homo sapiens
ctccttttccttacca

SEQ ID NO: 4342915 - DNA, 19 bp, Homo sapiens
ctcgatccaaattgtgctt

SEQ ID NO: 4342916 - DNA, 19 bp, Homo sapiens
ctcgcctactaagtaccct

SEQ ID NO: 4342917 - DNA, 18 bp, Homo sapiens
ctcggaggccccaaagga

SEQ ID NO: 4342918 - DNA, 16 bp, Homo sapiens
ctcggtgtggagaagc

SEQ ID NO: 4342919 - DNA, 18 bp, Homo sapiens
ctctaaaatggacatttt

SEQ ID NO: 4342920 - DNA, 19 bp, Homo sapiens
ctctaaaatggacattttc

SEQ ID NO: 4342921 - DNA, 13 bp, Homo sapiens
ctctaagaaaaga

SEQ ID NO: 4342922 - DNA, 18 bp, Homo sapiens
ctctaagaaaagagagga

SEQ ID NO: 4342923 - DNA, 14 bp, Homo sapiens
ctctataaagaaac

SEQ ID NO: 4342924 - DNA, 20 bp, Homo sapiens
ctctataagtgttcagtgtt

SEQ ID NO: 4342925 - DNA, 16 bp, Homo sapiens
ctctcaaatgatacag

SEQ ID NO: 4342926 - DNA, 16 bp, Homo sapiens
ctctcaatatgcttac

SEQ ID NO: 4342927 - DNA, 14 bp, Homo sapiens
ctctcagcccagaa

SEQ ID NO: 4342928 - DNA, 15 bp, Homo sapiens
ctctccacacggagc

SEQ ID NO: 4342929 - DNA, 16 bp, Homo sapiens
ctctccacacggagct

SEQ ID NO: 4342930 - DNA, 21 bp, Homo sapiens
ctctccacacggagctcctgg

SEQ ID NO: 4342931 - DNA, 15 bp, Homo sapiens
ctctcccacccaagg

SEQ ID NO: 4342932 - DNA, 17 bp, Homo sapiens
ctctcccacccaaggag

SEQ ID NO: 4342933 - DNA, 14 bp, Homo sapiens
ctctcctcctccat

SEQ ID NO: 4342934 - DNA, 18 bp, Homo sapiens
ctctccttttccttacca

SEQ ID NO: 4342935 - DNA, 14 bp, Homo sapiens
ctctctaagaaaag

SEQ ID NO: 4342936 - DNA, 15 bp, Homo sapiens
ctctctaagaaaaga

SEQ ID NO: 4342937 - DNA, 19 bp, Homo sapiens
ctctctataagtgttcagt

SEQ ID NO: 4342938 - DNA, 20 bp, Homo sapiens
ctctctataagtgttcagtg

SEQ ID NO: 4342939 - DNA, 18 bp, Homo sapiens
ctctctccacacggagct

SEQ ID NO: 4342940 - DNA, 13 bp, Homo sapiens
ctctctctcctgg

SEQ ID NO: 4342941 - DNA, 15 bp, Homo sapiens
ctctctgtggctcca

SEQ ID NO: 4342942 - DNA, 22 bp, Homo sapiens
ctctcttcagactctcagccca

SEQ ID NO: 4342943 - DNA, 23 bp, Homo sapiens
ctctcttcagactctcagcccag

SEQ ID NO: 4342944 - DNA, 14 bp, Homo sapiens
ctctctttgttctc

SEQ ID NO: 4342945 - DNA, 19 bp, Homo sapiens
ctctctttgttctcagctc

SEQ ID NO: 4342946 - DNA, 12 bp, Homo sapiens
ctctcttttctg

SEQ ID NO: 4342947 - DNA, 18 bp, Homo sapiens
ctctcttttctgtacttc

SEQ ID NO: 4342948 - DNA, 12 bp, Homo sapiens
ctctctttttct

SEQ ID NO: 4342949 - DNA, 22 bp, Homo sapiens
ctctgaatgctgagctgaagaa

SEQ ID NO: 4342950 - DNA, 23 bp, Homo sapiens
ctctgactgatggtttggaaaat

SEQ ID NO: 4342951 - DNA, 22 bp, Homo sapiens
ctctgagagcgaattgtgtgga

SEQ ID NO: 4342952 - DNA, 10 bp, Homo sapiens
ctctgcacaa

SEQ ID NO: 4342953 - DNA, 19 bp, Homo sapiens
ctctgcacaagctgcaccc

SEQ ID NO: 4342954 - DNA, 20 bp, Homo sapiens
ctctgcacaagctgcaccct

SEQ ID NO: 4342955 - DNA, 15 bp, Homo sapiens
ctctgcatctgactc

SEQ ID NO: 4342956 - DNA, 16 bp, Homo sapiens
ctctgccccaagagca

SEQ ID NO: 4342957 - DNA, 21 bp, Homo sapiens
ctctgcccccattgattttta

SEQ ID NO: 4342958 - DNA, 12 bp, Homo sapiens
ctctgcctggca

SEQ ID NO: 4342959 - DNA, 11 bp, Homo sapiens
ctctgcctggg

SEQ ID NO: 4342960 - DNA, 17 bp, Homo sapiens
ctctgcctgggatgccc

SEQ ID NO: 4342961 - DNA, 18 bp, Homo sapiens
ctctgcctgggatgccct

SEQ ID NO: 4342962 - DNA, 19 bp, Homo sapiens
ctctgcctgggatgccctt

SEQ ID NO: 4342963 - DNA, 15 bp, Homo sapiens
ctctggcaaactttt

SEQ ID NO: 4342964 - DNA, 16 bp, Homo sapiens
ctctgtgattacctct

SEQ ID NO: 4342965 - DNA, 21 bp, Homo sapiens
ctctgtggccaggagccctgg

SEQ ID NO: 4342966 - DNA, 17 bp, Homo sapiens
ctctgtggctccaaccc

SEQ ID NO: 4342967 - DNA, 13 bp, Homo sapiens
ctcttaaaaccca

SEQ ID NO: 4342968 - DNA, 24 bp, Homo sapiens
ctcttaaaacccaagtgccttagc

SEQ ID NO: 4342969 - DNA, 23 bp, Homo sapiens
ctcttcagactctcagcccagaa

SEQ ID NO: 4342970 - DNA, 15 bp, Homo sapiens
ctcttccacctctgg

SEQ ID NO: 4342971 - DNA, 16 bp, Homo sapiens
ctcttccacctctggg

SEQ ID NO: 4342972 - DNA, 13 bp, Homo sapiens
ctcttgagcctgg

SEQ ID NO: 4342973 - DNA, 16 bp, Homo sapiens
ctcttgagcctgggag

SEQ ID NO: 4342974 - DNA, 19 bp, Homo sapiens
ctcttggaaatgttaagaa

SEQ ID NO: 4342975 - DNA, 15 bp, Homo sapiens
ctctttgccctgagg

SEQ ID NO: 4342976 - DNA, 19 bp, Homo sapiens
ctctttgccttgatgttgt

SEQ ID NO: 4342977 - DNA, 20 bp, Homo sapiens
ctctttgccttgatgttgtg

SEQ ID NO: 4342978 - DNA, 18 bp, Homo sapiens
ctctttggacactcacac

SEQ ID NO: 4342979 - DNA, 18 bp, Homo sapiens
ctcttttgaggtccctgt

SEQ ID NO: 4342980 - DNA, 20 bp, Homo sapiens
ctcttttgaggtccctgtat

SEQ ID NO: 4342981 - DNA, 16 bp, Homo sapiens
ctctttttcttttcta

SEQ ID NO: 4342982 - DNA, 19 bp, Homo sapiens
ctcttttttgtttgtttct

SEQ ID NO: 4342983 - DNA, 22 bp, Homo sapiens
ctgaaacatgtgcccctgccaa

SEQ ID NO: 4342984 - DNA, 16 bp, Homo sapiens
ctgaaacgagaagtgc

SEQ ID NO: 4342985 - DNA, 19 bp, Homo sapiens
ctgaaacgagaagtgccct

SEQ ID NO: 4342986 - DNA, 23 bp, Homo sapiens
ctgaaagccctgagctttctgct

SEQ ID NO: 4342987 - DNA, 13 bp, Homo sapiens
ctgaaataaaaat

SEQ ID NO: 4342988 - DNA, 21 bp, Homo sapiens
ctgaacctgggtaactaggga

SEQ ID NO: 4342989 - DNA, 15 bp, Homo sapiens
ctgaagcctgcaggt

SEQ ID NO: 4342990 - DNA, 11 bp, Homo sapiens
ctgaagctggg

SEQ ID NO: 4342991 - DNA, 12 bp, Homo sapiens
ctgaagctgggg

SEQ ID NO: 4342992 - DNA, 14 bp, Homo sapiens
ctgaagctggggct

SEQ ID NO: 4342993 - DNA, 18 bp, Homo sapiens
ctgaaggattaatgaaaa

SEQ ID NO: 4342994 - DNA, 15 bp, Homo sapiens
ctgaagggaacagcc

SEQ ID NO: 4342995 - DNA, 18 bp, Homo sapiens
ctgaagggaacagcctga

SEQ ID NO: 4342996 - DNA, 19 bp, Homo sapiens
ctgaagggaacagcctgag

SEQ ID NO: 4342997 - DNA, 21 bp, Homo sapiens
ctgaagggaacagcctgagcc

SEQ ID NO: 4342998 - DNA, 20 bp, Homo sapiens
ctgaagggcattctttccca

SEQ ID NO: 4342999 - DNA, 21 bp, Homo sapiens
ctgaagtcaaaccttaagata

SEQ ID NO: 4343000 - DNA, 22 bp, Homo sapiens
ctgaagtcccagatacttgggg

SEQ ID NO: 4343001 - DNA, 15 bp, Homo sapiens
ctgaataaaaaataa

SEQ ID NO: 4343002 - DNA, 16 bp, Homo sapiens
ctgaatacagaggcaa

SEQ ID NO: 4343003 - DNA, 14 bp, Homo sapiens
ctgaatcatgtctg

SEQ ID NO: 4343004 - DNA, 16 bp, Homo sapiens
ctgaatgctgagctga

SEQ ID NO: 4343005 - DNA, 17 bp, Homo sapiens
ctgaattgagaaaagag

SEQ ID NO: 4343006 - DNA, 18 bp, Homo sapiens
ctgacacattgctgatat

SEQ ID NO: 4343007 - DNA, 16 bp, Homo sapiens
ctgacatcagatttct

SEQ ID NO: 4343008 - DNA, 17 bp, Homo sapiens
ctgacatcagatttctt

SEQ ID NO: 4343009 - DNA, 15 bp, Homo sapiens
ctgacggtttctccc

SEQ ID NO: 4343010 - DNA, 17 bp, Homo sapiens
ctgacggtttctccccg

SEQ ID NO: 4343011 - DNA, 15 bp, Homo sapiens
ctgactggttgtcag

SEQ ID NO: 4343012 - DNA, 19 bp, Homo sapiens
ctgactggttgtcagaatg

SEQ ID NO: 4343013 - DNA, 16 bp, Homo sapiens
ctgactgttttctctt

SEQ ID NO: 4343014 - DNA, 14 bp, Homo sapiens
ctgagaaattatta

SEQ ID NO: 4343015 - DNA, 16 bp, Homo sapiens
ctgagaagtactttac

SEQ ID NO: 4343016 - DNA, 15 bp, Homo sapiens
ctgagccccagcccc

SEQ ID NO: 4343017 - DNA, 14 bp, Homo sapiens
ctgagcctgcccag

SEQ ID NO: 4343018 - DNA, 22 bp, Homo sapiens
ctgagcctgttcccactcagca

SEQ ID NO: 4343019 - DNA, 14 bp, Homo sapiens
ctgagctttctgct

SEQ ID NO: 4343020 - DNA, 23 bp, Homo sapiens
ctgaggctctctaagaaaagaga

SEQ ID NO: 4343021 - DNA, 12 bp, Homo sapiens
ctgagggcaaat

SEQ ID NO: 4343022 - DNA, 12 bp, Homo sapiens
ctgaggtgggag

SEQ ID NO: 4343023 - DNA, 16 bp, Homo sapiens
ctgagtgctatgtgtg

SEQ ID NO: 4343024 - DNA, 18 bp, Homo sapiens
ctgagtgctatgtgtgct

SEQ ID NO: 4343025 - DNA, 16 bp, Homo sapiens
ctgagtgtattttact

SEQ ID NO: 4343026 - DNA, 14 bp, Homo sapiens
ctgagttctgacac

SEQ ID NO: 4343027 - DNA, 21 bp, Homo sapiens
ctgatctgtactttgtgttta

SEQ ID NO: 4343028 - DNA, 20 bp, Homo sapiens
ctgatgcccaccgaggagcc

SEQ ID NO: 4343029 - DNA, 19 bp, Homo sapiens
ctgatggtttggaaaataa

SEQ ID NO: 4343030 - DNA, 18 bp, Homo sapiens
ctgattaccagtctgatt

SEQ ID NO: 4343031 - DNA, 22 bp, Homo sapiens
ctgattagaagtataaggtgct

SEQ ID NO: 4343032 - DNA, 24 bp, Homo sapiens
ctgattcaagtaagtagatgcctg

SEQ ID NO: 4343033 - DNA, 20 bp, Homo sapiens
ctgatttacaggacttctct

SEQ ID NO: 4343034 - DNA, 15 bp, Homo sapiens
ctgatttagaagcaa

SEQ ID NO: 4343035 - DNA, 13 bp, Homo sapiens
ctgatttcccttt

SEQ ID NO: 4343036 - DNA, 22 bp, Homo sapiens
ctgcaaacccatgaagctggcc

SEQ ID NO: 4343037 - DNA, 17 bp, Homo sapiens
ctgcaagcatttttcca

SEQ ID NO: 4343038 - DNA, 18 bp, Homo sapiens
ctgcacaagctgcaccct

SEQ ID NO: 4343039 - DNA, 13 bp, Homo sapiens
ctgcaccctcagg

SEQ ID NO: 4343040 - DNA, 13 bp, Homo sapiens
ctgcactccagcc

SEQ ID NO: 4343041 - DNA, 17 bp, Homo sapiens
ctgcactccagcctggg

SEQ ID NO: 4343042 - DNA, 18 bp, Homo sapiens
ctgcactccagcctgggt

SEQ ID NO: 4343043 - DNA, 13 bp, Homo sapiens
ctgcagcaactcc

SEQ ID NO: 4343044 - DNA, 14 bp, Homo sapiens
ctgcagcaactccc

SEQ ID NO: 4343045 - DNA, 15 bp, Homo sapiens
ctgcagcaactccca

SEQ ID NO: 4343046 - DNA, 17 bp, Homo sapiens
ctgcagcaactcccacg

SEQ ID NO: 4343047 - DNA, 18 bp, Homo sapiens
ctgcaggtccggggagga

SEQ ID NO: 4343048 - DNA, 16 bp, Homo sapiens
ctgcatcgtttcatct

SEQ ID NO: 4343049 - DNA, 22 bp, Homo sapiens
ctgcatcgtttcatcttccaac

SEQ ID NO: 4343050 - DNA, 17 bp, Homo sapiens
ctgcatctgactctctt

SEQ ID NO: 4343051 - DNA, 20 bp, Homo sapiens
ctgcatgcctggtctttcct

SEQ ID NO: 4343052 - DNA, 22 bp, Homo sapiens
ctgcatgcctggtctttcctct

SEQ ID NO: 4343053 - DNA, 17 bp, Homo sapiens
ctgcattcattctgagc

SEQ ID NO: 4343054 - DNA, 16 bp, Homo sapiens
ctgcattgagaaggaa

SEQ ID NO: 4343055 - DNA, 17 bp, Homo sapiens
ctgcattgagaaggaac

SEQ ID NO: 4343056 - DNA, 13 bp, Homo sapiens
ctgcattggcttt

SEQ ID NO: 4343057 - DNA, 22 bp, Homo sapiens
ctgcattttacacatgtgctga

SEQ ID NO: 4343058 - DNA, 16 bp, Homo sapiens
ctgccatttctgagat

SEQ ID NO: 4343059 - DNA, 18 bp, Homo sapiens
ctgcccagccctctgtgg

SEQ ID NO: 4343060 - DNA, 19 bp, Homo sapiens
ctgcccagtcccccaaccc

SEQ ID NO: 4343061 - DNA, 13 bp, Homo sapiens
ctgccccagccca

SEQ ID NO: 4343062 - DNA, 18 bp, Homo sapiens
ctgccccagcccaagtcc

SEQ ID NO: 4343063 - DNA, 22 bp, Homo sapiens
ctgcccctgagttctgacactg

SEQ ID NO: 4343064 - DNA, 22 bp, Homo sapiens
ctgccctcaggctccccagtgc

SEQ ID NO: 4343065 - DNA, 19 bp, Homo sapiens
ctgcccttaccccacacac

SEQ ID NO: 4343066 - DNA, 23 bp, Homo sapiens
ctgccctttcccaggtaatttaa

SEQ ID NO: 4343067 - DNA, 11 bp, Homo sapiens
ctgcctggcaa

SEQ ID NO: 4343068 - DNA, 21 bp, Homo sapiens
ctgcctgggatgcccttcccc

SEQ ID NO: 4343069 - DNA, 14 bp, Homo sapiens
ctgcgtctggaggg

SEQ ID NO: 4343070 - DNA, 15 bp, Homo sapiens
ctgcgtctggagggg

SEQ ID NO: 4343071 - DNA, 22 bp, Homo sapiens
ctgcgtgactattttttaataa

SEQ ID NO: 4343072 - DNA, 16 bp, Homo sapiens
ctgctaagctaaagaa

SEQ ID NO: 4343073 - DNA, 20 bp, Homo sapiens
ctgctaagctaaagaaactg

SEQ ID NO: 4343074 - DNA, 18 bp, Homo sapiens
ctgctattttttttaaat

SEQ ID NO: 4343075 - DNA, 20 bp, Homo sapiens
ctgctattttttttaaatca

SEQ ID NO: 4343076 - DNA, 14 bp, Homo sapiens
ctgctccagctgtt

SEQ ID NO: 4343077 - DNA, 15 bp, Homo sapiens
ctgctcccagctctc

SEQ ID NO: 4343078 - DNA, 21 bp, Homo sapiens
ctgctcccagctctctctcct

SEQ ID NO: 4343079 - DNA, 23 bp, Homo sapiens
ctgctcccagctctctctcctgg

SEQ ID NO: 4343080 - DNA, 16 bp, Homo sapiens
ctgctgacctcccacc

SEQ ID NO: 4343081 - DNA, 15 bp, Homo sapiens
ctgctgggtgccagg

SEQ ID NO: 4343082 - DNA, 22 bp, Homo sapiens
ctgctgggtgccaggtgctggg

SEQ ID NO: 4343083 - DNA, 19 bp, Homo sapiens
ctgctgttctgtgtacata

SEQ ID NO: 4343084 - DNA, 14 bp, Homo sapiens
ctgcttctccagcc

SEQ ID NO: 4343085 - DNA, 15 bp, Homo sapiens
ctgcttgagctttct

SEQ ID NO: 4343086 - DNA, 23 bp, Homo sapiens
ctgcttgagctttctgtgcatgt

SEQ ID NO: 4343087 - DNA, 13 bp, Homo sapiens
ctgcttgaggcaa

SEQ ID NO: 4343088 - DNA, 22 bp, Homo sapiens
ctgcttgaggcaactcatctta

SEQ ID NO: 4343089 - DNA, 14 bp, Homo sapiens
ctgctttctttgat

SEQ ID NO: 4343090 - DNA, 18 bp, Homo sapiens
ctgctttgacaaggcaga

SEQ ID NO: 4343091 - DNA, 13 bp, Homo sapiens
ctgctttgtgcat

SEQ ID NO: 4343092 - DNA, 20 bp, Homo sapiens
ctgctttgtgcatatgttaa

SEQ ID NO: 4343093 - DNA, 17 bp, Homo sapiens
ctggaaaatcatattga

SEQ ID NO: 4343094 - DNA, 21 bp, Homo sapiens
ctggaaaatcatattgagaat

SEQ ID NO: 4343095 - DNA, 16 bp, Homo sapiens
ctggaaacagacaggg

SEQ ID NO: 4343096 - DNA, 16 bp, Homo sapiens
ctggaaaccacagtcc

SEQ ID NO: 4343097 - DNA, 13 bp, Homo sapiens
ctggaagcctgcc

SEQ ID NO: 4343098 - DNA, 13 bp, Homo sapiens
ctggactctgtgt

SEQ ID NO: 4343099 - DNA, 13 bp, Homo sapiens
ctggagagctgct

SEQ ID NO: 4343100 - DNA, 22 bp, Homo sapiens
ctggagctgctaagctaaagaa

SEQ ID NO: 4343101 - DNA, 12 bp, Homo sapiens
ctggaggggccc

SEQ ID NO: 4343102 - DNA, 23 bp, Homo sapiens
ctggaggggcccctgcttctcca

SEQ ID NO: 4343103 - DNA, 17 bp, Homo sapiens
ctggagtctgaagcctg

SEQ ID NO: 4343104 - DNA, 20 bp, Homo sapiens
ctggcaaacttttctttctt

SEQ ID NO: 4343105 - DNA, 20 bp, Homo sapiens
ctggcaacatcttacttgtc

SEQ ID NO: 4343106 - DNA, 14 bp, Homo sapiens
ctggcaagaatgtg

SEQ ID NO: 4343107 - DNA, 16 bp, Homo sapiens
ctggcacgtggccagg

SEQ ID NO: 4343108 - DNA, 22 bp, Homo sapiens
ctggcacgtggccaggagccat

SEQ ID NO: 4343109 - DNA, 17 bp, Homo sapiens
ctggcacttgcctgctg

SEQ ID NO: 4343110 - DNA, 19 bp, Homo sapiens
ctggcacttgcctgctgct

SEQ ID NO: 4343111 - DNA, 16 bp, Homo sapiens
ctggcagcgagaacta

SEQ ID NO: 4343112 - DNA, 21 bp, Homo sapiens
ctggcaggctactctgcccac

SEQ ID NO: 4343113 - DNA, 16 bp, Homo sapiens
ctggcatcgcagcttc

SEQ ID NO: 4343114 - DNA, 22 bp, Homo sapiens
ctggcatcgcagcttcctgtct

SEQ ID NO: 4343115 - DNA, 20 bp, Homo sapiens
ctggcccgcaagagggacag

SEQ ID NO: 4343116 - DNA, 17 bp, Homo sapiens
ctggccctcagctccct

SEQ ID NO: 4343117 - DNA, 21 bp, Homo sapiens
ctggcctgactggttgtcaga

SEQ ID NO: 4343118 - DNA, 20 bp, Homo sapiens
ctggcggaggtggagtggcc

SEQ ID NO: 4343119 - DNA, 21 bp, Homo sapiens
ctggcggaggtggagtggcca

SEQ ID NO: 4343120 - DNA, 13 bp, Homo sapiens
ctggcgggatggg

SEQ ID NO: 4343121 - DNA, 16 bp, Homo sapiens
ctggcgggatgggcca

SEQ ID NO: 4343122 - DNA, 20 bp, Homo sapiens
ctggcgggatgggccaccgc

SEQ ID NO: 4343123 - DNA, 22 bp, Homo sapiens
ctggctgggtggcaccagcagc

SEQ ID NO: 4343124 - DNA, 20 bp, Homo sapiens
ctgggaagctgagggcaaat

SEQ ID NO: 4343125 - DNA, 23 bp, Homo sapiens
ctgggacctaatgctggcctgac

SEQ ID NO: 4343126 - DNA, 21 bp, Homo sapiens
ctgggagcgtgggctcagcag

SEQ ID NO: 4343127 - DNA, 21 bp, Homo sapiens
ctgggaggtcaaggctgcagt

SEQ ID NO: 4343128 - DNA, 17 bp, Homo sapiens
ctgggatgcccttcccc

SEQ ID NO: 4343129 - DNA, 18 bp, Homo sapiens
ctgggcacccctgcctcc

SEQ ID NO: 4343130 - DNA, 20 bp, Homo sapiens
ctgggcacccctgcctcctg

SEQ ID NO: 4343131 - DNA, 20 bp, Homo sapiens
ctgggcaggttggtgggggc

SEQ ID NO: 4343132 - DNA, 14 bp, Homo sapiens
ctgggcagtgagtg

SEQ ID NO: 4343133 - DNA, 22 bp, Homo sapiens
ctgggcatttcacgaactgttc

SEQ ID NO: 4343134 - DNA, 23 bp, Homo sapiens
ctggggaaaaggatgatggaaaa

SEQ ID NO: 4343135 - DNA, 17 bp, Homo sapiens
ctggggaagatggagca

SEQ ID NO: 4343136 - DNA, 14 bp, Homo sapiens
ctggggcaggctgc

SEQ ID NO: 4343137 - DNA, 13 bp, Homo sapiens
ctgggggaagaag

SEQ ID NO: 4343138 - DNA, 20 bp, Homo sapiens
ctgggtaactagggaagata

SEQ ID NO: 4343139 - DNA, 19 bp, Homo sapiens
ctgggtattggaaatggat

SEQ ID NO: 4343140 - DNA, 20 bp, Homo sapiens
ctgggtcattacttctgagc

SEQ ID NO: 4343141 - DNA, 19 bp, Homo sapiens
ctgggtctactcaaacact

SEQ ID NO: 4343142 - DNA, 21 bp, Homo sapiens
ctgggtggcaccagcagcctg

SEQ ID NO: 4343143 - DNA, 13 bp, Homo sapiens
ctgggtgtcattt

SEQ ID NO: 4343144 - DNA, 21 bp, Homo sapiens
ctgggtgtcatttcattccat

SEQ ID NO: 4343145 - DNA, 12 bp, Homo sapiens
ctggtcacctcc

SEQ ID NO: 4343146 - DNA, 12 bp, Homo sapiens
ctggtctgtctt

SEQ ID NO: 4343147 - DNA, 13 bp, Homo sapiens
ctggtggccttgg

SEQ ID NO: 4343148 - DNA, 18 bp, Homo sapiens
ctggtggccttgggcctt

SEQ ID NO: 4343149 - DNA, 20 bp, Homo sapiens
ctggtggtgctggtcttttc

SEQ ID NO: 4343150 - DNA, 19 bp, Homo sapiens
ctggttaggacaaaaagac

SEQ ID NO: 4343151 - DNA, 20 bp, Homo sapiens
ctggttgtcagaatggaatc

SEQ ID NO: 4343152 - DNA, 16 bp, Homo sapiens
ctggttttatttatat

SEQ ID NO: 4343153 - DNA, 17 bp, Homo sapiens
ctgtaacctgaagtcaa

SEQ ID NO: 4343154 - DNA, 21 bp, Homo sapiens
ctgtaagactcattccctaga

SEQ ID NO: 4343155 - DNA, 19 bp, Homo sapiens
ctgtaattaaactagttta

SEQ ID NO: 4343156 - DNA, 13 bp, Homo sapiens
ctgtatccccagt

SEQ ID NO: 4343157 - DNA, 15 bp, Homo sapiens
ctgtatccccagtgc

SEQ ID NO: 4343158 - DNA, 20 bp, Homo sapiens
ctgtatgtctacctctgact

SEQ ID NO: 4343159 - DNA, 15 bp, Homo sapiens
ctgtatttcagtatt

SEQ ID NO: 4343160 - DNA, 18 bp, Homo sapiens
ctgtatttcagtattttc

SEQ ID NO: 4343161 - DNA, 17 bp, Homo sapiens
ctgtatttctttgtaga

SEQ ID NO: 4343162 - DNA, 20 bp, Homo sapiens
ctgtattttgtttttgtctt

SEQ ID NO: 4343163 - DNA, 18 bp, Homo sapiens
ctgtcagaagacactaat

SEQ ID NO: 4343164 - DNA, 16 bp, Homo sapiens
ctgtccaatttctgct

SEQ ID NO: 4343165 - DNA, 22 bp, Homo sapiens
ctgtccagccgtgtgtgcatgt

SEQ ID NO: 4343166 - DNA, 14 bp, Homo sapiens
ctgtccatgcttct

SEQ ID NO: 4343167 - DNA, 16 bp, Homo sapiens
ctgtccatgcttctca

SEQ ID NO: 4343168 - DNA, 16 bp, Homo sapiens
ctgtcccctcagctcc

SEQ ID NO: 4343169 - DNA, 17 bp, Homo sapiens
ctgtcccctcagctcca

SEQ ID NO: 4343170 - DNA, 14 bp, Homo sapiens
ctgtccgagctttg

SEQ ID NO: 4343171 - DNA, 20 bp, Homo sapiens
ctgtccgtgcttgctggtgc

SEQ ID NO: 4343172 - DNA, 22 bp, Homo sapiens
ctgtctcaaaaaaagaaaaaga

SEQ ID NO: 4343173 - DNA, 11 bp, Homo sapiens
ctgtctcctgt

SEQ ID NO: 4343174 - DNA, 11 bp, Homo sapiens
ctgtctctctc

SEQ ID NO: 4343175 - DNA, 16 bp, Homo sapiens
ctgtctctctctcttt

SEQ ID NO: 4343176 - DNA, 22 bp, Homo sapiens
ctgtgacacttatctcactgtt

SEQ ID NO: 4343177 - DNA, 17 bp, Homo sapiens
ctgtgactagatacaga

SEQ ID NO: 4343178 - DNA, 22 bp, Homo sapiens
ctgtgatgaggggaggggggca

SEQ ID NO: 4343179 - DNA, 14 bp, Homo sapiens
ctgtgattacctct

SEQ ID NO: 4343180 - DNA, 15 bp, Homo sapiens
ctgtgattacctctc

SEQ ID NO: 4343181 - DNA, 16 bp, Homo sapiens
ctgtgcacactaagaa

SEQ ID NO: 4343182 - DNA, 19 bp, Homo sapiens
ctgtgcacactaagaaatg

SEQ ID NO: 4343183 - DNA, 20 bp, Homo sapiens
ctgtgcttccttggttcatg

SEQ ID NO: 4343184 - DNA, 15 bp, Homo sapiens
ctgtggaaccaaagc

SEQ ID NO: 4343185 - DNA, 11 bp, Homo sapiens
ctgtggccagg

SEQ ID NO: 4343186 - DNA, 15 bp, Homo sapiens
ctgtggccaggagcc

SEQ ID NO: 4343187 - DNA, 16 bp, Homo sapiens
ctgtggccaggagccc

SEQ ID NO: 4343188 - DNA, 23 bp, Homo sapiens
ctgtggccatatatgctgtattt

SEQ ID NO: 4343189 - DNA, 23 bp, Homo sapiens
ctgtgggtggtgatttggtcagc

SEQ ID NO: 4343190 - DNA, 13 bp, Homo sapiens
ctgtgtaaaatga

SEQ ID NO: 4343191 - DNA, 14 bp, Homo sapiens
ctgtgtagttccct

SEQ ID NO: 4343192 - DNA, 17 bp, Homo sapiens
ctgtgtcagcatagaag

SEQ ID NO: 4343193 - DNA, 19 bp, Homo sapiens
ctgtgtctgaatcatgtct

SEQ ID NO: 4343194 - DNA, 20 bp, Homo sapiens
ctgtgtctgaatcatgtctg

SEQ ID NO: 4343195 - DNA, 21 bp, Homo sapiens
ctgtgtgagcgtgtccacaga

SEQ ID NO: 4343196 - DNA, 20 bp, Homo sapiens
ctgttaaccacccgccccgc

SEQ ID NO: 4343197 - DNA, 13 bp, Homo sapiens
ctgttactgcttc

SEQ ID NO: 4343198 - DNA, 18 bp, Homo sapiens
ctgttcagctggttgagg

SEQ ID NO: 4343199 - DNA, 19 bp, Homo sapiens
ctgttcagctggttgaggt

SEQ ID NO: 4343200 - DNA, 21 bp, Homo sapiens
ctgttcagctggttgaggttt

SEQ ID NO: 4343201 - DNA, 23 bp, Homo sapiens
ctgttcccccgccgcttttctcc

SEQ ID NO: 4343202 - DNA, 20 bp, Homo sapiens
ctgttctgtgtacataaagt

SEQ ID NO: 4343203 - DNA, 14 bp, Homo sapiens
ctgttgatcccctc

SEQ ID NO: 4343204 - DNA, 15 bp, Homo sapiens
ctgttgatcccctct

SEQ ID NO: 4343205 - DNA, 18 bp, Homo sapiens
ctgttgatcccctctctg

SEQ ID NO: 4343206 - DNA, 21 bp, Homo sapiens
ctgttgatcccctctctgtgg

SEQ ID NO: 4343207 - DNA, 22 bp, Homo sapiens
ctgttgcagcttgtgctgagcc

SEQ ID NO: 4343208 - DNA, 21 bp, Homo sapiens
ctgttgggggcttcaggtctc

SEQ ID NO: 4343209 - DNA, 22 bp, Homo sapiens
ctgttgggggcttcaggtctct

SEQ ID NO: 4343210 - DNA, 17 bp, Homo sapiens
ctgtttaccatttttca

SEQ ID NO: 4343211 - DNA, 20 bp, Homo sapiens
ctgtttactcccttctgtag

SEQ ID NO: 4343212 - DNA, 19 bp, Homo sapiens
ctgtttatatattgaaagt

SEQ ID NO: 4343213 - DNA, 14 bp, Homo sapiens
ctgtttcccaagct

SEQ ID NO: 4343214 - DNA, 17 bp, Homo sapiens
ctgttttataattagtc

SEQ ID NO: 4343215 - DNA, 17 bp, Homo sapiens
cttaaaaagtggaaaaa

SEQ ID NO: 4343216 - DNA, 14 bp, Homo sapiens
cttaaacttgtgaa

SEQ ID NO: 4343217 - DNA, 21 bp, Homo sapiens
cttaaagcttgatttgatctt

SEQ ID NO: 4343218 - DNA, 13 bp, Homo sapiens
cttaaatatttgt

SEQ ID NO: 4343219 - DNA, 17 bp, Homo sapiens
cttaaatgaactactgc

SEQ ID NO: 4343220 - DNA, 23 bp, Homo sapiens
cttaaatgaactactgctatttt

SEQ ID NO: 4343221 - DNA, 17 bp, Homo sapiens
cttaaatgagttactta

SEQ ID NO: 4343222 - DNA, 19 bp, Homo sapiens
cttaaatgagttacttaga

SEQ ID NO: 4343223 - DNA, 13 bp, Homo sapiens
cttaactgtattt

SEQ ID NO: 4343224 - DNA, 14 bp, Homo sapiens
cttaactgtatttc

SEQ ID NO: 4343225 - DNA, 23 bp, Homo sapiens
cttaagataatggataatcttcg

SEQ ID NO: 4343226 - DNA, 13 bp, Homo sapiens
cttaagcacaatt

SEQ ID NO: 4343227 - DNA, 16 bp, Homo sapiens
cttaagctgtagagag

SEQ ID NO: 4343228 - DNA, 20 bp, Homo sapiens
cttaatttaagtttgtagtt

SEQ ID NO: 4343229 - DNA, 17 bp, Homo sapiens
cttacaagcttaaagct

SEQ ID NO: 4343230 - DNA, 14 bp, Homo sapiens
cttacacgtgcgtg

SEQ ID NO: 4343231 - DNA, 23 bp, Homo sapiens
cttacagtttattttctgtgtaa

SEQ ID NO: 4343232 - DNA, 21 bp, Homo sapiens
cttacctcggtgccttcctct

SEQ ID NO: 4343233 - DNA, 14 bp, Homo sapiens
cttacggttttaaa

SEQ ID NO: 4343234 - DNA, 14 bp, Homo sapiens
cttacttgcactgt

SEQ ID NO: 4343235 - DNA, 13 bp, Homo sapiens
cttacttgtcctt

SEQ ID NO: 4343236 - DNA, 13 bp, Homo sapiens
cttagaatgccat

SEQ ID NO: 4343237 - DNA, 18 bp, Homo sapiens
cttagagcatctctgcct

SEQ ID NO: 4343238 - DNA, 17 bp, Homo sapiens
cttaggttggcaaaaag

SEQ ID NO: 4343239 - DNA, 18 bp, Homo sapiens
cttagtatagtagaaaga

SEQ ID NO: 4343240 - DNA, 23 bp, Homo sapiens
cttagttgatattcaaggcttta

SEQ ID NO: 4343241 - DNA, 16 bp, Homo sapiens
cttatgattttattac

SEQ ID NO: 4343242 - DNA, 21 bp, Homo sapiens
cttatgtgttacattattcca

SEQ ID NO: 4343243 - DNA, 14 bp, Homo sapiens
cttattgcttagta

SEQ ID NO: 4343244 - DNA, 13 bp, Homo sapiens
cttcaatcccagc

SEQ ID NO: 4343245 - DNA, 15 bp, Homo sapiens
cttcagagtttgtgt

SEQ ID NO: 4343246 - DNA, 11 bp, Homo sapiens
cttcagctgac

SEQ ID NO: 4343247 - DNA, 15 bp, Homo sapiens
cttcaggtaacacta

SEQ ID NO: 4343248 - DNA, 14 bp, Homo sapiens
cttcagtaagccgt

SEQ ID NO: 4343249 - DNA, 13 bp, Homo sapiens
cttccacctctgg

SEQ ID NO: 4343250 - DNA, 17 bp, Homo sapiens
cttccattgcaaaatag

SEQ ID NO: 4343251 - DNA, 22 bp, Homo sapiens
cttccattgcaaaatagaagaa

SEQ ID NO: 4343252 - DNA, 21 bp, Homo sapiens
cttccccagctcccccaggca

SEQ ID NO: 4343253 - DNA, 23 bp, Homo sapiens
cttccccagctcccccaggcaga

SEQ ID NO: 4343254 - DNA, 19 bp, Homo sapiens
cttccccctttctctgcct

SEQ ID NO: 4343255 - DNA, 22 bp, Homo sapiens
cttccccctttctctgcctggc

SEQ ID NO: 4343256 - DNA, 23 bp, Homo sapiens
cttccccctttctctgcctggca

SEQ ID NO: 4343257 - DNA, 14 bp, Homo sapiens
cttcccttcctcag

SEQ ID NO: 4343258 - DNA, 16 bp, Homo sapiens
cttcccttcctcagca

SEQ ID NO: 4343259 - DNA, 15 bp, Homo sapiens
cttcctcagcaggcc

SEQ ID NO: 4343260 - DNA, 16 bp, Homo sapiens
cttcctcagcaggcca

SEQ ID NO: 4343261 - DNA, 17 bp, Homo sapiens
cttcctcagcaggccaa

SEQ ID NO: 4343262 - DNA, 18 bp, Homo sapiens
cttcctccctgtctctgc

SEQ ID NO: 4343263 - DNA, 14 bp, Homo sapiens
cttcctcctctcct

SEQ ID NO: 4343264 - DNA, 15 bp, Homo sapiens
cttcctgtccccagg

SEQ ID NO: 4343265 - DNA, 14 bp, Homo sapiens
cttcctgtctgttt

SEQ ID NO: 4343266 - DNA, 17 bp, Homo sapiens
cttcctgtctgtttata

SEQ ID NO: 4343267 - DNA, 17 bp, Homo sapiens
cttccttggttcatgct

SEQ ID NO: 4343268 - DNA, 20 bp, Homo sapiens
cttcgggaggtcgaggcagg

SEQ ID NO: 4343269 - DNA, 15 bp, Homo sapiens
cttctaccccacctg

SEQ ID NO: 4343270 - DNA, 16 bp, Homo sapiens
cttctaccccacctga

SEQ ID NO: 4343271 - DNA, 20 bp, Homo sapiens
cttctagacactccttgaaa

SEQ ID NO: 4343272 - DNA, 21 bp, Homo sapiens
cttctcagttgcagaaaatga

SEQ ID NO: 4343273 - DNA, 16 bp, Homo sapiens
cttctccaattctgaa

SEQ ID NO: 4343274 - DNA, 13 bp, Homo sapiens
cttctcccaggcc

SEQ ID NO: 4343275 - DNA, 15 bp, Homo sapiens
cttctcccaggcctc

SEQ ID NO: 4343276 - DNA, 16 bp, Homo sapiens
cttctcccaggcctct

SEQ ID NO: 4343277 - DNA, 13 bp, Homo sapiens
cttctccccagaa

SEQ ID NO: 4343278 - DNA, 14 bp, Homo sapiens
cttctgagccccag

SEQ ID NO: 4343279 - DNA, 16 bp, Homo sapiens
cttctgagccccagcc

SEQ ID NO: 4343280 - DNA, 15 bp, Homo sapiens
cttctgcagcaactc

SEQ ID NO: 4343281 - DNA, 16 bp, Homo sapiens
cttctgtagtttttaa

SEQ ID NO: 4343282 - DNA, 20 bp, Homo sapiens
cttctgtggtccctctgtgt

SEQ ID NO: 4343283 - DNA, 16 bp, Homo sapiens
cttcttggaccttggc

SEQ ID NO: 4343284 - DNA, 17 bp, Homo sapiens
cttcttggaccttggcg

SEQ ID NO: 4343285 - DNA, 14 bp, Homo sapiens
cttctttgcttctt

SEQ ID NO: 4343286 - DNA, 23 bp, Homo sapiens
cttctttttcttaccctctcttt

SEQ ID NO: 4343287 - DNA, 23 bp, Homo sapiens
cttgaacccaggccatgtggtta

SEQ ID NO: 4343288 - DNA, 12 bp, Homo sapiens
cttgagcctggg

SEQ ID NO: 4343289 - DNA, 15 bp, Homo sapiens
cttgagcctgggagg

SEQ ID NO: 4343290 - DNA, 21 bp, Homo sapiens
cttgagctttctgtgcatgtg

SEQ ID NO: 4343291 - DNA, 18 bp, Homo sapiens
cttgagttgattcagctc

SEQ ID NO: 4343292 - DNA, 14 bp, Homo sapiens
cttgatgactgctg

SEQ ID NO: 4343293 - DNA, 16 bp, Homo sapiens
cttgcaaactctataa

SEQ ID NO: 4343294 - DNA, 21 bp, Homo sapiens
cttgccaaaatgttggctgcg

SEQ ID NO: 4343295 - DNA, 22 bp, Homo sapiens
cttgccaaaatgttggctgcgt

SEQ ID NO: 4343296 - DNA, 15 bp, Homo sapiens
cttgcccttggagct

SEQ ID NO: 4343297 - DNA, 18 bp, Homo sapiens
cttgcccttggagctgcc

SEQ ID NO: 4343298 - DNA, 21 bp, Homo sapiens
cttgctgcaaacccatgaagc

SEQ ID NO: 4343299 - DNA, 12 bp, Homo sapiens
cttgctggtgcc

SEQ ID NO: 4343300 - DNA, 20 bp, Homo sapiens
cttgctgtttactcccttct

SEQ ID NO: 4343301 - DNA, 21 bp, Homo sapiens
cttgcttagatgttccaaatt

SEQ ID NO: 4343302 - DNA, 11 bp, Homo sapiens
cttgcttctgc

SEQ ID NO: 4343303 - DNA, 23 bp, Homo sapiens
cttgcttctgcagcaactcccac

SEQ ID NO: 4343304 - DNA, 18 bp, Homo sapiens
cttgctttttgctgtgta

SEQ ID NO: 4343305 - DNA, 18 bp, Homo sapiens
cttggaaatgttaagaaa

SEQ ID NO: 4343306 - DNA, 20 bp, Homo sapiens
cttggaaatgttaagaaaga

SEQ ID NO: 4343307 - DNA, 22 bp, Homo sapiens
cttggagctgccgtgcctgtgt

SEQ ID NO: 4343308 - DNA, 14 bp, Homo sapiens
cttggagtgcccca

SEQ ID NO: 4343309 - DNA, 14 bp, Homo sapiens
cttggatcagaggt

SEQ ID NO: 4343310 - DNA, 16 bp, Homo sapiens
cttggatcagaggtca

SEQ ID NO: 4343311 - DNA, 15 bp, Homo sapiens
cttggcatagacatg

SEQ ID NO: 4343312 - DNA, 16 bp, Homo sapiens
cttggggggctgaggt

SEQ ID NO: 4343313 - DNA, 19 bp, Homo sapiens
cttggggtggtgctgggtc

SEQ ID NO: 4343314 - DNA, 19 bp, Homo sapiens
cttggtaagtgaatttatg

SEQ ID NO: 4343315 - DNA, 14 bp, Homo sapiens
cttggttcatgctt

SEQ ID NO: 4343316 - DNA, 17 bp, Homo sapiens
cttggttgttaatttag

SEQ ID NO: 4343317 - DNA, 18 bp, Homo sapiens
cttgtcctttgaggcccc

SEQ ID NO: 4343318 - DNA, 12 bp, Homo sapiens
cttgtctgagat

SEQ ID NO: 4343319 - DNA, 17 bp, Homo sapiens
cttgtgaatgcttctca

SEQ ID NO: 4343320 - DNA, 23 bp, Homo sapiens
cttgtgaatgtttagtgtgctgc

SEQ ID NO: 4343321 - DNA, 16 bp, Homo sapiens
cttgtgatgtattctt

SEQ ID NO: 4343322 - DNA, 16 bp, Homo sapiens
cttgtgctgagcctgc

SEQ ID NO: 4343323 - DNA, 18 bp, Homo sapiens
cttgtgctgagcctgccc

SEQ ID NO: 4343324 - DNA, 19 bp, Homo sapiens
cttgtgctgagcctgccca

SEQ ID NO: 4343325 - DNA, 21 bp, Homo sapiens
cttgttacaaattttttaatt

SEQ ID NO: 4343326 - DNA, 22 bp, Homo sapiens
cttgttacaaattttttaattt

SEQ ID NO: 4343327 - DNA, 15 bp, Homo sapiens
cttgttattaatgtt

SEQ ID NO: 4343328 - DNA, 22 bp, Homo sapiens
cttgttattaatgtttcttctc

SEQ ID NO: 4343329 - DNA, 13 bp, Homo sapiens
cttgtttctttct

SEQ ID NO: 4343330 - DNA, 18 bp, Homo sapiens
cttgtttctttctgtctc

SEQ ID NO: 4343331 - DNA, 11 bp, Homo sapiens
ctttacctctt

SEQ ID NO: 4343332 - DNA, 16 bp, Homo sapiens
ctttaggatgagcaaa

SEQ ID NO: 4343333 - DNA, 17 bp, Homo sapiens
ctttataaccaaagcaa

SEQ ID NO: 4343334 - DNA, 13 bp, Homo sapiens
ctttatctttgtg

SEQ ID NO: 4343335 - DNA, 14 bp, Homo sapiens
ctttatctttgtgt

SEQ ID NO: 4343336 - DNA, 16 bp, Homo sapiens
ctttattgcactagga

SEQ ID NO: 4343337 - DNA, 12 bp, Homo sapiens
ctttattttccc

SEQ ID NO: 4343338 - DNA, 22 bp, Homo sapiens
ctttcaattgcagatgccaaaa

SEQ ID NO: 4343339 - DNA, 14 bp, Homo sapiens
ctttcatctcccag

SEQ ID NO: 4343340 - DNA, 18 bp, Homo sapiens
ctttccaaatgcccagct

SEQ ID NO: 4343341 - DNA, 19 bp, Homo sapiens
ctttccaaatgcccagctt

SEQ ID NO: 4343342 - DNA, 21 bp, Homo sapiens
ctttcccaggtaatttaaatt

SEQ ID NO: 4343343 - DNA, 19 bp, Homo sapiens
ctttcccccaccccagagt

SEQ ID NO: 4343344 - DNA, 10 bp, Homo sapiens
ctttcccttc

SEQ ID NO: 4343345 - DNA, 15 bp, Homo sapiens
ctttcctaaatgttt

SEQ ID NO: 4343346 - DNA, 19 bp, Homo sapiens
ctttcctatctagcattta

SEQ ID NO: 4343347 - DNA, 18 bp, Homo sapiens
ctttctcccactgagttt

SEQ ID NO: 4343348 - DNA, 14 bp, Homo sapiens
ctttctctgcctgg

SEQ ID NO: 4343349 - DNA, 15 bp, Homo sapiens
ctttctctgcctggc

SEQ ID NO: 4343350 - DNA, 17 bp, Homo sapiens
ctttctctgcctggcaa

SEQ ID NO: 4343351 - DNA, 17 bp, Homo sapiens
ctttctttgattctcct

SEQ ID NO: 4343352 - DNA, 19 bp, Homo sapiens
ctttgaaacctgctctgta

SEQ ID NO: 4343353 - DNA, 16 bp, Homo sapiens
ctttgaataaaagaat

SEQ ID NO: 4343354 - DNA, 18 bp, Homo sapiens
ctttgagaccagaagaaa

SEQ ID NO: 4343355 - DNA, 20 bp, Homo sapiens
ctttgagaccagaagaaaag

SEQ ID NO: 4343356 - DNA, 21 bp, Homo sapiens
ctttgagaccagaagaaaaga

SEQ ID NO: 4343357 - DNA, 23 bp, Homo sapiens
ctttgattctccttttatgtgta

SEQ ID NO: 4343358 - DNA, 20 bp, Homo sapiens
ctttgcaaattatttattac

SEQ ID NO: 4343359 - DNA, 21 bp, Homo sapiens
ctttgccttgatgttgtgttg

SEQ ID NO: 4343360 - DNA, 12 bp, Homo sapiens
ctttgctccagg

SEQ ID NO: 4343361 - DNA, 15 bp, Homo sapiens
ctttgctgcatttta

SEQ ID NO: 4343362 - DNA, 20 bp, Homo sapiens
ctttgcttctttttcttacc

SEQ ID NO: 4343363 - DNA, 20 bp, Homo sapiens
ctttggataataggaattca

SEQ ID NO: 4343364 - DNA, 23 bp, Homo sapiens
ctttgggagattatcagtagaaa

SEQ ID NO: 4343365 - DNA, 13 bp, Homo sapiens
ctttgggaggcca

SEQ ID NO: 4343366 - DNA, 18 bp, Homo sapiens
ctttgtagaataaatggt

SEQ ID NO: 4343367 - DNA, 15 bp, Homo sapiens
ctttgtcaatgctct

SEQ ID NO: 4343368 - DNA, 11 bp, Homo sapiens
ctttgtgttgg

SEQ ID NO: 4343369 - DNA, 20 bp, Homo sapiens
ctttgtgttgggagggatta

SEQ ID NO: 4343370 - DNA, 17 bp, Homo sapiens
ctttgttctcagctccc

SEQ ID NO: 4343371 - DNA, 23 bp, Homo sapiens
ctttgttctcagctccccctgtc

SEQ ID NO: 4343372 - DNA, 15 bp, Homo sapiens
ctttgtttcttgttt

SEQ ID NO: 4343373 - DNA, 21 bp, Homo sapiens
ctttgtttgttgtcagctgaa

SEQ ID NO: 4343374 - DNA, 21 bp, Homo sapiens
cttttaagtttgaaactaact

SEQ ID NO: 4343375 - DNA, 16 bp, Homo sapiens
cttttaggttgttacc

SEQ ID NO: 4343376 - DNA, 20 bp, Homo sapiens
cttttatgaaattaacaaga

SEQ ID NO: 4343377 - DNA, 22 bp, Homo sapiens
cttttattgcaccattttcaat

SEQ ID NO: 4343378 - DNA, 16 bp, Homo sapiens
cttttattttcattgt

SEQ ID NO: 4343379 - DNA, 20 bp, Homo sapiens
cttttcgcttgcttctgcag

SEQ ID NO: 4343380 - DNA, 24 bp, Homo sapiens
cttttcgcttgcttctgcagcaac

SEQ ID NO: 4343381 - DNA, 17 bp, Homo sapiens
cttttctatggagcaaa

SEQ ID NO: 4343382 - DNA, 14 bp, Homo sapiens
cttttctttttctc

SEQ ID NO: 4343383 - DNA, 13 bp, Homo sapiens
cttttggaaataa

SEQ ID NO: 4343384 - DNA, 14 bp, Homo sapiens
ctttttaaaataga

SEQ ID NO: 4343385 - DNA, 13 bp, Homo sapiens
ctttttcttttct

SEQ ID NO: 4343386 - DNA, 13 bp, Homo sapiens
ctttttgctgtgt

SEQ ID NO: 4343387 - DNA, 12 bp, Homo sapiens
ctttttgtcaaa

SEQ ID NO: 4343388 - DNA, 12 bp, Homo sapiens
cttttttaaagt

SEQ ID NO: 4343389 - DNA, 17 bp, Homo sapiens
cttttttctctatgtac

SEQ ID NO: 4343390 - DNA, 13 bp, Homo sapiens
cttttttcttccc

SEQ ID NO: 4343391 - DNA, 18 bp, Homo sapiens
cttttttgtttgtttctt

SEQ ID NO: 4343392 - DNA, 21 bp, Homo sapiens
ctttttttccttcctttttat

SEQ ID NO: 4343393 - DNA, 13 bp, Homo sapiens
gaaaaagaagaag

SEQ ID NO: 4343394 - DNA, 14 bp, Homo sapiens
gaaaaagaagaagg

SEQ ID NO: 4343395 - DNA, 12 bp, Homo sapiens
gaaaaaggaaaa

SEQ ID NO: 4343396 - DNA, 12 bp, Homo sapiens
gaaaaaggagga

SEQ ID NO: 4343397 - DNA, 20 bp, Homo sapiens
gaaaaatattcaagtaacac

SEQ ID NO: 4343398 - DNA, 16 bp, Homo sapiens
gaaaacaaacttctcg

SEQ ID NO: 4343399 - DNA, 24 bp, Homo sapiens
gaaaacaatttgcataatactaat

SEQ ID NO: 4343400 - DNA, 19 bp, Homo sapiens
gaaaacactaacaaaattt

SEQ ID NO: 4343401 - DNA, 20 bp, Homo sapiens
gaaaacgttgacccctttcc

SEQ ID NO: 4343402 - DNA, 22 bp, Homo sapiens
gaaaacgttgacccctttcccc

SEQ ID NO: 4343403 - DNA, 23 bp, Homo sapiens
gaaaacgttgacccctttccccc

SEQ ID NO: 4343404 - DNA, 22 bp, Homo sapiens
gaaaactgacatcagatttctt

SEQ ID NO: 4343405 - DNA, 20 bp, Homo sapiens
gaaaaggatgatggaaaaat

SEQ ID NO: 4343406 - DNA, 13 bp, Homo sapiens
gaaaataattgtt

SEQ ID NO: 4343407 - DNA, 20 bp, Homo sapiens
gaaaatcatattgagaataa

SEQ ID NO: 4343408 - DNA, 21 bp, Homo sapiens
gaaaatgaatggacaaagctc

SEQ ID NO: 4343409 - DNA, 22 bp, Homo sapiens
gaaaatgcattttcttcagaat

SEQ ID NO: 4343410 - DNA, 19 bp, Homo sapiens
gaaaatggatgacaaagaa

SEQ ID NO: 4343411 - DNA, 17 bp, Homo sapiens
gaaaattcaaaggtgga

SEQ ID NO: 4343412 - DNA, 13 bp, Homo sapiens
gaaaattcacaga

SEQ ID NO: 4343413 - DNA, 17 bp, Homo sapiens
gaaacaaagcaaatttc

SEQ ID NO: 4343414 - DNA, 18 bp, Homo sapiens
gaaacagacagggagaag

SEQ ID NO: 4343415 - DNA, 12 bp, Homo sapiens
gaaacatagaaa

SEQ ID NO: 4343416 - DNA, 15 bp, Homo sapiens
gaaacatagaaacat

SEQ ID NO: 4343417 - DNA, 14 bp, Homo sapiens
gaaacatagaaaga

SEQ ID NO: 4343418 - DNA, 16 bp, Homo sapiens
gaaacatagaaagaca

SEQ ID NO: 4343419 - DNA, 21 bp, Homo sapiens
gaaagacaggagtttatctat

SEQ ID NO: 4343420 - DNA, 13 bp, Homo sapiens
gaaagacatctgc

SEQ ID NO: 4343421 - DNA, 20 bp, Homo sapiens
gaaagaggaggcagaaagat

SEQ ID NO: 4343422 - DNA, 19 bp, Homo sapiens
gaaagcaaacatgtgcaga

SEQ ID NO: 4343423 - DNA, 15 bp, Homo sapiens
gaaagccaccttgtt

SEQ ID NO: 4343424 - DNA, 16 bp, Homo sapiens
gaaagtcctgctttcc

SEQ ID NO: 4343425 - DNA, 19 bp, Homo sapiens
gaaagttgcttttattgca

SEQ ID NO: 4343426 - DNA, 12 bp, Homo sapiens
gaaataaagaaa

SEQ ID NO: 4343427 - DNA, 14 bp, Homo sapiens
gaaataaagaaaat

SEQ ID NO: 4343428 - DNA, 15 bp, Homo sapiens
gaaataaagaaaatt

SEQ ID NO: 4343429 - DNA, 16 bp, Homo sapiens
gaaatagttgtctgtg

SEQ ID NO: 4343430 - DNA, 20 bp, Homo sapiens
gaaatagtttccaagaaatt

SEQ ID NO: 4343431 - DNA, 19 bp, Homo sapiens
gaaatgaagcagaggaagg

SEQ ID NO: 4343432 - DNA, 20 bp, Homo sapiens
gaaatggactggtttgagat

SEQ ID NO: 4343433 - DNA, 17 bp, Homo sapiens
gaaatggatgcaaagta

SEQ ID NO: 4343434 - DNA, 13 bp, Homo sapiens
gaaatgttaagaa

SEQ ID NO: 4343435 - DNA, 15 bp, Homo sapiens
gaaatgttaagaaag

SEQ ID NO: 4343436 - DNA, 16 bp, Homo sapiens
gaaatgttaagaaaga

SEQ ID NO: 4343437 - DNA, 19 bp, Homo sapiens
gaaattattggtatatttg

SEQ ID NO: 4343438 - DNA, 20 bp, Homo sapiens
gaaattattggtatatttgt

SEQ ID NO: 4343439 - DNA, 19 bp, Homo sapiens
gaacagcaggatgccctgt

SEQ ID NO: 4343440 - DNA, 20 bp, Homo sapiens
gaacagcaggatgccctgtt

SEQ ID NO: 4343441 - DNA, 22 bp, Homo sapiens
gaacatgaatctctaacagctc

SEQ ID NO: 4343442 - DNA, 20 bp, Homo sapiens
gaacatgcaagaatttctgg

SEQ ID NO: 4343443 - DNA, 14 bp, Homo sapiens
gaacatggccaata

SEQ ID NO: 4343444 - DNA, 23 bp, Homo sapiens
gaacatggccaatagtcatatgt

SEQ ID NO: 4343445 - DNA, 18 bp, Homo sapiens
gaacattaggaattgttt

SEQ ID NO: 4343446 - DNA, 19 bp, Homo sapiens
gaaccaatagaaagcaaac

SEQ ID NO: 4343447 - DNA, 17 bp, Homo sapiens
gaaccagaagtgcagcc

SEQ ID NO: 4343448 - DNA, 21 bp, Homo sapiens
gaacccccacaaccccctcca

SEQ ID NO: 4343449 - DNA, 16 bp, Homo sapiens
gaactcagtgccacac

SEQ ID NO: 4343450 - DNA, 16 bp, Homo sapiens
gaactcattattttga

SEQ ID NO: 4343451 - DNA, 15 bp, Homo sapiens
gaactgatacatctg

SEQ ID NO: 4343452 - DNA, 18 bp, Homo sapiens
gaactggagctgctaagc

SEQ ID NO: 4343453 - DNA, 20 bp, Homo sapiens
gaactgttcacactgcagag

SEQ ID NO: 4343454 - DNA, 22 bp, Homo sapiens
gaagaaaatggatgacaaagaa

SEQ ID NO: 4343455 - DNA, 13 bp, Homo sapiens
gaagaagaggaag

SEQ ID NO: 4343456 - DNA, 23 bp, Homo sapiens
gaagacaatgtgaaaagaaaaat

SEQ ID NO: 4343457 - DNA, 23 bp, Homo sapiens
gaagacactaattccttaaatga

SEQ ID NO: 4343458 - DNA, 11 bp, Homo sapiens
gaagaggaagt

SEQ ID NO: 4343459 - DNA, 22 bp, Homo sapiens
gaagaggaagttagagataatt

SEQ ID NO: 4343460 - DNA, 14 bp, Homo sapiens
gaagagggagacag

SEQ ID NO: 4343461 - DNA, 14 bp, Homo sapiens
gaagagttgaggaa

SEQ ID NO: 4343462 - DNA, 23 bp, Homo sapiens
gaagatgttcaatagaacatgca

SEQ ID NO: 4343463 - DNA, 17 bp, Homo sapiens
gaagatttgaaaacaaa

SEQ ID NO: 4343464 - DNA, 16 bp, Homo sapiens
gaagcaccataacttt

SEQ ID NO: 4343465 - DNA, 22 bp, Homo sapiens
gaagcagaggaaggaaacatag

SEQ ID NO: 4343466 - DNA, 14 bp, Homo sapiens
gaagcggctggcag

SEQ ID NO: 4343467 - DNA, 15 bp, Homo sapiens
gaagcgtgagacgcc

SEQ ID NO: 4343468 - DNA, 22 bp, Homo sapiens
gaagctcccacacccacctctg

SEQ ID NO: 4343469 - DNA, 17 bp, Homo sapiens
gaagctgagggcaaatc

SEQ ID NO: 4343470 - DNA, 16 bp, Homo sapiens
gaagctggccctcagc

SEQ ID NO: 4343471 - DNA, 21 bp, Homo sapiens
gaagctggccctcagctccct

SEQ ID NO: 4343472 - DNA, 12 bp, Homo sapiens
gaaggaaacata

SEQ ID NO: 4343473 - DNA, 19 bp, Homo sapiens
gaaggaaacatagaaagac

SEQ ID NO: 4343474 - DNA, 17 bp, Homo sapiens
gaagggaacagcctgag

SEQ ID NO: 4343475 - DNA, 14 bp, Homo sapiens
gaagtagtccttgg

SEQ ID NO: 4343476 - DNA, 16 bp, Homo sapiens
gaagttttttactttg

SEQ ID NO: 4343477 - DNA, 14 bp, Homo sapiens
gaataaaaaataaa

SEQ ID NO: 4343478 - DNA, 23 bp, Homo sapiens
gaataaaaaataaataaaatgga

SEQ ID NO: 4343479 - DNA, 11 bp, Homo sapiens
gaataaaagaa

SEQ ID NO: 4343480 - DNA, 15 bp, Homo sapiens
gaataaatgttcaaa

SEQ ID NO: 4343481 - DNA, 17 bp, Homo sapiens
gaataagaaagtttcac

SEQ ID NO: 4343482 - DNA, 16 bp, Homo sapiens
gaataattatttcaga

SEQ ID NO: 4343483 - DNA, 15 bp, Homo sapiens
gaatacatctgtgga

SEQ ID NO: 4343484 - DNA, 14 bp, Homo sapiens
gaatatactgtctt

SEQ ID NO: 4343485 - DNA, 15 bp, Homo sapiens
gaatatatatatata

SEQ ID NO: 4343486 - DNA, 14 bp, Homo sapiens
gaatatattactga

SEQ ID NO: 4343487 - DNA, 13 bp, Homo sapiens
gaatcatgtctgt

SEQ ID NO: 4343488 - DNA, 14 bp, Homo sapiens
gaatcatgtctgta

SEQ ID NO: 4343489 - DNA, 22 bp, Homo sapiens
gaatccatatttcaacagagcc

SEQ ID NO: 4343490 - DNA, 18 bp, Homo sapiens
gaatcctacgctatgtag

SEQ ID NO: 4343491 - DNA, 20 bp, Homo sapiens
gaatcctacgctatgtagaa

SEQ ID NO: 4343492 - DNA, 16 bp, Homo sapiens
gaatctggacatttgt

SEQ ID NO: 4343493 - DNA, 19 bp, Homo sapiens
gaatctgtgcagtcatcaa

SEQ ID NO: 4343494 - DNA, 20 bp, Homo sapiens
gaatgatccctcagtctgag

SEQ ID NO: 4343495 - DNA, 21 bp, Homo sapiens
gaatgattggttaaaatgtga

SEQ ID NO: 4343496 - DNA, 16 bp, Homo sapiens
gaatgcacagatatac

SEQ ID NO: 4343497 - DNA, 22 bp, Homo sapiens
gaatgcacagatatactttgtg

SEQ ID NO: 4343498 - DNA, 18 bp, Homo sapiens
gaatgctgagctgaagaa

SEQ ID NO: 4343499 - DNA, 21 bp, Homo sapiens
gaatgctgagctgaagaaatt

SEQ ID NO: 4343500 - DNA, 12 bp, Homo sapiens
gaatgcttctca

SEQ ID NO: 4343501 - DNA, 20 bp, Homo sapiens
gaatgggcatgaatggagat

SEQ ID NO: 4343502 - DNA, 23 bp, Homo sapiens
gaatgtagccctctccaaatcaa

SEQ ID NO: 4343503 - DNA, 17 bp, Homo sapiens
gaatgtgaagccagatc

SEQ ID NO: 4343504 - DNA, 18 bp, Homo sapiens
gaatgtgtacaaagtgta

SEQ ID NO: 4343505 - DNA, 18 bp, Homo sapiens
gaattaccatagagtaat

SEQ ID NO: 4343506 - DNA, 19 bp, Homo sapiens
gaattaccatagagtaatg

SEQ ID NO: 4343507 - DNA, 13 bp, Homo sapiens
gaattctttgcat

SEQ ID NO: 4343508 - DNA, 15 bp, Homo sapiens
gaattggcataattt

SEQ ID NO: 4343509 - DNA, 17 bp, Homo sapiens
gaattggcataatttgt

SEQ ID NO: 4343510 - DNA, 21 bp, Homo sapiens
gaatttatgagatttactgct

SEQ ID NO: 4343511 - DNA, 19 bp, Homo sapiens
gaatttccattgacatttg

SEQ ID NO: 4343512 - DNA, 17 bp, Homo sapiens
gaatttctggaagaaag

SEQ ID NO: 4343513 - DNA, 18 bp, Homo sapiens
gaatttctggaagaaagg

SEQ ID NO: 4343514 - DNA, 13 bp, Homo sapiens
gaattttagtcct

SEQ ID NO: 4343515 - DNA, 14 bp, Homo sapiens
gacaatcattgttt

SEQ ID NO: 4343516 - DNA, 17 bp, Homo sapiens
gacaatcattgttttga

SEQ ID NO: 4343517 - DNA, 16 bp, Homo sapiens
gacaatgccaataggt

SEQ ID NO: 4343518 - DNA, 12 bp, Homo sapiens
gacaatgtgaaa

SEQ ID NO: 4343519 - DNA, 18 bp, Homo sapiens
gacaatgtgaaaagaaaa

SEQ ID NO: 4343520 - DNA, 20 bp, Homo sapiens
gacaatgtgaaaagaaaaat

SEQ ID NO: 4343521 - DNA, 15 bp, Homo sapiens
gacactaattcctta

SEQ ID NO: 4343522 - DNA, 23 bp, Homo sapiens
gacactcgcctactaagtaccct

SEQ ID NO: 4343523 - DNA, 14 bp, Homo sapiens
gacactgttgcaaa

SEQ ID NO: 4343524 - DNA, 21 bp, Homo sapiens
gacacttatctcactgtttta

SEQ ID NO: 4343525 - DNA, 14 bp, Homo sapiens
gacactttacctct

SEQ ID NO: 4343526 - DNA, 16 bp, Homo sapiens
gacagagatgtgcaga

SEQ ID NO: 4343527 - DNA, 16 bp, Homo sapiens
gacagcacagatgtga

SEQ ID NO: 4343528 - DNA, 18 bp, Homo sapiens
gacagcacagatgtgaag

SEQ ID NO: 4343529 - DNA, 15 bp, Homo sapiens
gacaggcctgaagat

SEQ ID NO: 4343530 - DNA, 19 bp, Homo sapiens
gacaggcctgaagatatta

SEQ ID NO: 4343531 - DNA, 21 bp, Homo sapiens
gacagggagaagttgagcagg

SEQ ID NO: 4343532 - DNA, 19 bp, Homo sapiens
gacaggggcgcttgggagg

SEQ ID NO: 4343533 - DNA, 14 bp, Homo sapiens
gacagtatgagaaa

SEQ ID NO: 4343534 - DNA, 11 bp, Homo sapiens
gacatagcctt

SEQ ID NO: 4343535 - DNA, 13 bp, Homo sapiens
gacatcagatttc

SEQ ID NO: 4343536 - DNA, 15 bp, Homo sapiens
gacatcagatttctt

SEQ ID NO: 4343537 - DNA, 16 bp, Homo sapiens
gacatcagatttctta

SEQ ID NO: 4343538 - DNA, 20 bp, Homo sapiens
gacatcagatttcttaatgt

SEQ ID NO: 4343539 - DNA, 15 bp, Homo sapiens
gacatcctagcccca

SEQ ID NO: 4343540 - DNA, 16 bp, Homo sapiens
gacatcctagccccac

SEQ ID NO: 4343541 - DNA, 13 bp, Homo sapiens
gacatctgcctgt

SEQ ID NO: 4343542 - DNA, 17 bp, Homo sapiens
gacatgatgctaagagt

SEQ ID NO: 4343543 - DNA, 22 bp, Homo sapiens
gacattttcttttattatcagt

SEQ ID NO: 4343544 - DNA, 23 bp, Homo sapiens
gacattttcttttattatcagtt

SEQ ID NO: 4343545 - DNA, 18 bp, Homo sapiens
gaccacaaaacttttcta

SEQ ID NO: 4343546 - DNA, 13 bp, Homo sapiens
gaccagaagaaaa

SEQ ID NO: 4343547 - DNA, 14 bp, Homo sapiens
gaccagaagaaaag

SEQ ID NO: 4343548 - DNA, 11 bp, Homo sapiens
gaccaggaggg

SEQ ID NO: 4343549 - DNA, 18 bp, Homo sapiens
gaccattgaaaaaggaaa

SEQ ID NO: 4343550 - DNA, 11 bp, Homo sapiens
gacccacagcc

SEQ ID NO: 4343551 - DNA, 15 bp, Homo sapiens
gacccacagccctga

SEQ ID NO: 4343552 - DNA, 20 bp, Homo sapiens
gacccctttcccccacccca

SEQ ID NO: 4343553 - DNA, 17 bp, Homo sapiens
gacccttttgagcctag

SEQ ID NO: 4343554 - DNA, 17 bp, Homo sapiens
gaccgttttgtattgct

SEQ ID NO: 4343555 - DNA, 18 bp, Homo sapiens
gaccgttttgtattgctt

SEQ ID NO: 4343556 - DNA, 18 bp, Homo sapiens
gacctaatgctggcctga

SEQ ID NO: 4343557 - DNA, 15 bp, Homo sapiens
gacctctgactgatg

SEQ ID NO: 4343558 - DNA, 15 bp, Homo sapiens
gacgccaccattcct

SEQ ID NO: 4343559 - DNA, 18 bp, Homo sapiens
gacgttgttgtcattgtc

SEQ ID NO: 4343560 - DNA, 17 bp, Homo sapiens
gactaatgttggacaga

SEQ ID NO: 4343561 - DNA, 18 bp, Homo sapiens
gactattttttaataaaa

SEQ ID NO: 4343562 - DNA, 19 bp, Homo sapiens
gactcctcttcccagagtc

SEQ ID NO: 4343563 - DNA, 17 bp, Homo sapiens
gactctgaactggagct

SEQ ID NO: 4343564 - DNA, 18 bp, Homo sapiens
gactctgaactggagctg

SEQ ID NO: 4343565 - DNA, 17 bp, Homo sapiens
gactctgtgtgagcgtg

SEQ ID NO: 4343566 - DNA, 14 bp, Homo sapiens
gactgaagctgggg

SEQ ID NO: 4343567 - DNA, 13 bp, Homo sapiens
gactgacactact

SEQ ID NO: 4343568 - DNA, 23 bp, Homo sapiens
gactgatttttcatggcaacatc

SEQ ID NO: 4343569 - DNA, 23 bp, Homo sapiens
gactgggcacccctgcctcctgc

SEQ ID NO: 4343570 - DNA, 18 bp, Homo sapiens
gactgggggcggggcctg

SEQ ID NO: 4343571 - DNA, 13 bp, Homo sapiens
gactggttgtcag

SEQ ID NO: 4343572 - DNA, 20 bp, Homo sapiens
gactgtaactttttttcagt

SEQ ID NO: 4343573 - DNA, 16 bp, Homo sapiens
gactgttttctcttga

SEQ ID NO: 4343574 - DNA, 19 bp, Homo sapiens
gactttgctgcattttaca

SEQ ID NO: 4343575 - DNA, 12 bp, Homo sapiens
gactttgctgtt

SEQ ID NO: 4343576 - DNA, 14 bp, Homo sapiens
gactttgtaccccc

SEQ ID NO: 4343577 - DNA, 22 bp, Homo sapiens
gagaaaaatattcaagtaacac

SEQ ID NO: 4343578 - DNA, 23 bp, Homo sapiens
gagaaaaatattcaagtaacact

SEQ ID NO: 4343579 - DNA, 15 bp, Homo sapiens
gagaaaccttgcaaa

SEQ ID NO: 4343580 - DNA, 13 bp, Homo sapiens
gagaaactgaagc

SEQ ID NO: 4343581 - DNA, 15 bp, Homo sapiens
gagaaatatgcagaa

SEQ ID NO: 4343582 - DNA, 15 bp, Homo sapiens
gagaaatgaagcaga

SEQ ID NO: 4343583 - DNA, 19 bp, Homo sapiens
gagaaatgaagcagaggaa

SEQ ID NO: 4343584 - DNA, 13 bp, Homo sapiens
gagaagcggctgg

SEQ ID NO: 4343585 - DNA, 15 bp, Homo sapiens
gagaaggaactgata

SEQ ID NO: 4343586 - DNA, 16 bp, Homo sapiens
gagaagttttgttttt

SEQ ID NO: 4343587 - DNA, 18 bp, Homo sapiens
gagaataattatttcaga

SEQ ID NO: 4343588 - DNA, 21 bp, Homo sapiens
gagaatacacatataaaaaca

SEQ ID NO: 4343589 - DNA, 17 bp, Homo sapiens
gagaatgcacagatata

SEQ ID NO: 4343590 - DNA, 20 bp, Homo sapiens
gagacagagatgtgcagagt

SEQ ID NO: 4343591 - DNA, 15 bp, Homo sapiens
gagaccagaagaaaa

SEQ ID NO: 4343592 - DNA, 13 bp, Homo sapiens
gagaccaggaggg

SEQ ID NO: 4343593 - DNA, 12 bp, Homo sapiens
gagaccaggggc

SEQ ID NO: 4343594 - DNA, 17 bp, Homo sapiens
gagacccacagccctga

SEQ ID NO: 4343595 - DNA, 19 bp, Homo sapiens
gagactaatgttggacaga

SEQ ID NO: 4343596 - DNA, 15 bp, Homo sapiens
gagactgcaagtaag

SEQ ID NO: 4343597 - DNA, 16 bp, Homo sapiens
gagactgcaagtaagg

SEQ ID NO: 4343598 - DNA, 23 bp, Homo sapiens
gagactgggcacccctgcctcct

SEQ ID NO: 4343599 - DNA, 14 bp, Homo sapiens
gagactttgctgtt

SEQ ID NO: 4343600 - DNA, 14 bp, Homo sapiens
gagagagtggtaaa

SEQ ID NO: 4343601 - DNA, 11 bp, Homo sapiens
gagagccctgt

SEQ ID NO: 4343602 - DNA, 16 bp, Homo sapiens
gagagccctgtccctg

SEQ ID NO: 4343603 - DNA, 14 bp, Homo sapiens
gagagcctctgttt

SEQ ID NO: 4343604 - DNA, 12 bp, Homo sapiens
gagaggaagaaa

SEQ ID NO: 4343605 - DNA, 15 bp, Homo sapiens
gagaggcctcggctg

SEQ ID NO: 4343606 - DNA, 20 bp, Homo sapiens
gagaggcctcggctgtctcc

SEQ ID NO: 4343607 - DNA, 21 bp, Homo sapiens
gagaggcctcggctgtctcct

SEQ ID NO: 4343608 - DNA, 19 bp, Homo sapiens
gagagtgggtcacatttgt

SEQ ID NO: 4343609 - DNA, 21 bp, Homo sapiens
gagagtggtaaaaaagaaatg

SEQ ID NO: 4343610 - DNA, 18 bp, Homo sapiens
gagattaggctgaggcag

SEQ ID NO: 4343611 - DNA, 17 bp, Homo sapiens
gagattatcagtagaaa

SEQ ID NO: 4343612 - DNA, 18 bp, Homo sapiens
gagattgcaccactgcac

SEQ ID NO: 4343613 - DNA, 15 bp, Homo sapiens
gagatttactgctct

SEQ ID NO: 4343614 - DNA, 18 bp, Homo sapiens
gagcagcatctagtttcc

SEQ ID NO: 4343615 - DNA, 13 bp, Homo sapiens
gagcattggcccc

SEQ ID NO: 4343616 - DNA, 14 bp, Homo sapiens
gagccccagcccca

SEQ ID NO: 4343617 - DNA, 15 bp, Homo sapiens
gagccccagccccaa

SEQ ID NO: 4343618 - DNA, 22 bp, Homo sapiens
gagccccagccccaatccagag

SEQ ID NO: 4343619 - DNA, 22 bp, Homo sapiens
gagcccccttcctgtccccagg

SEQ ID NO: 4343620 - DNA, 19 bp, Homo sapiens
gagcccctcatgccacagt

SEQ ID NO: 4343621 - DNA, 12 bp, Homo sapiens
gagccctgtccc

SEQ ID NO: 4343622 - DNA, 21 bp, Homo sapiens
gagccgcgctttcccctcctc

SEQ ID NO: 4343623 - DNA, 18 bp, Homo sapiens
gagcctcctgcccagtcc

SEQ ID NO: 4343624 - DNA, 18 bp, Homo sapiens
gagcctctgttttgtaaa

SEQ ID NO: 4343625 - DNA, 12 bp, Homo sapiens
gagcctgcccag

SEQ ID NO: 4343626 - DNA, 21 bp, Homo sapiens
gagcctgcccagttggaggag

SEQ ID NO: 4343627 - DNA, 11 bp, Homo sapiens
gagcctgtcca

SEQ ID NO: 4343628 - DNA, 17 bp, Homo sapiens
gagcgtgtccacagagt

SEQ ID NO: 4343629 - DNA, 16 bp, Homo sapiens
gagctcaactaaaagt

SEQ ID NO: 4343630 - DNA, 15 bp, Homo sapiens
gagctgagtggggga

SEQ ID NO: 4343631 - DNA, 17 bp, Homo sapiens
gagctgtttatgttttt

SEQ ID NO: 4343632 - DNA, 15 bp, Homo sapiens
gaggaaaaacagagg

SEQ ID NO: 4343633 - DNA, 17 bp, Homo sapiens
gaggaagagaaaaaata

SEQ ID NO: 4343634 - DNA, 18 bp, Homo sapiens
gaggacactaggagactg

SEQ ID NO: 4343635 - DNA, 21 bp, Homo sapiens
gaggactgaagctggggcttg

SEQ ID NO: 4343636 - DNA, 17 bp, Homo sapiens
gaggagccccagccccg

SEQ ID NO: 4343637 - DNA, 18 bp, Homo sapiens
gaggagccccagccccgt

SEQ ID NO: 4343638 - DNA, 17 bp, Homo sapiens
gaggagggagagccctg

SEQ ID NO: 4343639 - DNA, 23 bp, Homo sapiens
gaggaggttcgggattccctggt

SEQ ID NO: 4343640 - DNA, 13 bp, Homo sapiens
gaggatgctgaag

SEQ ID NO: 4343641 - DNA, 14 bp, Homo sapiens
gaggatgctgaagt

SEQ ID NO: 4343642 - DNA, 19 bp, Homo sapiens
gaggccccaaaggaaaaag

SEQ ID NO: 4343643 - DNA, 14 bp, Homo sapiens
gaggccccaactca

SEQ ID NO: 4343644 - DNA, 17 bp, Homo sapiens
gaggccgctgcccctga

SEQ ID NO: 4343645 - DNA, 18 bp, Homo sapiens
gaggccgctgcccctgag

SEQ ID NO: 4343646 - DNA, 18 bp, Homo sapiens
gaggcctcggctgtctcc

SEQ ID NO: 4343647 - DNA, 22 bp, Homo sapiens
gaggcctcggctgtctcctgtc

SEQ ID NO: 4343648 - DNA, 15 bp, Homo sapiens
gaggcgaataaatgt

SEQ ID NO: 4343649 - DNA, 16 bp, Homo sapiens
gaggctctctaagaaa

SEQ ID NO: 4343650 - DNA, 17 bp, Homo sapiens
gaggctctctaagaaaa

SEQ ID NO: 4343651 - DNA, 12 bp, Homo sapiens
gagggacagagc

SEQ ID NO: 4343652 - DNA, 20 bp, Homo sapiens
gagggacagagcccgggaga

SEQ ID NO: 4343653 - DNA, 17 bp, Homo sapiens
gagggactgtatttctg

SEQ ID NO: 4343654 - DNA, 22 bp, Homo sapiens
gaggggcccctgcttctccagc

SEQ ID NO: 4343655 - DNA, 15 bp, Homo sapiens
gaggggggcacatgc

SEQ ID NO: 4343656 - DNA, 18 bp, Homo sapiens
gaggggttgccacaggcc

SEQ ID NO: 4343657 - DNA, 22 bp, Homo sapiens
gaggggttgccacaggcctccc

SEQ ID NO: 4343658 - DNA, 23 bp, Homo sapiens
gaggggttgccacaggcctccct

SEQ ID NO: 4343659 - DNA, 13 bp, Homo sapiens
gagggtttctgat

SEQ ID NO: 4343660 - DNA, 18 bp, Homo sapiens
gagggtttctgatctgta

SEQ ID NO: 4343661 - DNA, 15 bp, Homo sapiens
gaggtcgaggcagga

SEQ ID NO: 4343662 - DNA, 18 bp, Homo sapiens
gaggtgcctgaaagctgg

SEQ ID NO: 4343663 - DNA, 22 bp, Homo sapiens
gaggtggccctcccaggctggt

SEQ ID NO: 4343664 - DNA, 11 bp, Homo sapiens
gaggtgggagg

SEQ ID NO: 4343665 - DNA, 15 bp, Homo sapiens
gaggtggtgaatttt

SEQ ID NO: 4343666 - DNA, 19 bp, Homo sapiens
gagtctgaaccaatagaaa

SEQ ID NO: 4343667 - DNA, 22 bp, Homo sapiens
gagtctgaaccaatagaaagca

SEQ ID NO: 4343668 - DNA, 17 bp, Homo sapiens
gagtctgtttcccaagc

SEQ ID NO: 4343669 - DNA, 19 bp, Homo sapiens
gagtctgtttcccaagcta

SEQ ID NO: 4343670 - DNA, 21 bp, Homo sapiens
gagtcttaactgtatttcagt

SEQ ID NO: 4343671 - DNA, 23 bp, Homo sapiens
gagtgggggatcacagcctctga

SEQ ID NO: 4343672 - DNA, 19 bp, Homo sapiens
gagtgtgtgtgtgtgtctg

SEQ ID NO: 4343673 - DNA, 14 bp, Homo sapiens
gagtgtttgaaaac

SEQ ID NO: 4343674 - DNA, 13 bp, Homo sapiens
gagttaaaatata

SEQ ID NO: 4343675 - DNA, 18 bp, Homo sapiens
gagttacttagaatgcca

SEQ ID NO: 4343676 - DNA, 16 bp, Homo sapiens
gagttcctctttgccc

SEQ ID NO: 4343677 - DNA, 21 bp, Homo sapiens
gagttctctttcttagtccct

SEQ ID NO: 4343678 - DNA, 16 bp, Homo sapiens
gagttgaggaactgta

SEQ ID NO: 4343679 - DNA, 17 bp, Homo sapiens
gagttgattcagctctg

SEQ ID NO: 4343680 - DNA, 14 bp, Homo sapiens
gagttgctggaaaa

SEQ ID NO: 4343681 - DNA, 17 bp, Homo sapiens
gagttgctggaaaatca

SEQ ID NO: 4343682 - DNA, 23 bp, Homo sapiens
gagttggggagaaactgaagccg

SEQ ID NO: 4343683 - DNA, 18 bp, Homo sapiens
gagttgttgtttgccaag

SEQ ID NO: 4343684 - DNA, 21 bp, Homo sapiens
gagtttatctatcggaagaac

SEQ ID NO: 4343685 - DNA, 12 bp, Homo sapiens
gagtttgctaaa

SEQ ID NO: 4343686 - DNA, 23 bp, Homo sapiens
gagtttgtaggtaaaatgtattt

SEQ ID NO: 4343687 - DNA, 20 bp, Homo sapiens
gataagacttgtttctttct

SEQ ID NO: 4343688 - DNA, 16 bp, Homo sapiens
gatacccaacagttta

SEQ ID NO: 4343689 - DNA, 16 bp, Homo sapiens
gatagaaaaaaactaa

SEQ ID NO: 4343690 - DNA, 20 bp, Homo sapiens
gatagcatggggcccctggc

SEQ ID NO: 4343691 - DNA, 16 bp, Homo sapiens
gatagcttgagctcag

SEQ ID NO: 4343692 - DNA, 15 bp, Homo sapiens
gatatactgcagctt

SEQ ID NO: 4343693 - DNA, 14 bp, Homo sapiens
gatatactttgtgg

SEQ ID NO: 4343694 - DNA, 12 bp, Homo sapiens
gatatagaaaat

SEQ ID NO: 4343695 - DNA, 16 bp, Homo sapiens
gatatgctgagaaatt

SEQ ID NO: 4343696 - DNA, 13 bp, Homo sapiens
gatcacatctaaa

SEQ ID NO: 4343697 - DNA, 17 bp, Homo sapiens
gatcaccccagccccca

SEQ ID NO: 4343698 - DNA, 13 bp, Homo sapiens
gatcacgctcccc

SEQ ID NO: 4343699 - DNA, 22 bp, Homo sapiens
gatcacgctccccgcctgttcc

SEQ ID NO: 4343700 - DNA, 15 bp, Homo sapiens
gatcagatgctgaat

SEQ ID NO: 4343701 - DNA, 16 bp, Homo sapiens
gatcagatgctgaatt

SEQ ID NO: 4343702 - DNA, 20 bp, Homo sapiens
gatcagatgctgaattgaga

SEQ ID NO: 4343703 - DNA, 21 bp, Homo sapiens
gatcagtctttgtcaatgctc

SEQ ID NO: 4343704 - DNA, 17 bp, Homo sapiens
gatcataggtatttcaa

SEQ ID NO: 4343705 - DNA, 21 bp, Homo sapiens
gatccatagtgctacctgcac

SEQ ID NO: 4343706 - DNA, 20 bp, Homo sapiens
gatcccaagatggagaggaa

SEQ ID NO: 4343707 - DNA, 22 bp, Homo sapiens
gatcccagcacctattgaatta

SEQ ID NO: 4343708 - DNA, 12 bp, Homo sapiens
gatcccctctct

SEQ ID NO: 4343709 - DNA, 22 bp, Homo sapiens
gatcccctctctgtggctccaa

SEQ ID NO: 4343710 - DNA, 17 bp, Homo sapiens
gatctcttgagcctggg

SEQ ID NO: 4343711 - DNA, 18 bp, Homo sapiens
gatctcttgagcctggga

SEQ ID NO: 4343712 - DNA, 18 bp, Homo sapiens
gatctttgtttaaatgcc

SEQ ID NO: 4343713 - DNA, 13 bp, Homo sapiens
gatgaaataattt

SEQ ID NO: 4343714 - DNA, 12 bp, Homo sapiens
gatgacaaagaa

SEQ ID NO: 4343715 - DNA, 16 bp, Homo sapiens
gatgacaaagaaaatg

SEQ ID NO: 4343716 - DNA, 13 bp, Homo sapiens
gatgatggaaaaa

SEQ ID NO: 4343717 - DNA, 14 bp, Homo sapiens
gatgatggaaaaat

SEQ ID NO: 4343718 - DNA, 21 bp, Homo sapiens
gatgcaaagtacaatgtgttt

SEQ ID NO: 4343719 - DNA, 20 bp, Homo sapiens
gatgccaacagacactacat

SEQ ID NO: 4343720 - DNA, 23 bp, Homo sapiens
gatgcccaccgaggagccccagc

SEQ ID NO: 4343721 - DNA, 22 bp, Homo sapiens
gatgccgaacattaggaattgt

SEQ ID NO: 4343722 - DNA, 16 bp, Homo sapiens
gatggacgctgccggg

SEQ ID NO: 4343723 - DNA, 18 bp, Homo sapiens
gatggacgctgccgggag

SEQ ID NO: 4343724 - DNA, 13 bp, Homo sapiens
gatggagaggaag

SEQ ID NO: 4343725 - DNA, 18 bp, Homo sapiens
gatggagaggaagaaacg

SEQ ID NO: 4343726 - DNA, 22 bp, Homo sapiens
gatggccgggcgcggtggctca

SEQ ID NO: 4343727 - DNA, 16 bp, Homo sapiens
gatgggaaataaagaa

SEQ ID NO: 4343728 - DNA, 13 bp, Homo sapiens
gatgggccaccgc

SEQ ID NO: 4343729 - DNA, 15 bp, Homo sapiens
gatgggccaccgccg

SEQ ID NO: 4343730 - DNA, 14 bp, Homo sapiens
gatggtttggaaaa

SEQ ID NO: 4343731 - DNA, 15 bp, Homo sapiens
gatgtctcttggaaa

SEQ ID NO: 4343732 - DNA, 21 bp, Homo sapiens
gatgtctcttggaaatgttaa

SEQ ID NO: 4343733 - DNA, 12 bp, Homo sapiens
gatgtgaagaaa

SEQ ID NO: 4343734 - DNA, 13 bp, Homo sapiens
gatgtgaagaaat

SEQ ID NO: 4343735 - DNA, 14 bp, Homo sapiens
gatgtgaagaaata

SEQ ID NO: 4343736 - DNA, 15 bp, Homo sapiens
gatgtgaagaaataa

SEQ ID NO: 4343737 - DNA, 18 bp, Homo sapiens
gatgttcaatagaacatg

SEQ ID NO: 4343738 - DNA, 14 bp, Homo sapiens
gatgtttaatgaag

SEQ ID NO: 4343739 - DNA, 11 bp, Homo sapiens
gattacctctc

SEQ ID NO: 4343740 - DNA, 20 bp, Homo sapiens
gattagggaaaatggatata

SEQ ID NO: 4343741 - DNA, 21 bp, Homo sapiens
gattatagttgtgggtgggag

SEQ ID NO: 4343742 - DNA, 15 bp, Homo sapiens
gattatcagtagaaa

SEQ ID NO: 4343743 - DNA, 18 bp, Homo sapiens
gattatttgggagggaaa

SEQ ID NO: 4343744 - DNA, 13 bp, Homo sapiens
gattcagctctgc

SEQ ID NO: 4343745 - DNA, 12 bp, Homo sapiens
gattccctctcc

SEQ ID NO: 4343746 - DNA, 17 bp, Homo sapiens
gattccctctcccaccc

SEQ ID NO: 4343747 - DNA, 11 bp, Homo sapiens
gattgaaagaa

SEQ ID NO: 4343748 - DNA, 16 bp, Homo sapiens
gattgaaagaaaaaaa

SEQ ID NO: 4343749 - DNA, 18 bp, Homo sapiens
gattgcttgagctcagga

SEQ ID NO: 4343750 - DNA, 16 bp, Homo sapiens
gattggatttgctgtg

SEQ ID NO: 4343751 - DNA, 22 bp, Homo sapiens
gattgggggatgtgaagaaata

SEQ ID NO: 4343752 - DNA, 14 bp, Homo sapiens
gatttatatataag

SEQ ID NO: 4343753 - DNA, 23 bp, Homo sapiens
gatttcagtagaattttagtcct

SEQ ID NO: 4343754 - DNA, 14 bp, Homo sapiens
gatttgaaaaactt

SEQ ID NO: 4343755 - DNA, 14 bp, Homo sapiens
gatttgatctttgt

SEQ ID NO: 4343756 - DNA, 13 bp, Homo sapiens
gatttggaaaatt

SEQ ID NO: 4343757 - DNA, 15 bp, Homo sapiens
gatttggaaaattca

SEQ ID NO: 4343758 - DNA, 16 bp, Homo sapiens
gatttggcatgggaca

SEQ ID NO: 4343759 - DNA, 21 bp, Homo sapiens
gattttaaaatgacttttatt

SEQ ID NO: 4343760 - DNA, 17 bp, Homo sapiens
gattttattacagaaat

SEQ ID NO: 4343761 - DNA, 20 bp, Homo sapiens
gattttattacagaaatgtt

SEQ ID NO: 4343762 - DNA, 13 bp, Homo sapiens
gattttgcctgtg

SEQ ID NO: 4343763 - DNA, 21 bp, Homo sapiens
gatttttcttcaggtaacact

SEQ ID NO: 4343764 - DNA, 23 bp, Homo sapiens
gattttttttttttggtaattat

SEQ ID NO: 4343765 - DNA, 15 bp, Homo sapiens
gcaaaagatgcttct

SEQ ID NO: 4343766 - DNA, 17 bp, Homo sapiens
gcaaaagatgcttctca

SEQ ID NO: 4343767 - DNA, 22 bp, Homo sapiens
gcaaaagatgcttctcactgcc

SEQ ID NO: 4343768 - DNA, 21 bp, Homo sapiens
gcaaaataaagaatagcaatt

SEQ ID NO: 4343769 - DNA, 21 bp, Homo sapiens
gcaaaatagaagaagaggaag

SEQ ID NO: 4343770 - DNA, 19 bp, Homo sapiens
gcaaacatgtgcagatatc

SEQ ID NO: 4343771 - DNA, 16 bp, Homo sapiens
gcaaagatttcagtag

SEQ ID NO: 4343772 - DNA, 22 bp, Homo sapiens
gcaaagatttcagtagaatttt

SEQ ID NO: 4343773 - DNA, 19 bp, Homo sapiens
gcaaagtacaatgtgtttt

SEQ ID NO: 4343774 - DNA, 18 bp, Homo sapiens
gcaaatttcattatctaa

SEQ ID NO: 4343775 - DNA, 15 bp, Homo sapiens
gcaacagcagagctc

SEQ ID NO: 4343776 - DNA, 14 bp, Homo sapiens
gcaactgaaggaag

SEQ ID NO: 4343777 - DNA, 17 bp, Homo sapiens
gcaagaattgaagcagg

SEQ ID NO: 4343778 - DNA, 23 bp, Homo sapiens
gcaagagggacagagcccgggag

SEQ ID NO: 4343779 - DNA, 16 bp, Homo sapiens
gcaaggaaattaagaa

SEQ ID NO: 4343780 - DNA, 21 bp, Homo sapiens
gcaaggaaattaagaactgaa

SEQ ID NO: 4343781 - DNA, 22 bp, Homo sapiens
gcaaggaaattaagaactgaat

SEQ ID NO: 4343782 - DNA, 16 bp, Homo sapiens
gcaaggagtggggagg

SEQ ID NO: 4343783 - DNA, 21 bp, Homo sapiens
gcaaggagtggggagggagtc

SEQ ID NO: 4343784 - DNA, 13 bp, Homo sapiens
gcaatattgcctg

SEQ ID NO: 4343785 - DNA, 23 bp, Homo sapiens
gcaatgaaaagtcgttttccaaa

SEQ ID NO: 4343786 - DNA, 11 bp, Homo sapiens
gcacaagaagc

SEQ ID NO: 4343787 - DNA, 14 bp, Homo sapiens
gcacaagctgcacc

SEQ ID NO: 4343788 - DNA, 22 bp, Homo sapiens
gcacaagctgcaccctcaggca

SEQ ID NO: 4343789 - DNA, 16 bp, Homo sapiens
gcacagtaatgtagaa

SEQ ID NO: 4343790 - DNA, 19 bp, Homo sapiens
gcacagtaatgtagaaatg

SEQ ID NO: 4343791 - DNA, 16 bp, Homo sapiens
gcaccagcagcctgga

SEQ ID NO: 4343792 - DNA, 17 bp, Homo sapiens
gcaccagggagaggcct

SEQ ID NO: 4343793 - DNA, 22 bp, Homo sapiens
gcaccattttcaatttggagca

SEQ ID NO: 4343794 - DNA, 13 bp, Homo sapiens
gcacccctgcctc

SEQ ID NO: 4343795 - DNA, 19 bp, Homo sapiens
gcaccctcaggcaggtggg

SEQ ID NO: 4343796 - DNA, 12 bp, Homo sapiens
gcacgtggccag

SEQ ID NO: 4343797 - DNA, 21 bp, Homo sapiens
gcactactgggtgtcatttca

SEQ ID NO: 4343798 - DNA, 15 bp, Homo sapiens
gcactgtccagctgg

SEQ ID NO: 4343799 - DNA, 15 bp, Homo sapiens
gcactgtctgcgtga

SEQ ID NO: 4343800 - DNA, 18 bp, Homo sapiens
gcacttacctgcttgagc

SEQ ID NO: 4343801 - DNA, 21 bp, Homo sapiens
gcacttagtagtttttacaaa

SEQ ID NO: 4343802 - DNA, 16 bp, Homo sapiens
gcacttattgtaaatt

SEQ ID NO: 4343803 - DNA, 15 bp, Homo sapiens
gcacttgcctgctgc

SEQ ID NO: 4343804 - DNA, 18 bp, Homo sapiens
gcacttttattttcattg

SEQ ID NO: 4343805 - DNA, 12 bp, Homo sapiens
gcagaaaatgaa

SEQ ID NO: 4343806 - DNA, 13 bp, Homo sapiens
gcagaaaatgaac

SEQ ID NO: 4343807 - DNA, 12 bp, Homo sapiens
gcagaaatagtt

SEQ ID NO: 4343808 - DNA, 16 bp, Homo sapiens
gcagaaatagttgtct

SEQ ID NO: 4343809 - DNA, 17 bp, Homo sapiens
gcagaaatagttgtctg

SEQ ID NO: 4343810 - DNA, 13 bp, Homo sapiens
gcagacaattctc

SEQ ID NO: 4343811 - DNA, 19 bp, Homo sapiens
gcagacgtcgtacccagcc

SEQ ID NO: 4343812 - DNA, 18 bp, Homo sapiens
gcagagccaccagggcac

SEQ ID NO: 4343813 - DNA, 20 bp, Homo sapiens
gcagattagtaactgttcct

SEQ ID NO: 4343814 - DNA, 15 bp, Homo sapiens
gcagcaacagcagag

SEQ ID NO: 4343815 - DNA, 13 bp, Homo sapiens
gcagcaactccca

SEQ ID NO: 4343816 - DNA, 14 bp, Homo sapiens
gcagcaactcccac

SEQ ID NO: 4343817 - DNA, 18 bp, Homo sapiens
gcagcagggagggcttct

SEQ ID NO: 4343818 - DNA, 24 bp, Homo sapiens
gcagcatcgaggaagggccgagga

SEQ ID NO: 4343819 - DNA, 21 bp, Homo sapiens
gcagccacaccgctggctccg

SEQ ID NO: 4343820 - DNA, 22 bp, Homo sapiens
gcagcccctctcacaggcagct

SEQ ID NO: 4343821 - DNA, 19 bp, Homo sapiens
gcagcctttttctggcctt

SEQ ID NO: 4343822 - DNA, 22 bp, Homo sapiens
gcagcctttttctggccttgac

SEQ ID NO: 4343823 - DNA, 20 bp, Homo sapiens
gcaggaggatcacttgagtc

SEQ ID NO: 4343824 - DNA, 21 bp, Homo sapiens
gcaggccaaacatggccagac

SEQ ID NO: 4343825 - DNA, 18 bp, Homo sapiens
gcagggaaggaatcctgg

SEQ ID NO: 4343826 - DNA, 16 bp, Homo sapiens
gcagggagggcttctg

SEQ ID NO: 4343827 - DNA, 19 bp, Homo sapiens
gcagggtcctagaaattcc

SEQ ID NO: 4343828 - DNA, 13 bp, Homo sapiens
gcaggtgcagccc

SEQ ID NO: 4343829 - DNA, 12 bp, Homo sapiens
gcagtaaaataa

SEQ ID NO: 4343830 - DNA, 15 bp, Homo sapiens
gcagtaaaataaaaa

SEQ ID NO: 4343831 - DNA, 13 bp, Homo sapiens
gcagttctctgcc

SEQ ID NO: 4343832 - DNA, 20 bp, Homo sapiens
gcataatactaatttattgc

SEQ ID NO: 4343833 - DNA, 19 bp, Homo sapiens
gcatagagtaggtactcca

SEQ ID NO: 4343834 - DNA, 20 bp, Homo sapiens
gcatagagtaggtactccat

SEQ ID NO: 4343835 - DNA, 21 bp, Homo sapiens
gcatccacttcaggagcccta

SEQ ID NO: 4343836 - DNA, 21 bp, Homo sapiens
gcatctagtttccctggtgcc

SEQ ID NO: 4343837 - DNA, 18 bp, Homo sapiens
gcatgagtctgtttccca

SEQ ID NO: 4343838 - DNA, 21 bp, Homo sapiens
gcatgagtctgtttcccaagc

SEQ ID NO: 4343839 - DNA, 22 bp, Homo sapiens
gcatgagtctgtttcccaagct

SEQ ID NO: 4343840 - DNA, 23 bp, Homo sapiens
gcatgagtctgtttcccaagcta

SEQ ID NO: 4343841 - DNA, 22 bp, Homo sapiens
gcatgctttgagaccagaagaa

SEQ ID NO: 4343842 - DNA, 17 bp, Homo sapiens
gcatggagactctgaga

SEQ ID NO: 4343843 - DNA, 21 bp, Homo sapiens
gcatgtttgtctgtgtgctgt

SEQ ID NO: 4343844 - DNA, 23 bp, Homo sapiens
gcatgtttgtctgtgtgctgtaa

SEQ ID NO: 4343845 - DNA, 17 bp, Homo sapiens
gcattcattctgagccc

SEQ ID NO: 4343846 - DNA, 20 bp, Homo sapiens
gcattccttacttgcactgt

SEQ ID NO: 4343847 - DNA, 14 bp, Homo sapiens
gcattgagaaggaa

SEQ ID NO: 4343848 - DNA, 19 bp, Homo sapiens
gcattggcccctgagccca

SEQ ID NO: 4343849 - DNA, 16 bp, Homo sapiens
gcatttaaactctgcc

SEQ ID NO: 4343850 - DNA, 22 bp, Homo sapiens
gcatttaaactctgccagaaaa

SEQ ID NO: 4343851 - DNA, 17 bp, Homo sapiens
gcatttcacgaactgtt

SEQ ID NO: 4343852 - DNA, 13 bp, Homo sapiens
gcatttgctgttg

SEQ ID NO: 4343853 - DNA, 15 bp, Homo sapiens
gccaaaatgtactta

SEQ ID NO: 4343854 - DNA, 21 bp, Homo sapiens
gccaaaatgtacttaaatgag

SEQ ID NO: 4343855 - DNA, 19 bp, Homo sapiens
gccaacagacactacatta

SEQ ID NO: 4343856 - DNA, 17 bp, Homo sapiens
gccaagctaatctgcct

SEQ ID NO: 4343857 - DNA, 17 bp, Homo sapiens
gccaaggccggagaccc

SEQ ID NO: 4343858 - DNA, 23 bp, Homo sapiens
gccaatatgacacagcttgtgaa

SEQ ID NO: 4343859 - DNA, 19 bp, Homo sapiens
gccaatggagaaaatgaat

SEQ ID NO: 4343860 - DNA, 14 bp, Homo sapiens
gccacaggcctccc

SEQ ID NO: 4343861 - DNA, 16 bp, Homo sapiens
gccaccagggcactgt

SEQ ID NO: 4343862 - DNA, 22 bp, Homo sapiens
gccaccattcctggaaaccaca

SEQ ID NO: 4343863 - DNA, 12 bp, Homo sapiens
gccaccctgtct

SEQ ID NO: 4343864 - DNA, 23 bp, Homo sapiens
gccaccctgtctcagtacctccc

SEQ ID NO: 4343865 - DNA, 13 bp, Homo sapiens
gccacgattttaa

SEQ ID NO: 4343866 - DNA, 15 bp, Homo sapiens
gccacggaaacatag

SEQ ID NO: 4343867 - DNA, 22 bp, Homo sapiens
gccactggcacttgcctgctgc

SEQ ID NO: 4343868 - DNA, 16 bp, Homo sapiens
gccagaaaaagaagaa

SEQ ID NO: 4343869 - DNA, 12 bp, Homo sapiens
gccagactccct

SEQ ID NO: 4343870 - DNA, 17 bp, Homo sapiens
gccaggagccctggccc

SEQ ID NO: 4343871 - DNA, 19 bp, Homo sapiens
gccataccttctcccaggc

SEQ ID NO: 4343872 - DNA, 18 bp, Homo sapiens
gccatgccagcttatctc

SEQ ID NO: 4343873 - DNA, 19 bp, Homo sapiens
gccatgccagcttatctca

SEQ ID NO: 4343874 - DNA, 23 bp, Homo sapiens
gccatgcccttacacgtgcgtgt

SEQ ID NO: 4343875 - DNA, 17 bp, Homo sapiens
gccatgctttttggtga

SEQ ID NO: 4343876 - DNA, 19 bp, Homo sapiens
gccatgggaaatgagccag

SEQ ID NO: 4343877 - DNA, 17 bp, Homo sapiens
gccatggtacccccttc

SEQ ID NO: 4343878 - DNA, 19 bp, Homo sapiens
gccatggtacccccttctg

SEQ ID NO: 4343879 - DNA, 20 bp, Homo sapiens
gccatggtacccccttctgg

SEQ ID NO: 4343880 - DNA, 21 bp, Homo sapiens
gccatggtacccccttctggg

SEQ ID NO: 4343881 - DNA, 15 bp, Homo sapiens
gccattgtctttcct

SEQ ID NO: 4343882 - DNA, 16 bp, Homo sapiens
gccattgtctttcctc

SEQ ID NO: 4343883 - DNA, 17 bp, Homo sapiens
gccattgtctttcctcc

SEQ ID NO: 4343884 - DNA, 19 bp, Homo sapiens
gcccaaatgtcagggttct

SEQ ID NO: 4343885 - DNA, 13 bp, Homo sapiens
gcccaacaccagc

SEQ ID NO: 4343886 - DNA, 14 bp, Homo sapiens
gcccaacaccagcc

SEQ ID NO: 4343887 - DNA, 18 bp, Homo sapiens
gcccaacaccagcccctg

SEQ ID NO: 4343888 - DNA, 23 bp, Homo sapiens
gcccaacagacaccatcttttgt

SEQ ID NO: 4343889 - DNA, 15 bp, Homo sapiens
gcccaagtccaaatg

SEQ ID NO: 4343890 - DNA, 19 bp, Homo sapiens
gcccaatggagaaatgaag

SEQ ID NO: 4343891 - DNA, 13 bp, Homo sapiens
gcccaccgaggag

SEQ ID NO: 4343892 - DNA, 16 bp, Homo sapiens
gcccaccgaggagccc

SEQ ID NO: 4343893 - DNA, 23 bp, Homo sapiens
gcccactccccagttggcccttc

SEQ ID NO: 4343894 - DNA, 17 bp, Homo sapiens
gcccagtcccccaaccc

SEQ ID NO: 4343895 - DNA, 21 bp, Homo sapiens
gcccagtcccccaaccccagc

SEQ ID NO: 4343896 - DNA, 16 bp, Homo sapiens
gccccacccagaggtg

SEQ ID NO: 4343897 - DNA, 21 bp, Homo sapiens
gccccagccccaatccagaga

SEQ ID NO: 4343898 - DNA, 22 bp, Homo sapiens
gccccagccccgtcccagaggc

SEQ ID NO: 4343899 - DNA, 17 bp, Homo sapiens
gcccccacagccctgga

SEQ ID NO: 4343900 - DNA, 13 bp, Homo sapiens
gccccctccctgc

SEQ ID NO: 4343901 - DNA, 22 bp, Homo sapiens
gccccctgaaacatgtgcccct

SEQ ID NO: 4343902 - DNA, 22 bp, Homo sapiens
gcccccttcctgtccccagggg

SEQ ID NO: 4343903 - DNA, 19 bp, Homo sapiens
gccccgccccctccctgct

SEQ ID NO: 4343904 - DNA, 22 bp, Homo sapiens
gcccctctcacaggcagctctg

SEQ ID NO: 4343905 - DNA, 16 bp, Homo sapiens
gcccctgcttctccag

SEQ ID NO: 4343906 - DNA, 20 bp, Homo sapiens
gcccctgcttctccagcctg

SEQ ID NO: 4343907 - DNA, 17 bp, Homo sapiens
gcccgaagagggagaca

SEQ ID NO: 4343908 - DNA, 23 bp, Homo sapiens
gcccgcaagagggacagagcccg

SEQ ID NO: 4343909 - DNA, 19 bp, Homo sapiens
gcccggtgcagggcctggc

SEQ ID NO: 4343910 - DNA, 21 bp, Homo sapiens
gcccggtgcagggcctggcat

SEQ ID NO: 4343911 - DNA, 18 bp, Homo sapiens
gcccggtttggggctgcg

SEQ ID NO: 4343912 - DNA, 23 bp, Homo sapiens
gccctactgaagggaacagcctg

SEQ ID NO: 4343913 - DNA, 19 bp, Homo sapiens
gccctagaggacactagga

SEQ ID NO: 4343914 - DNA, 21 bp, Homo sapiens
gccctagaggacactaggaga

SEQ ID NO: 4343915 - DNA, 17 bp, Homo sapiens
gccctatgtgaaaagat

SEQ ID NO: 4343916 - DNA, 20 bp, Homo sapiens
gccctattggcttactgaaa

SEQ ID NO: 4343917 - DNA, 15 bp, Homo sapiens
gccctcagctccctg

SEQ ID NO: 4343918 - DNA, 19 bp, Homo sapiens
gccctcagctccctgaccc

SEQ ID NO: 4343919 - DNA, 20 bp, Homo sapiens
gccctcagctccctgacccc

SEQ ID NO: 4343920 - DNA, 15 bp, Homo sapiens
gccctccacccacta

SEQ ID NO: 4343921 - DNA, 18 bp, Homo sapiens
gccctccacccactaggt

SEQ ID NO: 4343922 - DNA, 12 bp, Homo sapiens
gccctcccaggc

SEQ ID NO: 4343923 - DNA, 14 bp, Homo sapiens
gccctctgtggcca

SEQ ID NO: 4343924 - DNA, 18 bp, Homo sapiens
gccctctgtggccaggag

SEQ ID NO: 4343925 - DNA, 21 bp, Homo sapiens
gccctctgtggccaggagccc

SEQ ID NO: 4343926 - DNA, 11 bp, Homo sapiens
gccctgcagca

SEQ ID NO: 4343927 - DNA, 13 bp, Homo sapiens
gccctgtccctgc

SEQ ID NO: 4343928 - DNA, 18 bp, Homo sapiens
gcccttacacgtgcgtgt

SEQ ID NO: 4343929 - DNA, 13 bp, Homo sapiens
gcccttccccctt

SEQ ID NO: 4343930 - DNA, 16 bp, Homo sapiens
gcccttccccctttct

SEQ ID NO: 4343931 - DNA, 22 bp, Homo sapiens
gcccttcctccctgtctctgca

SEQ ID NO: 4343932 - DNA, 13 bp, Homo sapiens
gcccttctgccct

SEQ ID NO: 4343933 - DNA, 22 bp, Homo sapiens
gccctttcccaggtaatttaaa

SEQ ID NO: 4343934 - DNA, 16 bp, Homo sapiens
gccctttcttgcactg

SEQ ID NO: 4343935 - DNA, 21 bp, Homo sapiens
gccctttcttgcactgtccag

SEQ ID NO: 4343936 - DNA, 17 bp, Homo sapiens
gccgaacattaggaatt

SEQ ID NO: 4343937 - DNA, 19 bp, Homo sapiens
gccgaacattaggaattgt

SEQ ID NO: 4343938 - DNA, 21 bp, Homo sapiens
gccgactttgtaccccccaac

SEQ ID NO: 4343939 - DNA, 23 bp, Homo sapiens
gccgactttgtaccccccaaccc

SEQ ID NO: 4343940 - DNA, 17 bp, Homo sapiens
gccgagattgcaccact

SEQ ID NO: 4343941 - DNA, 15 bp, Homo sapiens
gccgccatgctcctg

SEQ ID NO: 4343942 - DNA, 17 bp, Homo sapiens
gccgctcggaggcccca

SEQ ID NO: 4343943 - DNA, 20 bp, Homo sapiens
gccgctcggaggccccaaag

SEQ ID NO: 4343944 - DNA, 15 bp, Homo sapiens
gccgctgcccctgag

SEQ ID NO: 4343945 - DNA, 13 bp, Homo sapiens
gccgggactgggg

SEQ ID NO: 4343946 - DNA, 15 bp, Homo sapiens
gccgggggcggggcc

SEQ ID NO: 4343947 - DNA, 20 bp, Homo sapiens
gccgtgcccttgcccttgga

SEQ ID NO: 4343948 - DNA, 20 bp, Homo sapiens
gccgtgtaaccatggaccca

SEQ ID NO: 4343949 - DNA, 14 bp, Homo sapiens
gccgtgtgtgcatg

SEQ ID NO: 4343950 - DNA, 15 bp, Homo sapiens
gccgtgtgtgcatgt

SEQ ID NO: 4343951 - DNA, 23 bp, Homo sapiens
gccgtgtgtgcatgtgccgaggt

SEQ ID NO: 4343952 - DNA, 23 bp, Homo sapiens
gcctacctctcgtttctgcccag

SEQ ID NO: 4343953 - DNA, 15 bp, Homo sapiens
gcctcccttttctcc

SEQ ID NO: 4343954 - DNA, 18 bp, Homo sapiens
gcctcccttttctcctct

SEQ ID NO: 4343955 - DNA, 13 bp, Homo sapiens
gcctcctccagcc

SEQ ID NO: 4343956 - DNA, 16 bp, Homo sapiens
gcctcgacgtcccttg

SEQ ID NO: 4343957 - DNA, 21 bp, Homo sapiens
gcctctccctaggagaagagt

SEQ ID NO: 4343958 - DNA, 17 bp, Homo sapiens
gcctctgggatctgcca

SEQ ID NO: 4343959 - DNA, 19 bp, Homo sapiens
gcctctgggatctgccaac

SEQ ID NO: 4343960 - DNA, 12 bp, Homo sapiens
gcctcttctcta

SEQ ID NO: 4343961 - DNA, 21 bp, Homo sapiens
gcctcttttcagtagtgagca

SEQ ID NO: 4343962 - DNA, 22 bp, Homo sapiens
gcctcttttcagtagtgagcag

SEQ ID NO: 4343963 - DNA, 17 bp, Homo sapiens
gcctgaaagctgggagc

SEQ ID NO: 4343964 - DNA, 13 bp, Homo sapiens
gcctgcccttgtc

SEQ ID NO: 4343965 - DNA, 21 bp, Homo sapiens
gcctgcccttgtctgagatgc

SEQ ID NO: 4343966 - DNA, 16 bp, Homo sapiens
gcctgctccagctgtt

SEQ ID NO: 4343967 - DNA, 12 bp, Homo sapiens
gcctgctgggtg

SEQ ID NO: 4343968 - DNA, 18 bp, Homo sapiens
gcctgctgggtgccaggt

SEQ ID NO: 4343969 - DNA, 21 bp, Homo sapiens
gcctgctgggtgccaggtgct

SEQ ID NO: 4343970 - DNA, 10 bp, Homo sapiens
gcctggcaac

SEQ ID NO: 4343971 - DNA, 20 bp, Homo sapiens
gcctggcgggatgggccacc

SEQ ID NO: 4343972 - DNA, 21 bp, Homo sapiens
gcctggcgggatgggccaccg

SEQ ID NO: 4343973 - DNA, 22 bp, Homo sapiens
gcctgggaggtcaaggctgcag

SEQ ID NO: 4343974 - DNA, 18 bp, Homo sapiens
gcctggttcgtgccatgc

SEQ ID NO: 4343975 - DNA, 15 bp, Homo sapiens
gcctgtaatcctagc

SEQ ID NO: 4343976 - DNA, 16 bp, Homo sapiens
gccttaagcacaatta

SEQ ID NO: 4343977 - DNA, 21 bp, Homo sapiens
gccttaagcacaattaattaa

SEQ ID NO: 4343978 - DNA, 16 bp, Homo sapiens
gccttactcacctctc

SEQ ID NO: 4343979 - DNA, 17 bp, Homo sapiens
gccttactcacctctct

SEQ ID NO: 4343980 - DNA, 13 bp, Homo sapiens
gccttatgtgtta

SEQ ID NO: 4343981 - DNA, 16 bp, Homo sapiens
gccttgatgttgtgtt

SEQ ID NO: 4343982 - DNA, 19 bp, Homo sapiens
gccttgctgcataaaattc

SEQ ID NO: 4343983 - DNA, 19 bp, Homo sapiens
gcctttttctggccttgac

SEQ ID NO: 4343984 - DNA, 19 bp, Homo sapiens
gcgaaaacgttgacccctt

SEQ ID NO: 4343985 - DNA, 15 bp, Homo sapiens
gcgaagcaagaagaa

SEQ ID NO: 4343986 - DNA, 21 bp, Homo sapiens
gcgaataaatgttcaaactgt

SEQ ID NO: 4343987 - DNA, 17 bp, Homo sapiens
gcgaattgtgtggagaa

SEQ ID NO: 4343988 - DNA, 22 bp, Homo sapiens
gcgctgccgagtccgggccggg

SEQ ID NO: 4343989 - DNA, 17 bp, Homo sapiens
gcggaggtggagtggcc

SEQ ID NO: 4343990 - DNA, 14 bp, Homo sapiens
gcgggatgggccac

SEQ ID NO: 4343991 - DNA, 15 bp, Homo sapiens
gcggggtgcctgctg

SEQ ID NO: 4343992 - DNA, 12 bp, Homo sapiens
gcgggtggcgct

SEQ ID NO: 4343993 - DNA, 22 bp, Homo sapiens
gcgtatttagactgtggccata

SEQ ID NO: 4343994 - DNA, 20 bp, Homo sapiens
gcgtcccccgttgtgcctgg

SEQ ID NO: 4343995 - DNA, 23 bp, Homo sapiens
gcgtctggaggggcccctgcttc

SEQ ID NO: 4343996 - DNA, 15 bp, Homo sapiens
gcgtgtccacagagt

SEQ ID NO: 4343997 - DNA, 13 bp, Homo sapiens
gctaaattataaa

SEQ ID NO: 4343998 - DNA, 16 bp, Homo sapiens
gctaactgggaagaac

SEQ ID NO: 4343999 - DNA, 14 bp, Homo sapiens
gctaagctaaagaa

SEQ ID NO: 4344000 - DNA, 13 bp, Homo sapiens
gctaatctgcctg

SEQ ID NO: 4344001 - DNA, 14 bp, Homo sapiens
gctaatctgcctgg

SEQ ID NO: 4344002 - DNA, 20 bp, Homo sapiens
gctaatctgcctggttttat

SEQ ID NO: 4344003 - DNA, 20 bp, Homo sapiens
gctaatggagtgtttgaaaa

SEQ ID NO: 4344004 - DNA, 21 bp, Homo sapiens
gctaatggagtgtttgaaaac

SEQ ID NO: 4344005 - DNA, 20 bp, Homo sapiens
gctaattcatacctccctcc

SEQ ID NO: 4344006 - DNA, 14 bp, Homo sapiens
gctacccttttcct

SEQ ID NO: 4344007 - DNA, 19 bp, Homo sapiens
gctacccttttcctttgtg

SEQ ID NO: 4344008 - DNA, 16 bp, Homo sapiens
gctacctgcacctctg

SEQ ID NO: 4344009 - DNA, 21 bp, Homo sapiens
gctacggggaaaatgcatttt

SEQ ID NO: 4344010 - DNA, 15 bp, Homo sapiens
gctagaatttctggt

SEQ ID NO: 4344011 - DNA, 13 bp, Homo sapiens
gctagactgtgtc

SEQ ID NO: 4344012 - DNA, 14 bp, Homo sapiens
gctagactgtgtct

SEQ ID NO: 4344013 - DNA, 22 bp, Homo sapiens
gctagcagcagggagggcttct

SEQ ID NO: 4344014 - DNA, 17 bp, Homo sapiens
gctatagtgaagaatag

SEQ ID NO: 4344015 - DNA, 19 bp, Homo sapiens
gctatatttttaaagaagg

SEQ ID NO: 4344016 - DNA, 15 bp, Homo sapiens
gctatcagggaggaa

SEQ ID NO: 4344017 - DNA, 16 bp, Homo sapiens
gctatcagggaggaag

SEQ ID NO: 4344018 - DNA, 13 bp, Homo sapiens
gctcaagaatgta

SEQ ID NO: 4344019 - DNA, 16 bp, Homo sapiens
gctcaaggctgtgcag

SEQ ID NO: 4344020 - DNA, 14 bp, Homo sapiens
gctcacaaattccg

SEQ ID NO: 4344021 - DNA, 15 bp, Homo sapiens
gctcagcagggctgg

SEQ ID NO: 4344022 - DNA, 21 bp, Homo sapiens
gctcagcagggctggtcacct

SEQ ID NO: 4344023 - DNA, 19 bp, Homo sapiens
gctcattaaactgattcca

SEQ ID NO: 4344024 - DNA, 22 bp, Homo sapiens
gctccaacccgttgggtccctt

SEQ ID NO: 4344025 - DNA, 21 bp, Homo sapiens
gctcccacacccacctctgcc

SEQ ID NO: 4344026 - DNA, 13 bp, Homo sapiens
gctcccagctctc

SEQ ID NO: 4344027 - DNA, 15 bp, Homo sapiens
gctcccagctctctc

SEQ ID NO: 4344028 - DNA, 20 bp, Homo sapiens
gctcccagctctctctcctg

SEQ ID NO: 4344029 - DNA, 22 bp, Homo sapiens
gctcccagctctctctcctgga

SEQ ID NO: 4344030 - DNA, 20 bp, Homo sapiens
gctccccagtgctcctggcc

SEQ ID NO: 4344031 - DNA, 22 bp, Homo sapiens
gctcccccaggcagaaatagtt

SEQ ID NO: 4344032 - DNA, 14 bp, Homo sapiens
gctccccctgtccc

SEQ ID NO: 4344033 - DNA, 22 bp, Homo sapiens
gctccccgcctgttcccccgcc

SEQ ID NO: 4344034 - DNA, 15 bp, Homo sapiens
gctcctaagcttcaa

SEQ ID NO: 4344035 - DNA, 17 bp, Homo sapiens
gctcctagagaggagaa

SEQ ID NO: 4344036 - DNA, 18 bp, Homo sapiens
gctcctagagaggagaaa

SEQ ID NO: 4344037 - DNA, 18 bp, Homo sapiens
gctcctggcccactgcat

SEQ ID NO: 4344038 - DNA, 21 bp, Homo sapiens
gctcgatccaaattgtgcttc

SEQ ID NO: 4344039 - DNA, 18 bp, Homo sapiens
gctctcaagttatcaggg

SEQ ID NO: 4344040 - DNA, 16 bp, Homo sapiens
gctctcatccattcct

SEQ ID NO: 4344041 - DNA, 15 bp, Homo sapiens
gctctctctcctgga

SEQ ID NO: 4344042 - DNA, 20 bp, Homo sapiens
gctcttttttgtttgtttct

SEQ ID NO: 4344043 - DNA, 19 bp, Homo sapiens
gctgaaagtcctgctttcc

SEQ ID NO: 4344044 - DNA, 13 bp, Homo sapiens
gctgaagaaatta

SEQ ID NO: 4344045 - DNA, 22 bp, Homo sapiens
gctgaatacagaggcaactgca

SEQ ID NO: 4344046 - DNA, 16 bp, Homo sapiens
gctgacggtttctccc

SEQ ID NO: 4344047 - DNA, 15 bp, Homo sapiens
gctgagaaattatta

SEQ ID NO: 4344048 - DNA, 15 bp, Homo sapiens
gctgagctgaagaaa

SEQ ID NO: 4344049 - DNA, 18 bp, Homo sapiens
gctgagggtgagtgggtg

SEQ ID NO: 4344050 - DNA, 15 bp, Homo sapiens
gctgaggtgggagga

SEQ ID NO: 4344051 - DNA, 13 bp, Homo sapiens
gctgagtctccca

SEQ ID NO: 4344052 - DNA, 16 bp, Homo sapiens
gctgagtctcccaagg

SEQ ID NO: 4344053 - DNA, 23 bp, Homo sapiens
gctgcaaacccatgaagctggcc

SEQ ID NO: 4344054 - DNA, 22 bp, Homo sapiens
gctgcaagtcattgagtgactt

SEQ ID NO: 4344055 - DNA, 15 bp, Homo sapiens
gctgcaccctcaggc

SEQ ID NO: 4344056 - DNA, 19 bp, Homo sapiens
gctgcaccctcaggcaggt

SEQ ID NO: 4344057 - DNA, 20 bp, Homo sapiens
gctgcatgcctggtctttcc

SEQ ID NO: 4344058 - DNA, 18 bp, Homo sapiens
gctgccccagcgtcttga

SEQ ID NO: 4344059 - DNA, 15 bp, Homo sapiens
gctgcccctgagttc

SEQ ID NO: 4344060 - DNA, 12 bp, Homo sapiens
gctgccctgagg

SEQ ID NO: 4344061 - DNA, 21 bp, Homo sapiens
gctgccgtgcctgtgtcctga

SEQ ID NO: 4344062 - DNA, 21 bp, Homo sapiens
gctgcgaaaacgttgacccct

SEQ ID NO: 4344063 - DNA, 16 bp, Homo sapiens
gctgcgtactccactg

SEQ ID NO: 4344064 - DNA, 16 bp, Homo sapiens
gctgcgtctggagggg

SEQ ID NO: 4344065 - DNA, 13 bp, Homo sapiens
gctgctgctgccc

SEQ ID NO: 4344066 - DNA, 13 bp, Homo sapiens
gctgctgttctgt

SEQ ID NO: 4344067 - DNA, 14 bp, Homo sapiens
gctggccctcagct

SEQ ID NO: 4344068 - DNA, 15 bp, Homo sapiens
gctgggacctaatgc

SEQ ID NO: 4344069 - DNA, 18 bp, Homo sapiens
gctgggacctaatgctgg

SEQ ID NO: 4344070 - DNA, 23 bp, Homo sapiens
gctgggggaagaagctctctcct

SEQ ID NO: 4344071 - DNA, 15 bp, Homo sapiens
gctgggtattggaaa

SEQ ID NO: 4344072 - DNA, 15 bp, Homo sapiens
gctgggtgccaggtg

SEQ ID NO: 4344073 - DNA, 16 bp, Homo sapiens
gctgggtgccaggtgc

SEQ ID NO: 4344074 - DNA, 17 bp, Homo sapiens
gctgggtgccaggtgct

SEQ ID NO: 4344075 - DNA, 17 bp, Homo sapiens
gctggtatattgtgtaa

SEQ ID NO: 4344076 - DNA, 14 bp, Homo sapiens
gctggtcacctccc

SEQ ID NO: 4344077 - DNA, 16 bp, Homo sapiens
gctggtggccttgggc

SEQ ID NO: 4344078 - DNA, 18 bp, Homo sapiens
gctggtggccttgggcct

SEQ ID NO: 4344079 - DNA, 22 bp, Homo sapiens
gctggttgtaccctctccaggc

SEQ ID NO: 4344080 - DNA, 15 bp, Homo sapiens
gctgtccgtgcttgc

SEQ ID NO: 4344081 - DNA, 22 bp, Homo sapiens
gctgtccgtgcttgctggtgcc

SEQ ID NO: 4344082 - DNA, 21 bp, Homo sapiens
gctgtgtagttccctctgcct

SEQ ID NO: 4344083 - DNA, 22 bp, Homo sapiens
gctgtgtagttccctctgcctg

SEQ ID NO: 4344084 - DNA, 17 bp, Homo sapiens
gctgttactgcttctct

SEQ ID NO: 4344085 - DNA, 20 bp, Homo sapiens
gctgttactgcttctctttg

SEQ ID NO: 4344086 - DNA, 20 bp, Homo sapiens
gctgttagttataaaactat

SEQ ID NO: 4344087 - DNA, 20 bp, Homo sapiens
gctgtttactcccttctgta

SEQ ID NO: 4344088 - DNA, 23 bp, Homo sapiens
gctgtttactcccttctgtagtt

SEQ ID NO: 4344089 - DNA, 23 bp, Homo sapiens
gcttacagtttattttctgtgta

SEQ ID NO: 4344090 - DNA, 23 bp, Homo sapiens
gcttacttccattgcaaaataga

SEQ ID NO: 4344091 - DNA, 18 bp, Homo sapiens
gcttagagaatgttctcc

SEQ ID NO: 4344092 - DNA, 21 bp, Homo sapiens
gcttagatgttccaaatttag

SEQ ID NO: 4344093 - DNA, 19 bp, Homo sapiens
gcttagtaaaatttatttc

SEQ ID NO: 4344094 - DNA, 18 bp, Homo sapiens
gcttattgcttagtaaaa

SEQ ID NO: 4344095 - DNA, 14 bp, Homo sapiens
gcttcacatttgta

SEQ ID NO: 4344096 - DNA, 17 bp, Homo sapiens
gcttcacggaagagcct

SEQ ID NO: 4344097 - DNA, 16 bp, Homo sapiens
gcttccaagcattact

SEQ ID NO: 4344098 - DNA, 13 bp, Homo sapiens
gcttctccagcct

SEQ ID NO: 4344099 - DNA, 14 bp, Homo sapiens
gcttctccagcctg

SEQ ID NO: 4344100 - DNA, 21 bp, Homo sapiens
gcttctcttctttattgcact

SEQ ID NO: 4344101 - DNA, 21 bp, Homo sapiens
gcttctgcagcaactcccacg

SEQ ID NO: 4344102 - DNA, 21 bp, Homo sapiens
gcttgcttctgcagcaactcc

SEQ ID NO: 4344103 - DNA, 14 bp, Homo sapiens
gcttggagtgcccc

SEQ ID NO: 4344104 - DNA, 21 bp, Homo sapiens
gcttgtctattattgaaatag

SEQ ID NO: 4344105 - DNA, 15 bp, Homo sapiens
gcttgtgctgagcct

SEQ ID NO: 4344106 - DNA, 22 bp, Homo sapiens
gcttgtggaggagggagagccc

SEQ ID NO: 4344107 - DNA, 18 bp, Homo sapiens
gctttaaaagtcattatt

SEQ ID NO: 4344108 - DNA, 13 bp, Homo sapiens
gctttcccctcct

SEQ ID NO: 4344109 - DNA, 14 bp, Homo sapiens
gctttcctatctag

SEQ ID NO: 4344110 - DNA, 14 bp, Homo sapiens
gctttctgtgcatg

SEQ ID NO: 4344111 - DNA, 16 bp, Homo sapiens
gctttgagaggctgag

SEQ ID NO: 4344112 - DNA, 16 bp, Homo sapiens
gctttgtctgtccagc

SEQ ID NO: 4344113 - DNA, 23 bp, Homo sapiens
gctttgtgcatatgttaaagctt

SEQ ID NO: 4344114 - DNA, 21 bp, Homo sapiens
gctttgtttgttgtcagctga

SEQ ID NO: 4344115 - DNA, 20 bp, Homo sapiens
gcttttcgcttgcttctgca

SEQ ID NO: 4344116 - DNA, 16 bp, Homo sapiens
gcttttctcctctttc

SEQ ID NO: 4344117 - DNA, 20 bp, Homo sapiens
ggaaaaaactttgctccagg

SEQ ID NO: 4344118 - DNA, 17 bp, Homo sapiens
ggaaaaagcacaagaag

SEQ ID NO: 4344119 - DNA, 18 bp, Homo sapiens
ggaaaaccatctctgtga

SEQ ID NO: 4344120 - DNA, 19 bp, Homo sapiens
ggaaaatcagcctgctcca

SEQ ID NO: 4344121 - DNA, 20 bp, Homo sapiens
ggaaagaggaggcagaaaga

SEQ ID NO: 4344122 - DNA, 15 bp, Homo sapiens
ggaaataaagaaaat

SEQ ID NO: 4344123 - DNA, 13 bp, Homo sapiens
ggaaatgagccag

SEQ ID NO: 4344124 - DNA, 22 bp, Homo sapiens
ggaaatgagccagcccaagggc

SEQ ID NO: 4344125 - DNA, 12 bp, Homo sapiens
ggaaattaagaa

SEQ ID NO: 4344126 - DNA, 16 bp, Homo sapiens
ggaaattaagaactga

SEQ ID NO: 4344127 - DNA, 15 bp, Homo sapiens
ggaacagcctgagcc

SEQ ID NO: 4344128 - DNA, 15 bp, Homo sapiens
ggaacccccaaattt

SEQ ID NO: 4344129 - DNA, 19 bp, Homo sapiens
ggaaccgaggtgttgccag

SEQ ID NO: 4344130 - DNA, 13 bp, Homo sapiens
ggaagagaaaaaa

SEQ ID NO: 4344131 - DNA, 18 bp, Homo sapiens
ggaagatgggggcaagaa

SEQ ID NO: 4344132 - DNA, 22 bp, Homo sapiens
ggaagatgggggcaagaagatc

SEQ ID NO: 4344133 - DNA, 19 bp, Homo sapiens
ggaaggtgggtgaggctgg

SEQ ID NO: 4344134 - DNA, 14 bp, Homo sapiens
ggaagtagtccttg

SEQ ID NO: 4344135 - DNA, 11 bp, Homo sapiens
ggaagtgctta

SEQ ID NO: 4344136 - DNA, 22 bp, Homo sapiens
ggaatgattggttaaaatgtga

SEQ ID NO: 4344137 - DNA, 13 bp, Homo sapiens
ggacactaggaga

SEQ ID NO: 4344138 - DNA, 12 bp, Homo sapiens
ggacagagcccg

SEQ ID NO: 4344139 - DNA, 18 bp, Homo sapiens
ggacagatttgaggactg

SEQ ID NO: 4344140 - DNA, 19 bp, Homo sapiens
ggacagatttgaggactga

SEQ ID NO: 4344141 - DNA, 15 bp, Homo sapiens
ggacagtggatgccc

SEQ ID NO: 4344142 - DNA, 15 bp, Homo sapiens
ggaccagcccacagc

SEQ ID NO: 4344143 - DNA, 13 bp, Homo sapiens
ggacccccagctt

SEQ ID NO: 4344144 - DNA, 17 bp, Homo sapiens
ggacctaatgctggcct

SEQ ID NO: 4344145 - DNA, 16 bp, Homo sapiens
ggacgctgccgggaga

SEQ ID NO: 4344146 - DNA, 19 bp, Homo sapiens
ggacgctgccgggagactg

SEQ ID NO: 4344147 - DNA, 12 bp, Homo sapiens
ggactgtatttc

SEQ ID NO: 4344148 - DNA, 20 bp, Homo sapiens
ggactttcctaaatgtttaa

SEQ ID NO: 4344149 - DNA, 22 bp, Homo sapiens
ggagaaaggggtgattgaaaga

SEQ ID NO: 4344150 - DNA, 12 bp, Homo sapiens
ggagaaatgaag

SEQ ID NO: 4344151 - DNA, 22 bp, Homo sapiens
ggagaaatgaagcagaggaagg

SEQ ID NO: 4344152 - DNA, 20 bp, Homo sapiens
ggagaagagttgaggaactg

SEQ ID NO: 4344153 - DNA, 18 bp, Homo sapiens
ggagaagcggctggcagc

SEQ ID NO: 4344154 - DNA, 22 bp, Homo sapiens
ggagaatatgcgggacatgatg

SEQ ID NO: 4344155 - DNA, 17 bp, Homo sapiens
ggagacccacagccctg

SEQ ID NO: 4344156 - DNA, 13 bp, Homo sapiens
ggagactctgaga

SEQ ID NO: 4344157 - DNA, 21 bp, Homo sapiens
ggagactgggcacccctgcct

SEQ ID NO: 4344158 - DNA, 22 bp, Homo sapiens
ggagactttgctgttactgctt

SEQ ID NO: 4344159 - DNA, 23 bp, Homo sapiens
ggagactttgctgttactgcttc

SEQ ID NO: 4344160 - DNA, 12 bp, Homo sapiens
ggagagccctgt

SEQ ID NO: 4344161 - DNA, 21 bp, Homo sapiens
ggagagctagcagcagggagg

SEQ ID NO: 4344162 - DNA, 17 bp, Homo sapiens
ggagattatcagtagaa

SEQ ID NO: 4344163 - DNA, 22 bp, Homo sapiens
ggagattatcagtagaaagagt

SEQ ID NO: 4344164 - DNA, 11 bp, Homo sapiens
ggagcaaaaca

SEQ ID NO: 4344165 - DNA, 16 bp, Homo sapiens
ggagcattggcccctg

SEQ ID NO: 4344166 - DNA, 16 bp, Homo sapiens
ggagccccagccccgt

SEQ ID NO: 4344167 - DNA, 11 bp, Homo sapiens
ggagcctcctg

SEQ ID NO: 4344168 - DNA, 12 bp, Homo sapiens
ggagcctcctgc

SEQ ID NO: 4344169 - DNA, 19 bp, Homo sapiens
ggagcgtgggctcagcagg

SEQ ID NO: 4344170 - DNA, 15 bp, Homo sapiens
ggagctcctggcagc

SEQ ID NO: 4344171 - DNA, 16 bp, Homo sapiens
ggagctgagtggggga

SEQ ID NO: 4344172 - DNA, 13 bp, Homo sapiens
ggaggaagatgtt

SEQ ID NO: 4344173 - DNA, 17 bp, Homo sapiens
ggaggcgaataaatgtt

SEQ ID NO: 4344174 - DNA, 18 bp, Homo sapiens
ggaggcgaataaatgttc

SEQ ID NO: 4344175 - DNA, 19 bp, Homo sapiens
ggagggaaaagggaagtag

SEQ ID NO: 4344176 - DNA, 13 bp, Homo sapiens
ggagggagagcct

SEQ ID NO: 4344177 - DNA, 21 bp, Homo sapiens
ggaggggttgccacaggcctc

SEQ ID NO: 4344178 - DNA, 14 bp, Homo sapiens
ggaggtcgaggcag

SEQ ID NO: 4344179 - DNA, 18 bp, Homo sapiens
ggaggtcgaggcaggagg

SEQ ID NO: 4344180 - DNA, 19 bp, Homo sapiens
ggaggttcgggattccctg

SEQ ID NO: 4344181 - DNA, 20 bp, Homo sapiens
ggaggttcgggattccctgg

SEQ ID NO: 4344182 - DNA, 14 bp, Homo sapiens
ggaggttctgggcc

SEQ ID NO: 4344183 - DNA, 19 bp, Homo sapiens
ggagtgccataccttctcc

SEQ ID NO: 4344184 - DNA, 21 bp, Homo sapiens
ggagtgccataccttctccca

SEQ ID NO: 4344185 - DNA, 13 bp, Homo sapiens
ggagtgccccaag

SEQ ID NO: 4344186 - DNA, 18 bp, Homo sapiens
ggagtgccccaaggaggt

SEQ ID NO: 4344187 - DNA, 22 bp, Homo sapiens
ggagtgccccaaggaggtggct

SEQ ID NO: 4344188 - DNA, 18 bp, Homo sapiens
ggatagaaaaaaactaaa

SEQ ID NO: 4344189 - DNA, 16 bp, Homo sapiens
ggatcacagcctctga

SEQ ID NO: 4344190 - DNA, 16 bp, Homo sapiens
ggatcaccccagcccc

SEQ ID NO: 4344191 - DNA, 17 bp, Homo sapiens
ggatcaccccagccccc

SEQ ID NO: 4344192 - DNA, 23 bp, Homo sapiens
ggatcaccccagcccccacagcc

SEQ ID NO: 4344193 - DNA, 16 bp, Homo sapiens
ggatcagaggtcatcc

SEQ ID NO: 4344194 - DNA, 21 bp, Homo sapiens
ggatcatatgaccattgaaaa

SEQ ID NO: 4344195 - DNA, 18 bp, Homo sapiens
ggatctcttgagcctggg

SEQ ID NO: 4344196 - DNA, 15 bp, Homo sapiens
ggatgcccttccccc

SEQ ID NO: 4344197 - DNA, 16 bp, Homo sapiens
ggatggacgctgccgg

SEQ ID NO: 4344198 - DNA, 23 bp, Homo sapiens
ggatggagcccagttggaaaatt

SEQ ID NO: 4344199 - DNA, 15 bp, Homo sapiens
ggattatatgtatta

SEQ ID NO: 4344200 - DNA, 15 bp, Homo sapiens
ggcaaaaaggcagga

SEQ ID NO: 4344201 - DNA, 18 bp, Homo sapiens
ggcaactgcattggcttt

SEQ ID NO: 4344202 - DNA, 13 bp, Homo sapiens
ggcaattggaaca

SEQ ID NO: 4344203 - DNA, 19 bp, Homo sapiens
ggcacatgctgagtctccc

SEQ ID NO: 4344204 - DNA, 17 bp, Homo sapiens
ggcaccagcagcctgga

SEQ ID NO: 4344205 - DNA, 13 bp, Homo sapiens
ggcacccctgcct

SEQ ID NO: 4344206 - DNA, 12 bp, Homo sapiens
ggcacgggcctg

SEQ ID NO: 4344207 - DNA, 13 bp, Homo sapiens
ggcacgtggccag

SEQ ID NO: 4344208 - DNA, 14 bp, Homo sapiens
ggcacttgcctgct

SEQ ID NO: 4344209 - DNA, 11 bp, Homo sapiens
ggcagaaagat

SEQ ID NO: 4344210 - DNA, 14 bp, Homo sapiens
ggcagctctgagcc

SEQ ID NO: 4344211 - DNA, 16 bp, Homo sapiens
ggcagctctgagccgc

SEQ ID NO: 4344212 - DNA, 17 bp, Homo sapiens
ggcaggaccttccttcc

SEQ ID NO: 4344213 - DNA, 13 bp, Homo sapiens
ggcatagagtagg

SEQ ID NO: 4344214 - DNA, 19 bp, Homo sapiens
ggcatcactgattccctct

SEQ ID NO: 4344215 - DNA, 14 bp, Homo sapiens
ggcatcatcctcag

SEQ ID NO: 4344216 - DNA, 14 bp, Homo sapiens
ggcatgagtctgtt

SEQ ID NO: 4344217 - DNA, 23 bp, Homo sapiens
ggcatgagtctgtttcccaagct

SEQ ID NO: 4344218 - DNA, 18 bp, Homo sapiens
ggcatttcacgaactgtt

SEQ ID NO: 4344219 - DNA, 20 bp, Homo sapiens
ggccaatggagaaaatgaat

SEQ ID NO: 4344220 - DNA, 17 bp, Homo sapiens
ggccaatttactggcca

SEQ ID NO: 4344221 - DNA, 18 bp, Homo sapiens
ggccaatttactggccac

SEQ ID NO: 4344222 - DNA, 11 bp, Homo sapiens
ggccactgtga

SEQ ID NO: 4344223 - DNA, 18 bp, Homo sapiens
ggccagaaaaagaagaag

SEQ ID NO: 4344224 - DNA, 21 bp, Homo sapiens
ggccagaaaaagaagaaggag

SEQ ID NO: 4344225 - DNA, 14 bp, Homo sapiens
ggccagactccctt

SEQ ID NO: 4344226 - DNA, 15 bp, Homo sapiens
ggccagactcccttg

SEQ ID NO: 4344227 - DNA, 11 bp, Homo sapiens
ggccaggagcc

SEQ ID NO: 4344228 - DNA, 15 bp, Homo sapiens
ggccaggagccctgg

SEQ ID NO: 4344229 - DNA, 19 bp, Homo sapiens
ggccatatatgctgtattt

SEQ ID NO: 4344230 - DNA, 22 bp, Homo sapiens
ggccatatatgctgtatttctt

SEQ ID NO: 4344231 - DNA, 19 bp, Homo sapiens
ggcccctgcttctccagcc

SEQ ID NO: 4344232 - DNA, 12 bp, Homo sapiens
ggcccggaagaa

SEQ ID NO: 4344233 - DNA, 13 bp, Homo sapiens
ggccctagaggac

SEQ ID NO: 4344234 - DNA, 14 bp, Homo sapiens
ggccctagaggaca

SEQ ID NO: 4344235 - DNA, 16 bp, Homo sapiens
ggccctcagctccctg

SEQ ID NO: 4344236 - DNA, 21 bp, Homo sapiens
ggccctttcttgcactgtcca

SEQ ID NO: 4344237 - DNA, 13 bp, Homo sapiens
ggccgctgcccct

SEQ ID NO: 4344238 - DNA, 15 bp, Homo sapiens
ggccgctgcccctga

SEQ ID NO: 4344239 - DNA, 17 bp, Homo sapiens
ggccgctgcccctgagt

SEQ ID NO: 4344240 - DNA, 19 bp, Homo sapiens
ggccggagacccacagccc

SEQ ID NO: 4344241 - DNA, 21 bp, Homo sapiens
ggcctcggctgtctcctgtcc

SEQ ID NO: 4344242 - DNA, 15 bp, Homo sapiens
ggcgaataaatgttc

SEQ ID NO: 4344243 - DNA, 16 bp, Homo sapiens
ggcgaataaatgttca

SEQ ID NO: 4344244 - DNA, 13 bp, Homo sapiens
ggctactctgccc

SEQ ID NO: 4344245 - DNA, 13 bp, Homo sapiens
ggctcagcagggc

SEQ ID NO: 4344246 - DNA, 23 bp, Homo sapiens
ggctccaacccgttgggtccctt

SEQ ID NO: 4344247 - DNA, 13 bp, Homo sapiens
ggctctgaaataa

SEQ ID NO: 4344248 - DNA, 13 bp, Homo sapiens
ggctgaggtggga

SEQ ID NO: 4344249 - DNA, 15 bp, Homo sapiens
ggctgaggtgggagg

SEQ ID NO: 4344250 - DNA, 15 bp, Homo sapiens
ggctgcgaaaacgtt

SEQ ID NO: 4344251 - DNA, 23 bp, Homo sapiens
ggctgcgtactccactggtctgt

SEQ ID NO: 4344252 - DNA, 16 bp, Homo sapiens
ggctgggggaagaagc

SEQ ID NO: 4344253 - DNA, 15 bp, Homo sapiens
ggctggtggccttgg

SEQ ID NO: 4344254 - DNA, 12 bp, Homo sapiens
ggctgtctcctg

SEQ ID NO: 4344255 - DNA, 20 bp, Homo sapiens
ggctgttaaccacccgcccc

SEQ ID NO: 4344256 - DNA, 17 bp, Homo sapiens
ggcttactgaaagacag

SEQ ID NO: 4344257 - DNA, 18 bp, Homo sapiens
ggcttcaggtctctgtgg

SEQ ID NO: 4344258 - DNA, 18 bp, Homo sapiens
ggcttcttggaccttggc

SEQ ID NO: 4344259 - DNA, 11 bp, Homo sapiens
ggcttgctgtt

SEQ ID NO: 4344260 - DNA, 21 bp, Homo sapiens
ggcttgctgtttactcccttc

SEQ ID NO: 4344261 - DNA, 22 bp, Homo sapiens
gggaacccccaaatttaattaa

SEQ ID NO: 4344262 - DNA, 23 bp, Homo sapiens
gggaagatggagcaggtctttgg

SEQ ID NO: 4344263 - DNA, 12 bp, Homo sapiens
gggacagagccc

SEQ ID NO: 4344264 - DNA, 18 bp, Homo sapiens
gggacagagcccgggaga

SEQ ID NO: 4344265 - DNA, 19 bp, Homo sapiens
gggaccgtctttacccctg

SEQ ID NO: 4344266 - DNA, 17 bp, Homo sapiens
gggacctaatgctggcc

SEQ ID NO: 4344267 - DNA, 21 bp, Homo sapiens
gggacctaatgctggcctgac

SEQ ID NO: 4344268 - DNA, 19 bp, Homo sapiens
gggactgtatttctgtgga

SEQ ID NO: 4344269 - DNA, 14 bp, Homo sapiens
gggagagcctctgt

SEQ ID NO: 4344270 - DNA, 11 bp, Homo sapiens
gggagcctcct

SEQ ID NO: 4344271 - DNA, 19 bp, Homo sapiens
gggaggcatctgcatgggt

SEQ ID NO: 4344272 - DNA, 20 bp, Homo sapiens
gggagggaaaagggaagtag

SEQ ID NO: 4344273 - DNA, 23 bp, Homo sapiens
gggaggggttgccacaggcctcc

SEQ ID NO: 4344274 - DNA, 18 bp, Homo sapiens
gggaggtcaaggctgcag

SEQ ID NO: 4344275 - DNA, 17 bp, Homo sapiens
gggaggtcgaggcagga

SEQ ID NO: 4344276 - DNA, 18 bp, Homo sapiens
gggaggtcgaggcaggag

SEQ ID NO: 4344277 - DNA, 20 bp, Homo sapiens
gggatgagctcaagcaggaa

SEQ ID NO: 4344278 - DNA, 21 bp, Homo sapiens
gggatggacgctgccgggaga

SEQ ID NO: 4344279 - DNA, 20 bp, Homo sapiens
gggcaagaagatcacgctcc

SEQ ID NO: 4344280 - DNA, 13 bp, Homo sapiens
gggcacgggcctg

SEQ ID NO: 4344281 - DNA, 23 bp, Homo sapiens
gggcatgagtctgtttcccaagc

SEQ ID NO: 4344282 - DNA, 16 bp, Homo sapiens
gggccgggggcggggc

SEQ ID NO: 4344283 - DNA, 15 bp, Homo sapiens
gggccgtgcccttgc

SEQ ID NO: 4344284 - DNA, 12 bp, Homo sapiens
gggcctggcata

SEQ ID NO: 4344285 - DNA, 18 bp, Homo sapiens
gggcctggcggaggtgga

SEQ ID NO: 4344286 - DNA, 22 bp, Homo sapiens
gggcctggcgggatgggccacc

SEQ ID NO: 4344287 - DNA, 13 bp, Homo sapiens
gggcctgggcggg

SEQ ID NO: 4344288 - DNA, 18 bp, Homo sapiens
gggcctggtcgttttcaa

SEQ ID NO: 4344289 - DNA, 20 bp, Homo sapiens
gggcgggtgatgagacctgg

SEQ ID NO: 4344290 - DNA, 14 bp, Homo sapiens
gggcgtgttgtttt

SEQ ID NO: 4344291 - DNA, 18 bp, Homo sapiens
gggctcagcaaaagatgc

SEQ ID NO: 4344292 - DNA, 15 bp, Homo sapiens
gggctcagcagggct

SEQ ID NO: 4344293 - DNA, 16 bp, Homo sapiens
gggctcagcagggctg

SEQ ID NO: 4344294 - DNA, 18 bp, Homo sapiens
gggctctgaaataaaaat

SEQ ID NO: 4344295 - DNA, 16 bp, Homo sapiens
ggggaaaatcagcctg

SEQ ID NO: 4344296 - DNA, 19 bp, Homo sapiens
ggggaaaatcagcctgctc

SEQ ID NO: 4344297 - DNA, 21 bp, Homo sapiens
ggggaaaatcagcctgctcca

SEQ ID NO: 4344298 - DNA, 14 bp, Homo sapiens
ggggaggagagagg

SEQ ID NO: 4344299 - DNA, 18 bp, Homo sapiens
ggggcggggccgggactg

SEQ ID NO: 4344300 - DNA, 17 bp, Homo sapiens
ggggctgaggtgggagg

SEQ ID NO: 4344301 - DNA, 19 bp, Homo sapiens
ggggctgaggtgggaggat

SEQ ID NO: 4344302 - DNA, 23 bp, Homo sapiens
gggggcacatgctgagtctccca

SEQ ID NO: 4344303 - DNA, 14 bp, Homo sapiens
ggggtgcctgctgt

SEQ ID NO: 4344304 - DNA, 21 bp, Homo sapiens
ggggtttagaaccccaggtga

SEQ ID NO: 4344305 - DNA, 21 bp, Homo sapiens
gggtgaagcaccagggagagg

SEQ ID NO: 4344306 - DNA, 15 bp, Homo sapiens
gggtgaagtgcctgc

SEQ ID NO: 4344307 - DNA, 16 bp, Homo sapiens
gggtgatgagacctgg

SEQ ID NO: 4344308 - DNA, 13 bp, Homo sapiens
gggtggtgggtgg

SEQ ID NO: 4344309 - DNA, 18 bp, Homo sapiens
gggttgccacaggcctcc

SEQ ID NO: 4344310 - DNA, 20 bp, Homo sapiens
gggttgccacaggcctccct

SEQ ID NO: 4344311 - DNA, 16 bp, Homo sapiens
gggtttgagacagaca

SEQ ID NO: 4344312 - DNA, 17 bp, Homo sapiens
ggtaaaaaagaaatgaa

SEQ ID NO: 4344313 - DNA, 19 bp, Homo sapiens
ggtaaacacataaatgaaa

SEQ ID NO: 4344314 - DNA, 14 bp, Homo sapiens
ggtaagtgaattta

SEQ ID NO: 4344315 - DNA, 20 bp, Homo sapiens
ggtaatttaaattggtcatg

SEQ ID NO: 4344316 - DNA, 22 bp, Homo sapiens
ggtacaatcgacatcctagccc

SEQ ID NO: 4344317 - DNA, 22 bp, Homo sapiens
ggtacagtaaagaggcttccaa

SEQ ID NO: 4344318 - DNA, 17 bp, Homo sapiens
ggtataatgtgtctgtg

SEQ ID NO: 4344319 - DNA, 15 bp, Homo sapiens
ggtccggggaggagg

SEQ ID NO: 4344320 - DNA, 12 bp, Homo sapiens
ggtcttatgatt

SEQ ID NO: 4344321 - DNA, 22 bp, Homo sapiens
ggtcttatgattttattacaga

SEQ ID NO: 4344322 - DNA, 18 bp, Homo sapiens
ggtgaagcaccagggaga

SEQ ID NO: 4344323 - DNA, 17 bp, Homo sapiens
ggtgaagtgcctgctgg

SEQ ID NO: 4344324 - DNA, 20 bp, Homo sapiens
ggtgagctatagtgaagaat

SEQ ID NO: 4344325 - DNA, 17 bp, Homo sapiens
ggtgagtctgaaccaat

SEQ ID NO: 4344326 - DNA, 15 bp, Homo sapiens
ggtgatgagacctgg

SEQ ID NO: 4344327 - DNA, 16 bp, Homo sapiens
ggtgattgaaagaaaa

SEQ ID NO: 4344328 - DNA, 12 bp, Homo sapiens
ggtgcagggcct

SEQ ID NO: 4344329 - DNA, 14 bp, Homo sapiens
ggtgcagggcctgg

SEQ ID NO: 4344330 - DNA, 11 bp, Homo sapiens
ggtgcatctgg

SEQ ID NO: 4344331 - DNA, 16 bp, Homo sapiens
ggtgcatctggcacgt

SEQ ID NO: 4344332 - DNA, 22 bp, Homo sapiens
ggtgcatctggcacgtggccag

SEQ ID NO: 4344333 - DNA, 18 bp, Homo sapiens
ggtgcccttccctggagg

SEQ ID NO: 4344334 - DNA, 19 bp, Homo sapiens
ggtgcccttccctggaggt

SEQ ID NO: 4344335 - DNA, 23 bp, Homo sapiens
ggtgcgcacttacctgcttgagc

SEQ ID NO: 4344336 - DNA, 23 bp, Homo sapiens
ggtgcgtcccccgttgtgcctgg

SEQ ID NO: 4344337 - DNA, 17 bp, Homo sapiens
ggtggccctcccaggct

SEQ ID NO: 4344338 - DNA, 17 bp, Homo sapiens
ggtgtattgtgtatgta

SEQ ID NO: 4344339 - DNA, 13 bp, Homo sapiens
ggtgttgagattt

SEQ ID NO: 4344340 - DNA, 12 bp, Homo sapiens
ggttaatttcta

SEQ ID NO: 4344341 - DNA, 19 bp, Homo sapiens
ggttagagacagtatgtat

SEQ ID NO: 4344342 - DNA, 19 bp, Homo sapiens
ggttagcccaatggagaaa

SEQ ID NO: 4344343 - DNA, 13 bp, Homo sapiens
ggttatggagagg

SEQ ID NO: 4344344 - DNA, 11 bp, Homo sapiens
ggttcatgctt

SEQ ID NO: 4344345 - DNA, 20 bp, Homo sapiens
ggttcgggattccctggtgg

SEQ ID NO: 4344346 - DNA, 15 bp, Homo sapiens
ggttctgggcctctg

SEQ ID NO: 4344347 - DNA, 13 bp, Homo sapiens
ggttgccacaggc

SEQ ID NO: 4344348 - DNA, 20 bp, Homo sapiens
ggttgccacaggcctccctg

SEQ ID NO: 4344349 - DNA, 14 bp, Homo sapiens
ggtttctccccgga

SEQ ID NO: 4344350 - DNA, 19 bp, Homo sapiens
ggtttcttttggaaataat

SEQ ID NO: 4344351 - DNA, 15 bp, Homo sapiens
ggtttgagacagaca

SEQ ID NO: 4344352 - DNA, 22 bp, Homo sapiens
ggtttgagattgccccaggtct

SEQ ID NO: 4344353 - DNA, 13 bp, Homo sapiens
ggtttggggctgc

SEQ ID NO: 4344354 - DNA, 16 bp, Homo sapiens
ggttttaaatgtgttg

SEQ ID NO: 4344355 - DNA, 15 bp, Homo sapiens
gtaaaaaagaaatga

SEQ ID NO: 4344356 - DNA, 18 bp, Homo sapiens
gtaaaatgtatttttcta

SEQ ID NO: 4344357 - DNA, 21 bp, Homo sapiens
gtaaacacataaatgaaagaa

SEQ ID NO: 4344358 - DNA, 22 bp, Homo sapiens
gtaaacacataaatgaaagaaa

SEQ ID NO: 4344359 - DNA, 15 bp, Homo sapiens
gtaaagaggcttcca

SEQ ID NO: 4344360 - DNA, 18 bp, Homo sapiens
gtaaagaggcttccaagc

SEQ ID NO: 4344361 - DNA, 17 bp, Homo sapiens
gtaaatatgagactatt

SEQ ID NO: 4344362 - DNA, 16 bp, Homo sapiens
gtaaatattaaagctc

SEQ ID NO: 4344363 - DNA, 18 bp, Homo sapiens
gtaaatgtggtgagaatg

SEQ ID NO: 4344364 - DNA, 21 bp, Homo sapiens
gtaacactttaaaaccagtta

SEQ ID NO: 4344365 - DNA, 17 bp, Homo sapiens
gtaacagtgcaagattt

SEQ ID NO: 4344366 - DNA, 20 bp, Homo sapiens
gtaaccatatcacctctctt

SEQ ID NO: 4344367 - DNA, 18 bp, Homo sapiens
gtaactgttcctactttg

SEQ ID NO: 4344368 - DNA, 15 bp, Homo sapiens
gtaagaccaccttcc

SEQ ID NO: 4344369 - DNA, 18 bp, Homo sapiens
gtaagtaattatgcacta

SEQ ID NO: 4344370 - DNA, 23 bp, Homo sapiens
gtaatcctagcactttgggaggc

SEQ ID NO: 4344371 - DNA, 12 bp, Homo sapiens
gtaatgtagaaa

SEQ ID NO: 4344372 - DNA, 15 bp, Homo sapiens
gtaatgtagaaatgt

SEQ ID NO: 4344373 - DNA, 17 bp, Homo sapiens
gtaatgtcagactttgc

SEQ ID NO: 4344374 - DNA, 17 bp, Homo sapiens
gtaattatgtaacctat

SEQ ID NO: 4344375 - DNA, 13 bp, Homo sapiens
gtacaatgtgttt

SEQ ID NO: 4344376 - DNA, 13 bp, Homo sapiens
gtacatgaagaat

SEQ ID NO: 4344377 - DNA, 16 bp, Homo sapiens
gtacatgaagaatgta

SEQ ID NO: 4344378 - DNA, 17 bp, Homo sapiens
gtacccagccatgtgtt

SEQ ID NO: 4344379 - DNA, 14 bp, Homo sapiens
gtaccccccaaccc

SEQ ID NO: 4344380 - DNA, 14 bp, Homo sapiens
gtacccccttctgg

SEQ ID NO: 4344381 - DNA, 15 bp, Homo sapiens
gtaccctctccaggc

SEQ ID NO: 4344382 - DNA, 20 bp, Homo sapiens
gtactgtttaccatttttca

SEQ ID NO: 4344383 - DNA, 22 bp, Homo sapiens
gtactttgtgtttagctacctt

SEQ ID NO: 4344384 - DNA, 18 bp, Homo sapiens
gtagaaagacatctgcct

SEQ ID NO: 4344385 - DNA, 22 bp, Homo sapiens
gtagaaagacatctgcctgtaa

SEQ ID NO: 4344386 - DNA, 14 bp, Homo sapiens
gtagagagtgggtc

SEQ ID NO: 4344387 - DNA, 12 bp, Homo sapiens
gtagaggaaaat

SEQ ID NO: 4344388 - DNA, 14 bp, Homo sapiens
gtaggtaaaatgta

SEQ ID NO: 4344389 - DNA, 18 bp, Homo sapiens
gtaggtaaaatgtatttt

SEQ ID NO: 4344390 - DNA, 20 bp, Homo sapiens
gtaggtaaaatgtatttttc

SEQ ID NO: 4344391 - DNA, 22 bp, Homo sapiens
gtaggtaaaatgtatttttcta

SEQ ID NO: 4344392 - DNA, 22 bp, Homo sapiens
gtaggtgagctatagtgaagaa

SEQ ID NO: 4344393 - DNA, 21 bp, Homo sapiens
gtagtcaagaggtttttctcc

SEQ ID NO: 4344394 - DNA, 18 bp, Homo sapiens
gtagtcagactgacacta

SEQ ID NO: 4344395 - DNA, 14 bp, Homo sapiens
gtagtccttggcat

SEQ ID NO: 4344396 - DNA, 18 bp, Homo sapiens
gtagttccctctgcctgg

SEQ ID NO: 4344397 - DNA, 17 bp, Homo sapiens
gtagtttttgctgaagg

SEQ ID NO: 4344398 - DNA, 22 bp, Homo sapiens
gtataaattaaataaactgttt

SEQ ID NO: 4344399 - DNA, 19 bp, Homo sapiens
gtataatctcctctgctca

SEQ ID NO: 4344400 - DNA, 22 bp, Homo sapiens
gtatataataactttgaagcca

SEQ ID NO: 4344401 - DNA, 15 bp, Homo sapiens
gtatatatattctca

SEQ ID NO: 4344402 - DNA, 21 bp, Homo sapiens
gtatattatgtatttatattt

SEQ ID NO: 4344403 - DNA, 12 bp, Homo sapiens
gtatattggaag

SEQ ID NO: 4344404 - DNA, 20 bp, Homo sapiens
gtatcaactaggggaggaga

SEQ ID NO: 4344405 - DNA, 21 bp, Homo sapiens
gtatcaacttcccagtgatct

SEQ ID NO: 4344406 - DNA, 19 bp, Homo sapiens
gtatgccttcgggaaaatt

SEQ ID NO: 4344407 - DNA, 15 bp, Homo sapiens
gtatgtatataatca

SEQ ID NO: 4344408 - DNA, 15 bp, Homo sapiens
gtatgtatattttca

SEQ ID NO: 4344409 - DNA, 17 bp, Homo sapiens
gtatgtccttcagctga

SEQ ID NO: 4344410 - DNA, 19 bp, Homo sapiens
gtatgtggtatgtatattt

SEQ ID NO: 4344411 - DNA, 14 bp, Homo sapiens
gtattaataaagca

SEQ ID NO: 4344412 - DNA, 17 bp, Homo sapiens
gtattaataaagcattc

SEQ ID NO: 4344413 - DNA, 19 bp, Homo sapiens
gtattaataaagcattctt

SEQ ID NO: 4344414 - DNA, 21 bp, Homo sapiens
gtattgagtcttaactgtatt

SEQ ID NO: 4344415 - DNA, 13 bp, Homo sapiens
gtattgcttcctg

SEQ ID NO: 4344416 - DNA, 18 bp, Homo sapiens
gtatttaactacatctgc

SEQ ID NO: 4344417 - DNA, 20 bp, Homo sapiens
gtatttaactacatctgcct

SEQ ID NO: 4344418 - DNA, 21 bp, Homo sapiens
gtatttaactacatctgcctc

SEQ ID NO: 4344419 - DNA, 22 bp, Homo sapiens
gtatttatgtaatgaagtaaag

SEQ ID NO: 4344420 - DNA, 11 bp, Homo sapiens
gtatttctgtg

SEQ ID NO: 4344421 - DNA, 15 bp, Homo sapiens
gtatttctgtggaaa

SEQ ID NO: 4344422 - DNA, 21 bp, Homo sapiens
gtatttctgtggaaaacaatt

SEQ ID NO: 4344423 - DNA, 21 bp, Homo sapiens
gtatttctttgtagaataaat

SEQ ID NO: 4344424 - DNA, 18 bp, Homo sapiens
gtatttgtattaataaag

SEQ ID NO: 4344425 - DNA, 23 bp, Homo sapiens
gtattttaataaactttgaataa

SEQ ID NO: 4344426 - DNA, 18 bp, Homo sapiens
gtcaactggggaaaagga

SEQ ID NO: 4344427 - DNA, 19 bp, Homo sapiens
gtcaagaggtttttctccc

SEQ ID NO: 4344428 - DNA, 16 bp, Homo sapiens
gtcaagtgaaaaagga

SEQ ID NO: 4344429 - DNA, 17 bp, Homo sapiens
gtcaagtttttctctca

SEQ ID NO: 4344430 - DNA, 17 bp, Homo sapiens
gtcacaagtagcctctg

SEQ ID NO: 4344431 - DNA, 19 bp, Homo sapiens
gtcacaagtagcctctggg

SEQ ID NO: 4344432 - DNA, 15 bp, Homo sapiens
gtcacctcccatccc

SEQ ID NO: 4344433 - DNA, 14 bp, Homo sapiens
gtcacctccttccc

SEQ ID NO: 4344434 - DNA, 19 bp, Homo sapiens
gtcacctccttccccagct

SEQ ID NO: 4344435 - DNA, 16 bp, Homo sapiens
gtcagaatggaatcca

SEQ ID NO: 4344436 - DNA, 22 bp, Homo sapiens
gtcagactttgctgcattttac

SEQ ID NO: 4344437 - DNA, 19 bp, Homo sapiens
gtcagagttaaaatatata

SEQ ID NO: 4344438 - DNA, 23 bp, Homo sapiens
gtcagccatgggaaatgagccag

SEQ ID NO: 4344439 - DNA, 21 bp, Homo sapiens
gtcagcgtggtttttatgtgt

SEQ ID NO: 4344440 - DNA, 23 bp, Homo sapiens
gtcattacttctgagccccagcc

SEQ ID NO: 4344441 - DNA, 17 bp, Homo sapiens
gtcattgagtgacttta

SEQ ID NO: 4344442 - DNA, 14 bp, Homo sapiens
gtcatttcattcca

SEQ ID NO: 4344443 - DNA, 16 bp, Homo sapiens
gtcatttcattccatt

SEQ ID NO: 4344444 - DNA, 21 bp, Homo sapiens
gtccaactcttccacctctgg

SEQ ID NO: 4344445 - DNA, 15 bp, Homo sapiens
gtccactcccaagcc

SEQ ID NO: 4344446 - DNA, 20 bp, Homo sapiens
gtccagttataagcgtattt

SEQ ID NO: 4344447 - DNA, 22 bp, Homo sapiens
gtccattccattaataactgaa

SEQ ID NO: 4344448 - DNA, 22 bp, Homo sapiens
gtcccacagggaaatgtgtatc

SEQ ID NO: 4344449 - DNA, 12 bp, Homo sapiens
gtcccagaggcc

SEQ ID NO: 4344450 - DNA, 13 bp, Homo sapiens
gtcccagaggccg

SEQ ID NO: 4344451 - DNA, 20 bp, Homo sapiens
gtcccagaggccgctgcccc

SEQ ID NO: 4344452 - DNA, 14 bp, Homo sapiens
gtcccagcacattt

SEQ ID NO: 4344453 - DNA, 21 bp, Homo sapiens
gtccccggcggggtgcctgct

SEQ ID NO: 4344454 - DNA, 15 bp, Homo sapiens
gtcccctcagctcca

SEQ ID NO: 4344455 - DNA, 21 bp, Homo sapiens
gtccctctgtgtctgctctca

SEQ ID NO: 4344456 - DNA, 12 bp, Homo sapiens
gtccctgccctc

SEQ ID NO: 4344457 - DNA, 19 bp, Homo sapiens
gtcccttggatcagaggtc

SEQ ID NO: 4344458 - DNA, 18 bp, Homo sapiens
gtccttgcacctgagcct

SEQ ID NO: 4344459 - DNA, 17 bp, Homo sapiens
gtccttggaagtttcat

SEQ ID NO: 4344460 - DNA, 15 bp, Homo sapiens
gtcctttgaggcccc

SEQ ID NO: 4344461 - DNA, 21 bp, Homo sapiens
gtcgggcatgagtctgtttcc

SEQ ID NO: 4344462 - DNA, 21 bp, Homo sapiens
gtcgtgtcaccagctggtata

SEQ ID NO: 4344463 - DNA, 14 bp, Homo sapiens
gtctacattaaaca

SEQ ID NO: 4344464 - DNA, 23 bp, Homo sapiens
gtctacattcttggttgttaatt

SEQ ID NO: 4344465 - DNA, 13 bp, Homo sapiens
gtctacctctgac

SEQ ID NO: 4344466 - DNA, 14 bp, Homo sapiens
gtctattattgaaa

SEQ ID NO: 4344467 - DNA, 13 bp, Homo sapiens
gtctcagcagtgg

SEQ ID NO: 4344468 - DNA, 18 bp, Homo sapiens
gtctcagtacctcccctc

SEQ ID NO: 4344469 - DNA, 17 bp, Homo sapiens
gtctcctgtccccggcg

SEQ ID NO: 4344470 - DNA, 15 bp, Homo sapiens
gtctccttgattttt

SEQ ID NO: 4344471 - DNA, 20 bp, Homo sapiens
gtctctcttcagactctcag

SEQ ID NO: 4344472 - DNA, 21 bp, Homo sapiens
gtctcttggaaatgttaagaa

SEQ ID NO: 4344473 - DNA, 22 bp, Homo sapiens
gtctcttggaaatgttaagaaa

SEQ ID NO: 4344474 - DNA, 23 bp, Homo sapiens
gtctgaaccaatagaaagcaaac

SEQ ID NO: 4344475 - DNA, 16 bp, Homo sapiens
gtctgaattgagaaaa

SEQ ID NO: 4344476 - DNA, 15 bp, Homo sapiens
gtctgcgtgactatt

SEQ ID NO: 4344477 - DNA, 22 bp, Homo sapiens
gtctgctctcatccattcctct

SEQ ID NO: 4344478 - DNA, 18 bp, Homo sapiens
gtctggaggggcccctgc

SEQ ID NO: 4344479 - DNA, 22 bp, Homo sapiens
gtctggcaggctactctgccca

SEQ ID NO: 4344480 - DNA, 14 bp, Homo sapiens
gtctggtggtgctg

SEQ ID NO: 4344481 - DNA, 22 bp, Homo sapiens
gtctgtatccccagtgcccggt

SEQ ID NO: 4344482 - DNA, 23 bp, Homo sapiens
gtctgtcagaagacactaattcc

SEQ ID NO: 4344483 - DNA, 15 bp, Homo sapiens
gtctgtttcccaagc

SEQ ID NO: 4344484 - DNA, 16 bp, Homo sapiens
gtctgtttcccaagct

SEQ ID NO: 4344485 - DNA, 21 bp, Homo sapiens
gtcttaaaaagtggaaaaata

SEQ ID NO: 4344486 - DNA, 16 bp, Homo sapiens
gtcttatgattttatt

SEQ ID NO: 4344487 - DNA, 18 bp, Homo sapiens
gtcttatgattttattac

SEQ ID NO: 4344488 - DNA, 20 bp, Homo sapiens
gtcttatgattttattacag

SEQ ID NO: 4344489 - DNA, 17 bp, Homo sapiens
gtcttgatgactgctga

SEQ ID NO: 4344490 - DNA, 12 bp, Homo sapiens
gtcttgttctgt

SEQ ID NO: 4344491 - DNA, 22 bp, Homo sapiens
gtctttcctcccttctttgctt

SEQ ID NO: 4344492 - DNA, 22 bp, Homo sapiens
gtctttggataataggaattca

SEQ ID NO: 4344493 - DNA, 23 bp, Homo sapiens
gtgaaaagaaaaatgagcctggc

SEQ ID NO: 4344494 - DNA, 19 bp, Homo sapiens
gtgaacttgggccactgtg

SEQ ID NO: 4344495 - DNA, 15 bp, Homo sapiens
gtgaagcaccaggga

SEQ ID NO: 4344496 - DNA, 13 bp, Homo sapiens
gtgaaggacatga

SEQ ID NO: 4344497 - DNA, 24 bp, Homo sapiens
gtgaaggacatgagactaagagaa

SEQ ID NO: 4344498 - DNA, 13 bp, Homo sapiens
gtgaagtgcctgc

SEQ ID NO: 4344499 - DNA, 23 bp, Homo sapiens
gtgaagtgcctgctgggtgccag

SEQ ID NO: 4344500 - DNA, 23 bp, Homo sapiens
gtgaataatacagtatctcaggg

SEQ ID NO: 4344501 - DNA, 22 bp, Homo sapiens
gtgaggtcacatgttggtgctg

SEQ ID NO: 4344502 - DNA, 17 bp, Homo sapiens
gtgatcaactgttcagg

SEQ ID NO: 4344503 - DNA, 15 bp, Homo sapiens
gtgatgaggggaggg

SEQ ID NO: 4344504 - DNA, 15 bp, Homo sapiens
gtgatggagggaagg

SEQ ID NO: 4344505 - DNA, 21 bp, Homo sapiens
gtgatgtattcttttatgaaa

SEQ ID NO: 4344506 - DNA, 13 bp, Homo sapiens
gtgcacaaggatt

SEQ ID NO: 4344507 - DNA, 16 bp, Homo sapiens
gtgcacactaagaaat

SEQ ID NO: 4344508 - DNA, 19 bp, Homo sapiens
gtgcagggcctggcataga

SEQ ID NO: 4344509 - DNA, 15 bp, Homo sapiens
gtgcatgtgccgagg

SEQ ID NO: 4344510 - DNA, 15 bp, Homo sapiens
gtgcatttaaactct

SEQ ID NO: 4344511 - DNA, 22 bp, Homo sapiens
gtgccataccttctcccaggcc

SEQ ID NO: 4344512 - DNA, 23 bp, Homo sapiens
gtgccattgtctttcctcccttc

SEQ ID NO: 4344513 - DNA, 14 bp, Homo sapiens
gtgccccaaggagg

SEQ ID NO: 4344514 - DNA, 17 bp, Homo sapiens
gtgccccaaggaggtgg

SEQ ID NO: 4344515 - DNA, 12 bp, Homo sapiens
gtgcccctgcca

SEQ ID NO: 4344516 - DNA, 13 bp, Homo sapiens
gtgcccctgccaa

SEQ ID NO: 4344517 - DNA, 21 bp, Homo sapiens
gtgcccggtgcagggcctggc

SEQ ID NO: 4344518 - DNA, 23 bp, Homo sapiens
gtgcccggtgcagggcctggcat

SEQ ID NO: 4344519 - DNA, 15 bp, Homo sapiens
gtgcccttccctgga

SEQ ID NO: 4344520 - DNA, 17 bp, Homo sapiens
gtgcccttccctggagg

SEQ ID NO: 4344521 - DNA, 22 bp, Homo sapiens
gtgcccttgcccttggagctgc

SEQ ID NO: 4344522 - DNA, 23 bp, Homo sapiens
gtgcctgctgggtgccaggtgct

SEQ ID NO: 4344523 - DNA, 12 bp, Homo sapiens
gtgcctgtgtcc

SEQ ID NO: 4344524 - DNA, 19 bp, Homo sapiens
gtgcgtcccccgttgtgcc

SEQ ID NO: 4344525 - DNA, 22 bp, Homo sapiens
gtgcgtcccccgttgtgcctgg

SEQ ID NO: 4344526 - DNA, 17 bp, Homo sapiens
gtgcgtgtgagtgtgtg

SEQ ID NO: 4344527 - DNA, 18 bp, Homo sapiens
gtgctaagctgccctgag

SEQ ID NO: 4344528 - DNA, 19 bp, Homo sapiens
gtgctacctgcacctctgg

SEQ ID NO: 4344529 - DNA, 23 bp, Homo sapiens
gtgctatatttttaaagaaggag

SEQ ID NO: 4344530 - DNA, 14 bp, Homo sapiens
gtgctgagcctgcc

SEQ ID NO: 4344531 - DNA, 16 bp, Homo sapiens
gtgctgagcctgccca

SEQ ID NO: 4344532 - DNA, 12 bp, Homo sapiens
gtgctgagtgct

SEQ ID NO: 4344533 - DNA, 15 bp, Homo sapiens
gtgctgagtgctatg

SEQ ID NO: 4344534 - DNA, 22 bp, Homo sapiens
gtgctgggaatacatctgtgga

SEQ ID NO: 4344535 - DNA, 19 bp, Homo sapiens
gtgctgtaacctgaagtca

SEQ ID NO: 4344536 - DNA, 18 bp, Homo sapiens
gtgctgtccatgcttctc

SEQ ID NO: 4344537 - DNA, 22 bp, Homo sapiens
gtgctgtcttgatgactgctga

SEQ ID NO: 4344538 - DNA, 13 bp, Homo sapiens
gtgcttcacattt

SEQ ID NO: 4344539 - DNA, 17 bp, Homo sapiens
gtgcttcagagtttgtg

SEQ ID NO: 4344540 - DNA, 20 bp, Homo sapiens
gtgcttctcagttgcagaaa

SEQ ID NO: 4344541 - DNA, 16 bp, Homo sapiens
gtgcttctccccagaa

SEQ ID NO: 4344542 - DNA, 21 bp, Homo sapiens
gtgcttctccccagaattcac

SEQ ID NO: 4344543 - DNA, 15 bp, Homo sapiens
gtgcttgctggtgcc

SEQ ID NO: 4344544 - DNA, 18 bp, Homo sapiens
gtgcttgctggtgcctct

SEQ ID NO: 4344545 - DNA, 18 bp, Homo sapiens
gtggaaaaatagcctgcc

SEQ ID NO: 4344546 - DNA, 19 bp, Homo sapiens
gtggaaaacaatttgcata

SEQ ID NO: 4344547 - DNA, 20 bp, Homo sapiens
gtggaagggccaatggagaa

SEQ ID NO: 4344548 - DNA, 19 bp, Homo sapiens
gtggaggagggagagccct

SEQ ID NO: 4344549 - DNA, 13 bp, Homo sapiens
gtggcaccagcag

SEQ ID NO: 4344550 - DNA, 23 bp, Homo sapiens
gtggccactggcacttgcctgct

SEQ ID NO: 4344551 - DNA, 12 bp, Homo sapiens
gtggccaggagc

SEQ ID NO: 4344552 - DNA, 13 bp, Homo sapiens
gtggccaggagcc

SEQ ID NO: 4344553 - DNA, 15 bp, Homo sapiens
gtggccaggagccct

SEQ ID NO: 4344554 - DNA, 16 bp, Homo sapiens
gtggccaggagccctg

SEQ ID NO: 4344555 - DNA, 17 bp, Homo sapiens
gtggccatatatgctgt

SEQ ID NO: 4344556 - DNA, 15 bp, Homo sapiens
gtggccctcccaggc

SEQ ID NO: 4344557 - DNA, 19 bp, Homo sapiens
gtggctgttaaccacccgc

SEQ ID NO: 4344558 - DNA, 20 bp, Homo sapiens
gtgggtgaagtgcctgctgg

SEQ ID NO: 4344559 - DNA, 14 bp, Homo sapiens
gtggtaaaaaagaa

SEQ ID NO: 4344560 - DNA, 16 bp, Homo sapiens
gtggtaaaaaagaaat

SEQ ID NO: 4344561 - DNA, 18 bp, Homo sapiens
gtggtaaaaaagaaatga

SEQ ID NO: 4344562 - DNA, 15 bp, Homo sapiens
gtggtactctgtgtc

SEQ ID NO: 4344563 - DNA, 19 bp, Homo sapiens
gtgtaatctaagtatatgt

SEQ ID NO: 4344564 - DNA, 15 bp, Homo sapiens
gtgtacatgaagaat

SEQ ID NO: 4344565 - DNA, 18 bp, Homo sapiens
gtgtagttccctctgcct

SEQ ID NO: 4344566 - DNA, 21 bp, Homo sapiens
gtgtatttgtattaataaagc

SEQ ID NO: 4344567 - DNA, 23 bp, Homo sapiens
gtgtatttgtattaataaagcat

SEQ ID NO: 4344568 - DNA, 14 bp, Homo sapiens
gtgtcaagaaggaa

SEQ ID NO: 4344569 - DNA, 16 bp, Homo sapiens
gtgtcacctccttccc

SEQ ID NO: 4344570 - DNA, 16 bp, Homo sapiens
gtgtcagcatagaagt

SEQ ID NO: 4344571 - DNA, 23 bp, Homo sapiens
gtgtctgaatcatgtctgtatcc

SEQ ID NO: 4344572 - DNA, 23 bp, Homo sapiens
gtgtctgctctcatccattcctc

SEQ ID NO: 4344573 - DNA, 11 bp, Homo sapiens
gtgtctgtgtt

SEQ ID NO: 4344574 - DNA, 22 bp, Homo sapiens
gtgtgcaactaactgactctgt

SEQ ID NO: 4344575 - DNA, 13 bp, Homo sapiens
gtgtggagaagcg

SEQ ID NO: 4344576 - DNA, 16 bp, Homo sapiens
gtgtggtagagtgtgc

SEQ ID NO: 4344577 - DNA, 12 bp, Homo sapiens
gtgtgtatttgt

SEQ ID NO: 4344578 - DNA, 21 bp, Homo sapiens
gtgtgtatttgtattaataaa

SEQ ID NO: 4344579 - DNA, 20 bp, Homo sapiens
gtgttataatgggtaatata

SEQ ID NO: 4344580 - DNA, 15 bp, Homo sapiens
gtgttcagtgttgac

SEQ ID NO: 4344581 - DNA, 22 bp, Homo sapiens
gtgttcagtgttgacatagcct

SEQ ID NO: 4344582 - DNA, 13 bp, Homo sapiens
gtgttgacatagc

SEQ ID NO: 4344583 - DNA, 12 bp, Homo sapiens
gtgtttgaaaac

SEQ ID NO: 4344584 - DNA, 15 bp, Homo sapiens
gtgtttgaaaactga

SEQ ID NO: 4344585 - DNA, 13 bp, Homo sapiens
gtgtttttctcca

SEQ ID NO: 4344586 - DNA, 14 bp, Homo sapiens
gtgtttttctccag

SEQ ID NO: 4344587 - DNA, 21 bp, Homo sapiens
gttaaaatcacattttaagtg

SEQ ID NO: 4344588 - DNA, 14 bp, Homo sapiens
gttaaaatgtgatt

SEQ ID NO: 4344589 - DNA, 20 bp, Homo sapiens
gttaaagcttatttttatgt

SEQ ID NO: 4344590 - DNA, 14 bp, Homo sapiens
gttaaataaataga

SEQ ID NO: 4344591 - DNA, 18 bp, Homo sapiens
gttaaataaatagaaaga

SEQ ID NO: 4344592 - DNA, 17 bp, Homo sapiens
gttaaccacccgccccg

SEQ ID NO: 4344593 - DNA, 21 bp, Homo sapiens
gttaagcctgtaattatgtaa

SEQ ID NO: 4344594 - DNA, 16 bp, Homo sapiens
gttaagtgtcatttct

SEQ ID NO: 4344595 - DNA, 20 bp, Homo sapiens
gttaccaagtatgaagtata

SEQ ID NO: 4344596 - DNA, 20 bp, Homo sapiens
gttactgcttctctttgtgc

SEQ ID NO: 4344597 - DNA, 23 bp, Homo sapiens
gttactgcttctctttgtgcagt

SEQ ID NO: 4344598 - DNA, 18 bp, Homo sapiens
gttagcccaatggagaaa

SEQ ID NO: 4344599 - DNA, 11 bp, Homo sapiens
gttagctggag

SEQ ID NO: 4344600 - DNA, 23 bp, Homo sapiens
gttagttataaaactatgtgttc

SEQ ID NO: 4344601 - DNA, 18 bp, Homo sapiens
gttatttgtataaattaa

SEQ ID NO: 4344602 - DNA, 15 bp, Homo sapiens
gttcaacttccagaa

SEQ ID NO: 4344603 - DNA, 19 bp, Homo sapiens
gttcaagcttttcctttct

SEQ ID NO: 4344604 - DNA, 14 bp, Homo sapiens
gttcagtgttgaca

SEQ ID NO: 4344605 - DNA, 19 bp, Homo sapiens
gttcagtgttgacatagcc

SEQ ID NO: 4344606 - DNA, 23 bp, Homo sapiens
gttcagtgttgacatagcctttg

SEQ ID NO: 4344607 - DNA, 19 bp, Homo sapiens
gttcattctgcattgagaa

SEQ ID NO: 4344608 - DNA, 23 bp, Homo sapiens
gttcattctgcattgagaaggaa

SEQ ID NO: 4344609 - DNA, 19 bp, Homo sapiens
gttccaaatgaatgttgtc

SEQ ID NO: 4344610 - DNA, 14 bp, Homo sapiens
gttccattcttggt

SEQ ID NO: 4344611 - DNA, 16 bp, Homo sapiens
gttccccccatagaga

SEQ ID NO: 4344612 - DNA, 12 bp, Homo sapiens
gttccctctgcc

SEQ ID NO: 4344613 - DNA, 13 bp, Homo sapiens
gttccctctgcct

SEQ ID NO: 4344614 - DNA, 15 bp, Homo sapiens
gttccctctgcctgg

SEQ ID NO: 4344615 - DNA, 16 bp, Homo sapiens
gttccctctgcctggg

SEQ ID NO: 4344616 - DNA, 22 bp, Homo sapiens
gttcctcattagcattttgcta

SEQ ID NO: 4344617 - DNA, 15 bp, Homo sapiens
gttcgggattccctg

SEQ ID NO: 4344618 - DNA, 18 bp, Homo sapiens
gttcgggattccctggtg

SEQ ID NO: 4344619 - DNA, 16 bp, Homo sapiens
gttctaaattctataa

SEQ ID NO: 4344620 - DNA, 20 bp, Homo sapiens
gttctaaattctataaaaac

SEQ ID NO: 4344621 - DNA, 14 bp, Homo sapiens
gttctatccaaaca

SEQ ID NO: 4344622 - DNA, 17 bp, Homo sapiens
gttctcagctccccctg

SEQ ID NO: 4344623 - DNA, 19 bp, Homo sapiens
gttctcagctccccctgtc

SEQ ID NO: 4344624 - DNA, 21 bp, Homo sapiens
gttcttacaagcttaaagctt

SEQ ID NO: 4344625 - DNA, 16 bp, Homo sapiens
gttgacatagcctttg

SEQ ID NO: 4344626 - DNA, 14 bp, Homo sapiens
gttgacccctttcc

SEQ ID NO: 4344627 - DNA, 16 bp, Homo sapiens
gttgacccctttcccc

SEQ ID NO: 4344628 - DNA, 16 bp, Homo sapiens
gttgatcccctctctg

SEQ ID NO: 4344629 - DNA, 13 bp, Homo sapiens
gttgcagaaaatg

SEQ ID NO: 4344630 - DNA, 20 bp, Homo sapiens
gttgcagcacattcacactg

SEQ ID NO: 4344631 - DNA, 16 bp, Homo sapiens
gttgccacaggcctcc

SEQ ID NO: 4344632 - DNA, 17 bp, Homo sapiens
gttgccacaggcctccc

SEQ ID NO: 4344633 - DNA, 20 bp, Homo sapiens
gttgcccgccctccacccac

SEQ ID NO: 4344634 - DNA, 11 bp, Homo sapiens
gttggaaaatt

SEQ ID NO: 4344635 - DNA, 18 bp, Homo sapiens
gttgtacaagctcaggag

SEQ ID NO: 4344636 - DNA, 16 bp, Homo sapiens
gttgtagtcaagaggt

SEQ ID NO: 4344637 - DNA, 12 bp, Homo sapiens
gttgtcagctga

SEQ ID NO: 4344638 - DNA, 17 bp, Homo sapiens
gttgtcattgtccagct

SEQ ID NO: 4344639 - DNA, 22 bp, Homo sapiens
gttgtctgaattgagaaaagag

SEQ ID NO: 4344640 - DNA, 12 bp, Homo sapiens
gttgtctgtgct

SEQ ID NO: 4344641 - DNA, 20 bp, Homo sapiens
gttgtgcctggttcgtgcca

SEQ ID NO: 4344642 - DNA, 22 bp, Homo sapiens
gttgtgctatatttttaaagaa

SEQ ID NO: 4344643 - DNA, 16 bp, Homo sapiens
gttgtgggtgggagag

SEQ ID NO: 4344644 - DNA, 19 bp, Homo sapiens
gttgttatcatttaagatt

SEQ ID NO: 4344645 - DNA, 14 bp, Homo sapiens
gttgtttctataaa

SEQ ID NO: 4344646 - DNA, 19 bp, Homo sapiens
gttgtttctataaatgact

SEQ ID NO: 4344647 - DNA, 15 bp, Homo sapiens
gtttaaatgccaaaa

SEQ ID NO: 4344648 - DNA, 18 bp, Homo sapiens
gtttacaatgatgccgaa

SEQ ID NO: 4344649 - DNA, 18 bp, Homo sapiens
gtttacagggagcctcct

SEQ ID NO: 4344650 - DNA, 23 bp, Homo sapiens
gtttacagggagcctcctgccca

SEQ ID NO: 4344651 - DNA, 16 bp, Homo sapiens
gtttaccttcagccat

SEQ ID NO: 4344652 - DNA, 17 bp, Homo sapiens
gtttactcccttctgta

SEQ ID NO: 4344653 - DNA, 16 bp, Homo sapiens
gtttatacacaacttt

SEQ ID NO: 4344654 - DNA, 18 bp, Homo sapiens
gtttatacacaactttgc

SEQ ID NO: 4344655 - DNA, 23 bp, Homo sapiens
gtttatatattgaaagttgcttt

SEQ ID NO: 4344656 - DNA, 21 bp, Homo sapiens
gtttatctatcggaagaacat

SEQ ID NO: 4344657 - DNA, 11 bp, Homo sapiens
gtttatgtgtg

SEQ ID NO: 4344658 - DNA, 21 bp, Homo sapiens
gtttattgagtttgtaggtaa

SEQ ID NO: 4344659 - DNA, 16 bp, Homo sapiens
gtttattttctgtgta

SEQ ID NO: 4344660 - DNA, 20 bp, Homo sapiens
gtttattttctgtgtaaaat

SEQ ID NO: 4344661 - DNA, 19 bp, Homo sapiens
gtttcatgtatgtatataa

SEQ ID NO: 4344662 - DNA, 15 bp, Homo sapiens
gtttccaagaaattt

SEQ ID NO: 4344663 - DNA, 11 bp, Homo sapiens
gtttcccaagc

SEQ ID NO: 4344664 - DNA, 17 bp, Homo sapiens
gtttccctggtgccctt

SEQ ID NO: 4344665 - DNA, 18 bp, Homo sapiens
gtttcctaactgtgattt

SEQ ID NO: 4344666 - DNA, 14 bp, Homo sapiens
gtttctcattaaac

SEQ ID NO: 4344667 - DNA, 22 bp, Homo sapiens
gtttctgatctgtactttgtgt

SEQ ID NO: 4344668 - DNA, 13 bp, Homo sapiens
gtttctgcccagc

SEQ ID NO: 4344669 - DNA, 19 bp, Homo sapiens
gtttctttctgtctctctc

SEQ ID NO: 4344670 - DNA, 14 bp, Homo sapiens
gtttcttttggaaa

SEQ ID NO: 4344671 - DNA, 12 bp, Homo sapiens
gtttgaacttca

SEQ ID NO: 4344672 - DNA, 15 bp, Homo sapiens
gtttgaagcctgccc

SEQ ID NO: 4344673 - DNA, 21 bp, Homo sapiens
gtttgaagcctgcccttgtct

SEQ ID NO: 4344674 - DNA, 13 bp, Homo sapiens
gtttgagacagac

SEQ ID NO: 4344675 - DNA, 17 bp, Homo sapiens
gtttgagatcagcctgg

SEQ ID NO: 4344676 - DNA, 22 bp, Homo sapiens
gtttgcatccacttcaggagcc

SEQ ID NO: 4344677 - DNA, 13 bp, Homo sapiens
gtttggaaaataa

SEQ ID NO: 4344678 - DNA, 21 bp, Homo sapiens
gtttgtagtttttgctgaagg

SEQ ID NO: 4344679 - DNA, 13 bp, Homo sapiens
gtttgtccttgca

SEQ ID NO: 4344680 - DNA, 20 bp, Homo sapiens
gtttgtccttgcacctgagc

SEQ ID NO: 4344681 - DNA, 22 bp, Homo sapiens
gtttgtccttgcacctgagcct

SEQ ID NO: 4344682 - DNA, 14 bp, Homo sapiens
gtttgtttctttgt

SEQ ID NO: 4344683 - DNA, 15 bp, Homo sapiens
gttttactgcagctt

SEQ ID NO: 4344684 - DNA, 16 bp, Homo sapiens
gttttactgcagcttt

SEQ ID NO: 4344685 - DNA, 18 bp, Homo sapiens
gttttactgcagctttgt

SEQ ID NO: 4344686 - DNA, 13 bp, Homo sapiens
gttttatttacat

SEQ ID NO: 4344687 - DNA, 20 bp, Homo sapiens
gttttccaggtttaagctgt

SEQ ID NO: 4344688 - DNA, 18 bp, Homo sapiens
gtttttattgcatttgct

SEQ ID NO: 4344689 - DNA, 22 bp, Homo sapiens
gtttttattgcatttgctgttg

SEQ ID NO: 4344690 - DNA, 23 bp, Homo sapiens
gttttttactttggtttagtctt

SEQ ID NO: 4344691 - DNA, 23 bp, Homo sapiens
taaaaaactgctgactgttttct

SEQ ID NO: 4344692 - DNA, 14 bp, Homo sapiens
taaaaaatatatat

SEQ ID NO: 4344693 - DNA, 19 bp, Homo sapiens
taaaaaccacccacaaaga

SEQ ID NO: 4344694 - DNA, 21 bp, Homo sapiens
taaaaaccacccacaaagaaa

SEQ ID NO: 4344695 - DNA, 20 bp, Homo sapiens
taaaaagccctatgtgaaaa

SEQ ID NO: 4344696 - DNA, 19 bp, Homo sapiens
taaaaagggtaacttgttt

SEQ ID NO: 4344697 - DNA, 15 bp, Homo sapiens
taaaaatagaatcca

SEQ ID NO: 4344698 - DNA, 17 bp, Homo sapiens
taaaaatgttcttacac

SEQ ID NO: 4344699 - DNA, 13 bp, Homo sapiens
taaaactatgtgt

SEQ ID NO: 4344700 - DNA, 23 bp, Homo sapiens
taaaactctccttttccttacca

SEQ ID NO: 4344701 - DNA, 18 bp, Homo sapiens
taaaaggatagtattttt

SEQ ID NO: 4344702 - DNA, 16 bp, Homo sapiens
taaaagtactgaagac

SEQ ID NO: 4344703 - DNA, 17 bp, Homo sapiens
taaaagtcattattcct

SEQ ID NO: 4344704 - DNA, 18 bp, Homo sapiens
taaaagtggcatagagaa

SEQ ID NO: 4344705 - DNA, 19 bp, Homo sapiens
taaaagtggcatagagaat

SEQ ID NO: 4344706 - DNA, 13 bp, Homo sapiens
taaaatgactttt

SEQ ID NO: 4344707 - DNA, 23 bp, Homo sapiens
taaaatggacattttcttttatt

SEQ ID NO: 4344708 - DNA, 12 bp, Homo sapiens
taaaatgtgatt

SEQ ID NO: 4344709 - DNA, 21 bp, Homo sapiens
taaaatgtgatttttcttcag

SEQ ID NO: 4344710 - DNA, 13 bp, Homo sapiens
taaaattgaaaac

SEQ ID NO: 4344711 - DNA, 19 bp, Homo sapiens
taaaattgcagtttcatgt

SEQ ID NO: 4344712 - DNA, 20 bp, Homo sapiens
taaaattgcagtttcatgta

SEQ ID NO: 4344713 - DNA, 23 bp, Homo sapiens
taaaattgcagtttcatgtatgt

SEQ ID NO: 4344714 - DNA, 15 bp, Homo sapiens
taaaatttatttcat

SEQ ID NO: 4344715 - DNA, 18 bp, Homo sapiens
taaacaaaatttcacagt

SEQ ID NO: 4344716 - DNA, 23 bp, Homo sapiens
taaacaatgatgccctgctccag

SEQ ID NO: 4344717 - DNA, 17 bp, Homo sapiens
taaacacataaatgaaa

SEQ ID NO: 4344718 - DNA, 15 bp, Homo sapiens
taaactctgccagaa

SEQ ID NO: 4344719 - DNA, 14 bp, Homo sapiens
taaactgttttcaa

SEQ ID NO: 4344720 - DNA, 20 bp, Homo sapiens
taaactttgaataaaagaat

SEQ ID NO: 4344721 - DNA, 11 bp, Homo sapiens
taaagaaaatt

SEQ ID NO: 4344722 - DNA, 15 bp, Homo sapiens
taaagaaactgctta

SEQ ID NO: 4344723 - DNA, 15 bp, Homo sapiens
taaagaaacttttga

SEQ ID NO: 4344724 - DNA, 16 bp, Homo sapiens
taaagaaacttttgaa

SEQ ID NO: 4344725 - DNA, 18 bp, Homo sapiens
taaagaaacttttgaaaa

SEQ ID NO: 4344726 - DNA, 18 bp, Homo sapiens
taaagaaagaatgcattc

SEQ ID NO: 4344727 - DNA, 21 bp, Homo sapiens
taaagattatagctcccaaaa

SEQ ID NO: 4344728 - DNA, 15 bp, Homo sapiens
taaagcattctttaa

SEQ ID NO: 4344729 - DNA, 14 bp, Homo sapiens
taaagccttaagca

SEQ ID NO: 4344730 - DNA, 15 bp, Homo sapiens
taaagccttaagcac

SEQ ID NO: 4344731 - DNA, 16 bp, Homo sapiens
taaagcttatttttat

SEQ ID NO: 4344732 - DNA, 13 bp, Homo sapiens
taaagcttgattt

SEQ ID NO: 4344733 - DNA, 23 bp, Homo sapiens
taaagcttgatttgatctttgtt

SEQ ID NO: 4344734 - DNA, 15 bp, Homo sapiens
taaaggcaaggaaat

SEQ ID NO: 4344735 - DNA, 17 bp, Homo sapiens
taaagggagaaatgcca

SEQ ID NO: 4344736 - DNA, 16 bp, Homo sapiens
taaagtaaacttgtgt

SEQ ID NO: 4344737 - DNA, 18 bp, Homo sapiens
taaagtatagagagaagt

SEQ ID NO: 4344738 - DNA, 19 bp, Homo sapiens
taaagtatagagagaagtt

SEQ ID NO: 4344739 - DNA, 20 bp, Homo sapiens
taaagtatagagagaagttc

SEQ ID NO: 4344740 - DNA, 11 bp, Homo sapiens
taaatatatat

SEQ ID NO: 4344741 - DNA, 22 bp, Homo sapiens
taaatatgaaccctttgtttct

SEQ ID NO: 4344742 - DNA, 23 bp, Homo sapiens
taaatattaaagctccattggga

SEQ ID NO: 4344743 - DNA, 17 bp, Homo sapiens
taaatatttgtaattgt

SEQ ID NO: 4344744 - DNA, 11 bp, Homo sapiens
taaatcaaaaa

SEQ ID NO: 4344745 - DNA, 15 bp, Homo sapiens
taaatcaaaaacttt

SEQ ID NO: 4344746 - DNA, 16 bp, Homo sapiens
taaatcaaaaactttt

SEQ ID NO: 4344747 - DNA, 17 bp, Homo sapiens
taaatcaaaaacttttc

SEQ ID NO: 4344748 - DNA, 22 bp, Homo sapiens
taaatcaaaaacttttcatttc

SEQ ID NO: 4344749 - DNA, 15 bp, Homo sapiens
taaatcatttggtta

SEQ ID NO: 4344750 - DNA, 15 bp, Homo sapiens
taaatcgatccatgt

SEQ ID NO: 4344751 - DNA, 17 bp, Homo sapiens
taaatcgatccatgttt

SEQ ID NO: 4344752 - DNA, 20 bp, Homo sapiens
taaatcgatccatgttttgt

SEQ ID NO: 4344753 - DNA, 22 bp, Homo sapiens
taaatctggggaagaggtttta

SEQ ID NO: 4344754 - DNA, 15 bp, Homo sapiens
taaatgaaagaaacc

SEQ ID NO: 4344755 - DNA, 16 bp, Homo sapiens
taaatgaactactgct

SEQ ID NO: 4344756 - DNA, 15 bp, Homo sapiens
taaatgaatattttg

SEQ ID NO: 4344757 - DNA, 18 bp, Homo sapiens
taaatgactattgtaatg

SEQ ID NO: 4344758 - DNA, 20 bp, Homo sapiens
taaatgagggtttctgatct

SEQ ID NO: 4344759 - DNA, 19 bp, Homo sapiens
taaatgccaaaatgtactt

SEQ ID NO: 4344760 - DNA, 16 bp, Homo sapiens
taaatgctcatacaca

SEQ ID NO: 4344761 - DNA, 21 bp, Homo sapiens
taaatggtttctcattaaact

SEQ ID NO: 4344762 - DNA, 16 bp, Homo sapiens
taaattaaataaactg

SEQ ID NO: 4344763 - DNA, 19 bp, Homo sapiens
taaattaaataaactgttt

SEQ ID NO: 4344764 - DNA, 21 bp, Homo sapiens
taaattaaataaactgttttc

SEQ ID NO: 4344765 - DNA, 15 bp, Homo sapiens
taaattctataaaaa

SEQ ID NO: 4344766 - DNA, 21 bp, Homo sapiens
taacaaagcaacctttccctt

SEQ ID NO: 4344767 - DNA, 14 bp, Homo sapiens
taacactacagagt

SEQ ID NO: 4344768 - DNA, 21 bp, Homo sapiens
taacactttaaaaccagttac

SEQ ID NO: 4344769 - DNA, 13 bp, Homo sapiens
taacagagaaata

SEQ ID NO: 4344770 - DNA, 20 bp, Homo sapiens
taaccaaagcaattaaatga

SEQ ID NO: 4344771 - DNA, 22 bp, Homo sapiens
taaccacccgccccgccccctc

SEQ ID NO: 4344772 - DNA, 16 bp, Homo sapiens
taaccacttcagctga

SEQ ID NO: 4344773 - DNA, 18 bp, Homo sapiens
taaccattgtcttgttct

SEQ ID NO: 4344774 - DNA, 19 bp, Homo sapiens
taaccattgtcttgttctg

SEQ ID NO: 4344775 - DNA, 23 bp, Homo sapiens
taaccattgtcttgttctgtgat

SEQ ID NO: 4344776 - DNA, 16 bp, Homo sapiens
taactaaatgctcata

SEQ ID NO: 4344777 - DNA, 19 bp, Homo sapiens
taactactgacgaaagagt

SEQ ID NO: 4344778 - DNA, 19 bp, Homo sapiens
taactgaataaaaaataaa

SEQ ID NO: 4344779 - DNA, 16 bp, Homo sapiens
taactgactctgttat

SEQ ID NO: 4344780 - DNA, 20 bp, Homo sapiens
taactgttcctactttgtat

SEQ ID NO: 4344781 - DNA, 17 bp, Homo sapiens
taacttacatgactttc

SEQ ID NO: 4344782 - DNA, 16 bp, Homo sapiens
taacttgtttttattg

SEQ ID NO: 4344783 - DNA, 19 bp, Homo sapiens
taacttgtttttattgcat

SEQ ID NO: 4344784 - DNA, 22 bp, Homo sapiens
taacttgtttttattgcatttg

SEQ ID NO: 4344785 - DNA, 18 bp, Homo sapiens
taagaaatgggactctga

SEQ ID NO: 4344786 - DNA, 15 bp, Homo sapiens
taagaatgagcctgt

SEQ ID NO: 4344787 - DNA, 20 bp, Homo sapiens
taagaatttgaggtctacat

SEQ ID NO: 4344788 - DNA, 17 bp, Homo sapiens
taagacttgtttctttc

SEQ ID NO: 4344789 - DNA, 14 bp, Homo sapiens
taagcacaattaat

SEQ ID NO: 4344790 - DNA, 15 bp, Homo sapiens
taagctaaagaaact

SEQ ID NO: 4344791 - DNA, 16 bp, Homo sapiens
taagctaaagaaactg

SEQ ID NO: 4344792 - DNA, 13 bp, Homo sapiens
taaggaagacaat

SEQ ID NO: 4344793 - DNA, 20 bp, Homo sapiens
taaggatcaccccagccccc

SEQ ID NO: 4344794 - DNA, 17 bp, Homo sapiens
taagggtggaaaaatgc

SEQ ID NO: 4344795 - DNA, 16 bp, Homo sapiens
taagtaatatttaaag

SEQ ID NO: 4344796 - DNA, 12 bp, Homo sapiens
taagtaattatg

SEQ ID NO: 4344797 - DNA, 14 bp, Homo sapiens
taagtacccttggg

SEQ ID NO: 4344798 - DNA, 15 bp, Homo sapiens
taagtctacattaaa

SEQ ID NO: 4344799 - DNA, 10 bp, Homo sapiens
taagtgacat

SEQ ID NO: 4344800 - DNA, 14 bp, Homo sapiens
taagtgttcagtgt

SEQ ID NO: 4344801 - DNA, 19 bp, Homo sapiens
taagtgttcagtgttgaca

SEQ ID NO: 4344802 - DNA, 22 bp, Homo sapiens
taataaactttgaataaaagaa

SEQ ID NO: 4344803 - DNA, 12 bp, Homo sapiens
taataaagcatt

SEQ ID NO: 4344804 - DNA, 20 bp, Homo sapiens
taatattaaggaagacaatg

SEQ ID NO: 4344805 - DNA, 19 bp, Homo sapiens
taatattgtttttctttct

SEQ ID NO: 4344806 - DNA, 20 bp, Homo sapiens
taatcagcaatattgcctgt

SEQ ID NO: 4344807 - DNA, 15 bp, Homo sapiens
taatcatgctcatgt

SEQ ID NO: 4344808 - DNA, 19 bp, Homo sapiens
taatcatgctcatgtatat

SEQ ID NO: 4344809 - DNA, 21 bp, Homo sapiens
taatcatgctcatgtatattt

SEQ ID NO: 4344810 - DNA, 14 bp, Homo sapiens
taatctactttttg

SEQ ID NO: 4344811 - DNA, 17 bp, Homo sapiens
taatctactttttgtat

SEQ ID NO: 4344812 - DNA, 21 bp, Homo sapiens
taatctactttttgtatttag

SEQ ID NO: 4344813 - DNA, 14 bp, Homo sapiens
taatctatattaaa

SEQ ID NO: 4344814 - DNA, 16 bp, Homo sapiens
taatctatattaaatg

SEQ ID NO: 4344815 - DNA, 17 bp, Homo sapiens
taatctatattaaatga

SEQ ID NO: 4344816 - DNA, 17 bp, Homo sapiens
taatctcctctgctcat

SEQ ID NO: 4344817 - DNA, 21 bp, Homo sapiens
taatctcctctgctcattaaa

SEQ ID NO: 4344818 - DNA, 11 bp, Homo sapiens
taatctgcctg

SEQ ID NO: 4344819 - DNA, 12 bp, Homo sapiens
taatctgcctgg

SEQ ID NO: 4344820 - DNA, 16 bp, Homo sapiens
taatctgcctggtttt

SEQ ID NO: 4344821 - DNA, 19 bp, Homo sapiens
taatgaaaacctttactag

SEQ ID NO: 4344822 - DNA, 17 bp, Homo sapiens
taatgagttgctggaaa

SEQ ID NO: 4344823 - DNA, 19 bp, Homo sapiens
taatgagttgctggaaaat

SEQ ID NO: 4344824 - DNA, 21 bp, Homo sapiens
taatgagttgctggaaaatca

SEQ ID NO: 4344825 - DNA, 22 bp, Homo sapiens
taatgagttgctggaaaatcat

SEQ ID NO: 4344826 - DNA, 23 bp, Homo sapiens
taatgagttgctggaaaatcata

SEQ ID NO: 4344827 - DNA, 16 bp, Homo sapiens
taatgccctatgtgta

SEQ ID NO: 4344828 - DNA, 22 bp, Homo sapiens
taatggagtgtttgaaaactga

SEQ ID NO: 4344829 - DNA, 17 bp, Homo sapiens
taatgtagggttatatt

SEQ ID NO: 4344830 - DNA, 23 bp, Homo sapiens
taatgtctgtcagaagacactaa

SEQ ID NO: 4344831 - DNA, 13 bp, Homo sapiens
taatgtgtctgtg

SEQ ID NO: 4344832 - DNA, 23 bp, Homo sapiens
taattaaagccttaagcacaatt

SEQ ID NO: 4344833 - DNA, 19 bp, Homo sapiens
taattactacattagggaa

SEQ ID NO: 4344834 - DNA, 23 bp, Homo sapiens
taattagttcctcattagcattt

SEQ ID NO: 4344835 - DNA, 20 bp, Homo sapiens
taattatgtaacctatttat

SEQ ID NO: 4344836 - DNA, 13 bp, Homo sapiens
taattcctacagc

SEQ ID NO: 4344837 - DNA, 21 bp, Homo sapiens
taattgatcagatgctgaatt

SEQ ID NO: 4344838 - DNA, 14 bp, Homo sapiens
taatttagagcgtt

SEQ ID NO: 4344839 - DNA, 16 bp, Homo sapiens
taatttctaggcaggt

SEQ ID NO: 4344840 - DNA, 13 bp, Homo sapiens
tacaaaactgctt

SEQ ID NO: 4344841 - DNA, 19 bp, Homo sapiens
tacaaaactgctttgtgca

SEQ ID NO: 4344842 - DNA, 23 bp, Homo sapiens
tacaaagcactagagaatgcaca

SEQ ID NO: 4344843 - DNA, 16 bp, Homo sapiens
tacaaagcgtgcacaa

SEQ ID NO: 4344844 - DNA, 17 bp, Homo sapiens
tacaagcagttaatcac

SEQ ID NO: 4344845 - DNA, 16 bp, Homo sapiens
tacaagcttaaagctt

SEQ ID NO: 4344846 - DNA, 20 bp, Homo sapiens
tacaagcttaaagcttgatt

SEQ ID NO: 4344847 - DNA, 13 bp, Homo sapiens
tacaatgtgtttt

SEQ ID NO: 4344848 - DNA, 22 bp, Homo sapiens
tacaatttgttcttgtatttta

SEQ ID NO: 4344849 - DNA, 18 bp, Homo sapiens
tacacaactttgcaaatt

SEQ ID NO: 4344850 - DNA, 15 bp, Homo sapiens
tacacacatacatac

SEQ ID NO: 4344851 - DNA, 17 bp, Homo sapiens
tacacagttaaataaat

SEQ ID NO: 4344852 - DNA, 18 bp, Homo sapiens
tacacatataaaaacaat

SEQ ID NO: 4344853 - DNA, 17 bp, Homo sapiens
tacacgtgcgtgtgagt

SEQ ID NO: 4344854 - DNA, 13 bp, Homo sapiens
tacagaaatgttt

SEQ ID NO: 4344855 - DNA, 21 bp, Homo sapiens
tacagaaatgtttttaacact

SEQ ID NO: 4344856 - DNA, 20 bp, Homo sapiens
tacagatggagcaaatgtcc

SEQ ID NO: 4344857 - DNA, 19 bp, Homo sapiens
tacagcactactgggtgtc

SEQ ID NO: 4344858 - DNA, 14 bp, Homo sapiens
tacaggacttctct

SEQ ID NO: 4344859 - DNA, 13 bp, Homo sapiens
tacagggagcctc

SEQ ID NO: 4344860 - DNA, 16 bp, Homo sapiens
tacagtcaggacacat

SEQ ID NO: 4344861 - DNA, 16 bp, Homo sapiens
tacagtcccagcacat

SEQ ID NO: 4344862 - DNA, 19 bp, Homo sapiens
tacagttgaaaaacagctg

SEQ ID NO: 4344863 - DNA, 17 bp, Homo sapiens
tacagtttattttctgt

SEQ ID NO: 4344864 - DNA, 16 bp, Homo sapiens
tacatacaaatatatg

SEQ ID NO: 4344865 - DNA, 13 bp, Homo sapiens
tacatacatacat

SEQ ID NO: 4344866 - DNA, 20 bp, Homo sapiens
tacatctgatgcatgctttg

SEQ ID NO: 4344867 - DNA, 23 bp, Homo sapiens
tacattagggaagctactgtcta

SEQ ID NO: 4344868 - DNA, 15 bp, Homo sapiens
tacattcttaaacta

SEQ ID NO: 4344869 - DNA, 17 bp, Homo sapiens
taccaagtatgaagtat

SEQ ID NO: 4344870 - DNA, 21 bp, Homo sapiens
taccaagtatgaagtataaat

SEQ ID NO: 4344871 - DNA, 16 bp, Homo sapiens
taccatagagtaatga

SEQ ID NO: 4344872 - DNA, 16 bp, Homo sapiens
taccatgtgtgctaat

SEQ ID NO: 4344873 - DNA, 19 bp, Homo sapiens
taccccacctgacctctgc

SEQ ID NO: 4344874 - DNA, 18 bp, Homo sapiens
taccctcctgcactgttt

SEQ ID NO: 4344875 - DNA, 14 bp, Homo sapiens
taccctctctttca

SEQ ID NO: 4344876 - DNA, 21 bp, Homo sapiens
tacccttttcctttgtggttt

SEQ ID NO: 4344877 - DNA, 22 bp, Homo sapiens
tacctcccctccccgccccctg

SEQ ID NO: 4344878 - DNA, 22 bp, Homo sapiens
taccttcagccatagcttgatt

SEQ ID NO: 4344879 - DNA, 22 bp, Homo sapiens
taccttctcccaggcctctgcc

SEQ ID NO: 4344880 - DNA, 18 bp, Homo sapiens
tacctttttatatttaaa

SEQ ID NO: 4344881 - DNA, 15 bp, Homo sapiens
tacgtacatacacac

SEQ ID NO: 4344882 - DNA, 12 bp, Homo sapiens
tacgtgcattta

SEQ ID NO: 4344883 - DNA, 18 bp, Homo sapiens
tacgtgcatttaaactct

SEQ ID NO: 4344884 - DNA, 20 bp, Homo sapiens
tactaaaagttcttctccaa

SEQ ID NO: 4344885 - DNA, 18 bp, Homo sapiens
tactcacctctctctaag

SEQ ID NO: 4344886 - DNA, 21 bp, Homo sapiens
tactccataaaaggtgtgttg

SEQ ID NO: 4344887 - DNA, 15 bp, Homo sapiens
tactcccttctgtag

SEQ ID NO: 4344888 - DNA, 21 bp, Homo sapiens
tactctaaaatggacattttc

SEQ ID NO: 4344889 - DNA, 22 bp, Homo sapiens
tactctaaaatggacattttct

SEQ ID NO: 4344890 - DNA, 16 bp, Homo sapiens
tactctaccctcttag

SEQ ID NO: 4344891 - DNA, 21 bp, Homo sapiens
tactcttaaatcatttggtta

SEQ ID NO: 4344892 - DNA, 22 bp, Homo sapiens
tactgatttagaagcaaagatt

SEQ ID NO: 4344893 - DNA, 22 bp, Homo sapiens
tactgcattgccgacagcacag

SEQ ID NO: 4344894 - DNA, 14 bp, Homo sapiens
tactgctatttttt

SEQ ID NO: 4344895 - DNA, 23 bp, Homo sapiens
tactgctattttttttaaatcaa

SEQ ID NO: 4344896 - DNA, 14 bp, Homo sapiens
tactgcttctcttt

SEQ ID NO: 4344897 - DNA, 15 bp, Homo sapiens
tactgggtgtcattt

SEQ ID NO: 4344898 - DNA, 21 bp, Homo sapiens
tactgtttaccatttttcatt

SEQ ID NO: 4344899 - DNA, 14 bp, Homo sapiens
tacttacggtttta

SEQ ID NO: 4344900 - DNA, 18 bp, Homo sapiens
tacttctgagccccagcc

SEQ ID NO: 4344901 - DNA, 17 bp, Homo sapiens
tactttttgtatttagt

SEQ ID NO: 4344902 - DNA, 23 bp, Homo sapiens
tactttttttgttatagattgtc

SEQ ID NO: 4344903 - DNA, 15 bp, Homo sapiens
tagaaaatcttagta

SEQ ID NO: 4344904 - DNA, 15 bp, Homo sapiens
tagaaacatacacaa

SEQ ID NO: 4344905 - DNA, 19 bp, Homo sapiens
tagaaagacatctgcctgt

SEQ ID NO: 4344906 - DNA, 23 bp, Homo sapiens
tagaaagacatctgcctgtaatt

SEQ ID NO: 4344907 - DNA, 12 bp, Homo sapiens
tagaaagacatg

SEQ ID NO: 4344908 - DNA, 17 bp, Homo sapiens
tagaaagacatgggcta

SEQ ID NO: 4344909 - DNA, 16 bp, Homo sapiens
tagaaagagttctatg

SEQ ID NO: 4344910 - DNA, 17 bp, Homo sapiens
tagaacatgcaagaatt

SEQ ID NO: 4344911 - DNA, 11 bp, Homo sapiens
tagaagaagag

SEQ ID NO: 4344912 - DNA, 17 bp, Homo sapiens
tagaagcacggctgtgg

SEQ ID NO: 4344913 - DNA, 17 bp, Homo sapiens
tagaatatactgtcttg

SEQ ID NO: 4344914 - DNA, 16 bp, Homo sapiens
tagaatgatcatctgt

SEQ ID NO: 4344915 - DNA, 20 bp, Homo sapiens
tagaatgatcatctgtaatc

SEQ ID NO: 4344916 - DNA, 16 bp, Homo sapiens
tagacactttacctct

SEQ ID NO: 4344917 - DNA, 23 bp, Homo sapiens
tagaccgctctcttttctgtact

SEQ ID NO: 4344918 - DNA, 15 bp, Homo sapiens
tagactctgacttcc

SEQ ID NO: 4344919 - DNA, 24 bp, Homo sapiens
tagactgtgtctgaatcatgtctg

SEQ ID NO: 4344920 - DNA, 14 bp, Homo sapiens
tagagacagtatgt

SEQ ID NO: 4344921 - DNA, 19 bp, Homo sapiens
tagagaccaggagggagag

SEQ ID NO: 4344922 - DNA, 15 bp, Homo sapiens
tagagaggagaaagg

SEQ ID NO: 4344923 - DNA, 14 bp, Homo sapiens
tagaggaaaatcaa

SEQ ID NO: 4344924 - DNA, 15 bp, Homo sapiens
tagaggaaaatcaat

SEQ ID NO: 4344925 - DNA, 14 bp, Homo sapiens
tagagtaatgatgt

SEQ ID NO: 4344926 - DNA, 13 bp, Homo sapiens
tagataccgagaa

SEQ ID NO: 4344927 - DNA, 15 bp, Homo sapiens
tagcatggggcccct

SEQ ID NO: 4344928 - DNA, 21 bp, Homo sapiens
tagcatggggcccctggccca

SEQ ID NO: 4344929 - DNA, 22 bp, Homo sapiens
tagcatttatttctctggcaaa

SEQ ID NO: 4344930 - DNA, 22 bp, Homo sapiens
tagccactagtaagtaattatg

SEQ ID NO: 4344931 - DNA, 17 bp, Homo sapiens
tagccacttagacactt

SEQ ID NO: 4344932 - DNA, 19 bp, Homo sapiens
tagcccaatggagaaatga

SEQ ID NO: 4344933 - DNA, 21 bp, Homo sapiens
tagcccaatggagaaatgaag

SEQ ID NO: 4344934 - DNA, 22 bp, Homo sapiens
tagcccaatggagaaatgaagc

SEQ ID NO: 4344935 - DNA, 20 bp, Homo sapiens
tagccctctccaaatcaagg

SEQ ID NO: 4344936 - DNA, 20 bp, Homo sapiens
tagcccttctaccccacctg

SEQ ID NO: 4344937 - DNA, 22 bp, Homo sapiens
tagcccttctaccccacctgac

SEQ ID NO: 4344938 - DNA, 17 bp, Homo sapiens
tagcctgcctcttctct

SEQ ID NO: 4344939 - DNA, 20 bp, Homo sapiens
tagccttagagcatctctgc

SEQ ID NO: 4344940 - DNA, 19 bp, Homo sapiens
tagctcccaaaagaatgga

SEQ ID NO: 4344941 - DNA, 19 bp, Homo sapiens
tagctcttttttgtttgtt

SEQ ID NO: 4344942 - DNA, 22 bp, Homo sapiens
tagctcttttttgtttgtttct

SEQ ID NO: 4344943 - DNA, 16 bp, Homo sapiens
tagcttgtctattatt

SEQ ID NO: 4344944 - DNA, 15 bp, Homo sapiens
tagcttgttccctgt

SEQ ID NO: 4344945 - DNA, 19 bp, Homo sapiens
taggaaagaggaggcagaa

SEQ ID NO: 4344946 - DNA, 15 bp, Homo sapiens
taggaattctttgca

SEQ ID NO: 4344947 - DNA, 17 bp, Homo sapiens
taggaattctttgcatt

SEQ ID NO: 4344948 - DNA, 15 bp, Homo sapiens
taggatgagcaaaac

SEQ ID NO: 4344949 - DNA, 18 bp, Homo sapiens
taggatgtctcttggaaa

SEQ ID NO: 4344950 - DNA, 19 bp, Homo sapiens
taggatgtctcttggaaat

SEQ ID NO: 4344951 - DNA, 20 bp, Homo sapiens
taggcatttgctgaatacag

SEQ ID NO: 4344952 - DNA, 16 bp, Homo sapiens
taggctggtggccttg

SEQ ID NO: 4344953 - DNA, 21 bp, Homo sapiens
tagggaaaaaccagcgtgtga

SEQ ID NO: 4344954 - DNA, 15 bp, Homo sapiens
tagggcaattggaac

SEQ ID NO: 4344955 - DNA, 18 bp, Homo sapiens
tagggtataatgtgtctg

SEQ ID NO: 4344956 - DNA, 19 bp, Homo sapiens
tagggtgggtaagaaagcc

SEQ ID NO: 4344957 - DNA, 21 bp, Homo sapiens
taggtaaaatgtatttttcta

SEQ ID NO: 4344958 - DNA, 15 bp, Homo sapiens
taggtaccatggcca

SEQ ID NO: 4344959 - DNA, 13 bp, Homo sapiens
taggtgtggggga

SEQ ID NO: 4344960 - DNA, 17 bp, Homo sapiens
taggtgtgggggaagca

SEQ ID NO: 4344961 - DNA, 20 bp, Homo sapiens
taggttgttaccaagtatga

SEQ ID NO: 4344962 - DNA, 22 bp, Homo sapiens
tagtaaaaagccctatgtgaaa

SEQ ID NO: 4344963 - DNA, 18 bp, Homo sapiens
tagtaaaatttatttcat

SEQ ID NO: 4344964 - DNA, 19 bp, Homo sapiens
tagtaaatattatgatttt

SEQ ID NO: 4344965 - DNA, 21 bp, Homo sapiens
tagtaaatattatgattttat

SEQ ID NO: 4344966 - DNA, 21 bp, Homo sapiens
tagtagaaagacatctgcctg

SEQ ID NO: 4344967 - DNA, 16 bp, Homo sapiens
tagtagtttttacaaa

SEQ ID NO: 4344968 - DNA, 23 bp, Homo sapiens
tagtatagtagaaagacatctgc

SEQ ID NO: 4344969 - DNA, 22 bp, Homo sapiens
tagtatatgattgtatttaaag

SEQ ID NO: 4344970 - DNA, 13 bp, Homo sapiens
tagtatttttatc

SEQ ID NO: 4344971 - DNA, 13 bp, Homo sapiens
tagtcatatgtga

SEQ ID NO: 4344972 - DNA, 16 bp, Homo sapiens
tagtcatatgtgaaga

SEQ ID NO: 4344973 - DNA, 15 bp, Homo sapiens
tagtctttttttcct

SEQ ID NO: 4344974 - DNA, 13 bp, Homo sapiens
tagtgaagaatag

SEQ ID NO: 4344975 - DNA, 16 bp, Homo sapiens
tagtgtgctgctgttc

SEQ ID NO: 4344976 - DNA, 22 bp, Homo sapiens
tagttacgtataatgctttctg

SEQ ID NO: 4344977 - DNA, 16 bp, Homo sapiens
tagttccctctgcctg

SEQ ID NO: 4344978 - DNA, 22 bp, Homo sapiens
tagttccctctgcctgggatgc

SEQ ID NO: 4344979 - DNA, 20 bp, Homo sapiens
tagttcctcattagcatttt

SEQ ID NO: 4344980 - DNA, 16 bp, Homo sapiens
tagttgtctgaattga

SEQ ID NO: 4344981 - DNA, 17 bp, Homo sapiens
tagttgtgggtgggaga

SEQ ID NO: 4344982 - DNA, 15 bp, Homo sapiens
tagtttccctggtgc

SEQ ID NO: 4344983 - DNA, 22 bp, Homo sapiens
tagtttttaattaaaaacttta

SEQ ID NO: 4344984 - DNA, 17 bp, Homo sapiens
tataaaaacaatatatt

SEQ ID NO: 4344985 - DNA, 22 bp, Homo sapiens
tataaaaaccacccacaaagaa

SEQ ID NO: 4344986 - DNA, 13 bp, Homo sapiens
tataaaattgaaa

SEQ ID NO: 4344987 - DNA, 14 bp, Homo sapiens
tataaagaaacttt

SEQ ID NO: 4344988 - DNA, 16 bp, Homo sapiens
tataaagaaacttttg

SEQ ID NO: 4344989 - DNA, 18 bp, Homo sapiens
tataaagaaacttttgaa

SEQ ID NO: 4344990 - DNA, 19 bp, Homo sapiens
tataaatatatataaagaa

SEQ ID NO: 4344991 - DNA, 16 bp, Homo sapiens
tataaattaaataaac

SEQ ID NO: 4344992 - DNA, 17 bp, Homo sapiens
tataaattaaataaact

SEQ ID NO: 4344993 - DNA, 20 bp, Homo sapiens
tataaattaaataaactgtt

SEQ ID NO: 4344994 - DNA, 20 bp, Homo sapiens
tataagaatgagcctgtcca

SEQ ID NO: 4344995 - DNA, 20 bp, Homo sapiens
tataagcgtatttagactgt

SEQ ID NO: 4344996 - DNA, 15 bp, Homo sapiens
tataaggtaatgtag

SEQ ID NO: 4344997 - DNA, 22 bp, Homo sapiens
tataaggtttgttcctttgaag

SEQ ID NO: 4344998 - DNA, 15 bp, Homo sapiens
tataagtgttcagtg

SEQ ID NO: 4344999 - DNA, 16 bp, Homo sapiens
tataagtgttcagtgt

SEQ ID NO: 4345000 - DNA, 19 bp, Homo sapiens
tataagtgttcagtgttga

SEQ ID NO: 4345001 - DNA, 13 bp, Homo sapiens
tataatgctttct

SEQ ID NO: 4345002 - DNA, 16 bp, Homo sapiens
tataatgtgtctgtgt

SEQ ID NO: 4345003 - DNA, 16 bp, Homo sapiens
tatacacaactttgca

SEQ ID NO: 4345004 - DNA, 13 bp, Homo sapiens
tatacctgccttt

SEQ ID NO: 4345005 - DNA, 20 bp, Homo sapiens
tataccttactgacacattg

SEQ ID NO: 4345006 - DNA, 20 bp, Homo sapiens
tatactttgtggaccaatta

SEQ ID NO: 4345007 - DNA, 17 bp, Homo sapiens
tatactttttttgttat

SEQ ID NO: 4345008 - DNA, 18 bp, Homo sapiens
tatagctcccaaaagaat

SEQ ID NO: 4345009 - DNA, 21 bp, Homo sapiens
tatagctcccaaaagaatgga

SEQ ID NO: 4345010 - DNA, 18 bp, Homo sapiens
tatagtaccagaagcaag

SEQ ID NO: 4345011 - DNA, 13 bp, Homo sapiens
tatagtagaaaga

SEQ ID NO: 4345012 - DNA, 24 bp, Homo sapiens
tatagtagaaagacatctgcctgt

SEQ ID NO: 4345013 - DNA, 13 bp, Homo sapiens
tatagtgaagaat

SEQ ID NO: 4345014 - DNA, 16 bp, Homo sapiens
tatataaggtaatgta

SEQ ID NO: 4345015 - DNA, 16 bp, Homo sapiens
tatataatcatgctca

SEQ ID NO: 4345016 - DNA, 10 bp, Homo sapiens
tatatataaa

SEQ ID NO: 4345017 - DNA, 11 bp, Homo sapiens
tatatatataa

SEQ ID NO: 4345018 - DNA, 14 bp, Homo sapiens
tatatatataaagt

SEQ ID NO: 4345019 - DNA, 19 bp, Homo sapiens
tatatgctgtatttctttg

SEQ ID NO: 4345020 - DNA, 14 bp, Homo sapiens
tatatgtgagaaat

SEQ ID NO: 4345021 - DNA, 12 bp, Homo sapiens
tatattaaatga

SEQ ID NO: 4345022 - DNA, 13 bp, Homo sapiens
tatattaaatgag

SEQ ID NO: 4345023 - DNA, 17 bp, Homo sapiens
tatattgaaagttgctt

SEQ ID NO: 4345024 - DNA, 18 bp, Homo sapiens
tatattgtgtaaatatta

SEQ ID NO: 4345025 - DNA, 22 bp, Homo sapiens
tatatttagttacgtataatgc

SEQ ID NO: 4345026 - DNA, 15 bp, Homo sapiens
tatatttttaaagaa

SEQ ID NO: 4345027 - DNA, 21 bp, Homo sapiens
tatcagttaaaatcacatttt

SEQ ID NO: 4345028 - DNA, 15 bp, Homo sapiens
tatcatattggtgct

SEQ ID NO: 4345029 - DNA, 22 bp, Homo sapiens
tatcatggaatttccattgaca

SEQ ID NO: 4345030 - DNA, 18 bp, Homo sapiens
tatccagctagtgccaaa

SEQ ID NO: 4345031 - DNA, 15 bp, Homo sapiens
tatccattacgtgca

SEQ ID NO: 4345032 - DNA, 16 bp, Homo sapiens
tatccattacgtgcat

SEQ ID NO: 4345033 - DNA, 18 bp, Homo sapiens
tatccattacgtgcattt

SEQ ID NO: 4345034 - DNA, 19 bp, Homo sapiens
tatccattacgtgcattta

SEQ ID NO: 4345035 - DNA, 15 bp, Homo sapiens
tatccccagtgcccg

SEQ ID NO: 4345036 - DNA, 16 bp, Homo sapiens
tatccgccctgcagca

SEQ ID NO: 4345037 - DNA, 16 bp, Homo sapiens
tatcctacagtacaat

SEQ ID NO: 4345038 - DNA, 14 bp, Homo sapiens
tatcctagttccat

SEQ ID NO: 4345039 - DNA, 21 bp, Homo sapiens
tatcctgctgaaagtcctgct

SEQ ID NO: 4345040 - DNA, 14 bp, Homo sapiens
tatcgcaacatgaa

SEQ ID NO: 4345041 - DNA, 16 bp, Homo sapiens
tatcggaagaacatga

SEQ ID NO: 4345042 - DNA, 16 bp, Homo sapiens
tatctatcggaagaac

SEQ ID NO: 4345043 - DNA, 20 bp, Homo sapiens
tatctatcggaagaacatga

SEQ ID NO: 4345044 - DNA, 15 bp, Homo sapiens
tatctcactgtttta

SEQ ID NO: 4345045 - DNA, 16 bp, Homo sapiens
tatctcactgttttat

SEQ ID NO: 4345046 - DNA, 22 bp, Homo sapiens
tatctgatatgctgagaaatta

SEQ ID NO: 4345047 - DNA, 21 bp, Homo sapiens
tatcttgttattaatgtttct

SEQ ID NO: 4345048 - DNA, 12 bp, Homo sapiens
tatgaaatcata

SEQ ID NO: 4345049 - DNA, 19 bp, Homo sapiens
tatgaaatcatagtatatg

SEQ ID NO: 4345050 - DNA, 17 bp, Homo sapiens
tatgaagtataaatctg

SEQ ID NO: 4345051 - DNA, 17 bp, Homo sapiens
tatgaccattgaaaaag

SEQ ID NO: 4345052 - DNA, 20 bp, Homo sapiens
tatgaccattgaaaaaggaa

SEQ ID NO: 4345053 - DNA, 13 bp, Homo sapiens
tatgagatttact

SEQ ID NO: 4345054 - DNA, 19 bp, Homo sapiens
tatgattggttcagttttt

SEQ ID NO: 4345055 - DNA, 20 bp, Homo sapiens
tatgattttatttaaactat

SEQ ID NO: 4345056 - DNA, 21 bp, Homo sapiens
tatgcagaacgtatttagcca

SEQ ID NO: 4345057 - DNA, 20 bp, Homo sapiens
tatgctaaacctcctgcctc

SEQ ID NO: 4345058 - DNA, 18 bp, Homo sapiens
tatgctacacatatgtgc

SEQ ID NO: 4345059 - DNA, 15 bp, Homo sapiens
tatgctgagaaatta

SEQ ID NO: 4345060 - DNA, 17 bp, Homo sapiens
tatggagaattgctgaa

SEQ ID NO: 4345061 - DNA, 17 bp, Homo sapiens
tatggagactttgctgt

SEQ ID NO: 4345062 - DNA, 22 bp, Homo sapiens
tatggctatctatacctgcctt

SEQ ID NO: 4345063 - DNA, 16 bp, Homo sapiens
tatgtacgataaagta

SEQ ID NO: 4345064 - DNA, 18 bp, Homo sapiens
tatgtatataatcatgct

SEQ ID NO: 4345065 - DNA, 19 bp, Homo sapiens
tatgtatatatattctcag

SEQ ID NO: 4345066 - DNA, 16 bp, Homo sapiens
tatgtccttcagctga

SEQ ID NO: 4345067 - DNA, 19 bp, Homo sapiens
tatgtcttggacctatcaa

SEQ ID NO: 4345068 - DNA, 21 bp, Homo sapiens
tatgtgcgaagcaagaagaat

SEQ ID NO: 4345069 - DNA, 22 bp, Homo sapiens
tatgtgcgaagcaagaagaatt

SEQ ID NO: 4345070 - DNA, 22 bp, Homo sapiens
tatgtgcttctcagttgcagaa

SEQ ID NO: 4345071 - DNA, 22 bp, Homo sapiens
tatgtggcccaagtcattccta

SEQ ID NO: 4345072 - DNA, 15 bp, Homo sapiens
tatgtgttgccaaag

SEQ ID NO: 4345073 - DNA, 15 bp, Homo sapiens
tattaaaatgtaact

SEQ ID NO: 4345074 - DNA, 14 bp, Homo sapiens
tattaataaagcat

SEQ ID NO: 4345075 - DNA, 15 bp, Homo sapiens
tattaataaagcatt

SEQ ID NO: 4345076 - DNA, 16 bp, Homo sapiens
tattacagaaatgttt

SEQ ID NO: 4345077 - DNA, 14 bp, Homo sapiens
tattacttgtgcac

SEQ ID NO: 4345078 - DNA, 13 bp, Homo sapiens
tattagattgcca

SEQ ID NO: 4345079 - DNA, 23 bp, Homo sapiens
tattaggattgggggatgtgaag

SEQ ID NO: 4345080 - DNA, 22 bp, Homo sapiens
tattatcagttaaaatcacatt

SEQ ID NO: 4345081 - DNA, 19 bp, Homo sapiens
tattcaatatttactgaga

SEQ ID NO: 4345082 - DNA, 14 bp, Homo sapiens
tattcagctagaat

SEQ ID NO: 4345083 - DNA, 20 bp, Homo sapiens
tattcagctagaatttctgg

SEQ ID NO: 4345084 - DNA, 12 bp, Homo sapiens
tattgaatgttt

SEQ ID NO: 4345085 - DNA, 21 bp, Homo sapiens
tattgagtttgtaggtaaaat

SEQ ID NO: 4345086 - DNA, 10 bp, Homo sapiens
tattgcacta

SEQ ID NO: 4345087 - DNA, 17 bp, Homo sapiens
tattgcactaggaattc

SEQ ID NO: 4345088 - DNA, 24 bp, Homo sapiens
tattgcatttgctgttgtttctat

SEQ ID NO: 4345089 - DNA, 17 bp, Homo sapiens
tattgcttagtaaaatt

SEQ ID NO: 4345090 - DNA, 18 bp, Homo sapiens
tattgcttagtaaaattt

SEQ ID NO: 4345091 - DNA, 19 bp, Homo sapiens
tattgcttagtaaaattta

SEQ ID NO: 4345092 - DNA, 18 bp, Homo sapiens
tattgcttagtgaaaata

SEQ ID NO: 4345093 - DNA, 18 bp, Homo sapiens
tattggaaatggatgcaa

SEQ ID NO: 4345094 - DNA, 16 bp, Homo sapiens
tattggcttactgaaa

SEQ ID NO: 4345095 - DNA, 19 bp, Homo sapiens
tattggcttactgaaagac

SEQ ID NO: 4345096 - DNA, 14 bp, Homo sapiens
tattggtatatttg

SEQ ID NO: 4345097 - DNA, 17 bp, Homo sapiens
tattgtaaattttagaa

SEQ ID NO: 4345098 - DNA, 12 bp, Homo sapiens
tatttaaactat

SEQ ID NO: 4345099 - DNA, 13 bp, Homo sapiens
tatttatatcttg

SEQ ID NO: 4345100 - DNA, 22 bp, Homo sapiens
tatttatcgcaacatgaatttt

SEQ ID NO: 4345101 - DNA, 18 bp, Homo sapiens
tatttattgcttagtgaa

SEQ ID NO: 4345102 - DNA, 23 bp, Homo sapiens
tatttattgcttagtgaaaatac

SEQ ID NO: 4345103 - DNA, 17 bp, Homo sapiens
tatttcagattcctcag

SEQ ID NO: 4345104 - DNA, 18 bp, Homo sapiens
tatttcagtattttccag

SEQ ID NO: 4345105 - DNA, 22 bp, Homo sapiens
tatttcagtattttccagcctt

SEQ ID NO: 4345106 - DNA, 15 bp, Homo sapiens
tatttctctggcaaa

SEQ ID NO: 4345107 - DNA, 16 bp, Homo sapiens
tatttctctggcaaac

SEQ ID NO: 4345108 - DNA, 19 bp, Homo sapiens
tatttctctggcaaacttt

SEQ ID NO: 4345109 - DNA, 19 bp, Homo sapiens
tatttctgtggaaaacaat

SEQ ID NO: 4345110 - DNA, 20 bp, Homo sapiens
tatttctgtggaaaacaatt

SEQ ID NO: 4345111 - DNA, 13 bp, Homo sapiens
tatttctttgtag

SEQ ID NO: 4345112 - DNA, 16 bp, Homo sapiens
tatttgggctctgaaa

SEQ ID NO: 4345113 - DNA, 17 bp, Homo sapiens
tatttgggctctgaaat

SEQ ID NO: 4345114 - DNA, 21 bp, Homo sapiens
tatttgtataaattaaataaa

SEQ ID NO: 4345115 - DNA, 15 bp, Homo sapiens
tatttgtattaataa

SEQ ID NO: 4345116 - DNA, 17 bp, Homo sapiens
tatttgtattaataaag

SEQ ID NO: 4345117 - DNA, 16 bp, Homo sapiens
tattttaaaaaatata

SEQ ID NO: 4345118 - DNA, 17 bp, Homo sapiens
tattttctgtgtaaaat

SEQ ID NO: 4345119 - DNA, 15 bp, Homo sapiens
tattttgataataat

SEQ ID NO: 4345120 - DNA, 13 bp, Homo sapiens
tatttttaaagaa

SEQ ID NO: 4345121 - DNA, 22 bp, Homo sapiens
tatttttgaaaggcatgttcct

SEQ ID NO: 4345122 - DNA, 13 bp, Homo sapiens
tattttttaataa

SEQ ID NO: 4345123 - DNA, 18 bp, Homo sapiens
tatttttttaaacaaaat

SEQ ID NO: 4345124 - DNA, 22 bp, Homo sapiens
tatttttttaaacaaaatttca

SEQ ID NO: 4345125 - DNA, 14 bp, Homo sapiens
tcaaaaaaagaaaa

SEQ ID NO: 4345126 - DNA, 15 bp, Homo sapiens
tcaaaaactgacttt

SEQ ID NO: 4345127 - DNA, 13 bp, Homo sapiens
tcaaaaacttttc

SEQ ID NO: 4345128 - DNA, 21 bp, Homo sapiens
tcaaaacacatctttcctgtc

SEQ ID NO: 4345129 - DNA, 15 bp, Homo sapiens
tcaaaagctggatta

SEQ ID NO: 4345130 - DNA, 16 bp, Homo sapiens
tcaaacagaattttaa

SEQ ID NO: 4345131 - DNA, 20 bp, Homo sapiens
tcaaaccttaagataatgga

SEQ ID NO: 4345132 - DNA, 14 bp, Homo sapiens
tcaaagacacacag

SEQ ID NO: 4345133 - DNA, 16 bp, Homo sapiens
tcaaagagaaaactta

SEQ ID NO: 4345134 - DNA, 18 bp, Homo sapiens
tcaaagtggggtacagta

SEQ ID NO: 4345135 - DNA, 19 bp, Homo sapiens
tcaaatggcattgggctga

SEQ ID NO: 4345136 - DNA, 13 bp, Homo sapiens
tcaacaatgattt

SEQ ID NO: 4345137 - DNA, 23 bp, Homo sapiens
tcaactaaaagtggcatagagaa

SEQ ID NO: 4345138 - DNA, 18 bp, Homo sapiens
tcaactgggctctgtccc

SEQ ID NO: 4345139 - DNA, 13 bp, Homo sapiens
tcaagtaacactt

SEQ ID NO: 4345140 - DNA, 17 bp, Homo sapiens
tcaagtaataaaaagag

SEQ ID NO: 4345141 - DNA, 18 bp, Homo sapiens
tcaagtgtcacctccttc

SEQ ID NO: 4345142 - DNA, 21 bp, Homo sapiens
tcaagtgtcacctccttcccc

SEQ ID NO: 4345143 - DNA, 16 bp, Homo sapiens
tcaagtttttctctca

SEQ ID NO: 4345144 - DNA, 16 bp, Homo sapiens
tcaattgcagatgcca

SEQ ID NO: 4345145 - DNA, 19 bp, Homo sapiens
tcaattgcagatgccaaaa

SEQ ID NO: 4345146 - DNA, 18 bp, Homo sapiens
tcacaagtagcctctggg

SEQ ID NO: 4345147 - DNA, 16 bp, Homo sapiens
tcacactgcagagact

SEQ ID NO: 4345148 - DNA, 13 bp, Homo sapiens
tcacagcctctga

SEQ ID NO: 4345149 - DNA, 19 bp, Homo sapiens
tcacaggcagctctgagcc

SEQ ID NO: 4345150 - DNA, 20 bp, Homo sapiens
tcacaggcagctctgagccg

SEQ ID NO: 4345151 - DNA, 14 bp, Homo sapiens
tcacagtgggaaga

SEQ ID NO: 4345152 - DNA, 16 bp, Homo sapiens
tcacatctaaagcttt

SEQ ID NO: 4345153 - DNA, 20 bp, Homo sapiens
tcacatctaaagctttatct

SEQ ID NO: 4345154 - DNA, 15 bp, Homo sapiens
tcacattttaagtgc

SEQ ID NO: 4345155 - DNA, 15 bp, Homo sapiens
tcaccccagccccca

SEQ ID NO: 4345156 - DNA, 16 bp, Homo sapiens
tcaccccagcccccac

SEQ ID NO: 4345157 - DNA, 23 bp, Homo sapiens
tcaccccagcccccacagccctg

SEQ ID NO: 4345158 - DNA, 23 bp, Homo sapiens
tcacctctctctaagtttagaag

SEQ ID NO: 4345159 - DNA, 19 bp, Homo sapiens
tcacgcctgtaatcctagc

SEQ ID NO: 4345160 - DNA, 13 bp, Homo sapiens
tcactgattccct

SEQ ID NO: 4345161 - DNA, 14 bp, Homo sapiens
tcactgattccctc

SEQ ID NO: 4345162 - DNA, 23 bp, Homo sapiens
tcactgattccctctcccaccca

SEQ ID NO: 4345163 - DNA, 22 bp, Homo sapiens
tcactgcattcattctgagccc

SEQ ID NO: 4345164 - DNA, 18 bp, Homo sapiens
tcactgccatgccagctt

SEQ ID NO: 4345165 - DNA, 23 bp, Homo sapiens
tcactgtaagactcattccctag

SEQ ID NO: 4345166 - DNA, 10 bp, Homo sapiens
tcacttgagt

SEQ ID NO: 4345167 - DNA, 12 bp, Homo sapiens
tcagaaactgtt

SEQ ID NO: 4345168 - DNA, 23 bp, Homo sapiens
tcagaagacactaattccttaaa

SEQ ID NO: 4345169 - DNA, 19 bp, Homo sapiens
tcagaatggaatccatctg

SEQ ID NO: 4345170 - DNA, 23 bp, Homo sapiens
tcagaatggaatccatctgtctc

SEQ ID NO: 4345171 - DNA, 20 bp, Homo sapiens
tcagaattggcataatttgt

SEQ ID NO: 4345172 - DNA, 16 bp, Homo sapiens
tcagactctcagccca

SEQ ID NO: 4345173 - DNA, 20 bp, Homo sapiens
tcagaggaaaaacagaggat

SEQ ID NO: 4345174 - DNA, 22 bp, Homo sapiens
tcagaggtcatcccttcctcct

SEQ ID NO: 4345175 - DNA, 15 bp, Homo sapiens
tcagagttaaaatat

SEQ ID NO: 4345176 - DNA, 17 bp, Homo sapiens
tcagagttaaaatatat

SEQ ID NO: 4345177 - DNA, 17 bp, Homo sapiens
tcagagtttgtgtgtat

SEQ ID NO: 4345178 - DNA, 18 bp, Homo sapiens
tcagagtttgtgtgtatt

SEQ ID NO: 4345179 - DNA, 16 bp, Homo sapiens
tcagatgctgaattga

SEQ ID NO: 4345180 - DNA, 13 bp, Homo sapiens
tcagatttcttaa

SEQ ID NO: 4345181 - DNA, 16 bp, Homo sapiens
tcagatttcttaatgt

SEQ ID NO: 4345182 - DNA, 16 bp, Homo sapiens
tcagcaatattgcctg

SEQ ID NO: 4345183 - DNA, 12 bp, Homo sapiens
tcagcagggctg

SEQ ID NO: 4345184 - DNA, 15 bp, Homo sapiens
tcagccacagcctga

SEQ ID NO: 4345185 - DNA, 21 bp, Homo sapiens
tcagccatgggaaatgagcca

SEQ ID NO: 4345186 - DNA, 19 bp, Homo sapiens
tcagccattcctgttctct

SEQ ID NO: 4345187 - DNA, 23 bp, Homo sapiens
tcagccgtgtaaccatggaccca

SEQ ID NO: 4345188 - DNA, 10 bp, Homo sapiens
tcagcctggg

SEQ ID NO: 4345189 - DNA, 13 bp, Homo sapiens
tcagctccccctg

SEQ ID NO: 4345190 - DNA, 13 bp, Homo sapiens
tcagctccctgac

SEQ ID NO: 4345191 - DNA, 19 bp, Homo sapiens
tcagctccctgaccccctg

SEQ ID NO: 4345192 - DNA, 21 bp, Homo sapiens
tcagctccctgaccccctgtc

SEQ ID NO: 4345193 - DNA, 21 bp, Homo sapiens
tcagcttaatttaagtttgta

SEQ ID NO: 4345194 - DNA, 20 bp, Homo sapiens
tcaggaggcgaataaatgtt

SEQ ID NO: 4345195 - DNA, 23 bp, Homo sapiens
tcaggaggcgaataaatgttcaa

SEQ ID NO: 4345196 - DNA, 13 bp, Homo sapiens
tcaggctccccag

SEQ ID NO: 4345197 - DNA, 19 bp, Homo sapiens
tcaggggtgtgcggccttt

SEQ ID NO: 4345198 - DNA, 23 bp, Homo sapiens
tcaggggtgtgcggcctttggct

SEQ ID NO: 4345199 - DNA, 16 bp, Homo sapiens
tcaggtgagaagcaga

SEQ ID NO: 4345200 - DNA, 21 bp, Homo sapiens
tcaggtgagaagcagaggaag

SEQ ID NO: 4345201 - DNA, 19 bp, Homo sapiens
tcagtattttccagcctta

SEQ ID NO: 4345202 - DNA, 22 bp, Homo sapiens
tcagtattttccagccttatgt

SEQ ID NO: 4345203 - DNA, 21 bp, Homo sapiens
tcagtctttgtcaatgctcta

SEQ ID NO: 4345204 - DNA, 12 bp, Homo sapiens
tcagtgttgaca

SEQ ID NO: 4345205 - DNA, 13 bp, Homo sapiens
tcagtgttgacat

SEQ ID NO: 4345206 - DNA, 21 bp, Homo sapiens
tcagtgttgacatagcctttg

SEQ ID NO: 4345207 - DNA, 18 bp, Homo sapiens
tcagttccacggttgcta

SEQ ID NO: 4345208 - DNA, 18 bp, Homo sapiens
tcataattcctacagcac

SEQ ID NO: 4345209 - DNA, 23 bp, Homo sapiens
tcataattcctacagcactactg

SEQ ID NO: 4345210 - DNA, 20 bp, Homo sapiens
tcatagtatatgattgtatt

SEQ ID NO: 4345211 - DNA, 22 bp, Homo sapiens
tcatatgaccattgaaaaagga

SEQ ID NO: 4345212 - DNA, 23 bp, Homo sapiens
tcatatgaccattgaaaaaggaa

SEQ ID NO: 4345213 - DNA, 13 bp, Homo sapiens
tcatatgcagaac

SEQ ID NO: 4345214 - DNA, 20 bp, Homo sapiens
tcatatgcagaacgtattta

SEQ ID NO: 4345215 - DNA, 19 bp, Homo sapiens
tcatattgaatgtttccaa

SEQ ID NO: 4345216 - DNA, 20 bp, Homo sapiens
tcatcaaagtggggtacagt

SEQ ID NO: 4345217 - DNA, 15 bp, Homo sapiens
tcatcctcagcagca

SEQ ID NO: 4345218 - DNA, 16 bp, Homo sapiens
tcatcctcagcagcat

SEQ ID NO: 4345219 - DNA, 23 bp, Homo sapiens
tcatcgctcgtgtgttctatcca

SEQ ID NO: 4345220 - DNA, 13 bp, Homo sapiens
tcatctgtaatct

SEQ ID NO: 4345221 - DNA, 23 bp, Homo sapiens
tcatcttaggttggcaaaaaggc

SEQ ID NO: 4345222 - DNA, 15 bp, Homo sapiens
tcatcttgtgaaatg

SEQ ID NO: 4345223 - DNA, 19 bp, Homo sapiens
tcatgaaggacactctgca

SEQ ID NO: 4345224 - DNA, 22 bp, Homo sapiens
tcatgaattagaagaaaatgga

SEQ ID NO: 4345225 - DNA, 14 bp, Homo sapiens
tcatgccacagtgg

SEQ ID NO: 4345226 - DNA, 17 bp, Homo sapiens
tcatgcttcttccttac

SEQ ID NO: 4345227 - DNA, 21 bp, Homo sapiens
tcatggtagatttttttcata

SEQ ID NO: 4345228 - DNA, 18 bp, Homo sapiens
tcatgtctgtatccccag

SEQ ID NO: 4345229 - DNA, 15 bp, Homo sapiens
tcattaaactgattc

SEQ ID NO: 4345230 - DNA, 22 bp, Homo sapiens
tcattacttctgagccccagcc

SEQ ID NO: 4345231 - DNA, 16 bp, Homo sapiens
tcattcacttctctta

SEQ ID NO: 4345232 - DNA, 21 bp, Homo sapiens
tcattctcataattcctacag

SEQ ID NO: 4345233 - DNA, 14 bp, Homo sapiens
tcattgtccagctg

SEQ ID NO: 4345234 - DNA, 12 bp, Homo sapiens
tcatttaagatt

SEQ ID NO: 4345235 - DNA, 18 bp, Homo sapiens
tcatttatagcacgtctc

SEQ ID NO: 4345236 - DNA, 15 bp, Homo sapiens
tcatttcattccatt

SEQ ID NO: 4345237 - DNA, 19 bp, Homo sapiens
tcatttggcttgctgttta

SEQ ID NO: 4345238 - DNA, 16 bp, Homo sapiens
tcatttggttaaatca

SEQ ID NO: 4345239 - DNA, 20 bp, Homo sapiens
tccaacccagcagttctctg

SEQ ID NO: 4345240 - DNA, 19 bp, Homo sapiens
tccaactcttccacctctg

SEQ ID NO: 4345241 - DNA, 19 bp, Homo sapiens
tccaactgtgttcattaga

SEQ ID NO: 4345242 - DNA, 17 bp, Homo sapiens
tccaagcattactttaa

SEQ ID NO: 4345243 - DNA, 19 bp, Homo sapiens
tccaagggccgtgcccttg

SEQ ID NO: 4345244 - DNA, 21 bp, Homo sapiens
tccaagggccgtgcccttgcc

SEQ ID NO: 4345245 - DNA, 23 bp, Homo sapiens
tccaagggccgtgcccttgccct

SEQ ID NO: 4345246 - DNA, 15 bp, Homo sapiens
tccactcccaagcca

SEQ ID NO: 4345247 - DNA, 22 bp, Homo sapiens
tccactgcaaataaagcctttt

SEQ ID NO: 4345248 - DNA, 12 bp, Homo sapiens
tccacttctccc

SEQ ID NO: 4345249 - DNA, 22 bp, Homo sapiens
tccagaagtttgagatcagcct

SEQ ID NO: 4345250 - DNA, 18 bp, Homo sapiens
tccagacgtaggggaggg

SEQ ID NO: 4345251 - DNA, 15 bp, Homo sapiens
tccagccgtgtgtgc

SEQ ID NO: 4345252 - DNA, 20 bp, Homo sapiens
tccagccgtgtgtgcatgtg

SEQ ID NO: 4345253 - DNA, 21 bp, Homo sapiens
tccagccgtgtgtgcatgtgc

SEQ ID NO: 4345254 - DNA, 13 bp, Homo sapiens
tccagcctggacc

SEQ ID NO: 4345255 - DNA, 14 bp, Homo sapiens
tccagcctggaccc

SEQ ID NO: 4345256 - DNA, 17 bp, Homo sapiens
tccagcctggaccccca

SEQ ID NO: 4345257 - DNA, 19 bp, Homo sapiens
tccagcctggacccccagc

SEQ ID NO: 4345258 - DNA, 21 bp, Homo sapiens
tccagcctggacccccagctt

SEQ ID NO: 4345259 - DNA, 24 bp, Homo sapiens
tccagcctgggtgacagagcaagt

SEQ ID NO: 4345260 - DNA, 19 bp, Homo sapiens
tccagccttatgtgttaca

SEQ ID NO: 4345261 - DNA, 20 bp, Homo sapiens
tccagccttatgtgttacat

SEQ ID NO: 4345262 - DNA, 23 bp, Homo sapiens
tccagctagtgccaaataattga

SEQ ID NO: 4345263 - DNA, 18 bp, Homo sapiens
tccaggtttaagctgtta

SEQ ID NO: 4345264 - DNA, 16 bp, Homo sapiens
tccatatttcaacaga

SEQ ID NO: 4345265 - DNA, 17 bp, Homo sapiens
tccattaataactgaat

SEQ ID NO: 4345266 - DNA, 22 bp, Homo sapiens
tccattacgtgcatttaaactc

SEQ ID NO: 4345267 - DNA, 17 bp, Homo sapiens
tccattccattaataac

SEQ ID NO: 4345268 - DNA, 15 bp, Homo sapiens
tccattgcaaaatag

SEQ ID NO: 4345269 - DNA, 19 bp, Homo sapiens
tccattgggactgattttt

SEQ ID NO: 4345270 - DNA, 12 bp, Homo sapiens
tcccaaaagaat

SEQ ID NO: 4345271 - DNA, 20 bp, Homo sapiens
tcccaagatggagaggaaga

SEQ ID NO: 4345272 - DNA, 15 bp, Homo sapiens
tcccaagctagactg

SEQ ID NO: 4345273 - DNA, 20 bp, Homo sapiens
tcccaagctagactgtgtct

SEQ ID NO: 4345274 - DNA, 16 bp, Homo sapiens
tcccacaaaggagagc

SEQ ID NO: 4345275 - DNA, 13 bp, Homo sapiens
tcccacccaagga

SEQ ID NO: 4345276 - DNA, 22 bp, Homo sapiens
tcccactgaaggattaatgaaa

SEQ ID NO: 4345277 - DNA, 19 bp, Homo sapiens
tcccagaggccgctgcccc

SEQ ID NO: 4345278 - DNA, 20 bp, Homo sapiens
tcccagaggccgctgcccct

SEQ ID NO: 4345279 - DNA, 13 bp, Homo sapiens
tcccagatcctgg

SEQ ID NO: 4345280 - DNA, 16 bp, Homo sapiens
tcccagcacatttcct

SEQ ID NO: 4345281 - DNA, 20 bp, Homo sapiens
tcccagcacatttcctctct

SEQ ID NO: 4345282 - DNA, 19 bp, Homo sapiens
tcccagcacctattgaatt

SEQ ID NO: 4345283 - DNA, 19 bp, Homo sapiens
tcccagctctctctcctgg

SEQ ID NO: 4345284 - DNA, 18 bp, Homo sapiens
tcccaggtaatttaaatt

SEQ ID NO: 4345285 - DNA, 23 bp, Homo sapiens
tcccatcccgtaagaccaccttc

SEQ ID NO: 4345286 - DNA, 18 bp, Homo sapiens
tccccaaatggctgcttt

SEQ ID NO: 4345287 - DNA, 18 bp, Homo sapiens
tccccaatccatgcttca

SEQ ID NO: 4345288 - DNA, 16 bp, Homo sapiens
tcccccaccccagagt

SEQ ID NO: 4345289 - DNA, 14 bp, Homo sapiens
tcccccagagcccc

SEQ ID NO: 4345290 - DNA, 23 bp, Homo sapiens
tccccccatagagaccaggaggg

SEQ ID NO: 4345291 - DNA, 20 bp, Homo sapiens
tcccccgttgtgcctggttc

SEQ ID NO: 4345292 - DNA, 16 bp, Homo sapiens
tccccctggttgggtg

SEQ ID NO: 4345293 - DNA, 19 bp, Homo sapiens
tccccctgtcccctcagct

SEQ ID NO: 4345294 - DNA, 14 bp, Homo sapiens
tccccctttctctg

SEQ ID NO: 4345295 - DNA, 16 bp, Homo sapiens
tccccctttctctgcc

SEQ ID NO: 4345296 - DNA, 18 bp, Homo sapiens
tccccctttctctgcctg

SEQ ID NO: 4345297 - DNA, 19 bp, Homo sapiens
tccccctttctctgcctgg

SEQ ID NO: 4345298 - DNA, 13 bp, Homo sapiens
tccccgccccctg

SEQ ID NO: 4345299 - DNA, 15 bp, Homo sapiens
tccccgccccctgaa

SEQ ID NO: 4345300 - DNA, 15 bp, Homo sapiens
tcccctcagctccag

SEQ ID NO: 4345301 - DNA, 21 bp, Homo sapiens
tcccctccccgccccctgaaa

SEQ ID NO: 4345302 - DNA, 19 bp, Homo sapiens
tcccctgtagagtgggagc

SEQ ID NO: 4345303 - DNA, 13 bp, Homo sapiens
tccctaaactgta

SEQ ID NO: 4345304 - DNA, 19 bp, Homo sapiens
tccctccccaaatggctgc

SEQ ID NO: 4345305 - DNA, 18 bp, Homo sapiens
tccctcccccagagcccc

SEQ ID NO: 4345306 - DNA, 15 bp, Homo sapiens
tccctctctccacac

SEQ ID NO: 4345307 - DNA, 12 bp, Homo sapiens
tccctctgcctg

SEQ ID NO: 4345308 - DNA, 18 bp, Homo sapiens
tccctctgtgtctgctct

SEQ ID NO: 4345309 - DNA, 21 bp, Homo sapiens
tccctgaccccctgtcctagg

SEQ ID NO: 4345310 - DNA, 12 bp, Homo sapiens
tccctgctccca

SEQ ID NO: 4345311 - DNA, 14 bp, Homo sapiens
tccctgctcccagc

SEQ ID NO: 4345312 - DNA, 18 bp, Homo sapiens
tccctggcaaggagaata

SEQ ID NO: 4345313 - DNA, 21 bp, Homo sapiens
tccctgggatggacgctgccg

SEQ ID NO: 4345314 - DNA, 23 bp, Homo sapiens
tccctggtgcccttccctggagg

SEQ ID NO: 4345315 - DNA, 18 bp, Homo sapiens
tccctgtatgtctacctc

SEQ ID NO: 4345316 - DNA, 22 bp, Homo sapiens
tccctgtatgtctacctctgac

SEQ ID NO: 4345317 - DNA, 16 bp, Homo sapiens
tccctgtctctgcatc

SEQ ID NO: 4345318 - DNA, 18 bp, Homo sapiens
tcccttcctcctctcctg

SEQ ID NO: 4345319 - DNA, 22 bp, Homo sapiens
tcccttctttgcttctttttct

SEQ ID NO: 4345320 - DNA, 17 bp, Homo sapiens
tcccttttttcttcccc

SEQ ID NO: 4345321 - DNA, 17 bp, Homo sapiens
tccggtccctgtcccag

SEQ ID NO: 4345322 - DNA, 20 bp, Homo sapiens
tcctacagcactactgggtg

SEQ ID NO: 4345323 - DNA, 21 bp, Homo sapiens
tcctacagcactactgggtgt

SEQ ID NO: 4345324 - DNA, 13 bp, Homo sapiens
tcctacagtacaa

SEQ ID NO: 4345325 - DNA, 15 bp, Homo sapiens
tcctacgctatgtag

SEQ ID NO: 4345326 - DNA, 14 bp, Homo sapiens
tcctactcctggag

SEQ ID NO: 4345327 - DNA, 22 bp, Homo sapiens
tcctagaaattccccaccctga

SEQ ID NO: 4345328 - DNA, 15 bp, Homo sapiens
tcctagccccaccca

SEQ ID NO: 4345329 - DNA, 14 bp, Homo sapiens
tcctaggcatttgc

SEQ ID NO: 4345330 - DNA, 19 bp, Homo sapiens
tcctagttccattcttggt

SEQ ID NO: 4345331 - DNA, 15 bp, Homo sapiens
tcctatctagcattt

SEQ ID NO: 4345332 - DNA, 23 bp, Homo sapiens
tcctatctagcatttatttctct

SEQ ID NO: 4345333 - DNA, 17 bp, Homo sapiens
tcctatttttgtaaact

SEQ ID NO: 4345334 - DNA, 18 bp, Homo sapiens
tcctcattagcattttgc

SEQ ID NO: 4345335 - DNA, 17 bp, Homo sapiens
tcctccccattcctaca

SEQ ID NO: 4345336 - DNA, 18 bp, Homo sapiens
tcctccctgtctctgcat

SEQ ID NO: 4345337 - DNA, 20 bp, Homo sapiens
tcctctctttgttctcagct

SEQ ID NO: 4345338 - DNA, 23 bp, Homo sapiens
tcctctctttgttctcagctccc

SEQ ID NO: 4345339 - DNA, 20 bp, Homo sapiens
tcctgaggctctctaagaaa

SEQ ID NO: 4345340 - DNA, 17 bp, Homo sapiens
tcctgagtggccaggga

SEQ ID NO: 4345341 - DNA, 13 bp, Homo sapiens
tcctgccaggcat

SEQ ID NO: 4345342 - DNA, 14 bp, Homo sapiens
tcctgccaggcatg

SEQ ID NO: 4345343 - DNA, 16 bp, Homo sapiens
tcctgcccagtccccc

SEQ ID NO: 4345344 - DNA, 21 bp, Homo sapiens
tcctgcccagtcccccaaccc

SEQ ID NO: 4345345 - DNA, 17 bp, Homo sapiens
tcctgcctcccgcctcc

SEQ ID NO: 4345346 - DNA, 23 bp, Homo sapiens
tcctggaaacagacagggagaag

SEQ ID NO: 4345347 - DNA, 13 bp, Homo sapiens
tcctggagtctga

SEQ ID NO: 4345348 - DNA, 19 bp, Homo sapiens
tcctggagtctgaagcctg

SEQ ID NO: 4345349 - DNA, 17 bp, Homo sapiens
tcctggcccactgcatc

SEQ ID NO: 4345350 - DNA, 15 bp, Homo sapiens
tcctgtaataaagct

SEQ ID NO: 4345351 - DNA, 13 bp, Homo sapiens
tcctgtccccggc

SEQ ID NO: 4345352 - DNA, 13 bp, Homo sapiens
tcctgtctgttta

SEQ ID NO: 4345353 - DNA, 12 bp, Homo sapiens
tccttaaatgaa

SEQ ID NO: 4345354 - DNA, 14 bp, Homo sapiens
tccttaaatgaact

SEQ ID NO: 4345355 - DNA, 16 bp, Homo sapiens
tccttcactctaaaaa

SEQ ID NO: 4345356 - DNA, 18 bp, Homo sapiens
tccttcactctaaaaata

SEQ ID NO: 4345357 - DNA, 20 bp, Homo sapiens
tccttcactctaaaaataga

SEQ ID NO: 4345358 - DNA, 12 bp, Homo sapiens
tccttccccagc

SEQ ID NO: 4345359 - DNA, 15 bp, Homo sapiens
tccttccccagctcc

SEQ ID NO: 4345360 - DNA, 16 bp, Homo sapiens
tccttccccagctccc

SEQ ID NO: 4345361 - DNA, 17 bp, Homo sapiens
tccttccccagctcccc

SEQ ID NO: 4345362 - DNA, 18 bp, Homo sapiens
tccttccccagctccccc

SEQ ID NO: 4345363 - DNA, 15 bp, Homo sapiens
tccttggttcatgct

SEQ ID NO: 4345364 - DNA, 13 bp, Homo sapiens
tcctttgaggccc

SEQ ID NO: 4345365 - DNA, 14 bp, Homo sapiens
tccttttccttacc

SEQ ID NO: 4345366 - DNA, 17 bp, Homo sapiens
tcgaagacccagcagat

SEQ ID NO: 4345367 - DNA, 15 bp, Homo sapiens
tcgacgtcccttgga

SEQ ID NO: 4345368 - DNA, 15 bp, Homo sapiens
tcgcaactgaaggaa

SEQ ID NO: 4345369 - DNA, 16 bp, Homo sapiens
tcgcaactgaaggaag

SEQ ID NO: 4345370 - DNA, 16 bp, Homo sapiens
tcgccataaaggcccc

SEQ ID NO: 4345371 - DNA, 22 bp, Homo sapiens
tcgcccgagctgtttatgtttt

SEQ ID NO: 4345372 - DNA, 20 bp, Homo sapiens
tcggaggccccaaaggaaaa

SEQ ID NO: 4345373 - DNA, 14 bp, Homo sapiens
tcggctcacaaatt

SEQ ID NO: 4345374 - DNA, 14 bp, Homo sapiens
tcggctgtctcctg

SEQ ID NO: 4345375 - DNA, 15 bp, Homo sapiens
tcggctgtctcctgt

SEQ ID NO: 4345376 - DNA, 16 bp, Homo sapiens
tcggctgtctcctgtc

SEQ ID NO: 4345377 - DNA, 23 bp, Homo sapiens
tcgggaaaaaactttgctccagg

SEQ ID NO: 4345378 - DNA, 14 bp, Homo sapiens
tcgggaattttccc

SEQ ID NO: 4345379 - DNA, 19 bp, Homo sapiens
tcgggaggtcgaggcagga

SEQ ID NO: 4345380 - DNA, 21 bp, Homo sapiens
tcgggaggtcgaggcaggagg

SEQ ID NO: 4345381 - DNA, 12 bp, Homo sapiens
tcgggcatgagt

SEQ ID NO: 4345382 - DNA, 15 bp, Homo sapiens
tcgggcatgagtctg

SEQ ID NO: 4345383 - DNA, 23 bp, Homo sapiens
tcgggcatgagtctgtttcccaa

SEQ ID NO: 4345384 - DNA, 20 bp, Homo sapiens
tcgttttccaaactgactca

SEQ ID NO: 4345385 - DNA, 15 bp, Homo sapiens
tctaaaatggacatt

SEQ ID NO: 4345386 - DNA, 17 bp, Homo sapiens
tctaaaatggacatttt

SEQ ID NO: 4345387 - DNA, 23 bp, Homo sapiens
tctaaagctttatctttgtgtaa

SEQ ID NO: 4345388 - DNA, 13 bp, Homo sapiens
tctaagaaaagag

SEQ ID NO: 4345389 - DNA, 16 bp, Homo sapiens
tctaagtatttgaaac

SEQ ID NO: 4345390 - DNA, 14 bp, Homo sapiens
tctacattattgct

SEQ ID NO: 4345391 - DNA, 21 bp, Homo sapiens
tctacattcttggttgttaat

SEQ ID NO: 4345392 - DNA, 21 bp, Homo sapiens
tctaccctcttagaaaaacca

SEQ ID NO: 4345393 - DNA, 15 bp, Homo sapiens
tctacctctgacttc

SEQ ID NO: 4345394 - DNA, 22 bp, Homo sapiens
tctacgacccttttgagcctag

SEQ ID NO: 4345395 - DNA, 13 bp, Homo sapiens
tctactcaaacac

SEQ ID NO: 4345396 - DNA, 19 bp, Homo sapiens
tctactttttgtatttagt

SEQ ID NO: 4345397 - DNA, 16 bp, Homo sapiens
tctagcatttatttct

SEQ ID NO: 4345398 - DNA, 12 bp, Homo sapiens
tctagtgggaag

SEQ ID NO: 4345399 - DNA, 14 bp, Homo sapiens
tctataaagaaact

SEQ ID NO: 4345400 - DNA, 15 bp, Homo sapiens
tctataaagaaactt

SEQ ID NO: 4345401 - DNA, 16 bp, Homo sapiens
tctataaagaaacttt

SEQ ID NO: 4345402 - DNA, 21 bp, Homo sapiens
tctataaagaaacttttgaaa

SEQ ID NO: 4345403 - DNA, 12 bp, Homo sapiens
tctataaatgac

SEQ ID NO: 4345404 - DNA, 13 bp, Homo sapiens
tctataaatgact

SEQ ID NO: 4345405 - DNA, 18 bp, Homo sapiens
tctataaatgactattgt

SEQ ID NO: 4345406 - DNA, 20 bp, Homo sapiens
tctataaatgactattgtaa

SEQ ID NO: 4345407 - DNA, 21 bp, Homo sapiens
tctataaatgactattgtaat

SEQ ID NO: 4345408 - DNA, 16 bp, Homo sapiens
tctataagtgttcagt

SEQ ID NO: 4345409 - DNA, 22 bp, Homo sapiens
tctataagtgttcagtgttgac

SEQ ID NO: 4345410 - DNA, 22 bp, Homo sapiens
tctatccaaacatgtatttatg

SEQ ID NO: 4345411 - DNA, 14 bp, Homo sapiens
tctatcggaagaac

SEQ ID NO: 4345412 - DNA, 19 bp, Homo sapiens
tctatggagactttgctgt

SEQ ID NO: 4345413 - DNA, 19 bp, Homo sapiens
tctatgtacgataaagtaa

SEQ ID NO: 4345414 - DNA, 14 bp, Homo sapiens
tctcaatatgctta

SEQ ID NO: 4345415 - DNA, 18 bp, Homo sapiens
tctcacaggcagctctga

SEQ ID NO: 4345416 - DNA, 22 bp, Homo sapiens
tctcagcccagaagaaaattct

SEQ ID NO: 4345417 - DNA, 11 bp, Homo sapiens
tctcagctccc

SEQ ID NO: 4345418 - DNA, 12 bp, Homo sapiens
tctcagggcctg

SEQ ID NO: 4345419 - DNA, 15 bp, Homo sapiens
tctcagggcctggtc

SEQ ID NO: 4345420 - DNA, 21 bp, Homo sapiens
tctcagttgcagaaaatgaac

SEQ ID NO: 4345421 - DNA, 18 bp, Homo sapiens
tctcataattcctacagc

SEQ ID NO: 4345422 - DNA, 20 bp, Homo sapiens
tctcataattcctacagcac

SEQ ID NO: 4345423 - DNA, 15 bp, Homo sapiens
tctccaaatcaagga

SEQ ID NO: 4345424 - DNA, 21 bp, Homo sapiens
tctccaaatcaaggatctttt

SEQ ID NO: 4345425 - DNA, 15 bp, Homo sapiens
tctccaattctgaaa

SEQ ID NO: 4345426 - DNA, 15 bp, Homo sapiens
tctccacacggagct

SEQ ID NO: 4345427 - DNA, 13 bp, Homo sapiens
tctcccaggcctc

SEQ ID NO: 4345428 - DNA, 18 bp, Homo sapiens
tctccccaatccatgctt

SEQ ID NO: 4345429 - DNA, 21 bp, Homo sapiens
tctccccaatccatgcttcac

SEQ ID NO: 4345430 - DNA, 22 bp, Homo sapiens
tctccccaatccatgcttcact

SEQ ID NO: 4345431 - DNA, 19 bp, Homo sapiens
tctccctcccccagagccc

SEQ ID NO: 4345432 - DNA, 12 bp, Homo sapiens
tctccctgaggt

SEQ ID NO: 4345433 - DNA, 18 bp, Homo sapiens
tctccctggcaaggagaa

SEQ ID NO: 4345434 - DNA, 14 bp, Homo sapiens
tctcctagacactc

SEQ ID NO: 4345435 - DNA, 14 bp, Homo sapiens
tctcctctgctcat

SEQ ID NO: 4345436 - DNA, 19 bp, Homo sapiens
tctcctctgctcattaaac

SEQ ID NO: 4345437 - DNA, 13 bp, Homo sapiens
tctccttgatttt

SEQ ID NO: 4345438 - DNA, 17 bp, Homo sapiens
tctccttttccttacca

SEQ ID NO: 4345439 - DNA, 14 bp, Homo sapiens
tctcgcaactgaag

SEQ ID NO: 4345440 - DNA, 11 bp, Homo sapiens
tctctatgtac

SEQ ID NO: 4345441 - DNA, 17 bp, Homo sapiens
tctctccacacggagct

SEQ ID NO: 4345442 - DNA, 12 bp, Homo sapiens
tctctctcctgg

SEQ ID NO: 4345443 - DNA, 15 bp, Homo sapiens
tctctctctttttct

SEQ ID NO: 4345444 - DNA, 16 bp, Homo sapiens
tctctcttcagactct

SEQ ID NO: 4345445 - DNA, 23 bp, Homo sapiens
tctctctttttcttttctatgga

SEQ ID NO: 4345446 - DNA, 13 bp, Homo sapiens
tctctgcatctga

SEQ ID NO: 4345447 - DNA, 12 bp, Homo sapiens
tctctgcctggc

SEQ ID NO: 4345448 - DNA, 23 bp, Homo sapiens
tctctgcctggcaacatcttact

SEQ ID NO: 4345449 - DNA, 16 bp, Homo sapiens
tctctggggcaggctg

SEQ ID NO: 4345450 - DNA, 20 bp, Homo sapiens
tctctggggcaggctgcttc

SEQ ID NO: 4345451 - DNA, 18 bp, Homo sapiens
tctcttaaacttgtgaat

SEQ ID NO: 4345452 - DNA, 20 bp, Homo sapiens
tctcttctttattgcactag

SEQ ID NO: 4345453 - DNA, 14 bp, Homo sapiens
tctcttgagcctgg

SEQ ID NO: 4345454 - DNA, 22 bp, Homo sapiens
tctcttggaaatgttaagaaag

SEQ ID NO: 4345455 - DNA, 21 bp, Homo sapiens
tctgaaaggctatcctgctga

SEQ ID NO: 4345456 - DNA, 14 bp, Homo sapiens
tctgaaataaaaat

SEQ ID NO: 4345457 - DNA, 16 bp, Homo sapiens
tctgaaataaaaatta

SEQ ID NO: 4345458 - DNA, 15 bp, Homo sapiens
tctgaactggagctg

SEQ ID NO: 4345459 - DNA, 18 bp, Homo sapiens
tctgaactggagctgcta

SEQ ID NO: 4345460 - DNA, 21 bp, Homo sapiens
tctgactgatggtttggaaaa

SEQ ID NO: 4345461 - DNA, 23 bp, Homo sapiens
tctgacttccgtcccactgaagg

SEQ ID NO: 4345462 - DNA, 18 bp, Homo sapiens
tctgagtgagttttactc

SEQ ID NO: 4345463 - DNA, 14 bp, Homo sapiens
tctgatcaatcatt

SEQ ID NO: 4345464 - DNA, 19 bp, Homo sapiens
tctgatctgtactttgtgt

SEQ ID NO: 4345465 - DNA, 22 bp, Homo sapiens
tctgattataccatgtgtgcta

SEQ ID NO: 4345466 - DNA, 18 bp, Homo sapiens
tctgcaaagaatgagaag

SEQ ID NO: 4345467 - DNA, 21 bp, Homo sapiens
tctgcaagaattgaagcagga

SEQ ID NO: 4345468 - DNA, 14 bp, Homo sapiens
tctgcagcaactcc

SEQ ID NO: 4345469 - DNA, 17 bp, Homo sapiens
tctgcagcaactcccac

SEQ ID NO: 4345470 - DNA, 17 bp, Homo sapiens
tctgcattgagaaggaa

SEQ ID NO: 4345471 - DNA, 18 bp, Homo sapiens
tctgcattgagaaggaac

SEQ ID NO: 4345472 - DNA, 16 bp, Homo sapiens
tctgcccagccctctg

SEQ ID NO: 4345473 - DNA, 21 bp, Homo sapiens
tctgccgctttgtctgtccag

SEQ ID NO: 4345474 - DNA, 19 bp, Homo sapiens
tctgcctccaacccagcag

SEQ ID NO: 4345475 - DNA, 20 bp, Homo sapiens
tctgcctccaacccagcagt

SEQ ID NO: 4345476 - DNA, 23 bp, Homo sapiens
tctgcctgggatgcccttccccc

SEQ ID NO: 4345477 - DNA, 17 bp, Homo sapiens
tctgcctggttttattt

SEQ ID NO: 4345478 - DNA, 20 bp, Homo sapiens
tctgctcggcttcttggacc

SEQ ID NO: 4345479 - DNA, 15 bp, Homo sapiens
tctggaggggcccct

SEQ ID NO: 4345480 - DNA, 17 bp, Homo sapiens
tctggaggggcccctgc

SEQ ID NO: 4345481 - DNA, 21 bp, Homo sapiens
tctggcacgtggccaggagcc

SEQ ID NO: 4345482 - DNA, 17 bp, Homo sapiens
tctgggagacttactgc

SEQ ID NO: 4345483 - DNA, 15 bp, Homo sapiens
tctgggatctgccaa

SEQ ID NO: 4345484 - DNA, 12 bp, Homo sapiens
tctgggcctctg

SEQ ID NO: 4345485 - DNA, 14 bp, Homo sapiens
tctgtcaatgaaaa

SEQ ID NO: 4345486 - DNA, 16 bp, Homo sapiens
tctgtccagccgtgtg

SEQ ID NO: 4345487 - DNA, 22 bp, Homo sapiens
tctgtccagccgtgtgtgcatg

SEQ ID NO: 4345488 - DNA, 19 bp, Homo sapiens
tctgtccgagctttgaaaa

SEQ ID NO: 4345489 - DNA, 21 bp, Homo sapiens
tctgtctctctctctttttct

SEQ ID NO: 4345490 - DNA, 15 bp, Homo sapiens
tctgtgattacctct

SEQ ID NO: 4345491 - DNA, 17 bp, Homo sapiens
tctgtgattacctctca

SEQ ID NO: 4345492 - DNA, 18 bp, Homo sapiens
tctgtgcacactaagaaa

SEQ ID NO: 4345493 - DNA, 12 bp, Homo sapiens
tctgtgcatgtg

SEQ ID NO: 4345494 - DNA, 14 bp, Homo sapiens
tctgtggccaggag

SEQ ID NO: 4345495 - DNA, 16 bp, Homo sapiens
tctgtggccaggagcc

SEQ ID NO: 4345496 - DNA, 15 bp, Homo sapiens
tctgtgtctgctctc

SEQ ID NO: 4345497 - DNA, 16 bp, Homo sapiens
tctgtgtctggcaggc

SEQ ID NO: 4345498 - DNA, 12 bp, Homo sapiens
tctgtgttgctt

SEQ ID NO: 4345499 - DNA, 19 bp, Homo sapiens
tctgttcagttaagttctt

SEQ ID NO: 4345500 - DNA, 15 bp, Homo sapiens
tcttaaacttgtgaa

SEQ ID NO: 4345501 - DNA, 13 bp, Homo sapiens
tcttaaatcattt

SEQ ID NO: 4345502 - DNA, 18 bp, Homo sapiens
tcttaaatcatttggtta

SEQ ID NO: 4345503 - DNA, 23 bp, Homo sapiens
tcttaacacatgtccttgtgtgt

SEQ ID NO: 4345504 - DNA, 13 bp, Homo sapiens
tcttaactgtatt

SEQ ID NO: 4345505 - DNA, 16 bp, Homo sapiens
tcttaactgtatttca

SEQ ID NO: 4345506 - DNA, 17 bp, Homo sapiens
tcttaactgtatttcag

SEQ ID NO: 4345507 - DNA, 22 bp, Homo sapiens
tcttaatgtctgtcagaagaca

SEQ ID NO: 4345508 - DNA, 16 bp, Homo sapiens
tcttaattttaaagac

SEQ ID NO: 4345509 - DNA, 17 bp, Homo sapiens
tcttacaaccaagaaca

SEQ ID NO: 4345510 - DNA, 17 bp, Homo sapiens
tcttaccctctctttca

SEQ ID NO: 4345511 - DNA, 19 bp, Homo sapiens
tcttagtatagtagaaaga

SEQ ID NO: 4345512 - DNA, 23 bp, Homo sapiens
tcttagtccctaatcatgtttct

SEQ ID NO: 4345513 - DNA, 19 bp, Homo sapiens
tcttagtgcttcagagttt

SEQ ID NO: 4345514 - DNA, 13 bp, Homo sapiens
tcttatgatttta

SEQ ID NO: 4345515 - DNA, 17 bp, Homo sapiens
tcttatgattttattac

SEQ ID NO: 4345516 - DNA, 22 bp, Homo sapiens
tcttcagactctcagcccagaa

SEQ ID NO: 4345517 - DNA, 18 bp, Homo sapiens
tcttcccccgctaattca

SEQ ID NO: 4345518 - DNA, 23 bp, Homo sapiens
tcttctccaattctgaaatactt

SEQ ID NO: 4345519 - DNA, 16 bp, Homo sapiens
tcttgcactgtccagc

SEQ ID NO: 4345520 - DNA, 20 bp, Homo sapiens
tcttggaaatgttaagaaag

SEQ ID NO: 4345521 - DNA, 15 bp, Homo sapiens
tcttggaccttggcg

SEQ ID NO: 4345522 - DNA, 14 bp, Homo sapiens
tcttggtattctta

SEQ ID NO: 4345523 - DNA, 18 bp, Homo sapiens
tcttggtcaagtttttct

SEQ ID NO: 4345524 - DNA, 21 bp, Homo sapiens
tcttggtctctatagcagtgt

SEQ ID NO: 4345525 - DNA, 22 bp, Homo sapiens
tcttgtccatgtggttcttcaa

SEQ ID NO: 4345526 - DNA, 16 bp, Homo sapiens
tcttgtgatgtattct

SEQ ID NO: 4345527 - DNA, 18 bp, Homo sapiens
tcttgttattaatgtttc

SEQ ID NO: 4345528 - DNA, 13 bp, Homo sapiens
tctttcctccctt

SEQ ID NO: 4345529 - DNA, 23 bp, Homo sapiens
tctttctacaaagcactagagaa

SEQ ID NO: 4345530 - DNA, 13 bp, Homo sapiens
tctttctggagtc

SEQ ID NO: 4345531 - DNA, 21 bp, Homo sapiens
tctttgcattccttacttgca

SEQ ID NO: 4345532 - DNA, 12 bp, Homo sapiens
tctttgcctggt

SEQ ID NO: 4345533 - DNA, 16 bp, Homo sapiens
tctttgtagaataaat

SEQ ID NO: 4345534 - DNA, 15 bp, Homo sapiens
tctttgtgcagtgtt

SEQ ID NO: 4345535 - DNA, 15 bp, Homo sapiens
tctttgtgtaatcta

SEQ ID NO: 4345536 - DNA, 20 bp, Homo sapiens
tctttgttctcagctccccc

SEQ ID NO: 4345537 - DNA, 22 bp, Homo sapiens
tctttgttctcagctccccctg

SEQ ID NO: 4345538 - DNA, 16 bp, Homo sapiens
tctttgtttaaatgcc

SEQ ID NO: 4345539 - DNA, 14 bp, Homo sapiens
tctttttcttttct

SEQ ID NO: 4345540 - DNA, 13 bp, Homo sapiens
tcttttttaaagt

SEQ ID NO: 4345541 - DNA, 17 bp, Homo sapiens
tctttttttccttcctt

SEQ ID NO: 4345542 - DNA, 20 bp, Homo sapiens
tgaaaaaggaggaagagaaa

SEQ ID NO: 4345543 - DNA, 16 bp, Homo sapiens
tgaaaaagtgtacatg

SEQ ID NO: 4345544 - DNA, 19 bp, Homo sapiens
tgaaaacactaacaaaatt

SEQ ID NO: 4345545 - DNA, 23 bp, Homo sapiens
tgaaaacactaacaaaatttgaa

SEQ ID NO: 4345546 - DNA, 15 bp, Homo sapiens
tgaaaactgacatca

SEQ ID NO: 4345547 - DNA, 17 bp, Homo sapiens
tgaaaactgacatcaga

SEQ ID NO: 4345548 - DNA, 20 bp, Homo sapiens
tgaaaactgacatcagattt

SEQ ID NO: 4345549 - DNA, 21 bp, Homo sapiens
tgaaaactgacatcagatttc

SEQ ID NO: 4345550 - DNA, 23 bp, Homo sapiens
tgaaaactgacatcagatttctt

SEQ ID NO: 4345551 - DNA, 15 bp, Homo sapiens
tgaaaagaaaaatga

SEQ ID NO: 4345552 - DNA, 19 bp, Homo sapiens
tgaaaagaaaaatgagcct

SEQ ID NO: 4345553 - DNA, 12 bp, Homo sapiens
tgaaaagtcgtt

SEQ ID NO: 4345554 - DNA, 20 bp, Homo sapiens
tgaaaattcgcccgagctgt

SEQ ID NO: 4345555 - DNA, 21 bp, Homo sapiens
tgaaaattcgcccgagctgtt

SEQ ID NO: 4345556 - DNA, 22 bp, Homo sapiens
tgaaaattcgcccgagctgttt

SEQ ID NO: 4345557 - DNA, 19 bp, Homo sapiens
tgaaacatgtgcccctgcc

SEQ ID NO: 4345558 - DNA, 22 bp, Homo sapiens
tgaaacatgtgcccctgccaag

SEQ ID NO: 4345559 - DNA, 22 bp, Homo sapiens
tgaaagacaggagtttatctat

SEQ ID NO: 4345560 - DNA, 14 bp, Homo sapiens
tgaaagttgctttt

SEQ ID NO: 4345561 - DNA, 18 bp, Homo sapiens
tgaaagttgcttttattg

SEQ ID NO: 4345562 - DNA, 11 bp, Homo sapiens
tgaaataattt

SEQ ID NO: 4345563 - DNA, 22 bp, Homo sapiens
tgaaccccctttccccacacct

SEQ ID NO: 4345564 - DNA, 13 bp, Homo sapiens
tgaaccctttgtt

SEQ ID NO: 4345565 - DNA, 13 bp, Homo sapiens
tgaactactgcta

SEQ ID NO: 4345566 - DNA, 17 bp, Homo sapiens
tgaactgggcatttcac

SEQ ID NO: 4345567 - DNA, 11 bp, Homo sapiens
tgaagaattgt

SEQ ID NO: 4345568 - DNA, 14 bp, Homo sapiens
tgaagcaccaggga

SEQ ID NO: 4345569 - DNA, 21 bp, Homo sapiens
tgaagcaccagggagaggcct

SEQ ID NO: 4345570 - DNA, 14 bp, Homo sapiens
tgaagcagaggaag

SEQ ID NO: 4345571 - DNA, 16 bp, Homo sapiens
tgaagcagaggaagga

SEQ ID NO: 4345572 - DNA, 23 bp, Homo sapiens
tgaagcagaggaaggaaacatag

SEQ ID NO: 4345573 - DNA, 22 bp, Homo sapiens
tgaagctggccctcagctccct

SEQ ID NO: 4345574 - DNA, 17 bp, Homo sapiens
tgaaggacatgagacta

SEQ ID NO: 4345575 - DNA, 16 bp, Homo sapiens
tgaaggattaatgaaa

SEQ ID NO: 4345576 - DNA, 22 bp, Homo sapiens
tgaaggctgctgcaagtcattg

SEQ ID NO: 4345577 - DNA, 21 bp, Homo sapiens
tgaagggaacagcctgagccg

SEQ ID NO: 4345578 - DNA, 20 bp, Homo sapiens
tgaagtacagtcccagcaca

SEQ ID NO: 4345579 - DNA, 13 bp, Homo sapiens
tgaagtataaatc

SEQ ID NO: 4345580 - DNA, 20 bp, Homo sapiens
tgaagtgttttgttctttct

SEQ ID NO: 4345581 - DNA, 18 bp, Homo sapiens
tgaagtttgaacttcata

SEQ ID NO: 4345582 - DNA, 14 bp, Homo sapiens
tgaatcatgtctgt

SEQ ID NO: 4345583 - DNA, 17 bp, Homo sapiens
tgaatctggacatttgt

SEQ ID NO: 4345584 - DNA, 23 bp, Homo sapiens
tgaatgatgatcctaggcatttg

SEQ ID NO: 4345585 - DNA, 23 bp, Homo sapiens
tgaatgctgagctgaagaaatta

SEQ ID NO: 4345586 - DNA, 21 bp, Homo sapiens
tgaatgttgtctgtttgttct

SEQ ID NO: 4345587 - DNA, 22 bp, Homo sapiens
tgaatgtttagtgtgctgctgt

SEQ ID NO: 4345588 - DNA, 18 bp, Homo sapiens
tgaattaccatagagtaa

SEQ ID NO: 4345589 - DNA, 13 bp, Homo sapiens
tgaatttggactt

SEQ ID NO: 4345590 - DNA, 21 bp, Homo sapiens
tgacaagctaggaaagaggag

SEQ ID NO: 4345591 - DNA, 16 bp, Homo sapiens
tgacacagcttgtgaa

SEQ ID NO: 4345592 - DNA, 12 bp, Homo sapiens
tgacacgcttca

SEQ ID NO: 4345593 - DNA, 13 bp, Homo sapiens
tgacatagccttt

SEQ ID NO: 4345594 - DNA, 22 bp, Homo sapiens
tgacatcagatttcttaatgtc

SEQ ID NO: 4345595 - DNA, 20 bp, Homo sapiens
tgaccattgaaaaaggaaaa

SEQ ID NO: 4345596 - DNA, 21 bp, Homo sapiens
tgaccattgaaaaaggaaaaa

SEQ ID NO: 4345597 - DNA, 19 bp, Homo sapiens
tgacccctttcccccaccc

SEQ ID NO: 4345598 - DNA, 20 bp, Homo sapiens
tgacctcccacctatccgcc

SEQ ID NO: 4345599 - DNA, 14 bp, Homo sapiens
tgacgcaatgaaaa

SEQ ID NO: 4345600 - DNA, 20 bp, Homo sapiens
tgactattttttaataaaag

SEQ ID NO: 4345601 - DNA, 18 bp, Homo sapiens
tgactccagtataatctc

SEQ ID NO: 4345602 - DNA, 15 bp, Homo sapiens
tgactcgtgctgcat

SEQ ID NO: 4345603 - DNA, 16 bp, Homo sapiens
tgactggttgtcagaa

SEQ ID NO: 4345604 - DNA, 18 bp, Homo sapiens
tgactgtgaactgggcat

SEQ ID NO: 4345605 - DNA, 20 bp, Homo sapiens
tgacttaggtaaaataaaag

SEQ ID NO: 4345606 - DNA, 23 bp, Homo sapiens
tgactttatttattgcttagtga

SEQ ID NO: 4345607 - DNA, 22 bp, Homo sapiens
tgacttttctgtccgagctttg

SEQ ID NO: 4345608 - DNA, 20 bp, Homo sapiens
tgagaaatcagaattggcat

SEQ ID NO: 4345609 - DNA, 21 bp, Homo sapiens
tgagaaggaactgatacatct

SEQ ID NO: 4345610 - DNA, 23 bp, Homo sapiens
tgagaaggaactgatacatctga

SEQ ID NO: 4345611 - DNA, 22 bp, Homo sapiens
tgagaaggagtcagaaactgtt

SEQ ID NO: 4345612 - DNA, 19 bp, Homo sapiens
tgagaataattatttcaga

SEQ ID NO: 4345613 - DNA, 20 bp, Homo sapiens
tgagaatctgtgcagtcatc

SEQ ID NO: 4345614 - DNA, 18 bp, Homo sapiens
tgagaccagaagaaaaga

SEQ ID NO: 4345615 - DNA, 13 bp, Homo sapiens
tgagaccagaagg

SEQ ID NO: 4345616 - DNA, 19 bp, Homo sapiens
tgagagtatattatgtatt

SEQ ID NO: 4345617 - DNA, 22 bp, Homo sapiens
tgagattttggaagaagttttt

SEQ ID NO: 4345618 - DNA, 17 bp, Homo sapiens
tgagccagcccaagggc

SEQ ID NO: 4345619 - DNA, 13 bp, Homo sapiens
tgagccccagccc

SEQ ID NO: 4345620 - DNA, 22 bp, Homo sapiens
tgagcccccttcctgtccccag

SEQ ID NO: 4345621 - DNA, 13 bp, Homo sapiens
tgagcctgcccag

SEQ ID NO: 4345622 - DNA, 23 bp, Homo sapiens
tgagcctgcccagttggaggaga

SEQ ID NO: 4345623 - DNA, 10 bp, Homo sapiens
tgagcctggc

SEQ ID NO: 4345624 - DNA, 14 bp, Homo sapiens
tgagcctgggaggt

SEQ ID NO: 4345625 - DNA, 12 bp, Homo sapiens
tgagcctgtcca

SEQ ID NO: 4345626 - DNA, 18 bp, Homo sapiens
tgagcgtgtccacagagt

SEQ ID NO: 4345627 - DNA, 19 bp, Homo sapiens
tgagctcaggagtttgaga

SEQ ID NO: 4345628 - DNA, 14 bp, Homo sapiens
tgagctgaagaaat

SEQ ID NO: 4345629 - DNA, 20 bp, Homo sapiens
tgagctttctgtgcatgtgc

SEQ ID NO: 4345630 - DNA, 19 bp, Homo sapiens
tgaggaactgtacagaaaa

SEQ ID NO: 4345631 - DNA, 14 bp, Homo sapiens
tgaggactgaagct

SEQ ID NO: 4345632 - DNA, 21 bp, Homo sapiens
tgaggactgaagctggggctt

SEQ ID NO: 4345633 - DNA, 16 bp, Homo sapiens
tgaggctctctaagaa

SEQ ID NO: 4345634 - DNA, 18 bp, Homo sapiens
tgaggctctctaagaaaa

SEQ ID NO: 4345635 - DNA, 20 bp, Homo sapiens
tgaggctctctaagaaaaga

SEQ ID NO: 4345636 - DNA, 13 bp, Homo sapiens
tgaggctgggcag

SEQ ID NO: 4345637 - DNA, 17 bp, Homo sapiens
tgaggctgggcagggcc

SEQ ID NO: 4345638 - DNA, 15 bp, Homo sapiens
tgaggggaggggggc

SEQ ID NO: 4345639 - DNA, 20 bp, Homo sapiens
tgaggggtttcttttggaaa

SEQ ID NO: 4345640 - DNA, 22 bp, Homo sapiens
tgaggggtttcttttggaaata

SEQ ID NO: 4345641 - DNA, 17 bp, Homo sapiens
tgaggtagaggaaaatc

SEQ ID NO: 4345642 - DNA, 18 bp, Homo sapiens
tgaggtagaggaaaatca

SEQ ID NO: 4345643 - DNA, 20 bp, Homo sapiens
tgaggttagcccaatggaga

SEQ ID NO: 4345644 - DNA, 22 bp, Homo sapiens
tgagtctctggggcaggctgct

SEQ ID NO: 4345645 - DNA, 18 bp, Homo sapiens
tgagtctgtttcccaagc

SEQ ID NO: 4345646 - DNA, 13 bp, Homo sapiens
tgagtcttaactg

SEQ ID NO: 4345647 - DNA, 12 bp, Homo sapiens
tgagtgccatgc

SEQ ID NO: 4345648 - DNA, 14 bp, Homo sapiens
tgagtgccatgctt

SEQ ID NO: 4345649 - DNA, 15 bp, Homo sapiens
tgagtgccatgcttt

SEQ ID NO: 4345650 - DNA, 15 bp, Homo sapiens
tgagtgctatgtgtg

SEQ ID NO: 4345651 - DNA, 11 bp, Homo sapiens
tgagtgtgtgt

SEQ ID NO: 4345652 - DNA, 18 bp, Homo sapiens
tgagttacttagaatgcc

SEQ ID NO: 4345653 - DNA, 16 bp, Homo sapiens
tgagttgattcagctc

SEQ ID NO: 4345654 - DNA, 13 bp, Homo sapiens
tgagtttgcttat

SEQ ID NO: 4345655 - DNA, 18 bp, Homo sapiens
tgatacctattaaaggaa

SEQ ID NO: 4345656 - DNA, 20 bp, Homo sapiens
tgatagcatggggcccctgg

SEQ ID NO: 4345657 - DNA, 16 bp, Homo sapiens
tgatatgctgagaaat

SEQ ID NO: 4345658 - DNA, 17 bp, Homo sapiens
tgatatgctgagaaatt

SEQ ID NO: 4345659 - DNA, 18 bp, Homo sapiens
tgatatgctgagaaatta

SEQ ID NO: 4345660 - DNA, 20 bp, Homo sapiens
tgatatgctgagaaattatt

SEQ ID NO: 4345661 - DNA, 19 bp, Homo sapiens
tgatcaatcattttggagg

SEQ ID NO: 4345662 - DNA, 16 bp, Homo sapiens
tgatcagatgctgaat

SEQ ID NO: 4345663 - DNA, 19 bp, Homo sapiens
tgatcataggtatttcaaa

SEQ ID NO: 4345664 - DNA, 20 bp, Homo sapiens
tgatccatagtgctacctgc

SEQ ID NO: 4345665 - DNA, 16 bp, Homo sapiens
tgatctgtactttgtg

SEQ ID NO: 4345666 - DNA, 17 bp, Homo sapiens
tgatctgtactttgtgt

SEQ ID NO: 4345667 - DNA, 22 bp, Homo sapiens
tgatctttgtttaaatgccaaa

SEQ ID NO: 4345668 - DNA, 12 bp, Homo sapiens
tgatgagacctg

SEQ ID NO: 4345669 - DNA, 21 bp, Homo sapiens
tgatgccgaacattaggaatt

SEQ ID NO: 4345670 - DNA, 23 bp, Homo sapiens
tgatgccgaacattaggaattgt

SEQ ID NO: 4345671 - DNA, 14 bp, Homo sapiens
tgatggaaaaatca

SEQ ID NO: 4345672 - DNA, 15 bp, Homo sapiens
tgatggaaaaatcac

SEQ ID NO: 4345673 - DNA, 11 bp, Homo sapiens
tgatgtttaca

SEQ ID NO: 4345674 - DNA, 19 bp, Homo sapiens
tgattaccagtctgattat

SEQ ID NO: 4345675 - DNA, 11 bp, Homo sapiens
tgattagatga

SEQ ID NO: 4345676 - DNA, 19 bp, Homo sapiens
tgattataccatgtgtgct

SEQ ID NO: 4345677 - DNA, 14 bp, Homo sapiens
tgattcagctctgc

SEQ ID NO: 4345678 - DNA, 20 bp, Homo sapiens
tgattgaaagaaaaaaaaat

SEQ ID NO: 4345679 - DNA, 15 bp, Homo sapiens
tgattggttcagttt

SEQ ID NO: 4345680 - DNA, 18 bp, Homo sapiens
tgatttacaggacttctc

SEQ ID NO: 4345681 - DNA, 18 bp, Homo sapiens
tgatttagaagcaaagat

SEQ ID NO: 4345682 - DNA, 23 bp, Homo sapiens
tgatttcccttttttcttccccc

SEQ ID NO: 4345683 - DNA, 15 bp, Homo sapiens
tgatttgatctttgt

SEQ ID NO: 4345684 - DNA, 22 bp, Homo sapiens
tgattttattacagaaatgttt

SEQ ID NO: 4345685 - DNA, 16 bp, Homo sapiens
tgatttttaacctcaa

SEQ ID NO: 4345686 - DNA, 23 bp, Homo sapiens
tgcaaaatagaagaagaggaagt

SEQ ID NO: 4345687 - DNA, 20 bp, Homo sapiens
tgcaaacccatgaagctggc

SEQ ID NO: 4345688 - DNA, 16 bp, Homo sapiens
tgcaaactgctttatt

SEQ ID NO: 4345689 - DNA, 13 bp, Homo sapiens
tgcaaataaagcc

SEQ ID NO: 4345690 - DNA, 22 bp, Homo sapiens
tgcaaatattggttagtattta

SEQ ID NO: 4345691 - DNA, 20 bp, Homo sapiens
tgcaagaatttctggaagaa

SEQ ID NO: 4345692 - DNA, 22 bp, Homo sapiens
tgcaagaatttctggaagaaag

SEQ ID NO: 4345693 - DNA, 23 bp, Homo sapiens
tgcaagattttttttttaagtga

SEQ ID NO: 4345694 - DNA, 14 bp, Homo sapiens
tgcacaagctgcac

SEQ ID NO: 4345695 - DNA, 18 bp, Homo sapiens
tgcacaagctgcaccctc

SEQ ID NO: 4345696 - DNA, 17 bp, Homo sapiens
tgcacaaggattgaaaa

SEQ ID NO: 4345697 - DNA, 19 bp, Homo sapiens
tgcacaaggattgaaaatt

SEQ ID NO: 4345698 - DNA, 16 bp, Homo sapiens
tgcacagatatacttt

SEQ ID NO: 4345699 - DNA, 19 bp, Homo sapiens
tgcacagatatactttgtg

SEQ ID NO: 4345700 - DNA, 16 bp, Homo sapiens
tgcaccctcaggcagg

SEQ ID NO: 4345701 - DNA, 16 bp, Homo sapiens
tgcacctgagcctgtt

SEQ ID NO: 4345702 - DNA, 16 bp, Homo sapiens
tgcactaggaattctt

SEQ ID NO: 4345703 - DNA, 21 bp, Homo sapiens
tgcactaggaattctttgcat

SEQ ID NO: 4345704 - DNA, 23 bp, Homo sapiens
tgcactaggaattctttgcattc

SEQ ID NO: 4345705 - DNA, 15 bp, Homo sapiens
tgcactccagcctgg

SEQ ID NO: 4345706 - DNA, 13 bp, Homo sapiens
tgcactgtccagc

SEQ ID NO: 4345707 - DNA, 22 bp, Homo sapiens
tgcactgttactcttaatttta

SEQ ID NO: 4345708 - DNA, 17 bp, Homo sapiens
tgcacttagtagttttt

SEQ ID NO: 4345709 - DNA, 12 bp, Homo sapiens
tgcagacaattc

SEQ ID NO: 4345710 - DNA, 14 bp, Homo sapiens
tgcagatgccaaaa

SEQ ID NO: 4345711 - DNA, 17 bp, Homo sapiens
tgcagcaactcccacga

SEQ ID NO: 4345712 - DNA, 20 bp, Homo sapiens
tgcagcaactcccacgactg

SEQ ID NO: 4345713 - DNA, 14 bp, Homo sapiens
tgcagcccttcctc

SEQ ID NO: 4345714 - DNA, 16 bp, Homo sapiens
tgcagcccttcctccc

SEQ ID NO: 4345715 - DNA, 16 bp, Homo sapiens
tgcagggcctggcata

SEQ ID NO: 4345716 - DNA, 15 bp, Homo sapiens
tgcagtttcatgtat

SEQ ID NO: 4345717 - DNA, 18 bp, Homo sapiens
tgcagtttcatgtatgta

SEQ ID NO: 4345718 - DNA, 15 bp, Homo sapiens
tgcataaaattctag

SEQ ID NO: 4345719 - DNA, 19 bp, Homo sapiens
tgcataacctttacactcc

SEQ ID NO: 4345720 - DNA, 12 bp, Homo sapiens
tgcataatacta

SEQ ID NO: 4345721 - DNA, 23 bp, Homo sapiens
tgcatatgctacacatatgtgct

SEQ ID NO: 4345722 - DNA, 23 bp, Homo sapiens
tgcatatgttaaagcttattttt

SEQ ID NO: 4345723 - DNA, 19 bp, Homo sapiens
tgcatccacttcaggagcc

SEQ ID NO: 4345724 - DNA, 15 bp, Homo sapiens
tgcatcgtttcatct

SEQ ID NO: 4345725 - DNA, 12 bp, Homo sapiens
tgcatctgactc

SEQ ID NO: 4345726 - DNA, 18 bp, Homo sapiens
tgcattcattctgagccc

SEQ ID NO: 4345727 - DNA, 21 bp, Homo sapiens
tgcattccttacttgcactgt

SEQ ID NO: 4345728 - DNA, 16 bp, Homo sapiens
tgcatttaaactctgc

SEQ ID NO: 4345729 - DNA, 14 bp, Homo sapiens
tgcatttgctgttg

SEQ ID NO: 4345730 - DNA, 15 bp, Homo sapiens
tgcattttcttcaga

SEQ ID NO: 4345731 - DNA, 18 bp, Homo sapiens
tgccaagctaatctgcct

SEQ ID NO: 4345732 - DNA, 22 bp, Homo sapiens
tgccacacctcgaactggttgt

SEQ ID NO: 4345733 - DNA, 18 bp, Homo sapiens
tgccacaggcctccctgt

SEQ ID NO: 4345734 - DNA, 23 bp, Homo sapiens
tgccacaggcctccctgtttgaa

SEQ ID NO: 4345735 - DNA, 23 bp, Homo sapiens
tgccacgtgccattgtctttcct

SEQ ID NO: 4345736 - DNA, 17 bp, Homo sapiens
tgccactcattcctgta

SEQ ID NO: 4345737 - DNA, 21 bp, Homo sapiens
tgccagtgctaagctgccctg

SEQ ID NO: 4345738 - DNA, 22 bp, Homo sapiens
tgccagtggagacggaatctgc

SEQ ID NO: 4345739 - DNA, 23 bp, Homo sapiens
tgccagtggagacggaatctgcc

SEQ ID NO: 4345740 - DNA, 16 bp, Homo sapiens
tgccataccttctccc

SEQ ID NO: 4345741 - DNA, 17 bp, Homo sapiens
tgccataccttctccca

SEQ ID NO: 4345742 - DNA, 20 bp, Homo sapiens
tgccataccttctcccaggc

SEQ ID NO: 4345743 - DNA, 23 bp, Homo sapiens
tgccataccttctcccaggcctc

SEQ ID NO: 4345744 - DNA, 20 bp, Homo sapiens
tgccatgcccttacacgtgc

SEQ ID NO: 4345745 - DNA, 18 bp, Homo sapiens
tgccattgtctttcctcc

SEQ ID NO: 4345746 - DNA, 21 bp, Homo sapiens
tgccattgtctttcctccctt

SEQ ID NO: 4345747 - DNA, 23 bp, Homo sapiens
tgcccaacaccagcccctgcccc

SEQ ID NO: 4345748 - DNA, 20 bp, Homo sapiens
tgcccaccgaggagccccag

SEQ ID NO: 4345749 - DNA, 18 bp, Homo sapiens
tgcccagccctctgtggc

SEQ ID NO: 4345750 - DNA, 21 bp, Homo sapiens
tgcccagccctctgtggccag

SEQ ID NO: 4345751 - DNA, 14 bp, Homo sapiens
tgcccagtccccca

SEQ ID NO: 4345752 - DNA, 22 bp, Homo sapiens
tgcccagtcccccaaccccagc

SEQ ID NO: 4345753 - DNA, 22 bp, Homo sapiens
tgcccagttggaggagactggg

SEQ ID NO: 4345754 - DNA, 24 bp, Homo sapiens
tgccccaagagcaggaggtgcctg

SEQ ID NO: 4345755 - DNA, 16 bp, Homo sapiens
tgccccagcccaagtc

SEQ ID NO: 4345756 - DNA, 17 bp, Homo sapiens
tgccccagcgtcttgac

SEQ ID NO: 4345757 - DNA, 11 bp, Homo sapiens
tgcccctgcca

SEQ ID NO: 4345758 - DNA, 17 bp, Homo sapiens
tgcccgccctccaccca

SEQ ID NO: 4345759 - DNA, 18 bp, Homo sapiens
tgcccgccctccacccac

SEQ ID NO: 4345760 - DNA, 22 bp, Homo sapiens
tgcccgccctccacccactagg

SEQ ID NO: 4345761 - DNA, 16 bp, Homo sapiens
tgcccggtgcagggcc

SEQ ID NO: 4345762 - DNA, 22 bp, Homo sapiens
tgcccggtgcagggcctggcat

SEQ ID NO: 4345763 - DNA, 19 bp, Homo sapiens
tgcccttacacgtgcgtgt

SEQ ID NO: 4345764 - DNA, 14 bp, Homo sapiens
tgcccttgcccttg

SEQ ID NO: 4345765 - DNA, 13 bp, Homo sapiens
tgcccttgtctga

SEQ ID NO: 4345766 - DNA, 15 bp, Homo sapiens
tgccgctttgtctgt

SEQ ID NO: 4345767 - DNA, 19 bp, Homo sapiens
tgccgctttgtctgtccag

SEQ ID NO: 4345768 - DNA, 20 bp, Homo sapiens
tgccgctttgtctgtccagc

SEQ ID NO: 4345769 - DNA, 22 bp, Homo sapiens
tgccgtcctggactctgtgtga

SEQ ID NO: 4345770 - DNA, 16 bp, Homo sapiens
tgcctgctgggtgcca

SEQ ID NO: 4345771 - DNA, 11 bp, Homo sapiens
tgcctggcaac

SEQ ID NO: 4345772 - DNA, 16 bp, Homo sapiens
tgcctgggatgccctt

SEQ ID NO: 4345773 - DNA, 15 bp, Homo sapiens
tgcctggttcgtgcc

SEQ ID NO: 4345774 - DNA, 17 bp, Homo sapiens
tgcctggttttatttat

SEQ ID NO: 4345775 - DNA, 18 bp, Homo sapiens
tgcctgttttgagaccag

SEQ ID NO: 4345776 - DNA, 19 bp, Homo sapiens
tgcctgttttgagaccaga

SEQ ID NO: 4345777 - DNA, 16 bp, Homo sapiens
tgccttcgggaaaatt

SEQ ID NO: 4345778 - DNA, 19 bp, Homo sapiens
tgccttcgggaaaattcaa

SEQ ID NO: 4345779 - DNA, 15 bp, Homo sapiens
tgccttttaagtttg

SEQ ID NO: 4345780 - DNA, 19 bp, Homo sapiens
tgcgaaaggatgaaagtga

SEQ ID NO: 4345781 - DNA, 14 bp, Homo sapiens
tgcggctgccgggc

SEQ ID NO: 4345782 - DNA, 14 bp, Homo sapiens
tgcgtactccactg

SEQ ID NO: 4345783 - DNA, 23 bp, Homo sapiens
tgcgtctggaggggcccctgctt

SEQ ID NO: 4345784 - DNA, 15 bp, Homo sapiens
tgctaaatgtgaatg

SEQ ID NO: 4345785 - DNA, 15 bp, Homo sapiens
tgctaaattataaaa

SEQ ID NO: 4345786 - DNA, 18 bp, Homo sapiens
tgctaagctaaagaaact

SEQ ID NO: 4345787 - DNA, 13 bp, Homo sapiens
tgctactgtacat

SEQ ID NO: 4345788 - DNA, 19 bp, Homo sapiens
tgctatatttttaaagaag

SEQ ID NO: 4345789 - DNA, 15 bp, Homo sapiens
tgctcaagaatgtag

SEQ ID NO: 4345790 - DNA, 22 bp, Homo sapiens
tgctcatacacagttaaataaa

SEQ ID NO: 4345791 - DNA, 16 bp, Homo sapiens
tgctccagctgttcag

SEQ ID NO: 4345792 - DNA, 19 bp, Homo sapiens
tgctccagctgttcagctg

SEQ ID NO: 4345793 - DNA, 20 bp, Homo sapiens
tgctccagctgttcagctgg

SEQ ID NO: 4345794 - DNA, 14 bp, Homo sapiens
tgctcccagctctc

SEQ ID NO: 4345795 - DNA, 22 bp, Homo sapiens
tgctccctctctccacacggag

SEQ ID NO: 4345796 - DNA, 14 bp, Homo sapiens
tgctcctagagagg

SEQ ID NO: 4345797 - DNA, 18 bp, Homo sapiens
tgctgaaagtcctgcttt

SEQ ID NO: 4345798 - DNA, 21 bp, Homo sapiens
tgctgaagtacagtcccagca

SEQ ID NO: 4345799 - DNA, 18 bp, Homo sapiens
tgctgaatacagaggcaa

SEQ ID NO: 4345800 - DNA, 24 bp, Homo sapiens
tgctgactgttttctcttgagagg

SEQ ID NO: 4345801 - DNA, 12 bp, Homo sapiens
tgctgagcctgc

SEQ ID NO: 4345802 - DNA, 16 bp, Homo sapiens
tgctgagctgaagaaa

SEQ ID NO: 4345803 - DNA, 13 bp, Homo sapiens
tgctgatgtttac

SEQ ID NO: 4345804 - DNA, 22 bp, Homo sapiens
tgctgcaaacccatgaagctgg

SEQ ID NO: 4345805 - DNA, 15 bp, Homo sapiens
tgctgcatgcctggt

SEQ ID NO: 4345806 - DNA, 16 bp, Homo sapiens
tgctgcattttacaca

SEQ ID NO: 4345807 - DNA, 20 bp, Homo sapiens
tgctgcttggagtgccccaa

SEQ ID NO: 4345808 - DNA, 14 bp, Homo sapiens
tgctggaaaatcat

SEQ ID NO: 4345809 - DNA, 23 bp, Homo sapiens
tgctggaaaatcatattgagaat

SEQ ID NO: 4345810 - DNA, 17 bp, Homo sapiens
tgctgggaatacatctg

SEQ ID NO: 4345811 - DNA, 17 bp, Homo sapiens
tgctgggtgccaggtgc

SEQ ID NO: 4345812 - DNA, 16 bp, Homo sapiens
tgctgtatttctttgt

SEQ ID NO: 4345813 - DNA, 17 bp, Homo sapiens
tgctgtccatgcttctc

SEQ ID NO: 4345814 - DNA, 16 bp, Homo sapiens
tgctgtgtagttccct

SEQ ID NO: 4345815 - DNA, 18 bp, Homo sapiens
tgctgttagttataaaac

SEQ ID NO: 4345816 - DNA, 13 bp, Homo sapiens
tgctgttctgtgt

SEQ ID NO: 4345817 - DNA, 22 bp, Homo sapiens
tgctgttgtttctataaatgac

SEQ ID NO: 4345818 - DNA, 17 bp, Homo sapiens
tgcttacagtttatttt

SEQ ID NO: 4345819 - DNA, 16 bp, Homo sapiens
tgcttagtaaaattta

SEQ ID NO: 4345820 - DNA, 19 bp, Homo sapiens
tgcttagtgaaaatactag

SEQ ID NO: 4345821 - DNA, 15 bp, Homo sapiens
tgcttattctctcat

SEQ ID NO: 4345822 - DNA, 15 bp, Homo sapiens
tgcttcaatcccagc

SEQ ID NO: 4345823 - DNA, 14 bp, Homo sapiens
tgcttcagagtttg

SEQ ID NO: 4345824 - DNA, 13 bp, Homo sapiens
tgcttcctgatta

SEQ ID NO: 4345825 - DNA, 16 bp, Homo sapiens
tgcttctactgtgaca

SEQ ID NO: 4345826 - DNA, 20 bp, Homo sapiens
tgcttctcagttgcagaaaa

SEQ ID NO: 4345827 - DNA, 17 bp, Homo sapiens
tgcttctcatcttgtga

SEQ ID NO: 4345828 - DNA, 18 bp, Homo sapiens
tgcttctcatcttgtgaa

SEQ ID NO: 4345829 - DNA, 13 bp, Homo sapiens
tgcttctccagcc

SEQ ID NO: 4345830 - DNA, 15 bp, Homo sapiens
tgcttctccccagaa

SEQ ID NO: 4345831 - DNA, 16 bp, Homo sapiens
tgcttctccccagaat

SEQ ID NO: 4345832 - DNA, 14 bp, Homo sapiens
tgcttctcttcttt

SEQ ID NO: 4345833 - DNA, 16 bp, Homo sapiens
tgcttctctttgtgca

SEQ ID NO: 4345834 - DNA, 17 bp, Homo sapiens
tgcttctgcagcaactc

SEQ ID NO: 4345835 - DNA, 23 bp, Homo sapiens
tgcttgagctttctgtgcatgtg

SEQ ID NO: 4345836 - DNA, 19 bp, Homo sapiens
tgcttggagtgccccaagg

SEQ ID NO: 4345837 - DNA, 21 bp, Homo sapiens
tgcttggagtgccccaaggag

SEQ ID NO: 4345838 - DNA, 20 bp, Homo sapiens
tgcttgggtcctactcctgg

SEQ ID NO: 4345839 - DNA, 15 bp, Homo sapiens
tgctttcctatctag

SEQ ID NO: 4345840 - DNA, 19 bp, Homo sapiens
tgctttgagaccagaagaa

SEQ ID NO: 4345841 - DNA, 21 bp, Homo sapiens
tgctttgagaccagaagaaaa

SEQ ID NO: 4345842 - DNA, 20 bp, Homo sapiens
tgctttgtgcatatgttaaa

SEQ ID NO: 4345843 - DNA, 13 bp, Homo sapiens
tgctttttggtga

SEQ ID NO: 4345844 - DNA, 21 bp, Homo sapiens
tggaaaatcatattgagaata

SEQ ID NO: 4345845 - DNA, 22 bp, Homo sapiens
tggaagaagttttttactttgg

SEQ ID NO: 4345846 - DNA, 19 bp, Homo sapiens
tggaagggccaatggagaa

SEQ ID NO: 4345847 - DNA, 20 bp, Homo sapiens
tggaagggccaatggagaaa

SEQ ID NO: 4345848 - DNA, 23 bp, Homo sapiens
tggaagggccaatggagaaaatg

SEQ ID NO: 4345849 - DNA, 19 bp, Homo sapiens
tggaatgttacatctgtct

SEQ ID NO: 4345850 - DNA, 17 bp, Homo sapiens
tggaattaaaaggatag

SEQ ID NO: 4345851 - DNA, 21 bp, Homo sapiens
tggaatttccattgacatttg

SEQ ID NO: 4345852 - DNA, 13 bp, Homo sapiens
tggacaagacatg

SEQ ID NO: 4345853 - DNA, 14 bp, Homo sapiens
tggacagacactgt

SEQ ID NO: 4345854 - DNA, 17 bp, Homo sapiens
tggacagacactgttgc

SEQ ID NO: 4345855 - DNA, 18 bp, Homo sapiens
tggacagacactgttgca

SEQ ID NO: 4345856 - DNA, 13 bp, Homo sapiens
tggacattttctt

SEQ ID NO: 4345857 - DNA, 16 bp, Homo sapiens
tggacattttctttta

SEQ ID NO: 4345858 - DNA, 22 bp, Homo sapiens
tggaccaattattgatatatat

SEQ ID NO: 4345859 - DNA, 13 bp, Homo sapiens
tggacccccagct

SEQ ID NO: 4345860 - DNA, 14 bp, Homo sapiens
tggacccccagctt

SEQ ID NO: 4345861 - DNA, 21 bp, Homo sapiens
tggagaaatgaagcagaggaa

SEQ ID NO: 4345862 - DNA, 15 bp, Homo sapiens
tggagaactcagtgc

SEQ ID NO: 4345863 - DNA, 17 bp, Homo sapiens
tggagaactcagtgcca

SEQ ID NO: 4345864 - DNA, 22 bp, Homo sapiens
tggagaagcggctggcagccca

SEQ ID NO: 4345865 - DNA, 14 bp, Homo sapiens
tggagacacggggc

SEQ ID NO: 4345866 - DNA, 19 bp, Homo sapiens
tggagacctctccttccta

SEQ ID NO: 4345867 - DNA, 22 bp, Homo sapiens
tggagactgcaagtaaggcttt

SEQ ID NO: 4345868 - DNA, 16 bp, Homo sapiens
tggagactttgctgtt

SEQ ID NO: 4345869 - DNA, 16 bp, Homo sapiens
tggagaggaagaaacg

SEQ ID NO: 4345870 - DNA, 23 bp, Homo sapiens
tggagcaaaacaaagctgatttc

SEQ ID NO: 4345871 - DNA, 23 bp, Homo sapiens
tggagcattaactaaatgctcat

SEQ ID NO: 4345872 - DNA, 20 bp, Homo sapiens
tggagcccagttggaaaatt

SEQ ID NO: 4345873 - DNA, 23 bp, Homo sapiens
tggagctgctaagctaaagaaac

SEQ ID NO: 4345874 - DNA, 15 bp, Homo sapiens
tggaggagactgggc

SEQ ID NO: 4345875 - DNA, 16 bp, Homo sapiens
tggaggcctacctctc

SEQ ID NO: 4345876 - DNA, 14 bp, Homo sapiens
tggaggggcccctg

SEQ ID NO: 4345877 - DNA, 22 bp, Homo sapiens
tggaggtctctccctcccccag

SEQ ID NO: 4345878 - DNA, 16 bp, Homo sapiens
tggagtataatattca

SEQ ID NO: 4345879 - DNA, 12 bp, Homo sapiens
tggagtgcccca

SEQ ID NO: 4345880 - DNA, 14 bp, Homo sapiens
tggagtgtttgaaa

SEQ ID NO: 4345881 - DNA, 16 bp, Homo sapiens
tggagtgtttgaaaac

SEQ ID NO: 4345882 - DNA, 17 bp, Homo sapiens
tggagtgtttgaaaact

SEQ ID NO: 4345883 - DNA, 23 bp, Homo sapiens
tggataatcttcggccaatttat

SEQ ID NO: 4345884 - DNA, 13 bp, Homo sapiens
tggatagaaaaaa

SEQ ID NO: 4345885 - DNA, 13 bp, Homo sapiens
tggatatagaaaa

SEQ ID NO: 4345886 - DNA, 17 bp, Homo sapiens
tggattcattctcataa

SEQ ID NO: 4345887 - DNA, 23 bp, Homo sapiens
tggattcattctcataattccta

SEQ ID NO: 4345888 - DNA, 12 bp, Homo sapiens
tggatttgctgt

SEQ ID NO: 4345889 - DNA, 15 bp, Homo sapiens
tggcaaacttttctt

SEQ ID NO: 4345890 - DNA, 14 bp, Homo sapiens
tggcaaggagaata

SEQ ID NO: 4345891 - DNA, 13 bp, Homo sapiens
tggcaattccaat

SEQ ID NO: 4345892 - DNA, 17 bp, Homo sapiens
tggcaattccaatattt

SEQ ID NO: 4345893 - DNA, 17 bp, Homo sapiens
tggcaccagcagcctgg

SEQ ID NO: 4345894 - DNA, 19 bp, Homo sapiens
tggcatcgcagcttcctgt

SEQ ID NO: 4345895 - DNA, 16 bp, Homo sapiens
tggcatggagactctg

SEQ ID NO: 4345896 - DNA, 22 bp, Homo sapiens
tggccaaaggaccgttttgtat

SEQ ID NO: 4345897 - DNA, 14 bp, Homo sapiens
tggccagactccct

SEQ ID NO: 4345898 - DNA, 16 bp, Homo sapiens
tggccaggagccatga

SEQ ID NO: 4345899 - DNA, 17 bp, Homo sapiens
tggccatatatgctgta

SEQ ID NO: 4345900 - DNA, 18 bp, Homo sapiens
tggccatggtaccccctt

SEQ ID NO: 4345901 - DNA, 19 bp, Homo sapiens
tggcccacgcacttcggga

SEQ ID NO: 4345902 - DNA, 14 bp, Homo sapiens
tggccctcagctcc

SEQ ID NO: 4345903 - DNA, 15 bp, Homo sapiens
tggcccttctgccct

SEQ ID NO: 4345904 - DNA, 23 bp, Homo sapiens
tggccgggcgcggtggctcacgc

SEQ ID NO: 4345905 - DNA, 13 bp, Homo sapiens
tggccttgggcct

SEQ ID NO: 4345906 - DNA, 16 bp, Homo sapiens
tggcgggatgggccac

SEQ ID NO: 4345907 - DNA, 19 bp, Homo sapiens
tggctaatggagtgtttga

SEQ ID NO: 4345908 - DNA, 20 bp, Homo sapiens
tggctgcgtactccactggt

SEQ ID NO: 4345909 - DNA, 14 bp, Homo sapiens
tggcttactgaaag

SEQ ID NO: 4345910 - DNA, 12 bp, Homo sapiens
tggcttgctgtt

SEQ ID NO: 4345911 - DNA, 13 bp, Homo sapiens
tggcttgctgttt

SEQ ID NO: 4345912 - DNA, 21 bp, Homo sapiens
tggctttttgtcaaataaaat

SEQ ID NO: 4345913 - DNA, 16 bp, Homo sapiens
tgggaaataaagaaaa

SEQ ID NO: 4345914 - DNA, 18 bp, Homo sapiens
tgggaagctcccacaccc

SEQ ID NO: 4345915 - DNA, 13 bp, Homo sapiens
tgggaatacatct

SEQ ID NO: 4345916 - DNA, 16 bp, Homo sapiens
tgggacctaatgctgg

SEQ ID NO: 4345917 - DNA, 18 bp, Homo sapiens
tgggagagctagaaagtt

SEQ ID NO: 4345918 - DNA, 19 bp, Homo sapiens
tgggagagctagaaagttg

SEQ ID NO: 4345919 - DNA, 15 bp, Homo sapiens
tgggagattatcagt

SEQ ID NO: 4345920 - DNA, 20 bp, Homo sapiens
tgggagattatcagtagaaa

SEQ ID NO: 4345921 - DNA, 23 bp, Homo sapiens
tgggagattatcagtagaaagag

SEQ ID NO: 4345922 - DNA, 16 bp, Homo sapiens
tgggaggatctcttga

SEQ ID NO: 4345923 - DNA, 18 bp, Homo sapiens
tgggaggatctcttgagc

SEQ ID NO: 4345924 - DNA, 20 bp, Homo sapiens
tgggaggatctcttgagcct

SEQ ID NO: 4345925 - DNA, 21 bp, Homo sapiens
tgggaggattgcttgagctca

SEQ ID NO: 4345926 - DNA, 20 bp, Homo sapiens
tgggaggccaaggtgggagg

SEQ ID NO: 4345927 - DNA, 19 bp, Homo sapiens
tgggaggtcaaggctgcag

SEQ ID NO: 4345928 - DNA, 13 bp, Homo sapiens
tgggatgcggggc

SEQ ID NO: 4345929 - DNA, 21 bp, Homo sapiens
tgggatggacgctgccgggag

SEQ ID NO: 4345930 - DNA, 22 bp, Homo sapiens
tgggatggacgctgccgggaga

SEQ ID NO: 4345931 - DNA, 14 bp, Homo sapiens
tgggcacccctgcc

SEQ ID NO: 4345932 - DNA, 15 bp, Homo sapiens
tgggcacccctgcct

SEQ ID NO: 4345933 - DNA, 23 bp, Homo sapiens
tgggcagctaccacgggtctgcc

SEQ ID NO: 4345934 - DNA, 23 bp, Homo sapiens
tgggcagggcctggcggaggtgg

SEQ ID NO: 4345935 - DNA, 16 bp, Homo sapiens
tgggcatgaatggaga

SEQ ID NO: 4345936 - DNA, 19 bp, Homo sapiens
tgggccaatttactggcca

SEQ ID NO: 4345937 - DNA, 20 bp, Homo sapiens
tgggccaatttactggccac

SEQ ID NO: 4345938 - DNA, 23 bp, Homo sapiens
tgggccttggggctcagccacag

SEQ ID NO: 4345939 - DNA, 18 bp, Homo sapiens
tggggagaaactgaagcc

SEQ ID NO: 4345940 - DNA, 15 bp, Homo sapiens
tggggagggagtctg

SEQ ID NO: 4345941 - DNA, 17 bp, Homo sapiens
tggggcccctggcccag

SEQ ID NO: 4345942 - DNA, 21 bp, Homo sapiens
tggggctcagccacagcctga

SEQ ID NO: 4345943 - DNA, 23 bp, Homo sapiens
tggggctgcgaaaacgttgaccc

SEQ ID NO: 4345944 - DNA, 20 bp, Homo sapiens
tgggggatcacagcctctga

SEQ ID NO: 4345945 - DNA, 14 bp, Homo sapiens
tggggtacagtaaa

SEQ ID NO: 4345946 - DNA, 16 bp, Homo sapiens
tggggtggtgctgggt

SEQ ID NO: 4345947 - DNA, 16 bp, Homo sapiens
tggggtttagaacccc

SEQ ID NO: 4345948 - DNA, 22 bp, Homo sapiens
tggggtttagaaccccaggtga

SEQ ID NO: 4345949 - DNA, 13 bp, Homo sapiens
tgggtatgtgttg

SEQ ID NO: 4345950 - DNA, 19 bp, Homo sapiens
tgggtcctactcctggagc

SEQ ID NO: 4345951 - DNA, 17 bp, Homo sapiens
tgggtgaagtgcctgct

SEQ ID NO: 4345952 - DNA, 15 bp, Homo sapiens
tgggtgaggctgggc

SEQ ID NO: 4345953 - DNA, 17 bp, Homo sapiens
tgggtgaggctgggcag

SEQ ID NO: 4345954 - DNA, 20 bp, Homo sapiens
tgggtggcaccagcagcctg

SEQ ID NO: 4345955 - DNA, 22 bp, Homo sapiens
tgggtggcaccagcagcctgga

SEQ ID NO: 4345956 - DNA, 12 bp, Homo sapiens
tgggtgggagag

SEQ ID NO: 4345957 - DNA, 20 bp, Homo sapiens
tgggtgtcatttcattccat

SEQ ID NO: 4345958 - DNA, 15 bp, Homo sapiens
tggtaaaaaagaaat

SEQ ID NO: 4345959 - DNA, 20 bp, Homo sapiens
tggtacccccttctgggcat

SEQ ID NO: 4345960 - DNA, 13 bp, Homo sapiens
tggtactctgtgt

SEQ ID NO: 4345961 - DNA, 22 bp, Homo sapiens
tggtagggtataatgtgtctgt

SEQ ID NO: 4345962 - DNA, 16 bp, Homo sapiens
tggtatattgtgtaaa

SEQ ID NO: 4345963 - DNA, 16 bp, Homo sapiens
tggtatatttgtagat

SEQ ID NO: 4345964 - DNA, 18 bp, Homo sapiens
tggtatggccaaaagtca

SEQ ID NO: 4345965 - DNA, 23 bp, Homo sapiens
tggtatttatctgcaaggttgta

SEQ ID NO: 4345966 - DNA, 22 bp, Homo sapiens
tggtcatggtagatttttttca

SEQ ID NO: 4345967 - DNA, 17 bp, Homo sapiens
tggtcatgtcctgaggc

SEQ ID NO: 4345968 - DNA, 17 bp, Homo sapiens
tggtcgtcatgctgtcc

SEQ ID NO: 4345969 - DNA, 23 bp, Homo sapiens
tggtcttttcctccccattccta

SEQ ID NO: 4345970 - DNA, 18 bp, Homo sapiens
tggtgcccttccctggag

SEQ ID NO: 4345971 - DNA, 15 bp, Homo sapiens
tggtgctgagtgcta

SEQ ID NO: 4345972 - DNA, 13 bp, Homo sapiens
tggtgggttgatg

SEQ ID NO: 4345973 - DNA, 18 bp, Homo sapiens
tggttaaaatgtgatttt

SEQ ID NO: 4345974 - DNA, 17 bp, Homo sapiens
tggttagtatttaacta

SEQ ID NO: 4345975 - DNA, 14 bp, Homo sapiens
tggttatggagagg

SEQ ID NO: 4345976 - DNA, 13 bp, Homo sapiens
tggtttggaaaat

SEQ ID NO: 4345977 - DNA, 15 bp, Homo sapiens
tggtttggaaaataa

SEQ ID NO: 4345978 - DNA, 20 bp, Homo sapiens
tgtaaactggaattaaaagg

SEQ ID NO: 4345979 - DNA, 17 bp, Homo sapiens
tgtaactttttttcagt

SEQ ID NO: 4345980 - DNA, 18 bp, Homo sapiens
tgtaactttttttcagtt

SEQ ID NO: 4345981 - DNA, 19 bp, Homo sapiens
tgtaactttttttcagttc

SEQ ID NO: 4345982 - DNA, 23 bp, Homo sapiens
tgtaatgccaatatgacacagct

SEQ ID NO: 4345983 - DNA, 22 bp, Homo sapiens
tgtaattaaactagtttaaggg

SEQ ID NO: 4345984 - DNA, 19 bp, Homo sapiens
tgtacataaacaatgatgc

SEQ ID NO: 4345985 - DNA, 16 bp, Homo sapiens
tgtacataaagtcatc

SEQ ID NO: 4345986 - DNA, 14 bp, Homo sapiens
tgtacatacaaatt

SEQ ID NO: 4345987 - DNA, 15 bp, Homo sapiens
tgtacatgaagaatg

SEQ ID NO: 4345988 - DNA, 22 bp, Homo sapiens
tgtacttaaatgagttacttag

SEQ ID NO: 4345989 - DNA, 14 bp, Homo sapiens
tgtagaataaatgg

SEQ ID NO: 4345990 - DNA, 22 bp, Homo sapiens
tgtagaataaatggtttctcat

SEQ ID NO: 4345991 - DNA, 18 bp, Homo sapiens
tgtagataccgagaatga

SEQ ID NO: 4345992 - DNA, 19 bp, Homo sapiens
tgtagccttagagcatctc

SEQ ID NO: 4345993 - DNA, 19 bp, Homo sapiens
tgtagtaaatattatgatt

SEQ ID NO: 4345994 - DNA, 14 bp, Homo sapiens
tgtagtcaagaggt

SEQ ID NO: 4345995 - DNA, 15 bp, Homo sapiens
tgtagtcacattagt

SEQ ID NO: 4345996 - DNA, 16 bp, Homo sapiens
tgtagttccctctgcc

SEQ ID NO: 4345997 - DNA, 13 bp, Homo sapiens
tgtagttcttagt

SEQ ID NO: 4345998 - DNA, 22 bp, Homo sapiens
tgtataaattaaataaactgtt

SEQ ID NO: 4345999 - DNA, 23 bp, Homo sapiens
tgtatataatcatgctcatgtat

SEQ ID NO: 4346000 - DNA, 20 bp, Homo sapiens
tgtatatatattctcagctg

SEQ ID NO: 4346001 - DNA, 22 bp, Homo sapiens
tgtatgccttcgggaaaattca

SEQ ID NO: 4346002 - DNA, 18 bp, Homo sapiens
tgtatgtggtatgtatat

SEQ ID NO: 4346003 - DNA, 19 bp, Homo sapiens
tgtatgtgtgtagactgta

SEQ ID NO: 4346004 - DNA, 19 bp, Homo sapiens
tgtattaataaagcattct

SEQ ID NO: 4346005 - DNA, 14 bp, Homo sapiens
tgtattaatactta

SEQ ID NO: 4346006 - DNA, 15 bp, Homo sapiens
tgtattgagtcttaa

SEQ ID NO: 4346007 - DNA, 19 bp, Homo sapiens
tgtattgagtcttaactgt

SEQ ID NO: 4346008 - DNA, 22 bp, Homo sapiens
tgtattgagtcttaactgtatt

SEQ ID NO: 4346009 - DNA, 14 bp, Homo sapiens
tgtattgcttcctg

SEQ ID NO: 4346010 - DNA, 21 bp, Homo sapiens
tgtatttatattttgtgctat

SEQ ID NO: 4346011 - DNA, 13 bp, Homo sapiens
tgtatttcagtat

SEQ ID NO: 4346012 - DNA, 16 bp, Homo sapiens
tgtatttctgtggaaa

SEQ ID NO: 4346013 - DNA, 21 bp, Homo sapiens
tgtatttctgtggaaaacaat

SEQ ID NO: 4346014 - DNA, 16 bp, Homo sapiens
tgtatttgtattaata

SEQ ID NO: 4346015 - DNA, 14 bp, Homo sapiens
tgtatttttctaca

SEQ ID NO: 4346016 - DNA, 18 bp, Homo sapiens
tgtcaatcttaagaggat

SEQ ID NO: 4346017 - DNA, 18 bp, Homo sapiens
tgtcaatgctctaacaaa

SEQ ID NO: 4346018 - DNA, 13 bp, Homo sapiens
tgtcagaagacac

SEQ ID NO: 4346019 - DNA, 16 bp, Homo sapiens
tgtcagaagacactaa

SEQ ID NO: 4346020 - DNA, 17 bp, Homo sapiens
tgtcagaatggaatcca

SEQ ID NO: 4346021 - DNA, 21 bp, Homo sapiens
tgtcagaatggaatccatctg

SEQ ID NO: 4346022 - DNA, 21 bp, Homo sapiens
tgtcagactttgctgcatttt

SEQ ID NO: 4346023 - DNA, 19 bp, Homo sapiens
tgtcagctgaacctgggta

SEQ ID NO: 4346024 - DNA, 16 bp, Homo sapiens
tgtcatgaattcttat

SEQ ID NO: 4346025 - DNA, 21 bp, Homo sapiens
tgtcatgaattcttatgctta

SEQ ID NO: 4346026 - DNA, 15 bp, Homo sapiens
tgtcattgtccagct

SEQ ID NO: 4346027 - DNA, 23 bp, Homo sapiens
tgtccagccgtgtgtgcatgtgc

SEQ ID NO: 4346028 - DNA, 14 bp, Homo sapiens
tgtccagctgggac

SEQ ID NO: 4346029 - DNA, 15 bp, Homo sapiens
tgtccagctggttgt

SEQ ID NO: 4346030 - DNA, 15 bp, Homo sapiens
tgtccatgcttctca

SEQ ID NO: 4346031 - DNA, 20 bp, Homo sapiens
tgtccatgtggttcttcaaa

SEQ ID NO: 4346032 - DNA, 13 bp, Homo sapiens
tgtccgagctttg

SEQ ID NO: 4346033 - DNA, 17 bp, Homo sapiens
tgtccttgcacctgagc

SEQ ID NO: 4346034 - DNA, 18 bp, Homo sapiens
tgtccttggaagtttcat

SEQ ID NO: 4346035 - DNA, 15 bp, Homo sapiens
tgtcctttgaggccc

SEQ ID NO: 4346036 - DNA, 20 bp, Homo sapiens
tgtcctttgaggccccaact

SEQ ID NO: 4346037 - DNA, 21 bp, Homo sapiens
tgtcctttgaggccccaactc

SEQ ID NO: 4346038 - DNA, 17 bp, Homo sapiens
tgtctcctgtccccggc

SEQ ID NO: 4346039 - DNA, 21 bp, Homo sapiens
tgtctctcttcagactctcag

SEQ ID NO: 4346040 - DNA, 15 bp, Homo sapiens
tgtctctgcatctga

SEQ ID NO: 4346041 - DNA, 18 bp, Homo sapiens
tgtctctgcatctgactc

SEQ ID NO: 4346042 - DNA, 16 bp, Homo sapiens
tgtctgaatcatgtct

SEQ ID NO: 4346043 - DNA, 15 bp, Homo sapiens
tgtctgtatccccag

SEQ ID NO: 4346044 - DNA, 17 bp, Homo sapiens
tgtctgtcagaagacac

SEQ ID NO: 4346045 - DNA, 22 bp, Homo sapiens
tgtctgtttatatattgaaagt

SEQ ID NO: 4346046 - DNA, 13 bp, Homo sapiens
tgtcttagttgat

SEQ ID NO: 4346047 - DNA, 18 bp, Homo sapiens
tgtcttgatgactgctga

SEQ ID NO: 4346048 - DNA, 15 bp, Homo sapiens
tgtcttgtctcactt

SEQ ID NO: 4346049 - DNA, 16 bp, Homo sapiens
tgtctttcctcccttc

SEQ ID NO: 4346050 - DNA, 21 bp, Homo sapiens
tgtctttggataataggaatt

SEQ ID NO: 4346051 - DNA, 13 bp, Homo sapiens
tgtgaaaagaaaa

SEQ ID NO: 4346052 - DNA, 23 bp, Homo sapiens
tgtgaaaagaaaaatgagcctgg

SEQ ID NO: 4346053 - DNA, 17 bp, Homo sapiens
tgtgaatgcttctcact

SEQ ID NO: 4346054 - DNA, 17 bp, Homo sapiens
tgtgactcagtgtattt

SEQ ID NO: 4346055 - DNA, 18 bp, Homo sapiens
tgtgactcagtgtatttt

SEQ ID NO: 4346056 - DNA, 12 bp, Homo sapiens
tgtgatcaactg

SEQ ID NO: 4346057 - DNA, 15 bp, Homo sapiens
tgtgcacactaagaa

SEQ ID NO: 4346058 - DNA, 17 bp, Homo sapiens
tgtgcacactaagaaat

SEQ ID NO: 4346059 - DNA, 18 bp, Homo sapiens
tgtgcagtgttagtattc

SEQ ID NO: 4346060 - DNA, 13 bp, Homo sapiens
tgtgcatgtgccg

SEQ ID NO: 4346061 - DNA, 14 bp, Homo sapiens
tgtgcccctgccaa

SEQ ID NO: 4346062 - DNA, 17 bp, Homo sapiens
tgtgcccctgccaaggc

SEQ ID NO: 4346063 - DNA, 21 bp, Homo sapiens
tgtgcctggttcgtgccatgc

SEQ ID NO: 4346064 - DNA, 19 bp, Homo sapiens
tgtgcgaagcaagaagaat

SEQ ID NO: 4346065 - DNA, 20 bp, Homo sapiens
tgtgcttctcagttgcagaa

SEQ ID NO: 4346066 - DNA, 12 bp, Homo sapiens
tgtggaaaacaa

SEQ ID NO: 4346067 - DNA, 18 bp, Homo sapiens
tgtggaaaacaatttgca

SEQ ID NO: 4346068 - DNA, 21 bp, Homo sapiens
tgtggaaccaaagctggccca

SEQ ID NO: 4346069 - DNA, 21 bp, Homo sapiens
tgtggagaagcggctggcagc

SEQ ID NO: 4346070 - DNA, 14 bp, Homo sapiens
tgtggccaggagcc

SEQ ID NO: 4346071 - DNA, 15 bp, Homo sapiens
tgtggccaggagccc

SEQ ID NO: 4346072 - DNA, 18 bp, Homo sapiens
tgtggccaggagccctgg

SEQ ID NO: 4346073 - DNA, 20 bp, Homo sapiens
tgtggccaggagccctggcc

SEQ ID NO: 4346074 - DNA, 20 bp, Homo sapiens
tgtgggtgaagtgcctgctg

SEQ ID NO: 4346075 - DNA, 17 bp, Homo sapiens
tgtggtcttatgatttt

SEQ ID NO: 4346076 - DNA, 19 bp, Homo sapiens
tgtggtcttatgattttat

SEQ ID NO: 4346077 - DNA, 12 bp, Homo sapiens
tgtggtttcatt

SEQ ID NO: 4346078 - DNA, 17 bp, Homo sapiens
tgtggttttatggagac

SEQ ID NO: 4346079 - DNA, 13 bp, Homo sapiens
tgtgtagttccct

SEQ ID NO: 4346080 - DNA, 20 bp, Homo sapiens
tgtgtagttccctctgcctg

SEQ ID NO: 4346081 - DNA, 21 bp, Homo sapiens
tgtgtagttccctctgcctgg

SEQ ID NO: 4346082 - DNA, 16 bp, Homo sapiens
tgtgtatacagccctg

SEQ ID NO: 4346083 - DNA, 22 bp, Homo sapiens
tgtgtatacagccctgacgcaa

SEQ ID NO: 4346084 - DNA, 17 bp, Homo sapiens
tgtgtctgaatcatgtc

SEQ ID NO: 4346085 - DNA, 18 bp, Homo sapiens
tgtgtctgaatcatgtct

SEQ ID NO: 4346086 - DNA, 21 bp, Homo sapiens
tgtgtctgaatcatgtctgta

SEQ ID NO: 4346087 - DNA, 20 bp, Homo sapiens
tgtgtggagaactcagtgcc

SEQ ID NO: 4346088 - DNA, 14 bp, Homo sapiens
tgtgtgtatttgta

SEQ ID NO: 4346089 - DNA, 20 bp, Homo sapiens
tgtgtgtatttgtattaata

SEQ ID NO: 4346090 - DNA, 13 bp, Homo sapiens
tgtgttgccaaag

SEQ ID NO: 4346091 - DNA, 16 bp, Homo sapiens
tgtgtttttctccagt

SEQ ID NO: 4346092 - DNA, 11 bp, Homo sapiens
tgttaagaaag

SEQ ID NO: 4346093 - DNA, 12 bp, Homo sapiens
tgttactgcttc

SEQ ID NO: 4346094 - DNA, 13 bp, Homo sapiens
tgttactgcttct

SEQ ID NO: 4346095 - DNA, 14 bp, Homo sapiens
tgttagttataaaa

SEQ ID NO: 4346096 - DNA, 17 bp, Homo sapiens
tgttatagattgtctta

SEQ ID NO: 4346097 - DNA, 15 bp, Homo sapiens
tgttattaatgtttc

SEQ ID NO: 4346098 - DNA, 18 bp, Homo sapiens
tgttattaatgtttcttc

SEQ ID NO: 4346099 - DNA, 19 bp, Homo sapiens
tgttcaagcttttcctttc

SEQ ID NO: 4346100 - DNA, 13 bp, Homo sapiens
tgttcagtgttga

SEQ ID NO: 4346101 - DNA, 17 bp, Homo sapiens
tgttcagtgttgacata

SEQ ID NO: 4346102 - DNA, 20 bp, Homo sapiens
tgttcagtgttgacatagcc

SEQ ID NO: 4346103 - DNA, 19 bp, Homo sapiens
tgttcattctgcattgaga

SEQ ID NO: 4346104 - DNA, 14 bp, Homo sapiens
tgttccaaatttag

SEQ ID NO: 4346105 - DNA, 19 bp, Homo sapiens
tgttccacccgacctctga

SEQ ID NO: 4346106 - DNA, 21 bp, Homo sapiens
tgttccactgcaaataaagcc

SEQ ID NO: 4346107 - DNA, 23 bp, Homo sapiens
tgttccactgcaaataaagcctt

SEQ ID NO: 4346108 - DNA, 23 bp, Homo sapiens
tgttctctctgaatgctgagctg

SEQ ID NO: 4346109 - DNA, 23 bp, Homo sapiens
tgttctgtgatgaggggaggggg

SEQ ID NO: 4346110 - DNA, 19 bp, Homo sapiens
tgttgcccgccctccaccc

SEQ ID NO: 4346111 - DNA, 17 bp, Homo sapiens
tgttgtctgtttgttct

SEQ ID NO: 4346112 - DNA, 21 bp, Homo sapiens
tgttgttatcatttaagattt

SEQ ID NO: 4346113 - DNA, 22 bp, Homo sapiens
tgttgttcaagcttttcctttc

SEQ ID NO: 4346114 - DNA, 19 bp, Homo sapiens
tgttgtttctataaatgac

SEQ ID NO: 4346115 - DNA, 17 bp, Homo sapiens
tgtttaaatgccaaaat

SEQ ID NO: 4346116 - DNA, 22 bp, Homo sapiens
tgtttacagggagcctcctgcc

SEQ ID NO: 4346117 - DNA, 23 bp, Homo sapiens
tgtttacagggagcctcctgccc

SEQ ID NO: 4346118 - DNA, 20 bp, Homo sapiens
tgtttatacacaactttgca

SEQ ID NO: 4346119 - DNA, 22 bp, Homo sapiens
tgtttcatacagctattaaaat

SEQ ID NO: 4346120 - DNA, 20 bp, Homo sapiens
tgtttcctaactgtgatttg

SEQ ID NO: 4346121 - DNA, 14 bp, Homo sapiens
tgtttcttctccaa

SEQ ID NO: 4346122 - DNA, 22 bp, Homo sapiens
tgtttcttctccaattctgaaa

SEQ ID NO: 4346123 - DNA, 15 bp, Homo sapiens
tgtttctttctgtct

SEQ ID NO: 4346124 - DNA, 16 bp, Homo sapiens
tgtttgaaaactgaca

SEQ ID NO: 4346125 - DNA, 15 bp, Homo sapiens
tgttttgaatattac

SEQ ID NO: 4346126 - DNA, 15 bp, Homo sapiens
tgtttttataaaaat

SEQ ID NO: 4346127 - DNA, 14 bp, Homo sapiens
tgtttttctccagt

SEQ ID NO: 4346128 - DNA, 16 bp, Homo sapiens
tgtttttctttctaca

SEQ ID NO: 4346129 - DNA, 15 bp, Homo sapiens
ttaaaaaatatatat

SEQ ID NO: 4346130 - DNA, 15 bp, Homo sapiens
ttaaaaaattaaaaa

SEQ ID NO: 4346131 - DNA, 22 bp, Homo sapiens
ttaaaaagttatataaaggcaa

SEQ ID NO: 4346132 - DNA, 14 bp, Homo sapiens
ttaaaacccaagtg

SEQ ID NO: 4346133 - DNA, 15 bp, Homo sapiens
ttaaaatcacatttt

SEQ ID NO: 4346134 - DNA, 15 bp, Homo sapiens
ttaaaatgtgatttt

SEQ ID NO: 4346135 - DNA, 22 bp, Homo sapiens
ttaaaatgtgatttttcttcag

SEQ ID NO: 4346136 - DNA, 21 bp, Homo sapiens
ttaaacaaaatttcacagttc

SEQ ID NO: 4346137 - DNA, 18 bp, Homo sapiens
ttaaactattcagaggaa

SEQ ID NO: 4346138 - DNA, 18 bp, Homo sapiens
ttaaactctgccagaaaa

SEQ ID NO: 4346139 - DNA, 14 bp, Homo sapiens
ttaaacttgtgaat

SEQ ID NO: 4346140 - DNA, 15 bp, Homo sapiens
ttaaacttgtgaatg

SEQ ID NO: 4346141 - DNA, 14 bp, Homo sapiens
ttaaagcttatttt

SEQ ID NO: 4346142 - DNA, 13 bp, Homo sapiens
ttaaagtaaactt

SEQ ID NO: 4346143 - DNA, 18 bp, Homo sapiens
ttaaagtaaacttgtgta

SEQ ID NO: 4346144 - DNA, 17 bp, Homo sapiens
ttaaataaatagaaaga

SEQ ID NO: 4346145 - DNA, 15 bp, Homo sapiens
ttaaatcaaaaactt

SEQ ID NO: 4346146 - DNA, 16 bp, Homo sapiens
ttaaatcaaaaacttt

SEQ ID NO: 4346147 - DNA, 17 bp, Homo sapiens
ttaaatcaaaaactttt

SEQ ID NO: 4346148 - DNA, 18 bp, Homo sapiens
ttaaatcaaaaacttttc

SEQ ID NO: 4346149 - DNA, 19 bp, Homo sapiens
ttaaatcatttggttaaat

SEQ ID NO: 4346150 - DNA, 21 bp, Homo sapiens
ttaaatgaatattttgataat

SEQ ID NO: 4346151 - DNA, 13 bp, Homo sapiens
ttaaatgccaaaa

SEQ ID NO: 4346152 - DNA, 21 bp, Homo sapiens
ttaaatgccaaaatgtactta

SEQ ID NO: 4346153 - DNA, 15 bp, Homo sapiens
ttaaattctcagtca

SEQ ID NO: 4346154 - DNA, 17 bp, Homo sapiens
ttaacaagaactcatta

SEQ ID NO: 4346155 - DNA, 20 bp, Homo sapiens
ttaacctccctcaacaaggt

SEQ ID NO: 4346156 - DNA, 12 bp, Homo sapiens
ttaactgtattt

SEQ ID NO: 4346157 - DNA, 15 bp, Homo sapiens
ttaacttacatgact

SEQ ID NO: 4346158 - DNA, 16 bp, Homo sapiens
ttaagctgtagagagt

SEQ ID NO: 4346159 - DNA, 19 bp, Homo sapiens
ttaagtcagtggctttgca

SEQ ID NO: 4346160 - DNA, 13 bp, Homo sapiens
ttaataaagcatt

SEQ ID NO: 4346161 - DNA, 14 bp, Homo sapiens
ttaataaagcattc

SEQ ID NO: 4346162 - DNA, 15 bp, Homo sapiens
ttaataactgaataa

SEQ ID NO: 4346163 - DNA, 21 bp, Homo sapiens
ttaataactgaataaaaaata

SEQ ID NO: 4346164 - DNA, 20 bp, Homo sapiens
ttaatctactttttgtattt

SEQ ID NO: 4346165 - DNA, 15 bp, Homo sapiens
ttaatgaagtcacta

SEQ ID NO: 4346166 - DNA, 21 bp, Homo sapiens
ttaatgtctgtcagaagacac

SEQ ID NO: 4346167 - DNA, 22 bp, Homo sapiens
ttaatgtctgtcagaagacact

SEQ ID NO: 4346168 - DNA, 23 bp, Homo sapiens
ttaatgtctgtcagaagacacta

SEQ ID NO: 4346169 - DNA, 23 bp, Homo sapiens
ttaattaaaaactttaaagataa

SEQ ID NO: 4346170 - DNA, 16 bp, Homo sapiens
ttaattaaagccttaa

SEQ ID NO: 4346171 - DNA, 22 bp, Homo sapiens
ttaatttaagtttgtagttttt

SEQ ID NO: 4346172 - DNA, 21 bp, Homo sapiens
ttaatttagagcgtttggtta

SEQ ID NO: 4346173 - DNA, 14 bp, Homo sapiens
ttacaaaactgctt

SEQ ID NO: 4346174 - DNA, 23 bp, Homo sapiens
ttacaaaactgctttgtgcatat

SEQ ID NO: 4346175 - DNA, 17 bp, Homo sapiens
ttacaagcttaaagctt

SEQ ID NO: 4346176 - DNA, 14 bp, Homo sapiens
ttacagaaatgttt

SEQ ID NO: 4346177 - DNA, 16 bp, Homo sapiens
ttacaggacttctctt

SEQ ID NO: 4346178 - DNA, 14 bp, Homo sapiens
ttacagggagcctc

SEQ ID NO: 4346179 - DNA, 17 bp, Homo sapiens
ttacagggagcctcctg

SEQ ID NO: 4346180 - DNA, 19 bp, Homo sapiens
ttacagggagcctcctgcc

SEQ ID NO: 4346181 - DNA, 23 bp, Homo sapiens
ttacagtttattttctgtgtaaa

SEQ ID NO: 4346182 - DNA, 12 bp, Homo sapiens
ttacattattcc

SEQ ID NO: 4346183 - DNA, 14 bp, Homo sapiens
ttaccatttttcat

SEQ ID NO: 4346184 - DNA, 15 bp, Homo sapiens
ttaccctctctttca

SEQ ID NO: 4346185 - DNA, 20 bp, Homo sapiens
ttacctcctaatggcatgga

SEQ ID NO: 4346186 - DNA, 23 bp, Homo sapiens
ttacctgcttgagctttctgtgc

SEQ ID NO: 4346187 - DNA, 13 bp, Homo sapiens
ttacgtgcattta

SEQ ID NO: 4346188 - DNA, 17 bp, Homo sapiens
ttacgtgcatttaaact

SEQ ID NO: 4346189 - DNA, 15 bp, Homo sapiens
ttactgcagctttgt

SEQ ID NO: 4346190 - DNA, 18 bp, Homo sapiens
ttactgcttctctttgtg

SEQ ID NO: 4346191 - DNA, 16 bp, Homo sapiens
ttactggactgtctga

SEQ ID NO: 4346192 - DNA, 19 bp, Homo sapiens
ttacttgcactgttactct

SEQ ID NO: 4346193 - DNA, 15 bp, Homo sapiens
ttacttgtgcactta

SEQ ID NO: 4346194 - DNA, 15 bp, Homo sapiens
ttagaaccccaggtg

SEQ ID NO: 4346195 - DNA, 12 bp, Homo sapiens
ttagaatgaaaa

SEQ ID NO: 4346196 - DNA, 12 bp, Homo sapiens
ttagaatgccat

SEQ ID NO: 4346197 - DNA, 17 bp, Homo sapiens
ttagaatgccataaaat

SEQ ID NO: 4346198 - DNA, 18 bp, Homo sapiens
ttagacactttacctctt

SEQ ID NO: 4346199 - DNA, 15 bp, Homo sapiens
ttagaccttatgtta

SEQ ID NO: 4346200 - DNA, 22 bp, Homo sapiens
ttagatatgttaagcatggatt

SEQ ID NO: 4346201 - DNA, 17 bp, Homo sapiens
ttagatgtttaccttca

SEQ ID NO: 4346202 - DNA, 18 bp, Homo sapiens
ttagccaagtgtggtaga

SEQ ID NO: 4346203 - DNA, 16 bp, Homo sapiens
ttagccacggaaacat

SEQ ID NO: 4346204 - DNA, 21 bp, Homo sapiens
ttagctgaggtttagtaatct

SEQ ID NO: 4346205 - DNA, 19 bp, Homo sapiens
ttaggaattgtttatacac

SEQ ID NO: 4346206 - DNA, 19 bp, Homo sapiens
ttaggatgagcaaaacatt

SEQ ID NO: 4346207 - DNA, 23 bp, Homo sapiens
ttaggattgggggatgtgaagaa

SEQ ID NO: 4346208 - DNA, 14 bp, Homo sapiens
ttaggttgttacca

SEQ ID NO: 4346209 - DNA, 21 bp, Homo sapiens
ttagtaaaaagccctatgtga

SEQ ID NO: 4346210 - DNA, 15 bp, Homo sapiens
ttagtagttatttgt

SEQ ID NO: 4346211 - DNA, 17 bp, Homo sapiens
ttagtagtttttacaaa

SEQ ID NO: 4346212 - DNA, 20 bp, Homo sapiens
ttagtatagtagaaagacat

SEQ ID NO: 4346213 - DNA, 23 bp, Homo sapiens
ttagtcccacagggaaatgtgta

SEQ ID NO: 4346214 - DNA, 15 bp, Homo sapiens
ttagtccccatcccg

SEQ ID NO: 4346215 - DNA, 17 bp, Homo sapiens
ttagtcgggcatgagtc

SEQ ID NO: 4346216 - DNA, 14 bp, Homo sapiens
ttagtgcctgtgtg

SEQ ID NO: 4346217 - DNA, 17 bp, Homo sapiens
ttagtgcttcagagttt

SEQ ID NO: 4346218 - DNA, 12 bp, Homo sapiens
ttagtgtgctgc

SEQ ID NO: 4346219 - DNA, 20 bp, Homo sapiens
ttagttacgtataatgcttt

SEQ ID NO: 4346220 - DNA, 21 bp, Homo sapiens
ttataaaaataaatagaaaag

SEQ ID NO: 4346221 - DNA, 16 bp, Homo sapiens
ttataaatatatataa

SEQ ID NO: 4346222 - DNA, 16 bp, Homo sapiens
ttatacgtacatacac

SEQ ID NO: 4346223 - DNA, 14 bp, Homo sapiens
ttatagattgtctt

SEQ ID NO: 4346224 - DNA, 17 bp, Homo sapiens
ttatagctcccaaaaga

SEQ ID NO: 4346225 - DNA, 19 bp, Homo sapiens
ttatataaaggcaaggaaa

SEQ ID NO: 4346226 - DNA, 20 bp, Homo sapiens
ttatataaaggcaaggaaat

SEQ ID NO: 4346227 - DNA, 22 bp, Homo sapiens
ttatatatcatagtataaatct

SEQ ID NO: 4346228 - DNA, 19 bp, Homo sapiens
ttatatcatatataaaagt

SEQ ID NO: 4346229 - DNA, 22 bp, Homo sapiens
ttatcagttaaaatcacatttt

SEQ ID NO: 4346230 - DNA, 15 bp, Homo sapiens
ttatcatttaagatt

SEQ ID NO: 4346231 - DNA, 19 bp, Homo sapiens
ttatccattacgtgcattt

SEQ ID NO: 4346232 - DNA, 13 bp, Homo sapiens
ttatctaatgagt

SEQ ID NO: 4346233 - DNA, 15 bp, Homo sapiens
ttatgattttattac

SEQ ID NO: 4346234 - DNA, 20 bp, Homo sapiens
ttatgcagagtcagccattc

SEQ ID NO: 4346235 - DNA, 21 bp, Homo sapiens
ttatggagacctctccttcct

SEQ ID NO: 4346236 - DNA, 13 bp, Homo sapiens
ttatgtggtctta

SEQ ID NO: 4346237 - DNA, 20 bp, Homo sapiens
ttatgtgttacattattcca

SEQ ID NO: 4346238 - DNA, 17 bp, Homo sapiens
ttatgttagagtcattt

SEQ ID NO: 4346239 - DNA, 17 bp, Homo sapiens
ttattacagaaatgttt

SEQ ID NO: 4346240 - DNA, 15 bp, Homo sapiens
ttattacttgtgcac

SEQ ID NO: 4346241 - DNA, 16 bp, Homo sapiens
ttattacttgtgcact

SEQ ID NO: 4346242 - DNA, 18 bp, Homo sapiens
ttattacttgtgcactta

SEQ ID NO: 4346243 - DNA, 21 bp, Homo sapiens
ttattgaaatagtttccaaga

SEQ ID NO: 4346244 - DNA, 14 bp, Homo sapiens
ttattgatatatat

SEQ ID NO: 4346245 - DNA, 23 bp, Homo sapiens
ttattgcaccattttcaatttgg

SEQ ID NO: 4346246 - DNA, 12 bp, Homo sapiens
ttattgcatttg

SEQ ID NO: 4346247 - DNA, 17 bp, Homo sapiens
ttattggtatatttgta

SEQ ID NO: 4346248 - DNA, 23 bp, Homo sapiens
ttattttctgtgtaaaatgagta

SEQ ID NO: 4346249 - DNA, 23 bp, Homo sapiens
ttcaacagagccctattggctta

SEQ ID NO: 4346250 - DNA, 21 bp, Homo sapiens
ttcaaggatatactgcagctt

SEQ ID NO: 4346251 - DNA, 19 bp, Homo sapiens
ttcaaggctttaaaagtca

SEQ ID NO: 4346252 - DNA, 22 bp, Homo sapiens
ttcaagtaagtagatgcctgtt

SEQ ID NO: 4346253 - DNA, 20 bp, Homo sapiens
ttcaattgcagatgccaaaa

SEQ ID NO: 4346254 - DNA, 22 bp, Homo sapiens
ttcacagaccaagtccaagccc

SEQ ID NO: 4346255 - DNA, 16 bp, Homo sapiens
ttcacagttctgtaat

SEQ ID NO: 4346256 - DNA, 20 bp, Homo sapiens
ttcacagttctgtaatgtag

SEQ ID NO: 4346257 - DNA, 13 bp, Homo sapiens
ttcacgaactgtt

SEQ ID NO: 4346258 - DNA, 22 bp, Homo sapiens
ttcactgaagaaaccttcagat

SEQ ID NO: 4346259 - DNA, 19 bp, Homo sapiens
ttcactggggcatgagatt

SEQ ID NO: 4346260 - DNA, 20 bp, Homo sapiens
ttcactgtaagactcattcc

SEQ ID NO: 4346261 - DNA, 14 bp, Homo sapiens
ttcagagtttgtgt

SEQ ID NO: 4346262 - DNA, 17 bp, Homo sapiens
ttcagagtttgtgtgta

SEQ ID NO: 4346263 - DNA, 23 bp, Homo sapiens
ttcagagtttgtgtgtatttgta

SEQ ID NO: 4346264 - DNA, 14 bp, Homo sapiens
ttcagctagaattt

SEQ ID NO: 4346265 - DNA, 18 bp, Homo sapiens
ttcagctagaatttctgg

SEQ ID NO: 4346266 - DNA, 16 bp, Homo sapiens
ttcaggtaacactaca

SEQ ID NO: 4346267 - DNA, 14 bp, Homo sapiens
ttcagtaagccgtg

SEQ ID NO: 4346268 - DNA, 15 bp, Homo sapiens
ttcagtattttccag

SEQ ID NO: 4346269 - DNA, 12 bp, Homo sapiens
ttcagtgggtta

SEQ ID NO: 4346270 - DNA, 21 bp, Homo sapiens
ttcagtgtcgggaattttccc

SEQ ID NO: 4346271 - DNA, 14 bp, Homo sapiens
ttcagtgttgacat

SEQ ID NO: 4346272 - DNA, 16 bp, Homo sapiens
ttcagtgttgacatag

SEQ ID NO: 4346273 - DNA, 20 bp, Homo sapiens
ttcagttaagttcttctccc

SEQ ID NO: 4346274 - DNA, 18 bp, Homo sapiens
ttcagttcatatgcagaa

SEQ ID NO: 4346275 - DNA, 19 bp, Homo sapiens
ttcagtttttttttttcca

SEQ ID NO: 4346276 - DNA, 17 bp, Homo sapiens
ttcataccccagaaatt

SEQ ID NO: 4346277 - DNA, 15 bp, Homo sapiens
ttcattccattgcct

SEQ ID NO: 4346278 - DNA, 23 bp, Homo sapiens
ttcattctcataattcctacagc

SEQ ID NO: 4346279 - DNA, 19 bp, Homo sapiens
ttccaaaataatctatatt

SEQ ID NO: 4346280 - DNA, 21 bp, Homo sapiens
ttccaaatgaatgttgtctgt

SEQ ID NO: 4346281 - DNA, 13 bp, Homo sapiens
ttccaatatttct

SEQ ID NO: 4346282 - DNA, 15 bp, Homo sapiens
ttccaatatttctgc

SEQ ID NO: 4346283 - DNA, 24 bp, Homo sapiens
ttccaatatttctgctttctttga

SEQ ID NO: 4346284 - DNA, 21 bp, Homo sapiens
ttccactgcaaataaagcctt

SEQ ID NO: 4346285 - DNA, 16 bp, Homo sapiens
ttccagaacaaattgt

SEQ ID NO: 4346286 - DNA, 19 bp, Homo sapiens
ttccagagttgttgtttgc

SEQ ID NO: 4346287 - DNA, 20 bp, Homo sapiens
ttccagagttgttgtttgcc

SEQ ID NO: 4346288 - DNA, 22 bp, Homo sapiens
ttccagccttatgtgttacatt

SEQ ID NO: 4346289 - DNA, 19 bp, Homo sapiens
ttccccagctcccccaggc

SEQ ID NO: 4346290 - DNA, 16 bp, Homo sapiens
ttcccccaccccagag

SEQ ID NO: 4346291 - DNA, 17 bp, Homo sapiens
ttcccccaccccagagt

SEQ ID NO: 4346292 - DNA, 13 bp, Homo sapiens
ttcccccgccgct

SEQ ID NO: 4346293 - DNA, 17 bp, Homo sapiens
ttccccctttctctgcc

SEQ ID NO: 4346294 - DNA, 22 bp, Homo sapiens
ttccccctttctctgcctggca

SEQ ID NO: 4346295 - DNA, 15 bp, Homo sapiens
ttccctctcccaccc

SEQ ID NO: 4346296 - DNA, 15 bp, Homo sapiens
ttccctctgcctggg

SEQ ID NO: 4346297 - DNA, 14 bp, Homo sapiens
ttcccttcctcagc

SEQ ID NO: 4346298 - DNA, 23 bp, Homo sapiens
ttcccttgaaattttaaactata

SEQ ID NO: 4346299 - DNA, 22 bp, Homo sapiens
ttcctacagcactactgggtgt

SEQ ID NO: 4346300 - DNA, 15 bp, Homo sapiens
ttcctcagcaggcca

SEQ ID NO: 4346301 - DNA, 18 bp, Homo sapiens
ttcctccccattcctaca

SEQ ID NO: 4346302 - DNA, 12 bp, Homo sapiens
ttcctccctgtc

SEQ ID NO: 4346303 - DNA, 18 bp, Homo sapiens
ttcctccttcatttcagc

SEQ ID NO: 4346304 - DNA, 21 bp, Homo sapiens
ttcctctctttgttctcagct

SEQ ID NO: 4346305 - DNA, 22 bp, Homo sapiens
ttcctctttttatttagttcct

SEQ ID NO: 4346306 - DNA, 16 bp, Homo sapiens
ttcctgtccccagggg

SEQ ID NO: 4346307 - DNA, 17 bp, Homo sapiens
ttcctgtccccagggga

SEQ ID NO: 4346308 - DNA, 13 bp, Homo sapiens
ttcctgtctgttt

SEQ ID NO: 4346309 - DNA, 17 bp, Homo sapiens
ttcctgtctgtttatat

SEQ ID NO: 4346310 - DNA, 18 bp, Homo sapiens
ttccttaaatgaactact

SEQ ID NO: 4346311 - DNA, 21 bp, Homo sapiens
ttccttaaatgaactactgct

SEQ ID NO: 4346312 - DNA, 24 bp, Homo sapiens
ttccttaaatgaactactgctatt

SEQ ID NO: 4346313 - DNA, 14 bp, Homo sapiens
ttccttacttgcac

SEQ ID NO: 4346314 - DNA, 21 bp, Homo sapiens
ttccttgagttgattcagctc

SEQ ID NO: 4346315 - DNA, 23 bp, Homo sapiens
ttcgaagacccagcagatgttta

SEQ ID NO: 4346316 - DNA, 20 bp, Homo sapiens
ttcgcccgagctgtttatgt

SEQ ID NO: 4346317 - DNA, 13 bp, Homo sapiens
ttctaaattctat

SEQ ID NO: 4346318 - DNA, 19 bp, Homo sapiens
ttctaccccacctgacctc

SEQ ID NO: 4346319 - DNA, 23 bp, Homo sapiens
ttctacgacccttttgagcctag

SEQ ID NO: 4346320 - DNA, 20 bp, Homo sapiens
ttctagacactccttgaaat

SEQ ID NO: 4346321 - DNA, 14 bp, Homo sapiens
ttctataaatgact

SEQ ID NO: 4346322 - DNA, 15 bp, Homo sapiens
ttctataaatgacta

SEQ ID NO: 4346323 - DNA, 15 bp, Homo sapiens
ttctatggagacttt

SEQ ID NO: 4346324 - DNA, 21 bp, Homo sapiens
ttctatggagactttgctgtt

SEQ ID NO: 4346325 - DNA, 21 bp, Homo sapiens
ttctcactgccatgccagctt

SEQ ID NO: 4346326 - DNA, 18 bp, Homo sapiens
ttctcagctccccctgtc

SEQ ID NO: 4346327 - DNA, 19 bp, Homo sapiens
ttctcagttgcagaaaatg

SEQ ID NO: 4346328 - DNA, 20 bp, Homo sapiens
ttctcagttgcagaaaatga

SEQ ID NO: 4346329 - DNA, 23 bp, Homo sapiens
ttctcataattcctacagcacta

SEQ ID NO: 4346330 - DNA, 15 bp, Homo sapiens
ttctcatcttgtgaa

SEQ ID NO: 4346331 - DNA, 18 bp, Homo sapiens
ttctcatcttgtgaaatg

SEQ ID NO: 4346332 - DNA, 22 bp, Homo sapiens
ttctccagcctggacccccagc

SEQ ID NO: 4346333 - DNA, 23 bp, Homo sapiens
ttctccagcctggacccccagct

SEQ ID NO: 4346334 - DNA, 12 bp, Homo sapiens
ttctcccaggcc

SEQ ID NO: 4346335 - DNA, 18 bp, Homo sapiens
ttctcccaggcctctgcc

SEQ ID NO: 4346336 - DNA, 20 bp, Homo sapiens
ttctcccaggcctctgcccc

SEQ ID NO: 4346337 - DNA, 16 bp, Homo sapiens
ttctccctagcccttc

SEQ ID NO: 4346338 - DNA, 19 bp, Homo sapiens
ttctcctgccctttcccag

SEQ ID NO: 4346339 - DNA, 18 bp, Homo sapiens
ttctcgcaactgaaggaa

SEQ ID NO: 4346340 - DNA, 19 bp, Homo sapiens
ttctcgcaactgaaggaag

SEQ ID NO: 4346341 - DNA, 12 bp, Homo sapiens
ttctctgcctgg

SEQ ID NO: 4346342 - DNA, 14 bp, Homo sapiens
ttctctgcctggca

SEQ ID NO: 4346343 - DNA, 16 bp, Homo sapiens
ttctctggcaaacttt

SEQ ID NO: 4346344 - DNA, 18 bp, Homo sapiens
ttctcttaaacttgtgaa

SEQ ID NO: 4346345 - DNA, 19 bp, Homo sapiens
ttctcttctttattgcact

SEQ ID NO: 4346346 - DNA, 24 bp, Homo sapiens
ttctcttctttattgcactaggaa

SEQ ID NO: 4346347 - DNA, 15 bp, Homo sapiens
ttctctttgtgcagt

SEQ ID NO: 4346348 - DNA, 14 bp, Homo sapiens
ttctgagccccagc

SEQ ID NO: 4346349 - DNA, 17 bp, Homo sapiens
ttctgagccccagcccc

SEQ ID NO: 4346350 - DNA, 16 bp, Homo sapiens
ttctgcagcaactccc

SEQ ID NO: 4346351 - DNA, 15 bp, Homo sapiens
ttctgctttctttga

SEQ ID NO: 4346352 - DNA, 19 bp, Homo sapiens
ttctgctttctttgattct

SEQ ID NO: 4346353 - DNA, 13 bp, Homo sapiens
ttctggaagaaag

SEQ ID NO: 4346354 - DNA, 12 bp, Homo sapiens
ttctgtgcatgt

SEQ ID NO: 4346355 - DNA, 15 bp, Homo sapiens
ttctgtgtaaaatga

SEQ ID NO: 4346356 - DNA, 12 bp, Homo sapiens
ttcttaatgtct

SEQ ID NO: 4346357 - DNA, 21 bp, Homo sapiens
ttcttaatgtctgtcagaaga

SEQ ID NO: 4346358 - DNA, 12 bp, Homo sapiens
ttcttcagaatt

SEQ ID NO: 4346359 - DNA, 18 bp, Homo sapiens
ttcttcagaattatccat

SEQ ID NO: 4346360 - DNA, 15 bp, Homo sapiens
ttcttgcactgtcca

SEQ ID NO: 4346361 - DNA, 16 bp, Homo sapiens
ttcttggttgttaatt

SEQ ID NO: 4346362 - DNA, 22 bp, Homo sapiens
ttcttgtattttaataaacttt

SEQ ID NO: 4346363 - DNA, 13 bp, Homo sapiens
ttctttattgcac

SEQ ID NO: 4346364 - DNA, 15 bp, Homo sapiens
ttctttattgcacta

SEQ ID NO: 4346365 - DNA, 16 bp, Homo sapiens
ttctttcccagtgagt

SEQ ID NO: 4346366 - DNA, 14 bp, Homo sapiens
ttctttctgtctct

SEQ ID NO: 4346367 - DNA, 13 bp, Homo sapiens
ttctttgattctc

SEQ ID NO: 4346368 - DNA, 10 bp, Homo sapiens
ttctttgtgt

SEQ ID NO: 4346369 - DNA, 11 bp, Homo sapiens
ttctttgtgtt

SEQ ID NO: 4346370 - DNA, 17 bp, Homo sapiens
ttcttttattatcagtt

SEQ ID NO: 4346371 - DNA, 14 bp, Homo sapiens
ttcttttttaaagt

SEQ ID NO: 4346372 - DNA, 17 bp, Homo sapiens
ttcttttttttcttggt

SEQ ID NO: 4346373 - DNA, 12 bp, Homo sapiens
ttgaaaaacttt

SEQ ID NO: 4346374 - DNA, 14 bp, Homo sapiens
ttgaaaaaggaaaa

SEQ ID NO: 4346375 - DNA, 22 bp, Homo sapiens
ttgaaaaaggaaaaatgtagac

SEQ ID NO: 4346376 - DNA, 16 bp, Homo sapiens
ttgaaaaagtgtacat

SEQ ID NO: 4346377 - DNA, 18 bp, Homo sapiens
ttgaaaacaaacttctcg

SEQ ID NO: 4346378 - DNA, 13 bp, Homo sapiens
ttgaaaactgaca

SEQ ID NO: 4346379 - DNA, 15 bp, Homo sapiens
ttgaaaactgacatc

SEQ ID NO: 4346380 - DNA, 18 bp, Homo sapiens
ttgaaaactgacatcaga

SEQ ID NO: 4346381 - DNA, 11 bp, Homo sapiens
ttgaaagaaaa

SEQ ID NO: 4346382 - DNA, 19 bp, Homo sapiens
ttgaaagaaaaaaaaatac

SEQ ID NO: 4346383 - DNA, 15 bp, Homo sapiens
ttgaaagttgctttt

SEQ ID NO: 4346384 - DNA, 21 bp, Homo sapiens
ttgaaatagtttccaagaaat

SEQ ID NO: 4346385 - DNA, 22 bp, Homo sapiens
ttgaaatagtttccaagaaatt

SEQ ID NO: 4346386 - DNA, 12 bp, Homo sapiens
ttgaaattttaa

SEQ ID NO: 4346387 - DNA, 14 bp, Homo sapiens
ttgaagaattgtag

SEQ ID NO: 4346388 - DNA, 23 bp, Homo sapiens
ttgaagaattgtagttcttagtc

SEQ ID NO: 4346389 - DNA, 19 bp, Homo sapiens
ttgaagatacacaagaggg

SEQ ID NO: 4346390 - DNA, 14 bp, Homo sapiens
ttgaataataaatc

SEQ ID NO: 4346391 - DNA, 13 bp, Homo sapiens
ttgaatattactc

SEQ ID NO: 4346392 - DNA, 21 bp, Homo sapiens
ttgaatattactcctattttt

SEQ ID NO: 4346393 - DNA, 15 bp, Homo sapiens
ttgacatagcctttg

SEQ ID NO: 4346394 - DNA, 14 bp, Homo sapiens
ttgacccctttccc

SEQ ID NO: 4346395 - DNA, 22 bp, Homo sapiens
ttgacgggagcattggcccctg

SEQ ID NO: 4346396 - DNA, 17 bp, Homo sapiens
ttgacgttgttgtcatt

SEQ ID NO: 4346397 - DNA, 14 bp, Homo sapiens
ttgagaaaagagtg

SEQ ID NO: 4346398 - DNA, 12 bp, Homo sapiens
ttgagaaggaac

SEQ ID NO: 4346399 - DNA, 17 bp, Homo sapiens
ttgagaccagaagaaaa

SEQ ID NO: 4346400 - DNA, 16 bp, Homo sapiens
ttgagatcagcctggg

SEQ ID NO: 4346401 - DNA, 19 bp, Homo sapiens
ttgagattgccccaggtct

SEQ ID NO: 4346402 - DNA, 16 bp, Homo sapiens
ttgagctttctgtgca

SEQ ID NO: 4346403 - DNA, 19 bp, Homo sapiens
ttgaggaactgtacagaaa

SEQ ID NO: 4346404 - DNA, 16 bp, Homo sapiens
ttgaggtaaagatatg

SEQ ID NO: 4346405 - DNA, 16 bp, Homo sapiens
ttgaggtagaggaaaa

SEQ ID NO: 4346406 - DNA, 18 bp, Homo sapiens
ttgaggtagaggaaaatc

SEQ ID NO: 4346407 - DNA, 20 bp, Homo sapiens
ttgagtcttaactgtatttc

SEQ ID NO: 4346408 - DNA, 13 bp, Homo sapiens
ttgagtttgtagg

SEQ ID NO: 4346409 - DNA, 18 bp, Homo sapiens
ttgataataatattgttt

SEQ ID NO: 4346410 - DNA, 20 bp, Homo sapiens
ttgatagcatggggcccctg

SEQ ID NO: 4346411 - DNA, 23 bp, Homo sapiens
ttgatatatattataaatatata

SEQ ID NO: 4346412 - DNA, 17 bp, Homo sapiens
ttgatcagatgctgaat

SEQ ID NO: 4346413 - DNA, 16 bp, Homo sapiens
ttgatcccctctctgt

SEQ ID NO: 4346414 - DNA, 16 bp, Homo sapiens
ttgatctttgtttaaa

SEQ ID NO: 4346415 - DNA, 20 bp, Homo sapiens
ttgatctttgtttaaatgcc

SEQ ID NO: 4346416 - DNA, 20 bp, Homo sapiens
ttgattctccttttatgtgt

SEQ ID NO: 4346417 - DNA, 12 bp, Homo sapiens
ttgattcttcct

SEQ ID NO: 4346418 - DNA, 16 bp, Homo sapiens
ttgcaaaatagaagaa

SEQ ID NO: 4346419 - DNA, 24 bp, Homo sapiens
ttgcaaactctataaagaaacttt

SEQ ID NO: 4346420 - DNA, 19 bp, Homo sapiens
ttgcaaattatttattact

SEQ ID NO: 4346421 - DNA, 15 bp, Homo sapiens
ttgcaccactgcact

SEQ ID NO: 4346422 - DNA, 14 bp, Homo sapiens
ttgcacctgagcct

SEQ ID NO: 4346423 - DNA, 23 bp, Homo sapiens
ttgcactaggaattctttgcatt

SEQ ID NO: 4346424 - DNA, 15 bp, Homo sapiens
ttgcataatactaat

SEQ ID NO: 4346425 - DNA, 22 bp, Homo sapiens
ttgcattccttacttgcactgt

SEQ ID NO: 4346426 - DNA, 15 bp, Homo sapiens
ttgccacaggcctcc

SEQ ID NO: 4346427 - DNA, 12 bp, Homo sapiens
ttgccactaagt

SEQ ID NO: 4346428 - DNA, 19 bp, Homo sapiens
ttgcccaacaccagcccct

SEQ ID NO: 4346429 - DNA, 21 bp, Homo sapiens
ttgcccaacaccagcccctgc

SEQ ID NO: 4346430 - DNA, 22 bp, Homo sapiens
ttgctaaattataaaattgaaa

SEQ ID NO: 4346431 - DNA, 19 bp, Homo sapiens
ttgctctgggagacttact

SEQ ID NO: 4346432 - DNA, 23 bp, Homo sapiens
ttgctctgggagacttactgcat

SEQ ID NO: 4346433 - DNA, 22 bp, Homo sapiens
ttgctgaaggattatatgtatt

SEQ ID NO: 4346434 - DNA, 15 bp, Homo sapiens
ttgctgcataaaatt

SEQ ID NO: 4346435 - DNA, 18 bp, Homo sapiens
ttgctgcataaaattcta

SEQ ID NO: 4346436 - DNA, 12 bp, Homo sapiens
ttgctgcatttt

SEQ ID NO: 4346437 - DNA, 15 bp, Homo sapiens
ttgctgttactgctt

SEQ ID NO: 4346438 - DNA, 14 bp, Homo sapiens
ttgctgttgtttct

SEQ ID NO: 4346439 - DNA, 22 bp, Homo sapiens
ttgctgttgtttctataaatga

SEQ ID NO: 4346440 - DNA, 14 bp, Homo sapiens
ttgcttagtaaaat

SEQ ID NO: 4346441 - DNA, 15 bp, Homo sapiens
ttgcttagtaaaatt

SEQ ID NO: 4346442 - DNA, 17 bp, Homo sapiens
ttgctttggatacacac

SEQ ID NO: 4346443 - DNA, 10 bp, Homo sapiens
ttggaaaatt

SEQ ID NO: 4346444 - DNA, 15 bp, Homo sapiens
ttggaaataaaaatg

SEQ ID NO: 4346445 - DNA, 13 bp, Homo sapiens
ttggaaatattca

SEQ ID NO: 4346446 - DNA, 21 bp, Homo sapiens
ttggaaatggatgcaaagtac

SEQ ID NO: 4346447 - DNA, 16 bp, Homo sapiens
ttggaacaaagtgaag

SEQ ID NO: 4346448 - DNA, 17 bp, Homo sapiens
ttggacagacactgttg

SEQ ID NO: 4346449 - DNA, 22 bp, Homo sapiens
ttggacagacactgttgcaaag

SEQ ID NO: 4346450 - DNA, 23 bp, Homo sapiens
ttggagcattaactaaatgctca

SEQ ID NO: 4346451 - DNA, 13 bp, Homo sapiens
ttggagtgcccca

SEQ ID NO: 4346452 - DNA, 18 bp, Homo sapiens
ttggagtgccccaaggag

SEQ ID NO: 4346453 - DNA, 14 bp, Homo sapiens
ttggatacacacat

SEQ ID NO: 4346454 - DNA, 16 bp, Homo sapiens
ttggcccttctgccct

SEQ ID NO: 4346455 - DNA, 14 bp, Homo sapiens
ttggcttactgaaa

SEQ ID NO: 4346456 - DNA, 13 bp, Homo sapiens
ttggcttgctgtt

SEQ ID NO: 4346457 - DNA, 21 bp, Homo sapiens
ttgggagattatcagtagaaa

SEQ ID NO: 4346458 - DNA, 19 bp, Homo sapiens
ttgggagggaaaagggaag

SEQ ID NO: 4346459 - DNA, 16 bp, Homo sapiens
ttgggaggggccggag

SEQ ID NO: 4346460 - DNA, 20 bp, Homo sapiens
ttgggccaatttactggcca

SEQ ID NO: 4346461 - DNA, 19 bp, Homo sapiens
ttggtaacacaaattttca

SEQ ID NO: 4346462 - DNA, 13 bp, Homo sapiens
ttggttcatgctt

SEQ ID NO: 4346463 - DNA, 21 bp, Homo sapiens
ttgtaatgccaatatgacaca

SEQ ID NO: 4346464 - DNA, 15 bp, Homo sapiens
ttgtacaagctcagg

SEQ ID NO: 4346465 - DNA, 20 bp, Homo sapiens
ttgtaccccccaacccctga

SEQ ID NO: 4346466 - DNA, 16 bp, Homo sapiens
ttgtattaataaagca

SEQ ID NO: 4346467 - DNA, 19 bp, Homo sapiens
ttgtattaataaagcattc

SEQ ID NO: 4346468 - DNA, 21 bp, Homo sapiens
ttgtattttaataaactttga

SEQ ID NO: 4346469 - DNA, 22 bp, Homo sapiens
ttgtcctttgaggccccaactc

SEQ ID NO: 4346470 - DNA, 19 bp, Homo sapiens
ttgtctctcttcagactct

SEQ ID NO: 4346471 - DNA, 22 bp, Homo sapiens
ttgtcttaaaaagtggaaaaat

SEQ ID NO: 4346472 - DNA, 18 bp, Homo sapiens
ttgtgcagtgttagtatt

SEQ ID NO: 4346473 - DNA, 19 bp, Homo sapiens
ttgtgcctggttcgtgcca

SEQ ID NO: 4346474 - DNA, 11 bp, Homo sapiens
ttgtgcttctc

SEQ ID NO: 4346475 - DNA, 17 bp, Homo sapiens
ttgtggaccaattattg

SEQ ID NO: 4346476 - DNA, 18 bp, Homo sapiens
ttgtggaccaattattga

SEQ ID NO: 4346477 - DNA, 15 bp, Homo sapiens
ttgtggttttatgga

SEQ ID NO: 4346478 - DNA, 16 bp, Homo sapiens
ttgtgtgtatttgtat

SEQ ID NO: 4346479 - DNA, 21 bp, Homo sapiens
ttgtgtgtatttgtattaata

SEQ ID NO: 4346480 - DNA, 23 bp, Homo sapiens
ttgtgtgtatttgtattaataaa

SEQ ID NO: 4346481 - DNA, 18 bp, Homo sapiens
ttgttatcatttaagatt

SEQ ID NO: 4346482 - DNA, 20 bp, Homo sapiens
ttgttccacccgacctctga

SEQ ID NO: 4346483 - DNA, 13 bp, Homo sapiens
ttgttctcagctc

SEQ ID NO: 4346484 - DNA, 14 bp, Homo sapiens
ttgttgaaaaatgt

SEQ ID NO: 4346485 - DNA, 13 bp, Homo sapiens
ttgtttcttgttt

SEQ ID NO: 4346486 - DNA, 12 bp, Homo sapiens
ttgtttctttct

SEQ ID NO: 4346487 - DNA, 13 bp, Homo sapiens
ttgttttaatcta

SEQ ID NO: 4346488 - DNA, 14 bp, Homo sapiens
tttaaaaaatatat

SEQ ID NO: 4346489 - DNA, 19 bp, Homo sapiens
tttaaaaagggtaacttgt

SEQ ID NO: 4346490 - DNA, 18 bp, Homo sapiens
tttaaaaagttatataaa

SEQ ID NO: 4346491 - DNA, 17 bp, Homo sapiens
tttaaaaccagttaccc

SEQ ID NO: 4346492 - DNA, 18 bp, Homo sapiens
tttaaaagtcattattcc

SEQ ID NO: 4346493 - DNA, 13 bp, Homo sapiens
tttaaagtaaact

SEQ ID NO: 4346494 - DNA, 16 bp, Homo sapiens
tttaaagtaaacttgt

SEQ ID NO: 4346495 - DNA, 20 bp, Homo sapiens
tttaaagtaaacttgtgtat

SEQ ID NO: 4346496 - DNA, 17 bp, Homo sapiens
tttaaatcaaaaacttt

SEQ ID NO: 4346497 - DNA, 12 bp, Homo sapiens
tttaaatgccaa

SEQ ID NO: 4346498 - DNA, 18 bp, Homo sapiens
tttaaatgccaaaatgta

SEQ ID NO: 4346499 - DNA, 13 bp, Homo sapiens
tttaagtttgaaa

SEQ ID NO: 4346500 - DNA, 21 bp, Homo sapiens
tttaataaactttgaataaaa

SEQ ID NO: 4346501 - DNA, 16 bp, Homo sapiens
tttaattaaaaacttt

SEQ ID NO: 4346502 - DNA, 19 bp, Homo sapiens
tttaattaaaaactttaaa

SEQ ID NO: 4346503 - DNA, 14 bp, Homo sapiens
tttaatttccaaaa

SEQ ID NO: 4346504 - DNA, 21 bp, Homo sapiens
tttaatttccaaaataatcta

SEQ ID NO: 4346505 - DNA, 16 bp, Homo sapiens
tttacaaaactgcttt

SEQ ID NO: 4346506 - DNA, 17 bp, Homo sapiens
tttacaaaactgctttg

SEQ ID NO: 4346507 - DNA, 17 bp, Homo sapiens
tttacaatgatgccgaa

SEQ ID NO: 4346508 - DNA, 15 bp, Homo sapiens
tttactatttgggct

SEQ ID NO: 4346509 - DNA, 13 bp, Homo sapiens
tttactgagactt

SEQ ID NO: 4346510 - DNA, 17 bp, Homo sapiens
tttagaaccccaggtga

SEQ ID NO: 4346511 - DNA, 23 bp, Homo sapiens
tttagaagcaaagatttcagtag

SEQ ID NO: 4346512 - DNA, 23 bp, Homo sapiens
tttagactgtggccatatatgct

SEQ ID NO: 4346513 - DNA, 19 bp, Homo sapiens
tttagagcgtttggttaaa

SEQ ID NO: 4346514 - DNA, 13 bp, Homo sapiens
tttagccattacc

SEQ ID NO: 4346515 - DNA, 19 bp, Homo sapiens
tttagctacctttttatat

SEQ ID NO: 4346516 - DNA, 19 bp, Homo sapiens
tttataaaaataaatagaa

SEQ ID NO: 4346517 - DNA, 18 bp, Homo sapiens
tttatacacaactttgca

SEQ ID NO: 4346518 - DNA, 14 bp, Homo sapiens
tttatatataaggt

SEQ ID NO: 4346519 - DNA, 22 bp, Homo sapiens
tttatcaaacagaattttaaag

SEQ ID NO: 4346520 - DNA, 14 bp, Homo sapiens
tttatcgcaacatg

SEQ ID NO: 4346521 - DNA, 17 bp, Homo sapiens
tttatcgcaacatgaat

SEQ ID NO: 4346522 - DNA, 17 bp, Homo sapiens
tttatctatcggaagaa

SEQ ID NO: 4346523 - DNA, 15 bp, Homo sapiens
tttatctttgtgtaa

SEQ ID NO: 4346524 - DNA, 16 bp, Homo sapiens
tttatgagatttactg

SEQ ID NO: 4346525 - DNA, 17 bp, Homo sapiens
tttatgagatttactgc

SEQ ID NO: 4346526 - DNA, 13 bp, Homo sapiens
tttatgatttctt

SEQ ID NO: 4346527 - DNA, 18 bp, Homo sapiens
tttattacagaaatgttt

SEQ ID NO: 4346528 - DNA, 13 bp, Homo sapiens
tttattatacacc

SEQ ID NO: 4346529 - DNA, 23 bp, Homo sapiens
tttattcagctagaatttctggt

SEQ ID NO: 4346530 - DNA, 19 bp, Homo sapiens
tttattgcactaggaattc

SEQ ID NO: 4346531 - DNA, 18 bp, Homo sapiens
tttattgcatttgctgtt

SEQ ID NO: 4346532 - DNA, 14 bp, Homo sapiens
tttatttaaactat

SEQ ID NO: 4346533 - DNA, 14 bp, Homo sapiens
tttatttatatctt

SEQ ID NO: 4346534 - DNA, 22 bp, Homo sapiens
tttcaacagagccctattggct

SEQ ID NO: 4346535 - DNA, 21 bp, Homo sapiens
tttcaatttggagcattaact

SEQ ID NO: 4346536 - DNA, 13 bp, Homo sapiens
tttcacagttctg

SEQ ID NO: 4346537 - DNA, 21 bp, Homo sapiens
tttcagtagaattttagtcct

SEQ ID NO: 4346538 - DNA, 13 bp, Homo sapiens
tttcattgtgatt

SEQ ID NO: 4346539 - DNA, 17 bp, Homo sapiens
tttcattgtgatttata

SEQ ID NO: 4346540 - DNA, 22 bp, Homo sapiens
tttcattgtgatttatatataa

SEQ ID NO: 4346541 - DNA, 15 bp, Homo sapiens
tttcatttcagattt

SEQ ID NO: 4346542 - DNA, 17 bp, Homo sapiens
tttccatgaagtttgaa

SEQ ID NO: 4346543 - DNA, 23 bp, Homo sapiens
tttcccaagctagactgtgtctg

SEQ ID NO: 4346544 - DNA, 14 bp, Homo sapiens
tttccctggtgccc

SEQ ID NO: 4346545 - DNA, 21 bp, Homo sapiens
tttcctatctagcatttattt

SEQ ID NO: 4346546 - DNA, 23 bp, Homo sapiens
tttcctatctagcatttatttct

SEQ ID NO: 4346547 - DNA, 15 bp, Homo sapiens
tttcctctctatctt

SEQ ID NO: 4346548 - DNA, 22 bp, Homo sapiens
tttcctctctttgttctcagct

SEQ ID NO: 4346549 - DNA, 21 bp, Homo sapiens
tttcctttgtggttttatgga

SEQ ID NO: 4346550 - DNA, 17 bp, Homo sapiens
tttcgcttgcttctgca

SEQ ID NO: 4346551 - DNA, 22 bp, Homo sapiens
tttctaatgttctaaattctat

SEQ ID NO: 4346552 - DNA, 20 bp, Homo sapiens
tttctacattattgcttatt

SEQ ID NO: 4346553 - DNA, 13 bp, Homo sapiens
tttctataaatga

SEQ ID NO: 4346554 - DNA, 13 bp, Homo sapiens
tttctcattaaac

SEQ ID NO: 4346555 - DNA, 13 bp, Homo sapiens
tttctctatgtac

SEQ ID NO: 4346556 - DNA, 11 bp, Homo sapiens
tttctctgcct

SEQ ID NO: 4346557 - DNA, 14 bp, Homo sapiens
tttctctgcctggc

SEQ ID NO: 4346558 - DNA, 22 bp, Homo sapiens
tttctctgcctggcaacatctt

SEQ ID NO: 4346559 - DNA, 21 bp, Homo sapiens
tttctgagtgagttttactct

SEQ ID NO: 4346560 - DNA, 24 bp, Homo sapiens
tttctgcccagccctctgtggcca

SEQ ID NO: 4346561 - DNA, 11 bp, Homo sapiens
tttctggaaga

SEQ ID NO: 4346562 - DNA, 16 bp, Homo sapiens
tttctggccttgactt

SEQ ID NO: 4346563 - DNA, 17 bp, Homo sapiens
tttctgtgcatgtgcag

SEQ ID NO: 4346564 - DNA, 10 bp, Homo sapiens
tttctgtgga

SEQ ID NO: 4346565 - DNA, 15 bp, Homo sapiens
tttctgtgtaaaatg

SEQ ID NO: 4346566 - DNA, 15 bp, Homo sapiens
tttcttaatgtctgt

SEQ ID NO: 4346567 - DNA, 20 bp, Homo sapiens
tttcttaatgtctgtcagaa

SEQ ID NO: 4346568 - DNA, 22 bp, Homo sapiens
tttcttaatgtctgtcagaaga

SEQ ID NO: 4346569 - DNA, 17 bp, Homo sapiens
tttcttgcactgtccag

SEQ ID NO: 4346570 - DNA, 15 bp, Homo sapiens
tttctttctgtctct

SEQ ID NO: 4346571 - DNA, 14 bp, Homo sapiens
tttgaaaactgaca

SEQ ID NO: 4346572 - DNA, 21 bp, Homo sapiens
tttgaaaactgacatcagatt

SEQ ID NO: 4346573 - DNA, 15 bp, Homo sapiens
tttgaaacctgctct

SEQ ID NO: 4346574 - DNA, 16 bp, Homo sapiens
tttgaaactaactcat

SEQ ID NO: 4346575 - DNA, 12 bp, Homo sapiens
tttgaagaattg

SEQ ID NO: 4346576 - DNA, 15 bp, Homo sapiens
tttgaagcctgccct

SEQ ID NO: 4346577 - DNA, 12 bp, Homo sapiens
tttgaataaaag

SEQ ID NO: 4346578 - DNA, 16 bp, Homo sapiens
tttgagaccagaagaa

SEQ ID NO: 4346579 - DNA, 18 bp, Homo sapiens
tttgagaccagaagaaaa

SEQ ID NO: 4346580 - DNA, 20 bp, Homo sapiens
tttgagaccagaagaaaaga

SEQ ID NO: 4346581 - DNA, 23 bp, Homo sapiens
tttgagaccagaagaaaagactt

SEQ ID NO: 4346582 - DNA, 15 bp, Homo sapiens
tttgaggactgaagc

SEQ ID NO: 4346583 - DNA, 16 bp, Homo sapiens
tttgaggtagaggaaa

SEQ ID NO: 4346584 - DNA, 22 bp, Homo sapiens
tttgaggtagaggaaaatcaat

SEQ ID NO: 4346585 - DNA, 20 bp, Homo sapiens
tttgatctttgtttaaatgc

SEQ ID NO: 4346586 - DNA, 21 bp, Homo sapiens
tttgatctttgtttaaatgcc

SEQ ID NO: 4346587 - DNA, 21 bp, Homo sapiens
tttgcatccacttcaggagcc

SEQ ID NO: 4346588 - DNA, 16 bp, Homo sapiens
tttgccaagctaatct

SEQ ID NO: 4346589 - DNA, 13 bp, Homo sapiens
tttgccctgaggc

SEQ ID NO: 4346590 - DNA, 14 bp, Homo sapiens
tttgccctgaggct

SEQ ID NO: 4346591 - DNA, 20 bp, Homo sapiens
tttgcctgagtgtattttac

SEQ ID NO: 4346592 - DNA, 24 bp, Homo sapiens
tttgctactgtacataaacaatga

SEQ ID NO: 4346593 - DNA, 17 bp, Homo sapiens
tttgctgcattttacac

SEQ ID NO: 4346594 - DNA, 18 bp, Homo sapiens
tttgctgcattttacaca

SEQ ID NO: 4346595 - DNA, 22 bp, Homo sapiens
tttggagcattaactaaatgct

SEQ ID NO: 4346596 - DNA, 16 bp, Homo sapiens
tttggattttaacttt

SEQ ID NO: 4346597 - DNA, 14 bp, Homo sapiens
tttggcttgctgtt

SEQ ID NO: 4346598 - DNA, 16 bp, Homo sapiens
tttgggagggaaaagg

SEQ ID NO: 4346599 - DNA, 13 bp, Homo sapiens
tttggttaaagta

SEQ ID NO: 4346600 - DNA, 20 bp, Homo sapiens
tttgtaccccccaacccctg

SEQ ID NO: 4346601 - DNA, 15 bp, Homo sapiens
tttgtaggtaaaatg

SEQ ID NO: 4346602 - DNA, 20 bp, Homo sapiens
tttgtaggtaaaatgtattt

SEQ ID NO: 4346603 - DNA, 19 bp, Homo sapiens
tttgtattaataaagcatt

SEQ ID NO: 4346604 - DNA, 22 bp, Homo sapiens
tttgtccattccattaataact

SEQ ID NO: 4346605 - DNA, 19 bp, Homo sapiens
tttgtccttgcacctgagc

SEQ ID NO: 4346606 - DNA, 19 bp, Homo sapiens
tttgtctgtgtgctgtaac

SEQ ID NO: 4346607 - DNA, 14 bp, Homo sapiens
tttgtcttaaaaag

SEQ ID NO: 4346608 - DNA, 17 bp, Homo sapiens
tttgtggcaccttttct

SEQ ID NO: 4346609 - DNA, 20 bp, Homo sapiens
tttgtgtgtatttgtattaa

SEQ ID NO: 4346610 - DNA, 17 bp, Homo sapiens
tttgttcctttgaagaa

SEQ ID NO: 4346611 - DNA, 13 bp, Homo sapiens
tttgttgaaaaat

SEQ ID NO: 4346612 - DNA, 15 bp, Homo sapiens
tttgttgtcagctga

SEQ ID NO: 4346613 - DNA, 10 bp, Homo sapiens
tttgtttctt

SEQ ID NO: 4346614 - DNA, 23 bp, Homo sapiens
ttttaaacaaaatttcacagttc

SEQ ID NO: 4346615 - DNA, 13 bp, Homo sapiens
ttttaaagaagga

SEQ ID NO: 4346616 - DNA, 19 bp, Homo sapiens
ttttaaagtaaacttgtgt

SEQ ID NO: 4346617 - DNA, 19 bp, Homo sapiens
ttttaaatcaaaaactttt

SEQ ID NO: 4346618 - DNA, 20 bp, Homo sapiens
ttttaaatcaaaaacttttc

SEQ ID NO: 4346619 - DNA, 21 bp, Homo sapiens
ttttaaccattgtcttgttct

SEQ ID NO: 4346620 - DNA, 18 bp, Homo sapiens
ttttaacctcaaaatggt

SEQ ID NO: 4346621 - DNA, 19 bp, Homo sapiens
ttttaagtgcttcacattt

SEQ ID NO: 4346622 - DNA, 13 bp, Homo sapiens
ttttaataaaagt

SEQ ID NO: 4346623 - DNA, 19 bp, Homo sapiens
ttttaataaactttgaata

SEQ ID NO: 4346624 - DNA, 12 bp, Homo sapiens
ttttaatttcca

SEQ ID NO: 4346625 - DNA, 16 bp, Homo sapiens
ttttacaaaactgctt

SEQ ID NO: 4346626 - DNA, 19 bp, Homo sapiens
ttttacaaaactgctttgt

SEQ ID NO: 4346627 - DNA, 14 bp, Homo sapiens
ttttatgtggtctt

SEQ ID NO: 4346628 - DNA, 15 bp, Homo sapiens
ttttatgtggtctta

SEQ ID NO: 4346629 - DNA, 19 bp, Homo sapiens
ttttattacagaaatgttt

SEQ ID NO: 4346630 - DNA, 13 bp, Homo sapiens
ttttattatcagt

SEQ ID NO: 4346631 - DNA, 23 bp, Homo sapiens
ttttattatcagttaaaatcaca

SEQ ID NO: 4346632 - DNA, 15 bp, Homo sapiens
ttttattttcattgt

SEQ ID NO: 4346633 - DNA, 15 bp, Homo sapiens
ttttcagtagtgagc

SEQ ID NO: 4346634 - DNA, 20 bp, Homo sapiens
ttttcagttcatatgcagaa

SEQ ID NO: 4346635 - DNA, 14 bp, Homo sapiens
ttttcatagatttg

SEQ ID NO: 4346636 - DNA, 16 bp, Homo sapiens
ttttcatagatttgaa

SEQ ID NO: 4346637 - DNA, 13 bp, Homo sapiens
ttttcatttcaga

SEQ ID NO: 4346638 - DNA, 18 bp, Homo sapiens
ttttcatttcagatttta

SEQ ID NO: 4346639 - DNA, 19 bp, Homo sapiens
ttttccagccttatgtgtt

SEQ ID NO: 4346640 - DNA, 19 bp, Homo sapiens
ttttccaggtttaagctgt

SEQ ID NO: 4346641 - DNA, 17 bp, Homo sapiens
ttttccatctgtgtgca

SEQ ID NO: 4346642 - DNA, 18 bp, Homo sapiens
ttttccctattagagaag

SEQ ID NO: 4346643 - DNA, 22 bp, Homo sapiens
ttttccctattagagaagagat

SEQ ID NO: 4346644 - DNA, 20 bp, Homo sapiens
ttttccttcctttttattca

SEQ ID NO: 4346645 - DNA, 21 bp, Homo sapiens
ttttcgcttgcttctgcagca

SEQ ID NO: 4346646 - DNA, 19 bp, Homo sapiens
ttttctgtgtaaaatgagt

SEQ ID NO: 4346647 - DNA, 19 bp, Homo sapiens
ttttcttaccctctctttc

SEQ ID NO: 4346648 - DNA, 11 bp, Homo sapiens
ttttcttcagg

SEQ ID NO: 4346649 - DNA, 22 bp, Homo sapiens
ttttcttttattatcagttaaa

SEQ ID NO: 4346650 - DNA, 15 bp, Homo sapiens
ttttcttttctatgg

SEQ ID NO: 4346651 - DNA, 21 bp, Homo sapiens
ttttgaaaaagtgtacatgaa

SEQ ID NO: 4346652 - DNA, 20 bp, Homo sapiens
ttttgataataatattgttt

SEQ ID NO: 4346653 - DNA, 13 bp, Homo sapiens
ttttgtgagatgt

SEQ ID NO: 4346654 - DNA, 21 bp, Homo sapiens
ttttgtttgtttctttgtgtt

SEQ ID NO: 4346655 - DNA, 15 bp, Homo sapiens
tttttaaaatagaca

SEQ ID NO: 4346656 - DNA, 16 bp, Homo sapiens
tttttaaagtaaactt

SEQ ID NO: 4346657 - DNA, 20 bp, Homo sapiens
tttttaaatcaaaaactttt

SEQ ID NO: 4346658 - DNA, 13 bp, Homo sapiens
tttttaatagaat

SEQ ID NO: 4346659 - DNA, 17 bp, Homo sapiens
tttttacaaaactgctt

SEQ ID NO: 4346660 - DNA, 12 bp, Homo sapiens
tttttataggtt

SEQ ID NO: 4346661 - DNA, 15 bp, Homo sapiens
tttttctccagtgct

SEQ ID NO: 4346662 - DNA, 12 bp, Homo sapiens
tttttctctcaa

SEQ ID NO: 4346663 - DNA, 16 bp, Homo sapiens
tttttctggccttgac

SEQ ID NO: 4346664 - DNA, 11 bp, Homo sapiens
tttttcttggt

SEQ ID NO: 4346665 - DNA, 12 bp, Homo sapiens
tttttgctaatt

SEQ ID NO: 4346666 - DNA, 23 bp, Homo sapiens
tttttgtaaactggaattaaaag

SEQ ID NO: 4346667 - DNA, 12 bp, Homo sapiens
ttttttaaatca

SEQ ID NO: 4346668 - DNA, 13 bp, Homo sapiens
ttttttcttcccc

SEQ ID NO: 4346669 - DNA, 12 bp, Homo sapiens
ttttttttaagt

SEQ ID NO: 4346670 - DNA, 23 bp, Homo sapiens
aaaggcagctaagatagaaagct

SEQ ID NO: 4346671 - DNA, 12 bp, Homo sapiens
aaaggcttggct

SEQ ID NO: 4346672 - DNA, 17 bp, Homo sapiens
aaaggcttggctggtgt

SEQ ID NO: 4346673 - DNA, 21 bp, Homo sapiens
aaagggaagttatttatattt

SEQ ID NO: 4346674 - DNA, 20 bp, Homo sapiens
aaagggttgaaaatgtgttt

SEQ ID NO: 4346675 - DNA, 18 bp, Homo sapiens
aaaggtggcaatgcttaa

SEQ ID NO: 4346676 - DNA, 15 bp, Homo sapiens
aaaggtggtaaattc

SEQ ID NO: 4346677 - DNA, 13 bp, Homo sapiens
aaaggttttgtat

SEQ ID NO: 4346678 - DNA, 21 bp, Homo sapiens
aaagtgatcttgagaaccttt

SEQ ID NO: 4346679 - DNA, 19 bp, Homo sapiens
aaagttgcagatgtattga

SEQ ID NO: 4346680 - DNA, 15 bp, Homo sapiens
aaagttggagcttct

SEQ ID NO: 4346681 - DNA, 13 bp, Homo sapiens
aaataatgaataa

SEQ ID NO: 4346682 - DNA, 19 bp, Homo sapiens
aaataatgaataaactgaa

SEQ ID NO: 4346683 - DNA, 21 bp, Homo sapiens
aaatactgtgcagaataatgg

SEQ ID NO: 4346684 - DNA, 17 bp, Homo sapiens
aaatcaggcagaaatat

SEQ ID NO: 4346685 - DNA, 14 bp, Homo sapiens
aaatcatgtatgtt

SEQ ID NO: 4346686 - DNA, 18 bp, Homo sapiens
aaatcatgtatgttatga

SEQ ID NO: 4346687 - DNA, 18 bp, Homo sapiens
aaatgagcgcagcagaga

SEQ ID NO: 4346688 - DNA, 14 bp, Homo sapiens
aaatgccagagcca

SEQ ID NO: 4346689 - DNA, 16 bp, Homo sapiens
aaatgccagagccaac

SEQ ID NO: 4346690 - DNA, 23 bp, Homo sapiens
aaatgccagagccaacctggact

SEQ ID NO: 4346691 - DNA, 19 bp, Homo sapiens
aaatggttcatattttata

SEQ ID NO: 4346692 - DNA, 15 bp, Homo sapiens
aaatgtggtttttga

SEQ ID NO: 4346693 - DNA, 13 bp, Homo sapiens
aaattcagttttt

SEQ ID NO: 4346694 - DNA, 17 bp, Homo sapiens
aaattcagtttttgtat

SEQ ID NO: 4346695 - DNA, 18 bp, Homo sapiens
aaattcagtttttgtatc

SEQ ID NO: 4346696 - DNA, 21 bp, Homo sapiens
aaattcagtttttgtatcttg

SEQ ID NO: 4346697 - DNA, 15 bp, Homo sapiens
aaattctatgttaaa

SEQ ID NO: 4346698 - DNA, 20 bp, Homo sapiens
aaatttagccctttaaaacg

SEQ ID NO: 4346699 - DNA, 23 bp, Homo sapiens
aaatttatatgtcagagctgtta

SEQ ID NO: 4346700 - DNA, 19 bp, Homo sapiens
aacagtagttgtattcttc

SEQ ID NO: 4346701 - DNA, 13 bp, Homo sapiens
aacatccaagcca

SEQ ID NO: 4346702 - DNA, 17 bp, Homo sapiens
aacatcgatatgtatat

SEQ ID NO: 4346703 - DNA, 19 bp, Homo sapiens
aacatgaaagctgatgcca

SEQ ID NO: 4346704 - DNA, 14 bp, Homo sapiens
aacattatgatcta

SEQ ID NO: 4346705 - DNA, 18 bp, Homo sapiens
aacattatgatctaataa

SEQ ID NO: 4346706 - DNA, 22 bp, Homo sapiens
aacattatgatctaataaactt

SEQ ID NO: 4346707 - DNA, 14 bp, Homo sapiens
aaccaggccttcat

SEQ ID NO: 4346708 - DNA, 20 bp, Homo sapiens
aaccaggccttcatcctcct

SEQ ID NO: 4346709 - DNA, 16 bp, Homo sapiens
aacctttcagtactct

SEQ ID NO: 4346710 - DNA, 20 bp, Homo sapiens
aacggtgctttctgtgaaag

SEQ ID NO: 4346711 - DNA, 16 bp, Homo sapiens
aactaaataatgaata

SEQ ID NO: 4346712 - DNA, 18 bp, Homo sapiens
aactctagactgcaagaa

SEQ ID NO: 4346713 - DNA, 15 bp, Homo sapiens
aactgaatattttgg

SEQ ID NO: 4346714 - DNA, 22 bp, Homo sapiens
aacttcagttttatttttgcca

SEQ ID NO: 4346715 - DNA, 23 bp, Homo sapiens
aacttcagttttatttttgccaa

SEQ ID NO: 4346716 - DNA, 22 bp, Homo sapiens
aacttcattagggtaatatcat

SEQ ID NO: 4346717 - DNA, 14 bp, Homo sapiens
aacttctaaacact

SEQ ID NO: 4346718 - DNA, 15 bp, Homo sapiens
aacttctaaacactt

SEQ ID NO: 4346719 - DNA, 19 bp, Homo sapiens
aacttgtgaagacaatgaa

SEQ ID NO: 4346720 - DNA, 21 bp, Homo sapiens
aactttactctgtgtttaaaa

SEQ ID NO: 4346721 - DNA, 18 bp, Homo sapiens
aacttttttatatctttt

SEQ ID NO: 4346722 - DNA, 23 bp, Homo sapiens
aagaaatgttataaagtagaact

SEQ ID NO: 4346723 - DNA, 13 bp, Homo sapiens
aagaagataaatg

SEQ ID NO: 4346724 - DNA, 14 bp, Homo sapiens
aagaagggggtggg

SEQ ID NO: 4346725 - DNA, 22 bp, Homo sapiens
aagactgcagaacccccaggtg

SEQ ID NO: 4346726 - DNA, 23 bp, Homo sapiens
aagaggctgcccctctcaccaaa

SEQ ID NO: 4346727 - DNA, 13 bp, Homo sapiens
aagagtaacttta

SEQ ID NO: 4346728 - DNA, 13 bp, Homo sapiens
aagatagaaagct

SEQ ID NO: 4346729 - DNA, 18 bp, Homo sapiens
aagatagaaagctggact

SEQ ID NO: 4346730 - DNA, 22 bp, Homo sapiens
aagatatatttcacttttgttc

SEQ ID NO: 4346731 - DNA, 16 bp, Homo sapiens
aagatggctgctgcct

SEQ ID NO: 4346732 - DNA, 21 bp, Homo sapiens
aagatgggtccctggccacca

SEQ ID NO: 4346733 - DNA, 14 bp, Homo sapiens
aagatggtttcaat

SEQ ID NO: 4346734 - DNA, 17 bp, Homo sapiens
aagatggtttcaattca

SEQ ID NO: 4346735 - DNA, 18 bp, Homo sapiens
aagcattgcctggactga

SEQ ID NO: 4346736 - DNA, 19 bp, Homo sapiens
aagcattgcctggactgac

SEQ ID NO: 4346737 - DNA, 22 bp, Homo sapiens
aagcattgcctggactgaccac

SEQ ID NO: 4346738 - DNA, 14 bp, Homo sapiens
aagccttctggatc

SEQ ID NO: 4346739 - DNA, 20 bp, Homo sapiens
aagccttctggatccatggg

SEQ ID NO: 4346740 - DNA, 21 bp, Homo sapiens
aagccttctggatccatgggg

SEQ ID NO: 4346741 - DNA, 14 bp, Homo sapiens
aagctggactgacc

SEQ ID NO: 4346742 - DNA, 15 bp, Homo sapiens
aagctggactgacca

SEQ ID NO: 4346743 - DNA, 13 bp, Homo sapiens
aagcttgaggcca

SEQ ID NO: 4346744 - DNA, 14 bp, Homo sapiens
aagcttgaggccaa

SEQ ID NO: 4346745 - DNA, 21 bp, Homo sapiens
aagcttgaggccaagatggct

SEQ ID NO: 4346746 - DNA, 18 bp, Homo sapiens
aaggaatcattccagtgc

SEQ ID NO: 4346747 - DNA, 20 bp, Homo sapiens
aaggaatcattccagtgcta

SEQ ID NO: 4346748 - DNA, 15 bp, Homo sapiens
aaggcaagcttgagg

SEQ ID NO: 4346749 - DNA, 16 bp, Homo sapiens
aagggaaaggcaagct

SEQ ID NO: 4346750 - DNA, 18 bp, Homo sapiens
aagggaaaggcaagcttg

SEQ ID NO: 4346751 - DNA, 16 bp, Homo sapiens
aagggggtggggggag

SEQ ID NO: 4346752 - DNA, 15 bp, Homo sapiens
aaggttttgtatttt

SEQ ID NO: 4346753 - DNA, 20 bp, Homo sapiens
aagtaagttaataatgtatt

SEQ ID NO: 4346754 - DNA, 24 bp, Homo sapiens
aagtaatatatcaaatccaggact

SEQ ID NO: 4346755 - DNA, 18 bp, Homo sapiens
aagtagaaaagttgcaga

SEQ ID NO: 4346756 - DNA, 23 bp, Homo sapiens
aagtagaaaagttgcagatgtat

SEQ ID NO: 4346757 - DNA, 16 bp, Homo sapiens
aagtgggtttttatga

SEQ ID NO: 4346758 - DNA, 22 bp, Homo sapiens
aagtgttgtatcaaagtgtgat

SEQ ID NO: 4346759 - DNA, 20 bp, Homo sapiens
aagttaattcacctatgtta

SEQ ID NO: 4346760 - DNA, 19 bp, Homo sapiens
aagttctcaaagttaattc

SEQ ID NO: 4346761 - DNA, 13 bp, Homo sapiens
aataaactttatt

SEQ ID NO: 4346762 - DNA, 16 bp, Homo sapiens
aataatccagtattgc

SEQ ID NO: 4346763 - DNA, 16 bp, Homo sapiens
aataatgaataaactg

SEQ ID NO: 4346764 - DNA, 12 bp, Homo sapiens
aataatggaaac

SEQ ID NO: 4346765 - DNA, 15 bp, Homo sapiens
aataatggaaacatt

SEQ ID NO: 4346766 - DNA, 20 bp, Homo sapiens
aataatggaaacattacagt

SEQ ID NO: 4346767 - DNA, 16 bp, Homo sapiens
aataatttatatgcat

SEQ ID NO: 4346768 - DNA, 18 bp, Homo sapiens
aataatttatatgcatgc

SEQ ID NO: 4346769 - DNA, 23 bp, Homo sapiens
aataatttatatgcatgcacagg

SEQ ID NO: 4346770 - DNA, 15 bp, Homo sapiens
aatactgtgcagaat

SEQ ID NO: 4346771 - DNA, 21 bp, Homo sapiens
aataggtagtttggatatttt

SEQ ID NO: 4346772 - DNA, 18 bp, Homo sapiens
aatataaattttcagaat

SEQ ID NO: 4346773 - DNA, 11 bp, Homo sapiens
aatatgtatgc

SEQ ID NO: 4346774 - DNA, 15 bp, Homo sapiens
aatattttggaaact

SEQ ID NO: 4346775 - DNA, 12 bp, Homo sapiens
aatcatgtatgt

SEQ ID NO: 4346776 - DNA, 23 bp, Homo sapiens
aatcatgtatgttatgatattgt

SEQ ID NO: 4346777 - DNA, 12 bp, Homo sapiens
aatcattccagt

SEQ ID NO: 4346778 - DNA, 18 bp, Homo sapiens
aatcattccagtgctaga

SEQ ID NO: 4346779 - DNA, 16 bp, Homo sapiens
aatccaggactttgtt

SEQ ID NO: 4346780 - DNA, 13 bp, Homo sapiens
aatccagtattgc

SEQ ID NO: 4346781 - DNA, 12 bp, Homo sapiens
aatctgaagata

SEQ ID NO: 4346782 - DNA, 23 bp, Homo sapiens
aatctgaagatatatttcacttt

SEQ ID NO: 4346783 - DNA, 15 bp, Homo sapiens
aatgaataaactgaa

SEQ ID NO: 4346784 - DNA, 16 bp, Homo sapiens
aatgaataaactgaat

SEQ ID NO: 4346785 - DNA, 22 bp, Homo sapiens
aatgatcatatcaattggcagt

SEQ ID NO: 4346786 - DNA, 20 bp, Homo sapiens
aatgccagagccaacctgga

SEQ ID NO: 4346787 - DNA, 23 bp, Homo sapiens
aatgccagagccaacctggactt

SEQ ID NO: 4346788 - DNA, 18 bp, Homo sapiens
aatggaaacattacagtt

SEQ ID NO: 4346789 - DNA, 14 bp, Homo sapiens
aatggttcatattt

SEQ ID NO: 4346790 - DNA, 15 bp, Homo sapiens
aatgtatgtcagtgc

SEQ ID NO: 4346791 - DNA, 16 bp, Homo sapiens
aatgtctcactgttct

SEQ ID NO: 4346792 - DNA, 11 bp, Homo sapiens
aatgtgcttta

SEQ ID NO: 4346793 - DNA, 19 bp, Homo sapiens
aatgtgctttatttgcaaa

SEQ ID NO: 4346794 - DNA, 12 bp, Homo sapiens
aatgtggttttt

SEQ ID NO: 4346795 - DNA, 22 bp, Homo sapiens
aatgtggtttttgatgcctttt

SEQ ID NO: 4346796 - DNA, 12 bp, Homo sapiens
aatgtttaaatc

SEQ ID NO: 4346797 - DNA, 17 bp, Homo sapiens
aattcacctatgttatt

SEQ ID NO: 4346798 - DNA, 23 bp, Homo sapiens
aattcacctatgttattttgtgt

SEQ ID NO: 4346799 - DNA, 11 bp, Homo sapiens
aattcagacaa

SEQ ID NO: 4346800 - DNA, 21 bp, Homo sapiens
aattcagacaacattatgatc

SEQ ID NO: 4346801 - DNA, 18 bp, Homo sapiens
aattcagtttttgtatct

SEQ ID NO: 4346802 - DNA, 18 bp, Homo sapiens
aattccaggctgagccat

SEQ ID NO: 4346803 - DNA, 20 bp, Homo sapiens
aattccaggctgagccatga

SEQ ID NO: 4346804 - DNA, 13 bp, Homo sapiens
aattctatgttaa

SEQ ID NO: 4346805 - DNA, 22 bp, Homo sapiens
aattctatgttaaatactgtgc

SEQ ID NO: 4346806 - DNA, 15 bp, Homo sapiens
aattggcagtgactt

SEQ ID NO: 4346807 - DNA, 17 bp, Homo sapiens
aattggcagtgactttg

SEQ ID NO: 4346808 - DNA, 20 bp, Homo sapiens
aattggcagtgactttgtat

SEQ ID NO: 4346809 - DNA, 18 bp, Homo sapiens
aatttatatgcatgcaca

SEQ ID NO: 4346810 - DNA, 12 bp, Homo sapiens
aattttttcaaa

SEQ ID NO: 4346811 - DNA, 23 bp, Homo sapiens
aattttttttttcctcttcagaa

SEQ ID NO: 4346812 - DNA, 19 bp, Homo sapiens
acaaaatacaatcctgttt

SEQ ID NO: 4346813 - DNA, 14 bp, Homo sapiens
acaacattatgatc

SEQ ID NO: 4346814 - DNA, 17 bp, Homo sapiens
acaacattatgatctaa

SEQ ID NO: 4346815 - DNA, 19 bp, Homo sapiens
acaacattatgatctaata

SEQ ID NO: 4346816 - DNA, 21 bp, Homo sapiens
acaaccatactttatatatgt

SEQ ID NO: 4346817 - DNA, 13 bp, Homo sapiens
acaatatgtatgc

SEQ ID NO: 4346818 - DNA, 14 bp, Homo sapiens
acaatatgtatgct

SEQ ID NO: 4346819 - DNA, 16 bp, Homo sapiens
acaatatgtatgcttt

SEQ ID NO: 4346820 - DNA, 22 bp, Homo sapiens
acaatatgtatgctttttacct

SEQ ID NO: 4346821 - DNA, 16 bp, Homo sapiens
acaattttttttttcc

SEQ ID NO: 4346822 - DNA, 18 bp, Homo sapiens
acaattttttttttcctc

SEQ ID NO: 4346823 - DNA, 16 bp, Homo sapiens
acacaatatgtatgct

SEQ ID NO: 4346824 - DNA, 20 bp, Homo sapiens
acactgcggaagccaaaggc

SEQ ID NO: 4346825 - DNA, 23 bp, Homo sapiens
acagaaactggattaaaacaatt

SEQ ID NO: 4346826 - DNA, 13 bp, Homo sapiens
acagaaagcctcc

SEQ ID NO: 4346827 - DNA, 23 bp, Homo sapiens
acagaataatccagtattgctga

SEQ ID NO: 4346828 - DNA, 23 bp, Homo sapiens
acagacacaatatgtatgctttt

SEQ ID NO: 4346829 - DNA, 19 bp, Homo sapiens
acagacctggctctcagag

SEQ ID NO: 4346830 - DNA, 17 bp, Homo sapiens
acagcctatagatgatg

SEQ ID NO: 4346831 - DNA, 23 bp, Homo sapiens
acagggtgtggtatgagggggtg

SEQ ID NO: 4346832 - DNA, 16 bp, Homo sapiens
acatcgatatgtatat

SEQ ID NO: 4346833 - DNA, 21 bp, Homo sapiens
acattatgatctaataaactt

SEQ ID NO: 4346834 - DNA, 22 bp, Homo sapiens
acattatgatctaataaacttt

SEQ ID NO: 4346835 - DNA, 13 bp, Homo sapiens
accaaagactgca

SEQ ID NO: 4346836 - DNA, 14 bp, Homo sapiens
accaaagactgcag

SEQ ID NO: 4346837 - DNA, 14 bp, Homo sapiens
accaaccaggcctt

SEQ ID NO: 4346838 - DNA, 15 bp, Homo sapiens
accaagagtaacttt

SEQ ID NO: 4346839 - DNA, 17 bp, Homo sapiens
accacaccaaccaggcc

SEQ ID NO: 4346840 - DNA, 22 bp, Homo sapiens
accagagcttctctgggctgaa

SEQ ID NO: 4346841 - DNA, 23 bp, Homo sapiens
accagagcttctctgggctgaat

SEQ ID NO: 4346842 - DNA, 13 bp, Homo sapiens
accagctttattt

SEQ ID NO: 4346843 - DNA, 12 bp, Homo sapiens
accaggccttca

SEQ ID NO: 4346844 - DNA, 20 bp, Homo sapiens
accatggtcatcaccaccct

SEQ ID NO: 4346845 - DNA, 14 bp, Homo sapiens
acccacagccatag

SEQ ID NO: 4346846 - DNA, 15 bp, Homo sapiens
acccacagccataga

SEQ ID NO: 4346847 - DNA, 17 bp, Homo sapiens
acccctcccctcccacc

SEQ ID NO: 4346848 - DNA, 22 bp, Homo sapiens
acccctcccctcccacccacag

SEQ ID NO: 4346849 - DNA, 13 bp, Homo sapiens
accctgagcccac

SEQ ID NO: 4346850 - DNA, 18 bp, Homo sapiens
acctaatgtctcactgtt

SEQ ID NO: 4346851 - DNA, 21 bp, Homo sapiens
acctaatgtctcactgttctg

SEQ ID NO: 4346852 - DNA, 22 bp, Homo sapiens
acctaatgtctcactgttctgc

SEQ ID NO: 4346853 - DNA, 16 bp, Homo sapiens
acctacagacctggct

SEQ ID NO: 4346854 - DNA, 23 bp, Homo sapiens
acctacagacctggctctcagag

SEQ ID NO: 4346855 - DNA, 21 bp, Homo sapiens
acctatgttattttgtgtaca

SEQ ID NO: 4346856 - DNA, 14 bp, Homo sapiens
acctgagactttca

SEQ ID NO: 4346857 - DNA, 18 bp, Homo sapiens
acctggacttcctgtcat

SEQ ID NO: 4346858 - DNA, 14 bp, Homo sapiens
acctggctctcaga

SEQ ID NO: 4346859 - DNA, 21 bp, Homo sapiens
acgtcttagagccttttatct

SEQ ID NO: 4346860 - DNA, 21 bp, Homo sapiens
actaaaagcagcgtcactcta

SEQ ID NO: 4346861 - DNA, 23 bp, Homo sapiens
actaaataatgaataaactgaat

SEQ ID NO: 4346862 - DNA, 14 bp, Homo sapiens
actacgtgttcaca

SEQ ID NO: 4346863 - DNA, 21 bp, Homo sapiens
actcaagggaaaggcaagctt

SEQ ID NO: 4346864 - DNA, 11 bp, Homo sapiens
actccaggcct

SEQ ID NO: 4346865 - DNA, 22 bp, Homo sapiens
actccaggcctgaccagggggc

SEQ ID NO: 4346866 - DNA, 13 bp, Homo sapiens
actcctttacaac

SEQ ID NO: 4346867 - DNA, 23 bp, Homo sapiens
actctacctaatgtctcactgtt

SEQ ID NO: 4346868 - DNA, 13 bp, Homo sapiens
actctagactgca

SEQ ID NO: 4346869 - DNA, 12 bp, Homo sapiens
actctcccagat

SEQ ID NO: 4346870 - DNA, 14 bp, Homo sapiens
actctgtgtttaaa

SEQ ID NO: 4346871 - DNA, 22 bp, Homo sapiens
actcttaatctgtgtgtatatt

SEQ ID NO: 4346872 - DNA, 20 bp, Homo sapiens
actgaatattttggaaactg

SEQ ID NO: 4346873 - DNA, 19 bp, Homo sapiens
actgaccaaagactgcaga

SEQ ID NO: 4346874 - DNA, 23 bp, Homo sapiens
actgaccaaagactgcagaaccc

SEQ ID NO: 4346875 - DNA, 20 bp, Homo sapiens
actgaggagacagaaagcct

SEQ ID NO: 4346876 - DNA, 23 bp, Homo sapiens
actgcaaacttttttatatcttt

SEQ ID NO: 4346877 - DNA, 24 bp, Homo sapiens
actgcaaacttttttatatctttt

SEQ ID NO: 4346878 - DNA, 12 bp, Homo sapiens
actgcaagaact

SEQ ID NO: 4346879 - DNA, 20 bp, Homo sapiens
actgcagaacccccaggtgg

SEQ ID NO: 4346880 - DNA, 16 bp, Homo sapiens
actgcggaagccaaag

SEQ ID NO: 4346881 - DNA, 14 bp, Homo sapiens
actggcagaagcat

SEQ ID NO: 4346882 - DNA, 17 bp, Homo sapiens
actgtataactgttctt

SEQ ID NO: 4346883 - DNA, 20 bp, Homo sapiens
actgtataactgttcttcaa

SEQ ID NO: 4346884 - DNA, 16 bp, Homo sapiens
actgtgcagaataatg

SEQ ID NO: 4346885 - DNA, 12 bp, Homo sapiens
actgttctgcaa

SEQ ID NO: 4346886 - DNA, 13 bp, Homo sapiens
actgttctgcaaa

SEQ ID NO: 4346887 - DNA, 20 bp, Homo sapiens
actgttctgcaaaggtggca

SEQ ID NO: 4346888 - DNA, 17 bp, Homo sapiens
acttcaggtaaaaactt

SEQ ID NO: 4346889 - DNA, 13 bp, Homo sapiens
acttcattcttta

SEQ ID NO: 4346890 - DNA, 15 bp, Homo sapiens
acttcattctttata

SEQ ID NO: 4346891 - DNA, 22 bp, Homo sapiens
acttctaaacacttcattcttt

SEQ ID NO: 4346892 - DNA, 22 bp, Homo sapiens
acttctgacaaaggtggtaaat

SEQ ID NO: 4346893 - DNA, 23 bp, Homo sapiens
acttctgacaaaggtggtaaatt

SEQ ID NO: 4346894 - DNA, 17 bp, Homo sapiens
acttgtttagagagcct

SEQ ID NO: 4346895 - DNA, 20 bp, Homo sapiens
actttattttttaaaaatga

SEQ ID NO: 4346896 - DNA, 20 bp, Homo sapiens
acttttcccctgttaaacag

SEQ ID NO: 4346897 - DNA, 22 bp, Homo sapiens
acttttcccctgttaaacagta

SEQ ID NO: 4346898 - DNA, 13 bp, Homo sapiens
acttttgttctgc

SEQ ID NO: 4346899 - DNA, 21 bp, Homo sapiens
acttttgttctgctttatctt

SEQ ID NO: 4346900 - DNA, 15 bp, Homo sapiens
agaaaatttagccct

SEQ ID NO: 4346901 - DNA, 16 bp, Homo sapiens
agaaacacattcttat

SEQ ID NO: 4346902 - DNA, 21 bp, Homo sapiens
agaaactctagactgcaagaa

SEQ ID NO: 4346903 - DNA, 18 bp, Homo sapiens
agaaactggattaaaaca

SEQ ID NO: 4346904 - DNA, 11 bp, Homo sapiens
agaaagcactt

SEQ ID NO: 4346905 - DNA, 19 bp, Homo sapiens
agaaagcctccgctgggct

SEQ ID NO: 4346906 - DNA, 20 bp, Homo sapiens
agaaagcctccgctgggctt

SEQ ID NO: 4346907 - DNA, 21 bp, Homo sapiens
agaaagcctccgctgggcttc

SEQ ID NO: 4346908 - DNA, 14 bp, Homo sapiens
agaaagctggactg

SEQ ID NO: 4346909 - DNA, 16 bp, Homo sapiens
agaaagctggactgac

SEQ ID NO: 4346910 - DNA, 19 bp, Homo sapiens
agaaagctggactgaccaa

SEQ ID NO: 4346911 - DNA, 20 bp, Homo sapiens
agaaagctggactgaccaaa

SEQ ID NO: 4346912 - DNA, 18 bp, Homo sapiens
agaaatttatatgtcaga

SEQ ID NO: 4346913 - DNA, 17 bp, Homo sapiens
agaactaaatataaatt

SEQ ID NO: 4346914 - DNA, 21 bp, Homo sapiens
agaactaaatataaattttca

SEQ ID NO: 4346915 - DNA, 13 bp, Homo sapiens
agaagataaatga

SEQ ID NO: 4346916 - DNA, 14 bp, Homo sapiens
agaagataaatgag

SEQ ID NO: 4346917 - DNA, 17 bp, Homo sapiens
agaagcattgcctggac

SEQ ID NO: 4346918 - DNA, 19 bp, Homo sapiens
agaagcattgcctggactg

SEQ ID NO: 4346919 - DNA, 18 bp, Homo sapiens
agaagttctcaaagttaa

SEQ ID NO: 4346920 - DNA, 20 bp, Homo sapiens
agaatcccttaaaattacca

SEQ ID NO: 4346921 - DNA, 13 bp, Homo sapiens
agaattaatgcat

SEQ ID NO: 4346922 - DNA, 18 bp, Homo sapiens
agaattaatgcattcaaa

SEQ ID NO: 4346923 - DNA, 18 bp, Homo sapiens
agacaaaaaaatttaaaa

SEQ ID NO: 4346924 - DNA, 20 bp, Homo sapiens
agacaacattatgatctaat

SEQ ID NO: 4346925 - DNA, 13 bp, Homo sapiens
agacagaaactgg

SEQ ID NO: 4346926 - DNA, 15 bp, Homo sapiens
agacagaaactggat

SEQ ID NO: 4346927 - DNA, 13 bp, Homo sapiens
agacagaaagcct

SEQ ID NO: 4346928 - DNA, 13 bp, Homo sapiens
agacccctcccct

SEQ ID NO: 4346929 - DNA, 14 bp, Homo sapiens
agacctacagacct

SEQ ID NO: 4346930 - DNA, 18 bp, Homo sapiens
agacctggctctcagagg

SEQ ID NO: 4346931 - DNA, 16 bp, Homo sapiens
agactcctcaggagag

SEQ ID NO: 4346932 - DNA, 18 bp, Homo sapiens
agactcctcaggagagac

SEQ ID NO: 4346933 - DNA, 14 bp, Homo sapiens
agactgcaagaact

SEQ ID NO: 4346934 - DNA, 17 bp, Homo sapiens
agactgcaagaactgtt

SEQ ID NO: 4346935 - DNA, 22 bp, Homo sapiens
agactgcagaacccccaggtgg

SEQ ID NO: 4346936 - DNA, 19 bp, Homo sapiens
agagagcctgtcaccagag

SEQ ID NO: 4346937 - DNA, 16 bp, Homo sapiens
agagagggactcaagg

SEQ ID NO: 4346938 - DNA, 16 bp, Homo sapiens
agagccaacctggact

SEQ ID NO: 4346939 - DNA, 17 bp, Homo sapiens
agagccaacctggactt

SEQ ID NO: 4346940 - DNA, 19 bp, Homo sapiens
agagccgaggggagagagg

SEQ ID NO: 4346941 - DNA, 13 bp, Homo sapiens
agagcctgtcacc

SEQ ID NO: 4346942 - DNA, 19 bp, Homo sapiens
agagcctgtcaccagagct

SEQ ID NO: 4346943 - DNA, 21 bp, Homo sapiens
agagccttttatctgcagaac

SEQ ID NO: 4346944 - DNA, 12 bp, Homo sapiens
agagcttctctg

SEQ ID NO: 4346945 - DNA, 14 bp, Homo sapiens
agagcttgaagatt

SEQ ID NO: 4346946 - DNA, 16 bp, Homo sapiens
agaggaaaaatgggag

SEQ ID NO: 4346947 - DNA, 20 bp, Homo sapiens
agaggaaaaatgggagccag

SEQ ID NO: 4346948 - DNA, 19 bp, Homo sapiens
agagggactcaagggaaag

SEQ ID NO: 4346949 - DNA, 20 bp, Homo sapiens
agagtaactttactctgtgt

SEQ ID NO: 4346950 - DNA, 18 bp, Homo sapiens
agagtggaataaggatgt

SEQ ID NO: 4346951 - DNA, 16 bp, Homo sapiens
agataaatgagctttc

SEQ ID NO: 4346952 - DNA, 13 bp, Homo sapiens
agatggctgctgc

SEQ ID NO: 4346953 - DNA, 14 bp, Homo sapiens
agatggctgctgcc

SEQ ID NO: 4346954 - DNA, 16 bp, Homo sapiens
agatgtattgactgta

SEQ ID NO: 4346955 - DNA, 17 bp, Homo sapiens
agatgtattgactgtac

SEQ ID NO: 4346956 - DNA, 13 bp, Homo sapiens
agattgtcttgca

SEQ ID NO: 4346957 - DNA, 19 bp, Homo sapiens
agatttttattttgaaaaa

SEQ ID NO: 4346958 - DNA, 17 bp, Homo sapiens
agcaattccaggctgag

SEQ ID NO: 4346959 - DNA, 24 bp, Homo sapiens
agcaattccaggctgagccatgag

SEQ ID NO: 4346960 - DNA, 12 bp, Homo sapiens
agcagacagaaa

SEQ ID NO: 4346961 - DNA, 15 bp, Homo sapiens
agcagacagaaactg

SEQ ID NO: 4346962 - DNA, 18 bp, Homo sapiens
agcagacagaaactggat

SEQ ID NO: 4346963 - DNA, 15 bp, Homo sapiens
agcattgcctggact

SEQ ID NO: 4346964 - DNA, 16 bp, Homo sapiens
agcattgcctggactg

SEQ ID NO: 4346965 - DNA, 19 bp, Homo sapiens
agcattgcctggactgacc

SEQ ID NO: 4346966 - DNA, 21 bp, Homo sapiens
agcattgcctggactgaccac

SEQ ID NO: 4346967 - DNA, 13 bp, Homo sapiens
agccaaaggcagc

SEQ ID NO: 4346968 - DNA, 17 bp, Homo sapiens
agccaaaggcagctaag

SEQ ID NO: 4346969 - DNA, 16 bp, Homo sapiens
agccaacctggacttc

SEQ ID NO: 4346970 - DNA, 18 bp, Homo sapiens
agccaacctggacttcct

SEQ ID NO: 4346971 - DNA, 19 bp, Homo sapiens
agccaacctggacttcctg

SEQ ID NO: 4346972 - DNA, 20 bp, Homo sapiens
agccaacctggacttcctgt

SEQ ID NO: 4346973 - DNA, 21 bp, Homo sapiens
agccagagtttttaaagcctt

SEQ ID NO: 4346974 - DNA, 20 bp, Homo sapiens
aaaaatgagagctgtaactg

SEQ ID NO: 4346975 - DNA, 15 bp, Homo sapiens
aaaaatgcaatatct

SEQ ID NO: 4346976 - DNA, 18 bp, Homo sapiens
aaaagcagcgtcactcta

SEQ ID NO: 4346977 - DNA, 18 bp, Homo sapiens
aaaatcaggcagaaatat

SEQ ID NO: 4346978 - DNA, 19 bp, Homo sapiens
aaaatcaggcagaaatatt

SEQ ID NO: 4346979 - DNA, 18 bp, Homo sapiens
aaaatgggagccaggagt

SEQ ID NO: 4346980 - DNA, 21 bp, Homo sapiens
aaaatggttcatattttatag

SEQ ID NO: 4346981 - DNA, 14 bp, Homo sapiens
aaaatgtgtttgct

SEQ ID NO: 4346982 - DNA, 17 bp, Homo sapiens
aaaattacgtttgttat

SEQ ID NO: 4346983 - DNA, 20 bp, Homo sapiens
aaaattcagtttttgtatct

SEQ ID NO: 4346984 - DNA, 14 bp, Homo sapiens
aaacactaaaagca

SEQ ID NO: 4346985 - DNA, 18 bp, Homo sapiens
aaacattacagttcataa

SEQ ID NO: 4346986 - DNA, 22 bp, Homo sapiens
aaacctttcagtactcttatta

SEQ ID NO: 4346987 - DNA, 14 bp, Homo sapiens
aaactaaataatga

SEQ ID NO: 4346988 - DNA, 23 bp, Homo sapiens
aaactctagactgcaagaactgt

SEQ ID NO: 4346989 - DNA, 17 bp, Homo sapiens
aaactgaatattttgga

SEQ ID NO: 4346990 - DNA, 16 bp, Homo sapiens
aaactggattaaaaca

SEQ ID NO: 4346991 - DNA, 19 bp, Homo sapiens
aaactggattaaaacaatt

SEQ ID NO: 4346992 - DNA, 22 bp, Homo sapiens
aaactggattaaaacaattttt

SEQ ID NO: 4346993 - DNA, 15 bp, Homo sapiens
aaagactgcagaacc

SEQ ID NO: 4346994 - DNA, 20 bp, Homo sapiens
aaagaggctgcccctctcac

SEQ ID NO: 4346995 - DNA, 16 bp, Homo sapiens
aaagccttctggatcc

SEQ ID NO: 4346996 - DNA, 12 bp, Homo sapiens
agtttttgtatc

SEQ ID NO: 4346997 - DNA, 12 bp, Homo sapiens
ataaactgaata

SEQ ID NO: 4346998 - DNA, 14 bp, Homo sapiens
ataaactgaatatt

SEQ ID NO: 4346999 - DNA, 19 bp, Homo sapiens
ataaactgaatattttgga

SEQ ID NO: 4347000 - DNA, 12 bp, Homo sapiens
ataaactttatt

SEQ ID NO: 4347001 - DNA, 16 bp, Homo sapiens
ataaagggttgaaaat

SEQ ID NO: 4347002 - DNA, 17 bp, Homo sapiens
ataaagggttgaaaatg

SEQ ID NO: 4347003 - DNA, 14 bp, Homo sapiens
ataaataaaactga

SEQ ID NO: 4347004 - DNA, 19 bp, Homo sapiens
ataaataaaactgaatctc

SEQ ID NO: 4347005 - DNA, 14 bp, Homo sapiens
ataaatgccagagc

SEQ ID NO: 4347006 - DNA, 17 bp, Homo sapiens
ataaatgccagagccaa

SEQ ID NO: 4347007 - DNA, 16 bp, Homo sapiens
ataagaggaatttctt

SEQ ID NO: 4347008 - DNA, 22 bp, Homo sapiens
ataaggatgttaacttggttct

SEQ ID NO: 4347009 - DNA, 21 bp, Homo sapiens
ataataggtagtttggatatt

SEQ ID NO: 4347010 - DNA, 15 bp, Homo sapiens
ataatgaataaactg

SEQ ID NO: 4347011 - DNA, 16 bp, Homo sapiens
ataatgaataaactga

SEQ ID NO: 4347012 - DNA, 14 bp, Homo sapiens
ataatgtattgtaa

SEQ ID NO: 4347013 - DNA, 12 bp, Homo sapiens
ataatgtttaaa

SEQ ID NO: 4347014 - DNA, 13 bp, Homo sapiens
ataatgtttaaat

SEQ ID NO: 4347015 - DNA, 17 bp, Homo sapiens
ataatgtttaaatcatg

SEQ ID NO: 4347016 - DNA, 20 bp, Homo sapiens
ataatgtttaaatcatgtat

SEQ ID NO: 4347017 - DNA, 21 bp, Homo sapiens
atacaagccatttactttgca

SEQ ID NO: 4347018 - DNA, 21 bp, Homo sapiens
atacaagctgggaacttctaa

SEQ ID NO: 4347019 - DNA, 20 bp, Homo sapiens
atactgtgcagaataatgga

SEQ ID NO: 4347020 - DNA, 21 bp, Homo sapiens
atactgtgcagaataatggaa

SEQ ID NO: 4347021 - DNA, 19 bp, Homo sapiens
atacttttcccctgttaaa

SEQ ID NO: 4347022 - DNA, 21 bp, Homo sapiens
atacttttcccctgttaaaca

SEQ ID NO: 4347023 - DNA, 16 bp, Homo sapiens
atagaaagctggactg

SEQ ID NO: 4347024 - DNA, 18 bp, Homo sapiens
atagaaagctggactgac

SEQ ID NO: 4347025 - DNA, 21 bp, Homo sapiens
atagacctacagacctggctc

SEQ ID NO: 4347026 - DNA, 17 bp, Homo sapiens
ataggtagtttggatat

SEQ ID NO: 4347027 - DNA, 18 bp, Homo sapiens
catcgatatgtatatcat

SEQ ID NO: 4347028 - DNA, 15 bp, Homo sapiens
catcggaggagaaac

SEQ ID NO: 4347029 - DNA, 19 bp, Homo sapiens
catctggctttttctgcca

SEQ ID NO: 4347030 - DNA, 14 bp, Homo sapiens
catgaaagctgatg

SEQ ID NO: 4347031 - DNA, 17 bp, Homo sapiens
catgaggagcgtggact

SEQ ID NO: 4347032 - DNA, 15 bp, Homo sapiens
catggctcagagctt

SEQ ID NO: 4347033 - DNA, 14 bp, Homo sapiens
catgtatgttatga

SEQ ID NO: 4347034 - DNA, 13 bp, Homo sapiens
catgtccaaagag

SEQ ID NO: 4347035 - DNA, 14 bp, Homo sapiens
catgtccaaagagg

SEQ ID NO: 4347036 - DNA, 16 bp, Homo sapiens
catgtccaaagaggct

SEQ ID NO: 4347037 - DNA, 18 bp, Homo sapiens
catgttctatattcttta

SEQ ID NO: 4347038 - DNA, 20 bp, Homo sapiens
catgttctatattctttatt

SEQ ID NO: 4347039 - DNA, 12 bp, Homo sapiens
cattatgatcta

SEQ ID NO: 4347040 - DNA, 17 bp, Homo sapiens
cattatgatctaataaa

SEQ ID NO: 4347041 - DNA, 17 bp, Homo sapiens
cattccggactggcaga

SEQ ID NO: 4347042 - DNA, 15 bp, Homo sapiens
cattctacagaataa

SEQ ID NO: 4347043 - DNA, 20 bp, Homo sapiens
cattctacagaataatccag

SEQ ID NO: 4347044 - DNA, 21 bp, Homo sapiens
cattctacagaataatccagt

SEQ ID NO: 4347045 - DNA, 15 bp, Homo sapiens
cattgcctggactga

SEQ ID NO: 4347046 - DNA, 16 bp, Homo sapiens
catttgagatttttgg

SEQ ID NO: 4347047 - DNA, 14 bp, Homo sapiens
catttgatagcaat

SEQ ID NO: 4347048 - DNA, 17 bp, Homo sapiens
cattttttttgtggtta

SEQ ID NO: 4347049 - DNA, 13 bp, Homo sapiens
ccaaagactgcag

SEQ ID NO: 4347050 - DNA, 16 bp, Homo sapiens
ccaaagaggctgcccc

SEQ ID NO: 4347051 - DNA, 20 bp, Homo sapiens
ccaaagaggctgcccctctc

SEQ ID NO: 4347052 - DNA, 21 bp, Homo sapiens
ccaaagaggctgcccctctca

SEQ ID NO: 4347053 - DNA, 13 bp, Homo sapiens
ccaaaggcagcta

SEQ ID NO: 4347054 - DNA, 17 bp, Homo sapiens
ccaaaggcagctaagat

SEQ ID NO: 4347055 - DNA, 12 bp, Homo sapiens
ccaacctggact

SEQ ID NO: 4347056 - DNA, 16 bp, Homo sapiens
ccaacctggacttcct

SEQ ID NO: 4347057 - DNA, 17 bp, Homo sapiens
ccaacctggacttcctg

SEQ ID NO: 4347058 - DNA, 21 bp, Homo sapiens
ccaacctggacttcctgtcat

SEQ ID NO: 4347059 - DNA, 16 bp, Homo sapiens
ccaagatggctgctgc

SEQ ID NO: 4347060 - DNA, 20 bp, Homo sapiens
ccaagatggctgctgcctgc

SEQ ID NO: 4347061 - DNA, 22 bp, Homo sapiens
ccaagatggctgctgcctgctc

SEQ ID NO: 4347062 - DNA, 14 bp, Homo sapiens
ccacaccaaccagg

SEQ ID NO: 4347063 - DNA, 17 bp, Homo sapiens
ccacaccaaccaggcct

SEQ ID NO: 4347064 - DNA, 12 bp, Homo sapiens
ccaccatttttt

SEQ ID NO: 4347065 - DNA, 12 bp, Homo sapiens
ccaccctggcag

SEQ ID NO: 4347066 - DNA, 23 bp, Homo sapiens
ccaccgggttctgcagcggcaga

SEQ ID NO: 4347067 - DNA, 16 bp, Homo sapiens
ccactgaggagacaga

SEQ ID NO: 4347068 - DNA, 17 bp, Homo sapiens
ccactgaggagacagaa

SEQ ID NO: 4347069 - DNA, 21 bp, Homo sapiens
ccagagccaacctggacttcc

SEQ ID NO: 4347070 - DNA, 13 bp, Homo sapiens
ccagagcttctct

SEQ ID NO: 4347071 - DNA, 17 bp, Homo sapiens
ccagagcttctctgggc

SEQ ID NO: 4347072 - DNA, 19 bp, Homo sapiens
ccagagtttttaaagcctt

SEQ ID NO: 4347073 - DNA, 14 bp, Homo sapiens
ccagctcctgaata

SEQ ID NO: 4347074 - DNA, 21 bp, Homo sapiens
ccagctcttctcttcctagat

SEQ ID NO: 4347075 - DNA, 16 bp, Homo sapiens
ccagctgggcctcctg

SEQ ID NO: 4347076 - DNA, 22 bp, Homo sapiens
ccaggaaaggcttggctggtgt

SEQ ID NO: 4347077 - DNA, 14 bp, Homo sapiens
ccaggcctgaccag

SEQ ID NO: 4347078 - DNA, 14 bp, Homo sapiens
ccaggctgagccat

SEQ ID NO: 4347079 - DNA, 16 bp, Homo sapiens
ccaggctgagccatga

SEQ ID NO: 4347080 - DNA, 19 bp, Homo sapiens
ccaggctgagccatgagga

SEQ ID NO: 4347081 - DNA, 23 bp, Homo sapiens
ccagggggcccgaacagggactt

SEQ ID NO: 4347082 - DNA, 12 bp, Homo sapiens
ccaggtggcctg

SEQ ID NO: 4347083 - DNA, 24 bp, Homo sapiens
ccatagacctacagacctggctct

SEQ ID NO: 4347084 - DNA, 19 bp, Homo sapiens
cccagaccaggaaaggctt

SEQ ID NO: 4347085 - DNA, 17 bp, Homo sapiens
cccatctggctttttct

SEQ ID NO: 4347086 - DNA, 19 bp, Homo sapiens
cccccaggtggcctgcgtc

SEQ ID NO: 4347087 - DNA, 20 bp, Homo sapiens
cccctgaggcagcccagctc

SEQ ID NO: 4347088 - DNA, 22 bp, Homo sapiens
cccctgaggcagcccagctcct

SEQ ID NO: 4347089 - DNA, 13 bp, Homo sapiens
ccctctcaccaaa

SEQ ID NO: 4347090 - DNA, 14 bp, Homo sapiens
ccctgagcccacca

SEQ ID NO: 4347091 - DNA, 16 bp, Homo sapiens
ccctggcaggcttcca

SEQ ID NO: 4347092 - DNA, 18 bp, Homo sapiens
ccctgggtaccctgagcc

SEQ ID NO: 4347093 - DNA, 13 bp, Homo sapiens
cccttcagcccac

SEQ ID NO: 4347094 - DNA, 20 bp, Homo sapiens
cccttcagcccaccaccctg

SEQ ID NO: 4347095 - DNA, 17 bp, Homo sapiens
ccggactggcagaagca

SEQ ID NO: 4347096 - DNA, 19 bp, Homo sapiens
ccggtggttttgtgcttta

SEQ ID NO: 4347097 - DNA, 21 bp, Homo sapiens
cctaacttgtgaagacaatga

SEQ ID NO: 4347098 - DNA, 19 bp, Homo sapiens
cctaatgtctcactgttct

SEQ ID NO: 4347099 - DNA, 14 bp, Homo sapiens
cctagatctgcagg

SEQ ID NO: 4347100 - DNA, 19 bp, Homo sapiens
cctagatctgcaggctgca

SEQ ID NO: 4347101 - DNA, 17 bp, Homo sapiens
cctagcagacagaaact

SEQ ID NO: 4347102 - DNA, 19 bp, Homo sapiens
cctagcagacagaaactgg

SEQ ID NO: 4347103 - DNA, 17 bp, Homo sapiens
cctagtggatgactgtt

SEQ ID NO: 4347104 - DNA, 19 bp, Homo sapiens
cctatagatgatgatgtgt

SEQ ID NO: 4347105 - DNA, 12 bp, Homo sapiens
cctatgttattt

SEQ ID NO: 4347106 - DNA, 17 bp, Homo sapiens
cctcatatcccatcctt

SEQ ID NO: 4347107 - DNA, 20 bp, Homo sapiens
cctcccacccacagccatag

SEQ ID NO: 4347108 - DNA, 21 bp, Homo sapiens
cctcccacccacagccataga

SEQ ID NO: 4347109 - DNA, 15 bp, Homo sapiens
cctccccagctcttc

SEQ ID NO: 4347110 - DNA, 15 bp, Homo sapiens
cctcctccccagctc

SEQ ID NO: 4347111 - DNA, 16 bp, Homo sapiens
cctcctccccagctct

SEQ ID NO: 4347112 - DNA, 22 bp, Homo sapiens
cctcggaggtccagctgggcct

SEQ ID NO: 4347113 - DNA, 16 bp, Homo sapiens
cctctggctagagccg

SEQ ID NO: 4347114 - DNA, 19 bp, Homo sapiens
cctctggctagagccgagg

SEQ ID NO: 4347115 - DNA, 18 bp, Homo sapiens
cctgaggcagcccagctc

SEQ ID NO: 4347116 - DNA, 21 bp, Homo sapiens
cctgggtaccctgagcccacc

SEQ ID NO: 4347117 - DNA, 17 bp, Homo sapiens
cctgttatgtatgaagg

SEQ ID NO: 4347118 - DNA, 23 bp, Homo sapiens
cctgttcataaaacggtgctttc

SEQ ID NO: 4347119 - DNA, 15 bp, Homo sapiens
ccttcagcccaccac

SEQ ID NO: 4347120 - DNA, 17 bp, Homo sapiens
ccttcagcccaccaccc

SEQ ID NO: 4347121 - DNA, 23 bp, Homo sapiens
ccttccagggcctgagcagctgg

SEQ ID NO: 4347122 - DNA, 15 bp, Homo sapiens
ccttctggatccatg

SEQ ID NO: 4347123 - DNA, 16 bp, Homo sapiens
ccttctggatccatgg

SEQ ID NO: 4347124 - DNA, 19 bp, Homo sapiens
ccttttatctgcagaacat

SEQ ID NO: 4347125 - DNA, 22 bp, Homo sapiens
cgcagatttttatgttttgaaa

SEQ ID NO: 4347126 - DNA, 15 bp, Homo sapiens
cgcccttcagcccac

SEQ ID NO: 4347127 - DNA, 18 bp, Homo sapiens
cgcccttcagcccaccac

SEQ ID NO: 4347128 - DNA, 14 bp, Homo sapiens
cggactggcagaag

SEQ ID NO: 4347129 - DNA, 23 bp, Homo sapiens
cggactggcagaagcattgcctg

SEQ ID NO: 4347130 - DNA, 18 bp, Homo sapiens
cggaggagaaactctaga

SEQ ID NO: 4347131 - DNA, 15 bp, Homo sapiens
cggaggtccagctgg

SEQ ID NO: 4347132 - DNA, 19 bp, Homo sapiens
cggcagagcaattccaggc

SEQ ID NO: 4347133 - DNA, 20 bp, Homo sapiens
cggcagagcaattccaggct

SEQ ID NO: 4347134 - DNA, 21 bp, Homo sapiens
cgggttctgcagcggcagagc

SEQ ID NO: 4347135 - DNA, 22 bp, Homo sapiens
cgggttctgcagcggcagagca

SEQ ID NO: 4347136 - DNA, 12 bp, Homo sapiens
ctaaataatgaa

SEQ ID NO: 4347137 - DNA, 20 bp, Homo sapiens
ctaaataatgaataaactga

SEQ ID NO: 4347138 - DNA, 22 bp, Homo sapiens
ctaaataatgaataaactgaat

SEQ ID NO: 4347139 - DNA, 18 bp, Homo sapiens
ctaaatataaattttcag

SEQ ID NO: 4347140 - DNA, 17 bp, Homo sapiens
ctaaattctatgttaaa

SEQ ID NO: 4347141 - DNA, 21 bp, Homo sapiens
cttctggggcaggctgggcca

SEQ ID NO: 4347142 - DNA, 21 bp, Homo sapiens
cttctgtatttctaggcacaa

SEQ ID NO: 4347143 - DNA, 13 bp, Homo sapiens
cttgatttgatgt

SEQ ID NO: 4347144 - DNA, 23 bp, Homo sapiens
cttgctcctagcagacagaaact

SEQ ID NO: 4347145 - DNA, 14 bp, Homo sapiens
cttgtgaagacaat

SEQ ID NO: 4347146 - DNA, 18 bp, Homo sapiens
cttgtttagagagcctgt

SEQ ID NO: 4347147 - DNA, 21 bp, Homo sapiens
ctttacaaccatactttatat

SEQ ID NO: 4347148 - DNA, 18 bp, Homo sapiens
ctttactctgtgtttaaa

SEQ ID NO: 4347149 - DNA, 19 bp, Homo sapiens
ctttactctgtgtttaaaa

SEQ ID NO: 4347150 - DNA, 19 bp, Homo sapiens
ctagatctgcaggctgcac

SEQ ID NO: 4347151 - DNA, 21 bp, Homo sapiens
ctagcagacagaaactggatt

SEQ ID NO: 4347152 - DNA, 15 bp, Homo sapiens
ctaggcacaaggttg

SEQ ID NO: 4347153 - DNA, 16 bp, Homo sapiens
ctagtcagtatctgta

SEQ ID NO: 4347154 - DNA, 22 bp, Homo sapiens
ctataaatgccagagccaacct

SEQ ID NO: 4347155 - DNA, 17 bp, Homo sapiens
ctatgttaaatactgtg

SEQ ID NO: 4347156 - DNA, 22 bp, Homo sapiens
ctatgttaaatactgtgcagaa

SEQ ID NO: 4347157 - DNA, 22 bp, Homo sapiens
ctattgccatgaaccatgctta

SEQ ID NO: 4347158 - DNA, 23 bp, Homo sapiens
ctcaagaaatatactctcccaga

SEQ ID NO: 4347159 - DNA, 15 bp, Homo sapiens
ctcagagcttgaaga

SEQ ID NO: 4347160 - DNA, 16 bp, Homo sapiens
ctcagagcttgaagat

SEQ ID NO: 4347161 - DNA, 18 bp, Homo sapiens
ctcaggagagacccctcc

SEQ ID NO: 4347162 - DNA, 13 bp, Homo sapiens
ctcagtaactttt

SEQ ID NO: 4347163 - DNA, 18 bp, Homo sapiens
ctcagtaacttttaaaag

SEQ ID NO: 4347164 - DNA, 23 bp, Homo sapiens
ctcatacaagccatttactttgc

SEQ ID NO: 4347165 - DNA, 18 bp, Homo sapiens
ctccaggcctgaccaggg

SEQ ID NO: 4347166 - DNA, 15 bp, Homo sapiens
ctccagtcaagctct

SEQ ID NO: 4347167 - DNA, 17 bp, Homo sapiens
ctcccacccacagccat

SEQ ID NO: 4347168 - DNA, 16 bp, Homo sapiens
ctcccagatttttact

SEQ ID NO: 4347169 - DNA, 22 bp, Homo sapiens
ctcccagatttttactttttcc

SEQ ID NO: 4347170 - DNA, 16 bp, Homo sapiens
ctcccctcccacccac

SEQ ID NO: 4347171 - DNA, 15 bp, Homo sapiens
ctccgctgggcttca

SEQ ID NO: 4347172 - DNA, 16 bp, Homo sapiens
ctccgggcaggcaagg

SEQ ID NO: 4347173 - DNA, 15 bp, Homo sapiens
ctcctcaggagagac

SEQ ID NO: 4347174 - DNA, 18 bp, Homo sapiens
ctctagactgcaagaact

SEQ ID NO: 4347175 - DNA, 11 bp, Homo sapiens
ctctgctgcca

SEQ ID NO: 4347176 - DNA, 13 bp, Homo sapiens
ctctggctagagc

SEQ ID NO: 4347177 - DNA, 18 bp, Homo sapiens
ctctggctagagccgagg

SEQ ID NO: 4347178 - DNA, 19 bp, Homo sapiens
ctctggctagagccgaggg

SEQ ID NO: 4347179 - DNA, 22 bp, Homo sapiens
ctctggctagagccgaggggag

SEQ ID NO: 4347180 - DNA, 13 bp, Homo sapiens
ctctgtgtttaaa

SEQ ID NO: 4347181 - DNA, 14 bp, Homo sapiens
ctcttaatctgtgt

SEQ ID NO: 4347182 - DNA, 21 bp, Homo sapiens
ctcttaatctgtgtgtatatt

SEQ ID NO: 4347183 - DNA, 15 bp, Homo sapiens
ctcttcccttcccag

SEQ ID NO: 4347184 - DNA, 18 bp, Homo sapiens
ctcttcccttcccagacc

SEQ ID NO: 4347185 - DNA, 23 bp, Homo sapiens
ctcttctggggcaggctgggcca

SEQ ID NO: 4347186 - DNA, 17 bp, Homo sapiens
ctgaatattttggaaac

SEQ ID NO: 4347187 - DNA, 22 bp, Homo sapiens
ctgacaaaggtggtaaattcag

SEQ ID NO: 4347188 - DNA, 16 bp, Homo sapiens
ctgagcagctggatct

SEQ ID NO: 4347189 - DNA, 14 bp, Homo sapiens
ctgagccatgagga

SEQ ID NO: 4347190 - DNA, 22 bp, Homo sapiens
ctgagcccaccagggacacctc

SEQ ID NO: 4347191 - DNA, 14 bp, Homo sapiens
ctgaggcagcccag

SEQ ID NO: 4347192 - DNA, 17 bp, Homo sapiens
ctgatgaagaagggggt

SEQ ID NO: 4347193 - DNA, 20 bp, Homo sapiens
ctgcaaaggtggcaatgctt

SEQ ID NO: 4347194 - DNA, 15 bp, Homo sapiens
ctgcacctctggcta

SEQ ID NO: 4347195 - DNA, 22 bp, Homo sapiens
ctgcagaacatcgatatgtata

SEQ ID NO: 4347196 - DNA, 18 bp, Homo sapiens
ctgcagaacccccaggtg

SEQ ID NO: 4347197 - DNA, 19 bp, Homo sapiens
ctgcagaacccccaggtgg

SEQ ID NO: 4347198 - DNA, 12 bp, Homo sapiens
ctgcaggctgca

SEQ ID NO: 4347199 - DNA, 23 bp, Homo sapiens
ctgcaggctgcacctctggctag

SEQ ID NO: 4347200 - DNA, 13 bp, Homo sapiens
ctgcatttgatag

SEQ ID NO: 4347201 - DNA, 15 bp, Homo sapiens
ctgcatttgatagca

SEQ ID NO: 4347202 - DNA, 17 bp, Homo sapiens
ctgccactgaggagaca

SEQ ID NO: 4347203 - DNA, 17 bp, Homo sapiens
ctgcccctctcaccaaa

SEQ ID NO: 4347204 - DNA, 16 bp, Homo sapiens
ctgcctgctcatggcc

SEQ ID NO: 4347205 - DNA, 20 bp, Homo sapiens
ctgcctgctcatggccctcg

SEQ ID NO: 4347206 - DNA, 24 bp, Homo sapiens
ctgcgtcttttttctcttcccttc

SEQ ID NO: 4347207 - DNA, 19 bp, Homo sapiens
ctgctaatattaaaccttt

SEQ ID NO: 4347208 - DNA, 19 bp, Homo sapiens
ctgctcatggccctcggag

SEQ ID NO: 4347209 - DNA, 14 bp, Homo sapiens
ctgctgcctgctca

SEQ ID NO: 4347210 - DNA, 15 bp, Homo sapiens
ctgctgcctgctcat

SEQ ID NO: 4347211 - DNA, 18 bp, Homo sapiens
ctgctgcctgctcatggc

SEQ ID NO: 4347212 - DNA, 13 bp, Homo sapiens
ctggacttcctgt

SEQ ID NO: 4347213 - DNA, 23 bp, Homo sapiens
ctggacttcctgtcattttcaca

SEQ ID NO: 4347214 - DNA, 17 bp, Homo sapiens
ctggatccatgggggga

SEQ ID NO: 4347215 - DNA, 18 bp, Homo sapiens
ctggcagaagcattgcct

SEQ ID NO: 4347216 - DNA, 23 bp, Homo sapiens
ctggcagaagcattgcctggact

SEQ ID NO: 4347217 - DNA, 16 bp, Homo sapiens
ctggctagagccgagg

SEQ ID NO: 4347218 - DNA, 19 bp, Homo sapiens
ctggctagagccgagggga

SEQ ID NO: 4347219 - DNA, 17 bp, Homo sapiens
ctggctttttctgccac

SEQ ID NO: 4347220 - DNA, 20 bp, Homo sapiens
ctggctttttctgccactga

SEQ ID NO: 4347221 - DNA, 21 bp, Homo sapiens
ctggctttttctgccactgag

SEQ ID NO: 4347222 - DNA, 15 bp, Homo sapiens
ctgggcctcctgcct

SEQ ID NO: 4347223 - DNA, 22 bp, Homo sapiens
ctgggcttcattccggactggc

SEQ ID NO: 4347224 - DNA, 17 bp, Homo sapiens
ctggggcaggctgggcc

SEQ ID NO: 4347225 - DNA, 20 bp, Homo sapiens
ctggtagcataaataaaact

SEQ ID NO: 4347226 - DNA, 23 bp, Homo sapiens
ctggtagcataaataaaactgaa

SEQ ID NO: 4347227 - DNA, 16 bp, Homo sapiens
ctgtagctacactgta

SEQ ID NO: 4347228 - DNA, 19 bp, Homo sapiens
ctgtataactgttcttcaa

SEQ ID NO: 4347229 - DNA, 15 bp, Homo sapiens
ctgtcaccagagctt

SEQ ID NO: 4347230 - DNA, 19 bp, Homo sapiens
ctgtgcagaataatggaaa

SEQ ID NO: 4347231 - DNA, 21 bp, Homo sapiens
ctgtgtaacatccaagccaga

SEQ ID NO: 4347232 - DNA, 23 bp, Homo sapiens
ctgtgtaacatccaagccagagt

SEQ ID NO: 4347233 - DNA, 19 bp, Homo sapiens
ctgtgtttaaaaagtaagt

SEQ ID NO: 4347234 - DNA, 13 bp, Homo sapiens
ctgttataaattt

SEQ ID NO: 4347235 - DNA, 13 bp, Homo sapiens
ctgttatgtatga

SEQ ID NO: 4347236 - DNA, 21 bp, Homo sapiens
ctgttcataaaacggtgcttt

SEQ ID NO: 4347237 - DNA, 13 bp, Homo sapiens
ctgttctgcaaag

SEQ ID NO: 4347238 - DNA, 18 bp, Homo sapiens
ctgtttataatctgaaga

SEQ ID NO: 4347239 - DNA, 19 bp, Homo sapiens
ctgtttataatctgaagat

SEQ ID NO: 4347240 - DNA, 20 bp, Homo sapiens
ctgtttataatctgaagata

SEQ ID NO: 4347241 - DNA, 18 bp, Homo sapiens
cttaaaattaccagacaa

SEQ ID NO: 4347242 - DNA, 15 bp, Homo sapiens
cttaaactaaataat

SEQ ID NO: 4347243 - DNA, 17 bp, Homo sapiens
cttaaactaaataatga

SEQ ID NO: 4347244 - DNA, 18 bp, Homo sapiens
cttacaaagaaagcactt

SEQ ID NO: 4347245 - DNA, 13 bp, Homo sapiens
cttattgaagtga

SEQ ID NO: 4347246 - DNA, 11 bp, Homo sapiens
cttattttatg

SEQ ID NO: 4347247 - DNA, 19 bp, Homo sapiens
cttcaataaaatggttcat

SEQ ID NO: 4347248 - DNA, 19 bp, Homo sapiens
cttcacctgttatgtatga

SEQ ID NO: 4347249 - DNA, 20 bp, Homo sapiens
cttcactacgtgttcacagg

SEQ ID NO: 4347250 - DNA, 16 bp, Homo sapiens
cttcaggtaaaaactt

SEQ ID NO: 4347251 - DNA, 13 bp, Homo sapiens
cttcatcctcctc

SEQ ID NO: 4347252 - DNA, 15 bp, Homo sapiens
cttcatcctcctccc

SEQ ID NO: 4347253 - DNA, 14 bp, Homo sapiens
cttcattccggact

SEQ ID NO: 4347254 - DNA, 22 bp, Homo sapiens
cttcattccggactggcagaag

SEQ ID NO: 4347255 - DNA, 14 bp, Homo sapiens
cttcccagaccagg

SEQ ID NO: 4347256 - DNA, 16 bp, Homo sapiens
cttcccagaccaggaa

SEQ ID NO: 4347257 - DNA, 11 bp, Homo sapiens
cttcccttccc

SEQ ID NO: 4347258 - DNA, 12 bp, Homo sapiens
cttcccttccca

SEQ ID NO: 4347259 - DNA, 15 bp, Homo sapiens
cttcccttcccagac

SEQ ID NO: 4347260 - DNA, 16 bp, Homo sapiens
cttcccttcccagacc

SEQ ID NO: 4347261 - DNA, 12 bp, Homo sapiens
cttctaaacact

SEQ ID NO: 4347262 - DNA, 15 bp, Homo sapiens
cttctaaacacttca

SEQ ID NO: 4347263 - DNA, 14 bp, Homo sapiens
cttctattgccatg

SEQ ID NO: 4347264 - DNA, 19 bp, Homo sapiens
cttctattgccatgaacca

SEQ ID NO: 4347265 - DNA, 14 bp, Homo sapiens
cttctctgggctga

SEQ ID NO: 4347266 - DNA, 20 bp, Homo sapiens
cttctgacaaaggtggtaaa

SEQ ID NO: 4347267 - DNA, 17 bp, Homo sapiens
cttctggatccatgggg

SEQ ID NO: 4347268 - DNA, 15 bp, Homo sapiens
cttctggggcaggct

SEQ ID NO: 4347269 - DNA, 21 bp, Homo sapiens
ttgggatactgcttattttat

SEQ ID NO: 4347270 - DNA, 21 bp, Homo sapiens
ttggtataatgtttaaatcat

SEQ ID NO: 4347271 - DNA, 19 bp, Homo sapiens
ttggtggccggtggttttg

SEQ ID NO: 4347272 - DNA, 19 bp, Homo sapiens
ttggttattctaagccctt

SEQ ID NO: 4347273 - DNA, 20 bp, Homo sapiens
ttggttgctaagaagcctat

SEQ ID NO: 4347274 - DNA, 14 bp, Homo sapiens
ttgtaaaacagcct

SEQ ID NO: 4347275 - DNA, 22 bp, Homo sapiens
ttgtatcttggggcaagactgc

SEQ ID NO: 4347276 - DNA, 18 bp, Homo sapiens
ttgtattcttctgtattt

SEQ ID NO: 4347277 - DNA, 10 bp, Homo sapiens
ttgtgcttta

SEQ ID NO: 4347278 - DNA, 19 bp, Homo sapiens
ttgtgtataatgtgcttta

SEQ ID NO: 4347279 - DNA, 19 bp, Homo sapiens
ttgttgaacatacttcaaa

SEQ ID NO: 4347280 - DNA, 13 bp, Homo sapiens
ttgttgctgctgt

SEQ ID NO: 4347281 - DNA, 15 bp, Homo sapiens
ttgttgttgctgctg

SEQ ID NO: 4347282 - DNA, 16 bp, Homo sapiens
ttgtttaaaattcagt

SEQ ID NO: 4347283 - DNA, 18 bp, Homo sapiens
ttgtttaaaattcagttt

SEQ ID NO: 4347284 - DNA, 18 bp, Homo sapiens
tttaaaaagtaagttaat

SEQ ID NO: 4347285 - DNA, 10 bp, Homo sapiens
tttaaaatta

SEQ ID NO: 4347286 - DNA, 15 bp, Homo sapiens
tttaaagcatctgta

SEQ ID NO: 4347287 - DNA, 15 bp, Homo sapiens
tttaaagccttctgg

SEQ ID NO: 4347288 - DNA, 16 bp, Homo sapiens
tttaaatcatgtatgt

SEQ ID NO: 4347289 - DNA, 17 bp, Homo sapiens
tttaaatcatgtatgtt

SEQ ID NO: 4347290 - DNA, 18 bp, Homo sapiens
tttaccaagagtaacttt

SEQ ID NO: 4347291 - DNA, 13 bp, Homo sapiens
tttactctgtgtt

SEQ ID NO: 4347292 - DNA, 14 bp, Homo sapiens
tttagagagcctgt

SEQ ID NO: 4347293 - DNA, 23 bp, Homo sapiens
tttagagagcctgtcaccagagc

SEQ ID NO: 4347294 - DNA, 18 bp, Homo sapiens
gcagagcaattccaggct

SEQ ID NO: 4347295 - DNA, 19 bp, Homo sapiens
gcagagcaattccaggctg

SEQ ID NO: 4347296 - DNA, 22 bp, Homo sapiens
tacactgcggaagccaaaggca

SEQ ID NO: 4347297 - DNA, 16 bp, Homo sapiens
tacatacattcatact

SEQ ID NO: 4347298 - DNA, 18 bp, Homo sapiens
tacattcatactgtagaa

SEQ ID NO: 4347299 - DNA, 16 bp, Homo sapiens
taccctgagcccacca

SEQ ID NO: 4347300 - DNA, 15 bp, Homo sapiens
tactctgtgtttaaa

SEQ ID NO: 4347301 - DNA, 16 bp, Homo sapiens
tactctgtgtttaaaa

SEQ ID NO: 4347302 - DNA, 13 bp, Homo sapiens
tactgcttatttt

SEQ ID NO: 4347303 - DNA, 19 bp, Homo sapiens
tctgccactgaggagacag

SEQ ID NO: 4347304 - DNA, 18 bp, Homo sapiens
tctgctagactcctcagg

SEQ ID NO: 4347305 - DNA, 19 bp, Homo sapiens
tctgctagactcctcagga

SEQ ID NO: 4347306 - DNA, 23 bp, Homo sapiens
tctgctagactcctcaggagaga

SEQ ID NO: 4347307 - DNA, 18 bp, Homo sapiens
tctgctttatcttttcat

SEQ ID NO: 4347308 - DNA, 20 bp, Homo sapiens
tctgctttatcttttcataa

SEQ ID NO: 4347309 - DNA, 17 bp, Homo sapiens
tctggggcaggctgggc

SEQ ID NO: 4347310 - DNA, 18 bp, Homo sapiens
tctggggcaggctgggcc

SEQ ID NO: 4347311 - DNA, 20 bp, Homo sapiens
tctggggcaggctgggccat

SEQ ID NO: 4347312 - DNA, 20 bp, Homo sapiens
tctgtagctacactgtataa

SEQ ID NO: 4347313 - DNA, 13 bp, Homo sapiens
tctgtgaaagcct

SEQ ID NO: 4347314 - DNA, 20 bp, Homo sapiens
tctgtgtaacatccaagcca

SEQ ID NO: 4347315 - DNA, 22 bp, Homo sapiens
tctgtgtaacatccaagccaga

SEQ ID NO: 4347316 - DNA, 23 bp, Homo sapiens
tctgtgtaacatccaagccagag

SEQ ID NO: 4347317 - DNA, 15 bp, Homo sapiens
tctgtgtgtatattg

SEQ ID NO: 4347318 - DNA, 14 bp, Homo sapiens
tcttaatctgtgtg

SEQ ID NO: 4347319 - DNA, 15 bp, Homo sapiens
tcttaatctgtgtgt

SEQ ID NO: 4347320 - DNA, 23 bp, Homo sapiens
tcttagagccttttatctgcaga

SEQ ID NO: 4347321 - DNA, 13 bp, Homo sapiens
tcttcccttccca

SEQ ID NO: 4347322 - DNA, 14 bp, Homo sapiens
tcttcccttcccag

SEQ ID NO: 4347323 - DNA, 18 bp, Homo sapiens
tcttcctagatctgcagg

SEQ ID NO: 4347324 - DNA, 22 bp, Homo sapiens
tcttctggggcaggctgggcca

SEQ ID NO: 4347325 - DNA, 19 bp, Homo sapiens
tcttctgtatttctaggca

SEQ ID NO: 4347326 - DNA, 17 bp, Homo sapiens
tcttggggcaagactgc

SEQ ID NO: 4347327 - DNA, 20 bp, Homo sapiens
tcttggggctgatgaagaag

SEQ ID NO: 4347328 - DNA, 18 bp, Homo sapiens
tctttatatatggacagc

SEQ ID NO: 4347329 - DNA, 21 bp, Homo sapiens
tcttttcataaagggttgaaa

SEQ ID NO: 4347330 - DNA, 18 bp, Homo sapiens
tcttttggttattctaag

SEQ ID NO: 4347331 - DNA, 18 bp, Homo sapiens
tgaacatacttcaaaaat

SEQ ID NO: 4347332 - DNA, 21 bp, Homo sapiens
tgaacatacttcaaaaataat

SEQ ID NO: 4347333 - DNA, 15 bp, Homo sapiens
tgaactgcatcaaga

SEQ ID NO: 4347334 - DNA, 21 bp, Homo sapiens
tgaaggaatcattccagtgct

SEQ ID NO: 4347335 - DNA, 18 bp, Homo sapiens
tgaagggaagtggggagt

SEQ ID NO: 4347336 - DNA, 17 bp, Homo sapiens
tgaagtgaattcctgca

SEQ ID NO: 4347337 - DNA, 17 bp, Homo sapiens
tgaatattttggaaact

SEQ ID NO: 4347338 - DNA, 19 bp, Homo sapiens
tgaattgcctgttcataaa

SEQ ID NO: 4347339 - DNA, 19 bp, Homo sapiens
tgacaaaggtggtaaattc

SEQ ID NO: 4347340 - DNA, 19 bp, Homo sapiens
tgaccacaccaaccaggcc

SEQ ID NO: 4347341 - DNA, 20 bp, Homo sapiens
tgaccacaccaaccaggcct

SEQ ID NO: 4347342 - DNA, 19 bp, Homo sapiens
tgactgtaccacagacaca

SEQ ID NO: 4347343 - DNA, 19 bp, Homo sapiens
tgacttctgacaaaggtgg

SEQ ID NO: 4347344 - DNA, 12 bp, Homo sapiens
tgactttgtata

SEQ ID NO: 4347345 - DNA, 14 bp, Homo sapiens
tgagccatgaggag

SEQ ID NO: 4347346 - DNA, 21 bp, Homo sapiens
tgagcccaccagggacacctc

SEQ ID NO: 4347347 - DNA, 19 bp, Homo sapiens
tgaggagacagaaagcctc

SEQ ID NO: 4347348 - DNA, 20 bp, Homo sapiens
tgaggagacagaaagcctcc

SEQ ID NO: 4347349 - DNA, 18 bp, Homo sapiens
tgaggccaagatggctgc

SEQ ID NO: 4347350 - DNA, 19 bp, Homo sapiens
tgaggccaagatggctgct

SEQ ID NO: 4347351 - DNA, 23 bp, Homo sapiens
tgaggccaagatggctgctgcct

SEQ ID NO: 4347352 - DNA, 18 bp, Homo sapiens
tgatattgtttaaaattc

SEQ ID NO: 4347353 - DNA, 15 bp, Homo sapiens
tgatgaagtatactt

SEQ ID NO: 4347354 - DNA, 23 bp, Homo sapiens
tgatgtgactttttttggtataa

SEQ ID NO: 4347355 - DNA, 15 bp, Homo sapiens
tgatttgatgtgact

SEQ ID NO: 4347356 - DNA, 22 bp, Homo sapiens
tgattttaaaggcagagaagtt

SEQ ID NO: 4347357 - DNA, 13 bp, Homo sapiens
tgcaaatcaccca

SEQ ID NO: 4347358 - DNA, 20 bp, Homo sapiens
tgcacaggaagatattggtg

SEQ ID NO: 4347359 - DNA, 14 bp, Homo sapiens
tgcacagggtgtgg

SEQ ID NO: 4347360 - DNA, 13 bp, Homo sapiens
tgcaggctgcacc

SEQ ID NO: 4347361 - DNA, 12 bp, Homo sapiens
tgccaaggccaa

SEQ ID NO: 4347362 - DNA, 18 bp, Homo sapiens
tgccactgaggagacaga

SEQ ID NO: 4347363 - DNA, 19 bp, Homo sapiens
tgccactgaggagacagaa

SEQ ID NO: 4347364 - DNA, 16 bp, Homo sapiens
tgccagagccaacctg

SEQ ID NO: 4347365 - DNA, 23 bp, Homo sapiens
tgccagagccaacctggacttcc

SEQ ID NO: 4347366 - DNA, 14 bp, Homo sapiens
tgcccctctcacca

SEQ ID NO: 4347367 - DNA, 19 bp, Homo sapiens
tgcctataaccatgttcta

SEQ ID NO: 4347368 - DNA, 11 bp, Homo sapiens
tgcctggactg

SEQ ID NO: 4347369 - DNA, 14 bp, Homo sapiens
tgcctggactgacc

SEQ ID NO: 4347370 - DNA, 19 bp, Homo sapiens
tgcgtcttttttctcttcc

SEQ ID NO: 4347371 - DNA, 16 bp, Homo sapiens
tgctaaattctatgtt

SEQ ID NO: 4347372 - DNA, 21 bp, Homo sapiens
tgctagaaaatttagcccttt

SEQ ID NO: 4347373 - DNA, 17 bp, Homo sapiens
tgctagactcctcagga

SEQ ID NO: 4347374 - DNA, 20 bp, Homo sapiens
tgctagactcctcaggagag

SEQ ID NO: 4347375 - DNA, 17 bp, Homo sapiens
tgctataaatgccagag

SEQ ID NO: 4347376 - DNA, 9 bp, Homo sapiens
tgctgctgt

SEQ ID NO: 4347377 - DNA, 23 bp, Homo sapiens
tgctgtttgggttgttggtctgt

SEQ ID NO: 4347378 - DNA, 16 bp, Homo sapiens
tgctttctgtgaaagc

SEQ ID NO: 4347379 - DNA, 14 bp, Homo sapiens
tggaaactgctaaa

SEQ ID NO: 4347380 - DNA, 20 bp, Homo sapiens
tggaaactgctaaattctat

SEQ ID NO: 4347381 - DNA, 21 bp, Homo sapiens
tggaaactgctaaattctatg

SEQ ID NO: 4347382 - DNA, 19 bp, Homo sapiens
tggaagctttgagttgact

SEQ ID NO: 4347383 - DNA, 21 bp, Homo sapiens
tggacagctttattttaaatg

SEQ ID NO: 4347384 - DNA, 23 bp, Homo sapiens
tggacagctttattttaaatgtg

SEQ ID NO: 4347385 - DNA, 17 bp, Homo sapiens
tggactacaaaatacaa

SEQ ID NO: 4347386 - DNA, 13 bp, Homo sapiens
tggactgaccaaa

SEQ ID NO: 4347387 - DNA, 19 bp, Homo sapiens
tggactgaccaaagactgc

SEQ ID NO: 4347388 - DNA, 19 bp, Homo sapiens
tggactgaccacaccaacc

SEQ ID NO: 4347389 - DNA, 14 bp, Homo sapiens
tggacttcctgtca

SEQ ID NO: 4347390 - DNA, 16 bp, Homo sapiens
tggcaatgcttaaact

SEQ ID NO: 4347391 - DNA, 19 bp, Homo sapiens
tggcaatgcttaaactaaa

SEQ ID NO: 4347392 - DNA, 21 bp, Homo sapiens
tggcaatgcttaaactaaata

SEQ ID NO: 4347393 - DNA, 23 bp, Homo sapiens
tggcagaagcattgcctggactg

SEQ ID NO: 4347394 - DNA, 22 bp, Homo sapiens
tggccctcggaggtccagctgg

SEQ ID NO: 4347395 - DNA, 14 bp, Homo sapiens
tggctagagccgag

SEQ ID NO: 4347396 - DNA, 15 bp, Homo sapiens
tggctagagccgagg

SEQ ID NO: 4347397 - DNA, 14 bp, Homo sapiens
tggctctcagagga

SEQ ID NO: 4347398 - DNA, 14 bp, Homo sapiens
tggctggtgtatgc

SEQ ID NO: 4347399 - DNA, 17 bp, Homo sapiens
tggctttttctgccact

SEQ ID NO: 4347400 - DNA, 10 bp, Homo sapiens
tgggagccag

SEQ ID NO: 4347401 - DNA, 21 bp, Homo sapiens
tgggatttggggcctcaagaa

SEQ ID NO: 4347402 - DNA, 20 bp, Homo sapiens
tggggctgatgaagaagggg

SEQ ID NO: 4347403 - DNA, 13 bp, Homo sapiens
tggtaaattcaga

SEQ ID NO: 4347404 - DNA, 20 bp, Homo sapiens
tggtaaattcagacaacatt

SEQ ID NO: 4347405 - DNA, 22 bp, Homo sapiens
tggtaaattcagacaacattat

SEQ ID NO: 4347406 - DNA, 15 bp, Homo sapiens
tggtagcataaataa

SEQ ID NO: 4347407 - DNA, 23 bp, Homo sapiens
tggtagcataaataaaactgaat

SEQ ID NO: 4347408 - DNA, 20 bp, Homo sapiens
tggtataatgtttaaatcat

SEQ ID NO: 4347409 - DNA, 16 bp, Homo sapiens
tggtcatcaccaccct

SEQ ID NO: 4347410 - DNA, 20 bp, Homo sapiens
tggtgaagggaagtggggag

SEQ ID NO: 4347411 - DNA, 15 bp, Homo sapiens
tggtggactacaaaa

SEQ ID NO: 4347412 - DNA, 19 bp, Homo sapiens
tggttattggactccaggc

SEQ ID NO: 4347413 - DNA, 15 bp, Homo sapiens
tggttcatattttat

SEQ ID NO: 4347414 - DNA, 15 bp, Homo sapiens
tggttttgtgcttta

SEQ ID NO: 4347415 - DNA, 17 bp, Homo sapiens
tgtaacatccaagccag

SEQ ID NO: 4347416 - DNA, 21 bp, Homo sapiens
tgtaactgaggactgtttgca

SEQ ID NO: 4347417 - DNA, 21 bp, Homo sapiens
tgtaatctttcatccaaaata

SEQ ID NO: 4347418 - DNA, 18 bp, Homo sapiens
tgtacatacattcatact

SEQ ID NO: 4347419 - DNA, 23 bp, Homo sapiens
tgtaccacagacacaatatgtat

SEQ ID NO: 4347420 - DNA, 15 bp, Homo sapiens
tgtacttgatttgat

SEQ ID NO: 4347421 - DNA, 21 bp, Homo sapiens
tgtagaaaccagctcatgtgt

SEQ ID NO: 4347422 - DNA, 22 bp, Homo sapiens
tgtagaaaccagctcatgtgta

SEQ ID NO: 4347423 - DNA, 15 bp, Homo sapiens
tgtataactgttctt

SEQ ID NO: 4347424 - DNA, 16 bp, Homo sapiens
tgtataatgtgcttta

SEQ ID NO: 4347425 - DNA, 17 bp, Homo sapiens
tgtatagagaatttaag

SEQ ID NO: 4347426 - DNA, 22 bp, Homo sapiens
tgtatatcattctacagaataa

SEQ ID NO: 4347427 - DNA, 21 bp, Homo sapiens
tgtatcttggggcaagactgc

SEQ ID NO: 4347428 - DNA, 15 bp, Homo sapiens
tgtatgtcagtgcta

SEQ ID NO: 4347429 - DNA, 15 bp, Homo sapiens
tgtatgttatgatat

SEQ ID NO: 4347430 - DNA, 15 bp, Homo sapiens
tgtattcttctgtat

SEQ ID NO: 4347431 - DNA, 17 bp, Homo sapiens
tgtattgtaatctttca

SEQ ID NO: 4347432 - DNA, 14 bp, Homo sapiens
tgtattttttaaaa

SEQ ID NO: 4347433 - DNA, 19 bp, Homo sapiens
tgtattttttaaaacacta

SEQ ID NO: 4347434 - DNA, 21 bp, Homo sapiens
tgtattttttaaaacactaaa

SEQ ID NO: 4347435 - DNA, 22 bp, Homo sapiens
tgtattttttaaaacactaaaa

SEQ ID NO: 4347436 - DNA, 17 bp, Homo sapiens
tactgtagaaaccagct

SEQ ID NO: 4347437 - DNA, 17 bp, Homo sapiens
tactgtgcagaataatg

SEQ ID NO: 4347438 - DNA, 13 bp, Homo sapiens
tacttcaaaaata

SEQ ID NO: 4347439 - DNA, 17 bp, Homo sapiens
tacttcaaaaataatgt

SEQ ID NO: 4347440 - DNA, 21 bp, Homo sapiens
tactttttcccatctggcttt

SEQ ID NO: 4347441 - DNA, 16 bp, Homo sapiens
tagaaagctggactga

SEQ ID NO: 4347442 - DNA, 22 bp, Homo sapiens
tagagccgaggggagagaggga

SEQ ID NO: 4347443 - DNA, 15 bp, Homo sapiens
tagatctgcaggctg

SEQ ID NO: 4347444 - DNA, 15 bp, Homo sapiens
tagcataaataaaac

SEQ ID NO: 4347445 - DNA, 17 bp, Homo sapiens
tagcataaataaaactg

SEQ ID NO: 4347446 - DNA, 19 bp, Homo sapiens
tagcataaataaaactgaa

SEQ ID NO: 4347447 - DNA, 14 bp, Homo sapiens
taggagaaacacat

SEQ ID NO: 4347448 - DNA, 19 bp, Homo sapiens
taggtagtttggatatttt

SEQ ID NO: 4347449 - DNA, 17 bp, Homo sapiens
tagtttggatatttttg

SEQ ID NO: 4347450 - DNA, 16 bp, Homo sapiens
tataaatgccagagcc

SEQ ID NO: 4347451 - DNA, 18 bp, Homo sapiens
tataaatgccagagccaa

SEQ ID NO: 4347452 - DNA, 14 bp, Homo sapiens
tataaattttcaga

SEQ ID NO: 4347453 - DNA, 18 bp, Homo sapiens
tataaccatgttctatat

SEQ ID NO: 4347454 - DNA, 19 bp, Homo sapiens
tataactgttcttcaataa

SEQ ID NO: 4347455 - DNA, 13 bp, Homo sapiens
tataatctgaaga

SEQ ID NO: 4347456 - DNA, 13 bp, Homo sapiens
tataatgtttaaa

SEQ ID NO: 4347457 - DNA, 16 bp, Homo sapiens
tatactctcccagatt

SEQ ID NO: 4347458 - DNA, 19 bp, Homo sapiens
tatacttttcccctgttaa

SEQ ID NO: 4347459 - DNA, 18 bp, Homo sapiens
tatatcattctacagaat

SEQ ID NO: 4347460 - DNA, 21 bp, Homo sapiens
tatatgtacatacattcatac

SEQ ID NO: 4347461 - DNA, 20 bp, Homo sapiens
tatatttcacttttgttctg

SEQ ID NO: 4347462 - DNA, 22 bp, Homo sapiens
tatcaaatccaggactttgtta

SEQ ID NO: 4347463 - DNA, 21 bp, Homo sapiens
tatcaattggcagtgactttg

SEQ ID NO: 4347464 - DNA, 21 bp, Homo sapiens
tatcatctcaattttttcaaa

SEQ ID NO: 4347465 - DNA, 19 bp, Homo sapiens
tatctagtcagtatctgta

SEQ ID NO: 4347466 - DNA, 12 bp, Homo sapiens
tatctgcagaac

SEQ ID NO: 4347467 - DNA, 20 bp, Homo sapiens
tatcttggggcaagactgca

SEQ ID NO: 4347468 - DNA, 17 bp, Homo sapiens
tatgaaggaatcattcc

SEQ ID NO: 4347469 - DNA, 17 bp, Homo sapiens
tatggtgaagggaagtg

SEQ ID NO: 4347470 - DNA, 12 bp, Homo sapiens
tatgtatgaagg

SEQ ID NO: 4347471 - DNA, 13 bp, Homo sapiens
tatgtatgaagga

SEQ ID NO: 4347472 - DNA, 18 bp, Homo sapiens
tatgttaaatactgtgca

SEQ ID NO: 4347473 - DNA, 22 bp, Homo sapiens
tatgttaaatactgtgcagaat

SEQ ID NO: 4347474 - DNA, 21 bp, Homo sapiens
tattcctagtggatgactgtt

SEQ ID NO: 4347475 - DNA, 15 bp, Homo sapiens
tattctacctttgta

SEQ ID NO: 4347476 - DNA, 17 bp, Homo sapiens
tattctacctttgtaaa

SEQ ID NO: 4347477 - DNA, 20 bp, Homo sapiens
tattctcagtaacttttaaa

SEQ ID NO: 4347478 - DNA, 11 bp, Homo sapiens
tattgtttaaa

SEQ ID NO: 4347479 - DNA, 20 bp, Homo sapiens
tattgtttaaaattcagttt

SEQ ID NO: 4347480 - DNA, 19 bp, Homo sapiens
tatttcacttttgttctgc

SEQ ID NO: 4347481 - DNA, 14 bp, Homo sapiens
tatttctaggcaca

SEQ ID NO: 4347482 - DNA, 13 bp, Homo sapiens
tatttttgtactt

SEQ ID NO: 4347483 - DNA, 15 bp, Homo sapiens
tatttttgtacttga

SEQ ID NO: 4347484 - DNA, 19 bp, Homo sapiens
tcaaagtaatatatcaaat

SEQ ID NO: 4347485 - DNA, 20 bp, Homo sapiens
tcaaagtaatatatcaaatc

SEQ ID NO: 4347486 - DNA, 21 bp, Homo sapiens
tcaaagtaatatatcaaatcc

SEQ ID NO: 4347487 - DNA, 15 bp, Homo sapiens
tcaaagttaattcac

SEQ ID NO: 4347488 - DNA, 19 bp, Homo sapiens
tcaaagttaattcacctat

SEQ ID NO: 4347489 - DNA, 22 bp, Homo sapiens
tcaaagttaattcacctatgtt

SEQ ID NO: 4347490 - DNA, 22 bp, Homo sapiens
tcaaatgaaaggattctctaat

SEQ ID NO: 4347491 - DNA, 22 bp, Homo sapiens
tcaagaaatatactctcccaga

SEQ ID NO: 4347492 - DNA, 21 bp, Homo sapiens
tcaagggaaaggcaagcttga

SEQ ID NO: 4347493 - DNA, 22 bp, Homo sapiens
tcaataaaatggttcatatttt

SEQ ID NO: 4347494 - DNA, 23 bp, Homo sapiens
tcaattggcagtgactttgtata

SEQ ID NO: 4347495 - DNA, 20 bp, Homo sapiens
tcacaatcttggggctgatg

SEQ ID NO: 4347496 - DNA, 23 bp, Homo sapiens
tcacaatcttggggctgatgaag

SEQ ID NO: 4347497 - DNA, 16 bp, Homo sapiens
tcacacccatttaaaa

SEQ ID NO: 4347498 - DNA, 18 bp, Homo sapiens
tcaccagagcttctctgg

SEQ ID NO: 4347499 - DNA, 21 bp, Homo sapiens
tcaccagagcttctctgggct

SEQ ID NO: 4347500 - DNA, 17 bp, Homo sapiens
tcacctgttatgtatga

SEQ ID NO: 4347501 - DNA, 14 bp, Homo sapiens
tcactgttctgcaa

SEQ ID NO: 4347502 - DNA, 16 bp, Homo sapiens
tcactgttctgcaaag

SEQ ID NO: 4347503 - DNA, 13 bp, Homo sapiens
tcacttttgttct

SEQ ID NO: 4347504 - DNA, 16 bp, Homo sapiens
tcagagcttgaagatt

SEQ ID NO: 4347505 - DNA, 22 bp, Homo sapiens
tcagaggaaaaatgggagccag

SEQ ID NO: 4347506 - DNA, 16 bp, Homo sapiens
tcagcccaccaccctg

SEQ ID NO: 4347507 - DNA, 17 bp, Homo sapiens
tcaggcagaaatattta

SEQ ID NO: 4347508 - DNA, 19 bp, Homo sapiens
tcaggcatggctcagagct

SEQ ID NO: 4347509 - DNA, 19 bp, Homo sapiens
tcagtgctataaatgccag

SEQ ID NO: 4347510 - DNA, 20 bp, Homo sapiens
tcagtgctataaatgccaga

SEQ ID NO: 4347511 - DNA, 12 bp, Homo sapiens
tcagtttttgta

SEQ ID NO: 4347512 - DNA, 16 bp, Homo sapiens
tcagtttttgtatctt

SEQ ID NO: 4347513 - DNA, 15 bp, Homo sapiens
tcataataggtagtt

SEQ ID NO: 4347514 - DNA, 20 bp, Homo sapiens
tcataataggtagtttggat

SEQ ID NO: 4347515 - DNA, 16 bp, Homo sapiens
tcatacaagccattta

SEQ ID NO: 4347516 - DNA, 12 bp, Homo sapiens
tcatattttata

SEQ ID NO: 4347517 - DNA, 14 bp, Homo sapiens
tcatcaccaccctt

SEQ ID NO: 4347518 - DNA, 13 bp, Homo sapiens
tcatcctcctccc

SEQ ID NO: 4347519 - DNA, 19 bp, Homo sapiens
tcatgtatgttatgatatt

SEQ ID NO: 4347520 - DNA, 18 bp, Homo sapiens
tcattagggtaatatcat

SEQ ID NO: 4347521 - DNA, 18 bp, Homo sapiens
tcattccagtgctagaaa

SEQ ID NO: 4347522 - DNA, 15 bp, Homo sapiens
tcattccggactggc

SEQ ID NO: 4347523 - DNA, 22 bp, Homo sapiens
tcattccggactggcagaagca

SEQ ID NO: 4347524 - DNA, 23 bp, Homo sapiens
tcattccggactggcagaagcat

SEQ ID NO: 4347525 - DNA, 18 bp, Homo sapiens
tccaaaatattttttgca

SEQ ID NO: 4347526 - DNA, 16 bp, Homo sapiens
tccaaagaggctgccc

SEQ ID NO: 4347527 - DNA, 13 bp, Homo sapiens
tccaagccagagt

SEQ ID NO: 4347528 - DNA, 15 bp, Homo sapiens
tccagctgggcctcc

SEQ ID NO: 4347529 - DNA, 13 bp, Homo sapiens
tccaggctgagcc

SEQ ID NO: 4347530 - DNA, 14 bp, Homo sapiens
tccaggctgagcca

SEQ ID NO: 4347531 - DNA, 16 bp, Homo sapiens
tccaggctgagccatg

SEQ ID NO: 4347532 - DNA, 19 bp, Homo sapiens
tccaggctgagccatgagg

SEQ ID NO: 4347533 - DNA, 14 bp, Homo sapiens
tccagtattgctga

SEQ ID NO: 4347534 - DNA, 21 bp, Homo sapiens
tccagtcaagctctgggtact

SEQ ID NO: 4347535 - DNA, 15 bp, Homo sapiens
tcccacccacagcca

SEQ ID NO: 4347536 - DNA, 18 bp, Homo sapiens
tcccacccacagccatag

SEQ ID NO: 4347537 - DNA, 14 bp, Homo sapiens
tcccagaccaggaa

SEQ ID NO: 4347538 - DNA, 20 bp, Homo sapiens
tcccagatttttactttttc

SEQ ID NO: 4347539 - DNA, 14 bp, Homo sapiens
tcccatctggcttt

SEQ ID NO: 4347540 - DNA, 18 bp, Homo sapiens
tcccatctggctttttct

SEQ ID NO: 4347541 - DNA, 13 bp, Homo sapiens
tccccaccagctt

SEQ ID NO: 4347542 - DNA, 15 bp, Homo sapiens
tccccaccagcttta

SEQ ID NO: 4347543 - DNA, 21 bp, Homo sapiens
tccctaacttgtgaagacaat

SEQ ID NO: 4347544 - DNA, 22 bp, Homo sapiens
tcccttaaaattaccagacaaa

SEQ ID NO: 4347545 - DNA, 15 bp, Homo sapiens
tcccttcccagacca

SEQ ID NO: 4347546 - DNA, 16 bp, Homo sapiens
tcctagatctgcaggc

SEQ ID NO: 4347547 - DNA, 22 bp, Homo sapiens
tcctagcagacagaaactggat

SEQ ID NO: 4347548 - DNA, 18 bp, Homo sapiens
tcctagtggatgactgtt

SEQ ID NO: 4347549 - DNA, 17 bp, Homo sapiens
tccttcaaccaccattt

SEQ ID NO: 4347550 - DNA, 22 bp, Homo sapiens
tcctttacaaccatactttata

SEQ ID NO: 4347551 - DNA, 21 bp, Homo sapiens
tcgatatgtatatcattctac

SEQ ID NO: 4347552 - DNA, 22 bp, Homo sapiens
tcgcccttcagcccaccaccct

SEQ ID NO: 4347553 - DNA, 16 bp, Homo sapiens
tcggaggtccagctgg

SEQ ID NO: 4347554 - DNA, 16 bp, Homo sapiens
tctaaaaagaaaaaga

SEQ ID NO: 4347555 - DNA, 12 bp, Homo sapiens
tctaataaactt

SEQ ID NO: 4347556 - DNA, 14 bp, Homo sapiens
tctaattagaaatt

SEQ ID NO: 4347557 - DNA, 21 bp, Homo sapiens
aaaaaatttaaaattacgttt

SEQ ID NO: 4347558 - DNA, 18 bp, Homo sapiens
aaaaagaaaaagagataa

SEQ ID NO: 4347559 - DNA, 17 bp, Homo sapiens
aaaaatgggagccagga

SEQ ID NO: 4347560 - DNA, 21 bp, Homo sapiens
aaaaatttaaaattacgtttg

SEQ ID NO: 4347561 - DNA, 10 bp, Homo sapiens
aaaacactaa

SEQ ID NO: 4347562 - DNA, 13 bp, Homo sapiens
aaaactgaatctc

SEQ ID NO: 4347563 - DNA, 15 bp, Homo sapiens
aaaatacaatcctgt

SEQ ID NO: 4347564 - DNA, 19 bp, Homo sapiens
aaaatacaatcctgtttat

SEQ ID NO: 4347565 - DNA, 13 bp, Homo sapiens
aaaatattttttg

SEQ ID NO: 4347566 - DNA, 16 bp, Homo sapiens
aaaatattttttgcaa

SEQ ID NO: 4347567 - DNA, 21 bp, Homo sapiens
aaaattacgtttgttattcct

SEQ ID NO: 4347568 - DNA, 13 bp, Homo sapiens
aaaattcagtttt

SEQ ID NO: 4347569 - DNA, 15 bp, Homo sapiens
aaaattcagtttttg

SEQ ID NO: 4347570 - DNA, 16 bp, Homo sapiens
aaaattcagtttttgt

SEQ ID NO: 4347571 - DNA, 21 bp, Homo sapiens
aaaattcagtttttgtatctt

SEQ ID NO: 4347572 - DNA, 23 bp, Homo sapiens
aaaattcagtttttgtatcttgg

SEQ ID NO: 4347573 - DNA, 14 bp, Homo sapiens
aaacacttcattct

SEQ ID NO: 4347574 - DNA, 22 bp, Homo sapiens
aaactctagactgcaagaactg

SEQ ID NO: 4347575 - DNA, 18 bp, Homo sapiens
aaactcttaatctgtgtg

SEQ ID NO: 4347576 - DNA, 13 bp, Homo sapiens
aaactgaatattt

SEQ ID NO: 4347577 - DNA, 14 bp, Homo sapiens
aaactgaatatttt

SEQ ID NO: 4347578 - DNA, 15 bp, Homo sapiens
aaactgaatattttg

SEQ ID NO: 4347579 - DNA, 16 bp, Homo sapiens
aaactgctaaattcta

SEQ ID NO: 4347580 - DNA, 11 bp, Homo sapiens
aaactttattt

SEQ ID NO: 4347581 - DNA, 17 bp, Homo sapiens
aaacttttttatatctt

SEQ ID NO: 4347582 - DNA, 18 bp, Homo sapiens
aaacttttttatatcttt

SEQ ID NO: 4347583 - DNA, 13 bp, Homo sapiens
aaagaaagcactt

SEQ ID NO: 4347584 - DNA, 13 bp, Homo sapiens
aaagactgcagaa

SEQ ID NO: 4347585 - DNA, 22 bp, Homo sapiens
aaagaggctgcccctctcacca

SEQ ID NO: 4347586 - DNA, 23 bp, Homo sapiens
aaagaggctgcccctctcaccaa

SEQ ID NO: 4347587 - DNA, 17 bp, Homo sapiens
aaagccttaagaagata

SEQ ID NO: 4347588 - DNA, 13 bp, Homo sapiens
aatgtgtttgctg

SEQ ID NO: 4347589 - DNA, 11 bp, Homo sapiens
aatgtttaaat

SEQ ID NO: 4347590 - DNA, 18 bp, Homo sapiens
aatgtttaaatcatgtat

SEQ ID NO: 4347591 - DNA, 21 bp, Homo sapiens
aatgtttaaatcatgtatgtt

SEQ ID NO: 4347592 - DNA, 16 bp, Homo sapiens
aattacgtttgttatt

SEQ ID NO: 4347593 - DNA, 17 bp, Homo sapiens
aattcagattgtcttgc

SEQ ID NO: 4347594 - DNA, 18 bp, Homo sapiens
aattcagattgtcttgca

SEQ ID NO: 4347595 - DNA, 12 bp, Homo sapiens
aattcagttttt

SEQ ID NO: 4347596 - DNA, 19 bp, Homo sapiens
aattcagtttttgtatctt

SEQ ID NO: 4347597 - DNA, 13 bp, Homo sapiens
aattccaggctga

SEQ ID NO: 4347598 - DNA, 19 bp, Homo sapiens
aattccaggctgagccatg

SEQ ID NO: 4347599 - DNA, 21 bp, Homo sapiens
aattccaggctgagccatgag

SEQ ID NO: 4347600 - DNA, 20 bp, Homo sapiens
aattctatgttaaatactgt

SEQ ID NO: 4347601 - DNA, 19 bp, Homo sapiens
aatttagccctttaaaacg

SEQ ID NO: 4347602 - DNA, 13 bp, Homo sapiens
aatttatatgcat

SEQ ID NO: 4347603 - DNA, 19 bp, Homo sapiens
aatttatcaactgtcaaat

SEQ ID NO: 4347604 - DNA, 22 bp, Homo sapiens
aatttatcaactgtcaaatatg

SEQ ID NO: 4347605 - DNA, 20 bp, Homo sapiens
aattttcagaattaatgcat

SEQ ID NO: 4347606 - DNA, 14 bp, Homo sapiens
aattttttttttcc

SEQ ID NO: 4347607 - DNA, 18 bp, Homo sapiens
acaaaggtggtaaattca

SEQ ID NO: 4347608 - DNA, 18 bp, Homo sapiens
acaacattatgatctaat

SEQ ID NO: 4347609 - DNA, 23 bp, Homo sapiens
acaacattatgatctaataaact

SEQ ID NO: 4347610 - DNA, 17 bp, Homo sapiens
acaccaaccaggccttc

SEQ ID NO: 4347611 - DNA, 15 bp, Homo sapiens
acactgcggaagcca

SEQ ID NO: 4347612 - DNA, 18 bp, Homo sapiens
acactgcggaagccaaag

SEQ ID NO: 4347613 - DNA, 21 bp, Homo sapiens
acagaaagcctccgctgggct

SEQ ID NO: 4347614 - DNA, 15 bp, Homo sapiens
acagacacaatatgt

SEQ ID NO: 4347615 - DNA, 14 bp, Homo sapiens
acagctaaatcatt

SEQ ID NO: 4347616 - DNA, 18 bp, Homo sapiens
acagggacttgtttagag

SEQ ID NO: 4347617 - DNA, 20 bp, Homo sapiens
acagggacttgtttagagag

SEQ ID NO: 4347618 - DNA, 12 bp, Homo sapiens
acagttcataat

SEQ ID NO: 4347619 - DNA, 20 bp, Homo sapiens
acatacttcaaaaataatgt

SEQ ID NO: 4347620 - DNA, 22 bp, Homo sapiens
acatacttcaaaaataatgtgc

SEQ ID NO: 4347621 - DNA, 12 bp, Homo sapiens
acattacagttc

SEQ ID NO: 4347622 - DNA, 13 bp, Homo sapiens
acattacagttca

SEQ ID NO: 4347623 - DNA, 13 bp, Homo sapiens
acattatgatcta

SEQ ID NO: 4347624 - DNA, 17 bp, Homo sapiens
acattcttattaattct

SEQ ID NO: 4347625 - DNA, 18 bp, Homo sapiens
acattcttattaattctt

SEQ ID NO: 4347626 - DNA, 19 bp, Homo sapiens
acattcttattaattcttc

SEQ ID NO: 4347627 - DNA, 23 bp, Homo sapiens
accacagacacaatatgtatgct

SEQ ID NO: 4347628 - DNA, 20 bp, Homo sapiens
accagagcttctctgggctg

SEQ ID NO: 4347629 - DNA, 13 bp, Homo sapiens
accagctcatgtg

SEQ ID NO: 4347630 - DNA, 15 bp, Homo sapiens
accagctttattttt

SEQ ID NO: 4347631 - DNA, 21 bp, Homo sapiens
accaggccttcatcctcctcc

SEQ ID NO: 4347632 - DNA, 14 bp, Homo sapiens
accattttttttgt

SEQ ID NO: 4347633 - DNA, 14 bp, Homo sapiens
acccccaggtggcc

SEQ ID NO: 4347634 - DNA, 17 bp, Homo sapiens
acccccaggtggcctgc

SEQ ID NO: 4347635 - DNA, 16 bp, Homo sapiens
accgttggggccctta

SEQ ID NO: 4347636 - DNA, 23 bp, Homo sapiens
acctaatgtctcactgttctgca

SEQ ID NO: 4347637 - DNA, 19 bp, Homo sapiens
acctagctggtagcataaa

SEQ ID NO: 4347638 - DNA, 19 bp, Homo sapiens
acctcgcccttcagcccac

SEQ ID NO: 4347639 - DNA, 20 bp, Homo sapiens
acctctggctagagccgagg

SEQ ID NO: 4347640 - DNA, 14 bp, Homo sapiens
acctggacttcctg

SEQ ID NO: 4347641 - DNA, 15 bp, Homo sapiens
acctggacttcctgt

SEQ ID NO: 4347642 - DNA, 15 bp, Homo sapiens
acctggctctcagag

SEQ ID NO: 4347643 - DNA, 17 bp, Homo sapiens
acctggctctcagagga

SEQ ID NO: 4347644 - DNA, 14 bp, Homo sapiens
acctgttatgtatg

SEQ ID NO: 4347645 - DNA, 15 bp, Homo sapiens
acctttcagtactct

SEQ ID NO: 4347646 - DNA, 19 bp, Homo sapiens
acctttcagtactcttatt

SEQ ID NO: 4347647 - DNA, 19 bp, Homo sapiens
acctttgtaaaacagccta

SEQ ID NO: 4347648 - DNA, 12 bp, Homo sapiens
actaaataatga

SEQ ID NO: 4347649 - DNA, 15 bp, Homo sapiens
actaaataatgaata

SEQ ID NO: 4347650 - DNA, 16 bp, Homo sapiens
actacgtgttcacagg

SEQ ID NO: 4347651 - DNA, 21 bp, Homo sapiens
actacgtgttcacaggctgct

SEQ ID NO: 4347652 - DNA, 19 bp, Homo sapiens
actcaagggaaaggcaagc

SEQ ID NO: 4347653 - DNA, 20 bp, Homo sapiens
actcaagggaaaggcaagct

SEQ ID NO: 4347654 - DNA, 22 bp, Homo sapiens
actcaagggaaaggcaagcttg

SEQ ID NO: 4347655 - DNA, 21 bp, Homo sapiens
actcctttacaaccatacttt

SEQ ID NO: 4347656 - DNA, 22 bp, Homo sapiens
actcctttacaaccatacttta

SEQ ID NO: 4347657 - DNA, 15 bp, Homo sapiens
actctgctagactcc

SEQ ID NO: 4347658 - DNA, 22 bp, Homo sapiens
actctgctagactcctcaggag

SEQ ID NO: 4347659 - DNA, 13 bp, Homo sapiens
actcttaatctgt

SEQ ID NO: 4347660 - DNA, 15 bp, Homo sapiens
actcttaatctgtgt

SEQ ID NO: 4347661 - DNA, 14 bp, Homo sapiens
actctttcttcact

SEQ ID NO: 4347662 - DNA, 15 bp, Homo sapiens
actgaatattttgga

SEQ ID NO: 4347663 - DNA, 19 bp, Homo sapiens
actgaatattttggaaact

SEQ ID NO: 4347664 - DNA, 16 bp, Homo sapiens
actgaccaaagactgc

SEQ ID NO: 4347665 - DNA, 22 bp, Homo sapiens
actgaccaaagactgcagaacc

SEQ ID NO: 4347666 - DNA, 14 bp, Homo sapiens
actgaggagacaga

SEQ ID NO: 4347667 - DNA, 13 bp, Homo sapiens
actgcaaactttt

SEQ ID NO: 4347668 - DNA, 15 bp, Homo sapiens
actgcatcaagactt

SEQ ID NO: 4347669 - DNA, 14 bp, Homo sapiens
actgcggaagccaa

SEQ ID NO: 4347670 - DNA, 22 bp, Homo sapiens
actgcggaagccaaaggcagct

SEQ ID NO: 4347671 - DNA, 16 bp, Homo sapiens
actgctaaattctatg

SEQ ID NO: 4347672 - DNA, 17 bp, Homo sapiens
actgcttattttatgat

SEQ ID NO: 4347673 - DNA, 18 bp, Homo sapiens
actgcttattttatgata

SEQ ID NO: 4347674 - DNA, 22 bp, Homo sapiens
actggcagaagcattgcctgga

SEQ ID NO: 4347675 - DNA, 21 bp, Homo sapiens
actgtaccacagacacaatat

SEQ ID NO: 4347676 - DNA, 12 bp, Homo sapiens
actgtgcagaat

SEQ ID NO: 4347677 - DNA, 14 bp, Homo sapiens
actgtgcagaataa

SEQ ID NO: 4347678 - DNA, 21 bp, Homo sapiens
actgtgcagaataatggaaac

SEQ ID NO: 4347679 - DNA, 22 bp, Homo sapiens
actgtgcagaataatggaaaca

SEQ ID NO: 4347680 - DNA, 14 bp, Homo sapiens
actgttctgcaaag

SEQ ID NO: 4347681 - DNA, 21 bp, Homo sapiens
actgttgatgaagtatacttt

SEQ ID NO: 4347682 - DNA, 22 bp, Homo sapiens
actgttgatgaagtatactttt

SEQ ID NO: 4347683 - DNA, 16 bp, Homo sapiens
acttcaaaaataatgt

SEQ ID NO: 4347684 - DNA, 13 bp, Homo sapiens
acttcagttttat

SEQ ID NO: 4347685 - DNA, 16 bp, Homo sapiens
acttctaaacacttca

SEQ ID NO: 4347686 - DNA, 18 bp, Homo sapiens
acttctaaacacttcatt

SEQ ID NO: 4347687 - DNA, 15 bp, Homo sapiens
actttactctgtgtt

SEQ ID NO: 4347688 - DNA, 20 bp, Homo sapiens
actttatatatgtacataca

SEQ ID NO: 4347689 - DNA, 15 bp, Homo sapiens
actttattttttaaa

SEQ ID NO: 4347690 - DNA, 12 bp, Homo sapiens
actttgcctttt

SEQ ID NO: 4347691 - DNA, 21 bp, Homo sapiens
acttttcccctgttaaacagt

SEQ ID NO: 4347692 - DNA, 16 bp, Homo sapiens
agaaaagttgcagatg

SEQ ID NO: 4347693 - DNA, 19 bp, Homo sapiens
agaaaagttgcagatgtat

SEQ ID NO: 4347694 - DNA, 20 bp, Homo sapiens
agaaaagttgcagatgtatt

SEQ ID NO: 4347695 - DNA, 20 bp, Homo sapiens
agaaaatttagccctttaaa

SEQ ID NO: 4347696 - DNA, 21 bp, Homo sapiens
agaaaatttagccctttaaaa

SEQ ID NO: 4347697 - DNA, 23 bp, Homo sapiens
agaaaatttagccctttaaaacg

SEQ ID NO: 4347698 - DNA, 18 bp, Homo sapiens
agaaaccagctcatgtgt

SEQ ID NO: 4347699 - DNA, 13 bp, Homo sapiens
agaaatagacttt

SEQ ID NO: 4347700 - DNA, 19 bp, Homo sapiens
agaaatagactttgccttt

SEQ ID NO: 4347701 - DNA, 14 bp, Homo sapiens
agaaatgttataaa

SEQ ID NO: 4347702 - DNA, 23 bp, Homo sapiens
agaaatttatatgtcagagctgt

SEQ ID NO: 4347703 - DNA, 13 bp, Homo sapiens
agaagggggtggg

SEQ ID NO: 4347704 - DNA, 22 bp, Homo sapiens
agaagtttaaagcatctgtaaa

SEQ ID NO: 4347705 - DNA, 15 bp, Homo sapiens
agaatcccttaaaat

SEQ ID NO: 4347706 - DNA, 17 bp, Homo sapiens
agaatcccttaaaatta

SEQ ID NO: 4347707 - DNA, 20 bp, Homo sapiens
agacaaaaaaatttaaaatt

SEQ ID NO: 4347708 - DNA, 12 bp, Homo sapiens
agacaacattat

SEQ ID NO: 4347709 - DNA, 15 bp, Homo sapiens
agacaacattatgat

SEQ ID NO: 4347710 - DNA, 22 bp, Homo sapiens
agacaacattatgatctaataa

SEQ ID NO: 4347711 - DNA, 18 bp, Homo sapiens
agacagaaactggattaa

SEQ ID NO: 4347712 - DNA, 18 bp, Homo sapiens
agacctacagacctggct

SEQ ID NO: 4347713 - DNA, 19 bp, Homo sapiens
agacctacagacctggctc

SEQ ID NO: 4347714 - DNA, 15 bp, Homo sapiens
agactgcaaactttt

SEQ ID NO: 4347715 - DNA, 18 bp, Homo sapiens
agagaagttctcaaagtt

SEQ ID NO: 4347716 - DNA, 15 bp, Homo sapiens
agagacccctcccct

SEQ ID NO: 4347717 - DNA, 15 bp, Homo sapiens
agagatggagaaata

SEQ ID NO: 4347718 - DNA, 16 bp, Homo sapiens
agagcaattccaggct

SEQ ID NO: 4347719 - DNA, 18 bp, Homo sapiens
agagcaattccaggctga

SEQ ID NO: 4347720 - DNA, 20 bp, Homo sapiens
agagcaattccaggctgagc

SEQ ID NO: 4347721 - DNA, 21 bp, Homo sapiens
agagcaattccaggctgagcc

SEQ ID NO: 4347722 - DNA, 16 bp, Homo sapiens
aaagctggactgacca

SEQ ID NO: 4347723 - DNA, 13 bp, Homo sapiens
aaaggcaagcttg

SEQ ID NO: 4347724 - DNA, 22 bp, Homo sapiens
aaaggcaagcttgaggccaaga

SEQ ID NO: 4347725 - DNA, 21 bp, Homo sapiens
aaaggcagctaagatagaaag

SEQ ID NO: 4347726 - DNA, 22 bp, Homo sapiens
aaagggaagttatttatatttt

SEQ ID NO: 4347727 - DNA, 17 bp, Homo sapiens
aaaggtggtaaattcag

SEQ ID NO: 4347728 - DNA, 19 bp, Homo sapiens
aaaggtggtaaattcagac

SEQ ID NO: 4347729 - DNA, 20 bp, Homo sapiens
aaaggtggtaaattcagaca

SEQ ID NO: 4347730 - DNA, 17 bp, Homo sapiens
aaaggttttgtattttt

SEQ ID NO: 4347731 - DNA, 12 bp, Homo sapiens
aaagtaagttaa

SEQ ID NO: 4347732 - DNA, 15 bp, Homo sapiens
aaagtaagttaataa

SEQ ID NO: 4347733 - DNA, 17 bp, Homo sapiens
aaagtaagttaataatg

SEQ ID NO: 4347734 - DNA, 21 bp, Homo sapiens
aaagtaagttaataatgtatt

SEQ ID NO: 4347735 - DNA, 20 bp, Homo sapiens
aaagttaattcacctatgtt

SEQ ID NO: 4347736 - DNA, 17 bp, Homo sapiens
aaagttgcagatgtatt

SEQ ID NO: 4347737 - DNA, 23 bp, Homo sapiens
aaagttgcagatgtattgactgt

SEQ ID NO: 4347738 - DNA, 17 bp, Homo sapiens
aaataatttatatgcat

SEQ ID NO: 4347739 - DNA, 16 bp, Homo sapiens
aaatactgtgcagaat

SEQ ID NO: 4347740 - DNA, 23 bp, Homo sapiens
aaatactgtgcagaataatggaa

SEQ ID NO: 4347741 - DNA, 15 bp, Homo sapiens
aaatattttttgcaa

SEQ ID NO: 4347742 - DNA, 16 bp, Homo sapiens
aaatcaggcagaaata

SEQ ID NO: 4347743 - DNA, 19 bp, Homo sapiens
aaatcaggcagaaatattt

SEQ ID NO: 4347744 - DNA, 15 bp, Homo sapiens
aaatgccagagccaa

SEQ ID NO: 4347745 - DNA, 17 bp, Homo sapiens
aaatgccagagccaacc

SEQ ID NO: 4347746 - DNA, 14 bp, Homo sapiens
aaatgggagccagg

SEQ ID NO: 4347747 - DNA, 16 bp, Homo sapiens
aaatgggagccaggag

SEQ ID NO: 4347748 - DNA, 22 bp, Homo sapiens
aaatgtggtttttgatgccttt

SEQ ID NO: 4347749 - DNA, 15 bp, Homo sapiens
aaatgttataaagta

SEQ ID NO: 4347750 - DNA, 16 bp, Homo sapiens
aaattcagacaacatt

SEQ ID NO: 4347751 - DNA, 17 bp, Homo sapiens
aaattcagacaacatta

SEQ ID NO: 4347752 - DNA, 20 bp, Homo sapiens
aaattcagtttttgtatctt

SEQ ID NO: 4347753 - DNA, 16 bp, Homo sapiens
aaattctatgttaaat

SEQ ID NO: 4347754 - DNA, 20 bp, Homo sapiens
aaattctatgttaaatactg

SEQ ID NO: 4347755 - DNA, 21 bp, Homo sapiens
aaattctatgttaaatactgt

SEQ ID NO: 4347756 - DNA, 13 bp, Homo sapiens
aaatttaaaatta

SEQ ID NO: 4347757 - DNA, 18 bp, Homo sapiens
aaatttagccctttaaaa

SEQ ID NO: 4347758 - DNA, 21 bp, Homo sapiens
aacacttcattctttatatat

SEQ ID NO: 4347759 - DNA, 23 bp, Homo sapiens
aacagggacttgtttagagagcc

SEQ ID NO: 4347760 - DNA, 20 bp, Homo sapiens
aacatacttcaaaaataatg

SEQ ID NO: 4347761 - DNA, 14 bp, Homo sapiens
aacatccaagccag

SEQ ID NO: 4347762 - DNA, 15 bp, Homo sapiens
aacatccaagccaga

SEQ ID NO: 4347763 - DNA, 16 bp, Homo sapiens
aacatccaagccagag

SEQ ID NO: 4347764 - DNA, 14 bp, Homo sapiens
aacatcgatatgta

SEQ ID NO: 4347765 - DNA, 19 bp, Homo sapiens
aacatcgatatgtatatca

SEQ ID NO: 4347766 - DNA, 13 bp, Homo sapiens
aacattatgatct

SEQ ID NO: 4347767 - DNA, 21 bp, Homo sapiens
aacattatgatctaataaact

SEQ ID NO: 4347768 - DNA, 13 bp, Homo sapiens
aaccaccattttt

SEQ ID NO: 4347769 - DNA, 15 bp, Homo sapiens
aacccccaggtggcc

SEQ ID NO: 4347770 - DNA, 16 bp, Homo sapiens
aacctggacttcctgt

SEQ ID NO: 4347771 - DNA, 14 bp, Homo sapiens
aactaaataatgaa

SEQ ID NO: 4347772 - DNA, 15 bp, Homo sapiens
aactaaataatgaat

SEQ ID NO: 4347773 - DNA, 22 bp, Homo sapiens
aactaaatataaattttcagaa

SEQ ID NO: 4347774 - DNA, 16 bp, Homo sapiens
aactcttaatctgtgt

SEQ ID NO: 4347775 - DNA, 17 bp, Homo sapiens
aactcttaatctgtgtg

SEQ ID NO: 4347776 - DNA, 19 bp, Homo sapiens
aactgaatattttggaaac

SEQ ID NO: 4347777 - DNA, 20 bp, Homo sapiens
aactgaatattttggaaact

SEQ ID NO: 4347778 - DNA, 23 bp, Homo sapiens
aactgaatattttggaaactgct

SEQ ID NO: 4347779 - DNA, 22 bp, Homo sapiens
aactgctaaattctatgttaaa

SEQ ID NO: 4347780 - DNA, 23 bp, Homo sapiens
aactgctaaattctatgttaaat

SEQ ID NO: 4347781 - DNA, 21 bp, Homo sapiens
aacttcagttttatttttgcc

SEQ ID NO: 4347782 - DNA, 19 bp, Homo sapiens
aacttggttctcagactct

SEQ ID NO: 4347783 - DNA, 15 bp, Homo sapiens
aacttgtcaggcatg

SEQ ID NO: 4347784 - DNA, 16 bp, Homo sapiens
aacttgtgaagacaat

SEQ ID NO: 4347785 - DNA, 21 bp, Homo sapiens
aactttattttttaaaaatga

SEQ ID NO: 4347786 - DNA, 13 bp, Homo sapiens
aagagaagaaatg

SEQ ID NO: 4347787 - DNA, 14 bp, Homo sapiens
aagagaagaaatgt

SEQ ID NO: 4347788 - DNA, 18 bp, Homo sapiens
aagaggaatttcttttcc

SEQ ID NO: 4347789 - DNA, 14 bp, Homo sapiens
aagatagaaagctg

SEQ ID NO: 4347790 - DNA, 20 bp, Homo sapiens
aagatggctgctgcctgctc

SEQ ID NO: 4347791 - DNA, 18 bp, Homo sapiens
aagattaggagaaacaca

SEQ ID NO: 4347792 - DNA, 21 bp, Homo sapiens
aagcatcctctccaaagttgg

SEQ ID NO: 4347793 - DNA, 21 bp, Homo sapiens
aagcattgcctggactgacca

SEQ ID NO: 4347794 - DNA, 15 bp, Homo sapiens
aagccaaaggcagct

SEQ ID NO: 4347795 - DNA, 19 bp, Homo sapiens
aagccaaaggcagctaaga

SEQ ID NO: 4347796 - DNA, 10 bp, Homo sapiens
aagccagagt

SEQ ID NO: 4347797 - DNA, 21 bp, Homo sapiens
aagccagagtttttaaagcct

SEQ ID NO: 4347798 - DNA, 14 bp, Homo sapiens
aagccctttgccat

SEQ ID NO: 4347799 - DNA, 15 bp, Homo sapiens
aagccttctggatcc

SEQ ID NO: 4347800 - DNA, 19 bp, Homo sapiens
aagccttctggatccatgg

SEQ ID NO: 4347801 - DNA, 15 bp, Homo sapiens
aagctattgtctgta

SEQ ID NO: 4347802 - DNA, 12 bp, Homo sapiens
aagctggactga

SEQ ID NO: 4347803 - DNA, 15 bp, Homo sapiens
aagctgggaacttct

SEQ ID NO: 4347804 - DNA, 19 bp, Homo sapiens
aagcttgaggccaagatgg

SEQ ID NO: 4347805 - DNA, 22 bp, Homo sapiens
aagcttgaggccaagatggctg

SEQ ID NO: 4347806 - DNA, 16 bp, Homo sapiens
aaggaatcattccagt

SEQ ID NO: 4347807 - DNA, 20 bp, Homo sapiens
aaggcagagaagttctcaaa

SEQ ID NO: 4347808 - DNA, 22 bp, Homo sapiens
aaggcagctaagatagaaagct

SEQ ID NO: 4347809 - DNA, 13 bp, Homo sapiens
aaggcttggctgg

SEQ ID NO: 4347810 - DNA, 15 bp, Homo sapiens
aaggcttggctggtg

SEQ ID NO: 4347811 - DNA, 12 bp, Homo sapiens
aagggaagtggg

SEQ ID NO: 4347812 - DNA, 11 bp, Homo sapiens
aagggggtggg

SEQ ID NO: 4347813 - DNA, 18 bp, Homo sapiens
aaggtggcaatgcttaaa

SEQ ID NO: 4347814 - DNA, 14 bp, Homo sapiens
aaggtggtaaattc

SEQ ID NO: 4347815 - DNA, 23 bp, Homo sapiens
aaggttttgtattttttaaaaca

SEQ ID NO: 4347816 - DNA, 12 bp, Homo sapiens
aagtaagttaat

SEQ ID NO: 4347817 - DNA, 19 bp, Homo sapiens
aagtaagttaataatgtat

SEQ ID NO: 4347818 - DNA, 14 bp, Homo sapiens
aagtaatatatcaa

SEQ ID NO: 4347819 - DNA, 10 bp, Homo sapiens
aagtgatctt

SEQ ID NO: 4347820 - DNA, 20 bp, Homo sapiens
aagtgggatttggggcctca

SEQ ID NO: 4347821 - DNA, 23 bp, Homo sapiens
aagtgggatttggggcctcaaga

SEQ ID NO: 4347822 - DNA, 13 bp, Homo sapiens
aagttaataatgt

SEQ ID NO: 4347823 - DNA, 19 bp, Homo sapiens
aagttaattcacctatgtt

SEQ ID NO: 4347824 - DNA, 15 bp, Homo sapiens
aagttatttatattt

SEQ ID NO: 4347825 - DNA, 12 bp, Homo sapiens
aagttctcaaag

SEQ ID NO: 4347826 - DNA, 20 bp, Homo sapiens
aagttctcaaagttaattca

SEQ ID NO: 4347827 - DNA, 13 bp, Homo sapiens
aagttgttattgt

SEQ ID NO: 4347828 - DNA, 20 bp, Homo sapiens
aataaaatcatgtagtttgt

SEQ ID NO: 4347829 - DNA, 21 bp, Homo sapiens
aataaactgaatattttggaa

SEQ ID NO: 4347830 - DNA, 19 bp, Homo sapiens
aataatccagtattgctga

SEQ ID NO: 4347831 - DNA, 18 bp, Homo sapiens
aataatgaataaactgaa

SEQ ID NO: 4347832 - DNA, 16 bp, Homo sapiens
aataatggaaacatta

SEQ ID NO: 4347833 - DNA, 19 bp, Homo sapiens
aataatgtattgtaatctt

SEQ ID NO: 4347834 - DNA, 17 bp, Homo sapiens
aatactgtgcagaataa

SEQ ID NO: 4347835 - DNA, 19 bp, Homo sapiens
aatactgtgcagaataatg

SEQ ID NO: 4347836 - DNA, 22 bp, Homo sapiens
aatatcatctcaattttttcaa

SEQ ID NO: 4347837 - DNA, 16 bp, Homo sapiens
aatattttggaaactg

SEQ ID NO: 4347838 - DNA, 14 bp, Homo sapiens
aatattttttgcaa

SEQ ID NO: 4347839 - DNA, 15 bp, Homo sapiens
aatattttttgcaag

SEQ ID NO: 4347840 - DNA, 17 bp, Homo sapiens
aatattttttgcaagtt

SEQ ID NO: 4347841 - DNA, 17 bp, Homo sapiens
aatcaggcagaaatatt

SEQ ID NO: 4347842 - DNA, 16 bp, Homo sapiens
aatcattccagtgcta

SEQ ID NO: 4347843 - DNA, 13 bp, Homo sapiens
aatcccttaaaat

SEQ ID NO: 4347844 - DNA, 14 bp, Homo sapiens
aatcccttaaaatt

SEQ ID NO: 4347845 - DNA, 14 bp, Homo sapiens
aatcctgtttataa

SEQ ID NO: 4347846 - DNA, 19 bp, Homo sapiens
aatcctgtttataatctga

SEQ ID NO: 4347847 - DNA, 23 bp, Homo sapiens
aatctcatacaagccatttactt

SEQ ID NO: 4347848 - DNA, 16 bp, Homo sapiens
aatctgtgtgtatatt

SEQ ID NO: 4347849 - DNA, 18 bp, Homo sapiens
aatctttcatccaaaata

SEQ ID NO: 4347850 - DNA, 22 bp, Homo sapiens
aatgaaaaatcaggcagaaata

SEQ ID NO: 4347851 - DNA, 14 bp, Homo sapiens
aatgaataaactga

SEQ ID NO: 4347852 - DNA, 12 bp, Homo sapiens
aatgccagagcc

SEQ ID NO: 4347853 - DNA, 21 bp, Homo sapiens
aatgccagagccaacctggac

SEQ ID NO: 4347854 - DNA, 20 bp, Homo sapiens
aatgcttaaactaaataatg

SEQ ID NO: 4347855 - DNA, 18 bp, Homo sapiens
aatgtctcactgttctgc

SEQ ID NO: 4347856 - DNA, 13 bp, Homo sapiens
agagccaacctgg

SEQ ID NO: 4347857 - DNA, 23 bp, Homo sapiens
agagccaacctggacttcctgtc

SEQ ID NO: 4347858 - DNA, 15 bp, Homo sapiens
agagcctgtcaccag

SEQ ID NO: 4347859 - DNA, 16 bp, Homo sapiens
agagcctgtcaccaga

SEQ ID NO: 4347860 - DNA, 18 bp, Homo sapiens
agagcctgtcaccagagc

SEQ ID NO: 4347861 - DNA, 20 bp, Homo sapiens
agagcctgtcaccagagctt

SEQ ID NO: 4347862 - DNA, 16 bp, Homo sapiens
agagcttctctgggct

SEQ ID NO: 4347863 - DNA, 22 bp, Homo sapiens
agaggaaaaatgggagccagga

SEQ ID NO: 4347864 - DNA, 23 bp, Homo sapiens
agaggaaaaatgggagccaggag

SEQ ID NO: 4347865 - DNA, 16 bp, Homo sapiens
agaggctgcccctctc

SEQ ID NO: 4347866 - DNA, 14 bp, Homo sapiens
agagggactcaagg

SEQ ID NO: 4347867 - DNA, 23 bp, Homo sapiens
agagtaactttactctgtgttta

SEQ ID NO: 4347868 - DNA, 19 bp, Homo sapiens
agagtttttaaagccttct

SEQ ID NO: 4347869 - DNA, 17 bp, Homo sapiens
agatagaaagctggact

SEQ ID NO: 4347870 - DNA, 18 bp, Homo sapiens
agatagaaagctggactg

SEQ ID NO: 4347871 - DNA, 19 bp, Homo sapiens
agatctgcaggctgcacct

SEQ ID NO: 4347872 - DNA, 16 bp, Homo sapiens
agatgggtccctggcc

SEQ ID NO: 4347873 - DNA, 20 bp, Homo sapiens
agatgggtccctggccacca

SEQ ID NO: 4347874 - DNA, 22 bp, Homo sapiens
agattgtcttgcaacttcagtt

SEQ ID NO: 4347875 - DNA, 23 bp, Homo sapiens
agattgtcttgcaacttcagttt

SEQ ID NO: 4347876 - DNA, 15 bp, Homo sapiens
agatttttggttttt

SEQ ID NO: 4347877 - DNA, 22 bp, Homo sapiens
agcaattccaggctgagccatg

SEQ ID NO: 4347878 - DNA, 23 bp, Homo sapiens
agcaattccaggctgagccatga

SEQ ID NO: 4347879 - DNA, 14 bp, Homo sapiens
agcagacagaaact

SEQ ID NO: 4347880 - DNA, 17 bp, Homo sapiens
agcataaataaaactga

SEQ ID NO: 4347881 - DNA, 19 bp, Homo sapiens
agcataaataaaactgaat

SEQ ID NO: 4347882 - DNA, 18 bp, Homo sapiens
agcattgcctggactgac

SEQ ID NO: 4347883 - DNA, 20 bp, Homo sapiens
agcattgcctggactgacca

SEQ ID NO: 4347884 - DNA, 14 bp, Homo sapiens
agccaaaggcagct

SEQ ID NO: 4347885 - DNA, 21 bp, Homo sapiens
agccaacctggacttcctgtc

SEQ ID NO: 4347886 - DNA, 20 bp, Homo sapiens
agccaggagtaagacaagtg

SEQ ID NO: 4347887 - DNA, 21 bp, Homo sapiens
agccatagacctacagacctg

SEQ ID NO: 4347888 - DNA, 18 bp, Homo sapiens
agccatttactttgcaag

SEQ ID NO: 4347889 - DNA, 13 bp, Homo sapiens
agcccaccaccct

SEQ ID NO: 4347890 - DNA, 14 bp, Homo sapiens
agccctttaaaacg

SEQ ID NO: 4347891 - DNA, 19 bp, Homo sapiens
agccgaggggagagaggga

SEQ ID NO: 4347892 - DNA, 20 bp, Homo sapiens
agccgaggggagagagggac

SEQ ID NO: 4347893 - DNA, 15 bp, Homo sapiens
agcctccgctgggct

SEQ ID NO: 4347894 - DNA, 17 bp, Homo sapiens
agcctccgctgggcttc

SEQ ID NO: 4347895 - DNA, 22 bp, Homo sapiens
agcctccgctgggcttcattcc

SEQ ID NO: 4347896 - DNA, 16 bp, Homo sapiens
agcctgtcaccagagc

SEQ ID NO: 4347897 - DNA, 24 bp, Homo sapiens
agcctgtcaccagagcttctctgg

SEQ ID NO: 4347898 - DNA, 17 bp, Homo sapiens
agccttttatctgcaga

SEQ ID NO: 4347899 - DNA, 19 bp, Homo sapiens
agccttttatctgcagaac

SEQ ID NO: 4347900 - DNA, 20 bp, Homo sapiens
agcggcagagcaattccagg

SEQ ID NO: 4347901 - DNA, 19 bp, Homo sapiens
agctaagatagaaagctgg

SEQ ID NO: 4347902 - DNA, 20 bp, Homo sapiens
agctaagatagaaagctgga

SEQ ID NO: 4347903 - DNA, 13 bp, Homo sapiens
agctcctgaataa

SEQ ID NO: 4347904 - DNA, 14 bp, Homo sapiens
agctcttctcttcc

SEQ ID NO: 4347905 - DNA, 15 bp, Homo sapiens
agctgggcctcctgc

SEQ ID NO: 4347906 - DNA, 17 bp, Homo sapiens
agctgggcctcctgcct

SEQ ID NO: 4347907 - DNA, 18 bp, Homo sapiens
agctgggcctcctgcctc

SEQ ID NO: 4347908 - DNA, 17 bp, Homo sapiens
agctgttataaatttat

SEQ ID NO: 4347909 - DNA, 13 bp, Homo sapiens
agcttctctgggc

SEQ ID NO: 4347910 - DNA, 21 bp, Homo sapiens
agcttgaggccaagatggctg

SEQ ID NO: 4347911 - DNA, 18 bp, Homo sapiens
agctttattttttaacat

SEQ ID NO: 4347912 - DNA, 23 bp, Homo sapiens
agctttgagttgacttctgacaa

SEQ ID NO: 4347913 - DNA, 21 bp, Homo sapiens
aggaaaaatgggagccaggag

SEQ ID NO: 4347914 - DNA, 16 bp, Homo sapiens
aggaaaggcttggctg

SEQ ID NO: 4347915 - DNA, 19 bp, Homo sapiens
aggactttgttaacttcag

SEQ ID NO: 4347916 - DNA, 16 bp, Homo sapiens
aggagaaactctagac

SEQ ID NO: 4347917 - DNA, 18 bp, Homo sapiens
aggagaaactctagactg

SEQ ID NO: 4347918 - DNA, 23 bp, Homo sapiens
aggagaaactctagactgcaaga

SEQ ID NO: 4347919 - DNA, 16 bp, Homo sapiens
aggagacagaaagcct

SEQ ID NO: 4347920 - DNA, 17 bp, Homo sapiens
aggagacagaaagcctc

SEQ ID NO: 4347921 - DNA, 11 bp, Homo sapiens
aggagagaccc

SEQ ID NO: 4347922 - DNA, 16 bp, Homo sapiens
aggagagacccctccc

SEQ ID NO: 4347923 - DNA, 19 bp, Homo sapiens
aggagagacccctcccctc

SEQ ID NO: 4347924 - DNA, 16 bp, Homo sapiens
aggagcgtggactctg

SEQ ID NO: 4347925 - DNA, 19 bp, Homo sapiens
aggagcgtggactctgcta

SEQ ID NO: 4347926 - DNA, 22 bp, Homo sapiens
aggagcgtggactctgctagac

SEQ ID NO: 4347927 - DNA, 15 bp, Homo sapiens
aggagtaagacaagt

SEQ ID NO: 4347928 - DNA, 21 bp, Homo sapiens
aggattctctaattagaaatt

SEQ ID NO: 4347929 - DNA, 23 bp, Homo sapiens
aggattctctaattagaaattta

SEQ ID NO: 4347930 - DNA, 12 bp, Homo sapiens
aggcaagcttga

SEQ ID NO: 4347931 - DNA, 21 bp, Homo sapiens
aggcagctaagatagaaagct

SEQ ID NO: 4347932 - DNA, 20 bp, Homo sapiens
aggccaaaagaagtttaaag

SEQ ID NO: 4347933 - DNA, 18 bp, Homo sapiens
aggccaagatggctgctg

SEQ ID NO: 4347934 - DNA, 17 bp, Homo sapiens
aggcccctgaggcagcc

SEQ ID NO: 4347935 - DNA, 19 bp, Homo sapiens
aggcccctgaggcagccca

SEQ ID NO: 4347936 - DNA, 17 bp, Homo sapiens
aggccttcatcctcctc

SEQ ID NO: 4347937 - DNA, 21 bp, Homo sapiens
aggctgcacctctggctagag

SEQ ID NO: 4347938 - DNA, 21 bp, Homo sapiens
aggctgggccatgtccaaaga

SEQ ID NO: 4347939 - DNA, 19 bp, Homo sapiens
aggcttccatccccgtcca

SEQ ID NO: 4347940 - DNA, 14 bp, Homo sapiens
agggaaaggcaagc

SEQ ID NO: 4347941 - DNA, 15 bp, Homo sapiens
agggaaaggttttgt

SEQ ID NO: 4347942 - DNA, 17 bp, Homo sapiens
agggaaaggttttgtat

SEQ ID NO: 4347943 - DNA, 13 bp, Homo sapiens
agggaagtgggga

SEQ ID NO: 4347944 - DNA, 23 bp, Homo sapiens
agggactcaagggaaaggcaagc

SEQ ID NO: 4347945 - DNA, 15 bp, Homo sapiens
agggcctgagcagct

SEQ ID NO: 4347946 - DNA, 19 bp, Homo sapiens
agggggtggttattggact

SEQ ID NO: 4347947 - DNA, 22 bp, Homo sapiens
aggtagtttggatatttttgta

SEQ ID NO: 4347948 - DNA, 20 bp, Homo sapiens
aggtccagctgggcctcctg

SEQ ID NO: 4347949 - DNA, 22 bp, Homo sapiens
aggtccagctgggcctcctgcc

SEQ ID NO: 4347950 - DNA, 14 bp, Homo sapiens
aggtggcctgcgtc

SEQ ID NO: 4347951 - DNA, 19 bp, Homo sapiens
aggtggtaaattcagacaa

SEQ ID NO: 4347952 - DNA, 21 bp, Homo sapiens
aggtggtaaattcagacaaca

SEQ ID NO: 4347953 - DNA, 12 bp, Homo sapiens
aggttttgtatt

SEQ ID NO: 4347954 - DNA, 20 bp, Homo sapiens
agtaactttactctgtgttt

SEQ ID NO: 4347955 - DNA, 14 bp, Homo sapiens
agtaagttaataat

SEQ ID NO: 4347956 - DNA, 19 bp, Homo sapiens
agtaatattttactttgag

SEQ ID NO: 4347957 - DNA, 23 bp, Homo sapiens
agtatacttttcccctgttaaac

SEQ ID NO: 4347958 - DNA, 13 bp, Homo sapiens
agtgactttgtat

SEQ ID NO: 4347959 - DNA, 13 bp, Homo sapiens
agtgatcttgaga

SEQ ID NO: 4347960 - DNA, 19 bp, Homo sapiens
agtgctataaatgccagag

SEQ ID NO: 4347961 - DNA, 22 bp, Homo sapiens
agtgggatttggggcctcaaga

SEQ ID NO: 4347962 - DNA, 13 bp, Homo sapiens
agttaataatgta

SEQ ID NO: 4347963 - DNA, 17 bp, Homo sapiens
agttatttatattttgt

SEQ ID NO: 4347964 - DNA, 15 bp, Homo sapiens
agttgcagatgtatt

SEQ ID NO: 4347965 - DNA, 21 bp, Homo sapiens
agttgcagatgtattgactgt

SEQ ID NO: 4347966 - DNA, 18 bp, Homo sapiens
agttgtattcttctgtat

SEQ ID NO: 4347967 - DNA, 18 bp, Homo sapiens
agtttaaagcatctgtaa

SEQ ID NO: 4347968 - DNA, 23 bp, Homo sapiens
agtttgtgttgttgttgctgctg

SEQ ID NO: 4347969 - DNA, 13 bp, Homo sapiens
agttttatttttg

SEQ ID NO: 4347970 - DNA, 14 bp, Homo sapiens
agtttttgtatctt

SEQ ID NO: 4347971 - DNA, 12 bp, Homo sapiens
ataaaactgaat

SEQ ID NO: 4347972 - DNA, 17 bp, Homo sapiens
ataaaatggttcatatt

SEQ ID NO: 4347973 - DNA, 20 bp, Homo sapiens
ataaactgaatattttggaa

SEQ ID NO: 4347974 - DNA, 21 bp, Homo sapiens
ataaactgaatattttggaaa

SEQ ID NO: 4347975 - DNA, 15 bp, Homo sapiens
ataaagtagaactaa

SEQ ID NO: 4347976 - DNA, 20 bp, Homo sapiens
ataaataaaatcatgtagtt

SEQ ID NO: 4347977 - DNA, 21 bp, Homo sapiens
ataaatgccagagccaacctg

SEQ ID NO: 4347978 - DNA, 14 bp, Homo sapiens
ataaattttcagaa

SEQ ID NO: 4347979 - DNA, 15 bp, Homo sapiens
ataaccatgttctat

SEQ ID NO: 4347980 - DNA, 20 bp, Homo sapiens
ataaccatgttctatattct

SEQ ID NO: 4347981 - DNA, 12 bp, Homo sapiens
ataactgttctt

SEQ ID NO: 4347982 - DNA, 21 bp, Homo sapiens
ataataagtgatgtgctgaat

SEQ ID NO: 4347983 - DNA, 17 bp, Homo sapiens
ataataggtagtttgga

SEQ ID NO: 4347984 - DNA, 19 bp, Homo sapiens
ataataggtagtttggata

SEQ ID NO: 4347985 - DNA, 14 bp, Homo sapiens
ataatctgaagata

SEQ ID NO: 4347986 - DNA, 17 bp, Homo sapiens
ataatctgaagatatat

SEQ ID NO: 4347987 - DNA, 17 bp, Homo sapiens
ataatgaataaactgaa

SEQ ID NO: 4347988 - DNA, 18 bp, Homo sapiens
ataatgaataaactgaat

SEQ ID NO: 4347989 - DNA, 12 bp, Homo sapiens
ataatggaaaca

SEQ ID NO: 4347990 - DNA, 15 bp, Homo sapiens
ataatgtttaaatca

SEQ ID NO: 4347991 - DNA, 23 bp, Homo sapiens
atacaagccatttactttgcaag

SEQ ID NO: 4347992 - DNA, 16 bp, Homo sapiens
atacaatcctgtttat

SEQ ID NO: 4347993 - DNA, 19 bp, Homo sapiens
atactgtgcagaataatgg

SEQ ID NO: 4347994 - DNA, 22 bp, Homo sapiens
atactgtgcagaataatggaaa

SEQ ID NO: 4347995 - DNA, 19 bp, Homo sapiens
atacttcaaaaataatgtg

SEQ ID NO: 4347996 - DNA, 17 bp, Homo sapiens
atacttgccttctgata

SEQ ID NO: 4347997 - DNA, 16 bp, Homo sapiens
atactttatatatgta

SEQ ID NO: 4347998 - DNA, 13 bp, Homo sapiens
atagaaagctgga

SEQ ID NO: 4347999 - DNA, 21 bp, Homo sapiens
atagaaagctggactgaccaa

SEQ ID NO: 4348000 - DNA, 20 bp, Homo sapiens
atagacctacagacctggct

SEQ ID NO: 4348001 - DNA, 22 bp, Homo sapiens
atagccctgggtaccctgagcc

SEQ ID NO: 4348002 - DNA, 19 bp, Homo sapiens
atagggaaaggttttgtat

SEQ ID NO: 4348003 - DNA, 15 bp, Homo sapiens
ataggtagtttggat

SEQ ID NO: 4348004 - DNA, 12 bp, Homo sapiens
atatatcaaatc

SEQ ID NO: 4348005 - DNA, 17 bp, Homo sapiens
atatcaaatccaggact

SEQ ID NO: 4348006 - DNA, 22 bp, Homo sapiens
atatggacagctttattttaaa

SEQ ID NO: 4348007 - DNA, 12 bp, Homo sapiens
atatggtgaagg

SEQ ID NO: 4348008 - DNA, 14 bp, Homo sapiens
atatgtatgctttt

SEQ ID NO: 4348009 - DNA, 22 bp, Homo sapiens
atattgataagctattgtctgt

SEQ ID NO: 4348010 - DNA, 22 bp, Homo sapiens
atattggtggccggtggttttg

SEQ ID NO: 4348011 - DNA, 17 bp, Homo sapiens
atattgtttaaaattca

SEQ ID NO: 4348012 - DNA, 18 bp, Homo sapiens
atattgtttaaaattcag

SEQ ID NO: 4348013 - DNA, 21 bp, Homo sapiens
atatttcacttttgttctgct

SEQ ID NO: 4348014 - DNA, 14 bp, Homo sapiens
atattttggaaact

SEQ ID NO: 4348015 - DNA, 20 bp, Homo sapiens
atattttggaaactgctaaa

SEQ ID NO: 4348016 - DNA, 14 bp, Homo sapiens
atatttttgtactt

SEQ ID NO: 4348017 - DNA, 13 bp, Homo sapiens
atattttttgcaa

SEQ ID NO: 4348018 - DNA, 17 bp, Homo sapiens
atcaactgtcaaatatg

SEQ ID NO: 4348019 - DNA, 20 bp, Homo sapiens
atcaattggcagtgactttg

SEQ ID NO: 4348020 - DNA, 16 bp, Homo sapiens
atcacacccatttaaa

SEQ ID NO: 4348021 - DNA, 18 bp, Homo sapiens
atcatatcaattggcagt

SEQ ID NO: 4348022 - DNA, 16 bp, Homo sapiens
atcatgtatgttatga

SEQ ID NO: 4348023 - DNA, 22 bp, Homo sapiens
atccagtattgctgattttaaa

SEQ ID NO: 4348024 - DNA, 17 bp, Homo sapiens
atcccatccttaagaga

SEQ ID NO: 4348025 - DNA, 15 bp, Homo sapiens
atcctcctccccagc

SEQ ID NO: 4348026 - DNA, 14 bp, Homo sapiens
atcctgtttataat

SEQ ID NO: 4348027 - DNA, 13 bp, Homo sapiens
atctaataaactt

SEQ ID NO: 4348028 - DNA, 17 bp, Homo sapiens
atctaataaactttatt

SEQ ID NO: 4348029 - DNA, 13 bp, Homo sapiens
atctagtcagtat

SEQ ID NO: 4348030 - DNA, 18 bp, Homo sapiens
atctagtcagtatctgta

SEQ ID NO: 4348031 - DNA, 11 bp, Homo sapiens
atctgcagaac

SEQ ID NO: 4348032 - DNA, 16 bp, Homo sapiens
atctgcaggctgcacc

SEQ ID NO: 4348033 - DNA, 20 bp, Homo sapiens
atctggctttttctgccact

SEQ ID NO: 4348034 - DNA, 22 bp, Homo sapiens
atctgtaaatttggactgtttt

SEQ ID NO: 4348035 - DNA, 18 bp, Homo sapiens
atctgtagctacactgta

SEQ ID NO: 4348036 - DNA, 21 bp, Homo sapiens
atcttggggcaagactgcaaa

SEQ ID NO: 4348037 - DNA, 12 bp, Homo sapiens
atcttttcataa

SEQ ID NO: 4348038 - DNA, 14 bp, Homo sapiens
atgaggagcgtgga

SEQ ID NO: 4348039 - DNA, 19 bp, Homo sapiens
atgaggagcgtggactctg

SEQ ID NO: 4348040 - DNA, 20 bp, Homo sapiens
atgatattgtttaaaattca

SEQ ID NO: 4348041 - DNA, 15 bp, Homo sapiens
atgatctaataaact

SEQ ID NO: 4348042 - DNA, 19 bp, Homo sapiens
atgatctaataaactttat

SEQ ID NO: 4348043 - DNA, 15 bp, Homo sapiens
atgcacatgcacgcc

SEQ ID NO: 4348044 - DNA, 18 bp, Homo sapiens
atgccagagccaacctgg

SEQ ID NO: 4348045 - DNA, 24 bp, Homo sapiens
atgccagagccaacctggacttcc

SEQ ID NO: 4348046 - DNA, 12 bp, Homo sapiens
atggccctcgga

SEQ ID NO: 4348047 - DNA, 21 bp, Homo sapiens
atggccctcggaggtccagct

SEQ ID NO: 4348048 - DNA, 23 bp, Homo sapiens
atggccctcggaggtccagctgg

SEQ ID NO: 4348049 - DNA, 19 bp, Homo sapiens
atggctcagagcttgaaga

SEQ ID NO: 4348050 - DNA, 12 bp, Homo sapiens
atgggagccagg

SEQ ID NO: 4348051 - DNA, 15 bp, Homo sapiens
atgtatgtcagtgct

SEQ ID NO: 4348052 - DNA, 14 bp, Homo sapiens
atgtattgtaatct

SEQ ID NO: 4348053 - DNA, 23 bp, Homo sapiens
atgtcagtgctataaatgccaga

SEQ ID NO: 4348054 - DNA, 14 bp, Homo sapiens
atgtctcactgttc

SEQ ID NO: 4348055 - DNA, 21 bp, Homo sapiens
atgtctcactgttctgcaaag

SEQ ID NO: 4348056 - DNA, 19 bp, Homo sapiens
atgtgactttttttggtat

SEQ ID NO: 4348057 - DNA, 17 bp, Homo sapiens
atgtgctttatttgcaa

SEQ ID NO: 4348058 - DNA, 14 bp, Homo sapiens
atgtgtttgctgcc

SEQ ID NO: 4348059 - DNA, 13 bp, Homo sapiens
atgttaaatactg

SEQ ID NO: 4348060 - DNA, 14 bp, Homo sapiens
atgttaaatactgt

SEQ ID NO: 4348061 - DNA, 21 bp, Homo sapiens
atgttaacttggttctcagac

SEQ ID NO: 4348062 - DNA, 22 bp, Homo sapiens
atgttaacttggttctcagact

SEQ ID NO: 4348063 - DNA, 20 bp, Homo sapiens
atgttatgatattgtttaaa

SEQ ID NO: 4348064 - DNA, 22 bp, Homo sapiens
atgttatgatattgtttaaaat

SEQ ID NO: 4348065 - DNA, 17 bp, Homo sapiens
atgtttaaatcatgtat

SEQ ID NO: 4348066 - DNA, 15 bp, Homo sapiens
attacagttcataat

SEQ ID NO: 4348067 - DNA, 15 bp, Homo sapiens
attacgtttgttatt

SEQ ID NO: 4348068 - DNA, 14 bp, Homo sapiens
attagaaatttata

SEQ ID NO: 4348069 - DNA, 22 bp, Homo sapiens
attaggagaaacacattcttat

SEQ ID NO: 4348070 - DNA, 14 bp, Homo sapiens
attagtgtctccag

SEQ ID NO: 4348071 - DNA, 14 bp, Homo sapiens
attatgatctaata

SEQ ID NO: 4348072 - DNA, 19 bp, Homo sapiens
attatgatctaataaactt

SEQ ID NO: 4348073 - DNA, 21 bp, Homo sapiens
attatgatctaataaacttta

SEQ ID NO: 4348074 - DNA, 20 bp, Homo sapiens
attcacctatgttattttgt

SEQ ID NO: 4348075 - DNA, 18 bp, Homo sapiens
attcagacaacattatga

SEQ ID NO: 4348076 - DNA, 23 bp, Homo sapiens
attcagacaacattatgatctaa

SEQ ID NO: 4348077 - DNA, 18 bp, Homo sapiens
attcagattgtcttgcaa

SEQ ID NO: 4348078 - DNA, 22 bp, Homo sapiens
attcagattgtcttgcaacttc

SEQ ID NO: 4348079 - DNA, 18 bp, Homo sapiens
attccaggctgagccatg

SEQ ID NO: 4348080 - DNA, 19 bp, Homo sapiens
attccaggctgagccatga

SEQ ID NO: 4348081 - DNA, 15 bp, Homo sapiens
attccggactggcag

SEQ ID NO: 4348082 - DNA, 19 bp, Homo sapiens
attctaagccctttgccat

SEQ ID NO: 4348083 - DNA, 12 bp, Homo sapiens
attctacagaat

SEQ ID NO: 4348084 - DNA, 14 bp, Homo sapiens
attctacagaataa

SEQ ID NO: 4348085 - DNA, 15 bp, Homo sapiens
attctacctttgtaa

SEQ ID NO: 4348086 - DNA, 18 bp, Homo sapiens
attctacctttgtaaaac

SEQ ID NO: 4348087 - DNA, 13 bp, Homo sapiens
attctatgttaaa

SEQ ID NO: 4348088 - DNA, 20 bp, Homo sapiens
attctatgttaaatactgtg

SEQ ID NO: 4348089 - DNA, 17 bp, Homo sapiens
attctcagtaactttta

SEQ ID NO: 4348090 - DNA, 18 bp, Homo sapiens
attctcagtaacttttaa

SEQ ID NO: 4348091 - DNA, 16 bp, Homo sapiens
attctctaattagaaa

SEQ ID NO: 4348092 - DNA, 14 bp, Homo sapiens
attcttctgtattt

SEQ ID NO: 4348093 - DNA, 18 bp, Homo sapiens
attcttctgtatttctag

SEQ ID NO: 4348094 - DNA, 14 bp, Homo sapiens
attgcctgttcata

SEQ ID NO: 4348095 - DNA, 16 bp, Homo sapiens
attgctgattttaaag

SEQ ID NO: 4348096 - DNA, 21 bp, Homo sapiens
attggaagctttgagttgact

SEQ ID NO: 4348097 - DNA, 16 bp, Homo sapiens
attggactccaggcct

SEQ ID NO: 4348098 - DNA, 15 bp, Homo sapiens
attggcagtgacttt

SEQ ID NO: 4348099 - DNA, 13 bp, Homo sapiens
attgtaatctttc

SEQ ID NO: 4348100 - DNA, 18 bp, Homo sapiens
attgttgaacatacttca

SEQ ID NO: 4348101 - DNA, 13 bp, Homo sapiens
attgtttaaaatt

SEQ ID NO: 4348102 - DNA, 15 bp, Homo sapiens
attgtttaaaattca

SEQ ID NO: 4348103 - DNA, 18 bp, Homo sapiens
attgtttaaaattcagtt

SEQ ID NO: 4348104 - DNA, 16 bp, Homo sapiens
atttaaaattacgttt

SEQ ID NO: 4348105 - DNA, 18 bp, Homo sapiens
atttaagtagaaaagttg

SEQ ID NO: 4348106 - DNA, 14 bp, Homo sapiens
atttatatgcatgc

SEQ ID NO: 4348107 - DNA, 14 bp, Homo sapiens
atttatgcactgtg

SEQ ID NO: 4348108 - DNA, 15 bp, Homo sapiens
atttcacttttgttc

SEQ ID NO: 4348109 - DNA, 16 bp, Homo sapiens
atttcacttttgttct

SEQ ID NO: 4348110 - DNA, 13 bp, Homo sapiens
atttcttttcctt

SEQ ID NO: 4348111 - DNA, 24 bp, Homo sapiens
atttcttttccttcattcataggg

SEQ ID NO: 4348112 - DNA, 13 bp, Homo sapiens
atttgaattagaa

SEQ ID NO: 4348113 - DNA, 14 bp, Homo sapiens
atttggactgtttt

SEQ ID NO: 4348114 - DNA, 22 bp, Homo sapiens
attttcagaattaatgcattca

SEQ ID NO: 4348115 - DNA, 22 bp, Homo sapiens
attttggaaactgctaaattct

SEQ ID NO: 4348116 - DNA, 23 bp, Homo sapiens
attttgtgtataatgtgctttat

SEQ ID NO: 4348117 - DNA, 15 bp, Homo sapiens
atttttgtacttgat

SEQ ID NO: 4348118 - DNA, 18 bp, Homo sapiens
atttttgtacttgatttg

SEQ ID NO: 4348119 - DNA, 13 bp, Homo sapiens
attttttaaaaca

SEQ ID NO: 4348120 - DNA, 21 bp, Homo sapiens
attttttaaaacactaaaagc

SEQ ID NO: 4348121 - DNA, 17 bp, Homo sapiens
attttttttttcctctt

SEQ ID NO: 4348122 - DNA, 15 bp, Homo sapiens
caaaaaaatttaaaa

SEQ ID NO: 4348123 - DNA, 23 bp, Homo sapiens
ttgcaacttcagttttatttttg

SEQ ID NO: 4348124 - DNA, 18 bp, Homo sapiens
ttgccaaggcaaaaaact

SEQ ID NO: 4348125 - DNA, 22 bp, Homo sapiens
ttgcctggactgaccacaccaa

SEQ ID NO: 4348126 - DNA, 17 bp, Homo sapiens
ttgctcctagcagacag

SEQ ID NO: 4348127 - DNA, 10 bp, Homo sapiens
ttgctgctgt

SEQ ID NO: 4348128 - DNA, 16 bp, Homo sapiens
ttggactccaggcctg

SEQ ID NO: 4348129 - DNA, 19 bp, Homo sapiens
ttggatatttttgtacttg

SEQ ID NO: 4348130 - DNA, 20 bp, Homo sapiens
ttggtataatgtttaaatca

SEQ ID NO: 4348131 - DNA, 13 bp, Homo sapiens
ttgtacttgattt

SEQ ID NO: 4348132 - DNA, 12 bp, Homo sapiens
ttgtattcttct

SEQ ID NO: 4348133 - DNA, 17 bp, Homo sapiens
ttgtattttttaaaaca

SEQ ID NO: 4348134 - DNA, 15 bp, Homo sapiens
ttgtgctttaaaaat

SEQ ID NO: 4348135 - DNA, 21 bp, Homo sapiens
ttgtgttgttgttgctgctgt

SEQ ID NO: 4348136 - DNA, 12 bp, Homo sapiens
ttgttctgcttt

SEQ ID NO: 4348137 - DNA, 22 bp, Homo sapiens
tttaaaaagtaagttaataatg

SEQ ID NO: 4348138 - DNA, 23 bp, Homo sapiens
tttaaaaagtaagttaataatgt

SEQ ID NO: 4348139 - DNA, 15 bp, Homo sapiens
tttaaaattcagttt

SEQ ID NO: 4348140 - DNA, 11 bp, Homo sapiens
tttaaagcctt

SEQ ID NO: 4348141 - DNA, 21 bp, Homo sapiens
tttaagtagaaaagttgcaga

SEQ ID NO: 4348142 - DNA, 19 bp, Homo sapiens
tttaagtgggtttttatga

SEQ ID NO: 4348143 - DNA, 15 bp, Homo sapiens
tttacctgagacttt

SEQ ID NO: 4348144 - DNA, 19 bp, Homo sapiens
tttactctgtgtttaaaaa

SEQ ID NO: 4348145 - DNA, 13 bp, Homo sapiens
tttagagagcctg

SEQ ID NO: 4348146 - DNA, 16 bp, Homo sapiens
tttagccctttaaaac

SEQ ID NO: 4348147 - DNA, 18 bp, Homo sapiens
tttagtaatattttactt

SEQ ID NO: 4348148 - DNA, 16 bp, Homo sapiens
tttataatctgaagat

SEQ ID NO: 4348149 - DNA, 13 bp, Homo sapiens
tttatatatggac

SEQ ID NO: 4348150 - DNA, 14 bp, Homo sapiens
tttatatgcatgca

SEQ ID NO: 4348151 - DNA, 16 bp, Homo sapiens
tttatgaactgcatca

SEQ ID NO: 4348152 - DNA, 22 bp, Homo sapiens
tttatgaactgcatcaagactt

SEQ ID NO: 4348153 - DNA, 18 bp, Homo sapiens
tttattctcagtaacttt

SEQ ID NO: 4348154 - DNA, 18 bp, Homo sapiens
tttattttttaaaaatga

SEQ ID NO: 4348155 - DNA, 23 bp, Homo sapiens
tttcaattcagattgtcttgcaa

SEQ ID NO: 4348156 - DNA, 17 bp, Homo sapiens
tttcacttttgttctgc

SEQ ID NO: 4348157 - DNA, 17 bp, Homo sapiens
tttcagtactcttatta

SEQ ID NO: 4348158 - DNA, 20 bp, Homo sapiens
tttcagttcgtttgtattct

SEQ ID NO: 4348159 - DNA, 16 bp, Homo sapiens
tttccttcattcatag

SEQ ID NO: 4348160 - DNA, 13 bp, Homo sapiens
tttctcttccctt

SEQ ID NO: 4348161 - DNA, 19 bp, Homo sapiens
tttctcttcccttcccaga

SEQ ID NO: 4348162 - DNA, 19 bp, Homo sapiens
tttctgccactgaggagac

SEQ ID NO: 4348163 - DNA, 20 bp, Homo sapiens
tttgaaagacagagtcttca

SEQ ID NO: 4348164 - DNA, 17 bp, Homo sapiens
tttgccaaggcaaaaaa

SEQ ID NO: 4348165 - DNA, 19 bp, Homo sapiens
tttggatatttttgtactt

SEQ ID NO: 4348166 - DNA, 16 bp, Homo sapiens
tttgtaaaacagccta

SEQ ID NO: 4348167 - DNA, 12 bp, Homo sapiens
tttgttattcct

SEQ ID NO: 4348168 - DNA, 19 bp, Homo sapiens
ttttaaagccttctggatc

SEQ ID NO: 4348169 - DNA, 15 bp, Homo sapiens
ttttaccaagagtaa

SEQ ID NO: 4348170 - DNA, 16 bp, Homo sapiens
ttttacctgagacttt

SEQ ID NO: 4348171 - DNA, 19 bp, Homo sapiens
ttttcagaattaatgcatt

SEQ ID NO: 4348172 - DNA, 19 bp, Homo sapiens
ttttctcttcccttcccag

SEQ ID NO: 4348173 - DNA, 11 bp, Homo sapiens
ttttggaaact

SEQ ID NO: 4348174 - DNA, 23 bp, Homo sapiens
ttttggaaactgctaaattctat

SEQ ID NO: 4348175 - DNA, 14 bp, Homo sapiens
ttttggtataatgt

SEQ ID NO: 4348176 - DNA, 13 bp, Homo sapiens
tttttaaaacact

SEQ ID NO: 4348177 - DNA, 22 bp, Homo sapiens
tttttaaaacactaaaagcagc

SEQ ID NO: 4348178 - DNA, 14 bp, Homo sapiens
tttttatgaactgc

SEQ ID NO: 4348179 - DNA, 16 bp, Homo sapiens
tttttatgttttgaaa

SEQ ID NO: 4348180 - DNA, 20 bp, Homo sapiens
tttttggtataatgtttaaa

SEQ ID NO: 4348181 - DNA, 22 bp, Homo sapiens
ttttttaagtgggtttttatga

SEQ ID NO: 4348182 - DNA, 21 bp, Homo sapiens
ttttttggtataatgtttaaa

SEQ ID NO: 4348183 - DNA, 14 bp, Homo sapiens
tggactctgctaga

SEQ ID NO: 4348184 - DNA, 23 bp, Homo sapiens
tggatccatggggggagaagtga

SEQ ID NO: 4348185 - DNA, 12 bp, Homo sapiens
tggattaaaaca

SEQ ID NO: 4348186 - DNA, 15 bp, Homo sapiens
tggattaaaacaatt

SEQ ID NO: 4348187 - DNA, 20 bp, Homo sapiens
tggcagtgactttgtataga

SEQ ID NO: 4348188 - DNA, 21 bp, Homo sapiens
tggccctcggaggtccagctg

SEQ ID NO: 4348189 - DNA, 18 bp, Homo sapiens
tggctcagagcttgaaga

SEQ ID NO: 4348190 - DNA, 14 bp, Homo sapiens
tggctgctgcctgc

SEQ ID NO: 4348191 - DNA, 17 bp, Homo sapiens
tgggccatgtccaaaga

SEQ ID NO: 4348192 - DNA, 23 bp, Homo sapiens
tgggccatgtccaaagaggctgc

SEQ ID NO: 4348193 - DNA, 24 bp, Homo sapiens
tgggccatgtccaaagaggctgcc

SEQ ID NO: 4348194 - DNA, 14 bp, Homo sapiens
tgggcctcctgcct

SEQ ID NO: 4348195 - DNA, 14 bp, Homo sapiens
tggggcaggctggg

SEQ ID NO: 4348196 - DNA, 18 bp, Homo sapiens
tggggcaggctgggccat

SEQ ID NO: 4348197 - DNA, 13 bp, Homo sapiens
tggggcctcaaga

SEQ ID NO: 4348198 - DNA, 16 bp, Homo sapiens
tgggttgttggtctgt

SEQ ID NO: 4348199 - DNA, 14 bp, Homo sapiens
tggtaaattcagac

SEQ ID NO: 4348200 - DNA, 19 bp, Homo sapiens
tggtaaattcagacaacat

SEQ ID NO: 4348201 - DNA, 22 bp, Homo sapiens
tggtagcataaataaaactgaa

SEQ ID NO: 4348202 - DNA, 19 bp, Homo sapiens
tggtataatgtttaaatca

SEQ ID NO: 4348203 - DNA, 21 bp, Homo sapiens
tggttattggactccaggcct

SEQ ID NO: 4348204 - DNA, 16 bp, Homo sapiens
tggtttcaattcagat

SEQ ID NO: 4348205 - DNA, 14 bp, Homo sapiens
tggttttgtgcttt

SEQ ID NO: 4348206 - DNA, 18 bp, Homo sapiens
tgtacttgatttgatgtg

SEQ ID NO: 4348207 - DNA, 18 bp, Homo sapiens
tgtagctacactgtataa

SEQ ID NO: 4348208 - DNA, 19 bp, Homo sapiens
tgtataatgtgctttattt

SEQ ID NO: 4348209 - DNA, 16 bp, Homo sapiens
tgtatatcattctaca

SEQ ID NO: 4348210 - DNA, 18 bp, Homo sapiens
tgtatatcattctacaga

SEQ ID NO: 4348211 - DNA, 21 bp, Homo sapiens
tgtattctacctttgtaaaac

SEQ ID NO: 4348212 - DNA, 12 bp, Homo sapiens
tgtcaccagagc

SEQ ID NO: 4348213 - DNA, 20 bp, Homo sapiens
tgtcagagctgttataaatt

SEQ ID NO: 4348214 - DNA, 22 bp, Homo sapiens
tgtcaggcatggctcagagctt

SEQ ID NO: 4348215 - DNA, 11 bp, Homo sapiens
tgtccaaagag

SEQ ID NO: 4348216 - DNA, 18 bp, Homo sapiens
tgtccttagtgatgtgtg

SEQ ID NO: 4348217 - DNA, 19 bp, Homo sapiens
tgtctcactgttctgcaaa

SEQ ID NO: 4348218 - DNA, 21 bp, Homo sapiens
tgtctccatgcacatgcacgc

SEQ ID NO: 4348219 - DNA, 15 bp, Homo sapiens
tgtgcagaataatgg

SEQ ID NO: 4348220 - DNA, 18 bp, Homo sapiens
tgtgtaacatccaagcca

SEQ ID NO: 4348221 - DNA, 17 bp, Homo sapiens
tgtgtacaagttgttat

SEQ ID NO: 4348222 - DNA, 16 bp, Homo sapiens
tgtgtacctcatatcc

SEQ ID NO: 4348223 - DNA, 18 bp, Homo sapiens
tgtgtataatgtgcttta

SEQ ID NO: 4348224 - DNA, 23 bp, Homo sapiens
tgtgtgtctccatgcacatgcac

SEQ ID NO: 4348225 - DNA, 15 bp, Homo sapiens
tgtgtttgctgcctt

SEQ ID NO: 4348226 - DNA, 12 bp, Homo sapiens
tgttaaacagta

SEQ ID NO: 4348227 - DNA, 20 bp, Homo sapiens
tgttaaacagtagttgtatt

SEQ ID NO: 4348228 - DNA, 13 bp, Homo sapiens
tgttaaatactgt

SEQ ID NO: 4348229 - DNA, 21 bp, Homo sapiens
tgttatgatattgtttaaaat

SEQ ID NO: 4348230 - DNA, 13 bp, Homo sapiens
tgttatgtatgaa

SEQ ID NO: 4348231 - DNA, 16 bp, Homo sapiens
tgttattgttgaacat

SEQ ID NO: 4348232 - DNA, 21 bp, Homo sapiens
tgttcataaaacggtgctttc

SEQ ID NO: 4348233 - DNA, 12 bp, Homo sapiens
tgttctgcaaag

SEQ ID NO: 4348234 - DNA, 15 bp, Homo sapiens
tgttgaacatacttc

SEQ ID NO: 4348235 - DNA, 15 bp, Homo sapiens
tgttgttgctgctgt

SEQ ID NO: 4348236 - DNA, 17 bp, Homo sapiens
tgtttaaaaagtaagtt

SEQ ID NO: 4348237 - DNA, 19 bp, Homo sapiens
tgtttaaaaagtaagttaa

SEQ ID NO: 4348238 - DNA, 21 bp, Homo sapiens
tgtttaaaaagtaagttaata

SEQ ID NO: 4348239 - DNA, 13 bp, Homo sapiens
tgtttaaatcatg

SEQ ID NO: 4348240 - DNA, 19 bp, Homo sapiens
tgtttaaatcatgtatgtt

SEQ ID NO: 4348241 - DNA, 13 bp, Homo sapiens
tgtttagagagcc

SEQ ID NO: 4348242 - DNA, 15 bp, Homo sapiens
tgtttagagagcctg

SEQ ID NO: 4348243 - DNA, 17 bp, Homo sapiens
tgtttagagagcctgtc

SEQ ID NO: 4348244 - DNA, 14 bp, Homo sapiens
tgtttataatctga

SEQ ID NO: 4348245 - DNA, 17 bp, Homo sapiens
tgtttataatctgaaga

SEQ ID NO: 4348246 - DNA, 11 bp, Homo sapiens
tgttttgaaag

SEQ ID NO: 4348247 - DNA, 12 bp, Homo sapiens
ttaaaaatgcaa

SEQ ID NO: 4348248 - DNA, 19 bp, Homo sapiens
ttaaaaatgcaatatctga

SEQ ID NO: 4348249 - DNA, 21 bp, Homo sapiens
ttaaaacaattttttttttcc

SEQ ID NO: 4348250 - DNA, 15 bp, Homo sapiens
ttaaaacgtcttaga

SEQ ID NO: 4348251 - DNA, 21 bp, Homo sapiens
ttaaaatgaacctgctactta

SEQ ID NO: 4348252 - DNA, 15 bp, Homo sapiens
ttaaaattcagtttt

SEQ ID NO: 4348253 - DNA, 15 bp, Homo sapiens
ttaaactaaataatg

SEQ ID NO: 4348254 - DNA, 16 bp, Homo sapiens
ttaaatactgtgcaga

SEQ ID NO: 4348255 - DNA, 19 bp, Homo sapiens
ttaaatactgtgcagaata

SEQ ID NO: 4348256 - DNA, 20 bp, Homo sapiens
ttaaatcatgtatgttatga

SEQ ID NO: 4348257 - DNA, 15 bp, Homo sapiens
ttaaccctttttcca

SEQ ID NO: 4348258 - DNA, 22 bp, Homo sapiens
ttaacttcaggtaaaaacttca

SEQ ID NO: 4348259 - DNA, 20 bp, Homo sapiens
ttaagagaagaaatgttata

SEQ ID NO: 4348260 - DNA, 20 bp, Homo sapiens
ttaagtagaaaagttgcaga

SEQ ID NO: 4348261 - DNA, 22 bp, Homo sapiens
ttaagtagaaaagttgcagatg

SEQ ID NO: 4348262 - DNA, 21 bp, Homo sapiens
ttaataatgtattgtaatctt

SEQ ID NO: 4348263 - DNA, 13 bp, Homo sapiens
ttaatctgtgtgt

SEQ ID NO: 4348264 - DNA, 17 bp, Homo sapiens
ttaattcacctatgtta

SEQ ID NO: 4348265 - DNA, 19 bp, Homo sapiens
ttaattcacctatgttatt

SEQ ID NO: 4348266 - DNA, 13 bp, Homo sapiens
ttaattttaccaa

SEQ ID NO: 4348267 - DNA, 19 bp, Homo sapiens
ttacaaccatactttatat

SEQ ID NO: 4348268 - DNA, 14 bp, Homo sapiens
ttaccaagagtaac

SEQ ID NO: 4348269 - DNA, 16 bp, Homo sapiens
ttaccaagagtaactt

SEQ ID NO: 4348270 - DNA, 17 bp, Homo sapiens
ttaccagacaaaaaaat

SEQ ID NO: 4348271 - DNA, 19 bp, Homo sapiens
ttacgtttgttattcctag

SEQ ID NO: 4348272 - DNA, 16 bp, Homo sapiens
ttactctgtgtttaaa

SEQ ID NO: 4348273 - DNA, 15 bp, Homo sapiens
ttagagagcctgtca

SEQ ID NO: 4348274 - DNA, 18 bp, Homo sapiens
ttagagagcctgtcacca

SEQ ID NO: 4348275 - DNA, 14 bp, Homo sapiens
ttagagccttttat

SEQ ID NO: 4348276 - DNA, 20 bp, Homo sapiens
ttagtgtctccagtcaagct

SEQ ID NO: 4348277 - DNA, 12 bp, Homo sapiens
ttatatcttttg

SEQ ID NO: 4348278 - DNA, 17 bp, Homo sapiens
ttatatcttttggttat

SEQ ID NO: 4348279 - DNA, 17 bp, Homo sapiens
ttatattagtgaagatg

SEQ ID NO: 4348280 - DNA, 23 bp, Homo sapiens
ttatattagtgaagatggtttca

SEQ ID NO: 4348281 - DNA, 16 bp, Homo sapiens
ttatattttgtgtata

SEQ ID NO: 4348282 - DNA, 21 bp, Homo sapiens
ttatgaactgcatcaagactt

SEQ ID NO: 4348283 - DNA, 23 bp, Homo sapiens
ttatgaactgcatcaagacttca

SEQ ID NO: 4348284 - DNA, 23 bp, Homo sapiens
ttatgtatgaaggaatcattcca

SEQ ID NO: 4348285 - DNA, 18 bp, Homo sapiens
ttattgaagtgaattcct

SEQ ID NO: 4348286 - DNA, 12 bp, Homo sapiens
ttattgttgaac

SEQ ID NO: 4348287 - DNA, 12 bp, Homo sapiens
ttatttttgcca

SEQ ID NO: 4348288 - DNA, 21 bp, Homo sapiens
ttcaattcagattgtcttgca

SEQ ID NO: 4348289 - DNA, 15 bp, Homo sapiens
ttcacctgttatgta

SEQ ID NO: 4348290 - DNA, 23 bp, Homo sapiens
ttcacctgttatgtatgaaggaa

SEQ ID NO: 4348291 - DNA, 13 bp, Homo sapiens
ttcacttttgttc

SEQ ID NO: 4348292 - DNA, 17 bp, Homo sapiens
ttcacttttgttctgct

SEQ ID NO: 4348293 - DNA, 10 bp, Homo sapiens
ttcagcccac

SEQ ID NO: 4348294 - DNA, 19 bp, Homo sapiens
ttcagttttatttttgcca

SEQ ID NO: 4348295 - DNA, 20 bp, Homo sapiens
ttcatagggaaaggttttgt

SEQ ID NO: 4348296 - DNA, 11 bp, Homo sapiens
ttccagtgcta

SEQ ID NO: 4348297 - DNA, 13 bp, Homo sapiens
ttccttcaaccac

SEQ ID NO: 4348298 - DNA, 15 bp, Homo sapiens
ttccttcattcatag

SEQ ID NO: 4348299 - DNA, 16 bp, Homo sapiens
ttccttcattcatagg

SEQ ID NO: 4348300 - DNA, 15 bp, Homo sapiens
ttctacctttgtaaa

SEQ ID NO: 4348301 - DNA, 23 bp, Homo sapiens
ttctaggcacaaggttggttgct

SEQ ID NO: 4348302 - DNA, 21 bp, Homo sapiens
ttctatgttaaatactgtgca

SEQ ID NO: 4348303 - DNA, 22 bp, Homo sapiens
ttctattccctaacttgtgaag

SEQ ID NO: 4348304 - DNA, 17 bp, Homo sapiens
ttctctgggctgaatgt

SEQ ID NO: 4348305 - DNA, 20 bp, Homo sapiens
ttctcttcctagatctgcag

SEQ ID NO: 4348306 - DNA, 18 bp, Homo sapiens
ttctgcagcggcagagca

SEQ ID NO: 4348307 - DNA, 13 bp, Homo sapiens
ttctggatccatg

SEQ ID NO: 4348308 - DNA, 20 bp, Homo sapiens
ttctggggcaggctgggcca

SEQ ID NO: 4348309 - DNA, 15 bp, Homo sapiens
ttcttcaataaaatg

SEQ ID NO: 4348310 - DNA, 17 bp, Homo sapiens
ttcttcacctgttatgt

SEQ ID NO: 4348311 - DNA, 22 bp, Homo sapiens
ttcttcacctgttatgtatgaa

SEQ ID NO: 4348312 - DNA, 15 bp, Homo sapiens
ttgaaaatgtgtttg

SEQ ID NO: 4348313 - DNA, 13 bp, Homo sapiens
ttgaacacagttg

SEQ ID NO: 4348314 - DNA, 18 bp, Homo sapiens
ttgagatttttggttttt

SEQ ID NO: 4348315 - DNA, 15 bp, Homo sapiens
ttgaggccaagatgg

SEQ ID NO: 4348316 - DNA, 14 bp, Homo sapiens
ttgatgtgactttt

SEQ ID NO: 4348317 - DNA, 16 bp, Homo sapiens
tcccctgttaaacagt

SEQ ID NO: 4348318 - DNA, 15 bp, Homo sapiens
tccctaacttgtgaa

SEQ ID NO: 4348319 - DNA, 10 bp, Homo sapiens
tcccttccca

SEQ ID NO: 4348320 - DNA, 13 bp, Homo sapiens
tccgctgggcttc

SEQ ID NO: 4348321 - DNA, 14 bp, Homo sapiens
tccggactggcaga

SEQ ID NO: 4348322 - DNA, 22 bp, Homo sapiens
tcctagatctgcaggctgcacc

SEQ ID NO: 4348323 - DNA, 15 bp, Homo sapiens
tcctagcagacagaa

SEQ ID NO: 4348324 - DNA, 13 bp, Homo sapiens
tcctcttcagaac

SEQ ID NO: 4348325 - DNA, 19 bp, Homo sapiens
tcctcttcagaacttgtca

SEQ ID NO: 4348326 - DNA, 13 bp, Homo sapiens
tcctgcctccggg

SEQ ID NO: 4348327 - DNA, 19 bp, Homo sapiens
tccttaagagaagaaatgt

SEQ ID NO: 4348328 - DNA, 18 bp, Homo sapiens
tcctttacaaccatactt

SEQ ID NO: 4348329 - DNA, 13 bp, Homo sapiens
tcgatatgtatat

SEQ ID NO: 4348330 - DNA, 22 bp, Homo sapiens
tcgatatgtatatcattctaca

SEQ ID NO: 4348331 - DNA, 20 bp, Homo sapiens
tcgtttgtattctacctttg

SEQ ID NO: 4348332 - DNA, 14 bp, Homo sapiens
tctaaacacttcat

SEQ ID NO: 4348333 - DNA, 14 bp, Homo sapiens
tctaataaacttta

SEQ ID NO: 4348334 - DNA, 18 bp, Homo sapiens
tctacagaataatccagt

SEQ ID NO: 4348335 - DNA, 20 bp, Homo sapiens
tctacctaatgtctcactgt

SEQ ID NO: 4348336 - DNA, 21 bp, Homo sapiens
tctacctaatgtctcactgtt

SEQ ID NO: 4348337 - DNA, 23 bp, Homo sapiens
tctacctaatgtctcactgttct

SEQ ID NO: 4348338 - DNA, 21 bp, Homo sapiens
tctacctttgtaaaacagcct

SEQ ID NO: 4348339 - DNA, 18 bp, Homo sapiens
tctagactgcaagaactg

SEQ ID NO: 4348340 - DNA, 16 bp, Homo sapiens
tctaggcacaaggttg

SEQ ID NO: 4348341 - DNA, 17 bp, Homo sapiens
tctagtcagtatctgta

SEQ ID NO: 4348342 - DNA, 15 bp, Homo sapiens
tctatattctttatt

SEQ ID NO: 4348343 - DNA, 14 bp, Homo sapiens
tctatgttaaatac

SEQ ID NO: 4348344 - DNA, 16 bp, Homo sapiens
tctatgttaaatactg

SEQ ID NO: 4348345 - DNA, 18 bp, Homo sapiens
tctatgttaaatactgtg

SEQ ID NO: 4348346 - DNA, 22 bp, Homo sapiens
tctatgttaaatactgtgcaga

SEQ ID NO: 4348347 - DNA, 14 bp, Homo sapiens
tctcactgttctgc

SEQ ID NO: 4348348 - DNA, 18 bp, Homo sapiens
tctcagactctttcttca

SEQ ID NO: 4348349 - DNA, 23 bp, Homo sapiens
tctcagaggaaaaatgggagcca

SEQ ID NO: 4348350 - DNA, 14 bp, Homo sapiens
tctctaattagaaa

SEQ ID NO: 4348351 - DNA, 12 bp, Homo sapiens
tctctgggctga

SEQ ID NO: 4348352 - DNA, 17 bp, Homo sapiens
tctcttcccttcccaga

SEQ ID NO: 4348353 - DNA, 21 bp, Homo sapiens
tctcttcccttcccagaccag

SEQ ID NO: 4348354 - DNA, 18 bp, Homo sapiens
tctgacaaaggtggtaaa

SEQ ID NO: 4348355 - DNA, 19 bp, Homo sapiens
tctgacaaaggtggtaaat

SEQ ID NO: 4348356 - DNA, 19 bp, Homo sapiens
tctgcaaaggtggcaatgc

SEQ ID NO: 4348357 - DNA, 22 bp, Homo sapiens
tctgcagaacatcgatatgtat

SEQ ID NO: 4348358 - DNA, 17 bp, Homo sapiens
tctgcagcggcagagca

SEQ ID NO: 4348359 - DNA, 13 bp, Homo sapiens
tctggctttttct

SEQ ID NO: 4348360 - DNA, 24 bp, Homo sapiens
tctggctttttctgccactgagga

SEQ ID NO: 4348361 - DNA, 21 bp, Homo sapiens
tctggggcaggctgggccatg

SEQ ID NO: 4348362 - DNA, 18 bp, Homo sapiens
tctgtagctacactgtat

SEQ ID NO: 4348363 - DNA, 13 bp, Homo sapiens
tctgtatttctag

SEQ ID NO: 4348364 - DNA, 21 bp, Homo sapiens
tctgtgtgtatattgagaatc

SEQ ID NO: 4348365 - DNA, 12 bp, Homo sapiens
tcttaatctgtg

SEQ ID NO: 4348366 - DNA, 21 bp, Homo sapiens
tcttagagccttttatctgca

SEQ ID NO: 4348367 - DNA, 21 bp, Homo sapiens
tcttcctagatctgcaggctg

SEQ ID NO: 4348368 - DNA, 18 bp, Homo sapiens
tcttctggggcaggctgg

SEQ ID NO: 4348369 - DNA, 16 bp, Homo sapiens
tcttggggcaagactg

SEQ ID NO: 4348370 - DNA, 15 bp, Homo sapiens
tcttggggctgatga

SEQ ID NO: 4348371 - DNA, 22 bp, Homo sapiens
tctttattctcagtaactttta

SEQ ID NO: 4348372 - DNA, 23 bp, Homo sapiens
tcttttcataaagggttgaaaat

SEQ ID NO: 4348373 - DNA, 12 bp, Homo sapiens
tcttttggttat

SEQ ID NO: 4348374 - DNA, 15 bp, Homo sapiens
tcttttttctcttcc

SEQ ID NO: 4348375 - DNA, 16 bp, Homo sapiens
tgaaaggattctctaa

SEQ ID NO: 4348376 - DNA, 23 bp, Homo sapiens
tgaaaggattctctaattagaaa

SEQ ID NO: 4348377 - DNA, 16 bp, Homo sapiens
tgaagaagggggtggg

SEQ ID NO: 4348378 - DNA, 23 bp, Homo sapiens
tgaagatggtttcaattcagatt

SEQ ID NO: 4348379 - DNA, 15 bp, Homo sapiens
tgaagggaagtgggg

SEQ ID NO: 4348380 - DNA, 14 bp, Homo sapiens
tgaagtatactttt

SEQ ID NO: 4348381 - DNA, 14 bp, Homo sapiens
tgaataaactgaat

SEQ ID NO: 4348382 - DNA, 18 bp, Homo sapiens
tgaatattttggaaactg

SEQ ID NO: 4348383 - DNA, 19 bp, Homo sapiens
tgaatgtatgtcagtgcta

SEQ ID NO: 4348384 - DNA, 19 bp, Homo sapiens
tgaattttataaataaaat

SEQ ID NO: 4348385 - DNA, 17 bp, Homo sapiens
tgacaaaggtggtaaat

SEQ ID NO: 4348386 - DNA, 22 bp, Homo sapiens
tgacaaaggtggtaaattcaga

SEQ ID NO: 4348387 - DNA, 22 bp, Homo sapiens
tgaccacaccaaccaggccttc

SEQ ID NO: 4348388 - DNA, 14 bp, Homo sapiens
tgactgttgatgaa

SEQ ID NO: 4348389 - DNA, 22 bp, Homo sapiens
tgactgttgatgaagtatactt

SEQ ID NO: 4348390 - DNA, 17 bp, Homo sapiens
tgactttttttggtata

SEQ ID NO: 4348391 - DNA, 18 bp, Homo sapiens
tgactttttttggtataa

SEQ ID NO: 4348392 - DNA, 16 bp, Homo sapiens
tgagaaccttttcaaa

SEQ ID NO: 4348393 - DNA, 16 bp, Homo sapiens
tgaggagacagaaagc

SEQ ID NO: 4348394 - DNA, 17 bp, Homo sapiens
tgaggagacagaaagcc

SEQ ID NO: 4348395 - DNA, 14 bp, Homo sapiens
tgaggagcgtggac

SEQ ID NO: 4348396 - DNA, 16 bp, Homo sapiens
tgaggagcgtggactc

SEQ ID NO: 4348397 - DNA, 13 bp, Homo sapiens
tgaggcagcccag

SEQ ID NO: 4348398 - DNA, 12 bp, Homo sapiens
tgagggggtggt

SEQ ID NO: 4348399 - DNA, 14 bp, Homo sapiens
tgatattgtttaaa

SEQ ID NO: 4348400 - DNA, 16 bp, Homo sapiens
tgatattgtttaaaat

SEQ ID NO: 4348401 - DNA, 15 bp, Homo sapiens
tgatctaataaactt

SEQ ID NO: 4348402 - DNA, 17 bp, Homo sapiens
tgatctaataaacttta

SEQ ID NO: 4348403 - DNA, 18 bp, Homo sapiens
tgatctaataaactttat

SEQ ID NO: 4348404 - DNA, 18 bp, Homo sapiens
tgatcttgagaacctttt

SEQ ID NO: 4348405 - DNA, 22 bp, Homo sapiens
tgatcttgagaaccttttcaaa

SEQ ID NO: 4348406 - DNA, 12 bp, Homo sapiens
tgatgaagaagg

SEQ ID NO: 4348407 - DNA, 13 bp, Homo sapiens
tgatgtgactttt

SEQ ID NO: 4348408 - DNA, 21 bp, Homo sapiens
tgcaagaactgtttttaccca

SEQ ID NO: 4348409 - DNA, 23 bp, Homo sapiens
tgcacctctggctagagccgagg

SEQ ID NO: 4348410 - DNA, 14 bp, Homo sapiens
tgcagaacccccag

SEQ ID NO: 4348411 - DNA, 22 bp, Homo sapiens
tgcagaacccccaggtggcctg

SEQ ID NO: 4348412 - DNA, 14 bp, Homo sapiens
tgcagaataatgga

SEQ ID NO: 4348413 - DNA, 15 bp, Homo sapiens
tgcagcggcagagca

SEQ ID NO: 4348414 - DNA, 22 bp, Homo sapiens
tgcatcaagacttcaatcctga

SEQ ID NO: 4348415 - DNA, 18 bp, Homo sapiens
tgcatttgatagcaatgt

SEQ ID NO: 4348416 - DNA, 14 bp, Homo sapiens
tgccactgaggaga

SEQ ID NO: 4348417 - DNA, 11 bp, Homo sapiens
tgccagagcca

SEQ ID NO: 4348418 - DNA, 15 bp, Homo sapiens
tgccagagccaacct

SEQ ID NO: 4348419 - DNA, 17 bp, Homo sapiens
tgccagagccaacctgg

SEQ ID NO: 4348420 - DNA, 18 bp, Homo sapiens
tgccagagccaacctgga

SEQ ID NO: 4348421 - DNA, 21 bp, Homo sapiens
tgccagagccaacctggactt

SEQ ID NO: 4348422 - DNA, 15 bp, Homo sapiens
tgcccctctcaccaa

SEQ ID NO: 4348423 - DNA, 13 bp, Homo sapiens
tgcctggactgac

SEQ ID NO: 4348424 - DNA, 16 bp, Homo sapiens
tgccttgctcctagca

SEQ ID NO: 4348425 - DNA, 18 bp, Homo sapiens
tgccttgctcctagcaga

SEQ ID NO: 4348426 - DNA, 14 bp, Homo sapiens
tgcgtcttttttct

SEQ ID NO: 4348427 - DNA, 16 bp, Homo sapiens
tgcgtcttttttctct

SEQ ID NO: 4348428 - DNA, 20 bp, Homo sapiens
tgcgtcttttttctcttccc

SEQ ID NO: 4348429 - DNA, 19 bp, Homo sapiens
tgctaagaagcctataaga

SEQ ID NO: 4348430 - DNA, 22 bp, Homo sapiens
tgctagactcctcaggagagac

SEQ ID NO: 4348431 - DNA, 20 bp, Homo sapiens
tgctataaatgccagagcca

SEQ ID NO: 4348432 - DNA, 21 bp, Homo sapiens
tgctataaatgccagagccaa

SEQ ID NO: 4348433 - DNA, 22 bp, Homo sapiens
tgctataaatgccagagccaac

SEQ ID NO: 4348434 - DNA, 23 bp, Homo sapiens
tgctataaatgccagagccaacc

SEQ ID NO: 4348435 - DNA, 17 bp, Homo sapiens
tgctcctagcagacaga

SEQ ID NO: 4348436 - DNA, 18 bp, Homo sapiens
tgctcctagcagacagaa

SEQ ID NO: 4348437 - DNA, 18 bp, Homo sapiens
tgcttaaactaaataatg

SEQ ID NO: 4348438 - DNA, 23 bp, Homo sapiens
tgcttacaaagaaagcacttctt

SEQ ID NO: 4348439 - DNA, 20 bp, Homo sapiens
tgcttattttatgatagttt

SEQ ID NO: 4348440 - DNA, 16 bp, Homo sapiens
tgctttatcttttcat

SEQ ID NO: 4348441 - DNA, 15 bp, Homo sapiens
tgctttatttgcaaa

SEQ ID NO: 4348442 - DNA, 14 bp, Homo sapiens
tgctttctgtgaaa

SEQ ID NO: 4348443 - DNA, 20 bp, Homo sapiens
tgctttctgtgaaagcctta

SEQ ID NO: 4348444 - DNA, 15 bp, Homo sapiens
tggaaactgctaaat

SEQ ID NO: 4348445 - DNA, 19 bp, Homo sapiens
tggaaactgctaaattcta

SEQ ID NO: 4348446 - DNA, 22 bp, Homo sapiens
tggacagctttattttaaatgt

SEQ ID NO: 4348447 - DNA, 14 bp, Homo sapiens
tggactacaaaata

SEQ ID NO: 4348448 - DNA, 13 bp, Homo sapiens
tggactccaggcc

SEQ ID NO: 4348449 - DNA, 14 bp, Homo sapiens
tggactccaggcct

SEQ ID NO: 4348450 - DNA, 18 bp, Homo sapiens
tggactccaggcctgacc

SEQ ID NO: 4348451 - DNA, 12 bp, Homo sapiens
taattagaaatt

SEQ ID NO: 4348452 - DNA, 23 bp, Homo sapiens
taattcacctatgttattttgtg

SEQ ID NO: 4348453 - DNA, 15 bp, Homo sapiens
taattcttcacctgt

SEQ ID NO: 4348454 - DNA, 21 bp, Homo sapiens
tacaaagaaagcacttcttat

SEQ ID NO: 4348455 - DNA, 14 bp, Homo sapiens
tacaaccatacttt

SEQ ID NO: 4348456 - DNA, 18 bp, Homo sapiens
tacaagctgggaacttct

SEQ ID NO: 4348457 - DNA, 19 bp, Homo sapiens
tacaagctgggaacttcta

SEQ ID NO: 4348458 - DNA, 14 bp, Homo sapiens
tacaatcctgttta

SEQ ID NO: 4348459 - DNA, 23 bp, Homo sapiens
tacaatcctgtttataatctgaa

SEQ ID NO: 4348460 - DNA, 19 bp, Homo sapiens
tacactgcggaagccaaag

SEQ ID NO: 4348461 - DNA, 20 bp, Homo sapiens
tacagacctggctctcagag

SEQ ID NO: 4348462 - DNA, 18 bp, Homo sapiens
tacatacattcatactgt

SEQ ID NO: 4348463 - DNA, 17 bp, Homo sapiens
tacattcatactgtaga

SEQ ID NO: 4348464 - DNA, 23 bp, Homo sapiens
taccacagacacaatatgtatgc

SEQ ID NO: 4348465 - DNA, 19 bp, Homo sapiens
tacctttgtaaaacagcct

SEQ ID NO: 4348466 - DNA, 13 bp, Homo sapiens
tactctcccagat

SEQ ID NO: 4348467 - DNA, 22 bp, Homo sapiens
tactcttattaggatacaagct

SEQ ID NO: 4348468 - DNA, 18 bp, Homo sapiens
tactgcttattttatgat

SEQ ID NO: 4348469 - DNA, 16 bp, Homo sapiens
tactgtgcagaataat

SEQ ID NO: 4348470 - DNA, 12 bp, Homo sapiens
tactttatatat

SEQ ID NO: 4348471 - DNA, 21 bp, Homo sapiens
tactttatatatgtacataca

SEQ ID NO: 4348472 - DNA, 23 bp, Homo sapiens
tacttttcccctgttaaacagta

SEQ ID NO: 4348473 - DNA, 20 bp, Homo sapiens
tagaaaagttgcagatgtat

SEQ ID NO: 4348474 - DNA, 21 bp, Homo sapiens
tagaaaatttagccctttaaa

SEQ ID NO: 4348475 - DNA, 16 bp, Homo sapiens
tagacctacagacctg

SEQ ID NO: 4348476 - DNA, 18 bp, Homo sapiens
tagacctacagacctggc

SEQ ID NO: 4348477 - DNA, 14 bp, Homo sapiens
tagactcctcagga

SEQ ID NO: 4348478 - DNA, 15 bp, Homo sapiens
tagactgcaagaact

SEQ ID NO: 4348479 - DNA, 18 bp, Homo sapiens
tagagagcctgtcaccag

SEQ ID NO: 4348480 - DNA, 22 bp, Homo sapiens
tagagccttttatctgcagaac

SEQ ID NO: 4348481 - DNA, 17 bp, Homo sapiens
tagatgatgatgtgttt

SEQ ID NO: 4348482 - DNA, 19 bp, Homo sapiens
tagcagacagaaactggat

SEQ ID NO: 4348483 - DNA, 18 bp, Homo sapiens
tagcataaataaaactga

SEQ ID NO: 4348484 - DNA, 13 bp, Homo sapiens
tagccctttaaaa

SEQ ID NO: 4348485 - DNA, 14 bp, Homo sapiens
taggcacaaggttg

SEQ ID NO: 4348486 - DNA, 21 bp, Homo sapiens
tagtatctagtcagtatctgt

SEQ ID NO: 4348487 - DNA, 14 bp, Homo sapiens
tagttgtattcttc

SEQ ID NO: 4348488 - DNA, 12 bp, Homo sapiens
tagtttggatat

SEQ ID NO: 4348489 - DNA, 20 bp, Homo sapiens
tagtttggatatttttgtac

SEQ ID NO: 4348490 - DNA, 22 bp, Homo sapiens
tagtttggatatttttgtactt

SEQ ID NO: 4348491 - DNA, 13 bp, Homo sapiens
tataaatgccaga

SEQ ID NO: 4348492 - DNA, 19 bp, Homo sapiens
tataaatgccagagccaac

SEQ ID NO: 4348493 - DNA, 22 bp, Homo sapiens
tataaatgccagagccaacctg

SEQ ID NO: 4348494 - DNA, 22 bp, Homo sapiens
tataaatttatcaactgtcaaa

SEQ ID NO: 4348495 - DNA, 15 bp, Homo sapiens
tataatctgaagata

SEQ ID NO: 4348496 - DNA, 14 bp, Homo sapiens
tataatgtgcttta

SEQ ID NO: 4348497 - DNA, 14 bp, Homo sapiens
tatacaaagtgtac

SEQ ID NO: 4348498 - DNA, 20 bp, Homo sapiens
tatacttttcccctgttaaa

SEQ ID NO: 4348499 - DNA, 16 bp, Homo sapiens
tatatatgtacataca

SEQ ID NO: 4348500 - DNA, 20 bp, Homo sapiens
tatatcattctacagaataa

SEQ ID NO: 4348501 - DNA, 21 bp, Homo sapiens
tatatcattctacagaataat

SEQ ID NO: 4348502 - DNA, 20 bp, Homo sapiens
tatattgagaatcccttaaa

SEQ ID NO: 4348503 - DNA, 21 bp, Homo sapiens
tatatttcacttttgttctgc

SEQ ID NO: 4348504 - DNA, 22 bp, Homo sapiens
tatatttcacttttgttctgct

SEQ ID NO: 4348505 - DNA, 15 bp, Homo sapiens
tatattttgtgtata

SEQ ID NO: 4348506 - DNA, 14 bp, Homo sapiens
tatcaactgtcaaa

SEQ ID NO: 4348507 - DNA, 19 bp, Homo sapiens
tatcattctacagaataat

SEQ ID NO: 4348508 - DNA, 22 bp, Homo sapiens
tatctgtagctacactgtataa

SEQ ID NO: 4348509 - DNA, 22 bp, Homo sapiens
tatcttggggcaagactgcaaa

SEQ ID NO: 4348510 - DNA, 20 bp, Homo sapiens
tatgaaggaatcattccagt

SEQ ID NO: 4348511 - DNA, 13 bp, Homo sapiens
tatgatattgttt

SEQ ID NO: 4348512 - DNA, 15 bp, Homo sapiens
tatgatattgtttaa

SEQ ID NO: 4348513 - DNA, 16 bp, Homo sapiens
tatgatattgtttaaa

SEQ ID NO: 4348514 - DNA, 14 bp, Homo sapiens
tatgatctaataaa

SEQ ID NO: 4348515 - DNA, 16 bp, Homo sapiens
tatggacagctttatt

SEQ ID NO: 4348516 - DNA, 21 bp, Homo sapiens
tatgtatatcattctacagaa

SEQ ID NO: 4348517 - DNA, 12 bp, Homo sapiens
tatgttaaatac

SEQ ID NO: 4348518 - DNA, 14 bp, Homo sapiens
tatgttaaatactg

SEQ ID NO: 4348519 - DNA, 20 bp, Homo sapiens
tatgttatgatattgtttaa

SEQ ID NO: 4348520 - DNA, 17 bp, Homo sapiens
tattaattcttcacctg

SEQ ID NO: 4348521 - DNA, 19 bp, Homo sapiens
tattccgatacaaagtgtt

SEQ ID NO: 4348522 - DNA, 20 bp, Homo sapiens
tattgagaatcccttaaaat

SEQ ID NO: 4348523 - DNA, 16 bp, Homo sapiens
tattgctgattttaaa

SEQ ID NO: 4348524 - DNA, 21 bp, Homo sapiens
tattgttgaacatacttcaaa

SEQ ID NO: 4348525 - DNA, 12 bp, Homo sapiens
tatttagtatct

SEQ ID NO: 4348526 - DNA, 16 bp, Homo sapiens
tattttggaaactgct

SEQ ID NO: 4348527 - DNA, 19 bp, Homo sapiens
tattttggaaactgctaaa

SEQ ID NO: 4348528 - DNA, 12 bp, Homo sapiens
tatttttgtact

SEQ ID NO: 4348529 - DNA, 17 bp, Homo sapiens
tatttttgtacttgatt

SEQ ID NO: 4348530 - DNA, 17 bp, Homo sapiens
tattttttaaaacacta

SEQ ID NO: 4348531 - DNA, 13 bp, Homo sapiens
tattttttgcaag

SEQ ID NO: 4348532 - DNA, 14 bp, Homo sapiens
tcaaaaataatgtg

SEQ ID NO: 4348533 - DNA, 14 bp, Homo sapiens
tcaaagatttttat

SEQ ID NO: 4348534 - DNA, 18 bp, Homo sapiens
tcaaagttaattcaccta

SEQ ID NO: 4348535 - DNA, 18 bp, Homo sapiens
tcaaatatgttctggaca

SEQ ID NO: 4348536 - DNA, 20 bp, Homo sapiens
tcaaatgaaaggattctcta

SEQ ID NO: 4348537 - DNA, 15 bp, Homo sapiens
tcaacttaataagat

SEQ ID NO: 4348538 - DNA, 22 bp, Homo sapiens
tcaagggaaaggcaagcttgag

SEQ ID NO: 4348539 - DNA, 14 bp, Homo sapiens
tcaataaaatggtt

SEQ ID NO: 4348540 - DNA, 17 bp, Homo sapiens
tcaattggcagtgactt

SEQ ID NO: 4348541 - DNA, 18 bp, Homo sapiens
tcaattggcagtgacttt

SEQ ID NO: 4348542 - DNA, 22 bp, Homo sapiens
tcaattggcagtgactttgtat

SEQ ID NO: 4348543 - DNA, 14 bp, Homo sapiens
tcaattttttcaaa

SEQ ID NO: 4348544 - DNA, 22 bp, Homo sapiens
tcaccagagcttctctgggctg

SEQ ID NO: 4348545 - DNA, 23 bp, Homo sapiens
tcaccagagcttctctgggctga

SEQ ID NO: 4348546 - DNA, 21 bp, Homo sapiens
tcacccactcctttacaacca

SEQ ID NO: 4348547 - DNA, 23 bp, Homo sapiens
tcacctatgttattttgtgtaca

SEQ ID NO: 4348548 - DNA, 15 bp, Homo sapiens
tcacctgttatgtat

SEQ ID NO: 4348549 - DNA, 20 bp, Homo sapiens
tcacttttgttctgctttat

SEQ ID NO: 4348550 - DNA, 21 bp, Homo sapiens
tcagaattaatgcattcaaag

SEQ ID NO: 4348551 - DNA, 12 bp, Homo sapiens
tcagacaacatt

SEQ ID NO: 4348552 - DNA, 23 bp, Homo sapiens
tcagacaacattatgatctaata

SEQ ID NO: 4348553 - DNA, 14 bp, Homo sapiens
tcagagcttgaaga

SEQ ID NO: 4348554 - DNA, 23 bp, Homo sapiens
tcagaggaaaaatgggagccagg

SEQ ID NO: 4348555 - DNA, 19 bp, Homo sapiens
tcagattgtcttgcaactt

SEQ ID NO: 4348556 - DNA, 12 bp, Homo sapiens
tcaggcatggct

SEQ ID NO: 4348557 - DNA, 20 bp, Homo sapiens
tcaggcatggctcagagctt

SEQ ID NO: 4348558 - DNA, 17 bp, Homo sapiens
tcagtaacttttaaaag

SEQ ID NO: 4348559 - DNA, 18 bp, Homo sapiens
tcagtgctataaatgcca

SEQ ID NO: 4348560 - DNA, 23 bp, Homo sapiens
tcagtgctataaatgccagagcc

SEQ ID NO: 4348561 - DNA, 14 bp, Homo sapiens
tcagtttttgtatc

SEQ ID NO: 4348562 - DNA, 21 bp, Homo sapiens
tcataaagggttgaaaatgtg

SEQ ID NO: 4348563 - DNA, 21 bp, Homo sapiens
tcatagggaaaggttttgtat

SEQ ID NO: 4348564 - DNA, 21 bp, Homo sapiens
tcatccaaaatattttttgca

SEQ ID NO: 4348565 - DNA, 17 bp, Homo sapiens
tcatcctcctccccagc

SEQ ID NO: 4348566 - DNA, 20 bp, Homo sapiens
tcatcctcctccccagctct

SEQ ID NO: 4348567 - DNA, 21 bp, Homo sapiens
tcatctcaattttttcaaatg

SEQ ID NO: 4348568 - DNA, 18 bp, Homo sapiens
tcatgtgtacctcatatc

SEQ ID NO: 4348569 - DNA, 16 bp, Homo sapiens
tcattagggtaatatc

SEQ ID NO: 4348570 - DNA, 13 bp, Homo sapiens
tcattccggactg

SEQ ID NO: 4348571 - DNA, 17 bp, Homo sapiens
tcattctacagaataat

SEQ ID NO: 4348572 - DNA, 14 bp, Homo sapiens
tccaaagaggctgc

SEQ ID NO: 4348573 - DNA, 18 bp, Homo sapiens
tccaaagaggctgcccct

SEQ ID NO: 4348574 - DNA, 17 bp, Homo sapiens
tccagctgggcctcctg

SEQ ID NO: 4348575 - DNA, 15 bp, Homo sapiens
tccaggcctgaccag

SEQ ID NO: 4348576 - DNA, 16 bp, Homo sapiens
tccaggcctgaccagg

SEQ ID NO: 4348577 - DNA, 11 bp, Homo sapiens
tccaggctgag

SEQ ID NO: 4348578 - DNA, 21 bp, Homo sapiens
tccaggctgagccatgaggag

SEQ ID NO: 4348579 - DNA, 15 bp, Homo sapiens
tccagtattgctgat

SEQ ID NO: 4348580 - DNA, 16 bp, Homo sapiens
tcccagaccaggaaag

SEQ ID NO: 4348581 - DNA, 20 bp, Homo sapiens
tccccagctcttctcttcct

SEQ ID NO: 4348582 - DNA, 22 bp, Homo sapiens
tccccagctcttctcttcctag

SEQ ID NO: 4348583 - DNA, 19 bp, Homo sapiens
tcccctcccacccacagcc

SEQ ID NO: 4348584 - DNA, 18 bp, Homo sapiens
gggcccgaacagggactt

SEQ ID NO: 4348585 - DNA, 13 bp, Homo sapiens
gggcctcctgcct

SEQ ID NO: 4348586 - DNA, 20 bp, Homo sapiens
gggcctcctgcctccgggca

SEQ ID NO: 4348587 - DNA, 22 bp, Homo sapiens
gggcctcctgcctccgggcagg

SEQ ID NO: 4348588 - DNA, 14 bp, Homo sapiens
gggctgatgaagaa

SEQ ID NO: 4348589 - DNA, 20 bp, Homo sapiens
gggctgatgaagaagggggt

SEQ ID NO: 4348590 - DNA, 24 bp, Homo sapiens
gggcttcattccggactggcagaa

SEQ ID NO: 4348591 - DNA, 13 bp, Homo sapiens
ggggcaggctggg

SEQ ID NO: 4348592 - DNA, 16 bp, Homo sapiens
ggggctgatgaagaag

SEQ ID NO: 4348593 - DNA, 22 bp, Homo sapiens
gggtggttattggactccaggc

SEQ ID NO: 4348594 - DNA, 19 bp, Homo sapiens
gggtgtggtatgagggggt

SEQ ID NO: 4348595 - DNA, 18 bp, Homo sapiens
gggttctgcagcggcaga

SEQ ID NO: 4348596 - DNA, 12 bp, Homo sapiens
ggtaaattcaga

SEQ ID NO: 4348597 - DNA, 22 bp, Homo sapiens
ggtccagctgggcctcctgcct

SEQ ID NO: 4348598 - DNA, 19 bp, Homo sapiens
ggtggcaatgcttaaacta

SEQ ID NO: 4348599 - DNA, 15 bp, Homo sapiens
ggtggtaaattcaga

SEQ ID NO: 4348600 - DNA, 20 bp, Homo sapiens
ggtggttattggactccagg

SEQ ID NO: 4348601 - DNA, 16 bp, Homo sapiens
ggtttttgatgccttt

SEQ ID NO: 4348602 - DNA, 14 bp, Homo sapiens
gtaaattcagacaa

SEQ ID NO: 4348603 - DNA, 17 bp, Homo sapiens
gtaactttactctgtgt

SEQ ID NO: 4348604 - DNA, 21 bp, Homo sapiens
gtaactttactctgtgtttaa

SEQ ID NO: 4348605 - DNA, 14 bp, Homo sapiens
gtaagacaagtggg

SEQ ID NO: 4348606 - DNA, 18 bp, Homo sapiens
gtaagttaataatgtatt

SEQ ID NO: 4348607 - DNA, 15 bp, Homo sapiens
gtaccacagacacaa

SEQ ID NO: 4348608 - DNA, 19 bp, Homo sapiens
gtagcataaataaaactga

SEQ ID NO: 4348609 - DNA, 19 bp, Homo sapiens
gtagtttggatatttttgt

SEQ ID NO: 4348610 - DNA, 20 bp, Homo sapiens
gtagtttggatatttttgta

SEQ ID NO: 4348611 - DNA, 15 bp, Homo sapiens
gtataatgtgcttta

SEQ ID NO: 4348612 - DNA, 18 bp, Homo sapiens
gtataatgtgctttattt

SEQ ID NO: 4348613 - DNA, 14 bp, Homo sapiens
gtataatgtttaaa

SEQ ID NO: 4348614 - DNA, 16 bp, Homo sapiens
gtatatcattctacag

SEQ ID NO: 4348615 - DNA, 18 bp, Homo sapiens
gtatcttggggcaagact

SEQ ID NO: 4348616 - DNA, 21 bp, Homo sapiens
gtatcttggggcaagactgca

SEQ ID NO: 4348617 - DNA, 23 bp, Homo sapiens
gtatgtcagtgctataaatgcca

SEQ ID NO: 4348618 - DNA, 18 bp, Homo sapiens
gtattcttctgtatttct

SEQ ID NO: 4348619 - DNA, 21 bp, Homo sapiens
gtattgactgtaccacagaca

SEQ ID NO: 4348620 - DNA, 18 bp, Homo sapiens
gtattttttaaaacacta

SEQ ID NO: 4348621 - DNA, 22 bp, Homo sapiens
gtattttttaaaacactaaaag

SEQ ID NO: 4348622 - DNA, 16 bp, Homo sapiens
gtcagagctgttataa

SEQ ID NO: 4348623 - DNA, 23 bp, Homo sapiens
gtcagtgctataaatgccagagc

SEQ ID NO: 4348624 - DNA, 16 bp, Homo sapiens
gtcatcaccacccttc

SEQ ID NO: 4348625 - DNA, 23 bp, Homo sapiens
gtccagctgggcctcctgcctcc

SEQ ID NO: 4348626 - DNA, 16 bp, Homo sapiens
gtctcactgttctgca

SEQ ID NO: 4348627 - DNA, 21 bp, Homo sapiens
gtctgtgtaacatccaagcca

SEQ ID NO: 4348628 - DNA, 13 bp, Homo sapiens
gtcttagagcctt

SEQ ID NO: 4348629 - DNA, 17 bp, Homo sapiens
gtcttttttctcttccc

SEQ ID NO: 4348630 - DNA, 23 bp, Homo sapiens
gtcttttttctcttcccttccca

SEQ ID NO: 4348631 - DNA, 15 bp, Homo sapiens
gtgaagggaagtggg

SEQ ID NO: 4348632 - DNA, 16 bp, Homo sapiens
gtgcagaataatggaa

SEQ ID NO: 4348633 - DNA, 21 bp, Homo sapiens
gtgctagaaaatttagccctt

SEQ ID NO: 4348634 - DNA, 16 bp, Homo sapiens
gtgctataaatgccag

SEQ ID NO: 4348635 - DNA, 19 bp, Homo sapiens
gtgctataaatgccagagc

SEQ ID NO: 4348636 - DNA, 11 bp, Homo sapiens
gtgctttattt

SEQ ID NO: 4348637 - DNA, 15 bp, Homo sapiens
gtggactctgctaga

SEQ ID NO: 4348638 - DNA, 20 bp, Homo sapiens
gtggcctgcgtcttttttct

SEQ ID NO: 4348639 - DNA, 12 bp, Homo sapiens
gtggtatgaggg

SEQ ID NO: 4348640 - DNA, 20 bp, Homo sapiens
gtggttattggactccaggc

SEQ ID NO: 4348641 - DNA, 21 bp, Homo sapiens
gtggttattggactccaggcc

SEQ ID NO: 4348642 - DNA, 20 bp, Homo sapiens
gtgtggtatgagggggtggt

SEQ ID NO: 4348643 - DNA, 21 bp, Homo sapiens
gtgtgtgtctccatgcacatg

SEQ ID NO: 4348644 - DNA, 18 bp, Homo sapiens
gtgttgttgttgctgctg

SEQ ID NO: 4348645 - DNA, 15 bp, Homo sapiens
gttaaatactgtgca

SEQ ID NO: 4348646 - DNA, 21 bp, Homo sapiens
gttaacttcaggtaaaaactt

SEQ ID NO: 4348647 - DNA, 12 bp, Homo sapiens
gttataaagtag

SEQ ID NO: 4348648 - DNA, 17 bp, Homo sapiens
gttataaatttatcaac

SEQ ID NO: 4348649 - DNA, 12 bp, Homo sapiens
gttattggactc

SEQ ID NO: 4348650 - DNA, 12 bp, Homo sapiens
gttattgttgaa

SEQ ID NO: 4348651 - DNA, 20 bp, Homo sapiens
gttcataaaacggtgctttc

SEQ ID NO: 4348652 - DNA, 18 bp, Homo sapiens
gttctcagactctttctt

SEQ ID NO: 4348653 - DNA, 18 bp, Homo sapiens
gttctgcagcggcagagc

SEQ ID NO: 4348654 - DNA, 19 bp, Homo sapiens
gttctgcagcggcagagca

SEQ ID NO: 4348655 - DNA, 19 bp, Homo sapiens
gttcttctttctctgtatt

SEQ ID NO: 4348656 - DNA, 15 bp, Homo sapiens
gttgttgctgctgtt

SEQ ID NO: 4348657 - DNA, 14 bp, Homo sapiens
gttgttgttgctgc

SEQ ID NO: 4348658 - DNA, 15 bp, Homo sapiens
gttgttgttgctgct

SEQ ID NO: 4348659 - DNA, 13 bp, Homo sapiens
gtttaaaaagtaa

SEQ ID NO: 4348660 - DNA, 14 bp, Homo sapiens
gtttaaaattcagt

SEQ ID NO: 4348661 - DNA, 20 bp, Homo sapiens
gtttacactgcggaagccaa

SEQ ID NO: 4348662 - DNA, 22 bp, Homo sapiens
gtttacactgcggaagccaaag

SEQ ID NO: 4348663 - DNA, 15 bp, Homo sapiens
gtttagagagcctgt

SEQ ID NO: 4348664 - DNA, 23 bp, Homo sapiens
gtttagagagcctgtcaccagag

SEQ ID NO: 4348665 - DNA, 21 bp, Homo sapiens
gtttgtattctacctttgtaa

SEQ ID NO: 4348666 - DNA, 13 bp, Homo sapiens
gttttatttttgc

SEQ ID NO: 4348667 - DNA, 13 bp, Homo sapiens
gttttgtgcttta

SEQ ID NO: 4348668 - DNA, 12 bp, Homo sapiens
gtttttatgaac

SEQ ID NO: 4348669 - DNA, 16 bp, Homo sapiens
gtttttatgaactgca

SEQ ID NO: 4348670 - DNA, 14 bp, Homo sapiens
gtttttgtatcttg

SEQ ID NO: 4348671 - DNA, 15 bp, Homo sapiens
taaaaagtaagttaa

SEQ ID NO: 4348672 - DNA, 14 bp, Homo sapiens
taaaacactaaaag

SEQ ID NO: 4348673 - DNA, 22 bp, Homo sapiens
taaaacggtgctttctgtgaaa

SEQ ID NO: 4348674 - DNA, 19 bp, Homo sapiens
taaaatgaacctgctactt

SEQ ID NO: 4348675 - DNA, 22 bp, Homo sapiens
taaaatggttcatattttatag

SEQ ID NO: 4348676 - DNA, 16 bp, Homo sapiens
taaaattacgtttgtt

SEQ ID NO: 4348677 - DNA, 23 bp, Homo sapiens
taaaattcagtttttgtatcttg

SEQ ID NO: 4348678 - DNA, 17 bp, Homo sapiens
taaactgaatattttgg

SEQ ID NO: 4348679 - DNA, 22 bp, Homo sapiens
taaactgaatattttggaaact

SEQ ID NO: 4348680 - DNA, 13 bp, Homo sapiens
taaataaaactga

SEQ ID NO: 4348681 - DNA, 12 bp, Homo sapiens
taaataatgaat

SEQ ID NO: 4348682 - DNA, 19 bp, Homo sapiens
taaatcatgtatgttatga

SEQ ID NO: 4348683 - DNA, 13 bp, Homo sapiens
taaatgagctttc

SEQ ID NO: 4348684 - DNA, 13 bp, Homo sapiens
taaatgccagagc

SEQ ID NO: 4348685 - DNA, 16 bp, Homo sapiens
taaatgccagagccaa

SEQ ID NO: 4348686 - DNA, 10 bp, Homo sapiens
taaattcaga

SEQ ID NO: 4348687 - DNA, 13 bp, Homo sapiens
taaattcagacaa

SEQ ID NO: 4348688 - DNA, 15 bp, Homo sapiens
taaattcagacaaca

SEQ ID NO: 4348689 - DNA, 16 bp, Homo sapiens
taaattcagacaacat

SEQ ID NO: 4348690 - DNA, 18 bp, Homo sapiens
taaattcagacaacatta

SEQ ID NO: 4348691 - DNA, 20 bp, Homo sapiens
taaattcagacaacattatg

SEQ ID NO: 4348692 - DNA, 19 bp, Homo sapiens
taaattctatgttaaatac

SEQ ID NO: 4348693 - DNA, 19 bp, Homo sapiens
taaatttggactgttttcc

SEQ ID NO: 4348694 - DNA, 22 bp, Homo sapiens
taaattttcagaattaatgcat

SEQ ID NO: 4348695 - DNA, 13 bp, Homo sapiens
taacatccaagcc

SEQ ID NO: 4348696 - DNA, 15 bp, Homo sapiens
taacatccaagccag

SEQ ID NO: 4348697 - DNA, 16 bp, Homo sapiens
taaccttatcaggatg

SEQ ID NO: 4348698 - DNA, 13 bp, Homo sapiens
taacttgtgaaga

SEQ ID NO: 4348699 - DNA, 14 bp, Homo sapiens
taagagaagaaatg

SEQ ID NO: 4348700 - DNA, 16 bp, Homo sapiens
taagagaagaaatgtt

SEQ ID NO: 4348701 - DNA, 14 bp, Homo sapiens
taagatagaaagct

SEQ ID NO: 4348702 - DNA, 15 bp, Homo sapiens
taagatagaaagctg

SEQ ID NO: 4348703 - DNA, 17 bp, Homo sapiens
taagatagaaagctgga

SEQ ID NO: 4348704 - DNA, 18 bp, Homo sapiens
taagtgggtttttatgaa

SEQ ID NO: 4348705 - DNA, 21 bp, Homo sapiens
taagtgggtttttatgaactg

SEQ ID NO: 4348706 - DNA, 13 bp, Homo sapiens
taagttaataatg

SEQ ID NO: 4348707 - DNA, 14 bp, Homo sapiens
taagttaataatgt

SEQ ID NO: 4348708 - DNA, 17 bp, Homo sapiens
taagttaataatgtatt

SEQ ID NO: 4348709 - DNA, 14 bp, Homo sapiens
taataaactttatt

SEQ ID NO: 4348710 - DNA, 17 bp, Homo sapiens
taataagtgatgtgctg

SEQ ID NO: 4348711 - DNA, 20 bp, Homo sapiens
taataatgtattgtaatctt

SEQ ID NO: 4348712 - DNA, 18 bp, Homo sapiens
taatatcatctcaatttt

SEQ ID NO: 4348713 - DNA, 13 bp, Homo sapiens
taatctgaagata

SEQ ID NO: 4348714 - DNA, 15 bp, Homo sapiens
taatgaataaactga

SEQ ID NO: 4348715 - DNA, 17 bp, Homo sapiens
taatgaataaactgaat

SEQ ID NO: 4348716 - DNA, 22 bp, Homo sapiens
taatgtctcactgttctgcaaa

SEQ ID NO: 4348717 - DNA, 15 bp, Homo sapiens
taatgtgctttattt

SEQ ID NO: 4348718 - DNA, 15 bp, Homo sapiens
taatgtttaaatcat

SEQ ID NO: 4348719 - DNA, 18 bp, Homo sapiens
gcaattccaggctgagcc

SEQ ID NO: 4348720 - DNA, 19 bp, Homo sapiens
gcaattccaggctgagcca

SEQ ID NO: 4348721 - DNA, 19 bp, Homo sapiens
gcacaaggttggttgctaa

SEQ ID NO: 4348722 - DNA, 22 bp, Homo sapiens
gcacctctggctagagccgagg

SEQ ID NO: 4348723 - DNA, 17 bp, Homo sapiens
gcagaacccccaggtgg

SEQ ID NO: 4348724 - DNA, 19 bp, Homo sapiens
gcagaagcattgcctggac

SEQ ID NO: 4348725 - DNA, 15 bp, Homo sapiens
gcagaataatggaaa

SEQ ID NO: 4348726 - DNA, 16 bp, Homo sapiens
gcagaataatggaaac

SEQ ID NO: 4348727 - DNA, 16 bp, Homo sapiens
gcagacagaaactgga

SEQ ID NO: 4348728 - DNA, 18 bp, Homo sapiens
gcagacagaaactggatt

SEQ ID NO: 4348729 - DNA, 21 bp, Homo sapiens
gcagctaagatagaaagctgg

SEQ ID NO: 4348730 - DNA, 23 bp, Homo sapiens
gcagctaagatagaaagctggac

SEQ ID NO: 4348731 - DNA, 20 bp, Homo sapiens
gcaggctgcacctctggcta

SEQ ID NO: 4348732 - DNA, 14 bp, Homo sapiens
gcaggctgggccat

SEQ ID NO: 4348733 - DNA, 23 bp, Homo sapiens
gcaggctgggccatgtccaaaga

SEQ ID NO: 4348734 - DNA, 13 bp, Homo sapiens
gcagtgactttgt

SEQ ID NO: 4348735 - DNA, 15 bp, Homo sapiens
gcagtgactttgtat

SEQ ID NO: 4348736 - DNA, 18 bp, Homo sapiens
gcataaataaaactgaat

SEQ ID NO: 4348737 - DNA, 21 bp, Homo sapiens
gcatcaagacttcaatcctga

SEQ ID NO: 4348738 - DNA, 19 bp, Homo sapiens
gcattgcctggactgacca

SEQ ID NO: 4348739 - DNA, 19 bp, Homo sapiens
gcatttgatagcaatgtaa

SEQ ID NO: 4348740 - DNA, 14 bp, Homo sapiens
gccaaaagaagttt

SEQ ID NO: 4348741 - DNA, 14 bp, Homo sapiens
gccaacctggactt

SEQ ID NO: 4348742 - DNA, 15 bp, Homo sapiens
gccaacctggacttc

SEQ ID NO: 4348743 - DNA, 19 bp, Homo sapiens
gccaacctggacttcctgt

SEQ ID NO: 4348744 - DNA, 20 bp, Homo sapiens
gccaaggccaaaagaagttt

SEQ ID NO: 4348745 - DNA, 12 bp, Homo sapiens
gccactgaggag

SEQ ID NO: 4348746 - DNA, 14 bp, Homo sapiens
gccagagccaacct

SEQ ID NO: 4348747 - DNA, 15 bp, Homo sapiens
gccagagccaacctg

SEQ ID NO: 4348748 - DNA, 18 bp, Homo sapiens
gccagagccaacctggac

SEQ ID NO: 4348749 - DNA, 19 bp, Homo sapiens
gccagagccaacctggact

SEQ ID NO: 4348750 - DNA, 20 bp, Homo sapiens
gccagagccaacctggactt

SEQ ID NO: 4348751 - DNA, 22 bp, Homo sapiens
gccagagccaacctggacttcc

SEQ ID NO: 4348752 - DNA, 20 bp, Homo sapiens
gccagagtttttaaagcctt

SEQ ID NO: 4348753 - DNA, 16 bp, Homo sapiens
gccatagacctacaga

SEQ ID NO: 4348754 - DNA, 19 bp, Homo sapiens
gccatgaggagcgtggact

SEQ ID NO: 4348755 - DNA, 14 bp, Homo sapiens
gccatgtccaaaga

SEQ ID NO: 4348756 - DNA, 13 bp, Homo sapiens
gcccaccaccctg

SEQ ID NO: 4348757 - DNA, 21 bp, Homo sapiens
gccctcggaggtccagctggg

SEQ ID NO: 4348758 - DNA, 18 bp, Homo sapiens
gccctgggtaccctgagc

SEQ ID NO: 4348759 - DNA, 16 bp, Homo sapiens
gcccttcagcccacca

SEQ ID NO: 4348760 - DNA, 20 bp, Homo sapiens
gcccttcagcccaccaccct

SEQ ID NO: 4348761 - DNA, 15 bp, Homo sapiens
gccgaggggagagag

SEQ ID NO: 4348762 - DNA, 19 bp, Homo sapiens
gccgaggggagagagggac

SEQ ID NO: 4348763 - DNA, 16 bp, Homo sapiens
gcctccgctgggcttc

SEQ ID NO: 4348764 - DNA, 13 bp, Homo sapiens
gcctgtcaccaga

SEQ ID NO: 4348765 - DNA, 14 bp, Homo sapiens
gcctgtcaccagag

SEQ ID NO: 4348766 - DNA, 17 bp, Homo sapiens
gcctgtcaccagagctt

SEQ ID NO: 4348767 - DNA, 18 bp, Homo sapiens
gcctgtcaccagagcttc

SEQ ID NO: 4348768 - DNA, 19 bp, Homo sapiens
gccttcatcctcctcccca

SEQ ID NO: 4348769 - DNA, 19 bp, Homo sapiens
gccttgctcctagcagaca

SEQ ID NO: 4348770 - DNA, 23 bp, Homo sapiens
gccttgctcctagcagacagaaa

SEQ ID NO: 4348771 - DNA, 21 bp, Homo sapiens
gcggcagagcaattccaggct

SEQ ID NO: 4348772 - DNA, 18 bp, Homo sapiens
gcgtcttttttctcttcc

SEQ ID NO: 4348773 - DNA, 19 bp, Homo sapiens
gcgtcttttttctcttccc

SEQ ID NO: 4348774 - DNA, 21 bp, Homo sapiens
gctaatattaaacctttcagt

SEQ ID NO: 4348775 - DNA, 23 bp, Homo sapiens
gctaatattaaacctttcagtac

SEQ ID NO: 4348776 - DNA, 22 bp, Homo sapiens
gctagactcctcaggagagacc

SEQ ID NO: 4348777 - DNA, 19 bp, Homo sapiens
gctataaatgccagagcca

SEQ ID NO: 4348778 - DNA, 16 bp, Homo sapiens
gctcagagcttgaaga

SEQ ID NO: 4348779 - DNA, 13 bp, Homo sapiens
gctcatggccctc

SEQ ID NO: 4348780 - DNA, 17 bp, Homo sapiens
gctcctagcagacagaa

SEQ ID NO: 4348781 - DNA, 19 bp, Homo sapiens
gctcctagcagacagaaac

SEQ ID NO: 4348782 - DNA, 23 bp, Homo sapiens
gctgagccatgaggagcgtggac

SEQ ID NO: 4348783 - DNA, 20 bp, Homo sapiens
gctgcacctctggctagagc

SEQ ID NO: 4348784 - DNA, 21 bp, Homo sapiens
gctgcacctctggctagagcc

SEQ ID NO: 4348785 - DNA, 19 bp, Homo sapiens
gctgctaatattaaacctt

SEQ ID NO: 4348786 - DNA, 20 bp, Homo sapiens
gctgctaatattaaaccttt

SEQ ID NO: 4348787 - DNA, 22 bp, Homo sapiens
gctggactgaccaaagactgca

SEQ ID NO: 4348788 - DNA, 17 bp, Homo sapiens
gctgggccatgtccaaa

SEQ ID NO: 4348789 - DNA, 20 bp, Homo sapiens
gctgggccatgtccaaagag

SEQ ID NO: 4348790 - DNA, 17 bp, Homo sapiens
gctgggcctcctgcctc

SEQ ID NO: 4348791 - DNA, 16 bp, Homo sapiens
gcttaaactaaataat

SEQ ID NO: 4348792 - DNA, 16 bp, Homo sapiens
gcttcattccggactg

SEQ ID NO: 4348793 - DNA, 20 bp, Homo sapiens
gcttgaggccaagatggctg

SEQ ID NO: 4348794 - DNA, 22 bp, Homo sapiens
gcttgaggccaagatggctgct

SEQ ID NO: 4348795 - DNA, 23 bp, Homo sapiens
gcttgaggccaagatggctgctg

SEQ ID NO: 4348796 - DNA, 13 bp, Homo sapiens
gctttctgtgaaa

SEQ ID NO: 4348797 - DNA, 21 bp, Homo sapiens
gctttctgtgaaagccttaag

SEQ ID NO: 4348798 - DNA, 13 bp, Homo sapiens
gctttttctgcca

SEQ ID NO: 4348799 - DNA, 17 bp, Homo sapiens
ggaaaaatgggagccag

SEQ ID NO: 4348800 - DNA, 17 bp, Homo sapiens
ggaaactgctaaattct

SEQ ID NO: 4348801 - DNA, 15 bp, Homo sapiens
ggaaaggcttggctg

SEQ ID NO: 4348802 - DNA, 16 bp, Homo sapiens
ggaagctttgagttga

SEQ ID NO: 4348803 - DNA, 13 bp, Homo sapiens
ggaagtggggagt

SEQ ID NO: 4348804 - DNA, 13 bp, Homo sapiens
ggactccaggcct

SEQ ID NO: 4348805 - DNA, 16 bp, Homo sapiens
ggactccaggcctgac

SEQ ID NO: 4348806 - DNA, 16 bp, Homo sapiens
ggactgaccaaagact

SEQ ID NO: 4348807 - DNA, 17 bp, Homo sapiens
ggactgaccaaagactg

SEQ ID NO: 4348808 - DNA, 14 bp, Homo sapiens
ggacttcctgtcat

SEQ ID NO: 4348809 - DNA, 18 bp, Homo sapiens
ggacttgtttagagagcc

SEQ ID NO: 4348810 - DNA, 20 bp, Homo sapiens
ggacttgtttagagagcctg

SEQ ID NO: 4348811 - DNA, 23 bp, Homo sapiens
ggagagacccctcccctcccacc

SEQ ID NO: 4348812 - DNA, 17 bp, Homo sapiens
ggagagagggactcaag

SEQ ID NO: 4348813 - DNA, 22 bp, Homo sapiens
ggagccaggagtaagacaagtg

SEQ ID NO: 4348814 - DNA, 21 bp, Homo sapiens
ggaggagaaactctagactgc

SEQ ID NO: 4348815 - DNA, 14 bp, Homo sapiens
ggaggtccagctgg

SEQ ID NO: 4348816 - DNA, 18 bp, Homo sapiens
ggaggtccagctgggcct

SEQ ID NO: 4348817 - DNA, 20 bp, Homo sapiens
ggagtaagacaagtgggatt

SEQ ID NO: 4348818 - DNA, 18 bp, Homo sapiens
ggagtatttgaacacagt

SEQ ID NO: 4348819 - DNA, 17 bp, Homo sapiens
ggcaagactgcaaactt

SEQ ID NO: 4348820 - DNA, 14 bp, Homo sapiens
ggcaagcttgaggc

SEQ ID NO: 4348821 - DNA, 21 bp, Homo sapiens
ggcaagcttgaggccaagatg

SEQ ID NO: 4348822 - DNA, 21 bp, Homo sapiens
ggcaaggtttacactgcggaa

SEQ ID NO: 4348823 - DNA, 20 bp, Homo sapiens
ggcagaagcattgcctggac

SEQ ID NO: 4348824 - DNA, 21 bp, Homo sapiens
ggcagaagcattgcctggact

SEQ ID NO: 4348825 - DNA, 17 bp, Homo sapiens
ggcagagcaattccagg

SEQ ID NO: 4348826 - DNA, 19 bp, Homo sapiens
ggcagagcaattccaggct

SEQ ID NO: 4348827 - DNA, 20 bp, Homo sapiens
ggcagagcaattccaggctg

SEQ ID NO: 4348828 - DNA, 12 bp, Homo sapiens
ggcaggctgggc

SEQ ID NO: 4348829 - DNA, 14 bp, Homo sapiens
ggccaagatggctg

SEQ ID NO: 4348830 - DNA, 16 bp, Homo sapiens
ggccaagatggctgct

SEQ ID NO: 4348831 - DNA, 17 bp, Homo sapiens
ggccaagatggctgctg

SEQ ID NO: 4348832 - DNA, 13 bp, Homo sapiens
ggccatgtccaaa

SEQ ID NO: 4348833 - DNA, 22 bp, Homo sapiens
ggccatgtccaaagaggctgcc

SEQ ID NO: 4348834 - DNA, 16 bp, Homo sapiens
ggcctgaccagggggc

SEQ ID NO: 4348835 - DNA, 23 bp, Homo sapiens
ggcctgcgtcttttttctcttcc

SEQ ID NO: 4348836 - DNA, 13 bp, Homo sapiens
ggctagagccgag

SEQ ID NO: 4348837 - DNA, 17 bp, Homo sapiens
ggctcagagcttgaaga

SEQ ID NO: 4348838 - DNA, 15 bp, Homo sapiens
ggctgagccatgagg

SEQ ID NO: 4348839 - DNA, 13 bp, Homo sapiens
ggctgatgaagaa

SEQ ID NO: 4348840 - DNA, 14 bp, Homo sapiens
ggctgatgaagaag

SEQ ID NO: 4348841 - DNA, 22 bp, Homo sapiens
ggctgatgaagaagggggtggg

SEQ ID NO: 4348842 - DNA, 15 bp, Homo sapiens
ggctgcccctctcac

SEQ ID NO: 4348843 - DNA, 12 bp, Homo sapiens
ggctgctgcctg

SEQ ID NO: 4348844 - DNA, 13 bp, Homo sapiens
ggctgctgcctgc

SEQ ID NO: 4348845 - DNA, 13 bp, Homo sapiens
gggaagtggggag

SEQ ID NO: 4348846 - DNA, 18 bp, Homo sapiens
gggacttgtttagagagc

SEQ ID NO: 4348847 - DNA, 20 bp, Homo sapiens
gggacttgtttagagagcct

SEQ ID NO: 4348848 - DNA, 21 bp, Homo sapiens
gggagaagtgatatggtgaag

SEQ ID NO: 4348849 - DNA, 14 bp, Homo sapiens
gggcaggctgggcc

SEQ ID NO: 4348850 - DNA, 16 bp, Homo sapiens
gggcaggctgggccat

SEQ ID NO: 4348851 - DNA, 23 bp, Homo sapiens
gggccatgtccaaagaggctgcc

SEQ ID NO: 4348852 - DNA, 16 bp, Homo sapiens
cttctggatccatggg

SEQ ID NO: 4348853 - DNA, 20 bp, Homo sapiens
cttctggggcaggctgggcc

SEQ ID NO: 4348854 - DNA, 15 bp, Homo sapiens
cttctgtatttctag

SEQ ID NO: 4348855 - DNA, 14 bp, Homo sapiens
cttcttattgaagt

SEQ ID NO: 4348856 - DNA, 17 bp, Homo sapiens
cttgaggccaagatggc

SEQ ID NO: 4348857 - DNA, 23 bp, Homo sapiens
cttgaggccaagatggctgctgc

SEQ ID NO: 4348858 - DNA, 19 bp, Homo sapiens
cttgatttgatgtgacttt

SEQ ID NO: 4348859 - DNA, 14 bp, Homo sapiens
cttggggcaagact

SEQ ID NO: 4348860 - DNA, 15 bp, Homo sapiens
cttggggctgatgaa

SEQ ID NO: 4348861 - DNA, 19 bp, Homo sapiens
cttggggctgatgaagaag

SEQ ID NO: 4348862 - DNA, 13 bp, Homo sapiens
cttggttctcaga

SEQ ID NO: 4348863 - DNA, 21 bp, Homo sapiens
cttgtttagagagcctgtcac

SEQ ID NO: 4348864 - DNA, 23 bp, Homo sapiens
cttgtttagagagcctgtcacca

SEQ ID NO: 4348865 - DNA, 14 bp, Homo sapiens
ctttaaaaatgcaa

SEQ ID NO: 4348866 - DNA, 18 bp, Homo sapiens
ctttacaaccatacttta

SEQ ID NO: 4348867 - DNA, 19 bp, Homo sapiens
ctttacaaccatactttat

SEQ ID NO: 4348868 - DNA, 20 bp, Homo sapiens
ctttacaaccatactttata

SEQ ID NO: 4348869 - DNA, 17 bp, Homo sapiens
ctttactctgtgtttaa

SEQ ID NO: 4348870 - DNA, 16 bp, Homo sapiens
ctttatatatgtacat

SEQ ID NO: 4348871 - DNA, 16 bp, Homo sapiens
ctttctgtgaaagcct

SEQ ID NO: 4348872 - DNA, 21 bp, Homo sapiens
ctttctgtgaaagccttaaga

SEQ ID NO: 4348873 - DNA, 21 bp, Homo sapiens
ctttgccatcaatgatcatat

SEQ ID NO: 4348874 - DNA, 15 bp, Homo sapiens
cttttcccctgttaa

SEQ ID NO: 4348875 - DNA, 16 bp, Homo sapiens
cttttgttctgcttta

SEQ ID NO: 4348876 - DNA, 22 bp, Homo sapiens
ctttttcccatctggctttttc

SEQ ID NO: 4348877 - DNA, 15 bp, Homo sapiens
cttttttctcttccc

SEQ ID NO: 4348878 - DNA, 15 bp, Homo sapiens
gaaaaatgggagcca

SEQ ID NO: 4348879 - DNA, 20 bp, Homo sapiens
gaaaatttagccctttaaaa

SEQ ID NO: 4348880 - DNA, 17 bp, Homo sapiens
gaaacattacagttcat

SEQ ID NO: 4348881 - DNA, 22 bp, Homo sapiens
gaaactctagactgcaagaact

SEQ ID NO: 4348882 - DNA, 17 bp, Homo sapiens
gaaactgctaaattcta

SEQ ID NO: 4348883 - DNA, 21 bp, Homo sapiens
gaaactgctaaattctatgtt

SEQ ID NO: 4348884 - DNA, 13 bp, Homo sapiens
gaaagctggactg

SEQ ID NO: 4348885 - DNA, 23 bp, Homo sapiens
gaaaggttttgtattttttaaaa

SEQ ID NO: 4348886 - DNA, 18 bp, Homo sapiens
gaaatgttataaagtaga

SEQ ID NO: 4348887 - DNA, 15 bp, Homo sapiens
gaacagggacttgtt

SEQ ID NO: 4348888 - DNA, 15 bp, Homo sapiens
gaacatacttcaaaa

SEQ ID NO: 4348889 - DNA, 19 bp, Homo sapiens
gaacatcgatatgtatatc

SEQ ID NO: 4348890 - DNA, 16 bp, Homo sapiens
gaaccatgcttacaaa

SEQ ID NO: 4348891 - DNA, 22 bp, Homo sapiens
gaacccccaggtggcctgcgtc

SEQ ID NO: 4348892 - DNA, 13 bp, Homo sapiens
gaactaaatataa

SEQ ID NO: 4348893 - DNA, 16 bp, Homo sapiens
gaacttctaaacactt

SEQ ID NO: 4348894 - DNA, 17 bp, Homo sapiens
gaacttctaaacacttc

SEQ ID NO: 4348895 - DNA, 19 bp, Homo sapiens
gaacttctaaacacttcat

SEQ ID NO: 4348896 - DNA, 24 bp, Homo sapiens
gaagaagggggtggggggagtttg

SEQ ID NO: 4348897 - DNA, 16 bp, Homo sapiens
gaagggaagtggggag

SEQ ID NO: 4348898 - DNA, 15 bp, Homo sapiens
gaagtatacttttcc

SEQ ID NO: 4348899 - DNA, 13 bp, Homo sapiens
gaataatggaaac

SEQ ID NO: 4348900 - DNA, 16 bp, Homo sapiens
gaataatggaaacatt

SEQ ID NO: 4348901 - DNA, 18 bp, Homo sapiens
gaatattttggaaactgc

SEQ ID NO: 4348902 - DNA, 14 bp, Homo sapiens
gaatttcttttcct

SEQ ID NO: 4348903 - DNA, 19 bp, Homo sapiens
gacaaaaaaatttaaaatt

SEQ ID NO: 4348904 - DNA, 20 bp, Homo sapiens
gacaaaaaaatttaaaatta

SEQ ID NO: 4348905 - DNA, 21 bp, Homo sapiens
gacaaaggtggtaaattcaga

SEQ ID NO: 4348906 - DNA, 22 bp, Homo sapiens
gacaaaggtggtaaattcagac

SEQ ID NO: 4348907 - DNA, 20 bp, Homo sapiens
gacaacattatgatctaata

SEQ ID NO: 4348908 - DNA, 15 bp, Homo sapiens
gacaagtgggatttg

SEQ ID NO: 4348909 - DNA, 14 bp, Homo sapiens
gacaatgaaaaatc

SEQ ID NO: 4348910 - DNA, 16 bp, Homo sapiens
gacacaatatgtatgc

SEQ ID NO: 4348911 - DNA, 22 bp, Homo sapiens
gacacaatatgtatgcttttta

SEQ ID NO: 4348912 - DNA, 23 bp, Homo sapiens
gacagaaagcctccgctgggctt

SEQ ID NO: 4348913 - DNA, 19 bp, Homo sapiens
gaccaaagactgcagaacc

SEQ ID NO: 4348914 - DNA, 15 bp, Homo sapiens
gaccaggaaaggctt

SEQ ID NO: 4348915 - DNA, 11 bp, Homo sapiens
gacctacagac

SEQ ID NO: 4348916 - DNA, 19 bp, Homo sapiens
gacctacagacctggctct

SEQ ID NO: 4348917 - DNA, 15 bp, Homo sapiens
gactacaaaatacaa

SEQ ID NO: 4348918 - DNA, 10 bp, Homo sapiens
gactccaggc

SEQ ID NO: 4348919 - DNA, 13 bp, Homo sapiens
gactccaggcctg

SEQ ID NO: 4348920 - DNA, 14 bp, Homo sapiens
gactcctcaggaga

SEQ ID NO: 4348921 - DNA, 14 bp, Homo sapiens
gactctgctagact

SEQ ID NO: 4348922 - DNA, 23 bp, Homo sapiens
gactgaccaaagactgcagaacc

SEQ ID NO: 4348923 - DNA, 19 bp, Homo sapiens
gactgcaagaactgttttt

SEQ ID NO: 4348924 - DNA, 22 bp, Homo sapiens
gactgcagaacccccaggtggc

SEQ ID NO: 4348925 - DNA, 13 bp, Homo sapiens
gactggcagaagc

SEQ ID NO: 4348926 - DNA, 14 bp, Homo sapiens
gacttcaatcctga

SEQ ID NO: 4348927 - DNA, 22 bp, Homo sapiens
gacttctgacaaaggtggtaaa

SEQ ID NO: 4348928 - DNA, 23 bp, Homo sapiens
gacttgtttagagagcctgtcac

SEQ ID NO: 4348929 - DNA, 23 bp, Homo sapiens
gactttttttggtataatgttta

SEQ ID NO: 4348930 - DNA, 16 bp, Homo sapiens
gagaaactctagactg

SEQ ID NO: 4348931 - DNA, 15 bp, Homo sapiens
gagaaatagactttg

SEQ ID NO: 4348932 - DNA, 17 bp, Homo sapiens
gagaagttctcaaagtt

SEQ ID NO: 4348933 - DNA, 18 bp, Homo sapiens
gagaagttctcaaagtta

SEQ ID NO: 4348934 - DNA, 14 bp, Homo sapiens
gagaatcccttaaa

SEQ ID NO: 4348935 - DNA, 17 bp, Homo sapiens
gagaatcccttaaaatt

SEQ ID NO: 4348936 - DNA, 13 bp, Homo sapiens
gagacagaaagcc

SEQ ID NO: 4348937 - DNA, 15 bp, Homo sapiens
gagacagaaagcctc

SEQ ID NO: 4348938 - DNA, 14 bp, Homo sapiens
gagacccctcccct

SEQ ID NO: 4348939 - DNA, 16 bp, Homo sapiens
gagcaattccaggctg

SEQ ID NO: 4348940 - DNA, 20 bp, Homo sapiens
gagcaattccaggctgagcc

SEQ ID NO: 4348941 - DNA, 15 bp, Homo sapiens
gagccaacctggact

SEQ ID NO: 4348942 - DNA, 16 bp, Homo sapiens
gagccaacctggactt

SEQ ID NO: 4348943 - DNA, 20 bp, Homo sapiens
gagccaacctggacttcctg

SEQ ID NO: 4348944 - DNA, 23 bp, Homo sapiens
gagccaacctggacttcctgtca

SEQ ID NO: 4348945 - DNA, 14 bp, Homo sapiens
gagccaggagtaag

SEQ ID NO: 4348946 - DNA, 15 bp, Homo sapiens
gagccaggagtaaga

SEQ ID NO: 4348947 - DNA, 22 bp, Homo sapiens
gagccatgaggagcgtggactc

SEQ ID NO: 4348948 - DNA, 18 bp, Homo sapiens
gagccgaggggagagagg

SEQ ID NO: 4348949 - DNA, 19 bp, Homo sapiens
gagccgaggggagagaggg

SEQ ID NO: 4348950 - DNA, 20 bp, Homo sapiens
gagccgaggggagagaggga

SEQ ID NO: 4348951 - DNA, 16 bp, Homo sapiens
gagcctgtcaccagag

SEQ ID NO: 4348952 - DNA, 18 bp, Homo sapiens
gagccttttatctgcaga

SEQ ID NO: 4348953 - DNA, 12 bp, Homo sapiens
gagcgtggactc

SEQ ID NO: 4348954 - DNA, 19 bp, Homo sapiens
gagcttctctgggctgaat

SEQ ID NO: 4348955 - DNA, 19 bp, Homo sapiens
gaggaaaaatgggagccag

SEQ ID NO: 4348956 - DNA, 14 bp, Homo sapiens
gaggccaagatggc

SEQ ID NO: 4348957 - DNA, 18 bp, Homo sapiens
gaggcccctgaggcagcc

SEQ ID NO: 4348958 - DNA, 19 bp, Homo sapiens
gaggctgcccctctcacca

SEQ ID NO: 4348959 - DNA, 21 bp, Homo sapiens
gaggtccagctgggcctcctg

SEQ ID NO: 4348960 - DNA, 21 bp, Homo sapiens
gagtttttaaagccttctgga

SEQ ID NO: 4348961 - DNA, 16 bp, Homo sapiens
gatagaaagctggact

SEQ ID NO: 4348962 - DNA, 19 bp, Homo sapiens
gatagaaagctggactgac

SEQ ID NO: 4348963 - DNA, 18 bp, Homo sapiens
gatatacaaagtgtacca

SEQ ID NO: 4348964 - DNA, 22 bp, Homo sapiens
gatatatttcacttttgttctg

SEQ ID NO: 4348965 - DNA, 13 bp, Homo sapiens
gatattgtttaaa

SEQ ID NO: 4348966 - DNA, 18 bp, Homo sapiens
gatattgtttaaaattca

SEQ ID NO: 4348967 - DNA, 19 bp, Homo sapiens
gatattgtttaaaattcag

SEQ ID NO: 4348968 - DNA, 14 bp, Homo sapiens
gatatttttgtact

SEQ ID NO: 4348969 - DNA, 17 bp, Homo sapiens
gatccatggggggagaa

SEQ ID NO: 4348970 - DNA, 13 bp, Homo sapiens
gatctaataaact

SEQ ID NO: 4348971 - DNA, 15 bp, Homo sapiens
gatctgcaggctgca

SEQ ID NO: 4348972 - DNA, 15 bp, Homo sapiens
gatgaagaagggggt

SEQ ID NO: 4348973 - DNA, 17 bp, Homo sapiens
gatgaagaagggggtgg

SEQ ID NO: 4348974 - DNA, 17 bp, Homo sapiens
gatggtggactacaaaa

SEQ ID NO: 4348975 - DNA, 11 bp, Homo sapiens
gatgtgacttt

SEQ ID NO: 4348976 - DNA, 13 bp, Homo sapiens
gatgtgacttttt

SEQ ID NO: 4348977 - DNA, 21 bp, Homo sapiens
gatgttaacttggttctcaga

SEQ ID NO: 4348978 - DNA, 17 bp, Homo sapiens
gatttgatgtgactttt

SEQ ID NO: 4348979 - DNA, 19 bp, Homo sapiens
gatttgatgtgactttttt

SEQ ID NO: 4348980 - DNA, 18 bp, Homo sapiens
gatttggggcctcaagaa

SEQ ID NO: 4348981 - DNA, 20 bp, Homo sapiens
gatttggggcctcaagaaat

SEQ ID NO: 4348982 - DNA, 14 bp, Homo sapiens
gattttaaaggcag

SEQ ID NO: 4348983 - DNA, 21 bp, Homo sapiens
gcaaaggtggcaatgcttaaa

SEQ ID NO: 4348984 - DNA, 15 bp, Homo sapiens
gcaacttcagtttta

SEQ ID NO: 4348985 - DNA, 14 bp, Homo sapiens
gcaattccaggctg

SEQ ID NO: 4348986 - DNA, 17 bp, Homo sapiens
ctaagccctttgccatc

SEQ ID NO: 4348987 - DNA, 12 bp, Homo sapiens
ctaataaacttt

SEQ ID NO: 4348988 - DNA, 14 bp, Homo sapiens
ctaataaactttat

SEQ ID NO: 4348989 - DNA, 15 bp, Homo sapiens
ctaatattaaacctt

SEQ ID NO: 4348990 - DNA, 23 bp, Homo sapiens
ctacactgtataactgttcttca

SEQ ID NO: 4348991 - DNA, 15 bp, Homo sapiens
ctacagacctggctc

SEQ ID NO: 4348992 - DNA, 17 bp, Homo sapiens
ctacagacctggctctc

SEQ ID NO: 4348993 - DNA, 21 bp, Homo sapiens
ctacagacctggctctcagag

SEQ ID NO: 4348994 - DNA, 19 bp, Homo sapiens
ctagaaaatttagcccttt

SEQ ID NO: 4348995 - DNA, 11 bp, Homo sapiens
ctagagccgag

SEQ ID NO: 4348996 - DNA, 13 bp, Homo sapiens
ctagatctgcagg

SEQ ID NO: 4348997 - DNA, 14 bp, Homo sapiens
ctagatctgcaggc

SEQ ID NO: 4348998 - DNA, 16 bp, Homo sapiens
ctagatctgcaggctg

SEQ ID NO: 4348999 - DNA, 18 bp, Homo sapiens
ctagatctgcaggctgca

SEQ ID NO: 4349000 - DNA, 16 bp, Homo sapiens
ctagcagacagaaact

SEQ ID NO: 4349001 - DNA, 17 bp, Homo sapiens
ctagcagacagaaactg

SEQ ID NO: 4349002 - DNA, 15 bp, Homo sapiens
ctagtggatgactgt

SEQ ID NO: 4349003 - DNA, 19 bp, Homo sapiens
ctataaatgccagagccaa

SEQ ID NO: 4349004 - DNA, 19 bp, Homo sapiens
ctatgttaaatactgtgca

SEQ ID NO: 4349005 - DNA, 21 bp, Homo sapiens
ctatgttaaatactgtgcaga

SEQ ID NO: 4349006 - DNA, 23 bp, Homo sapiens
ctatgttaaatactgtgcagaat

SEQ ID NO: 4349007 - DNA, 14 bp, Homo sapiens
ctattccctaactt

SEQ ID NO: 4349008 - DNA, 15 bp, Homo sapiens
ctcaaagttaattca

SEQ ID NO: 4349009 - DNA, 20 bp, Homo sapiens
ctcaagaaatatactctccc

SEQ ID NO: 4349010 - DNA, 14 bp, Homo sapiens
ctcaagggaaaggc

SEQ ID NO: 4349011 - DNA, 16 bp, Homo sapiens
ctcaattttttcaaat

SEQ ID NO: 4349012 - DNA, 16 bp, Homo sapiens
ctcactgttctgcaaa

SEQ ID NO: 4349013 - DNA, 16 bp, Homo sapiens
ctcatatcccatcctt

SEQ ID NO: 4349014 - DNA, 10 bp, Homo sapiens
ctccaggcct

SEQ ID NO: 4349015 - DNA, 15 bp, Homo sapiens
ctccaggcctgacca

SEQ ID NO: 4349016 - DNA, 19 bp, Homo sapiens
ctccaggcctgaccagggg

SEQ ID NO: 4349017 - DNA, 16 bp, Homo sapiens
ctcccacccacagcca

SEQ ID NO: 4349018 - DNA, 14 bp, Homo sapiens
ctccccagctcttc

SEQ ID NO: 4349019 - DNA, 17 bp, Homo sapiens
ctccccagctcttctct

SEQ ID NO: 4349020 - DNA, 14 bp, Homo sapiens
ctccgctgggcttc

SEQ ID NO: 4349021 - DNA, 18 bp, Homo sapiens
ctcctagcagacagaaac

SEQ ID NO: 4349022 - DNA, 21 bp, Homo sapiens
ctcctagcagacagaaactgg

SEQ ID NO: 4349023 - DNA, 23 bp, Homo sapiens
ctcctagcagacagaaactggat

SEQ ID NO: 4349024 - DNA, 21 bp, Homo sapiens
ctcctcaggagagacccctcc

SEQ ID NO: 4349025 - DNA, 12 bp, Homo sapiens
ctcctgaataaa

SEQ ID NO: 4349026 - DNA, 16 bp, Homo sapiens
ctcctgcctccgggca

SEQ ID NO: 4349027 - DNA, 17 bp, Homo sapiens
ctcgcccttcagcccac

SEQ ID NO: 4349028 - DNA, 16 bp, Homo sapiens
ctcggaggtccagctg

SEQ ID NO: 4349029 - DNA, 20 bp, Homo sapiens
ctctaattagaaatttatat

SEQ ID NO: 4349030 - DNA, 21 bp, Homo sapiens
ctctccaaagttggagcttct

SEQ ID NO: 4349031 - DNA, 13 bp, Homo sapiens
ctctgctagactc

SEQ ID NO: 4349032 - DNA, 20 bp, Homo sapiens
ctctgctagactcctcagga

SEQ ID NO: 4349033 - DNA, 21 bp, Homo sapiens
ctctgctagactcctcaggag

SEQ ID NO: 4349034 - DNA, 16 bp, Homo sapiens
ctctggctagagccga

SEQ ID NO: 4349035 - DNA, 13 bp, Homo sapiens
ctcttaatctgtg

SEQ ID NO: 4349036 - DNA, 15 bp, Homo sapiens
ctcttaatctgtgtg

SEQ ID NO: 4349037 - DNA, 12 bp, Homo sapiens
ctcttctcttcc

SEQ ID NO: 4349038 - DNA, 15 bp, Homo sapiens
ctgaatattttggaa

SEQ ID NO: 4349039 - DNA, 18 bp, Homo sapiens
ctgaatgtatgtcagtgc

SEQ ID NO: 4349040 - DNA, 16 bp, Homo sapiens
ctgacaaaggtggtaa

SEQ ID NO: 4349041 - DNA, 23 bp, Homo sapiens
ctgacaaaggtggtaaattcaga

SEQ ID NO: 4349042 - DNA, 16 bp, Homo sapiens
ctgaccaaagactgca

SEQ ID NO: 4349043 - DNA, 19 bp, Homo sapiens
ctgaccaaagactgcagaa

SEQ ID NO: 4349044 - DNA, 20 bp, Homo sapiens
ctgaccaaagactgcagaac

SEQ ID NO: 4349045 - DNA, 21 bp, Homo sapiens
ctgaccacaccaaccaggcct

SEQ ID NO: 4349046 - DNA, 16 bp, Homo sapiens
ctgagccatgaggagc

SEQ ID NO: 4349047 - DNA, 22 bp, Homo sapiens
ctgagccatgaggagcgtggac

SEQ ID NO: 4349048 - DNA, 12 bp, Homo sapiens
ctgatgaagaag

SEQ ID NO: 4349049 - DNA, 20 bp, Homo sapiens
ctgatgaagaagggggtggg

SEQ ID NO: 4349050 - DNA, 23 bp, Homo sapiens
ctgattttaaaggcagagaagtt

SEQ ID NO: 4349051 - DNA, 15 bp, Homo sapiens
ctgcaagaactgttt

SEQ ID NO: 4349052 - DNA, 17 bp, Homo sapiens
ctgcacctctggctaga

SEQ ID NO: 4349053 - DNA, 20 bp, Homo sapiens
ctgcacctctggctagagcc

SEQ ID NO: 4349054 - DNA, 20 bp, Homo sapiens
ctgcagaacccccaggtggc

SEQ ID NO: 4349055 - DNA, 18 bp, Homo sapiens
ctgcagcggcagagcaat

SEQ ID NO: 4349056 - DNA, 13 bp, Homo sapiens
ctgccactgagga

SEQ ID NO: 4349057 - DNA, 15 bp, Homo sapiens
ctgccactgaggaga

SEQ ID NO: 4349058 - DNA, 16 bp, Homo sapiens
ctgccactgaggagac

SEQ ID NO: 4349059 - DNA, 19 bp, Homo sapiens
ctgccactgaggagacaga

SEQ ID NO: 4349060 - DNA, 23 bp, Homo sapiens
ctgccactgaggagacagaaagc

SEQ ID NO: 4349061 - DNA, 15 bp, Homo sapiens
ctgcctgctcatggc

SEQ ID NO: 4349062 - DNA, 12 bp, Homo sapiens
ctgcggaagcca

SEQ ID NO: 4349063 - DNA, 16 bp, Homo sapiens
ctgcggaagccaaagg

SEQ ID NO: 4349064 - DNA, 20 bp, Homo sapiens
ctgcgtcttttttctcttcc

SEQ ID NO: 4349065 - DNA, 21 bp, Homo sapiens
ctgcgtcttttttctcttccc

SEQ ID NO: 4349066 - DNA, 22 bp, Homo sapiens
ctgctaaattctatgttaaata

SEQ ID NO: 4349067 - DNA, 13 bp, Homo sapiens
ctgctagactcct

SEQ ID NO: 4349068 - DNA, 16 bp, Homo sapiens
ctgctagactcctcag

SEQ ID NO: 4349069 - DNA, 10 bp, Homo sapiens
ctggactgac

SEQ ID NO: 4349070 - DNA, 17 bp, Homo sapiens
ctggactgaccaaagac

SEQ ID NO: 4349071 - DNA, 14 bp, Homo sapiens
ctggactgaccaca

SEQ ID NO: 4349072 - DNA, 14 bp, Homo sapiens
ctggacttcctgtc

SEQ ID NO: 4349073 - DNA, 16 bp, Homo sapiens
ctggacttcctgtcat

SEQ ID NO: 4349074 - DNA, 14 bp, Homo sapiens
ctggatccatgggg

SEQ ID NO: 4349075 - DNA, 18 bp, Homo sapiens
ctggatccatggggggag

SEQ ID NO: 4349076 - DNA, 23 bp, Homo sapiens
ctggatccatggggggagaagtg

SEQ ID NO: 4349077 - DNA, 13 bp, Homo sapiens
ctggcagaagcat

SEQ ID NO: 4349078 - DNA, 22 bp, Homo sapiens
ctggcagaagcattgcctggac

SEQ ID NO: 4349079 - DNA, 15 bp, Homo sapiens
ctggctctcagagga

SEQ ID NO: 4349080 - DNA, 15 bp, Homo sapiens
ctggctttttctgcc

SEQ ID NO: 4349081 - DNA, 18 bp, Homo sapiens
ctggctttttctgccact

SEQ ID NO: 4349082 - DNA, 22 bp, Homo sapiens
ctggctttttctgccactgagg

SEQ ID NO: 4349083 - DNA, 19 bp, Homo sapiens
ctgggccatgtccaaagag

SEQ ID NO: 4349084 - DNA, 22 bp, Homo sapiens
ctgggccatgtccaaagaggct

SEQ ID NO: 4349085 - DNA, 21 bp, Homo sapiens
ctgggcttcattccggactgg

SEQ ID NO: 4349086 - DNA, 15 bp, Homo sapiens
ctggggcaggctggg

SEQ ID NO: 4349087 - DNA, 16 bp, Homo sapiens
ctggggcaggctgggc

SEQ ID NO: 4349088 - DNA, 12 bp, Homo sapiens
ctggtgtatgca

SEQ ID NO: 4349089 - DNA, 16 bp, Homo sapiens
ctgtaccacagacaca

SEQ ID NO: 4349090 - DNA, 23 bp, Homo sapiens
ctgtaccacagacacaatatgta

SEQ ID NO: 4349091 - DNA, 13 bp, Homo sapiens
ctgtcaccagagc

SEQ ID NO: 4349092 - DNA, 19 bp, Homo sapiens
ctgtcaccagagcttctct

SEQ ID NO: 4349093 - DNA, 23 bp, Homo sapiens
ctgtcattttcacaatcttgggg

SEQ ID NO: 4349094 - DNA, 15 bp, Homo sapiens
ctgtgcagaataatg

SEQ ID NO: 4349095 - DNA, 21 bp, Homo sapiens
ctgtgcagaataatggaaaca

SEQ ID NO: 4349096 - DNA, 20 bp, Homo sapiens
ctgtgtaacatccaagccag

SEQ ID NO: 4349097 - DNA, 19 bp, Homo sapiens
ctgtgtgtatattgagaat

SEQ ID NO: 4349098 - DNA, 13 bp, Homo sapiens
ctgttaaacagta

SEQ ID NO: 4349099 - DNA, 22 bp, Homo sapiens
ctgttaaacagtagttgtattc

SEQ ID NO: 4349100 - DNA, 20 bp, Homo sapiens
ctgttgatgaagtatacttt

SEQ ID NO: 4349101 - DNA, 11 bp, Homo sapiens
ctgtttataat

SEQ ID NO: 4349102 - DNA, 21 bp, Homo sapiens
ctgtttgggttgttggtctgt

SEQ ID NO: 4349103 - DNA, 22 bp, Homo sapiens
ctgtttgggttgttggtctgtg

SEQ ID NO: 4349104 - DNA, 17 bp, Homo sapiens
cttacaaagaaagcact

SEQ ID NO: 4349105 - DNA, 22 bp, Homo sapiens
cttagagccttttatctgcaga

SEQ ID NO: 4349106 - DNA, 20 bp, Homo sapiens
cttattttatgatagtttgt

SEQ ID NO: 4349107 - DNA, 15 bp, Homo sapiens
cttcacctgttatgt

SEQ ID NO: 4349108 - DNA, 15 bp, Homo sapiens
cttcagaacttgtca

SEQ ID NO: 4349109 - DNA, 18 bp, Homo sapiens
cttcagcccaccaccctg

SEQ ID NO: 4349110 - DNA, 17 bp, Homo sapiens
cttcatcctcctcccca

SEQ ID NO: 4349111 - DNA, 14 bp, Homo sapiens
cttcattctttata

SEQ ID NO: 4349112 - DNA, 12 bp, Homo sapiens
cttcccagacca

SEQ ID NO: 4349113 - DNA, 22 bp, Homo sapiens
cttcccagaccaggaaaggctt

SEQ ID NO: 4349114 - DNA, 17 bp, Homo sapiens
cttcctagatctgcagg

SEQ ID NO: 4349115 - DNA, 21 bp, Homo sapiens
cttcctagatctgcaggctgc

SEQ ID NO: 4349116 - DNA, 21 bp, Homo sapiens
cttctgacaaaggtggtaaat

SEQ ID NO: 4349117 - DNA, 22 bp, Homo sapiens
cttctgacaaaggtggtaaatt

SEQ ID NO: 4349118 - DNA, 13 bp, Homo sapiens
cttctggatccat

SEQ ID NO: 4349119 - DNA, 14 bp, Homo sapiens
cttctggatccatg

SEQ ID NO: 4349120 - DNA, 13 bp, Homo sapiens
catcacacccatt

SEQ ID NO: 4349121 - DNA, 13 bp, Homo sapiens
catccaagccaga

SEQ ID NO: 4349122 - DNA, 15 bp, Homo sapiens
catccaagccagagt

SEQ ID NO: 4349123 - DNA, 16 bp, Homo sapiens
catccaagccagagtt

SEQ ID NO: 4349124 - DNA, 15 bp, Homo sapiens
catccttaagagaag

SEQ ID NO: 4349125 - DNA, 19 bp, Homo sapiens
catctcaattttttcaaat

SEQ ID NO: 4349126 - DNA, 20 bp, Homo sapiens
catctcaattttttcaaatg

SEQ ID NO: 4349127 - DNA, 21 bp, Homo sapiens
catctggctttttctgccact

SEQ ID NO: 4349128 - DNA, 11 bp, Homo sapiens
catctgtaaat

SEQ ID NO: 4349129 - DNA, 13 bp, Homo sapiens
catctgtaaattt

SEQ ID NO: 4349130 - DNA, 15 bp, Homo sapiens
catgaggagcgtgga

SEQ ID NO: 4349131 - DNA, 19 bp, Homo sapiens
catgaggagcgtggactct

SEQ ID NO: 4349132 - DNA, 14 bp, Homo sapiens
catgcacgccggga

SEQ ID NO: 4349133 - DNA, 23 bp, Homo sapiens
catgcttacaaagaaagcacttc

SEQ ID NO: 4349134 - DNA, 11 bp, Homo sapiens
catggggggag

SEQ ID NO: 4349135 - DNA, 16 bp, Homo sapiens
catggtcatcaccacc

SEQ ID NO: 4349136 - DNA, 13 bp, Homo sapiens
catgtatgttatg

SEQ ID NO: 4349137 - DNA, 19 bp, Homo sapiens
catgtccaaagaggctgcc

SEQ ID NO: 4349138 - DNA, 20 bp, Homo sapiens
catgtccaaagaggctgccc

SEQ ID NO: 4349139 - DNA, 15 bp, Homo sapiens
catgtgggtgagtta

SEQ ID NO: 4349140 - DNA, 21 bp, Homo sapiens
catgttctatattctttattc

SEQ ID NO: 4349141 - DNA, 11 bp, Homo sapiens
cattatgatct

SEQ ID NO: 4349142 - DNA, 16 bp, Homo sapiens
cattatgatctaataa

SEQ ID NO: 4349143 - DNA, 23 bp, Homo sapiens
cattatgatctaataaactttat

SEQ ID NO: 4349144 - DNA, 19 bp, Homo sapiens
cattccagtgctagaaaat

SEQ ID NO: 4349145 - DNA, 20 bp, Homo sapiens
cattccggactggcagaagc

SEQ ID NO: 4349146 - DNA, 21 bp, Homo sapiens
cattccggactggcagaagca

SEQ ID NO: 4349147 - DNA, 16 bp, Homo sapiens
cattctacagaataat

SEQ ID NO: 4349148 - DNA, 12 bp, Homo sapiens
cattgcctggac

SEQ ID NO: 4349149 - DNA, 19 bp, Homo sapiens
catttgagatttttggttt

SEQ ID NO: 4349150 - DNA, 21 bp, Homo sapiens
catttgagatttttggttttt

SEQ ID NO: 4349151 - DNA, 21 bp, Homo sapiens
ccaaaagaagtttaaagcatc

SEQ ID NO: 4349152 - DNA, 12 bp, Homo sapiens
ccaaagaggctg

SEQ ID NO: 4349153 - DNA, 14 bp, Homo sapiens
ccaaagaggctgcc

SEQ ID NO: 4349154 - DNA, 17 bp, Homo sapiens
ccaaagaggctgcccct

SEQ ID NO: 4349155 - DNA, 22 bp, Homo sapiens
ccaaaggcagctaagatagaaa

SEQ ID NO: 4349156 - DNA, 20 bp, Homo sapiens
ccaaccaggccttcatcctc

SEQ ID NO: 4349157 - DNA, 13 bp, Homo sapiens
ccaacctggactt

SEQ ID NO: 4349158 - DNA, 12 bp, Homo sapiens
ccaagccagagt

SEQ ID NO: 4349159 - DNA, 16 bp, Homo sapiens
ccacagccatagacct

SEQ ID NO: 4349160 - DNA, 11 bp, Homo sapiens
ccaccaccctg

SEQ ID NO: 4349161 - DNA, 18 bp, Homo sapiens
ccaccagctttatttttt

SEQ ID NO: 4349162 - DNA, 13 bp, Homo sapiens
ccacccacagcca

SEQ ID NO: 4349163 - DNA, 18 bp, Homo sapiens
ccactcctttacaaccat

SEQ ID NO: 4349164 - DNA, 11 bp, Homo sapiens
ccactgaggag

SEQ ID NO: 4349165 - DNA, 22 bp, Homo sapiens
ccagaccaggaaaggcttggct

SEQ ID NO: 4349166 - DNA, 11 bp, Homo sapiens
ccagagccaac

SEQ ID NO: 4349167 - DNA, 19 bp, Homo sapiens
ccagagccaacctggactt

SEQ ID NO: 4349168 - DNA, 23 bp, Homo sapiens
ccagagccaacctggacttcctg

SEQ ID NO: 4349169 - DNA, 18 bp, Homo sapiens
ccagagcttctctgggct

SEQ ID NO: 4349170 - DNA, 19 bp, Homo sapiens
ccagagcttctctgggctg

SEQ ID NO: 4349171 - DNA, 20 bp, Homo sapiens
ccagagcttctctgggctga

SEQ ID NO: 4349172 - DNA, 18 bp, Homo sapiens
ccagagtttttaaagcct

SEQ ID NO: 4349173 - DNA, 22 bp, Homo sapiens
ccagctcttctcttcctagatc

SEQ ID NO: 4349174 - DNA, 13 bp, Homo sapiens
ccaggaaaggctt

SEQ ID NO: 4349175 - DNA, 19 bp, Homo sapiens
ccaggaaaggcttggctgg

SEQ ID NO: 4349176 - DNA, 20 bp, Homo sapiens
ccaggaaaggcttggctggt

SEQ ID NO: 4349177 - DNA, 23 bp, Homo sapiens
ccaggccttcatcctcctcccca

SEQ ID NO: 4349178 - DNA, 20 bp, Homo sapiens
ccaggctgagccatgaggag

SEQ ID NO: 4349179 - DNA, 21 bp, Homo sapiens
ccaggctgagccatgaggagc

SEQ ID NO: 4349180 - DNA, 20 bp, Homo sapiens
ccagggcctgagcagctgga

SEQ ID NO: 4349181 - DNA, 13 bp, Homo sapiens
ccagggggcccga

SEQ ID NO: 4349182 - DNA, 20 bp, Homo sapiens
ccatagacctacagacctgg

SEQ ID NO: 4349183 - DNA, 13 bp, Homo sapiens
ccatctggctttt

SEQ ID NO: 4349184 - DNA, 16 bp, Homo sapiens
ccatctggctttttct

SEQ ID NO: 4349185 - DNA, 11 bp, Homo sapiens
ccatgaggagc

SEQ ID NO: 4349186 - DNA, 19 bp, Homo sapiens
ccatgaggagcgtggactc

SEQ ID NO: 4349187 - DNA, 19 bp, Homo sapiens
ccatgtccaaagaggctgc

SEQ ID NO: 4349188 - DNA, 23 bp, Homo sapiens
ccatgtccaaagaggctgcccct

SEQ ID NO: 4349189 - DNA, 12 bp, Homo sapiens
cccacagccata

SEQ ID NO: 4349190 - DNA, 15 bp, Homo sapiens
cccaccaccctggca

SEQ ID NO: 4349191 - DNA, 18 bp, Homo sapiens
cccacccacagccataga

SEQ ID NO: 4349192 - DNA, 19 bp, Homo sapiens
cccagctcttctcttccta

SEQ ID NO: 4349193 - DNA, 20 bp, Homo sapiens
cccaggtggcctgcgtcttt

SEQ ID NO: 4349194 - DNA, 13 bp, Homo sapiens
cccatctggcttt

SEQ ID NO: 4349195 - DNA, 17 bp, Homo sapiens
ccccagctcttctcttc

SEQ ID NO: 4349196 - DNA, 18 bp, Homo sapiens
ccccagctcttctcttcc

SEQ ID NO: 4349197 - DNA, 16 bp, Homo sapiens
ccctgaggcagcccag

SEQ ID NO: 4349198 - DNA, 17 bp, Homo sapiens
ccctgaggcagcccagc

SEQ ID NO: 4349199 - DNA, 15 bp, Homo sapiens
ccctgggtaccctga

SEQ ID NO: 4349200 - DNA, 13 bp, Homo sapiens
ccctgttaaacag

SEQ ID NO: 4349201 - DNA, 11 bp, Homo sapiens
cccttaaaatt

SEQ ID NO: 4349202 - DNA, 16 bp, Homo sapiens
cccttcccagaccagg

SEQ ID NO: 4349203 - DNA, 14 bp, Homo sapiens
ccgaacagggactt

SEQ ID NO: 4349204 - DNA, 20 bp, Homo sapiens
ccgaggggagagagggactc

SEQ ID NO: 4349205 - DNA, 22 bp, Homo sapiens
ccgaggggagagagggactcaa

SEQ ID NO: 4349206 - DNA, 23 bp, Homo sapiens
ccgctgggcttcattccggactg

SEQ ID NO: 4349207 - DNA, 22 bp, Homo sapiens
ccgggttctgcagcggcagagc

SEQ ID NO: 4349208 - DNA, 23 bp, Homo sapiens
ccgggttctgcagcggcagagca

SEQ ID NO: 4349209 - DNA, 15 bp, Homo sapiens
cctaacttgtgaaga

SEQ ID NO: 4349210 - DNA, 15 bp, Homo sapiens
cctacagacctggct

SEQ ID NO: 4349211 - DNA, 18 bp, Homo sapiens
cctagatctgcaggctgc

SEQ ID NO: 4349212 - DNA, 22 bp, Homo sapiens
cctagatctgcaggctgcacct

SEQ ID NO: 4349213 - DNA, 18 bp, Homo sapiens
cctagtggatgactgttg

SEQ ID NO: 4349214 - DNA, 20 bp, Homo sapiens
cctagtggatgactgttgat

SEQ ID NO: 4349215 - DNA, 22 bp, Homo sapiens
cctccccagctcttctcttcct

SEQ ID NO: 4349216 - DNA, 14 bp, Homo sapiens
cctccgctgggctt

SEQ ID NO: 4349217 - DNA, 21 bp, Homo sapiens
cctccgctgggcttcattccg

SEQ ID NO: 4349218 - DNA, 19 bp, Homo sapiens
cctcgcccttcagcccacc

SEQ ID NO: 4349219 - DNA, 19 bp, Homo sapiens
cctcggaggtccagctggg

SEQ ID NO: 4349220 - DNA, 20 bp, Homo sapiens
cctcggaggtccagctgggc

SEQ ID NO: 4349221 - DNA, 21 bp, Homo sapiens
cctcggaggtccagctgggcc

SEQ ID NO: 4349222 - DNA, 14 bp, Homo sapiens
cctcttcagaactt

SEQ ID NO: 4349223 - DNA, 12 bp, Homo sapiens
cctgaccagggg

SEQ ID NO: 4349224 - DNA, 12 bp, Homo sapiens
cctggactgacc

SEQ ID NO: 4349225 - DNA, 14 bp, Homo sapiens
cctggacttcctgt

SEQ ID NO: 4349226 - DNA, 22 bp, Homo sapiens
cctggccaccatggtcatcacc

SEQ ID NO: 4349227 - DNA, 14 bp, Homo sapiens
cctggctctcagag

SEQ ID NO: 4349228 - DNA, 14 bp, Homo sapiens
cctgtcaccagagc

SEQ ID NO: 4349229 - DNA, 15 bp, Homo sapiens
cctgtcaccagagct

SEQ ID NO: 4349230 - DNA, 14 bp, Homo sapiens
cctgttaaacagta

SEQ ID NO: 4349231 - DNA, 18 bp, Homo sapiens
cctgtttataatctgaag

SEQ ID NO: 4349232 - DNA, 19 bp, Homo sapiens
cctgtttataatctgaaga

SEQ ID NO: 4349233 - DNA, 20 bp, Homo sapiens
ccttaagagaagaaatgtta

SEQ ID NO: 4349234 - DNA, 23 bp, Homo sapiens
ccttagtgatgtgtgtgtgtctc

SEQ ID NO: 4349235 - DNA, 13 bp, Homo sapiens
ccttcagcccacc

SEQ ID NO: 4349236 - DNA, 18 bp, Homo sapiens
ccttccagggcctgagca

SEQ ID NO: 4349237 - DNA, 13 bp, Homo sapiens
ccttcccagacca

SEQ ID NO: 4349238 - DNA, 18 bp, Homo sapiens
ccttctggatccatgggg

SEQ ID NO: 4349239 - DNA, 17 bp, Homo sapiens
ccttttatctgcagaac

SEQ ID NO: 4349240 - DNA, 15 bp, Homo sapiens
cgaacagggacttgt

SEQ ID NO: 4349241 - DNA, 14 bp, Homo sapiens
cgaggggagagagg

SEQ ID NO: 4349242 - DNA, 18 bp, Homo sapiens
cgctgggcttcattccgg

SEQ ID NO: 4349243 - DNA, 16 bp, Homo sapiens
cggaggtccagctggg

SEQ ID NO: 4349244 - DNA, 21 bp, Homo sapiens
cggcagagcaattccaggctg

SEQ ID NO: 4349245 - DNA, 18 bp, Homo sapiens
cggtggttttgtgcttta

SEQ ID NO: 4349246 - DNA, 19 bp, Homo sapiens
cgtcttttttctcttccct

SEQ ID NO: 4349247 - DNA, 16 bp, Homo sapiens
ctaaataatgaataaa

SEQ ID NO: 4349248 - DNA, 13 bp, Homo sapiens
ctaaatataaatt

SEQ ID NO: 4349249 - DNA, 20 bp, Homo sapiens
ctaaatataaattttcagaa

SEQ ID NO: 4349250 - DNA, 15 bp, Homo sapiens
ctaaatcatttgaga

SEQ ID NO: 4349251 - DNA, 14 bp, Homo sapiens
ctaaattctatgtt

SEQ ID NO: 4349252 - DNA, 20 bp, Homo sapiens
ctaagatagaaagctggact

SEQ ID NO: 4349253 - DNA, 22 bp, Homo sapiens
ctaagatagaaagctggactga

SEQ ID NO: 4349254 - DNA, 15 bp, Homo sapiens
caaaatattttttgc

SEQ ID NO: 4349255 - DNA, 16 bp, Homo sapiens
caaaatattttttgca

SEQ ID NO: 4349256 - DNA, 12 bp, Homo sapiens
caaagaggctgc

SEQ ID NO: 4349257 - DNA, 23 bp, Homo sapiens
caaagaggctgcccctctcacca

SEQ ID NO: 4349258 - DNA, 17 bp, Homo sapiens
caaagcaatcggacata

SEQ ID NO: 4349259 - DNA, 11 bp, Homo sapiens
caaaggcagct

SEQ ID NO: 4349260 - DNA, 16 bp, Homo sapiens
caaaggtggtaaattc

SEQ ID NO: 4349261 - DNA, 19 bp, Homo sapiens
caaaggtggtaaattcaga

SEQ ID NO: 4349262 - DNA, 21 bp, Homo sapiens
caaaggtggtaaattcagaca

SEQ ID NO: 4349263 - DNA, 19 bp, Homo sapiens
caaatcacccactccttta

SEQ ID NO: 4349264 - DNA, 23 bp, Homo sapiens
caaatcacccactcctttacaac

SEQ ID NO: 4349265 - DNA, 22 bp, Homo sapiens
caacattatgatctaataaact

SEQ ID NO: 4349266 - DNA, 20 bp, Homo sapiens
caacttcagttttatttttg

SEQ ID NO: 4349267 - DNA, 14 bp, Homo sapiens
caagactgcaaact

SEQ ID NO: 4349268 - DNA, 16 bp, Homo sapiens
caagactgcaaacttt

SEQ ID NO: 4349269 - DNA, 18 bp, Homo sapiens
caagactgcaaacttttt

SEQ ID NO: 4349270 - DNA, 23 bp, Homo sapiens
caagactgcaaacttttttatat

SEQ ID NO: 4349271 - DNA, 20 bp, Homo sapiens
caagagtaactttactctgt

SEQ ID NO: 4349272 - DNA, 18 bp, Homo sapiens
caagatggctgctgcctg

SEQ ID NO: 4349273 - DNA, 13 bp, Homo sapiens
caagatgggtccc

SEQ ID NO: 4349274 - DNA, 23 bp, Homo sapiens
caagccagagtttttaaagcctt

SEQ ID NO: 4349275 - DNA, 14 bp, Homo sapiens
caagcttgaggcca

SEQ ID NO: 4349276 - DNA, 15 bp, Homo sapiens
caagcttgaggccaa

SEQ ID NO: 4349277 - DNA, 18 bp, Homo sapiens
caagggaaaggcaagctt

SEQ ID NO: 4349278 - DNA, 18 bp, Homo sapiens
caaggtttacactgcgga

SEQ ID NO: 4349279 - DNA, 21 bp, Homo sapiens
caaggtttacactgcggaagc

SEQ ID NO: 4349280 - DNA, 20 bp, Homo sapiens
caagtgagatagcttcccca

SEQ ID NO: 4349281 - DNA, 14 bp, Homo sapiens
caatatgtatgctt

SEQ ID NO: 4349282 - DNA, 17 bp, Homo sapiens
caatatgtatgcttttt

SEQ ID NO: 4349283 - DNA, 21 bp, Homo sapiens
caatatgtatgctttttacct

SEQ ID NO: 4349284 - DNA, 22 bp, Homo sapiens
caatatgtatgctttttaccta

SEQ ID NO: 4349285 - DNA, 15 bp, Homo sapiens
caatcctgtttataa

SEQ ID NO: 4349286 - DNA, 17 bp, Homo sapiens
caatcttggggctgatg

SEQ ID NO: 4349287 - DNA, 19 bp, Homo sapiens
caatcttggggctgatgaa

SEQ ID NO: 4349288 - DNA, 20 bp, Homo sapiens
caatgcttaaactaaataat

SEQ ID NO: 4349289 - DNA, 13 bp, Homo sapiens
caattccaggctg

SEQ ID NO: 4349290 - DNA, 19 bp, Homo sapiens
caattccaggctgagccat

SEQ ID NO: 4349291 - DNA, 22 bp, Homo sapiens
caattgacataggcaataataa

SEQ ID NO: 4349292 - DNA, 18 bp, Homo sapiens
caattggcagtgactttg

SEQ ID NO: 4349293 - DNA, 13 bp, Homo sapiens
caattttttcaaa

SEQ ID NO: 4349294 - DNA, 14 bp, Homo sapiens
cacaatatgtatgc

SEQ ID NO: 4349295 - DNA, 23 bp, Homo sapiens
cacaatcttggggctgatgaaga

SEQ ID NO: 4349296 - DNA, 18 bp, Homo sapiens
cacaccaaccaggccttc

SEQ ID NO: 4349297 - DNA, 19 bp, Homo sapiens
cacatcacacccatttaaa

SEQ ID NO: 4349298 - DNA, 13 bp, Homo sapiens
caccaaccaggcc

SEQ ID NO: 4349299 - DNA, 14 bp, Homo sapiens
caccaaccaggcct

SEQ ID NO: 4349300 - DNA, 21 bp, Homo sapiens
caccaaccaggccttcatcct

SEQ ID NO: 4349301 - DNA, 14 bp, Homo sapiens
caccagagcttctc

SEQ ID NO: 4349302 - DNA, 16 bp, Homo sapiens
caccagagcttctctg

SEQ ID NO: 4349303 - DNA, 22 bp, Homo sapiens
caccatggtcatcaccaccctt

SEQ ID NO: 4349304 - DNA, 17 bp, Homo sapiens
cacctatgttattttgt

SEQ ID NO: 4349305 - DNA, 20 bp, Homo sapiens
cacctctggctagagccgag

SEQ ID NO: 4349306 - DNA, 16 bp, Homo sapiens
cacctgttatgtatga

SEQ ID NO: 4349307 - DNA, 20 bp, Homo sapiens
cactacgtgttcacaggctg

SEQ ID NO: 4349308 - DNA, 19 bp, Homo sapiens
cactgaggagacagaaagc

SEQ ID NO: 4349309 - DNA, 20 bp, Homo sapiens
cactgaggagacagaaagcc

SEQ ID NO: 4349310 - DNA, 11 bp, Homo sapiens
cactgttctgc

SEQ ID NO: 4349311 - DNA, 14 bp, Homo sapiens
cactgttctgcaaa

SEQ ID NO: 4349312 - DNA, 15 bp, Homo sapiens
cactgttctgcaaag

SEQ ID NO: 4349313 - DNA, 14 bp, Homo sapiens
cacttttgttctgc

SEQ ID NO: 4349314 - DNA, 15 bp, Homo sapiens
cacttttgttctgct

SEQ ID NO: 4349315 - DNA, 18 bp, Homo sapiens
cacttttgttctgcttta

SEQ ID NO: 4349316 - DNA, 22 bp, Homo sapiens
cagaaactggattaaaacaatt

SEQ ID NO: 4349317 - DNA, 18 bp, Homo sapiens
cagaaatatttagtatct

SEQ ID NO: 4349318 - DNA, 20 bp, Homo sapiens
cagaacatcgatatgtatat

SEQ ID NO: 4349319 - DNA, 16 bp, Homo sapiens
cagaacccccaggtgg

SEQ ID NO: 4349320 - DNA, 15 bp, Homo sapiens
cagaagcattgcctg

SEQ ID NO: 4349321 - DNA, 18 bp, Homo sapiens
cagaagcattgcctggac

SEQ ID NO: 4349322 - DNA, 19 bp, Homo sapiens
cagaagcattgcctggact

SEQ ID NO: 4349323 - DNA, 20 bp, Homo sapiens
cagaagcattgcctggactg

SEQ ID NO: 4349324 - DNA, 23 bp, Homo sapiens
cagaagcattgcctggactgacc

SEQ ID NO: 4349325 - DNA, 22 bp, Homo sapiens
cagaataatccagtattgctga

SEQ ID NO: 4349326 - DNA, 16 bp, Homo sapiens
cagaataatggaaaca

SEQ ID NO: 4349327 - DNA, 19 bp, Homo sapiens
cagacaaaaaaatttaaaa

SEQ ID NO: 4349328 - DNA, 22 bp, Homo sapiens
cagacaacattatgatctaata

SEQ ID NO: 4349329 - DNA, 18 bp, Homo sapiens
cagacacaatatgtatgc

SEQ ID NO: 4349330 - DNA, 14 bp, Homo sapiens
cagacagaaactgg

SEQ ID NO: 4349331 - DNA, 12 bp, Homo sapiens
cagacctggctc

SEQ ID NO: 4349332 - DNA, 23 bp, Homo sapiens
cagagaagttctcaaagttaatt

SEQ ID NO: 4349333 - DNA, 20 bp, Homo sapiens
cagagatggagaaatagact

SEQ ID NO: 4349334 - DNA, 16 bp, Homo sapiens
cagagcaattccaggc

SEQ ID NO: 4349335 - DNA, 21 bp, Homo sapiens
cagagcaattccaggctgagc

SEQ ID NO: 4349336 - DNA, 11 bp, Homo sapiens
cagagccaacc

SEQ ID NO: 4349337 - DNA, 13 bp, Homo sapiens
cagagccaacctg

SEQ ID NO: 4349338 - DNA, 19 bp, Homo sapiens
cagagccaacctggacttc

SEQ ID NO: 4349339 - DNA, 16 bp, Homo sapiens
cagagcttctctgggc

SEQ ID NO: 4349340 - DNA, 15 bp, Homo sapiens
cagagcttgaagatt

SEQ ID NO: 4349341 - DNA, 20 bp, Homo sapiens
cagagtcttcactaaccttt

SEQ ID NO: 4349342 - DNA, 13 bp, Homo sapiens
cagagtttttaaa

SEQ ID NO: 4349343 - DNA, 17 bp, Homo sapiens
cagagtttttaaagcct

SEQ ID NO: 4349344 - DNA, 18 bp, Homo sapiens
cagagtttttaaagcctt

SEQ ID NO: 4349345 - DNA, 23 bp, Homo sapiens
cagagtttttaaagccttctgga

SEQ ID NO: 4349346 - DNA, 17 bp, Homo sapiens
cagatgtattgactgta

SEQ ID NO: 4349347 - DNA, 19 bp, Homo sapiens
cagatgtattgactgtacc

SEQ ID NO: 4349348 - DNA, 20 bp, Homo sapiens
cagatttttatgttttgaaa

SEQ ID NO: 4349349 - DNA, 21 bp, Homo sapiens
cagccatagacctacagacct

SEQ ID NO: 4349350 - DNA, 15 bp, Homo sapiens
cagcccaccaccctg

SEQ ID NO: 4349351 - DNA, 19 bp, Homo sapiens
cagcctatagatgatgatg

SEQ ID NO: 4349352 - DNA, 19 bp, Homo sapiens
cagctaaatcatttgagat

SEQ ID NO: 4349353 - DNA, 21 bp, Homo sapiens
cagctaagatagaaagctgga

SEQ ID NO: 4349354 - DNA, 14 bp, Homo sapiens
cagctcatgtgtac

SEQ ID NO: 4349355 - DNA, 18 bp, Homo sapiens
cagctcttctcttcctag

SEQ ID NO: 4349356 - DNA, 18 bp, Homo sapiens
cagctgggcctcctgcct

SEQ ID NO: 4349357 - DNA, 20 bp, Homo sapiens
cagctgggcctcctgcctcc

SEQ ID NO: 4349358 - DNA, 22 bp, Homo sapiens
cagctgggcctcctgcctccgg

SEQ ID NO: 4349359 - DNA, 13 bp, Homo sapiens
caggcagaaatat

SEQ ID NO: 4349360 - DNA, 15 bp, Homo sapiens
caggcatggctcaga

SEQ ID NO: 4349361 - DNA, 16 bp, Homo sapiens
caggcatggctcagag

SEQ ID NO: 4349362 - DNA, 14 bp, Homo sapiens
caggcctgaccagg

SEQ ID NO: 4349363 - DNA, 18 bp, Homo sapiens
caggccttcatcctcctc

SEQ ID NO: 4349364 - DNA, 14 bp, Homo sapiens
caggctgagccatg

SEQ ID NO: 4349365 - DNA, 18 bp, Homo sapiens
caggctgagccatgagga

SEQ ID NO: 4349366 - DNA, 13 bp, Homo sapiens
caggctgcacctc

SEQ ID NO: 4349367 - DNA, 18 bp, Homo sapiens
caggctgcacctctggct

SEQ ID NO: 4349368 - DNA, 20 bp, Homo sapiens
caggctgcacctctggctag

SEQ ID NO: 4349369 - DNA, 22 bp, Homo sapiens
caggctgggccatgtccaaaga

SEQ ID NO: 4349370 - DNA, 19 bp, Homo sapiens
cagggacttgtttagagag

SEQ ID NO: 4349371 - DNA, 23 bp, Homo sapiens
cagggacttgtttagagagcctg

SEQ ID NO: 4349372 - DNA, 21 bp, Homo sapiens
cagggggcccgaacagggact

SEQ ID NO: 4349373 - DNA, 20 bp, Homo sapiens
cagggtgtggtatgaggggg

SEQ ID NO: 4349374 - DNA, 16 bp, Homo sapiens
cagtattgctgatttt

SEQ ID NO: 4349375 - DNA, 14 bp, Homo sapiens
cagtgactttgtat

SEQ ID NO: 4349376 - DNA, 22 bp, Homo sapiens
cagtgactttgtatagagaatt

SEQ ID NO: 4349377 - DNA, 14 bp, Homo sapiens
cagtgctagaaaat

SEQ ID NO: 4349378 - DNA, 16 bp, Homo sapiens
cagtgctataaatgcc

SEQ ID NO: 4349379 - DNA, 17 bp, Homo sapiens
cagtgctataaatgcca

SEQ ID NO: 4349380 - DNA, 14 bp, Homo sapiens
cagtttttgtatct

SEQ ID NO: 4349381 - DNA, 15 bp, Homo sapiens
cagtttttgtatctt

SEQ ID NO: 4349382 - DNA, 22 bp, Homo sapiens
cataaaacggtgctttctgtga

SEQ ID NO: 4349383 - DNA, 17 bp, Homo sapiens
cataaataaaactgaat

SEQ ID NO: 4349384 - DNA, 17 bp, Homo sapiens
catacaagccatttact

SEQ ID NO: 4349385 - DNA, 23 bp, Homo sapiens
catactttatatatgtacataca

SEQ ID NO: 4349386 - DNA, 18 bp, Homo sapiens
catagacctacagacctg

SEQ ID NO: 4349387 - DNA, 20 bp, Homo sapiens
aaaaaactcttaatctgtgt

SEQ ID NO: 4349388 - DNA, 15 bp, Homo sapiens
aaaaatgggagccag

SEQ ID NO: 4349389 - DNA, 16 bp, Homo sapiens
aaaaatgggagccagg

SEQ ID NO: 4349390 - DNA, 14 bp, Homo sapiens
aaaacggtgctttc

SEQ ID NO: 4349391 - DNA, 16 bp, Homo sapiens
aaaactcttaatctgt

SEQ ID NO: 4349392 - DNA, 15 bp, Homo sapiens
aaaatcaggcagaaa

SEQ ID NO: 4349393 - DNA, 19 bp, Homo sapiens
aaaatgagagctgtaactg

SEQ ID NO: 4349394 - DNA, 18 bp, Homo sapiens
aaaattcagtttttgtat

SEQ ID NO: 4349395 - DNA, 14 bp, Homo sapiens
aaaatttaaaatta

SEQ ID NO: 4349396 - DNA, 16 bp, Homo sapiens
aaaatttaaaattacg

SEQ ID NO: 4349397 - DNA, 18 bp, Homo sapiens
aaaatttagccctttaaa

SEQ ID NO: 4349398 - DNA, 23 bp, Homo sapiens
aaacacattcttattaattcttc

SEQ ID NO: 4349399 - DNA, 20 bp, Homo sapiens
aaacagtagttgtattcttc

SEQ ID NO: 4349400 - DNA, 20 bp, Homo sapiens
aaactaaataatgaataaac

SEQ ID NO: 4349401 - DNA, 15 bp, Homo sapiens
aaactctagactgca

SEQ ID NO: 4349402 - DNA, 17 bp, Homo sapiens
aaactcttaatctgtgt

SEQ ID NO: 4349403 - DNA, 15 bp, Homo sapiens
aaactgctaaattct

SEQ ID NO: 4349404 - DNA, 12 bp, Homo sapiens
aaactttatttt

SEQ ID NO: 4349405 - DNA, 16 bp, Homo sapiens
aaacttttttatatct

SEQ ID NO: 4349406 - DNA, 12 bp, Homo sapiens
aaagactgcaga

SEQ ID NO: 4349407 - DNA, 14 bp, Homo sapiens
aaagaggctgcccc

SEQ ID NO: 4349408 - DNA, 18 bp, Homo sapiens
aaagaggctgcccctctc

SEQ ID NO: 4349409 - DNA, 17 bp, Homo sapiens
aaagcctccgctgggct

SEQ ID NO: 4349410 - DNA, 20 bp, Homo sapiens
aaagccttaagaagataaat

SEQ ID NO: 4349411 - DNA, 12 bp, Homo sapiens
aaagctggactg

SEQ ID NO: 4349412 - DNA, 13 bp, Homo sapiens
aaagctggactga

SEQ ID NO: 4349413 - DNA, 17 bp, Homo sapiens
aaagctggactgaccaa

SEQ ID NO: 4349414 - DNA, 22 bp, Homo sapiens
aaagctggactgaccaaagact

SEQ ID NO: 4349415 - DNA, 18 bp, Homo sapiens
aaaggcagagaagttctc

SEQ ID NO: 4349416 - DNA, 14 bp, Homo sapiens
aaaggcagctaaga

SEQ ID NO: 4349417 - DNA, 20 bp, Homo sapiens
aaaggcagctaagatagaaa

SEQ ID NO: 4349418 - DNA, 22 bp, Homo sapiens
aaaggcagctaagatagaaagc

SEQ ID NO: 4349419 - DNA, 14 bp, Homo sapiens
aaaggcttggctgg

SEQ ID NO: 4349420 - DNA, 23 bp, Homo sapiens
aaagggttgaaaatgtgtttgct

SEQ ID NO: 4349421 - DNA, 16 bp, Homo sapiens
aaaggtggcaatgctt

SEQ ID NO: 4349422 - DNA, 16 bp, Homo sapiens
aaaggtggtaaattca

SEQ ID NO: 4349423 - DNA, 13 bp, Homo sapiens
aaagtaagttaat

SEQ ID NO: 4349424 - DNA, 18 bp, Homo sapiens
aaagtaagttaataatgt

SEQ ID NO: 4349425 - DNA, 18 bp, Homo sapiens
aaagttgcagatgtattg

SEQ ID NO: 4349426 - DNA, 22 bp, Homo sapiens
aaagttgcagatgtattgactg

SEQ ID NO: 4349427 - DNA, 20 bp, Homo sapiens
aaataatttatatgcatgca

SEQ ID NO: 4349428 - DNA, 16 bp, Homo sapiens
aaatacaatcctgttt

SEQ ID NO: 4349429 - DNA, 13 bp, Homo sapiens
aaatactgtgcag

SEQ ID NO: 4349430 - DNA, 13 bp, Homo sapiens
aaatataaatttt

SEQ ID NO: 4349431 - DNA, 17 bp, Homo sapiens
aaatatactctcccaga

SEQ ID NO: 4349432 - DNA, 18 bp, Homo sapiens
aaatattttttgcaagtt

SEQ ID NO: 4349433 - DNA, 13 bp, Homo sapiens
aaatcatgtatgt

SEQ ID NO: 4349434 - DNA, 21 bp, Homo sapiens
aaatcatgtatgttatgatat

SEQ ID NO: 4349435 - DNA, 15 bp, Homo sapiens
aaatgcaatatctga

SEQ ID NO: 4349436 - DNA, 13 bp, Homo sapiens
aaatgccagagcc

SEQ ID NO: 4349437 - DNA, 19 bp, Homo sapiens
aaatgccagagccaacctg

SEQ ID NO: 4349438 - DNA, 16 bp, Homo sapiens
aaatgtggtttttgat

SEQ ID NO: 4349439 - DNA, 13 bp, Homo sapiens
aaattcagacaac

SEQ ID NO: 4349440 - DNA, 18 bp, Homo sapiens
aaattcagacaacattat

SEQ ID NO: 4349441 - DNA, 23 bp, Homo sapiens
aaattcagacaacattatgatct

SEQ ID NO: 4349442 - DNA, 16 bp, Homo sapiens
aaattcagtttttgta

SEQ ID NO: 4349443 - DNA, 19 bp, Homo sapiens
aaattcagtttttgtatct

SEQ ID NO: 4349444 - DNA, 22 bp, Homo sapiens
aaattctatgttaaatactgtg

SEQ ID NO: 4349445 - DNA, 12 bp, Homo sapiens
aaatttaaaatt

SEQ ID NO: 4349446 - DNA, 22 bp, Homo sapiens
aaatttggactgttttccttca

SEQ ID NO: 4349447 - DNA, 23 bp, Homo sapiens
aacacttcattctttatatatgg

SEQ ID NO: 4349448 - DNA, 24 bp, Homo sapiens
aacagggacttgtttagagagcct

SEQ ID NO: 4349449 - DNA, 21 bp, Homo sapiens
aacatacttcaaaaataatgt

SEQ ID NO: 4349450 - DNA, 16 bp, Homo sapiens
aacatcgatatgtata

SEQ ID NO: 4349451 - DNA, 18 bp, Homo sapiens
aacatcgatatgtatatc

SEQ ID NO: 4349452 - DNA, 18 bp, Homo sapiens
aacattacagttcataat

SEQ ID NO: 4349453 - DNA, 20 bp, Homo sapiens
aacattacagttcataatag

SEQ ID NO: 4349454 - DNA, 23 bp, Homo sapiens
aacattatgatctaataaacttt

SEQ ID NO: 4349455 - DNA, 14 bp, Homo sapiens
aaccatactttata

SEQ ID NO: 4349456 - DNA, 23 bp, Homo sapiens
aaccatactttatatatgtacat

SEQ ID NO: 4349457 - DNA, 19 bp, Homo sapiens
aacctggacttcctgtcat

SEQ ID NO: 4349458 - DNA, 13 bp, Homo sapiens
aactaaataatga

SEQ ID NO: 4349459 - DNA, 23 bp, Homo sapiens
aactaaataatgaataaactgaa

SEQ ID NO: 4349460 - DNA, 22 bp, Homo sapiens
aactctagactgcaagaactgt

SEQ ID NO: 4349461 - DNA, 18 bp, Homo sapiens
aactgaatattttggaaa

SEQ ID NO: 4349462 - DNA, 15 bp, Homo sapiens
aactgcatcaagact

SEQ ID NO: 4349463 - DNA, 16 bp, Homo sapiens
aactgcatcaagactt

SEQ ID NO: 4349464 - DNA, 17 bp, Homo sapiens
aactgcatcaagacttc

SEQ ID NO: 4349465 - DNA, 15 bp, Homo sapiens
aactgctaaattcta

SEQ ID NO: 4349466 - DNA, 14 bp, Homo sapiens
aactggattaaaac

SEQ ID NO: 4349467 - DNA, 17 bp, Homo sapiens
aacttctaaacacttca

SEQ ID NO: 4349468 - DNA, 20 bp, Homo sapiens
aacttggttctcagactctt

SEQ ID NO: 4349469 - DNA, 15 bp, Homo sapiens
aactttactctgtgt

SEQ ID NO: 4349470 - DNA, 16 bp, Homo sapiens
aactttactctgtgtt

SEQ ID NO: 4349471 - DNA, 14 bp, Homo sapiens
aagaaatgttataa

SEQ ID NO: 4349472 - DNA, 14 bp, Homo sapiens
aagaagataaatga

SEQ ID NO: 4349473 - DNA, 17 bp, Homo sapiens
aagaagggggtgggggg

SEQ ID NO: 4349474 - DNA, 21 bp, Homo sapiens
aagaggctgcccctctcacca

SEQ ID NO: 4349475 - DNA, 14 bp, Homo sapiens
aagagtaactttac

SEQ ID NO: 4349476 - DNA, 22 bp, Homo sapiens
aagatagaaagctggactgacc

SEQ ID NO: 4349477 - DNA, 15 bp, Homo sapiens
aagatggctgctgcc

SEQ ID NO: 4349478 - DNA, 19 bp, Homo sapiens
aagattaggagaaacacat

SEQ ID NO: 4349479 - DNA, 18 bp, Homo sapiens
aagcatctgtaaatttgg

SEQ ID NO: 4349480 - DNA, 14 bp, Homo sapiens
aagcattgcctgga

SEQ ID NO: 4349481 - DNA, 17 bp, Homo sapiens
aagcattgcctggactg

SEQ ID NO: 4349482 - DNA, 20 bp, Homo sapiens
aagcattgcctggactgacc

SEQ ID NO: 4349483 - DNA, 14 bp, Homo sapiens
aagccaaaggcagc

SEQ ID NO: 4349484 - DNA, 22 bp, Homo sapiens
aagccagagtttttaaagcctt

SEQ ID NO: 4349485 - DNA, 23 bp, Homo sapiens
aagccagagtttttaaagccttc

SEQ ID NO: 4349486 - DNA, 17 bp, Homo sapiens
aagccatttactttgca

SEQ ID NO: 4349487 - DNA, 19 bp, Homo sapiens
aagccatttactttgcaag

SEQ ID NO: 4349488 - DNA, 16 bp, Homo sapiens
aagcctccgctgggct

SEQ ID NO: 4349489 - DNA, 17 bp, Homo sapiens
aagcctccgctgggctt

SEQ ID NO: 4349490 - DNA, 19 bp, Homo sapiens
aagcctccgctgggcttca

SEQ ID NO: 4349491 - DNA, 13 bp, Homo sapiens
aagctggactgac

SEQ ID NO: 4349492 - DNA, 23 bp, Homo sapiens
aagctgggaacttctaaacactt

SEQ ID NO: 4349493 - DNA, 16 bp, Homo sapiens
aagctttgagttgact

SEQ ID NO: 4349494 - DNA, 20 bp, Homo sapiens
aaggatgttaacttggttct

SEQ ID NO: 4349495 - DNA, 16 bp, Homo sapiens
aaggcttggctggtgt

SEQ ID NO: 4349496 - DNA, 15 bp, Homo sapiens
aagggaagtggggag

SEQ ID NO: 4349497 - DNA, 17 bp, Homo sapiens
aagggggtggggggagt

SEQ ID NO: 4349498 - DNA, 17 bp, Homo sapiens
aaggtggtaaattcaga

SEQ ID NO: 4349499 - DNA, 12 bp, Homo sapiens
aaggttttgtat

SEQ ID NO: 4349500 - DNA, 20 bp, Homo sapiens
aaggttttgtattttttaaa

SEQ ID NO: 4349501 - DNA, 12 bp, Homo sapiens
aagtatactttt

SEQ ID NO: 4349502 - DNA, 14 bp, Homo sapiens
aagtgatatggtga

SEQ ID NO: 4349503 - DNA, 21 bp, Homo sapiens
aagtgcctataaccatgttct

SEQ ID NO: 4349504 - DNA, 17 bp, Homo sapiens
aagtgggtttttatgaa

SEQ ID NO: 4349505 - DNA, 22 bp, Homo sapiens
aagtgggtttttatgaactgca

SEQ ID NO: 4349506 - DNA, 24 bp, Homo sapiens
aagttaataatgtattgtaatctt

SEQ ID NO: 4349507 - DNA, 18 bp, Homo sapiens
aagttatttatattttgt

SEQ ID NO: 4349508 - DNA, 16 bp, Homo sapiens
aagttctcaaagttaa

SEQ ID NO: 4349509 - DNA, 16 bp, Homo sapiens
aagttgcagatgtatt

SEQ ID NO: 4349510 - DNA, 22 bp, Homo sapiens
aagttgcagatgtattgactgt

SEQ ID NO: 4349511 - DNA, 12 bp, Homo sapiens
aataaaactgaa

SEQ ID NO: 4349512 - DNA, 12 bp, Homo sapiens
aataaactgaat

SEQ ID NO: 4349513 - DNA, 22 bp, Homo sapiens
aataaactgaatattttggaaa

SEQ ID NO: 4349514 - DNA, 20 bp, Homo sapiens
aataaactttattttttaaa

SEQ ID NO: 4349515 - DNA, 19 bp, Homo sapiens
aataataagtgatgtgctg

SEQ ID NO: 4349516 - DNA, 14 bp, Homo sapiens
aataatccagtatt

SEQ ID NO: 4349517 - DNA, 13 bp, Homo sapiens
aataatggaaaca

SEQ ID NO: 4349518 - DNA, 12 bp, Homo sapiens
aataatgtattg

SEQ ID NO: 4349519 - DNA, 15 bp, Homo sapiens
aataatgtattgtaa

SEQ ID NO: 4349520 - DNA, 21 bp, Homo sapiens
aatactgtgcagaataatgga

SEQ ID NO: 4349521 - DNA, 22 bp, Homo sapiens
aatactgtgcagaataatggaa

SEQ ID NO: 4349522 - DNA, 15 bp, Homo sapiens
aataggtagtttgga

SEQ ID NO: 4349523 - DNA, 18 bp, Homo sapiens
aataggtagtttggatat

SEQ ID NO: 4349524 - DNA, 12 bp, Homo sapiens
aatattttggaa

SEQ ID NO: 4349525 - DNA, 14 bp, Homo sapiens
aatattttggaaac

SEQ ID NO: 4349526 - DNA, 13 bp, Homo sapiens
aatcatgtagttt

SEQ ID NO: 4349527 - DNA, 17 bp, Homo sapiens
aatcatgtatgttatga

SEQ ID NO: 4349528 - DNA, 12 bp, Homo sapiens
aatcatttgaga

SEQ ID NO: 4349529 - DNA, 23 bp, Homo sapiens
aatccaggactttgttaacttca

SEQ ID NO: 4349530 - DNA, 21 bp, Homo sapiens
aatccagtattgctgatttta

SEQ ID NO: 4349531 - DNA, 15 bp, Homo sapiens
aatcccttaaaatta

SEQ ID NO: 4349532 - DNA, 17 bp, Homo sapiens
aatcttggggctgatga

SEQ ID NO: 4349533 - DNA, 18 bp, Homo sapiens
aatcttggggctgatgaa

SEQ ID NO: 4349534 - DNA, 13 bp, Homo sapiens
aatgcattcaaag

SEQ ID NO: 4349535 - DNA, 18 bp, Homo sapiens
aatgcattcaaagtaata

SEQ ID NO: 4349536 - DNA, 13 bp, Homo sapiens
aatgccagagcca

SEQ ID NO: 4349537 - DNA, 15 bp, Homo sapiens
aatgccagagccaac

SEQ ID NO: 4349538 - DNA, 18 bp, Homo sapiens
aatgccagagccaacctg

SEQ ID NO: 4349539 - DNA, 19 bp, Homo sapiens
aatgccagagccaacctgg

SEQ ID NO: 4349540 - DNA, 22 bp, Homo sapiens
aatgccagagccaacctggact

SEQ ID NO: 4349541 - DNA, 13 bp, Homo sapiens
aatggaaacatta

SEQ ID NO: 4349542 - DNA, 17 bp, Homo sapiens
aatggaaacattacagt

SEQ ID NO: 4349543 - DNA, 12 bp, Homo sapiens
aatgggagccag

SEQ ID NO: 4349544 - DNA, 15 bp, Homo sapiens
aatgggagccaggag

SEQ ID NO: 4349545 - DNA, 14 bp, Homo sapiens
aatgtctcactgtt

SEQ ID NO: 4349546 - DNA, 14 bp, Homo sapiens
aatgtgctttattt

SEQ ID NO: 4349547 - DNA, 20 bp, Homo sapiens
aatgtgctttatttgcaaat

SEQ ID NO: 4349548 - DNA, 19 bp, Homo sapiens
aatgtttaaatcatgtatg

SEQ ID NO: 4349549 - DNA, 22 bp, Homo sapiens
aattacgtttgttattcctagt

SEQ ID NO: 4349550 - DNA, 20 bp, Homo sapiens
aattagaaatttatatgtca

SEQ ID NO: 4349551 - DNA, 15 bp, Homo sapiens
aattcagacaacatt

SEQ ID NO: 4349552 - DNA, 17 bp, Homo sapiens
aattcagacaacattat

SEQ ID NO: 4349553 - DNA, 16 bp, Homo sapiens
aattcagtttttgtat

SEQ ID NO: 4349554 - DNA, 19 bp, Homo sapiens
aattctatgttaaatactg

SEQ ID NO: 4349555 - DNA, 23 bp, Homo sapiens
aattctatgttaaatactgtgca

SEQ ID NO: 4349556 - DNA, 23 bp, Homo sapiens
aattcttcacctgttatgtatga

SEQ ID NO: 4349557 - DNA, 21 bp, Homo sapiens
aattgacataggcaataataa

SEQ ID NO: 4349558 - DNA, 12 bp, Homo sapiens
aatttaaaatta

SEQ ID NO: 4349559 - DNA, 18 bp, Homo sapiens
aatttagccctttaaaac

SEQ ID NO: 4349560 - DNA, 16 bp, Homo sapiens
aatttatatgcatgca

SEQ ID NO: 4349561 - DNA, 16 bp, Homo sapiens
aatttatcaactgtca

SEQ ID NO: 4349562 - DNA, 20 bp, Homo sapiens
aatttcttttccttcattca

SEQ ID NO: 4349563 - DNA, 23 bp, Homo sapiens
aattttcagaattaatgcattca

SEQ ID NO: 4349564 - DNA, 17 bp, Homo sapiens
acaaaaaaatttaaaat

SEQ ID NO: 4349565 - DNA, 11 bp, Homo sapiens
acaaaggtggt

SEQ ID NO: 4349566 - DNA, 12 bp, Homo sapiens
acaaaggtggta

SEQ ID NO: 4349567 - DNA, 16 bp, Homo sapiens
acaacattatgatcta

SEQ ID NO: 4349568 - DNA, 16 bp, Homo sapiens
acaagctgggaacttc

SEQ ID NO: 4349569 - DNA, 17 bp, Homo sapiens
acaaggttggttgctaa

SEQ ID NO: 4349570 - DNA, 13 bp, Homo sapiens
acaagttgttatt

SEQ ID NO: 4349571 - DNA, 19 bp, Homo sapiens
acaagttgttattgttgaa

SEQ ID NO: 4349572 - DNA, 15 bp, Homo sapiens
acaatcttggggctg

SEQ ID NO: 4349573 - DNA, 19 bp, Homo sapiens
acaatcttggggctgatga

SEQ ID NO: 4349574 - DNA, 12 bp, Homo sapiens
acacaatatgta

SEQ ID NO: 4349575 - DNA, 22 bp, Homo sapiens
acacagttgaattttttctaaa

SEQ ID NO: 4349576 - DNA, 15 bp, Homo sapiens
acaccaaccaggcct

SEQ ID NO: 4349577 - DNA, 13 bp, Homo sapiens
acacccatttaaa

SEQ ID NO: 4349578 - DNA, 22 bp, Homo sapiens
acacctcgcccttcagcccacc

SEQ ID NO: 4349579 - DNA, 23 bp, Homo sapiens
acactgcggaagccaaaggcagc

SEQ ID NO: 4349580 - DNA, 15 bp, Homo sapiens
acactgtataactgt

SEQ ID NO: 4349581 - DNA, 19 bp, Homo sapiens
acagaaactggattaaaac

SEQ ID NO: 4349582 - DNA, 12 bp, Homo sapiens
acagaaagcctc

SEQ ID NO: 4349583 - DNA, 22 bp, Homo sapiens
acagaaagcctccgctgggctt

SEQ ID NO: 4349584 - DNA, 11 bp, Homo sapiens
acagaataatc

SEQ ID NO: 4349585 - DNA, 17 bp, Homo sapiens
acagacacaatatgtat

SEQ ID NO: 4349586 - DNA, 19 bp, Homo sapiens
acagacacaatatgtatgc

SEQ ID NO: 4349587 - DNA, 21 bp, Homo sapiens
acagagtcttcactaaccttt

SEQ ID NO: 4349588 - DNA, 22 bp, Homo sapiens
acagccatagacctacagacct

SEQ ID NO: 4349589 - DNA, 22 bp, Homo sapiens
acagctaaatcatttgagattt

SEQ ID NO: 4349590 - DNA, 19 bp, Homo sapiens
acagctttattttaaatgt

SEQ ID NO: 4349591 - DNA, 21 bp, Homo sapiens
acagggtgtggtatgaggggg

SEQ ID NO: 4349592 - DNA, 22 bp, Homo sapiens
acagggtgtggtatgagggggt

SEQ ID NO: 4349593 - DNA, 19 bp, Homo sapiens
acagtagttgtattcttct

SEQ ID NO: 4349594 - DNA, 21 bp, Homo sapiens
acagtagttgtattcttctgt

SEQ ID NO: 4349595 - DNA, 23 bp, Homo sapiens
acagtagttgtattcttctgtat

SEQ ID NO: 4349596 - DNA, 19 bp, Homo sapiens
acatacttcaaaaataatg

SEQ ID NO: 4349597 - DNA, 18 bp, Homo sapiens
acatcacacccatttaaa

SEQ ID NO: 4349598 - DNA, 14 bp, Homo sapiens
acatccaagccaga

SEQ ID NO: 4349599 - DNA, 18 bp, Homo sapiens
acatcgatatgtatatca

SEQ ID NO: 4349600 - DNA, 23 bp, Homo sapiens
acattatgatctaataaacttta

SEQ ID NO: 4349601 - DNA, 13 bp, Homo sapiens
accaaccaggcct

SEQ ID NO: 4349602 - DNA, 24 bp, Homo sapiens
accacagacacaatatgtatgctt

SEQ ID NO: 4349603 - DNA, 19 bp, Homo sapiens
accagacaaaaaaatttaa

SEQ ID NO: 4349604 - DNA, 19 bp, Homo sapiens
accagagcttctctgggct

SEQ ID NO: 4349605 - DNA, 18 bp, Homo sapiens
accaggaaaggcttggct

SEQ ID NO: 4349606 - DNA, 14 bp, Homo sapiens
accagggacacctc

SEQ ID NO: 4349607 - DNA, 13 bp, Homo sapiens
accatactttata

SEQ ID NO: 4349608 - DNA, 13 bp, Homo sapiens
accatgttctata

SEQ ID NO: 4349609 - DNA, 12 bp, Homo sapiens
acccacagccat

SEQ ID NO: 4349610 - DNA, 15 bp, Homo sapiens
acctacagacctggc

SEQ ID NO: 4349611 - DNA, 17 bp, Homo sapiens
acctacagacctggctc

SEQ ID NO: 4349612 - DNA, 13 bp, Homo sapiens
acctgagactttc

SEQ ID NO: 4349613 - DNA, 16 bp, Homo sapiens
acctgagactttcagt

SEQ ID NO: 4349614 - DNA, 17 bp, Homo sapiens
acctgttatgtatgaag

SEQ ID NO: 4349615 - DNA, 21 bp, Homo sapiens
actaaataatgaataaactga

SEQ ID NO: 4349616 - DNA, 20 bp, Homo sapiens
actaaatataaattttcaga

SEQ ID NO: 4349617 - DNA, 14 bp, Homo sapiens
actacaaaatacaa

SEQ ID NO: 4349618 - DNA, 15 bp, Homo sapiens
actacaaaatacaat

SEQ ID NO: 4349619 - DNA, 20 bp, Homo sapiens
actacaaaatacaatcctgt

SEQ ID NO: 4349620 - DNA, 16 bp, Homo sapiens
actccaggcctgacca

SEQ ID NO: 4349621 - DNA, 17 bp, Homo sapiens
actccaggcctgaccag

SEQ ID NO: 4349622 - DNA, 16 bp, Homo sapiens
actcctcaggagagac

SEQ ID NO: 4349623 - DNA, 23 bp, Homo sapiens
actcctttacaaccatactttat

SEQ ID NO: 4349624 - DNA, 16 bp, Homo sapiens
actctacctaatgtct

SEQ ID NO: 4349625 - DNA, 18 bp, Homo sapiens
actcttaatctgtgtgta

SEQ ID NO: 4349626 - DNA, 14 bp, Homo sapiens
actgaatattttgg

SEQ ID NO: 4349627 - DNA, 18 bp, Homo sapiens
actgaccaaagactgcag

SEQ ID NO: 4349628 - DNA, 22 bp, Homo sapiens
actgaccacaccaaccaggcct

SEQ ID NO: 4349629 - DNA, 15 bp, Homo sapiens
actgaggagacagaa

SEQ ID NO: 4349630 - DNA, 19 bp, Homo sapiens
actgaggagacagaaagcc

SEQ ID NO: 4349631 - DNA, 18 bp, Homo sapiens
actgcagaacccccaggt

SEQ ID NO: 4349632 - DNA, 22 bp, Homo sapiens
actgcagaacccccaggtggcc

SEQ ID NO: 4349633 - DNA, 17 bp, Homo sapiens
actgcatcaagacttca

SEQ ID NO: 4349634 - DNA, 15 bp, Homo sapiens
actgcggaagccaaa

SEQ ID NO: 4349635 - DNA, 16 bp, Homo sapiens
actgcttattttatga

SEQ ID NO: 4349636 - DNA, 17 bp, Homo sapiens
actggattaaaacaatt

SEQ ID NO: 4349637 - DNA, 13 bp, Homo sapiens
actggcagaagca

SEQ ID NO: 4349638 - DNA, 20 bp, Homo sapiens
actgttgatgaagtatactt

SEQ ID NO: 4349639 - DNA, 19 bp, Homo sapiens
acttcaggtaaaaacttca

SEQ ID NO: 4349640 - DNA, 21 bp, Homo sapiens
acttcaggtaaaaacttcatt

SEQ ID NO: 4349641 - DNA, 15 bp, Homo sapiens
acttctgacaaaggt

SEQ ID NO: 4349642 - DNA, 20 bp, Homo sapiens
acttctgacaaaggtggtaa

SEQ ID NO: 4349643 - DNA, 15 bp, Homo sapiens
acttgatttgatgtg

SEQ ID NO: 4349644 - DNA, 18 bp, Homo sapiens
acttgatttgatgtgact

SEQ ID NO: 4349645 - DNA, 21 bp, Homo sapiens
acttgatttgatgtgactttt

SEQ ID NO: 4349646 - DNA, 21 bp, Homo sapiens
acttgtttagagagcctgtca

SEQ ID NO: 4349647 - DNA, 19 bp, Homo sapiens
actttactctgtgtttaaa

SEQ ID NO: 4349648 - DNA, 18 bp, Homo sapiens
actttatatatgtacata

SEQ ID NO: 4349649 - DNA, 17 bp, Homo sapiens
acttttcccctgttaaa

SEQ ID NO: 4349650 - DNA, 18 bp, Homo sapiens
acttttcccctgttaaac

SEQ ID NO: 4349651 - DNA, 14 bp, Homo sapiens
acttttgttctgct

SEQ ID NO: 4349652 - DNA, 16 bp, Homo sapiens
acttttgttctgcttt

SEQ ID NO: 4349653 - DNA, 19 bp, Homo sapiens
actttttttggtataatgt

SEQ ID NO: 4349654 - DNA, 15 bp, Homo sapiens
agaaaagttgcagat

SEQ ID NO: 4349655 - DNA, 20 bp, Homo sapiens
agaaaataatttatatgcat

SEQ ID NO: 4349656 - DNA, 19 bp, Homo sapiens
agaaacacattcttattaa

SEQ ID NO: 4349657 - DNA, 21 bp, Homo sapiens
agaaactggattaaaacaatt

SEQ ID NO: 4349658 - DNA, 19 bp, Homo sapiens
agaacccccaggtggcctg

SEQ ID NO: 4349659 - DNA, 18 bp, Homo sapiens
agaactaaatataaattt

SEQ ID NO: 4349660 - DNA, 15 bp, Homo sapiens
agaagcattgcctgg

SEQ ID NO: 4349661 - DNA, 16 bp, Homo sapiens
agaagcattgcctgga

SEQ ID NO: 4349662 - DNA, 18 bp, Homo sapiens
agaagcattgcctggact

SEQ ID NO: 4349663 - DNA, 20 bp, Homo sapiens
agaagcattgcctggactga

SEQ ID NO: 4349664 - DNA, 21 bp, Homo sapiens
agaagcattgcctggactgac

SEQ ID NO: 4349665 - DNA, 16 bp, Homo sapiens
agaagggggtgggggg

SEQ ID NO: 4349666 - DNA, 18 bp, Homo sapiens
agaagtgatatggtgaag

SEQ ID NO: 4349667 - DNA, 21 bp, Homo sapiens
agaagtgatatggtgaaggga

SEQ ID NO: 4349668 - DNA, 22 bp, Homo sapiens
agaagtgatatggtgaagggaa

SEQ ID NO: 4349669 - DNA, 20 bp, Homo sapiens
agaataatccagtattgctg

SEQ ID NO: 4349670 - DNA, 14 bp, Homo sapiens
agaataatggaaac

SEQ ID NO: 4349671 - DNA, 19 bp, Homo sapiens
agaatcccttaaaattacc

SEQ ID NO: 4349672 - DNA, 14 bp, Homo sapiens
agacaacattatga

SEQ ID NO: 4349673 - DNA, 17 bp, Homo sapiens
agacaacattatgatct

SEQ ID NO: 4349674 - DNA, 19 bp, Homo sapiens
agacaacattatgatctaa

SEQ ID NO: 4349675 - DNA, 21 bp, Homo sapiens
agacaacattatgatctaata

SEQ ID NO: 4349676 - DNA, 19 bp, Homo sapiens
agacacaatatgtatgctt

SEQ ID NO: 4349677 - DNA, 14 bp, Homo sapiens
agacagaaactgga

SEQ ID NO: 4349678 - DNA, 12 bp, Homo sapiens
agacagaaagcc

SEQ ID NO: 4349679 - DNA, 14 bp, Homo sapiens
agacagaaagcctc

SEQ ID NO: 4349680 - DNA, 13 bp, Homo sapiens
agaccaggaaagg

SEQ ID NO: 4349681 - DNA, 17 bp, Homo sapiens
agacctggctctcagag

SEQ ID NO: 4349682 - DNA, 13 bp, Homo sapiens
agactcctcagga

SEQ ID NO: 4349683 - DNA, 21 bp, Homo sapiens
agactgcaaacttttttatat

SEQ ID NO: 4349684 - DNA, 16 bp, Homo sapiens
agactgcaagaactgt

SEQ ID NO: 4349685 - DNA, 18 bp, Homo sapiens
agactgcaagaactgttt

SEQ ID NO: 4349686 - DNA, 13 bp, Homo sapiens
agagaagaaatgt

SEQ ID NO: 4349687 - DNA, 22 bp, Homo sapiens
agagaagaaatgttataaagta

SEQ ID NO: 4349688 - DNA, 14 bp, Homo sapiens
agagaagttctcaa

SEQ ID NO: 4349689 - DNA, 21 bp, Homo sapiens
agagagcctgtcaccagagct

SEQ ID NO: 4349690 - DNA, 22 bp, Homo sapiens
agagagggactcaagggaaagg

SEQ ID NO: 4349691 - DNA, 19 bp, Homo sapiens
agagatggagaaatagact

SEQ ID NO: 4349692 - DNA, 19 bp, Homo sapiens
agagcaattccaggctgag

SEQ ID NO: 4349693 - DNA, 14 bp, Homo sapiens
agagccaacctgga

SEQ ID NO: 4349694 - DNA, 18 bp, Homo sapiens
agagccaacctggacttc

SEQ ID NO: 4349695 - DNA, 19 bp, Homo sapiens
agagccaacctggacttcc

SEQ ID NO: 4349696 - DNA, 20 bp, Homo sapiens
agagccaacctggacttcct

SEQ ID NO: 4349697 - DNA, 21 bp, Homo sapiens
agagccaacctggacttcctg

SEQ ID NO: 4349698 - DNA, 18 bp, Homo sapiens
agagccgaggggagagag

SEQ ID NO: 4349699 - DNA, 22 bp, Homo sapiens
agagcctgtcaccagagcttct

SEQ ID NO: 4349700 - DNA, 17 bp, Homo sapiens
agagcttctctgggctg

SEQ ID NO: 4349701 - DNA, 18 bp, Homo sapiens
agagcttctctgggctga

SEQ ID NO: 4349702 - DNA, 21 bp, Homo sapiens
agagcttctctgggctgaatg

SEQ ID NO: 4349703 - DNA, 12 bp, Homo sapiens
agaggctgcccc

SEQ ID NO: 4349704 - DNA, 14 bp, Homo sapiens
agaggctgcccctc

SEQ ID NO: 4349705 - DNA, 20 bp, Homo sapiens
agaggctgcccctctcacca

SEQ ID NO: 4349706 - DNA, 18 bp, Homo sapiens
agagggactcaagggaaa

SEQ ID NO: 4349707 - DNA, 16 bp, Homo sapiens
agagtaactttactct

SEQ ID NO: 4349708 - DNA, 17 bp, Homo sapiens
agagtttttaaagcctt

SEQ ID NO: 4349709 - DNA, 12 bp, Homo sapiens
agatagaaagct

SEQ ID NO: 4349710 - DNA, 15 bp, Homo sapiens
agatagaaagctgga

SEQ ID NO: 4349711 - DNA, 22 bp, Homo sapiens
agatagaaagctggactgacca

SEQ ID NO: 4349712 - DNA, 14 bp, Homo sapiens
agatagcttcccca

SEQ ID NO: 4349713 - DNA, 14 bp, Homo sapiens
agatatatttcact

SEQ ID NO: 4349714 - DNA, 16 bp, Homo sapiens
agatatatttcacttt

SEQ ID NO: 4349715 - DNA, 16 bp, Homo sapiens
agatggctgctgcctg

SEQ ID NO: 4349716 - DNA, 16 bp, Homo sapiens
agatggtttcaattca

SEQ ID NO: 4349717 - DNA, 14 bp, Homo sapiens
agcaattccaggct

SEQ ID NO: 4349718 - DNA, 18 bp, Homo sapiens
agcaattccaggctgagc

SEQ ID NO: 4349719 - DNA, 19 bp, Homo sapiens
agcaattccaggctgagcc

SEQ ID NO: 4349720 - DNA, 16 bp, Homo sapiens
agcagacagaaactgg

SEQ ID NO: 4349721 - DNA, 17 bp, Homo sapiens
agcatctgtaaatttgg

SEQ ID NO: 4349722 - DNA, 14 bp, Homo sapiens
agcattgcctggac

SEQ ID NO: 4349723 - DNA, 18 bp, Homo sapiens
agccaaaggcagctaaga

SEQ ID NO: 4349724 - DNA, 13 bp, Homo sapiens
agccaacctggac

SEQ ID NO: 4349725 - DNA, 22 bp, Homo sapiens
agccaacctggacttcctgtca

SEQ ID NO: 4349726 - DNA, 23 bp, Homo sapiens
agccaacctggacttcctgtcat

SEQ ID NO: 4349727 - DNA, 23 bp, Homo sapiens
agccatgaggagcgtggactctg

SEQ ID NO: 4349728 - DNA, 16 bp, Homo sapiens
agcccaccaccctggc

SEQ ID NO: 4349729 - DNA, 14 bp, Homo sapiens
agccgaggggagag

SEQ ID NO: 4349730 - DNA, 13 bp, Homo sapiens
agcctgtcaccag

SEQ ID NO: 4349731 - DNA, 22 bp, Homo sapiens
agcctgtcaccagagcttctct

SEQ ID NO: 4349732 - DNA, 13 bp, Homo sapiens
agccttctggatc

SEQ ID NO: 4349733 - DNA, 18 bp, Homo sapiens
agccttctggatccatgg

SEQ ID NO: 4349734 - DNA, 14 bp, Homo sapiens
agcgtggactctgc

SEQ ID NO: 4349735 - DNA, 18 bp, Homo sapiens
agcgtggactctgctaga

SEQ ID NO: 4349736 - DNA, 17 bp, Homo sapiens
agctaaatcatttgaga

SEQ ID NO: 4349737 - DNA, 16 bp, Homo sapiens
agctaagatagaaagc

SEQ ID NO: 4349738 - DNA, 18 bp, Homo sapiens
agctaagatagaaagctg

SEQ ID NO: 4349739 - DNA, 22 bp, Homo sapiens
agctaagatagaaagctggact

SEQ ID NO: 4349740 - DNA, 23 bp, Homo sapiens
agctaagatagaaagctggactg

SEQ ID NO: 4349741 - DNA, 15 bp, Homo sapiens
agctcctgaataaag

SEQ ID NO: 4349742 - DNA, 17 bp, Homo sapiens
agctcttctcttcctag

SEQ ID NO: 4349743 - DNA, 14 bp, Homo sapiens
agctggactgacca

SEQ ID NO: 4349744 - DNA, 20 bp, Homo sapiens
agctgggcctcctgcctccg

SEQ ID NO: 4349745 - DNA, 13 bp, Homo sapiens
agcttgaggccaa

SEQ ID NO: 4349746 - DNA, 15 bp, Homo sapiens
agcttgaggccaaga

SEQ ID NO: 4349747 - DNA, 23 bp, Homo sapiens
agcttgaggccaagatggctgct

SEQ ID NO: 4349748 - DNA, 15 bp, Homo sapiens
agctttattttaaat

SEQ ID NO: 4349749 - DNA, 20 bp, Homo sapiens
aggaaaaatgggagccagga

SEQ ID NO: 4349750 - DNA, 18 bp, Homo sapiens
aggagaaacacattctta

SEQ ID NO: 4349751 - DNA, 20 bp, Homo sapiens
aggagaaactctagactgca

SEQ ID NO: 4349752 - DNA, 14 bp, Homo sapiens
aggagacagaaagc

SEQ ID NO: 4349753 - DNA, 15 bp, Homo sapiens
aggagacagaaagcc

SEQ ID NO: 4349754 - DNA, 20 bp, Homo sapiens
aggatgttaacttggttctc

SEQ ID NO: 4349755 - DNA, 18 bp, Homo sapiens
aggattctctaattagaa

SEQ ID NO: 4349756 - DNA, 22 bp, Homo sapiens
aggattctctaattagaaattt

SEQ ID NO: 4349757 - DNA, 15 bp, Homo sapiens
aggcaaaaaactctt

SEQ ID NO: 4349758 - DNA, 16 bp, Homo sapiens
aggcaaaaaactctta

SEQ ID NO: 4349759 - DNA, 18 bp, Homo sapiens
aggcaagcttgaggccaa

SEQ ID NO: 4349760 - DNA, 21 bp, Homo sapiens
aggcagcccagctcctgaata

SEQ ID NO: 4349761 - DNA, 22 bp, Homo sapiens
aggcagcccagctcctgaataa

SEQ ID NO: 4349762 - DNA, 17 bp, Homo sapiens
aggcagctaagatagaa

SEQ ID NO: 4349763 - DNA, 16 bp, Homo sapiens
aggccaagatggctgc

SEQ ID NO: 4349764 - DNA, 19 bp, Homo sapiens
aggccaagatggctgctgc

SEQ ID NO: 4349765 - DNA, 18 bp, Homo sapiens
aggccttcatcctcctcc

SEQ ID NO: 4349766 - DNA, 16 bp, Homo sapiens
aggctgagccatgagg

SEQ ID NO: 4349767 - DNA, 17 bp, Homo sapiens
aggctgagccatgagga

SEQ ID NO: 4349768 - DNA, 18 bp, Homo sapiens
aggctgagccatgaggag

SEQ ID NO: 4349769 - DNA, 17 bp, Homo sapiens
aggctgcccctctcacc

SEQ ID NO: 4349770 - DNA, 22 bp, Homo sapiens
aggctgctaatattaaaccttt

SEQ ID NO: 4349771 - DNA, 12 bp, Homo sapiens
aggctgggccat

SEQ ID NO: 4349772 - DNA, 21 bp, Homo sapiens
agggaaaggttttgtattttt

SEQ ID NO: 4349773 - DNA, 16 bp, Homo sapiens
agggacttgtttagag

SEQ ID NO: 4349774 - DNA, 21 bp, Homo sapiens
agggacttgtttagagagcct

SEQ ID NO: 4349775 - DNA, 20 bp, Homo sapiens
agggggcccgaacagggact

SEQ ID NO: 4349776 - DNA, 12 bp, Homo sapiens
agggggtggggg

SEQ ID NO: 4349777 - DNA, 20 bp, Homo sapiens
agggtgtggtatgagggggt

SEQ ID NO: 4349778 - DNA, 16 bp, Homo sapiens
aggtccagctgggcct

SEQ ID NO: 4349779 - DNA, 19 bp, Homo sapiens
aggtccagctgggcctcct

SEQ ID NO: 4349780 - DNA, 21 bp, Homo sapiens
aggtccagctgggcctcctgc

SEQ ID NO: 4349781 - DNA, 23 bp, Homo sapiens
aggtccagctgggcctcctgcct

SEQ ID NO: 4349782 - DNA, 16 bp, Homo sapiens
aggtggcaatgcttaa

SEQ ID NO: 4349783 - DNA, 17 bp, Homo sapiens
aggtggcaatgcttaaa

SEQ ID NO: 4349784 - DNA, 22 bp, Homo sapiens
aggtggcaatgcttaaactaaa

SEQ ID NO: 4349785 - DNA, 16 bp, Homo sapiens
aggtggtaaattcaga

SEQ ID NO: 4349786 - DNA, 16 bp, Homo sapiens
aggtttacactgcgga

SEQ ID NO: 4349787 - DNA, 22 bp, Homo sapiens
aggttttgtattttttaaaaca

SEQ ID NO: 4349788 - DNA, 23 bp, Homo sapiens
agtaactttactctgtgtttaaa

SEQ ID NO: 4349789 - DNA, 15 bp, Homo sapiens
agtaatatatcaaat

SEQ ID NO: 4349790 - DNA, 17 bp, Homo sapiens
agtagaaaagttgcaga

SEQ ID NO: 4349791 - DNA, 12 bp, Homo sapiens
agtattgctgat

SEQ ID NO: 4349792 - DNA, 23 bp, Homo sapiens
agtgaagatggtttcaattcaga

SEQ ID NO: 4349793 - DNA, 20 bp, Homo sapiens
agtgactttgtatagagaat

SEQ ID NO: 4349794 - DNA, 16 bp, Homo sapiens
agtgatatggtgaagg

SEQ ID NO: 4349795 - DNA, 18 bp, Homo sapiens
agtgatatggtgaaggga

SEQ ID NO: 4349796 - DNA, 21 bp, Homo sapiens
agtgatatggtgaagggaagt

SEQ ID NO: 4349797 - DNA, 13 bp, Homo sapiens
agtgctagaaaat

SEQ ID NO: 4349798 - DNA, 24 bp, Homo sapiens
agtgctagaaaatttagcccttta

SEQ ID NO: 4349799 - DNA, 22 bp, Homo sapiens
agtgctataaatgccagagcca

SEQ ID NO: 4349800 - DNA, 23 bp, Homo sapiens
agtgctataaatgccagagccaa

SEQ ID NO: 4349801 - DNA, 20 bp, Homo sapiens
agtgtctccagtcaagctct

SEQ ID NO: 4349802 - DNA, 11 bp, Homo sapiens
agttaataatg

SEQ ID NO: 4349803 - DNA, 22 bp, Homo sapiens
agttgaattttttctaaaaaga

SEQ ID NO: 4349804 - DNA, 22 bp, Homo sapiens
agttgcagatgtattgactgta

SEQ ID NO: 4349805 - DNA, 19 bp, Homo sapiens
agttgtattcttctgtatt

SEQ ID NO: 4349806 - DNA, 17 bp, Homo sapiens
agttgttattgttgaac

SEQ ID NO: 4349807 - DNA, 18 bp, Homo sapiens
agttgttattgttgaaca

SEQ ID NO: 4349808 - DNA, 19 bp, Homo sapiens
agtttaaagcatctgtaaa

SEQ ID NO: 4349809 - DNA, 23 bp, Homo sapiens
agtttaaagcatctgtaaatttg

SEQ ID NO: 4349810 - DNA, 20 bp, Homo sapiens
agtttggatatttttgtact

SEQ ID NO: 4349811 - DNA, 16 bp, Homo sapiens
agtttttaaagccttc

SEQ ID NO: 4349812 - DNA, 18 bp, Homo sapiens
agtttttaaagccttctg

SEQ ID NO: 4349813 - DNA, 23 bp, Homo sapiens
agtttttgtatcttggggcaaga

SEQ ID NO: 4349814 - DNA, 11 bp, Homo sapiens
ataaaactgaa

SEQ ID NO: 4349815 - DNA, 13 bp, Homo sapiens
ataaataaaactg

SEQ ID NO: 4349816 - DNA, 15 bp, Homo sapiens
ataaataaaactgaa

SEQ ID NO: 4349817 - DNA, 16 bp, Homo sapiens
ataaataaaactgaat

SEQ ID NO: 4349818 - DNA, 15 bp, Homo sapiens
ataaatgccagagcc

SEQ ID NO: 4349819 - DNA, 16 bp, Homo sapiens
ataaatgccagagcca

SEQ ID NO: 4349820 - DNA, 13 bp, Homo sapiens
ataaatttatcaa

SEQ ID NO: 4349821 - DNA, 16 bp, Homo sapiens
ataaatttatcaactg

SEQ ID NO: 4349822 - DNA, 19 bp, Homo sapiens
ataaatttatcaactgtca

SEQ ID NO: 4349823 - DNA, 13 bp, Homo sapiens
ataaattttcaga

SEQ ID NO: 4349824 - DNA, 16 bp, Homo sapiens
ataaattttcagaatt

SEQ ID NO: 4349825 - DNA, 22 bp, Homo sapiens
ataactgttcttcaataaaatg

SEQ ID NO: 4349826 - DNA, 20 bp, Homo sapiens
ataataggtagtttggatat

SEQ ID NO: 4349827 - DNA, 14 bp, Homo sapiens
ataatggaaacatt

SEQ ID NO: 4349828 - DNA, 21 bp, Homo sapiens
ataatggaaacattacagttc

SEQ ID NO: 4349829 - DNA, 13 bp, Homo sapiens
ataatgtgcttta

SEQ ID NO: 4349830 - DNA, 18 bp, Homo sapiens
ataatgtttaaatcatgt

SEQ ID NO: 4349831 - DNA, 22 bp, Homo sapiens
ataatgtttaaatcatgtatgt

SEQ ID NO: 4349832 - DNA, 19 bp, Homo sapiens
atacaatcctgtttataat

SEQ ID NO: 4349833 - DNA, 19 bp, Homo sapiens
atacattcatactgtagaa

SEQ ID NO: 4349834 - DNA, 18 bp, Homo sapiens
atactgcttattttatga

SEQ ID NO: 4349835 - DNA, 13 bp, Homo sapiens
atactgtgcagaa

SEQ ID NO: 4349836 - DNA, 18 bp, Homo sapiens
atacttcaaaaataatgt

SEQ ID NO: 4349837 - DNA, 13 bp, Homo sapiens
atactttatatat

SEQ ID NO: 4349838 - DNA, 22 bp, Homo sapiens
atacttttcccctgttaaacag

SEQ ID NO: 4349839 - DNA, 20 bp, Homo sapiens
atagaaagctggactgacca

SEQ ID NO: 4349840 - DNA, 16 bp, Homo sapiens
atagactttgcctttt

SEQ ID NO: 4349841 - DNA, 22 bp, Homo sapiens
atatatttcacttttgttctgc

SEQ ID NO: 4349842 - DNA, 23 bp, Homo sapiens
atatatttcacttttgttctgct

SEQ ID NO: 4349843 - DNA, 22 bp, Homo sapiens
atatcatctcaattttttcaaa

SEQ ID NO: 4349844 - DNA, 19 bp, Homo sapiens
atatcattctacagaataa

SEQ ID NO: 4349845 - DNA, 15 bp, Homo sapiens
atatctgaccaagat

SEQ ID NO: 4349846 - DNA, 13 bp, Homo sapiens
atatcttttggtt

SEQ ID NO: 4349847 - DNA, 17 bp, Homo sapiens
atatggtgaagggaagt

SEQ ID NO: 4349848 - DNA, 19 bp, Homo sapiens
atattaaacctttcagtac

SEQ ID NO: 4349849 - DNA, 15 bp, Homo sapiens
atattagtgaagatg

SEQ ID NO: 4349850 - DNA, 23 bp, Homo sapiens
atattctttattctcagtaactt

SEQ ID NO: 4349851 - DNA, 12 bp, Homo sapiens
atattgtttaaa

SEQ ID NO: 4349852 - DNA, 15 bp, Homo sapiens
atattgtttaaaatt

SEQ ID NO: 4349853 - DNA, 16 bp, Homo sapiens
atattgtttaaaattc

SEQ ID NO: 4349854 - DNA, 16 bp, Homo sapiens
atatttagtatctagt

SEQ ID NO: 4349855 - DNA, 17 bp, Homo sapiens
atattttggaaactgct

SEQ ID NO: 4349856 - DNA, 23 bp, Homo sapiens
atattttggaaactgctaaattc

SEQ ID NO: 4349857 - DNA, 10 bp, Homo sapiens
atatttttgt

SEQ ID NO: 4349858 - DNA, 12 bp, Homo sapiens
atatttttgtac

SEQ ID NO: 4349859 - DNA, 16 bp, Homo sapiens
atatttttgtacttga

SEQ ID NO: 4349860 - DNA, 17 bp, Homo sapiens
atcaaatccaggacttt

SEQ ID NO: 4349861 - DNA, 16 bp, Homo sapiens
atcaactgtcaaatat

SEQ ID NO: 4349862 - DNA, 18 bp, Homo sapiens
atcaactgtcaaatatgt

SEQ ID NO: 4349863 - DNA, 19 bp, Homo sapiens
atcaattggcagtgacttt

SEQ ID NO: 4349864 - DNA, 15 bp, Homo sapiens
atcacacccatttaa

SEQ ID NO: 4349865 - DNA, 20 bp, Homo sapiens
atcatctcaattttttcaaa

SEQ ID NO: 4349866 - DNA, 23 bp, Homo sapiens
atcatttgagatttttggttttt

SEQ ID NO: 4349867 - DNA, 20 bp, Homo sapiens
atccaaaatattttttgcaa

SEQ ID NO: 4349868 - DNA, 16 bp, Homo sapiens
atccagtattgctgat

SEQ ID NO: 4349869 - DNA, 20 bp, Homo sapiens
atccagtattgctgatttta

SEQ ID NO: 4349870 - DNA, 15 bp, Homo sapiens
atccatggggggaga

SEQ ID NO: 4349871 - DNA, 13 bp, Homo sapiens
atcccttaaaatt

SEQ ID NO: 4349872 - DNA, 14 bp, Homo sapiens
atcctcctccccag

SEQ ID NO: 4349873 - DNA, 20 bp, Homo sapiens
atcctcctccccagctcttc

SEQ ID NO: 4349874 - DNA, 22 bp, Homo sapiens
atccttaagagaagaaatgtta

SEQ ID NO: 4349875 - DNA, 14 bp, Homo sapiens
atcgatatgtatat

SEQ ID NO: 4349876 - DNA, 17 bp, Homo sapiens
atcggacatagagttgg

SEQ ID NO: 4349877 - DNA, 15 bp, Homo sapiens
atctaataaacttta

SEQ ID NO: 4349878 - DNA, 17 bp, Homo sapiens
atctcaattttttcaaa

SEQ ID NO: 4349879 - DNA, 22 bp, Homo sapiens
atctgcagaacatcgatatgta

SEQ ID NO: 4349880 - DNA, 18 bp, Homo sapiens
atctggctttttctgcca

SEQ ID NO: 4349881 - DNA, 15 bp, Homo sapiens
atcttgagaaccttt

SEQ ID NO: 4349882 - DNA, 22 bp, Homo sapiens
atcttggggcaagactgcaaac

SEQ ID NO: 4349883 - DNA, 22 bp, Homo sapiens
atcttttcataaagggttgaaa

SEQ ID NO: 4349884 - DNA, 14 bp, Homo sapiens
atcttttggttatt

SEQ ID NO: 4349885 - DNA, 22 bp, Homo sapiens
atgaaaaatcaggcagaaatat

SEQ ID NO: 4349886 - DNA, 17 bp, Homo sapiens
atgaaaggattctctaa

SEQ ID NO: 4349887 - DNA, 17 bp, Homo sapiens
atgaagaagggggtggg

SEQ ID NO: 4349888 - DNA, 17 bp, Homo sapiens
atgaaggaatcattcca

SEQ ID NO: 4349889 - DNA, 14 bp, Homo sapiens
atgaagtatacttt

SEQ ID NO: 4349890 - DNA, 16 bp, Homo sapiens
atgaagtatacttttc

SEQ ID NO: 4349891 - DNA, 15 bp, Homo sapiens
atgaataaactgaat

SEQ ID NO: 4349892 - DNA, 16 bp, Homo sapiens
atgaggagcgtggact

SEQ ID NO: 4349893 - DNA, 15 bp, Homo sapiens
atgatattgtttaaa

SEQ ID NO: 4349894 - DNA, 22 bp, Homo sapiens
atgatattgtttaaaattcagt

SEQ ID NO: 4349895 - DNA, 18 bp, Homo sapiens
atgatctaataaacttta

SEQ ID NO: 4349896 - DNA, 11 bp, Homo sapiens
atgccagagcc

SEQ ID NO: 4349897 - DNA, 12 bp, Homo sapiens
atgccagagcca

SEQ ID NO: 4349898 - DNA, 17 bp, Homo sapiens
atgccagagccaacctg

SEQ ID NO: 4349899 - DNA, 23 bp, Homo sapiens
atgccagagccaacctggacttc

SEQ ID NO: 4349900 - DNA, 19 bp, Homo sapiens
atggacagctttattttaa

SEQ ID NO: 4349901 - DNA, 22 bp, Homo sapiens
atggccctcggaggtccagctg

SEQ ID NO: 4349902 - DNA, 21 bp, Homo sapiens
atggctcagagcttgaagatt

SEQ ID NO: 4349903 - DNA, 16 bp, Homo sapiens
atggctgctgcctgct

SEQ ID NO: 4349904 - DNA, 18 bp, Homo sapiens
atggctgctgcctgctca

SEQ ID NO: 4349905 - DNA, 11 bp, Homo sapiens
atgggagccag

SEQ ID NO: 4349906 - DNA, 13 bp, Homo sapiens
atgggagccagga

SEQ ID NO: 4349907 - DNA, 12 bp, Homo sapiens
atggggggagaa

SEQ ID NO: 4349908 - DNA, 21 bp, Homo sapiens
atgtatatcattctacagaat

SEQ ID NO: 4349909 - DNA, 21 bp, Homo sapiens
atgtatgaaggaatcattcca

SEQ ID NO: 4349910 - DNA, 15 bp, Homo sapiens
atgtatgctttttac

SEQ ID NO: 4349911 - DNA, 17 bp, Homo sapiens
atgtattgtaatctttc

SEQ ID NO: 4349912 - DNA, 12 bp, Homo sapiens
atgtccaaagag

SEQ ID NO: 4349913 - DNA, 20 bp, Homo sapiens
atgtccaaagaggctgcccc

SEQ ID NO: 4349914 - DNA, 21 bp, Homo sapiens
atgtccaaagaggctgcccct

SEQ ID NO: 4349915 - DNA, 16 bp, Homo sapiens
atgtctcactgttctg

SEQ ID NO: 4349916 - DNA, 18 bp, Homo sapiens
atgtctcactgttctgca

SEQ ID NO: 4349917 - DNA, 16 bp, Homo sapiens
atgtgactttttttgg

SEQ ID NO: 4349918 - DNA, 18 bp, Homo sapiens
atgtgactttttttggta

SEQ ID NO: 4349919 - DNA, 20 bp, Homo sapiens
atgtggtttttgatgccttt

SEQ ID NO: 4349920 - DNA, 18 bp, Homo sapiens
atgtgtgtgtgtctccat

SEQ ID NO: 4349921 - DNA, 19 bp, Homo sapiens
atgtgtttgggatactgct

SEQ ID NO: 4349922 - DNA, 19 bp, Homo sapiens
atgttaaatactgtgcaga

SEQ ID NO: 4349923 - DNA, 17 bp, Homo sapiens
atgttatgatattgttt

SEQ ID NO: 4349924 - DNA, 14 bp, Homo sapiens
atgtttaaatcatg

SEQ ID NO: 4349925 - DNA, 13 bp, Homo sapiens
attaatgcattca

SEQ ID NO: 4349926 - DNA, 17 bp, Homo sapiens
attaattcttcacctgt

SEQ ID NO: 4349927 - DNA, 21 bp, Homo sapiens
attagaagaaaataatttata

SEQ ID NO: 4349928 - DNA, 12 bp, Homo sapiens
attatgatctaa

SEQ ID NO: 4349929 - DNA, 13 bp, Homo sapiens
attatgatctaat

SEQ ID NO: 4349930 - DNA, 17 bp, Homo sapiens
attcagacaacattatg

SEQ ID NO: 4349931 - DNA, 19 bp, Homo sapiens
attcagtttttgtatcttg

SEQ ID NO: 4349932 - DNA, 20 bp, Homo sapiens
attcagtttttgtatcttgg

SEQ ID NO: 4349933 - DNA, 16 bp, Homo sapiens
attcatactgtagaaa

SEQ ID NO: 4349934 - DNA, 12 bp, Homo sapiens
attccaggctga

SEQ ID NO: 4349935 - DNA, 20 bp, Homo sapiens
attccagtgctagaaaattt

SEQ ID NO: 4349936 - DNA, 19 bp, Homo sapiens
attccctaacttgtgaaga

SEQ ID NO: 4349937 - DNA, 17 bp, Homo sapiens
attccggactggcagaa

SEQ ID NO: 4349938 - DNA, 19 bp, Homo sapiens
attcctagtggatgactgt

SEQ ID NO: 4349939 - DNA, 14 bp, Homo sapiens
attcctctgctgcc

SEQ ID NO: 4349940 - DNA, 18 bp, Homo sapiens
attcctctgctgccattt

SEQ ID NO: 4349941 - DNA, 16 bp, Homo sapiens
attcctgcatttgata

SEQ ID NO: 4349942 - DNA, 14 bp, Homo sapiens
attctatgttaaat

SEQ ID NO: 4349943 - DNA, 24 bp, Homo sapiens
attctatgttaaatactgtgcaga

SEQ ID NO: 4349944 - DNA, 15 bp, Homo sapiens
attctcagtaacttt

SEQ ID NO: 4349945 - DNA, 21 bp, Homo sapiens
attctctaattagaaatttat

SEQ ID NO: 4349946 - DNA, 17 bp, Homo sapiens
attcttcacctgttatg

SEQ ID NO: 4349947 - DNA, 15 bp, Homo sapiens
attcttctgtatttc

SEQ ID NO: 4349948 - DNA, 16 bp, Homo sapiens
attcttctgtatttct

SEQ ID NO: 4349949 - DNA, 19 bp, Homo sapiens
attcttctgtatttctagg

SEQ ID NO: 4349950 - DNA, 22 bp, Homo sapiens
attctttatatatggacagctt

SEQ ID NO: 4349951 - DNA, 13 bp, Homo sapiens
attgcctggactg

SEQ ID NO: 4349952 - DNA, 13 bp, Homo sapiens
attggactccagg

SEQ ID NO: 4349953 - DNA, 15 bp, Homo sapiens
attggactccaggcc

SEQ ID NO: 4349954 - DNA, 15 bp, Homo sapiens
attgtaatctttcat

SEQ ID NO: 4349955 - DNA, 14 bp, Homo sapiens
attgtttaaaattc

SEQ ID NO: 4349956 - DNA, 16 bp, Homo sapiens
attgtttaaaattcag

SEQ ID NO: 4349957 - DNA, 12 bp, Homo sapiens
atttatatgcat

SEQ ID NO: 4349958 - DNA, 17 bp, Homo sapiens
atttatcaactgtcaaa

SEQ ID NO: 4349959 - DNA, 15 bp, Homo sapiens
atttatgcactgtgg

SEQ ID NO: 4349960 - DNA, 20 bp, Homo sapiens
atttctattccctaacttgt

SEQ ID NO: 4349961 - DNA, 19 bp, Homo sapiens
atttgaattagaagaaaat

SEQ ID NO: 4349962 - DNA, 13 bp, Homo sapiens
atttggactgttt

SEQ ID NO: 4349963 - DNA, 13 bp, Homo sapiens
attttaaatgtgg

SEQ ID NO: 4349964 - DNA, 16 bp, Homo sapiens
attttaaatgtggttt

SEQ ID NO: 4349965 - DNA, 17 bp, Homo sapiens
attttaaatgtggtttt

SEQ ID NO: 4349966 - DNA, 11 bp, Homo sapiens
attttcagaat

SEQ ID NO: 4349967 - DNA, 19 bp, Homo sapiens
attttcagaattaatgcat

SEQ ID NO: 4349968 - DNA, 16 bp, Homo sapiens
attttggaaactgcta

SEQ ID NO: 4349969 - DNA, 18 bp, Homo sapiens
attttggaaactgctaaa

SEQ ID NO: 4349970 - DNA, 21 bp, Homo sapiens
attttgtgtataatgtgcttt

SEQ ID NO: 4349971 - DNA, 22 bp, Homo sapiens
attttgtgtataatgtgcttta

SEQ ID NO: 4349972 - DNA, 14 bp, Homo sapiens
atttttgtacttga

SEQ ID NO: 4349973 - DNA, 13 bp, Homo sapiens
attttttcaaatg

SEQ ID NO: 4349974 - DNA, 17 bp, Homo sapiens
attttttttgtggttat

SEQ ID NO: 4349975 - DNA, 21 bp, Homo sapiens
attttttttttcctcttcaga

SEQ ID NO: 4349976 - DNA, 12 bp, Homo sapiens
caaaatacaatc

SEQ ID NO: 4349977 - DNA, 13 bp, Homo sapiens
caaagactgcaga

SEQ ID NO: 4349978 - DNA, 21 bp, Homo sapiens
caaaggcagctaagatagaaa

SEQ ID NO: 4349979 - DNA, 14 bp, Homo sapiens
caaaggtggtaaat

SEQ ID NO: 4349980 - DNA, 22 bp, Homo sapiens
caaagttaattcacctatgtta

SEQ ID NO: 4349981 - DNA, 16 bp, Homo sapiens
caacattatgatctaa

SEQ ID NO: 4349982 - DNA, 20 bp, Homo sapiens
caacattatgatctaataaa

SEQ ID NO: 4349983 - DNA, 23 bp, Homo sapiens
caacattatgatctaataaactt

SEQ ID NO: 4349984 - DNA, 18 bp, Homo sapiens
caaccaggccttcatcct

SEQ ID NO: 4349985 - DNA, 13 bp, Homo sapiens
caaccatacttta

SEQ ID NO: 4349986 - DNA, 14 bp, Homo sapiens
caaccatactttat

SEQ ID NO: 4349987 - DNA, 12 bp, Homo sapiens
caacctggactt

SEQ ID NO: 4349988 - DNA, 16 bp, Homo sapiens
caacctggacttcctg

SEQ ID NO: 4349989 - DNA, 17 bp, Homo sapiens
caacctggacttcctgt

SEQ ID NO: 4349990 - DNA, 15 bp, Homo sapiens
caacttcagttttat

SEQ ID NO: 4349991 - DNA, 20 bp, Homo sapiens
caagaaatatactctcccag

SEQ ID NO: 4349992 - DNA, 13 bp, Homo sapiens
caagactgcaaac

SEQ ID NO: 4349993 - DNA, 16 bp, Homo sapiens
caagatggctgctgcc

SEQ ID NO: 4349994 - DNA, 19 bp, Homo sapiens
caagatggctgctgcctgc

SEQ ID NO: 4349995 - DNA, 22 bp, Homo sapiens
caagattcgccaatctcataca

SEQ ID NO: 4349996 - DNA, 14 bp, Homo sapiens
caagccagagtttt

SEQ ID NO: 4349997 - DNA, 21 bp, Homo sapiens
caagccagagtttttaaagcc

SEQ ID NO: 4349998 - DNA, 21 bp, Homo sapiens
caagttatattagtgaagatg

SEQ ID NO: 4349999 - DNA, 17 bp, Homo sapiens
caagttgttattgttga

SEQ ID NO: 4350000 - DNA, 20 bp, Homo sapiens
caagttgttattgttgaaca

SEQ ID NO: 4350001 - DNA, 18 bp, Homo sapiens
caataaaatggttcatat

SEQ ID NO: 4350002 - DNA, 12 bp, Homo sapiens
caatatgtatgc

SEQ ID NO: 4350003 - DNA, 20 bp, Homo sapiens
caatcttggggctgatgaag

SEQ ID NO: 4350004 - DNA, 21 bp, Homo sapiens
caatcttggggctgatgaaga

SEQ ID NO: 4350005 - DNA, 16 bp, Homo sapiens
caatgcttaaactaaa

SEQ ID NO: 4350006 - DNA, 19 bp, Homo sapiens
caattcagattgtcttgca

SEQ ID NO: 4350007 - DNA, 15 bp, Homo sapiens
caattccaggctgag

SEQ ID NO: 4350008 - DNA, 20 bp, Homo sapiens
caattccaggctgagccatg

SEQ ID NO: 4350009 - DNA, 15 bp, Homo sapiens
cacaccaaccaggcc

SEQ ID NO: 4350010 - DNA, 16 bp, Homo sapiens
cacaccaaccaggcct

SEQ ID NO: 4350011 - DNA, 17 bp, Homo sapiens
cacaccaaccaggcctt

SEQ ID NO: 4350012 - DNA, 19 bp, Homo sapiens
caccaaccaggccttcatc

SEQ ID NO: 4350013 - DNA, 13 bp, Homo sapiens
caccacccttcca

SEQ ID NO: 4350014 - DNA, 15 bp, Homo sapiens
caccagagcttctct

SEQ ID NO: 4350015 - DNA, 14 bp, Homo sapiens
caccatggtcatca

SEQ ID NO: 4350016 - DNA, 19 bp, Homo sapiens
caccatggtcatcaccacc

SEQ ID NO: 4350017 - DNA, 12 bp, Homo sapiens
cacccatttaaa

SEQ ID NO: 4350018 - DNA, 17 bp, Homo sapiens
cacctctggctagagcc

SEQ ID NO: 4350019 - DNA, 18 bp, Homo sapiens
cacctctggctagagccg

SEQ ID NO: 4350020 - DNA, 21 bp, Homo sapiens
cacctctggctagagccgagg

SEQ ID NO: 4350021 - DNA, 15 bp, Homo sapiens
cacctgttatgtatg

SEQ ID NO: 4350022 - DNA, 11 bp, Homo sapiens
cactctaccta

SEQ ID NO: 4350023 - DNA, 16 bp, Homo sapiens
cactgcggaagccaaa

SEQ ID NO: 4350024 - DNA, 17 bp, Homo sapiens
cactgcggaagccaaag

SEQ ID NO: 4350025 - DNA, 19 bp, Homo sapiens
cactgcggaagccaaaggc

SEQ ID NO: 4350026 - DNA, 19 bp, Homo sapiens
cagaaactggattaaaaca

SEQ ID NO: 4350027 - DNA, 11 bp, Homo sapiens
cagaaagcctc

SEQ ID NO: 4350028 - DNA, 20 bp, Homo sapiens
cagaaagcctccgctgggct

SEQ ID NO: 4350029 - DNA, 21 bp, Homo sapiens
cagaaagcctccgctgggctt

SEQ ID NO: 4350030 - DNA, 9 bp, Homo sapiens
cagaacttg

SEQ ID NO: 4350031 - DNA, 21 bp, Homo sapiens
cagaagcattgcctggactga

SEQ ID NO: 4350032 - DNA, 12 bp, Homo sapiens
cagaataatgga

SEQ ID NO: 4350033 - DNA, 19 bp, Homo sapiens
cagaataatggaaacatta

SEQ ID NO: 4350034 - DNA, 17 bp, Homo sapiens
cagaattaatgcattca

SEQ ID NO: 4350035 - DNA, 19 bp, Homo sapiens
cagacaacattatgatcta

SEQ ID NO: 4350036 - DNA, 16 bp, Homo sapiens
cagacacaatatgtat

SEQ ID NO: 4350037 - DNA, 17 bp, Homo sapiens
cagacacaatatgtatg

SEQ ID NO: 4350038 - DNA, 19 bp, Homo sapiens
cagacacaatatgtatgct

SEQ ID NO: 4350039 - DNA, 13 bp, Homo sapiens
cagaccaggaaag

SEQ ID NO: 4350040 - DNA, 17 bp, Homo sapiens
cagaccaggaaaggctt

SEQ ID NO: 4350041 - DNA, 20 bp, Homo sapiens
cagaccaggaaaggcttggc

SEQ ID NO: 4350042 - DNA, 13 bp, Homo sapiens
cagacctggctct

SEQ ID NO: 4350043 - DNA, 20 bp, Homo sapiens
cagacctggctctcagagga

SEQ ID NO: 4350044 - DNA, 18 bp, Homo sapiens
cagactctttcttcacta

SEQ ID NO: 4350045 - DNA, 20 bp, Homo sapiens
cagagaagttctcaaagtta

SEQ ID NO: 4350046 - DNA, 22 bp, Homo sapiens
cagagaagttctcaaagttaat

SEQ ID NO: 4350047 - DNA, 19 bp, Homo sapiens
cagagcaattccaggctga

SEQ ID NO: 4350048 - DNA, 14 bp, Homo sapiens
cagagccaacctgg

SEQ ID NO: 4350049 - DNA, 17 bp, Homo sapiens
cagagccaacctggact

SEQ ID NO: 4350050 - DNA, 13 bp, Homo sapiens
cagagctgttata

SEQ ID NO: 4350051 - DNA, 23 bp, Homo sapiens
cagagctgttataaatttatcaa

SEQ ID NO: 4350052 - DNA, 18 bp, Homo sapiens
cagagcttctctgggctg

SEQ ID NO: 4350053 - DNA, 21 bp, Homo sapiens
cagagcttctctgggctgaat

SEQ ID NO: 4350054 - DNA, 22 bp, Homo sapiens
cagagcttctctgggctgaatg

SEQ ID NO: 4350055 - DNA, 23 bp, Homo sapiens
cagagcttctctgggctgaatgt

SEQ ID NO: 4350056 - DNA, 22 bp, Homo sapiens
cagaggaaaaatgggagccagg

SEQ ID NO: 4350057 - DNA, 20 bp, Homo sapiens
cagagtttttaaagccttct

SEQ ID NO: 4350058 - DNA, 12 bp, Homo sapiens
cagatgtattga

SEQ ID NO: 4350059 - DNA, 16 bp, Homo sapiens
cagcccaccaccctgg

SEQ ID NO: 4350060 - DNA, 15 bp, Homo sapiens
cagcggcagagcaat

SEQ ID NO: 4350061 - DNA, 20 bp, Homo sapiens
cagctaagatagaaagctgg

SEQ ID NO: 4350062 - DNA, 19 bp, Homo sapiens
cagctcatgtgtacctcat

SEQ ID NO: 4350063 - DNA, 13 bp, Homo sapiens
cagctcctgaata

SEQ ID NO: 4350064 - DNA, 14 bp, Homo sapiens
cagctcctgaataa

SEQ ID NO: 4350065 - DNA, 15 bp, Homo sapiens
cagctcctgaataaa

SEQ ID NO: 4350066 - DNA, 17 bp, Homo sapiens
cagctcttctcttccta

SEQ ID NO: 4350067 - DNA, 14 bp, Homo sapiens
cagctgggcctcct

SEQ ID NO: 4350068 - DNA, 23 bp, Homo sapiens
cagctgggcctcctgcctccggg

SEQ ID NO: 4350069 - DNA, 18 bp, Homo sapiens
cagctttattttaaatgt

SEQ ID NO: 4350070 - DNA, 19 bp, Homo sapiens
cagctttattttaaatgtg

SEQ ID NO: 4350071 - DNA, 15 bp, Homo sapiens
caggcagaaatattt

SEQ ID NO: 4350072 - DNA, 10 bp, Homo sapiens
caggccttca

SEQ ID NO: 4350073 - DNA, 21 bp, Homo sapiens
caggctgcacctctggctaga

SEQ ID NO: 4350074 - DNA, 23 bp, Homo sapiens
caggctgctaatattaaaccttt

SEQ ID NO: 4350075 - DNA, 10 bp, Homo sapiens
caggctgggc

SEQ ID NO: 4350076 - DNA, 20 bp, Homo sapiens
caggctgggccatgtccaaa

SEQ ID NO: 4350077 - DNA, 20 bp, Homo sapiens
caggcttccatccccgtcca

SEQ ID NO: 4350078 - DNA, 16 bp, Homo sapiens
cagggacttgtttaga

SEQ ID NO: 4350079 - DNA, 18 bp, Homo sapiens
cagggcctgagcagctgg

SEQ ID NO: 4350080 - DNA, 20 bp, Homo sapiens
cagggggcccgaacagggac

SEQ ID NO: 4350081 - DNA, 17 bp, Homo sapiens
cagtattgctgatttta

SEQ ID NO: 4350082 - DNA, 15 bp, Homo sapiens
cagtgactttgtata

SEQ ID NO: 4350083 - DNA, 16 bp, Homo sapiens
cagtgactttgtatag

SEQ ID NO: 4350084 - DNA, 17 bp, Homo sapiens
cataaaacggtgctttc

SEQ ID NO: 4350085 - DNA, 16 bp, Homo sapiens
cataaagggttgaaaa

SEQ ID NO: 4350086 - DNA, 14 bp, Homo sapiens
cataaataaaactg

SEQ ID NO: 4350087 - DNA, 16 bp, Homo sapiens
cataaataaaactgaa

SEQ ID NO: 4350088 - DNA, 18 bp, Homo sapiens
cataaataaaactgaatc

SEQ ID NO: 4350089 - DNA, 18 bp, Homo sapiens
catacttcaaaaataatg

SEQ ID NO: 4350090 - DNA, 17 bp, Homo sapiens
catcacacccatttaaa

SEQ ID NO: 4350091 - DNA, 16 bp, Homo sapiens
catcaccacccttcca

SEQ ID NO: 4350092 - DNA, 17 bp, Homo sapiens
catccaaaatatttttt

SEQ ID NO: 4350093 - DNA, 12 bp, Homo sapiens
catcctcctccc

SEQ ID NO: 4350094 - DNA, 15 bp, Homo sapiens
catcctcctccccag

SEQ ID NO: 4350095 - DNA, 13 bp, Homo sapiens
catcctctccaaa

SEQ ID NO: 4350096 - DNA, 22 bp, Homo sapiens
catcctctccaaagttggagct

SEQ ID NO: 4350097 - DNA, 21 bp, Homo sapiens
catccttaagagaagaaatgt

SEQ ID NO: 4350098 - DNA, 20 bp, Homo sapiens
catctggctttttctgccac

SEQ ID NO: 4350099 - DNA, 15 bp, Homo sapiens
catgcttacaaagaa

SEQ ID NO: 4350100 - DNA, 14 bp, Homo sapiens
catggctcagagct

SEQ ID NO: 4350101 - DNA, 17 bp, Homo sapiens
catggtcatcaccaccc

SEQ ID NO: 4350102 - DNA, 18 bp, Homo sapiens
catggtcatcaccaccct

SEQ ID NO: 4350103 - DNA, 17 bp, Homo sapiens
catgtatgttatgatat

SEQ ID NO: 4350104 - DNA, 22 bp, Homo sapiens
catgtatgttatgatattgttt

SEQ ID NO: 4350105 - DNA, 23 bp, Homo sapiens
catgtatgttatgatattgttta

SEQ ID NO: 4350106 - DNA, 12 bp, Homo sapiens
catgtccaaaga

SEQ ID NO: 4350107 - DNA, 17 bp, Homo sapiens
catgtccaaagaggctg

SEQ ID NO: 4350108 - DNA, 18 bp, Homo sapiens
catgtccaaagaggctgc

SEQ ID NO: 4350109 - DNA, 21 bp, Homo sapiens
catgtccaaagaggctgcccc

SEQ ID NO: 4350110 - DNA, 16 bp, Homo sapiens
catgttctatattctt

SEQ ID NO: 4350111 - DNA, 15 bp, Homo sapiens
cattacagttcataa

SEQ ID NO: 4350112 - DNA, 14 bp, Homo sapiens
cattatgatctaat

SEQ ID NO: 4350113 - DNA, 15 bp, Homo sapiens
cattatgatctaata

SEQ ID NO: 4350114 - DNA, 19 bp, Homo sapiens
cattatgatctaataaact

SEQ ID NO: 4350115 - DNA, 21 bp, Homo sapiens
cattatgatctaataaacttt

SEQ ID NO: 4350116 - DNA, 22 bp, Homo sapiens
cattatgatctaataaacttta

SEQ ID NO: 4350117 - DNA, 18 bp, Homo sapiens
cattcatagggaaaggtt

SEQ ID NO: 4350118 - DNA, 13 bp, Homo sapiens
cattccagtgcta

SEQ ID NO: 4350119 - DNA, 20 bp, Homo sapiens
cattccagtgctagaaaatt

SEQ ID NO: 4350120 - DNA, 21 bp, Homo sapiens
cattccagtgctagaaaattt

SEQ ID NO: 4350121 - DNA, 13 bp, Homo sapiens
cattgcctggact

SEQ ID NO: 4350122 - DNA, 16 bp, Homo sapiens
cattgcctggactgac

SEQ ID NO: 4350123 - DNA, 17 bp, Homo sapiens
cattgcctggactgacc

SEQ ID NO: 4350124 - DNA, 20 bp, Homo sapiens
catttgatagcaatgtaagt

SEQ ID NO: 4350125 - DNA, 15 bp, Homo sapiens
ccaaagactgcagaa

SEQ ID NO: 4350126 - DNA, 17 bp, Homo sapiens
ccaaagactgcagaacc

SEQ ID NO: 4350127 - DNA, 13 bp, Homo sapiens
ccaaagaggctgc

SEQ ID NO: 4350128 - DNA, 23 bp, Homo sapiens
ccaaagaggctgcccctctcacc

SEQ ID NO: 4350129 - DNA, 22 bp, Homo sapiens
ccaaccaggccttcatcctcct

SEQ ID NO: 4350130 - DNA, 19 bp, Homo sapiens
ccaacctggacttcctgtc

SEQ ID NO: 4350131 - DNA, 15 bp, Homo sapiens
ccaagagtaacttta

SEQ ID NO: 4350132 - DNA, 17 bp, Homo sapiens
ccaagagtaactttact

SEQ ID NO: 4350133 - DNA, 15 bp, Homo sapiens
ccaagatggctgctg

SEQ ID NO: 4350134 - DNA, 11 bp, Homo sapiens
ccaagccagag

SEQ ID NO: 4350135 - DNA, 15 bp, Homo sapiens
ccacaccaaccaggc

SEQ ID NO: 4350136 - DNA, 13 bp, Homo sapiens
ccacagccataga

SEQ ID NO: 4350137 - DNA, 13 bp, Homo sapiens
ccaccaccctggc

SEQ ID NO: 4350138 - DNA, 17 bp, Homo sapiens
ccacccacagccataga

SEQ ID NO: 4350139 - DNA, 22 bp, Homo sapiens
ccaccgggttctgcagcggcag

SEQ ID NO: 4350140 - DNA, 12 bp, Homo sapiens
ccactgaggaga

SEQ ID NO: 4350141 - DNA, 23 bp, Homo sapiens
ccactgaggagacagaaagcctc

SEQ ID NO: 4350142 - DNA, 16 bp, Homo sapiens
ccagaccaggaaaggc

SEQ ID NO: 4350143 - DNA, 13 bp, Homo sapiens
ccagagccaacct

SEQ ID NO: 4350144 - DNA, 14 bp, Homo sapiens
ccagagccaacctg

SEQ ID NO: 4350145 - DNA, 17 bp, Homo sapiens
ccagagccaacctggac

SEQ ID NO: 4350146 - DNA, 22 bp, Homo sapiens
ccagagccaacctggacttcct

SEQ ID NO: 4350147 - DNA, 21 bp, Homo sapiens
ccagagcttctctgggctgaa

SEQ ID NO: 4350148 - DNA, 22 bp, Homo sapiens
ccagagcttctctgggctgaat

SEQ ID NO: 4350149 - DNA, 15 bp, Homo sapiens
ccagctcctgaataa

SEQ ID NO: 4350150 - DNA, 17 bp, Homo sapiens
ccagctcttctcttcct

SEQ ID NO: 4350151 - DNA, 19 bp, Homo sapiens
ccagctgggcctcctgcct

SEQ ID NO: 4350152 - DNA, 20 bp, Homo sapiens
ccagctgggcctcctgcctc

SEQ ID NO: 4350153 - DNA, 12 bp, Homo sapiens
ccagctttattt

SEQ ID NO: 4350154 - DNA, 15 bp, Homo sapiens
ccaggaaaggcttgg

SEQ ID NO: 4350155 - DNA, 15 bp, Homo sapiens
ccaggagtaagacaa

SEQ ID NO: 4350156 - DNA, 16 bp, Homo sapiens
ccaggagtaagacaag

SEQ ID NO: 4350157 - DNA, 13 bp, Homo sapiens
ccaggcctgacca

SEQ ID NO: 4350158 - DNA, 15 bp, Homo sapiens
ccaggcctgaccagg

SEQ ID NO: 4350159 - DNA, 17 bp, Homo sapiens
ccaggcctgaccagggg

SEQ ID NO: 4350160 - DNA, 15 bp, Homo sapiens
ccaggccttcatcct

SEQ ID NO: 4350161 - DNA, 15 bp, Homo sapiens
ccaggctgagccatg

SEQ ID NO: 4350162 - DNA, 17 bp, Homo sapiens
ccagggacacctcgccc

SEQ ID NO: 4350163 - DNA, 16 bp, Homo sapiens
ccaggtggcctgcgtc

SEQ ID NO: 4350164 - DNA, 17 bp, Homo sapiens
ccaggtggcctgcgtct

SEQ ID NO: 4350165 - DNA, 19 bp, Homo sapiens
ccatccccgtccatgctca

SEQ ID NO: 4350166 - DNA, 15 bp, Homo sapiens
ccatctggctttttc

SEQ ID NO: 4350167 - DNA, 21 bp, Homo sapiens
ccatctggctttttctgccac

SEQ ID NO: 4350168 - DNA, 21 bp, Homo sapiens
ccatgaggagcgtggactctg

SEQ ID NO: 4350169 - DNA, 20 bp, Homo sapiens
ccatggtcatcaccaccctt

SEQ ID NO: 4350170 - DNA, 13 bp, Homo sapiens
ccatgtccaaaga

SEQ ID NO: 4350171 - DNA, 14 bp, Homo sapiens
ccatgtccaaagag

SEQ ID NO: 4350172 - DNA, 17 bp, Homo sapiens
ccatgtccaaagaggct

SEQ ID NO: 4350173 - DNA, 18 bp, Homo sapiens
ccatgtccaaagaggctg

SEQ ID NO: 4350174 - DNA, 15 bp, Homo sapiens
cccagctcttctctt

SEQ ID NO: 4350175 - DNA, 13 bp, Homo sapiens
cccaggtggcctg

SEQ ID NO: 4350176 - DNA, 12 bp, Homo sapiens
cccatctggctt

SEQ ID NO: 4350177 - DNA, 21 bp, Homo sapiens
ccccaggtggcctgcgtcttt

SEQ ID NO: 4350178 - DNA, 18 bp, Homo sapiens
cccctcccacccacagcc

SEQ ID NO: 4350179 - DNA, 11 bp, Homo sapiens
cccctgaggca

SEQ ID NO: 4350180 - DNA, 14 bp, Homo sapiens
cccctgaggcagcc

SEQ ID NO: 4350181 - DNA, 18 bp, Homo sapiens
cccctgaggcagcccagc

SEQ ID NO: 4350182 - DNA, 19 bp, Homo sapiens
ccctcggaggtccagctgg

SEQ ID NO: 4350183 - DNA, 13 bp, Homo sapiens
ccctgaggcagcc

SEQ ID NO: 4350184 - DNA, 12 bp, Homo sapiens
ccctggccacca

SEQ ID NO: 4350185 - DNA, 19 bp, Homo sapiens
cccttcagcccaccaccct

SEQ ID NO: 4350186 - DNA, 14 bp, Homo sapiens
cccttcccagacca

SEQ ID NO: 4350187 - DNA, 12 bp, Homo sapiens
ccgaacagggac

SEQ ID NO: 4350188 - DNA, 12 bp, Homo sapiens
ccgctgggcttc

SEQ ID NO: 4350189 - DNA, 14 bp, Homo sapiens
ccggactggcagaa

SEQ ID NO: 4350190 - DNA, 12 bp, Homo sapiens
ccggtggttttg

SEQ ID NO: 4350191 - DNA, 18 bp, Homo sapiens
cctaatgtctcactgttc

SEQ ID NO: 4350192 - DNA, 17 bp, Homo sapiens
cctacagacctggctct

SEQ ID NO: 4350193 - DNA, 15 bp, Homo sapiens
cctagatctgcaggc

SEQ ID NO: 4350194 - DNA, 13 bp, Homo sapiens
cctcaggagagac

SEQ ID NO: 4350195 - DNA, 16 bp, Homo sapiens
cctccgggcaggcaag

SEQ ID NO: 4350196 - DNA, 18 bp, Homo sapiens
cctcctccccagctcttc

SEQ ID NO: 4350197 - DNA, 15 bp, Homo sapiens
cctctggctagagcc

SEQ ID NO: 4350198 - DNA, 17 bp, Homo sapiens
cctctggctagagccga

SEQ ID NO: 4350199 - DNA, 13 bp, Homo sapiens
cctcttcagaact

SEQ ID NO: 4350200 - DNA, 13 bp, Homo sapiens
cctggactgacca

SEQ ID NO: 4350201 - DNA, 18 bp, Homo sapiens
cctggactgaccacacca

SEQ ID NO: 4350202 - DNA, 13 bp, Homo sapiens
cctggacttcctg

SEQ ID NO: 4350203 - DNA, 22 bp, Homo sapiens
cctgttaaacagtagttgtatt

SEQ ID NO: 4350204 - DNA, 18 bp, Homo sapiens
ccttaaaattaccagaca

SEQ ID NO: 4350205 - DNA, 19 bp, Homo sapiens
ccttcagcccaccaccctg

SEQ ID NO: 4350206 - DNA, 16 bp, Homo sapiens
ccttgctcctagcaga

SEQ ID NO: 4350207 - DNA, 15 bp, Homo sapiens
ccttttatctgcaga

SEQ ID NO: 4350208 - DNA, 23 bp, Homo sapiens
cgcagatttttatgttttgaaag

SEQ ID NO: 4350209 - DNA, 12 bp, Homo sapiens
cgccaatctcat

SEQ ID NO: 4350210 - DNA, 21 bp, Homo sapiens
cgctgggcttcattccggact

SEQ ID NO: 4350211 - DNA, 12 bp, Homo sapiens
cggaagccaaag

SEQ ID NO: 4350212 - DNA, 15 bp, Homo sapiens
cggactggcagaagc

SEQ ID NO: 4350213 - DNA, 16 bp, Homo sapiens
cggactggcagaagca

SEQ ID NO: 4350214 - DNA, 19 bp, Homo sapiens
cggaggtccagctgggcct

SEQ ID NO: 4350215 - DNA, 21 bp, Homo sapiens
cggaggtccagctgggcctcc

SEQ ID NO: 4350216 - DNA, 24 bp, Homo sapiens
cggcagagcaattccaggctgagc

SEQ ID NO: 4350217 - DNA, 21 bp, Homo sapiens
cgtggactctgctagactcct

SEQ ID NO: 4350218 - DNA, 17 bp, Homo sapiens
cgtgttcacaggctgct

SEQ ID NO: 4350219 - DNA, 19 bp, Homo sapiens
ctaaacacttcattcttta

SEQ ID NO: 4350220 - DNA, 21 bp, Homo sapiens
ctaaataatgaataaactgaa

SEQ ID NO: 4350221 - DNA, 22 bp, Homo sapiens
ctaaattctatgttaaatactg

SEQ ID NO: 4350222 - DNA, 14 bp, Homo sapiens
ctaacttgtgaaga

SEQ ID NO: 4350223 - DNA, 18 bp, Homo sapiens
ctaagatagaaagctgga

SEQ ID NO: 4350224 - DNA, 19 bp, Homo sapiens
ctaagatagaaagctggac

SEQ ID NO: 4350225 - DNA, 21 bp, Homo sapiens
ctaagatagaaagctggactg

SEQ ID NO: 4350226 - DNA, 23 bp, Homo sapiens
ctaagatagaaagctggactgac

SEQ ID NO: 4350227 - DNA, 16 bp, Homo sapiens
ctaagccctttgccat

SEQ ID NO: 4350228 - DNA, 13 bp, Homo sapiens
ctaataaacttta

SEQ ID NO: 4350229 - DNA, 15 bp, Homo sapiens
ctaatgtctcactgt

SEQ ID NO: 4350230 - DNA, 16 bp, Homo sapiens
ctaatgtctcactgtt

SEQ ID NO: 4350231 - DNA, 21 bp, Homo sapiens
ctaatgtctcactgttctgca

SEQ ID NO: 4350232 - DNA, 14 bp, Homo sapiens
ctacctttgtaaaa

SEQ ID NO: 4350233 - DNA, 16 bp, Homo sapiens
ctagactcctcaggag

SEQ ID NO: 4350234 - DNA, 20 bp, Homo sapiens
ctagactcctcaggagagac

SEQ ID NO: 4350235 - DNA, 18 bp, Homo sapiens
ctagactgcaagaactgt

SEQ ID NO: 4350236 - DNA, 23 bp, Homo sapiens
ctagactgcaagaactgttttta

SEQ ID NO: 4350237 - DNA, 12 bp, Homo sapiens
ctagcagacaga

SEQ ID NO: 4350238 - DNA, 16 bp, Homo sapiens
ctagtggatgactgtt

SEQ ID NO: 4350239 - DNA, 19 bp, Homo sapiens
ctagtggatgactgttgat

SEQ ID NO: 4350240 - DNA, 16 bp, Homo sapiens
ctataaatgccagagc

SEQ ID NO: 4350241 - DNA, 17 bp, Homo sapiens
ctataaatgccagagcc

SEQ ID NO: 4350242 - DNA, 20 bp, Homo sapiens
ctataaatgccagagccaac

SEQ ID NO: 4350243 - DNA, 17 bp, Homo sapiens
ctataaccatgttctat

SEQ ID NO: 4350244 - DNA, 21 bp, Homo sapiens
ctataagaggaatttcttttc

SEQ ID NO: 4350245 - DNA, 22 bp, Homo sapiens
ctataagaggaatttcttttcc

SEQ ID NO: 4350246 - DNA, 18 bp, Homo sapiens
ctatagatgatgatgtgt

SEQ ID NO: 4350247 - DNA, 14 bp, Homo sapiens
ctatgttaaatact

SEQ ID NO: 4350248 - DNA, 16 bp, Homo sapiens
ctatgttaaatactgt

SEQ ID NO: 4350249 - DNA, 18 bp, Homo sapiens
ctatgttaaatactgtgc

SEQ ID NO: 4350250 - DNA, 20 bp, Homo sapiens
ctcaaagttaattcacctat

SEQ ID NO: 4350251 - DNA, 23 bp, Homo sapiens
ctcaaagttaattcacctatgtt

SEQ ID NO: 4350252 - DNA, 18 bp, Homo sapiens
ctcaagggaaaggcaagc

SEQ ID NO: 4350253 - DNA, 14 bp, Homo sapiens
ctcactgttctgca

SEQ ID NO: 4350254 - DNA, 15 bp, Homo sapiens
ctcactgttctgcaa

SEQ ID NO: 4350255 - DNA, 17 bp, Homo sapiens
ctcagagcttgaagatt

SEQ ID NO: 4350256 - DNA, 12 bp, Homo sapiens
ctcaggagagac

SEQ ID NO: 4350257 - DNA, 19 bp, Homo sapiens
ctcaggagagacccctccc

SEQ ID NO: 4350258 - DNA, 14 bp, Homo sapiens
ctcagtaactttta

SEQ ID NO: 4350259 - DNA, 15 bp, Homo sapiens
ctcatacaagccatt

SEQ ID NO: 4350260 - DNA, 15 bp, Homo sapiens
ctcccacccacagcc

SEQ ID NO: 4350261 - DNA, 16 bp, Homo sapiens
ctccccagctcttctc

SEQ ID NO: 4350262 - DNA, 13 bp, Homo sapiens
ctccgctgggctt

SEQ ID NO: 4350263 - DNA, 18 bp, Homo sapiens
ctccgctgggcttcattc

SEQ ID NO: 4350264 - DNA, 19 bp, Homo sapiens
ctccgctgggcttcattcc

SEQ ID NO: 4350265 - DNA, 14 bp, Homo sapiens
ctccgggcaggcaa

SEQ ID NO: 4350266 - DNA, 19 bp, Homo sapiens
ctcctagcagacagaaact

SEQ ID NO: 4350267 - DNA, 14 bp, Homo sapiens
ctcctccccagctc

SEQ ID NO: 4350268 - DNA, 22 bp, Homo sapiens
ctcctccccagctcttctcttc

SEQ ID NO: 4350269 - DNA, 16 bp, Homo sapiens
ctcctttacaaccata

SEQ ID NO: 4350270 - DNA, 16 bp, Homo sapiens
ctcgcccttcagccca

SEQ ID NO: 4350271 - DNA, 18 bp, Homo sapiens
ctcggaggtccagctggg

SEQ ID NO: 4350272 - DNA, 23 bp, Homo sapiens
ctcggaggtccagctgggcctcc

SEQ ID NO: 4350273 - DNA, 17 bp, Homo sapiens
ctctacctaatgtctca

SEQ ID NO: 4350274 - DNA, 22 bp, Homo sapiens
ctctacctaatgtctcactgtt

SEQ ID NO: 4350275 - DNA, 12 bp, Homo sapiens
ctctgctagact

SEQ ID NO: 4350276 - DNA, 18 bp, Homo sapiens
ctctgctagactcctcag

SEQ ID NO: 4350277 - DNA, 17 bp, Homo sapiens
ctctggctagagccgag

SEQ ID NO: 4350278 - DNA, 14 bp, Homo sapiens
ctctgtgtttaaaa

SEQ ID NO: 4350279 - DNA, 12 bp, Homo sapiens
ctcttaatctgt

SEQ ID NO: 4350280 - DNA, 12 bp, Homo sapiens
ctcttcagaact

SEQ ID NO: 4350281 - DNA, 14 bp, Homo sapiens
ctcttcccttccca

SEQ ID NO: 4350282 - DNA, 17 bp, Homo sapiens
ctcttcccttcccagac

SEQ ID NO: 4350283 - DNA, 19 bp, Homo sapiens
ctcttcctagatctgcagg

SEQ ID NO: 4350284 - DNA, 14 bp, Homo sapiens
ctcttctcttccta

SEQ ID NO: 4350285 - DNA, 21 bp, Homo sapiens
ctcttctggggcaggctgggc

SEQ ID NO: 4350286 - DNA, 14 bp, Homo sapiens
ctgaatattttgga

SEQ ID NO: 4350287 - DNA, 12 bp, Homo sapiens
ctgaatgtatgt

SEQ ID NO: 4350288 - DNA, 20 bp, Homo sapiens
ctgaatgtatgtcagtgcta

SEQ ID NO: 4350289 - DNA, 17 bp, Homo sapiens
ctgaattttataaataa

SEQ ID NO: 4350290 - DNA, 21 bp, Homo sapiens
ctgacaaaggtggtaaattca

SEQ ID NO: 4350291 - DNA, 17 bp, Homo sapiens
ctgaccaaagactgcag

SEQ ID NO: 4350292 - DNA, 20 bp, Homo sapiens
ctgaccacaccaaccaggcc

SEQ ID NO: 4350293 - DNA, 15 bp, Homo sapiens
ctgagccatgaggag

SEQ ID NO: 4350294 - DNA, 13 bp, Homo sapiens
ctgaggagacaga

SEQ ID NO: 4350295 - DNA, 14 bp, Homo sapiens
ctgaggagacagaa

SEQ ID NO: 4350296 - DNA, 15 bp, Homo sapiens
ctgaggagacagaaa

SEQ ID NO: 4350297 - DNA, 18 bp, Homo sapiens
ctgaggagacagaaagcc

SEQ ID NO: 4350298 - DNA, 19 bp, Homo sapiens
ctgattttaaaggcagaga

SEQ ID NO: 4350299 - DNA, 23 bp, Homo sapiens
ctgcaaaggtggcaatgcttaaa

SEQ ID NO: 4350300 - DNA, 18 bp, Homo sapiens
ctgcaagaactgttttta

SEQ ID NO: 4350301 - DNA, 16 bp, Homo sapiens
ctgcagaacccccagg

SEQ ID NO: 4350302 - DNA, 14 bp, Homo sapiens
ctgcagcggcagag

SEQ ID NO: 4350303 - DNA, 14 bp, Homo sapiens
ctgcatcaagactt

SEQ ID NO: 4350304 - DNA, 16 bp, Homo sapiens
ctgcatcaagacttca

SEQ ID NO: 4350305 - DNA, 22 bp, Homo sapiens
ctgcatcaagacttcaatcctg

SEQ ID NO: 4350306 - DNA, 23 bp, Homo sapiens
ctgcatcaagacttcaatcctga

SEQ ID NO: 4350307 - DNA, 20 bp, Homo sapiens
ctgccactgaggagacagaa

SEQ ID NO: 4350308 - DNA, 20 bp, Homo sapiens
ctgcctccgggcaggcaagg

SEQ ID NO: 4350309 - DNA, 15 bp, Homo sapiens
ctgcggaagccaaag

SEQ ID NO: 4350310 - DNA, 21 bp, Homo sapiens
ctgcggaagccaaaggcagct

SEQ ID NO: 4350311 - DNA, 19 bp, Homo sapiens
ctgctagactcctcaggag

SEQ ID NO: 4350312 - DNA, 18 bp, Homo sapiens
ctgctcatggccctcgga

SEQ ID NO: 4350313 - DNA, 16 bp, Homo sapiens
ctgctttatcttttca

SEQ ID NO: 4350314 - DNA, 12 bp, Homo sapiens
ctggactgacca

SEQ ID NO: 4350315 - DNA, 17 bp, Homo sapiens
ctggccaccatggtcat

SEQ ID NO: 4350316 - DNA, 13 bp, Homo sapiens
ctggctagagccg

SEQ ID NO: 4350317 - DNA, 13 bp, Homo sapiens
ctggctctcagag

SEQ ID NO: 4350318 - DNA, 14 bp, Homo sapiens
ctggctctcagagg

SEQ ID NO: 4350319 - DNA, 16 bp, Homo sapiens
ctggctctcagaggaa

SEQ ID NO: 4350320 - DNA, 17 bp, Homo sapiens
ctggctctcagaggaaa

SEQ ID NO: 4350321 - DNA, 13 bp, Homo sapiens
ctgggaacttcta

SEQ ID NO: 4350322 - DNA, 17 bp, Homo sapiens
ctgggccatgtccaaag

SEQ ID NO: 4350323 - DNA, 18 bp, Homo sapiens
ctgggccatgtccaaaga

SEQ ID NO: 4350324 - DNA, 19 bp, Homo sapiens
ctgggcctcctgcctccgg

SEQ ID NO: 4350325 - DNA, 12 bp, Homo sapiens
ctggggcaggct

SEQ ID NO: 4350326 - DNA, 21 bp, Homo sapiens
ctggtagcataaataaaactg

SEQ ID NO: 4350327 - DNA, 20 bp, Homo sapiens
ctgtattccgatacaaagtg

SEQ ID NO: 4350328 - DNA, 15 bp, Homo sapiens
ctgtatttctaggca

SEQ ID NO: 4350329 - DNA, 21 bp, Homo sapiens
ctgtcaccagagcttctctgg

SEQ ID NO: 4350330 - DNA, 18 bp, Homo sapiens
ctgtgcagaataatggaa

SEQ ID NO: 4350331 - DNA, 13 bp, Homo sapiens
ctgtgtttaaaaa

SEQ ID NO: 4350332 - DNA, 20 bp, Homo sapiens
ctgttctgcaaaggtggcaa

SEQ ID NO: 4350333 - DNA, 20 bp, Homo sapiens
ctgtttgggttgttggtctg

SEQ ID NO: 4350334 - DNA, 14 bp, Homo sapiens
cttaaactaaataa

SEQ ID NO: 4350335 - DNA, 19 bp, Homo sapiens
cttaaactaaataatgaat

SEQ ID NO: 4350336 - DNA, 20 bp, Homo sapiens
cttaaactaaataatgaata

SEQ ID NO: 4350337 - DNA, 20 bp, Homo sapiens
cttaatctgtgtgtatattg

SEQ ID NO: 4350338 - DNA, 23 bp, Homo sapiens
cttattaattcttcacctgttat

SEQ ID NO: 4350339 - DNA, 15 bp, Homo sapiens
cttattgaagtgaat

SEQ ID NO: 4350340 - DNA, 14 bp, Homo sapiens
cttcaaaaataatg

SEQ ID NO: 4350341 - DNA, 20 bp, Homo sapiens
cttcaataaaatggttcata

SEQ ID NO: 4350342 - DNA, 18 bp, Homo sapiens
cttcactacgtgttcaca

SEQ ID NO: 4350343 - DNA, 20 bp, Homo sapiens
cttcaggtaaaaacttcatt

SEQ ID NO: 4350344 - DNA, 19 bp, Homo sapiens
cttcatcctcctccccagc

SEQ ID NO: 4350345 - DNA, 20 bp, Homo sapiens
cttcattccggactggcaga

SEQ ID NO: 4350346 - DNA, 22 bp, Homo sapiens
cttccagggcctgagcagctgg

SEQ ID NO: 4350347 - DNA, 18 bp, Homo sapiens
cttcccagaccaggaaag

SEQ ID NO: 4350348 - DNA, 18 bp, Homo sapiens
cttcctagatctgcaggc

SEQ ID NO: 4350349 - DNA, 17 bp, Homo sapiens
cttctaaacacttcatt

SEQ ID NO: 4350350 - DNA, 23 bp, Homo sapiens
cttctcttcctagatctgcaggc

SEQ ID NO: 4350351 - DNA, 13 bp, Homo sapiens
cttctgacaaagg

SEQ ID NO: 4350352 - DNA, 14 bp, Homo sapiens
cttctggggcaggc

SEQ ID NO: 4350353 - DNA, 16 bp, Homo sapiens
cttctggggcaggctg

SEQ ID NO: 4350354 - DNA, 18 bp, Homo sapiens
cttgagaaccttttcaaa

SEQ ID NO: 4350355 - DNA, 19 bp, Homo sapiens
cttgaggccaagatggctg

SEQ ID NO: 4350356 - DNA, 20 bp, Homo sapiens
cttgctcctagcagacagaa

SEQ ID NO: 4350357 - DNA, 21 bp, Homo sapiens
cttggctggtgtatgcacagg

SEQ ID NO: 4350358 - DNA, 18 bp, Homo sapiens
cttgtcaggcatggctca

SEQ ID NO: 4350359 - DNA, 14 bp, Homo sapiens
ctttactctgtgtt

SEQ ID NO: 4350360 - DNA, 15 bp, Homo sapiens
ctttatacacagtgg

SEQ ID NO: 4350361 - DNA, 12 bp, Homo sapiens
ctttatatatgt

SEQ ID NO: 4350362 - DNA, 13 bp, Homo sapiens
ctttatatatgta

SEQ ID NO: 4350363 - DNA, 18 bp, Homo sapiens
ctttctgtgaaagcctta

SEQ ID NO: 4350364 - DNA, 15 bp, Homo sapiens
ctttgttaacttcag

SEQ ID NO: 4350365 - DNA, 15 bp, Homo sapiens
cttttatctgcagaa

SEQ ID NO: 4350366 - DNA, 22 bp, Homo sapiens
cttttcataaagggttgaaaat

SEQ ID NO: 4350367 - DNA, 16 bp, Homo sapiens
cttttcccctgttaaa

SEQ ID NO: 4350368 - DNA, 19 bp, Homo sapiens
cttttccttcattcatagg

SEQ ID NO: 4350369 - DNA, 22 bp, Homo sapiens
cttttgttctgctttatctttt

SEQ ID NO: 4350370 - DNA, 18 bp, Homo sapiens
gaaagcctccgctgggct

SEQ ID NO: 4350371 - DNA, 20 bp, Homo sapiens
gaaagctggactgaccaaag

SEQ ID NO: 4350372 - DNA, 19 bp, Homo sapiens
gaaaggcttggctggtgta

SEQ ID NO: 4350373 - DNA, 14 bp, Homo sapiens
gaaaggttttgtat

SEQ ID NO: 4350374 - DNA, 12 bp, Homo sapiens
gaaatagacttt

SEQ ID NO: 4350375 - DNA, 18 bp, Homo sapiens
gaacacagttgaattttt

SEQ ID NO: 4350376 - DNA, 20 bp, Homo sapiens
gaacagggacttgtttagag

SEQ ID NO: 4350377 - DNA, 19 bp, Homo sapiens
gaacatacttcaaaaataa

SEQ ID NO: 4350378 - DNA, 17 bp, Homo sapiens
gaacctgctacttaaaa

SEQ ID NO: 4350379 - DNA, 17 bp, Homo sapiens
gaactgcatcaagactt

SEQ ID NO: 4350380 - DNA, 17 bp, Homo sapiens
gaagatggtttcaattc

SEQ ID NO: 4350381 - DNA, 19 bp, Homo sapiens
gaagatggtttcaattcag

SEQ ID NO: 4350382 - DNA, 18 bp, Homo sapiens
gaagcattgcctggactg

SEQ ID NO: 4350383 - DNA, 19 bp, Homo sapiens
gaagcattgcctggactga

SEQ ID NO: 4350384 - DNA, 22 bp, Homo sapiens
gaagcattgcctggactgacca

SEQ ID NO: 4350385 - DNA, 20 bp, Homo sapiens
gaagccaaaggcagctaaga

SEQ ID NO: 4350386 - DNA, 21 bp, Homo sapiens
gaagctttgagttgacttctg

SEQ ID NO: 4350387 - DNA, 18 bp, Homo sapiens
gaagtatacttttcccct

SEQ ID NO: 4350388 - DNA, 17 bp, Homo sapiens
gaagtgatatggtgaag

SEQ ID NO: 4350389 - DNA, 22 bp, Homo sapiens
gaagtgatatggtgaagggaag

SEQ ID NO: 4350390 - DNA, 22 bp, Homo sapiens
gaatattttggaaactgctaaa

SEQ ID NO: 4350391 - DNA, 21 bp, Homo sapiens
gaattaatgcattcaaagtaa

SEQ ID NO: 4350392 - DNA, 12 bp, Homo sapiens
gacaaaggtggt

SEQ ID NO: 4350393 - DNA, 23 bp, Homo sapiens
gacaaaggtggtaaattcagaca

SEQ ID NO: 4350394 - DNA, 13 bp, Homo sapiens
gacaacattatga

SEQ ID NO: 4350395 - DNA, 15 bp, Homo sapiens
gacaacattatgatc

SEQ ID NO: 4350396 - DNA, 17 bp, Homo sapiens
gacaacattatgatcta

SEQ ID NO: 4350397 - DNA, 22 bp, Homo sapiens
gacaacattatgatctaataaa

SEQ ID NO: 4350398 - DNA, 20 bp, Homo sapiens
gacacaatatgtatgctttt

SEQ ID NO: 4350399 - DNA, 21 bp, Homo sapiens
gacacaatatgtatgcttttt

SEQ ID NO: 4350400 - DNA, 18 bp, Homo sapiens
gacacctcgcccttcagc

SEQ ID NO: 4350401 - DNA, 21 bp, Homo sapiens
gacacctcgcccttcagccca

SEQ ID NO: 4350402 - DNA, 20 bp, Homo sapiens
gaccaaagactgcagaaccc

SEQ ID NO: 4350403 - DNA, 17 bp, Homo sapiens
gaccacaccaaccaggc

SEQ ID NO: 4350404 - DNA, 17 bp, Homo sapiens
gacctacagacctggct

SEQ ID NO: 4350405 - DNA, 11 bp, Homo sapiens
gactccaggcc

SEQ ID NO: 4350406 - DNA, 15 bp, Homo sapiens
gactccaggcctgac

SEQ ID NO: 4350407 - DNA, 18 bp, Homo sapiens
gactccaggcctgaccag

SEQ ID NO: 4350408 - DNA, 15 bp, Homo sapiens
gactgaccaaagact

SEQ ID NO: 4350409 - DNA, 18 bp, Homo sapiens
gactgaccaaagactgca

SEQ ID NO: 4350410 - DNA, 21 bp, Homo sapiens
gactgaccaaagactgcagaa

SEQ ID NO: 4350411 - DNA, 23 bp, Homo sapiens
gactgaccacaccaaccaggcct

SEQ ID NO: 4350412 - DNA, 22 bp, Homo sapiens
gactgcaaacttttttatatct

SEQ ID NO: 4350413 - DNA, 16 bp, Homo sapiens
gactgtaccacagaca

SEQ ID NO: 4350414 - DNA, 20 bp, Homo sapiens
gactgtaccacagacacaat

SEQ ID NO: 4350415 - DNA, 19 bp, Homo sapiens
gacttgtttagagagcctg

SEQ ID NO: 4350416 - DNA, 14 bp, Homo sapiens
gagaaatagacttt

SEQ ID NO: 4350417 - DNA, 21 bp, Homo sapiens
gagaagaaatgttataaagta

SEQ ID NO: 4350418 - DNA, 12 bp, Homo sapiens
gagaagttctca

SEQ ID NO: 4350419 - DNA, 22 bp, Homo sapiens
gagaatcccttaaaattaccag

SEQ ID NO: 4350420 - DNA, 20 bp, Homo sapiens
gagacagaaagcctccgctg

SEQ ID NO: 4350421 - DNA, 12 bp, Homo sapiens
gagactttcagt

SEQ ID NO: 4350422 - DNA, 16 bp, Homo sapiens
gagagacccctcccct

SEQ ID NO: 4350423 - DNA, 17 bp, Homo sapiens
gagagagggactcaagg

SEQ ID NO: 4350424 - DNA, 21 bp, Homo sapiens
gagagcctgtcaccagagctt

SEQ ID NO: 4350425 - DNA, 15 bp, Homo sapiens
gagataaatgagctt

SEQ ID NO: 4350426 - DNA, 15 bp, Homo sapiens
gagatagcttcccca

SEQ ID NO: 4350427 - DNA, 16 bp, Homo sapiens
gagatttttggttttt

SEQ ID NO: 4350428 - DNA, 14 bp, Homo sapiens
gagcaattccaggc

SEQ ID NO: 4350429 - DNA, 15 bp, Homo sapiens
gagcaattccaggct

SEQ ID NO: 4350430 - DNA, 22 bp, Homo sapiens
gagcaattccaggctgagccat

SEQ ID NO: 4350431 - DNA, 10 bp, Homo sapiens
gagccaggag

SEQ ID NO: 4350432 - DNA, 15 bp, Homo sapiens
gagccatgaggagcg

SEQ ID NO: 4350433 - DNA, 18 bp, Homo sapiens
gagccatgaggagcgtgg

SEQ ID NO: 4350434 - DNA, 12 bp, Homo sapiens
gagcctgtcacc

SEQ ID NO: 4350435 - DNA, 15 bp, Homo sapiens
gagcctgtcaccaga

SEQ ID NO: 4350436 - DNA, 19 bp, Homo sapiens
gagcgtggactctgctaga

SEQ ID NO: 4350437 - DNA, 14 bp, Homo sapiens
gagcttctctgggc

SEQ ID NO: 4350438 - DNA, 21 bp, Homo sapiens
gaggaaaaatgggagccagga

SEQ ID NO: 4350439 - DNA, 21 bp, Homo sapiens
gaggcccctgaggcagcccag

SEQ ID NO: 4350440 - DNA, 14 bp, Homo sapiens
gaggctgcccctct

SEQ ID NO: 4350441 - DNA, 19 bp, Homo sapiens
gagggactcaagggaaagg

SEQ ID NO: 4350442 - DNA, 20 bp, Homo sapiens
gagtttgtgttgttgttgct

SEQ ID NO: 4350443 - DNA, 16 bp, Homo sapiens
gagtttttaaagcctt

SEQ ID NO: 4350444 - DNA, 18 bp, Homo sapiens
gagtttttaaagccttct

SEQ ID NO: 4350445 - DNA, 15 bp, Homo sapiens
gataaatgagctttc

SEQ ID NO: 4350446 - DNA, 13 bp, Homo sapiens
gatacaaagtgtt

SEQ ID NO: 4350447 - DNA, 11 bp, Homo sapiens
gatagaaagct

SEQ ID NO: 4350448 - DNA, 18 bp, Homo sapiens
gatatatttcacttttgt

SEQ ID NO: 4350449 - DNA, 21 bp, Homo sapiens
gatatatttcacttttgttct

SEQ ID NO: 4350450 - DNA, 23 bp, Homo sapiens
gatatatttcacttttgttctgc

SEQ ID NO: 4350451 - DNA, 18 bp, Homo sapiens
gatatggtgaagggaagt

SEQ ID NO: 4350452 - DNA, 23 bp, Homo sapiens
gatattggtggccggtggttttg

SEQ ID NO: 4350453 - DNA, 16 bp, Homo sapiens
gatattgtttaaaatt

SEQ ID NO: 4350454 - DNA, 15 bp, Homo sapiens
gatatttttgtactt

SEQ ID NO: 4350455 - DNA, 17 bp, Homo sapiens
gatatttttgtacttga

SEQ ID NO: 4350456 - DNA, 14 bp, Homo sapiens
gatccatgggggga

SEQ ID NO: 4350457 - DNA, 14 bp, Homo sapiens
gatctaataaactt

SEQ ID NO: 4350458 - DNA, 16 bp, Homo sapiens
gatctaataaacttta

SEQ ID NO: 4350459 - DNA, 13 bp, Homo sapiens
gatctgcaggctg

SEQ ID NO: 4350460 - DNA, 16 bp, Homo sapiens
gatctgcaggctgcac

SEQ ID NO: 4350461 - DNA, 12 bp, Homo sapiens
gatggctgctgc

SEQ ID NO: 4350462 - DNA, 14 bp, Homo sapiens
gatggctgctgcct

SEQ ID NO: 4350463 - DNA, 12 bp, Homo sapiens
gatgtgactttt

SEQ ID NO: 4350464 - DNA, 16 bp, Homo sapiens
gattcctctgctgcca

SEQ ID NO: 4350465 - DNA, 13 bp, Homo sapiens
gcaaaaaactctt

SEQ ID NO: 4350466 - DNA, 12 bp, Homo sapiens
gcaaactttttt

SEQ ID NO: 4350467 - DNA, 19 bp, Homo sapiens
gcaagactgcaaacttttt

SEQ ID NO: 4350468 - DNA, 22 bp, Homo sapiens
gcaagttatattagtgaagatg

SEQ ID NO: 4350469 - DNA, 22 bp, Homo sapiens
gcaatgcttaaactaaataatg

SEQ ID NO: 4350470 - DNA, 15 bp, Homo sapiens
gcaattccaggctga

SEQ ID NO: 4350471 - DNA, 20 bp, Homo sapiens
gcaattccaggctgagccat

SEQ ID NO: 4350472 - DNA, 18 bp, Homo sapiens
gcagaacatcgatatgta

SEQ ID NO: 4350473 - DNA, 11 bp, Homo sapiens
gcagaataatg

SEQ ID NO: 4350474 - DNA, 17 bp, Homo sapiens
gcagaataatggaaaca

SEQ ID NO: 4350475 - DNA, 17 bp, Homo sapiens
gcagacagaaactggat

SEQ ID NO: 4350476 - DNA, 20 bp, Homo sapiens
gcagagcaattccaggctga

SEQ ID NO: 4350477 - DNA, 21 bp, Homo sapiens
gcagagcaattccaggctgag

SEQ ID NO: 4350478 - DNA, 20 bp, Homo sapiens
gcagcccagctcctgaataa

SEQ ID NO: 4350479 - DNA, 16 bp, Homo sapiens
gcagcggcagagcaat

SEQ ID NO: 4350480 - DNA, 18 bp, Homo sapiens
gcagctaagatagaaagc

SEQ ID NO: 4350481 - DNA, 24 bp, Homo sapiens
gcagctaagatagaaagctggact

SEQ ID NO: 4350482 - DNA, 21 bp, Homo sapiens
gcaggctgcacctctggctag

SEQ ID NO: 4350483 - DNA, 11 bp, Homo sapiens
gcaggctgggc

SEQ ID NO: 4350484 - DNA, 17 bp, Homo sapiens
gcataaataaaactgaa

SEQ ID NO: 4350485 - DNA, 15 bp, Homo sapiens
gcatggctcagagct

SEQ ID NO: 4350486 - DNA, 17 bp, Homo sapiens
gcattgcctggactgac

SEQ ID NO: 4350487 - DNA, 13 bp, Homo sapiens
gccaaaagaagtt

SEQ ID NO: 4350488 - DNA, 13 bp, Homo sapiens
gccaacctggact

SEQ ID NO: 4350489 - DNA, 20 bp, Homo sapiens
gccaagatggctgctgcctg

SEQ ID NO: 4350490 - DNA, 21 bp, Homo sapiens
gccaagatggctgctgcctgc

SEQ ID NO: 4350491 - DNA, 16 bp, Homo sapiens
gccactgaggagacag

SEQ ID NO: 4350492 - DNA, 21 bp, Homo sapiens
gccactgaggagacagaaagc

SEQ ID NO: 4350493 - DNA, 22 bp, Homo sapiens
gccactgaggagacagaaagcc

SEQ ID NO: 4350494 - DNA, 11 bp, Homo sapiens
gccagagccaa

SEQ ID NO: 4350495 - DNA, 23 bp, Homo sapiens
gccagagccaacctggacttcct

SEQ ID NO: 4350496 - DNA, 21 bp, Homo sapiens
gccagagtttttaaagccttc

SEQ ID NO: 4350497 - DNA, 13 bp, Homo sapiens
gccaggagtaaga

SEQ ID NO: 4350498 - DNA, 21 bp, Homo sapiens
gccatagacctacagacctgg

SEQ ID NO: 4350499 - DNA, 16 bp, Homo sapiens
gccatgaaccatgctt

SEQ ID NO: 4350500 - DNA, 17 bp, Homo sapiens
gccatgaaccatgctta

SEQ ID NO: 4350501 - DNA, 19 bp, Homo sapiens
gccatgtccaaagaggctg

SEQ ID NO: 4350502 - DNA, 22 bp, Homo sapiens
gccatgtccaaagaggctgccc

SEQ ID NO: 4350503 - DNA, 18 bp, Homo sapiens
gcccaccagggacacctc

SEQ ID NO: 4350504 - DNA, 14 bp, Homo sapiens
gcccctctcaccaa

SEQ ID NO: 4350505 - DNA, 15 bp, Homo sapiens
gcccctgaggcagcc

SEQ ID NO: 4350506 - DNA, 17 bp, Homo sapiens
gcccctgaggcagccca

SEQ ID NO: 4350507 - DNA, 16 bp, Homo sapiens
gcccgaacagggactt

SEQ ID NO: 4350508 - DNA, 17 bp, Homo sapiens
gcccgaacagggacttg

SEQ ID NO: 4350509 - DNA, 20 bp, Homo sapiens
gccctcggaggtccagctgg

SEQ ID NO: 4350510 - DNA, 24 bp, Homo sapiens
gccctcggaggtccagctgggcct

SEQ ID NO: 4350511 - DNA, 11 bp, Homo sapiens
gccctttaaaa

SEQ ID NO: 4350512 - DNA, 23 bp, Homo sapiens
gcctcaagaaatatactctccca

SEQ ID NO: 4350513 - DNA, 18 bp, Homo sapiens
gcctccgctgggcttcat

SEQ ID NO: 4350514 - DNA, 16 bp, Homo sapiens
gcctggactgaccaca

SEQ ID NO: 4350515 - DNA, 16 bp, Homo sapiens
gcctgtcaccagagct

SEQ ID NO: 4350516 - DNA, 22 bp, Homo sapiens
gcctgtcaccagagcttctctg

SEQ ID NO: 4350517 - DNA, 21 bp, Homo sapiens
gccttcatcctcctccccagc

SEQ ID NO: 4350518 - DNA, 21 bp, Homo sapiens
gccttgctcctagcagacaga

SEQ ID NO: 4350519 - DNA, 13 bp, Homo sapiens
gccttttacctga

SEQ ID NO: 4350520 - DNA, 16 bp, Homo sapiens
gccttttatctgcaga

SEQ ID NO: 4350521 - DNA, 13 bp, Homo sapiens
gcggaagccaaag

SEQ ID NO: 4350522 - DNA, 20 bp, Homo sapiens
gcggaagccaaaggcagcta

SEQ ID NO: 4350523 - DNA, 16 bp, Homo sapiens
gctaaattctatgtta

SEQ ID NO: 4350524 - DNA, 19 bp, Homo sapiens
gctaagatagaaagctgga

SEQ ID NO: 4350525 - DNA, 17 bp, Homo sapiens
gctaatattaaaccttt

SEQ ID NO: 4350526 - DNA, 15 bp, Homo sapiens
gctagactcctcagg

SEQ ID NO: 4350527 - DNA, 20 bp, Homo sapiens
gctagagccgaggggagaga

SEQ ID NO: 4350528 - DNA, 17 bp, Homo sapiens
gctataaatgccagagc

SEQ ID NO: 4350529 - DNA, 18 bp, Homo sapiens
gctcagagcttgaagatt

SEQ ID NO: 4350530 - DNA, 14 bp, Homo sapiens
gctctcagaggaaa

SEQ ID NO: 4350531 - DNA, 20 bp, Homo sapiens
gctgaatgtatgtcagtgct

SEQ ID NO: 4350532 - DNA, 12 bp, Homo sapiens
gctgagccatga

SEQ ID NO: 4350533 - DNA, 15 bp, Homo sapiens
gctgagccatgagga

SEQ ID NO: 4350534 - DNA, 15 bp, Homo sapiens
gctgatgaagaaggg

SEQ ID NO: 4350535 - DNA, 18 bp, Homo sapiens
gctgcacctctggctaga

SEQ ID NO: 4350536 - DNA, 13 bp, Homo sapiens
gctgcccctctca

SEQ ID NO: 4350537 - DNA, 14 bp, Homo sapiens
gctgcccctctcac

SEQ ID NO: 4350538 - DNA, 12 bp, Homo sapiens
gctgctgcctgc

SEQ ID NO: 4350539 - DNA, 9 bp, Homo sapiens
gctgctgtt

SEQ ID NO: 4350540 - DNA, 20 bp, Homo sapiens
gctgggaacttctaaacact

SEQ ID NO: 4350541 - DNA, 13 bp, Homo sapiens
gctgggcctcctg

SEQ ID NO: 4350542 - DNA, 14 bp, Homo sapiens
gctgggcctcctgc

SEQ ID NO: 4350543 - DNA, 22 bp, Homo sapiens
gctgggcctcctgcctccgggc

SEQ ID NO: 4350544 - DNA, 23 bp, Homo sapiens
gctgggcttcattccggactggc

SEQ ID NO: 4350545 - DNA, 14 bp, Homo sapiens
gcttattttatgat

SEQ ID NO: 4350546 - DNA, 22 bp, Homo sapiens
gcttcattccggactggcagaa

SEQ ID NO: 4350547 - DNA, 13 bp, Homo sapiens
gcttctctgggct

SEQ ID NO: 4350548 - DNA, 14 bp, Homo sapiens
gcttctctgggctg

SEQ ID NO: 4350549 - DNA, 13 bp, Homo sapiens
gctttaaaaatgc

SEQ ID NO: 4350550 - DNA, 18 bp, Homo sapiens
gctttaaaaatgcaatat

SEQ ID NO: 4350551 - DNA, 22 bp, Homo sapiens
gctttaaaaatgcaatatctga

SEQ ID NO: 4350552 - DNA, 19 bp, Homo sapiens
gctttctgtgaaagcctta

SEQ ID NO: 4350553 - DNA, 15 bp, Homo sapiens
gctttgagttgactt

SEQ ID NO: 4350554 - DNA, 19 bp, Homo sapiens
ggaaaaatgggagccagga

SEQ ID NO: 4350555 - DNA, 15 bp, Homo sapiens
ggaaaggcaagcttg

SEQ ID NO: 4350556 - DNA, 19 bp, Homo sapiens
ggaaaggcttggctggtgt

SEQ ID NO: 4350557 - DNA, 23 bp, Homo sapiens
ggacacctcgcccttcagcccac

SEQ ID NO: 4350558 - DNA, 14 bp, Homo sapiens
ggacagctttattt

SEQ ID NO: 4350559 - DNA, 23 bp, Homo sapiens
ggacagctttattttaaatgtgg

SEQ ID NO: 4350560 - DNA, 14 bp, Homo sapiens
ggactcaagggaaa

SEQ ID NO: 4350561 - DNA, 14 bp, Homo sapiens
ggactccaggcctg

SEQ ID NO: 4350562 - DNA, 19 bp, Homo sapiens
ggactccaggcctgaccag

SEQ ID NO: 4350563 - DNA, 20 bp, Homo sapiens
ggactccaggcctgaccagg

SEQ ID NO: 4350564 - DNA, 21 bp, Homo sapiens
ggactgaccaaagactgcaga

SEQ ID NO: 4350565 - DNA, 15 bp, Homo sapiens
ggactggcagaagca

SEQ ID NO: 4350566 - DNA, 19 bp, Homo sapiens
ggacttgtttagagagcct

SEQ ID NO: 4350567 - DNA, 21 bp, Homo sapiens
ggagaagtgatatggtgaagg

SEQ ID NO: 4350568 - DNA, 14 bp, Homo sapiens
ggagacagaaagcc

SEQ ID NO: 4350569 - DNA, 18 bp, Homo sapiens
ggagacagaaagcctccg

SEQ ID NO: 4350570 - DNA, 21 bp, Homo sapiens
ggagagacccctcccctccca

SEQ ID NO: 4350571 - DNA, 14 bp, Homo sapiens
ggagagagggactc

SEQ ID NO: 4350572 - DNA, 22 bp, Homo sapiens
ggaggcccctgaggcagcccag

SEQ ID NO: 4350573 - DNA, 16 bp, Homo sapiens
ggagtaagacaagtgg

SEQ ID NO: 4350574 - DNA, 18 bp, Homo sapiens
ggatccatggggggagaa

SEQ ID NO: 4350575 - DNA, 22 bp, Homo sapiens
ggatccatggggggagaagtga

SEQ ID NO: 4350576 - DNA, 22 bp, Homo sapiens
ggatggtggactacaaaataca

SEQ ID NO: 4350577 - DNA, 21 bp, Homo sapiens
ggcaagactgcaaactttttt

SEQ ID NO: 4350578 - DNA, 16 bp, Homo sapiens
ggcaagcttgaggcca

SEQ ID NO: 4350579 - DNA, 15 bp, Homo sapiens
ggcagagaagttctc

SEQ ID NO: 4350580 - DNA, 23 bp, Homo sapiens
ggcagagcaattccaggctgagc

SEQ ID NO: 4350581 - DNA, 22 bp, Homo sapiens
ggcagcccagctcctgaataaa

SEQ ID NO: 4350582 - DNA, 23 bp, Homo sapiens
ggcagctaagatagaaagctgga

SEQ ID NO: 4350583 - DNA, 13 bp, Homo sapiens
ggcaggctgggcc

SEQ ID NO: 4350584 - DNA, 14 bp, Homo sapiens
ggcaggctgggcca

SEQ ID NO: 4350585 - DNA, 16 bp, Homo sapiens
ggcaggctgggccatg

SEQ ID NO: 4350586 - DNA, 14 bp, Homo sapiens
ggccaccatggtca

SEQ ID NO: 4350587 - DNA, 23 bp, Homo sapiens
ggccatgtccaaagaggctgccc

SEQ ID NO: 4350588 - DNA, 17 bp, Homo sapiens
ggcccgaacagggactt

SEQ ID NO: 4350589 - DNA, 17 bp, Homo sapiens
ggccttcatcctcctcc

SEQ ID NO: 4350590 - DNA, 14 bp, Homo sapiens
ggctagagccgagg

SEQ ID NO: 4350591 - DNA, 15 bp, Homo sapiens
ggctctcagaggaaa

SEQ ID NO: 4350592 - DNA, 12 bp, Homo sapiens
ggctgagccatg

SEQ ID NO: 4350593 - DNA, 14 bp, Homo sapiens
ggctgagccatgag

SEQ ID NO: 4350594 - DNA, 14 bp, Homo sapiens
ggctgctgcctgct

SEQ ID NO: 4350595 - DNA, 11 bp, Homo sapiens
ggctgggccat

SEQ ID NO: 4350596 - DNA, 18 bp, Homo sapiens
ggctggtgtatgcacagg

SEQ ID NO: 4350597 - DNA, 15 bp, Homo sapiens
ggctttttctgccac

SEQ ID NO: 4350598 - DNA, 13 bp, Homo sapiens
gggcaggctgggc

SEQ ID NO: 4350599 - DNA, 15 bp, Homo sapiens
gggcaggctgggcca

SEQ ID NO: 4350600 - DNA, 14 bp, Homo sapiens
gggccatgtccaaa

SEQ ID NO: 4350601 - DNA, 15 bp, Homo sapiens
gggccatgtccaaag

SEQ ID NO: 4350602 - DNA, 17 bp, Homo sapiens
gggccatgtccaaagag

SEQ ID NO: 4350603 - DNA, 21 bp, Homo sapiens
gggccatgtccaaagaggctg

SEQ ID NO: 4350604 - DNA, 22 bp, Homo sapiens
gggccatgtccaaagaggctgc

SEQ ID NO: 4350605 - DNA, 16 bp, Homo sapiens
gggcctgagcagctgg

SEQ ID NO: 4350606 - DNA, 23 bp, Homo sapiens
gggctgaatgtatgtcagtgcta

SEQ ID NO: 4350607 - DNA, 21 bp, Homo sapiens
gggcttcattccggactggca

SEQ ID NO: 4350608 - DNA, 22 bp, Homo sapiens
ggggagaagtgatatggtgaag

SEQ ID NO: 4350609 - DNA, 21 bp, Homo sapiens
ggggaggcccctgaggcagcc

SEQ ID NO: 4350610 - DNA, 14 bp, Homo sapiens
ggggcccgaacagg

SEQ ID NO: 4350611 - DNA, 13 bp, Homo sapiens
gggtggggggagt

SEQ ID NO: 4350612 - DNA, 13 bp, Homo sapiens
ggtaaattcagac

SEQ ID NO: 4350613 - DNA, 19 bp, Homo sapiens
ggtaaattcagacaacatt

SEQ ID NO: 4350614 - DNA, 15 bp, Homo sapiens
ggtagcataaataaa

SEQ ID NO: 4350615 - DNA, 13 bp, Homo sapiens
ggtatgagggggt

SEQ ID NO: 4350616 - DNA, 16 bp, Homo sapiens
ggtcatcaccaccctt

SEQ ID NO: 4350617 - DNA, 15 bp, Homo sapiens
ggtccagctgggcct

SEQ ID NO: 4350618 - DNA, 22 bp, Homo sapiens
ggtctgtgtaacatccaagcca

SEQ ID NO: 4350619 - DNA, 22 bp, Homo sapiens
ggtggttattggactccaggcc

SEQ ID NO: 4350620 - DNA, 13 bp, Homo sapiens
ggttattggactc

SEQ ID NO: 4350621 - DNA, 20 bp, Homo sapiens
ggttctgcagcggcagagca

SEQ ID NO: 4350622 - DNA, 18 bp, Homo sapiens
ggttgaaaatgtgtttgc

SEQ ID NO: 4350623 - DNA, 20 bp, Homo sapiens
ggttgaaaatgtgtttgctg

SEQ ID NO: 4350624 - DNA, 15 bp, Homo sapiens
ggttgttggtctgtg

SEQ ID NO: 4350625 - DNA, 21 bp, Homo sapiens
ggtttcaattcagattgtctt

SEQ ID NO: 4350626 - DNA, 14 bp, Homo sapiens
ggttttgtgcttta

SEQ ID NO: 4350627 - DNA, 14 bp, Homo sapiens
ggtttttatgaact

SEQ ID NO: 4350628 - DNA, 13 bp, Homo sapiens
gtaaattcagaca

SEQ ID NO: 4350629 - DNA, 20 bp, Homo sapiens
gtaaattcagacaacattat

SEQ ID NO: 4350630 - DNA, 15 bp, Homo sapiens
gtaacatccaagcca

SEQ ID NO: 4350631 - DNA, 18 bp, Homo sapiens
gtaacatccaagccagag

SEQ ID NO: 4350632 - DNA, 19 bp, Homo sapiens
gtaacatccaagccagagt

SEQ ID NO: 4350633 - DNA, 16 bp, Homo sapiens
gtaagacaagtgggat

SEQ ID NO: 4350634 - DNA, 18 bp, Homo sapiens
gtaatattttactttgag

SEQ ID NO: 4350635 - DNA, 21 bp, Homo sapiens
gtacaagttgttattgttgaa

SEQ ID NO: 4350636 - DNA, 21 bp, Homo sapiens
gtaccacagacacaatatgta

SEQ ID NO: 4350637 - DNA, 22 bp, Homo sapiens
gtaccacagacacaatatgtat

SEQ ID NO: 4350638 - DNA, 23 bp, Homo sapiens
gtaccctgagcccaccagggaca

SEQ ID NO: 4350639 - DNA, 17 bp, Homo sapiens
gtagaaaagttgcagat

SEQ ID NO: 4350640 - DNA, 20 bp, Homo sapiens
gtagcataaataaaactgaa

SEQ ID NO: 4350641 - DNA, 17 bp, Homo sapiens
gtagctacactgtataa

SEQ ID NO: 4350642 - DNA, 22 bp, Homo sapiens
gtagttgtattcttctgtattt

SEQ ID NO: 4350643 - DNA, 13 bp, Homo sapiens
gtataatgtttaa

SEQ ID NO: 4350644 - DNA, 16 bp, Homo sapiens
gtataatgtttaaatc

SEQ ID NO: 4350645 - DNA, 19 bp, Homo sapiens
gtataatgtttaaatcatg

SEQ ID NO: 4350646 - DNA, 21 bp, Homo sapiens
gtatctgtagctacactgtat

SEQ ID NO: 4350647 - DNA, 17 bp, Homo sapiens
gtatgtcagtgctataa

SEQ ID NO: 4350648 - DNA, 15 bp, Homo sapiens
gtattgactgtacca

SEQ ID NO: 4350649 - DNA, 16 bp, Homo sapiens
gtcaccagagcttctc

SEQ ID NO: 4350650 - DNA, 21 bp, Homo sapiens
gtcagtgctataaatgccaga

SEQ ID NO: 4350651 - DNA, 22 bp, Homo sapiens
gtcagtgctataaatgccagag

SEQ ID NO: 4350652 - DNA, 15 bp, Homo sapiens
gtcatcaccaccctt

SEQ ID NO: 4350653 - DNA, 16 bp, Homo sapiens
gtccaaagaggctgcc

SEQ ID NO: 4350654 - DNA, 13 bp, Homo sapiens
gtccagctgggcc

SEQ ID NO: 4350655 - DNA, 19 bp, Homo sapiens
gtccagctgggcctcctgc

SEQ ID NO: 4350656 - DNA, 20 bp, Homo sapiens
gtccagctgggcctcctgcc

SEQ ID NO: 4350657 - DNA, 21 bp, Homo sapiens
gtccagctgggcctcctgcct

SEQ ID NO: 4350658 - DNA, 22 bp, Homo sapiens
gtccagctgggcctcctgcctc

SEQ ID NO: 4350659 - DNA, 13 bp, Homo sapiens
gtctcactgttct

SEQ ID NO: 4350660 - DNA, 15 bp, Homo sapiens
gtctcactgttctgc

SEQ ID NO: 4350661 - DNA, 23 bp, Homo sapiens
gtctgtgtaacatccaagccaga

SEQ ID NO: 4350662 - DNA, 18 bp, Homo sapiens
gtcttttttctcttccct

SEQ ID NO: 4350663 - DNA, 14 bp, Homo sapiens
gtgaagggaagtgg

SEQ ID NO: 4350664 - DNA, 19 bp, Homo sapiens
gtgatatggtgaagggaag

SEQ ID NO: 4350665 - DNA, 20 bp, Homo sapiens
gtgcagaataatggaaacat

SEQ ID NO: 4350666 - DNA, 18 bp, Homo sapiens
gtgctataaatgccagag

SEQ ID NO: 4350667 - DNA, 22 bp, Homo sapiens
gtgctataaatgccagagccaa

SEQ ID NO: 4350668 - DNA, 14 bp, Homo sapiens
gtgctttctgtgaa

SEQ ID NO: 4350669 - DNA, 22 bp, Homo sapiens
gtggactctgctagactcctca

SEQ ID NO: 4350670 - DNA, 15 bp, Homo sapiens
gtggatgactgttga

SEQ ID NO: 4350671 - DNA, 14 bp, Homo sapiens
gtggtaaattcaga

SEQ ID NO: 4350672 - DNA, 16 bp, Homo sapiens
gtggtaaattcagaca

SEQ ID NO: 4350673 - DNA, 23 bp, Homo sapiens
gtggttattggactccaggcctg

SEQ ID NO: 4350674 - DNA, 17 bp, Homo sapiens
gtgtataatgtgcttta

SEQ ID NO: 4350675 - DNA, 19 bp, Homo sapiens
gtgttgttgttgctgctgt

SEQ ID NO: 4350676 - DNA, 13 bp, Homo sapiens
gttaaatactgtg

SEQ ID NO: 4350677 - DNA, 17 bp, Homo sapiens
gttaaatactgtgcaga

SEQ ID NO: 4350678 - DNA, 20 bp, Homo sapiens
gttaaatactgtgcagaata

SEQ ID NO: 4350679 - DNA, 21 bp, Homo sapiens
gttaaatactgtgcagaataa

SEQ ID NO: 4350680 - DNA, 22 bp, Homo sapiens
gttaaatactgtgcagaataat

SEQ ID NO: 4350681 - DNA, 12 bp, Homo sapiens
gttaattttacc

SEQ ID NO: 4350682 - DNA, 11 bp, Homo sapiens
gttatgtatga

SEQ ID NO: 4350683 - DNA, 20 bp, Homo sapiens
gttatgtatgaaggaatcat

SEQ ID NO: 4350684 - DNA, 21 bp, Homo sapiens
gttattctaagccctttgcca

SEQ ID NO: 4350685 - DNA, 14 bp, Homo sapiens
gttattggactcca

SEQ ID NO: 4350686 - DNA, 19 bp, Homo sapiens
gttattggactccaggcct

SEQ ID NO: 4350687 - DNA, 21 bp, Homo sapiens
gttattgttgaacatacttca

SEQ ID NO: 4350688 - DNA, 14 bp, Homo sapiens
gttgtattcttctg

SEQ ID NO: 4350689 - DNA, 13 bp, Homo sapiens
gttgttgctgctg

SEQ ID NO: 4350690 - DNA, 15 bp, Homo sapiens
gttgttggtctgtgt

SEQ ID NO: 4350691 - DNA, 14 bp, Homo sapiens
gtttaaaaagtaag

SEQ ID NO: 4350692 - DNA, 19 bp, Homo sapiens
gtttaaaaagtaagttaat

SEQ ID NO: 4350693 - DNA, 17 bp, Homo sapiens
gtttaaatcatgtatgt

SEQ ID NO: 4350694 - DNA, 13 bp, Homo sapiens
gtttataatctga

SEQ ID NO: 4350695 - DNA, 20 bp, Homo sapiens
gtttgtgttgttgttgctgc

SEQ ID NO: 4350696 - DNA, 21 bp, Homo sapiens
gtttgtgttgttgttgctgct

SEQ ID NO: 4350697 - DNA, 20 bp, Homo sapiens
gttttgtattttttaaaaca

SEQ ID NO: 4350698 - DNA, 22 bp, Homo sapiens
gttttgtattttttaaaacact

SEQ ID NO: 4350699 - DNA, 15 bp, Homo sapiens
gttttgtgctttaaa

SEQ ID NO: 4350700 - DNA, 21 bp, Homo sapiens
gttttgtgctttaaaaatgca

SEQ ID NO: 4350701 - DNA, 15 bp, Homo sapiens
gtttttgatgccttt

SEQ ID NO: 4350702 - DNA, 14 bp, Homo sapiens
taaaaatgcaatat

SEQ ID NO: 4350703 - DNA, 21 bp, Homo sapiens
taaaacgtcttagagcctttt

SEQ ID NO: 4350704 - DNA, 21 bp, Homo sapiens
taaaattcagtttttgtatct

SEQ ID NO: 4350705 - DNA, 17 bp, Homo sapiens
taaacagtagttgtatt

SEQ ID NO: 4350706 - DNA, 13 bp, Homo sapiens
taaacctttcagt

SEQ ID NO: 4350707 - DNA, 13 bp, Homo sapiens
taaactaaataat

SEQ ID NO: 4350708 - DNA, 15 bp, Homo sapiens
taaactaaataatga

SEQ ID NO: 4350709 - DNA, 20 bp, Homo sapiens
taaactgaatattttggaaa

SEQ ID NO: 4350710 - DNA, 12 bp, Homo sapiens
taaactttattt

SEQ ID NO: 4350711 - DNA, 18 bp, Homo sapiens
taaagattctacaacaca

SEQ ID NO: 4350712 - DNA, 14 bp, Homo sapiens
taaagcatctgtaa

SEQ ID NO: 4350713 - DNA, 16 bp, Homo sapiens
taaagcatctgtaaat

SEQ ID NO: 4350714 - DNA, 16 bp, Homo sapiens
taaagccttctggatc

SEQ ID NO: 4350715 - DNA, 18 bp, Homo sapiens
taaataaaatcatgtagt

SEQ ID NO: 4350716 - DNA, 18 bp, Homo sapiens
taaataatgaataaactg

SEQ ID NO: 4350717 - DNA, 20 bp, Homo sapiens
taaataatgaataaactgaa

SEQ ID NO: 4350718 - DNA, 21 bp, Homo sapiens
taaataatgaataaactgaat

SEQ ID NO: 4350719 - DNA, 21 bp, Homo sapiens
taaatactgtgcagaataatg

SEQ ID NO: 4350720 - DNA, 14 bp, Homo sapiens
taaatcatgtatgt

SEQ ID NO: 4350721 - DNA, 15 bp, Homo sapiens
taaatgccagagcca

SEQ ID NO: 4350722 - DNA, 13 bp, Homo sapiens
taaattctatgtt

SEQ ID NO: 4350723 - DNA, 16 bp, Homo sapiens
taaattctatgttaaa

SEQ ID NO: 4350724 - DNA, 20 bp, Homo sapiens
taaattctatgttaaatact

SEQ ID NO: 4350725 - DNA, 22 bp, Homo sapiens
taaattctatgttaaatactgt

SEQ ID NO: 4350726 - DNA, 20 bp, Homo sapiens
taaatttatcaactgtcaaa

SEQ ID NO: 4350727 - DNA, 23 bp, Homo sapiens
taacttcaggtaaaaacttcatt

SEQ ID NO: 4350728 - DNA, 15 bp, Homo sapiens
taacttgtgaagaca

SEQ ID NO: 4350729 - DNA, 20 bp, Homo sapiens
taagatagaaagctggactg

SEQ ID NO: 4350730 - DNA, 22 bp, Homo sapiens
taagtgatgtgctgaattttat

SEQ ID NO: 4350731 - DNA, 11 bp, Homo sapiens
taataaacttt

SEQ ID NO: 4350732 - DNA, 13 bp, Homo sapiens
taataaactttat

SEQ ID NO: 4350733 - DNA, 13 bp, Homo sapiens
taataatgtattg

SEQ ID NO: 4350734 - DNA, 21 bp, Homo sapiens
taatatatcaaatccaggact

SEQ ID NO: 4350735 - DNA, 18 bp, Homo sapiens
taatccagtattgctgat

SEQ ID NO: 4350736 - DNA, 23 bp, Homo sapiens
taatctgaagatatatttcactt

SEQ ID NO: 4350737 - DNA, 18 bp, Homo sapiens
taatggaaacattacagt

SEQ ID NO: 4350738 - DNA, 15 bp, Homo sapiens
taatgtctcactgtt

SEQ ID NO: 4350739 - DNA, 11 bp, Homo sapiens
taatgtttaaa

SEQ ID NO: 4350740 - DNA, 14 bp, Homo sapiens
taatgtttaaatca

SEQ ID NO: 4350741 - DNA, 19 bp, Homo sapiens
taatgtttaaatcatgtat

SEQ ID NO: 4350742 - DNA, 20 bp, Homo sapiens
taatgtttaaatcatgtatg

SEQ ID NO: 4350743 - DNA, 21 bp, Homo sapiens
taatgtttaaatcatgtatgt

SEQ ID NO: 4350744 - DNA, 17 bp, Homo sapiens
taattcttcacctgtta

SEQ ID NO: 4350745 - DNA, 14 bp, Homo sapiens
taatttatatgcat

SEQ ID NO: 4350746 - DNA, 15 bp, Homo sapiens
taatttatatgcatg

SEQ ID NO: 4350747 - DNA, 17 bp, Homo sapiens
taatttatatgcatgca

SEQ ID NO: 4350748 - DNA, 14 bp, Homo sapiens
tacaaagtgtacca

SEQ ID NO: 4350749 - DNA, 15 bp, Homo sapiens
tacaatcctgtttat

SEQ ID NO: 4350750 - DNA, 16 bp, Homo sapiens
tacactgcggaagcca

SEQ ID NO: 4350751 - DNA, 17 bp, Homo sapiens
tacactgcggaagccaa

SEQ ID NO: 4350752 - DNA, 20 bp, Homo sapiens
tacactgcggaagccaaagg

SEQ ID NO: 4350753 - DNA, 17 bp, Homo sapiens
tacactgtataactgtt

SEQ ID NO: 4350754 - DNA, 23 bp, Homo sapiens
tacagaataatccagtattgctg

SEQ ID NO: 4350755 - DNA, 19 bp, Homo sapiens
tacattggaagctttgagt

SEQ ID NO: 4350756 - DNA, 23 bp, Homo sapiens
taccaagagtaactttactctgt

SEQ ID NO: 4350757 - DNA, 17 bp, Homo sapiens
tacgtgttcacaggctg

SEQ ID NO: 4350758 - DNA, 20 bp, Homo sapiens
tactctgtgtttaaaaagta

SEQ ID NO: 4350759 - DNA, 16 bp, Homo sapiens
tacttcaaaaataatg

SEQ ID NO: 4350760 - DNA, 22 bp, Homo sapiens
tacttgatttgatgtgactttt

SEQ ID NO: 4350761 - DNA, 14 bp, Homo sapiens
tactttatatatgt

SEQ ID NO: 4350762 - DNA, 16 bp, Homo sapiens
tacttttcccctgtta

SEQ ID NO: 4350763 - DNA, 20 bp, Homo sapiens
tactttttcccatctggctt

SEQ ID NO: 4350764 - DNA, 17 bp, Homo sapiens
tagaaaagttgcagatg

SEQ ID NO: 4350765 - DNA, 21 bp, Homo sapiens
tagaaaagttgcagatgtatt

SEQ ID NO: 4350766 - DNA, 22 bp, Homo sapiens
tagaaaagttgcagatgtattg

SEQ ID NO: 4350767 - DNA, 23 bp, Homo sapiens
tagaaaagttgcagatgtattga

SEQ ID NO: 4350768 - DNA, 23 bp, Homo sapiens
tagaaaatttagccctttaaaac

SEQ ID NO: 4350769 - DNA, 13 bp, Homo sapiens
tagaaagctggac

SEQ ID NO: 4350770 - DNA, 18 bp, Homo sapiens
tagaaagctggactgacc

SEQ ID NO: 4350771 - DNA, 20 bp, Homo sapiens
tagaaagctggactgaccaa

SEQ ID NO: 4350772 - DNA, 18 bp, Homo sapiens
tagactcctcaggagaga

SEQ ID NO: 4350773 - DNA, 16 bp, Homo sapiens
tagactgcaagaactg

SEQ ID NO: 4350774 - DNA, 20 bp, Homo sapiens
tagactttgccttttacctg

SEQ ID NO: 4350775 - DNA, 12 bp, Homo sapiens
tagagagcctgt

SEQ ID NO: 4350776 - DNA, 13 bp, Homo sapiens
tagagagcctgtc

SEQ ID NO: 4350777 - DNA, 19 bp, Homo sapiens
tagagagcctgtcaccaga

SEQ ID NO: 4350778 - DNA, 22 bp, Homo sapiens
tagagagcctgtcaccagagct

SEQ ID NO: 4350779 - DNA, 14 bp, Homo sapiens
tagagccgagggga

SEQ ID NO: 4350780 - DNA, 17 bp, Homo sapiens
tagatctgcaggctgca

SEQ ID NO: 4350781 - DNA, 13 bp, Homo sapiens
tagcagacagaaa

SEQ ID NO: 4350782 - DNA, 17 bp, Homo sapiens
tagcagacagaaactgg

SEQ ID NO: 4350783 - DNA, 13 bp, Homo sapiens
tagcataaataaa

SEQ ID NO: 4350784 - DNA, 20 bp, Homo sapiens
tagcataaataaaactgaat

SEQ ID NO: 4350785 - DNA, 14 bp, Homo sapiens
tagggaaaggtttt

SEQ ID NO: 4350786 - DNA, 18 bp, Homo sapiens
tagggaaaggttttgtat

SEQ ID NO: 4350787 - DNA, 16 bp, Homo sapiens
tagtgaagatggtttc

SEQ ID NO: 4350788 - DNA, 21 bp, Homo sapiens
tagtggatgactgttgatgaa

SEQ ID NO: 4350789 - DNA, 23 bp, Homo sapiens
tagtggatgactgttgatgaagt

SEQ ID NO: 4350790 - DNA, 19 bp, Homo sapiens
tagttgtattcttctgtat

SEQ ID NO: 4350791 - DNA, 15 bp, Homo sapiens
tagtttggatatttt

SEQ ID NO: 4350792 - DNA, 21 bp, Homo sapiens
tagtttggatatttttgtact

SEQ ID NO: 4350793 - DNA, 14 bp, Homo sapiens
tataaatgccagag

SEQ ID NO: 4350794 - DNA, 15 bp, Homo sapiens
tataaatgccagagc

SEQ ID NO: 4350795 - DNA, 17 bp, Homo sapiens
tataaatgccagagcca

SEQ ID NO: 4350796 - DNA, 21 bp, Homo sapiens
tataaatgccagagccaacct

SEQ ID NO: 4350797 - DNA, 22 bp, Homo sapiens
tataaccatgttctatattctt

SEQ ID NO: 4350798 - DNA, 16 bp, Homo sapiens
tataatgtttaaatca

SEQ ID NO: 4350799 - DNA, 15 bp, Homo sapiens
tatatcattctacag

SEQ ID NO: 4350800 - DNA, 20 bp, Homo sapiens
tatatcttttggttattcta

SEQ ID NO: 4350801 - DNA, 19 bp, Homo sapiens
tatatgcatgcacaggaag

SEQ ID NO: 4350802 - DNA, 20 bp, Homo sapiens
tatatgtcagagctgttata

SEQ ID NO: 4350803 - DNA, 22 bp, Homo sapiens
tatattgagaatcccttaaaat

SEQ ID NO: 4350804 - DNA, 22 bp, Homo sapiens
tatattttgtgtataatgtgct

SEQ ID NO: 4350805 - DNA, 14 bp, Homo sapiens
tatcattctacaga

SEQ ID NO: 4350806 - DNA, 11 bp, Homo sapiens
tatctgcagaa

SEQ ID NO: 4350807 - DNA, 14 bp, Homo sapiens
tatctgcagaacat

SEQ ID NO: 4350808 - DNA, 12 bp, Homo sapiens
tatcttttcata

SEQ ID NO: 4350809 - DNA, 23 bp, Homo sapiens
tatgaactgcatcaagacttcaa

SEQ ID NO: 4350810 - DNA, 14 bp, Homo sapiens
tatgagggggtggt

SEQ ID NO: 4350811 - DNA, 23 bp, Homo sapiens
tatgatattgtttaaaattcagt

SEQ ID NO: 4350812 - DNA, 16 bp, Homo sapiens
tatgatctaataaact

SEQ ID NO: 4350813 - DNA, 18 bp, Homo sapiens
tatgatctaataaacttt

SEQ ID NO: 4350814 - DNA, 20 bp, Homo sapiens
tatgatctaataaactttat

SEQ ID NO: 4350815 - DNA, 15 bp, Homo sapiens
tatggtgaagggaag

SEQ ID NO: 4350816 - DNA, 21 bp, Homo sapiens
tatgtcagtgctataaatgcc

SEQ ID NO: 4350817 - DNA, 13 bp, Homo sapiens
tatgttaaatact

SEQ ID NO: 4350818 - DNA, 16 bp, Homo sapiens
tatgttaaatactgtg

SEQ ID NO: 4350819 - DNA, 16 bp, Homo sapiens
tatgttattttgtgta

SEQ ID NO: 4350820 - DNA, 16 bp, Homo sapiens
tattaaacctttcagt

SEQ ID NO: 4350821 - DNA, 18 bp, Homo sapiens
tattgagaatcccttaaa

SEQ ID NO: 4350822 - DNA, 22 bp, Homo sapiens
tattgagaatcccttaaaatta

SEQ ID NO: 4350823 - DNA, 15 bp, Homo sapiens
tattgccatgaacca

SEQ ID NO: 4350824 - DNA, 23 bp, Homo sapiens
tattgccatgaaccatgcttaca

SEQ ID NO: 4350825 - DNA, 15 bp, Homo sapiens
tattgtttaaaattc

SEQ ID NO: 4350826 - DNA, 23 bp, Homo sapiens
tatttagtatctagtcagtatct

SEQ ID NO: 4350827 - DNA, 13 bp, Homo sapiens
tattttaaatgtg

SEQ ID NO: 4350828 - DNA, 13 bp, Homo sapiens
tattttggaaact

SEQ ID NO: 4350829 - DNA, 23 bp, Homo sapiens
tattttggaaactgctaaattct

SEQ ID NO: 4350830 - DNA, 17 bp, Homo sapiens
tattttttaacatgaaa

SEQ ID NO: 4350831 - DNA, 14 bp, Homo sapiens
tcaaagtaatatat

SEQ ID NO: 4350832 - DNA, 14 bp, Homo sapiens
tcaaatccaggact

SEQ ID NO: 4350833 - DNA, 16 bp, Homo sapiens
tcaattggcagtgact

SEQ ID NO: 4350834 - DNA, 11 bp, Homo sapiens
tcaccagagct

SEQ ID NO: 4350835 - DNA, 12 bp, Homo sapiens
tcaccagagctt

SEQ ID NO: 4350836 - DNA, 17 bp, Homo sapiens
tcaccagagcttctctg

SEQ ID NO: 4350837 - DNA, 20 bp, Homo sapiens
tcaccagagcttctctgggc

SEQ ID NO: 4350838 - DNA, 16 bp, Homo sapiens
tcacctatgttatttt

SEQ ID NO: 4350839 - DNA, 12 bp, Homo sapiens
tcactgttctgc

SEQ ID NO: 4350840 - DNA, 13 bp, Homo sapiens
tcactgttctgca

SEQ ID NO: 4350841 - DNA, 14 bp, Homo sapiens
tcagacaacattat

SEQ ID NO: 4350842 - DNA, 17 bp, Homo sapiens
tcagacaacattatgat

SEQ ID NO: 4350843 - DNA, 16 bp, Homo sapiens
tcagagctgttataaa

SEQ ID NO: 4350844 - DNA, 16 bp, Homo sapiens
tcagattgtcttgcaa

SEQ ID NO: 4350845 - DNA, 17 bp, Homo sapiens
tcaggtaaaaacttcat

SEQ ID NO: 4350846 - DNA, 13 bp, Homo sapiens
tcagtttttgtat

SEQ ID NO: 4350847 - DNA, 17 bp, Homo sapiens
tcagtttttgtatcttg

SEQ ID NO: 4350848 - DNA, 17 bp, Homo sapiens
tcataaagggttgaaaa

SEQ ID NO: 4350849 - DNA, 20 bp, Homo sapiens
tcataaagggttgaaaatgt

SEQ ID NO: 4350850 - DNA, 12 bp, Homo sapiens
tcatacaagcca

SEQ ID NO: 4350851 - DNA, 14 bp, Homo sapiens
tcatactgtagaaa

SEQ ID NO: 4350852 - DNA, 15 bp, Homo sapiens
tcatagggaaaggtt

SEQ ID NO: 4350853 - DNA, 22 bp, Homo sapiens
tcatagggaaaggttttgtatt

SEQ ID NO: 4350854 - DNA, 13 bp, Homo sapiens
tcatcaccaccct

SEQ ID NO: 4350855 - DNA, 17 bp, Homo sapiens
tcatcaccacccttcca

SEQ ID NO: 4350856 - DNA, 13 bp, Homo sapiens
tcatccaaaatat

SEQ ID NO: 4350857 - DNA, 20 bp, Homo sapiens
tcatccaaaatattttttgc

SEQ ID NO: 4350858 - DNA, 22 bp, Homo sapiens
tcatccaaaatattttttgcaa

SEQ ID NO: 4350859 - DNA, 23 bp, Homo sapiens
tcatcctcctccccagctcttct

SEQ ID NO: 4350860 - DNA, 13 bp, Homo sapiens
tcattccagtgct

SEQ ID NO: 4350861 - DNA, 14 bp, Homo sapiens
tcattccagtgcta

SEQ ID NO: 4350862 - DNA, 20 bp, Homo sapiens
tcattccagtgctagaaaat

SEQ ID NO: 4350863 - DNA, 21 bp, Homo sapiens
tcattccggactggcagaagc

SEQ ID NO: 4350864 - DNA, 14 bp, Homo sapiens
tcattctacagaat

SEQ ID NO: 4350865 - DNA, 16 bp, Homo sapiens
tcattctacagaataa

SEQ ID NO: 4350866 - DNA, 19 bp, Homo sapiens
tccaaagaggctgcccctc

SEQ ID NO: 4350867 - DNA, 22 bp, Homo sapiens
tccaaagttggagcttctattg

SEQ ID NO: 4350868 - DNA, 13 bp, Homo sapiens
tccagctgggcct

SEQ ID NO: 4350869 - DNA, 14 bp, Homo sapiens
tccagctgggcctc

SEQ ID NO: 4350870 - DNA, 23 bp, Homo sapiens
tccagctgggcctcctgcctccg

SEQ ID NO: 4350871 - DNA, 15 bp, Homo sapiens
tccaggctgagccat

SEQ ID NO: 4350872 - DNA, 19 bp, Homo sapiens
tcccacccacagccataga

SEQ ID NO: 4350873 - DNA, 22 bp, Homo sapiens
tcccatctggctttttctgcca

SEQ ID NO: 4350874 - DNA, 15 bp, Homo sapiens
tccccagctcttctc

SEQ ID NO: 4350875 - DNA, 20 bp, Homo sapiens
tcccctcccacccacagcca

SEQ ID NO: 4350876 - DNA, 12 bp, Homo sapiens
tcccttaaaatt

SEQ ID NO: 4350877 - DNA, 14 bp, Homo sapiens
tcccttcccagacc

SEQ ID NO: 4350878 - DNA, 14 bp, Homo sapiens
tccgctgggcttca

SEQ ID NO: 4350879 - DNA, 17 bp, Homo sapiens
tccggactggcagaagc

SEQ ID NO: 4350880 - DNA, 22 bp, Homo sapiens
tccgggcaggcaaggtttacac

SEQ ID NO: 4350881 - DNA, 19 bp, Homo sapiens
tcctagatctgcaggctgc

SEQ ID NO: 4350882 - DNA, 17 bp, Homo sapiens
tcctagtggatgactgt

SEQ ID NO: 4350883 - DNA, 14 bp, Homo sapiens
tcctccccagctct

SEQ ID NO: 4350884 - DNA, 22 bp, Homo sapiens
tcctccccagctcttctcttcc

SEQ ID NO: 4350885 - DNA, 13 bp, Homo sapiens
tcctcctccccag

SEQ ID NO: 4350886 - DNA, 14 bp, Homo sapiens
tcctctgctgccat

SEQ ID NO: 4350887 - DNA, 14 bp, Homo sapiens
tcctgcatttgata

SEQ ID NO: 4350888 - DNA, 20 bp, Homo sapiens
tcctgcctccgggcaggcaa

SEQ ID NO: 4350889 - DNA, 19 bp, Homo sapiens
tcctgtttataatctgaag

SEQ ID NO: 4350890 - DNA, 17 bp, Homo sapiens
tccttaagagaagaaat

SEQ ID NO: 4350891 - DNA, 14 bp, Homo sapiens
tccttcattcatag

SEQ ID NO: 4350892 - DNA, 17 bp, Homo sapiens
tcctttacaaccatact

SEQ ID NO: 4350893 - DNA, 16 bp, Homo sapiens
tcgcccttcagcccac

SEQ ID NO: 4350894 - DNA, 14 bp, Homo sapiens
tcggacatagagtt

SEQ ID NO: 4350895 - DNA, 22 bp, Homo sapiens
tcgtttgtattctacctttgta

SEQ ID NO: 4350896 - DNA, 23 bp, Homo sapiens
tcgtttgtattctacctttgtaa

SEQ ID NO: 4350897 - DNA, 17 bp, Homo sapiens
tctacagaataatccag

SEQ ID NO: 4350898 - DNA, 14 bp, Homo sapiens
tctacctttgtaaa

SEQ ID NO: 4350899 - DNA, 15 bp, Homo sapiens
tctagactgcaagaa

SEQ ID NO: 4350900 - DNA, 20 bp, Homo sapiens
tctatgttaaatactgtgca

SEQ ID NO: 4350901 - DNA, 17 bp, Homo sapiens
tctattccctaacttgt

SEQ ID NO: 4350902 - DNA, 11 bp, Homo sapiens
tctcaaagtta

SEQ ID NO: 4350903 - DNA, 17 bp, Homo sapiens
tctcactgttctgcaaa

SEQ ID NO: 4350904 - DNA, 14 bp, Homo sapiens
tctcatacaagcca

SEQ ID NO: 4350905 - DNA, 17 bp, Homo sapiens
tctccaaagttggagct

SEQ ID NO: 4350906 - DNA, 15 bp, Homo sapiens
tctgaagatatattt

SEQ ID NO: 4350907 - DNA, 22 bp, Homo sapiens
tctgaagatatatttcactttt

SEQ ID NO: 4350908 - DNA, 21 bp, Homo sapiens
tctgcaaaggtggcaatgctt

SEQ ID NO: 4350909 - DNA, 13 bp, Homo sapiens
tctgcagcggcag

SEQ ID NO: 4350910 - DNA, 19 bp, Homo sapiens
tctgcagcggcagagcaat

SEQ ID NO: 4350911 - DNA, 17 bp, Homo sapiens
tctgctagactcctcag

SEQ ID NO: 4350912 - DNA, 15 bp, Homo sapiens
tctgctttatctttt

SEQ ID NO: 4350913 - DNA, 17 bp, Homo sapiens
tctgctttatcttttca

SEQ ID NO: 4350914 - DNA, 14 bp, Homo sapiens
tctggctagagccg

SEQ ID NO: 4350915 - DNA, 22 bp, Homo sapiens
tctggctagagccgaggggaga

SEQ ID NO: 4350916 - DNA, 23 bp, Homo sapiens
tctggctagagccgaggggagag

SEQ ID NO: 4350917 - DNA, 17 bp, Homo sapiens
tctggctttttctgcca

SEQ ID NO: 4350918 - DNA, 19 bp, Homo sapiens
tctggggcaggctgggcca

SEQ ID NO: 4350919 - DNA, 14 bp, Homo sapiens
tctgtgaaagcctt

SEQ ID NO: 4350920 - DNA, 21 bp, Homo sapiens
tctgtgtaacatccaagccag

SEQ ID NO: 4350921 - DNA, 12 bp, Homo sapiens
tctgtgtttaaa

SEQ ID NO: 4350922 - DNA, 13 bp, Homo sapiens
tcttagagccttt

SEQ ID NO: 4350923 - DNA, 22 bp, Homo sapiens
tcttagagccttttatctgcag

SEQ ID NO: 4350924 - DNA, 19 bp, Homo sapiens
tcttattaattcttcacct

SEQ ID NO: 4350925 - DNA, 12 bp, Homo sapiens
tcttcacctgtt

SEQ ID NO: 4350926 - DNA, 16 bp, Homo sapiens
tcttcacctgttatgt

SEQ ID NO: 4350927 - DNA, 21 bp, Homo sapiens
tcttcccttcccagaccagga

SEQ ID NO: 4350928 - DNA, 20 bp, Homo sapiens
tcttcctagatctgcaggct

SEQ ID NO: 4350929 - DNA, 14 bp, Homo sapiens
tcttctcttcctag

SEQ ID NO: 4350930 - DNA, 20 bp, Homo sapiens
tcttctggggcaggctgggc

SEQ ID NO: 4350931 - DNA, 21 bp, Homo sapiens
tcttctggggcaggctgggcc

SEQ ID NO: 4350932 - DNA, 14 bp, Homo sapiens
tcttctgtatttct

SEQ ID NO: 4350933 - DNA, 16 bp, Homo sapiens
tcttctgtatttctag

SEQ ID NO: 4350934 - DNA, 14 bp, Homo sapiens
tcttgcaacttcag

SEQ ID NO: 4350935 - DNA, 16 bp, Homo sapiens
tcttggggctgatgaa

SEQ ID NO: 4350936 - DNA, 17 bp, Homo sapiens
tcttggggctgatgaag

SEQ ID NO: 4350937 - DNA, 13 bp, Homo sapiens
tctttatatatgg

SEQ ID NO: 4350938 - DNA, 20 bp, Homo sapiens
tcttttccttcattcatagg

SEQ ID NO: 4350939 - DNA, 19 bp, Homo sapiens
tgaacatacttcaaaaata

SEQ ID NO: 4350940 - DNA, 23 bp, Homo sapiens
tgaacatacttcaaaaataatgt

SEQ ID NO: 4350941 - DNA, 21 bp, Homo sapiens
tgaaccatgcttacaaagaaa

SEQ ID NO: 4350942 - DNA, 15 bp, Homo sapiens
tgaacctgctactta

SEQ ID NO: 4350943 - DNA, 13 bp, Homo sapiens
tgaactgcatcaa

SEQ ID NO: 4350944 - DNA, 14 bp, Homo sapiens
tgaagaagggggtg

SEQ ID NO: 4350945 - DNA, 19 bp, Homo sapiens
tgaagaagggggtgggggg

SEQ ID NO: 4350946 - DNA, 20 bp, Homo sapiens
tgaagaagggggtgggggga

SEQ ID NO: 4350947 - DNA, 16 bp, Homo sapiens
tgaagatatatttcac

SEQ ID NO: 4350948 - DNA, 20 bp, Homo sapiens
tgaagatatatttcactttt

SEQ ID NO: 4350949 - DNA, 18 bp, Homo sapiens
tgaagatggtttcaattc

SEQ ID NO: 4350950 - DNA, 21 bp, Homo sapiens
tgaagatggtttcaattcaga

SEQ ID NO: 4350951 - DNA, 20 bp, Homo sapiens
tgaagattaggagaaacaca

SEQ ID NO: 4350952 - DNA, 19 bp, Homo sapiens
tgaaggaatcattccagtg

SEQ ID NO: 4350953 - DNA, 13 bp, Homo sapiens
tgaagggaagtgg

SEQ ID NO: 4350954 - DNA, 14 bp, Homo sapiens
tgaagggaagtggg

SEQ ID NO: 4350955 - DNA, 13 bp, Homo sapiens
tgaagtatacttt

SEQ ID NO: 4350956 - DNA, 21 bp, Homo sapiens
tgaagtgaattcctgcatttg

SEQ ID NO: 4350957 - DNA, 15 bp, Homo sapiens
tgaataaactgaata

SEQ ID NO: 4350958 - DNA, 16 bp, Homo sapiens
tgaataaactgaatat

SEQ ID NO: 4350959 - DNA, 19 bp, Homo sapiens
tgaatattttggaaactgc

SEQ ID NO: 4350960 - DNA, 20 bp, Homo sapiens
tgaatattttggaaactgct

SEQ ID NO: 4350961 - DNA, 21 bp, Homo sapiens
tgaattgcctgttcataaaac

SEQ ID NO: 4350962 - DNA, 16 bp, Homo sapiens
tgacaaaggtggtaaa

SEQ ID NO: 4350963 - DNA, 20 bp, Homo sapiens
tgacaaaggtggtaaattca

SEQ ID NO: 4350964 - DNA, 17 bp, Homo sapiens
tgaccaaagactgcaga

SEQ ID NO: 4350965 - DNA, 18 bp, Homo sapiens
tgaccaaagactgcagaa

SEQ ID NO: 4350966 - DNA, 21 bp, Homo sapiens
tgaccaaagactgcagaaccc

SEQ ID NO: 4350967 - DNA, 18 bp, Homo sapiens
tgactgttgatgaagtat

SEQ ID NO: 4350968 - DNA, 14 bp, Homo sapiens
tgacttctgacaaa

SEQ ID NO: 4350969 - DNA, 23 bp, Homo sapiens
tgacttctgacaaaggtggtaaa

SEQ ID NO: 4350970 - DNA, 17 bp, Homo sapiens
tgagaatcccttaaaat

SEQ ID NO: 4350971 - DNA, 18 bp, Homo sapiens
tgagaatcccttaaaatt

SEQ ID NO: 4350972 - DNA, 16 bp, Homo sapiens
tgagatttttggtttt

SEQ ID NO: 4350973 - DNA, 17 bp, Homo sapiens
tgagatttttggttttt

SEQ ID NO: 4350974 - DNA, 20 bp, Homo sapiens
tgagccatgaggagcgtgga

SEQ ID NO: 4350975 - DNA, 23 bp, Homo sapiens
tgagccatgaggagcgtggactc

SEQ ID NO: 4350976 - DNA, 18 bp, Homo sapiens
tgaggagacagaaagcct

SEQ ID NO: 4350977 - DNA, 17 bp, Homo sapiens
tgagttgacttctgaca

SEQ ID NO: 4350978 - DNA, 18 bp, Homo sapiens
tgatatggtgaagggaag

SEQ ID NO: 4350979 - DNA, 17 bp, Homo sapiens
tgatattgtttaaaatt

SEQ ID NO: 4350980 - DNA, 12 bp, Homo sapiens
tgatgaagtata

SEQ ID NO: 4350981 - DNA, 12 bp, Homo sapiens
tgatgccttttt

SEQ ID NO: 4350982 - DNA, 14 bp, Homo sapiens
tgatgtgacttttt

SEQ ID NO: 4350983 - DNA, 21 bp, Homo sapiens
tgatttctattccctaacttg

SEQ ID NO: 4350984 - DNA, 20 bp, Homo sapiens
tgcaaacttttttatatctt

SEQ ID NO: 4350985 - DNA, 21 bp, Homo sapiens
tgcaaaggtggcaatgcttaa

SEQ ID NO: 4350986 - DNA, 17 bp, Homo sapiens
tgcaagaactgttttta

SEQ ID NO: 4350987 - DNA, 21 bp, Homo sapiens
tgcaagttatattagtgaaga

SEQ ID NO: 4350988 - DNA, 22 bp, Homo sapiens
tgcacagggtgtggtatgaggg

SEQ ID NO: 4350989 - DNA, 13 bp, Homo sapiens
tgcacctctggct

SEQ ID NO: 4350990 - DNA, 24 bp, Homo sapiens
tgcagaacatcgatatgtatatca

SEQ ID NO: 4350991 - DNA, 15 bp, Homo sapiens
tgcagaacccccagg

SEQ ID NO: 4350992 - DNA, 20 bp, Homo sapiens
tgcagaacccccaggtggcc

SEQ ID NO: 4350993 - DNA, 23 bp, Homo sapiens
tgcagaacccccaggtggcctgc

SEQ ID NO: 4350994 - DNA, 15 bp, Homo sapiens
tgcagaataatggaa

SEQ ID NO: 4350995 - DNA, 21 bp, Homo sapiens
tgcagaataatggaaacatta

SEQ ID NO: 4350996 - DNA, 16 bp, Homo sapiens
tgcagcggcagagcaa

SEQ ID NO: 4350997 - DNA, 13 bp, Homo sapiens
tgccactgaggag

SEQ ID NO: 4350998 - DNA, 17 bp, Homo sapiens
tgccactgaggagacag

SEQ ID NO: 4350999 - DNA, 12 bp, Homo sapiens
tgccagagccaa

SEQ ID NO: 4351000 - DNA, 19 bp, Homo sapiens
tgccagagccaacctggac

SEQ ID NO: 4351001 - DNA, 20 bp, Homo sapiens
tgccagagccaacctggact

SEQ ID NO: 4351002 - DNA, 22 bp, Homo sapiens
tgccagagccaacctggacttc

SEQ ID NO: 4351003 - DNA, 22 bp, Homo sapiens
tgcctataaccatgttctatat

SEQ ID NO: 4351004 - DNA, 12 bp, Homo sapiens
tgcctggactga

SEQ ID NO: 4351005 - DNA, 13 bp, Homo sapiens
tgcggaagccaaa

SEQ ID NO: 4351006 - DNA, 20 bp, Homo sapiens
tgctaaattctatgttaaat

SEQ ID NO: 4351007 - DNA, 17 bp, Homo sapiens
tgctaatattaaacctt

SEQ ID NO: 4351008 - DNA, 21 bp, Homo sapiens
tgctagactcctcaggagaga

SEQ ID NO: 4351009 - DNA, 13 bp, Homo sapiens
tgcttaaactaaa

SEQ ID NO: 4351010 - DNA, 16 bp, Homo sapiens
tgcttattttatgata

SEQ ID NO: 4351011 - DNA, 15 bp, Homo sapiens
tgctttctgtgaaag

SEQ ID NO: 4351012 - DNA, 19 bp, Homo sapiens
tgctttctgtgaaagcctt

SEQ ID NO: 4351013 - DNA, 17 bp, Homo sapiens
tggaaacattacagttc

SEQ ID NO: 4351014 - DNA, 22 bp, Homo sapiens
tggaaactgctaaattctatgt

SEQ ID NO: 4351015 - DNA, 18 bp, Homo sapiens
tggacagctttattttaa

SEQ ID NO: 4351016 - DNA, 12 bp, Homo sapiens
tggactccaggc

SEQ ID NO: 4351017 - DNA, 15 bp, Homo sapiens
tggactccaggcctg

SEQ ID NO: 4351018 - DNA, 16 bp, Homo sapiens
tggactccaggcctga

SEQ ID NO: 4351019 - DNA, 20 bp, Homo sapiens
tggactccaggcctgaccag

SEQ ID NO: 4351020 - DNA, 21 bp, Homo sapiens
tggactccaggcctgaccagg

SEQ ID NO: 4351021 - DNA, 13 bp, Homo sapiens
tggactctgctag

SEQ ID NO: 4351022 - DNA, 20 bp, Homo sapiens
tggactctgctagactcctc

SEQ ID NO: 4351023 - DNA, 10 bp, Homo sapiens
tggactgacc

SEQ ID NO: 4351024 - DNA, 18 bp, Homo sapiens
tggactgaccaaagactg

SEQ ID NO: 4351025 - DNA, 22 bp, Homo sapiens
tggactgaccaaagactgcaga

SEQ ID NO: 4351026 - DNA, 23 bp, Homo sapiens
tggactgaccaaagactgcagaa

SEQ ID NO: 4351027 - DNA, 15 bp, Homo sapiens
tggatatttttgtac

SEQ ID NO: 4351028 - DNA, 18 bp, Homo sapiens
tggatatttttgtacttg

SEQ ID NO: 4351029 - DNA, 22 bp, Homo sapiens
tggatatttttgtacttgattt

SEQ ID NO: 4351030 - DNA, 12 bp, Homo sapiens
tggatgactgtt

SEQ ID NO: 4351031 - DNA, 17 bp, Homo sapiens
tggatgactgttgatga

SEQ ID NO: 4351032 - DNA, 21 bp, Homo sapiens
tggcagaagcattgcctggac

SEQ ID NO: 4351033 - DNA, 22 bp, Homo sapiens
tggcagaagcattgcctggact

SEQ ID NO: 4351034 - DNA, 21 bp, Homo sapiens
tggcaggcttccatccccgtc

SEQ ID NO: 4351035 - DNA, 14 bp, Homo sapiens
tggcagtgactttg

SEQ ID NO: 4351036 - DNA, 15 bp, Homo sapiens
tggccggtggttttg

SEQ ID NO: 4351037 - DNA, 13 bp, Homo sapiens
tggctagagccga

SEQ ID NO: 4351038 - DNA, 15 bp, Homo sapiens
tggctttttctgcca

SEQ ID NO: 4351039 - DNA, 16 bp, Homo sapiens
tggctttttctgccac

SEQ ID NO: 4351040 - DNA, 21 bp, Homo sapiens
tgggaacttctaaacacttca

SEQ ID NO: 4351041 - DNA, 14 bp, Homo sapiens
tgggagccaggagt

SEQ ID NO: 4351042 - DNA, 24 bp, Homo sapiens
tgggagccaggagtaagacaagtg

SEQ ID NO: 4351043 - DNA, 20 bp, Homo sapiens
tgggatttggggcctcaaga

SEQ ID NO: 4351044 - DNA, 18 bp, Homo sapiens
tgggccatgtccaaagag

SEQ ID NO: 4351045 - DNA, 16 bp, Homo sapiens
tgggcttcattccgga

SEQ ID NO: 4351046 - DNA, 21 bp, Homo sapiens
tggggcaagactgcaaacttt

SEQ ID NO: 4351047 - DNA, 16 bp, Homo sapiens
tggggcaggctgggcc

SEQ ID NO: 4351048 - DNA, 17 bp, Homo sapiens
tggggcaggctgggcca

SEQ ID NO: 4351049 - DNA, 14 bp, Homo sapiens
tgggtttttatgaa

SEQ ID NO: 4351050 - DNA, 15 bp, Homo sapiens
tggtaaattcagaca

SEQ ID NO: 4351051 - DNA, 16 bp, Homo sapiens
tggtaaattcagacaa

SEQ ID NO: 4351052 - DNA, 23 bp, Homo sapiens
tggtaaattcagacaacattatg

SEQ ID NO: 4351053 - DNA, 15 bp, Homo sapiens
tggtataatgtttaa

SEQ ID NO: 4351054 - DNA, 16 bp, Homo sapiens
tggtataatgtttaaa

SEQ ID NO: 4351055 - DNA, 18 bp, Homo sapiens
tggtataatgtttaaatc

SEQ ID NO: 4351056 - DNA, 14 bp, Homo sapiens
tggtatgagggggt

SEQ ID NO: 4351057 - DNA, 17 bp, Homo sapiens
tggtatgagggggtggt

SEQ ID NO: 4351058 - DNA, 18 bp, Homo sapiens
tggtcatcaccacccttc

SEQ ID NO: 4351059 - DNA, 14 bp, Homo sapiens
tggtgaagggaagt

SEQ ID NO: 4351060 - DNA, 18 bp, Homo sapiens
tggtgaagggaagtgggg

SEQ ID NO: 4351061 - DNA, 18 bp, Homo sapiens
tggtggccggtggttttg

SEQ ID NO: 4351062 - DNA, 15 bp, Homo sapiens
tggtgtatgcacagg

SEQ ID NO: 4351063 - DNA, 13 bp, Homo sapiens
tggttattctaag

SEQ ID NO: 4351064 - DNA, 19 bp, Homo sapiens
tgtaacatccaagccagag

SEQ ID NO: 4351065 - DNA, 22 bp, Homo sapiens
tgtatagagaatttaagtagaa

SEQ ID NO: 4351066 - DNA, 23 bp, Homo sapiens
tgtatattgagaatcccttaaaa

SEQ ID NO: 4351067 - DNA, 22 bp, Homo sapiens
tgtattcttctgtatttctagg

SEQ ID NO: 4351068 - DNA, 16 bp, Homo sapiens
tgtattttttaaaaca

SEQ ID NO: 4351069 - DNA, 19 bp, Homo sapiens
tgtcaccagagcttctctg

SEQ ID NO: 4351070 - DNA, 16 bp, Homo sapiens
tgtcacggaaagcatc

SEQ ID NO: 4351071 - DNA, 19 bp, Homo sapiens
tgtcagagctgttataaat

SEQ ID NO: 4351072 - DNA, 17 bp, Homo sapiens
tgtccaaagaggctgcc

SEQ ID NO: 4351073 - DNA, 21 bp, Homo sapiens
tgtccaaagaggctgcccctc

SEQ ID NO: 4351074 - DNA, 16 bp, Homo sapiens
tgtctcactgttctgc

SEQ ID NO: 4351075 - DNA, 17 bp, Homo sapiens
tgtctcactgttctgca

SEQ ID NO: 4351076 - DNA, 13 bp, Homo sapiens
tgtcttgcaactt

SEQ ID NO: 4351077 - DNA, 19 bp, Homo sapiens
tgtgaaagccttaagaaga

SEQ ID NO: 4351078 - DNA, 13 bp, Homo sapiens
tgtgcagaataat

SEQ ID NO: 4351079 - DNA, 17 bp, Homo sapiens
tgtgcagaataatggaa

SEQ ID NO: 4351080 - DNA, 20 bp, Homo sapiens
tgtgcagaataatggaaaca

SEQ ID NO: 4351081 - DNA, 14 bp, Homo sapiens
tgtggtatgagggg

SEQ ID NO: 4351082 - DNA, 12 bp, Homo sapiens
tgtgtaacatcc

SEQ ID NO: 4351083 - DNA, 21 bp, Homo sapiens
tgtgtaacatccaagccagag

SEQ ID NO: 4351084 - DNA, 21 bp, Homo sapiens
tgtgttgttgttgctgctgtt

SEQ ID NO: 4351085 - DNA, 14 bp, Homo sapiens
tgttaaatactgtg

SEQ ID NO: 4351086 - DNA, 20 bp, Homo sapiens
tgttaaatactgtgcagaat

SEQ ID NO: 4351087 - DNA, 23 bp, Homo sapiens
tgttataaatttatcaactgtca

SEQ ID NO: 4351088 - DNA, 15 bp, Homo sapiens
tgttatgtatgaagg

SEQ ID NO: 4351089 - DNA, 13 bp, Homo sapiens
tgttattcctagt

SEQ ID NO: 4351090 - DNA, 23 bp, Homo sapiens
tgttattcctagtggatgactgt

SEQ ID NO: 4351091 - DNA, 24 bp, Homo sapiens
tgttattcctagtggatgactgtt

SEQ ID NO: 4351092 - DNA, 13 bp, Homo sapiens
tgttattgttgaa

SEQ ID NO: 4351093 - DNA, 13 bp, Homo sapiens
tgttctggacagc

SEQ ID NO: 4351094 - DNA, 10 bp, Homo sapiens
tgttgctgct

SEQ ID NO: 4351095 - DNA, 12 bp, Homo sapiens
tgttgctgctgt

SEQ ID NO: 4351096 - DNA, 13 bp, Homo sapiens
tgttgctgctgtt

SEQ ID NO: 4351097 - DNA, 13 bp, Homo sapiens
tgttgttgctgct

SEQ ID NO: 4351098 - DNA, 15 bp, Homo sapiens
tgtttaaaattcagt

SEQ ID NO: 4351099 - DNA, 18 bp, Homo sapiens
tgtttaaatcatgtatgt

SEQ ID NO: 4351100 - DNA, 20 bp, Homo sapiens
tgtttagagagcctgtcacc

SEQ ID NO: 4351101 - DNA, 22 bp, Homo sapiens
tgtttagagagcctgtcaccag

SEQ ID NO: 4351102 - DNA, 18 bp, Homo sapiens
tgtttataatctgaagat

SEQ ID NO: 4351103 - DNA, 23 bp, Homo sapiens
tgtttgctgccttgctcctagca

SEQ ID NO: 4351104 - DNA, 13 bp, Homo sapiens
ttaaaacaatttt

SEQ ID NO: 4351105 - DNA, 14 bp, Homo sapiens
ttaaaattcagttt

SEQ ID NO: 4351106 - DNA, 12 bp, Homo sapiens
ttaaactaaata

SEQ ID NO: 4351107 - DNA, 16 bp, Homo sapiens
ttaaagcatctgtaaa

SEQ ID NO: 4351108 - DNA, 20 bp, Homo sapiens
ttaaagcatctgtaaatttg

SEQ ID NO: 4351109 - DNA, 20 bp, Homo sapiens
ttaaatactgtgcagaataa

SEQ ID NO: 4351110 - DNA, 22 bp, Homo sapiens
ttaaatactgtgcagaataatg

SEQ ID NO: 4351111 - DNA, 13 bp, Homo sapiens
ttaaatcatgtat

SEQ ID NO: 4351112 - DNA, 14 bp, Homo sapiens
ttaaatcatgtatg

SEQ ID NO: 4351113 - DNA, 21 bp, Homo sapiens
ttaaatcatgtatgttatgat

SEQ ID NO: 4351114 - DNA, 17 bp, Homo sapiens
ttaagagaagaaatgtt

SEQ ID NO: 4351115 - DNA, 18 bp, Homo sapiens
ttaataagatatttagta

SEQ ID NO: 4351116 - DNA, 14 bp, Homo sapiens
ttaataatgtattg

SEQ ID NO: 4351117 - DNA, 16 bp, Homo sapiens
ttaattcttcacctgt

SEQ ID NO: 4351118 - DNA, 18 bp, Homo sapiens
ttaattcttcacctgtta

SEQ ID NO: 4351119 - DNA, 17 bp, Homo sapiens
ttacactgcggaagcca

SEQ ID NO: 4351120 - DNA, 18 bp, Homo sapiens
ttacactgcggaagccaa

SEQ ID NO: 4351121 - DNA, 20 bp, Homo sapiens
ttacactgcggaagccaaag

SEQ ID NO: 4351122 - DNA, 20 bp, Homo sapiens
ttaccagacaaaaaaattta

SEQ ID NO: 4351123 - DNA, 17 bp, Homo sapiens
ttacgtttgttattcct

SEQ ID NO: 4351124 - DNA, 14 bp, Homo sapiens
ttactttttcccat

SEQ ID NO: 4351125 - DNA, 22 bp, Homo sapiens
ttagagagcctgtcaccagagc

SEQ ID NO: 4351126 - DNA, 15 bp, Homo sapiens
ttagagccttttatc

SEQ ID NO: 4351127 - DNA, 16 bp, Homo sapiens
ttataatctgaagata

SEQ ID NO: 4351128 - DNA, 14 bp, Homo sapiens
ttatatcttttggt

SEQ ID NO: 4351129 - DNA, 20 bp, Homo sapiens
ttatatcttttggttattct

SEQ ID NO: 4351130 - DNA, 10 bp, Homo sapiens
ttatatgcat

SEQ ID NO: 4351131 - DNA, 21 bp, Homo sapiens
ttatattttgtgtataatgtg

SEQ ID NO: 4351132 - DNA, 14 bp, Homo sapiens
ttatcttttcataa

SEQ ID NO: 4351133 - DNA, 20 bp, Homo sapiens
ttatgaactgcatcaagact

SEQ ID NO: 4351134 - DNA, 17 bp, Homo sapiens
ttatgatattgtttaaa

SEQ ID NO: 4351135 - DNA, 22 bp, Homo sapiens
ttatgatattgtttaaaattca

SEQ ID NO: 4351136 - DNA, 14 bp, Homo sapiens
ttatgatctaataa

SEQ ID NO: 4351137 - DNA, 16 bp, Homo sapiens
ttatgatctaataaac

SEQ ID NO: 4351138 - DNA, 20 bp, Homo sapiens
ttatgatctaataaacttta

SEQ ID NO: 4351139 - DNA, 21 bp, Homo sapiens
ttattcctagtggatgactgt

SEQ ID NO: 4351140 - DNA, 21 bp, Homo sapiens
ttattctaagccctttgccat

SEQ ID NO: 4351141 - DNA, 23 bp, Homo sapiens
ttattggactccaggcctgacca

SEQ ID NO: 4351142 - DNA, 19 bp, Homo sapiens
ttcacaatcttggggctga

SEQ ID NO: 4351143 - DNA, 21 bp, Homo sapiens
ttcacaatcttggggctgatg

SEQ ID NO: 4351144 - DNA, 16 bp, Homo sapiens
ttcacttttgttctgc

SEQ ID NO: 4351145 - DNA, 16 bp, Homo sapiens
ttcagacaacattatg

SEQ ID NO: 4351146 - DNA, 17 bp, Homo sapiens
ttcagacaacattatga

SEQ ID NO: 4351147 - DNA, 14 bp, Homo sapiens
ttcagattgtcttg

SEQ ID NO: 4351148 - DNA, 23 bp, Homo sapiens
ttcataaaacggtgctttctgtg

SEQ ID NO: 4351149 - DNA, 14 bp, Homo sapiens
ttcatactgtagaa

SEQ ID NO: 4351150 - DNA, 15 bp, Homo sapiens
ttcatactgtagaaa

SEQ ID NO: 4351151 - DNA, 21 bp, Homo sapiens
ttcatagggaaaggttttgta

SEQ ID NO: 4351152 - DNA, 20 bp, Homo sapiens
ttcattccggactggcagaa

SEQ ID NO: 4351153 - DNA, 16 bp, Homo sapiens
ttcattctttatatat

SEQ ID NO: 4351154 - DNA, 11 bp, Homo sapiens
ttccaggctga

SEQ ID NO: 4351155 - DNA, 16 bp, Homo sapiens
ttccagggcctgagca

SEQ ID NO: 4351156 - DNA, 15 bp, Homo sapiens
ttccatccccgtcca

SEQ ID NO: 4351157 - DNA, 22 bp, Homo sapiens
ttcccatctggctttttctgcc

SEQ ID NO: 4351158 - DNA, 16 bp, Homo sapiens
ttccccaccagcttta

SEQ ID NO: 4351159 - DNA, 17 bp, Homo sapiens
ttcctagtggatgactg

SEQ ID NO: 4351160 - DNA, 19 bp, Homo sapiens
ttctaaacacttcattctt

SEQ ID NO: 4351161 - DNA, 23 bp, Homo sapiens
ttctaaacacttcattctttata

SEQ ID NO: 4351162 - DNA, 17 bp, Homo sapiens
ttctacctttgtaaaac

SEQ ID NO: 4351163 - DNA, 19 bp, Homo sapiens
ttctatattctttattctc

SEQ ID NO: 4351164 - DNA, 17 bp, Homo sapiens
ttctatgttaaatactg

SEQ ID NO: 4351165 - DNA, 23 bp, Homo sapiens
ttctattccctaacttgtgaaga

SEQ ID NO: 4351166 - DNA, 14 bp, Homo sapiens
ttctcaaagttaat

SEQ ID NO: 4351167 - DNA, 18 bp, Homo sapiens
ttctcaaagttaattcac

SEQ ID NO: 4351168 - DNA, 22 bp, Homo sapiens
ttctcagactctttcttcacta

SEQ ID NO: 4351169 - DNA, 19 bp, Homo sapiens
ttctgacaaaggtggtaaa

SEQ ID NO: 4351170 - DNA, 20 bp, Homo sapiens
ttctgacaaaggtggtaaat

SEQ ID NO: 4351171 - DNA, 22 bp, Homo sapiens
ttctgcaaaggtggcaatgctt

SEQ ID NO: 4351172 - DNA, 15 bp, Homo sapiens
ttctgccactgagga

SEQ ID NO: 4351173 - DNA, 23 bp, Homo sapiens
ttctggatccatggggggagaag

SEQ ID NO: 4351174 - DNA, 14 bp, Homo sapiens
ttctgtatttctag

SEQ ID NO: 4351175 - DNA, 15 bp, Homo sapiens
ttctgtatttctagg

SEQ ID NO: 4351176 - DNA, 18 bp, Homo sapiens
ttctttatatatggacag

SEQ ID NO: 4351177 - DNA, 22 bp, Homo sapiens
ttgaagattaggagaaacacat

SEQ ID NO: 4351178 - DNA, 16 bp, Homo sapiens
ttgaattagaagaaaa

SEQ ID NO: 4351179 - DNA, 20 bp, Homo sapiens
ttgagaatcccttaaaatta

SEQ ID NO: 4351180 - DNA, 22 bp, Homo sapiens
ttgagaatcccttaaaattacc

SEQ ID NO: 4351181 - DNA, 18 bp, Homo sapiens
ttgatttgatgtgacttt

SEQ ID NO: 4351182 - DNA, 18 bp, Homo sapiens
ttgcaagttatattagtg

SEQ ID NO: 4351183 - DNA, 17 bp, Homo sapiens
ttgccatcaatgatcat

SEQ ID NO: 4351184 - DNA, 12 bp, Homo sapiens
ttgcctggactg

SEQ ID NO: 4351185 - DNA, 16 bp, Homo sapiens
ttgcctggactgacca

SEQ ID NO: 4351186 - DNA, 15 bp, Homo sapiens
ttgctaagaagccta

SEQ ID NO: 4351187 - DNA, 15 bp, Homo sapiens
ttgctcctagcagac

SEQ ID NO: 4351188 - DNA, 19 bp, Homo sapiens
ttggaagctttgagttgac

SEQ ID NO: 4351189 - DNA, 14 bp, Homo sapiens
ttggactccaggcc

SEQ ID NO: 4351190 - DNA, 22 bp, Homo sapiens
ttggactccaggcctgaccagg

SEQ ID NO: 4351191 - DNA, 13 bp, Homo sapiens
ttggatatttttg

SEQ ID NO: 4351192 - DNA, 18 bp, Homo sapiens
ttggatatttttgtactt

SEQ ID NO: 4351193 - DNA, 23 bp, Homo sapiens
ttgggatactgcttattttatga

SEQ ID NO: 4351194 - DNA, 19 bp, Homo sapiens
ttggggcaagactgcaaac

SEQ ID NO: 4351195 - DNA, 16 bp, Homo sapiens
ttggtataatgtttaa

SEQ ID NO: 4351196 - DNA, 20 bp, Homo sapiens
ttgtattttttaaaacacta

SEQ ID NO: 4351197 - DNA, 15 bp, Homo sapiens
ttgtgtacaagttgt

SEQ ID NO: 4351198 - DNA, 14 bp, Homo sapiens
ttgttggtctgtgt

SEQ ID NO: 4351199 - DNA, 14 bp, Homo sapiens
ttgttgttgctgct

SEQ ID NO: 4351200 - DNA, 20 bp, Homo sapiens
tttaaaaatgcaatatctga

SEQ ID NO: 4351201 - DNA, 13 bp, Homo sapiens
tttaaaacactaa

SEQ ID NO: 4351202 - DNA, 17 bp, Homo sapiens
tttaaagcatctgtaaa

SEQ ID NO: 4351203 - DNA, 14 bp, Homo sapiens
tttaaatcatgtat

SEQ ID NO: 4351204 - DNA, 21 bp, Homo sapiens
tttaaatcatgtatgttatga

SEQ ID NO: 4351205 - DNA, 19 bp, Homo sapiens
tttacactgcggaagccaa

SEQ ID NO: 4351206 - DNA, 12 bp, Homo sapiens
tttactctgtgt

SEQ ID NO: 4351207 - DNA, 22 bp, Homo sapiens
tttagagagcctgtcaccagag

SEQ ID NO: 4351208 - DNA, 12 bp, Homo sapiens
tttataatctga

SEQ ID NO: 4351209 - DNA, 11 bp, Homo sapiens
tttatatgcat

SEQ ID NO: 4351210 - DNA, 14 bp, Homo sapiens
tttatgaactgcat

SEQ ID NO: 4351211 - DNA, 21 bp, Homo sapiens
tttcacaatcttggggctgat

SEQ ID NO: 4351212 - DNA, 19 bp, Homo sapiens
tttccatagtgttaactgt

SEQ ID NO: 4351213 - DNA, 23 bp, Homo sapiens
tttcccatctggctttttctgcc

SEQ ID NO: 4351214 - DNA, 15 bp, Homo sapiens
tttcccctgttaaac

SEQ ID NO: 4351215 - DNA, 17 bp, Homo sapiens
tttctgccactgaggag

SEQ ID NO: 4351216 - DNA, 22 bp, Homo sapiens
tttcttttccttcattcatagg

SEQ ID NO: 4351217 - DNA, 20 bp, Homo sapiens
tttgcaagtgagatagcttc

SEQ ID NO: 4351218 - DNA, 14 bp, Homo sapiens
tttggtataatgtt

SEQ ID NO: 4351219 - DNA, 18 bp, Homo sapiens
tttggtataatgtttaaa

SEQ ID NO: 4351220 - DNA, 20 bp, Homo sapiens
tttgtacttgatttgatgtg

SEQ ID NO: 4351221 - DNA, 20 bp, Homo sapiens
tttgtgttgttgttgctgct

SEQ ID NO: 4351222 - DNA, 15 bp, Homo sapiens
ttttaaaacactaaa

SEQ ID NO: 4351223 - DNA, 12 bp, Homo sapiens
ttttaaagcctt

SEQ ID NO: 4351224 - DNA, 17 bp, Homo sapiens
ttttaccaagagtaact

SEQ ID NO: 4351225 - DNA, 23 bp, Homo sapiens
ttttacctagctggtagcataaa

SEQ ID NO: 4351226 - DNA, 16 bp, Homo sapiens
ttttatcgcagatttt

SEQ ID NO: 4351227 - DNA, 13 bp, Homo sapiens
ttttatctgcaga

SEQ ID NO: 4351228 - DNA, 12 bp, Homo sapiens
ttttatttttgc

SEQ ID NO: 4351229 - DNA, 21 bp, Homo sapiens
ttttcacaatcttggggctga

SEQ ID NO: 4351230 - DNA, 15 bp, Homo sapiens
ttttcccctgttaaa

SEQ ID NO: 4351231 - DNA, 13 bp, Homo sapiens
ttttctcttccct

SEQ ID NO: 4351232 - DNA, 14 bp, Homo sapiens
ttttgtatcttggg

SEQ ID NO: 4351233 - DNA, 11 bp, Homo sapiens
ttttgtgcttt

SEQ ID NO: 4351234 - DNA, 13 bp, Homo sapiens
tttttgtacttga

SEQ ID NO: 4351235 - DNA, 12 bp, Homo sapiens
tttttgtatctt

SEQ ID NO: 4351236 - DNA, 13 bp, Homo sapiens
ttttttttttcct

SEQ ID NO: 4351237 - DNA, 15 bp, Homo sapiens
tttataatctgaaga

SEQ ID NO: 4351238 - DNA, 18 bp, Homo sapiens
tttatatatggacagctt

SEQ ID NO: 4351239 - DNA, 17 bp, Homo sapiens
tttatatcttttggtta

SEQ ID NO: 4351240 - DNA, 12 bp, Homo sapiens
tttatctgcaga

SEQ ID NO: 4351241 - DNA, 16 bp, Homo sapiens
tttatctgcagaacat

SEQ ID NO: 4351242 - DNA, 14 bp, Homo sapiens
tttcaattcagatt

SEQ ID NO: 4351243 - DNA, 21 bp, Homo sapiens
tttcaattcagattgtcttgc

SEQ ID NO: 4351244 - DNA, 23 bp, Homo sapiens
tttcatccaaaatattttttgca

SEQ ID NO: 4351245 - DNA, 13 bp, Homo sapiens
tttcctcttcaga

SEQ ID NO: 4351246 - DNA, 22 bp, Homo sapiens
tttgagatttttggttttttga

SEQ ID NO: 4351247 - DNA, 13 bp, Homo sapiens
tttgatgtgactt

SEQ ID NO: 4351248 - DNA, 11 bp, Homo sapiens
tttgcctttta

SEQ ID NO: 4351249 - DNA, 17 bp, Homo sapiens
tttggaaactgctaaat

SEQ ID NO: 4351250 - DNA, 21 bp, Homo sapiens
tttggatatttttgtacttga

SEQ ID NO: 4351251 - DNA, 15 bp, Homo sapiens
tttgtaaaacagcct

SEQ ID NO: 4351252 - DNA, 11 bp, Homo sapiens
tttgtgcttta

SEQ ID NO: 4351253 - DNA, 15 bp, Homo sapiens
tttgtgtataatgtg

SEQ ID NO: 4351254 - DNA, 13 bp, Homo sapiens
ttttatatctttt

SEQ ID NO: 4351255 - DNA, 17 bp, Homo sapiens
ttttatgaactgcatca

SEQ ID NO: 4351256 - DNA, 19 bp, Homo sapiens
ttttcccctgttaaacagt

SEQ ID NO: 4351257 - DNA, 16 bp, Homo sapiens
ttttccttcattcata

SEQ ID NO: 4351258 - DNA, 19 bp, Homo sapiens
ttttggtataatgtttaaa

SEQ ID NO: 4351259 - DNA, 14 bp, Homo sapiens
ttttgtcacggaaa

SEQ ID NO: 4351260 - DNA, 12 bp, Homo sapiens
ttttgtgcttta

SEQ ID NO: 4351261 - DNA, 21 bp, Homo sapiens
ttttgtgtataatgtgcttta

SEQ ID NO: 4351262 - DNA, 16 bp, Homo sapiens
tttttaaaacactaaa

SEQ ID NO: 4351263 - DNA, 16 bp, Homo sapiens
tttttcctcttcagaa

SEQ ID NO: 4351264 - DNA, 23 bp, Homo sapiens
tttttcctcttcagaacttgtca

SEQ ID NO: 4351265 - DNA, 15 bp, Homo sapiens
tttttgatgcctttt

SEQ ID NO: 4351266 - DNA, 15 bp, Homo sapiens
tttttggtataatgt

SEQ ID NO: 4351267 - DNA, 13 bp, Homo sapiens
ttttttgcaagtt

SEQ ID NO: 4351268 - DNA, 13 bp, Homo sapiens
tgtcaccagagct

SEQ ID NO: 4351269 - DNA, 14 bp, Homo sapiens
tgtcaccagagctt

SEQ ID NO: 4351270 - DNA, 14 bp, Homo sapiens
tgtcaggcatggct

SEQ ID NO: 4351271 - DNA, 20 bp, Homo sapiens
tgtcaggcatggctcagagc

SEQ ID NO: 4351272 - DNA, 14 bp, Homo sapiens
tgtctcactgttct

SEQ ID NO: 4351273 - DNA, 15 bp, Homo sapiens
tgtcttgcaacttca

SEQ ID NO: 4351274 - DNA, 19 bp, Homo sapiens
tgtcttgcaacttcagttt

SEQ ID NO: 4351275 - DNA, 22 bp, Homo sapiens
tgtgcagaataatggaaacatt

SEQ ID NO: 4351276 - DNA, 18 bp, Homo sapiens
tgtgctttaaaaatgcaa

SEQ ID NO: 4351277 - DNA, 19 bp, Homo sapiens
tgtgtaacatccaagccag

SEQ ID NO: 4351278 - DNA, 20 bp, Homo sapiens
tgtgtaacatccaagccaga

SEQ ID NO: 4351279 - DNA, 15 bp, Homo sapiens
tgtgtataatgtgct

SEQ ID NO: 4351280 - DNA, 21 bp, Homo sapiens
tgtgtatattgagaatccctt

SEQ ID NO: 4351281 - DNA, 12 bp, Homo sapiens
tgttataaagta

SEQ ID NO: 4351282 - DNA, 12 bp, Homo sapiens
tgttatgtatga

SEQ ID NO: 4351283 - DNA, 14 bp, Homo sapiens
tgttattgttgaac

SEQ ID NO: 4351284 - DNA, 17 bp, Homo sapiens
tgttattttgtgtacaa

SEQ ID NO: 4351285 - DNA, 20 bp, Homo sapiens
tgttcataaaacggtgcttt

SEQ ID NO: 4351286 - DNA, 13 bp, Homo sapiens
tgttctgctttat

SEQ ID NO: 4351287 - DNA, 14 bp, Homo sapiens
tgtttaaaattcag

SEQ ID NO: 4351288 - DNA, 17 bp, Homo sapiens
tgtttaaaattcagttt

SEQ ID NO: 4351289 - DNA, 21 bp, Homo sapiens
tgtttaaatcatgtatgttat

SEQ ID NO: 4351290 - DNA, 18 bp, Homo sapiens
tgtttagagagcctgtca

SEQ ID NO: 4351291 - DNA, 12 bp, Homo sapiens
ttaaaattcagt

SEQ ID NO: 4351292 - DNA, 13 bp, Homo sapiens
ttaaaattcagtt

SEQ ID NO: 4351293 - DNA, 17 bp, Homo sapiens
ttaaacctttcagtact

SEQ ID NO: 4351294 - DNA, 21 bp, Homo sapiens
ttaaactaaataatgaataaa

SEQ ID NO: 4351295 - DNA, 14 bp, Homo sapiens
ttaaagcatctgta

SEQ ID NO: 4351296 - DNA, 11 bp, Homo sapiens
ttaaagccttc

SEQ ID NO: 4351297 - DNA, 21 bp, Homo sapiens
ttaaatactgtgcagaataat

SEQ ID NO: 4351298 - DNA, 12 bp, Homo sapiens
ttaaatcatgta

SEQ ID NO: 4351299 - DNA, 15 bp, Homo sapiens
ttaaatcatgtatgt

SEQ ID NO: 4351300 - DNA, 13 bp, Homo sapiens
ttaataatgtatt

SEQ ID NO: 4351301 - DNA, 22 bp, Homo sapiens
ttaataatgtattgtaatcttt

SEQ ID NO: 4351302 - DNA, 20 bp, Homo sapiens
ttaattttaccaagagtaac

SEQ ID NO: 4351303 - DNA, 22 bp, Homo sapiens
ttaattttaccaagagtaactt

SEQ ID NO: 4351304 - DNA, 16 bp, Homo sapiens
ttacaaccatacttta

SEQ ID NO: 4351305 - DNA, 22 bp, Homo sapiens
ttacactgcggaagccaaaggc

SEQ ID NO: 4351306 - DNA, 17 bp, Homo sapiens
ttactttttcccatctg

SEQ ID NO: 4351307 - DNA, 16 bp, Homo sapiens
ttatgaactgcatcaa

SEQ ID NO: 4351308 - DNA, 15 bp, Homo sapiens
ttatgatctaataaa

SEQ ID NO: 4351309 - DNA, 19 bp, Homo sapiens
ttattctcagtaactttta

SEQ ID NO: 4351310 - DNA, 14 bp, Homo sapiens
ttattgttgaacat

SEQ ID NO: 4351311 - DNA, 15 bp, Homo sapiens
ttattttaaatgtgg

SEQ ID NO: 4351312 - DNA, 12 bp, Homo sapiens
ttattttatgat

SEQ ID NO: 4351313 - DNA, 23 bp, Homo sapiens
ttatttttgtcacggaaagcatc

SEQ ID NO: 4351314 - DNA, 13 bp, Homo sapiens
ttcacctatgtta

SEQ ID NO: 4351315 - DNA, 12 bp, Homo sapiens
ttcacctgttat

SEQ ID NO: 4351316 - DNA, 11 bp, Homo sapiens
ttcagacaaca

SEQ ID NO: 4351317 - DNA, 13 bp, Homo sapiens
ttcagacaacatt

SEQ ID NO: 4351318 - DNA, 20 bp, Homo sapiens
ttcagacaacattatgatct

SEQ ID NO: 4351319 - DNA, 22 bp, Homo sapiens
ttcagacaacattatgatctaa

SEQ ID NO: 4351320 - DNA, 13 bp, Homo sapiens
ttcagattgtctt

SEQ ID NO: 4351321 - DNA, 12 bp, Homo sapiens
ttcagcccacca

SEQ ID NO: 4351322 - DNA, 16 bp, Homo sapiens
ttcagcccaccaccct

SEQ ID NO: 4351323 - DNA, 17 bp, Homo sapiens
ttcagcccaccaccctg

SEQ ID NO: 4351324 - DNA, 16 bp, Homo sapiens
ttcaggtaaaaacttc

SEQ ID NO: 4351325 - DNA, 13 bp, Homo sapiens
ttcagtttttgta

SEQ ID NO: 4351326 - DNA, 17 bp, Homo sapiens
ttcagtttttgtatctt

SEQ ID NO: 4351327 - DNA, 22 bp, Homo sapiens
ttcataaaacggtgctttctgt

SEQ ID NO: 4351328 - DNA, 21 bp, Homo sapiens
ttcatactgtagaaaccagct

SEQ ID NO: 4351329 - DNA, 22 bp, Homo sapiens
ttcatagggaaaggttttgtat

SEQ ID NO: 4351330 - DNA, 16 bp, Homo sapiens
ttcatcctcctcccca

SEQ ID NO: 4351331 - DNA, 22 bp, Homo sapiens
ttcattccggactggcagaagc

SEQ ID NO: 4351332 - DNA, 13 bp, Homo sapiens
ttcattctttata

SEQ ID NO: 4351333 - DNA, 12 bp, Homo sapiens
ttccaggctgag

SEQ ID NO: 4351334 - DNA, 14 bp, Homo sapiens
ttccaggctgagcc

SEQ ID NO: 4351335 - DNA, 18 bp, Homo sapiens
ttccaggctgagccatga

SEQ ID NO: 4351336 - DNA, 21 bp, Homo sapiens
ttcccagaccaggaaaggctt

SEQ ID NO: 4351337 - DNA, 14 bp, Homo sapiens
ttcccatctggctt

SEQ ID NO: 4351338 - DNA, 20 bp, Homo sapiens
ttcccatctggctttttctg

SEQ ID NO: 4351339 - DNA, 13 bp, Homo sapiens
ttcccttcccaga

SEQ ID NO: 4351340 - DNA, 18 bp, Homo sapiens
ttcctagatctgcaggct

SEQ ID NO: 4351341 - DNA, 20 bp, Homo sapiens
ttcctagtggatgactgttg

SEQ ID NO: 4351342 - DNA, 21 bp, Homo sapiens
ttcctgcatttgatagcaatg

SEQ ID NO: 4351343 - DNA, 19 bp, Homo sapiens
ttccttcaaccaccatttt

SEQ ID NO: 4351344 - DNA, 13 bp, Homo sapiens
ttctacagaataa

SEQ ID NO: 4351345 - DNA, 12 bp, Homo sapiens
ttctatgttaaa

SEQ ID NO: 4351346 - DNA, 15 bp, Homo sapiens
ttctatgttaaatac

SEQ ID NO: 4351347 - DNA, 19 bp, Homo sapiens
ttctatgttaaatactgtg

SEQ ID NO: 4351348 - DNA, 20 bp, Homo sapiens
ttctatgttaaatactgtgc

SEQ ID NO: 4351349 - DNA, 23 bp, Homo sapiens
ttctatgttaaatactgtgcaga

SEQ ID NO: 4351350 - DNA, 20 bp, Homo sapiens
ttctattccctaacttgtga

SEQ ID NO: 4351351 - DNA, 16 bp, Homo sapiens
ttctcttcccttccca

SEQ ID NO: 4351352 - DNA, 16 bp, Homo sapiens
ttctcttcctagatct

SEQ ID NO: 4351353 - DNA, 22 bp, Homo sapiens
ttctcttcctagatctgcaggc

SEQ ID NO: 4351354 - DNA, 19 bp, Homo sapiens
ttctgccactgaggagaca

SEQ ID NO: 4351355 - DNA, 20 bp, Homo sapiens
ttctgccactgaggagacag

SEQ ID NO: 4351356 - DNA, 19 bp, Homo sapiens
ttctgctttatcttttcat

SEQ ID NO: 4351357 - DNA, 18 bp, Homo sapiens
ttctggggcaggctgggc

SEQ ID NO: 4351358 - DNA, 14 bp, Homo sapiens
ttctgtgaaagcct

SEQ ID NO: 4351359 - DNA, 21 bp, Homo sapiens
ttcttcacctgttatgtatga

SEQ ID NO: 4351360 - DNA, 19 bp, Homo sapiens
ttctttatatatggacagc

SEQ ID NO: 4351361 - DNA, 23 bp, Homo sapiens
ttctttatatatggacagcttta

SEQ ID NO: 4351362 - DNA, 17 bp, Homo sapiens
ttgaaaatgtgtttgct

SEQ ID NO: 4351363 - DNA, 22 bp, Homo sapiens
ttgaggccaagatggctgctgc

SEQ ID NO: 4351364 - DNA, 23 bp, Homo sapiens
ttgagttgacttctgacaaaggt

SEQ ID NO: 4351365 - DNA, 21 bp, Homo sapiens
ttgataagctattgtctgtaa

SEQ ID NO: 4351366 - DNA, 22 bp, Homo sapiens
ttgataagctattgtctgtaat

SEQ ID NO: 4351367 - DNA, 17 bp, Homo sapiens
ttgatgaagtatacttt

SEQ ID NO: 4351368 - DNA, 12 bp, Homo sapiens
ttgatgcctttt

SEQ ID NO: 4351369 - DNA, 15 bp, Homo sapiens
ttgcaacttcagttt

SEQ ID NO: 4351370 - DNA, 14 bp, Homo sapiens
ttgcagatgtattg

SEQ ID NO: 4351371 - DNA, 17 bp, Homo sapiens
ttgccaaggcaaaaaac

SEQ ID NO: 4351372 - DNA, 13 bp, Homo sapiens
ttgcctggactga

SEQ ID NO: 4351373 - DNA, 14 bp, Homo sapiens
ttgcctggactgac

SEQ ID NO: 4351374 - DNA, 21 bp, Homo sapiens
ttgctcctagcagacagaaac

SEQ ID NO: 4351375 - DNA, 16 bp, Homo sapiens
ttggaaactgctaaat

SEQ ID NO: 4351376 - DNA, 15 bp, Homo sapiens
ttggactccaggcct

SEQ ID NO: 4351377 - DNA, 14 bp, Homo sapiens
ttggcagtgacttt

SEQ ID NO: 4351378 - DNA, 18 bp, Homo sapiens
agacaacattatgatcta

SEQ ID NO: 4351379 - DNA, 16 bp, Homo sapiens
agacacaatatgtatg

SEQ ID NO: 4351380 - DNA, 11 bp, Homo sapiens
agacagaaact

SEQ ID NO: 4351381 - DNA, 23 bp, Homo sapiens
agacagaaagcctccgctgggct

SEQ ID NO: 4351382 - DNA, 20 bp, Homo sapiens
agacctggctctcagaggaa

SEQ ID NO: 4351383 - DNA, 16 bp, Homo sapiens
agactgcaaacttttt

SEQ ID NO: 4351384 - DNA, 19 bp, Homo sapiens
agactgcagaacccccagg

SEQ ID NO: 4351385 - DNA, 16 bp, Homo sapiens
agacttcaatcctgat

SEQ ID NO: 4351386 - DNA, 23 bp, Homo sapiens
agagacccctcccctcccaccca

SEQ ID NO: 4351387 - DNA, 13 bp, Homo sapiens
agagagcctgtca

SEQ ID NO: 4351388 - DNA, 14 bp, Homo sapiens
agagagcctgtcac

SEQ ID NO: 4351389 - DNA, 20 bp, Homo sapiens
agagagcctgtcaccagagc

SEQ ID NO: 4351390 - DNA, 13 bp, Homo sapiens
agagagggactca

SEQ ID NO: 4351391 - DNA, 14 bp, Homo sapiens
agagatggagaaat

SEQ ID NO: 4351392 - DNA, 18 bp, Homo sapiens
agagatggagaaatagac

SEQ ID NO: 4351393 - DNA, 14 bp, Homo sapiens
agagcaattccagg

SEQ ID NO: 4351394 - DNA, 17 bp, Homo sapiens
agagcaattccaggctg

SEQ ID NO: 4351395 - DNA, 22 bp, Homo sapiens
agagcaattccaggctgagcca

SEQ ID NO: 4351396 - DNA, 15 bp, Homo sapiens
agagccaacctggac

SEQ ID NO: 4351397 - DNA, 22 bp, Homo sapiens
agagccaacctggacttcctgt

SEQ ID NO: 4351398 - DNA, 12 bp, Homo sapiens
agagcctgtcac

SEQ ID NO: 4351399 - DNA, 19 bp, Homo sapiens
agagccttttatctgcaga

SEQ ID NO: 4351400 - DNA, 18 bp, Homo sapiens
agagctgttataaattta

SEQ ID NO: 4351401 - DNA, 18 bp, Homo sapiens
agaggctgcccctctcac

SEQ ID NO: 4351402 - DNA, 19 bp, Homo sapiens
agaggctgcccctctcacc

SEQ ID NO: 4351403 - DNA, 18 bp, Homo sapiens
agagtttttaaagccttc

SEQ ID NO: 4351404 - DNA, 13 bp, Homo sapiens
agatagaaagctg

SEQ ID NO: 4351405 - DNA, 19 bp, Homo sapiens
agatagaaagctggactga

SEQ ID NO: 4351406 - DNA, 22 bp, Homo sapiens
agatatatttcacttttgttct

SEQ ID NO: 4351407 - DNA, 12 bp, Homo sapiens
agatctgcaggc

SEQ ID NO: 4351408 - DNA, 14 bp, Homo sapiens
agatctgcaggctg

SEQ ID NO: 4351409 - DNA, 15 bp, Homo sapiens
agatctgcaggctgc

SEQ ID NO: 4351410 - DNA, 15 bp, Homo sapiens
agatggctgctgcct

SEQ ID NO: 4351411 - DNA, 19 bp, Homo sapiens
agatggctgctgcctgctc

SEQ ID NO: 4351412 - DNA, 18 bp, Homo sapiens
agatggtttcaattcaga

SEQ ID NO: 4351413 - DNA, 15 bp, Homo sapiens
agatgtattgactgt

SEQ ID NO: 4351414 - DNA, 15 bp, Homo sapiens
agattaggagaaaca

SEQ ID NO: 4351415 - DNA, 17 bp, Homo sapiens
agattaggagaaacaca

SEQ ID NO: 4351416 - DNA, 14 bp, Homo sapiens
agatttttggtttt

SEQ ID NO: 4351417 - DNA, 21 bp, Homo sapiens
agatttttggttttttgattt

SEQ ID NO: 4351418 - DNA, 15 bp, Homo sapiens
agcaattccaggctg

SEQ ID NO: 4351419 - DNA, 16 bp, Homo sapiens
agcaattccaggctga

SEQ ID NO: 4351420 - DNA, 20 bp, Homo sapiens
agcaattccaggctgagcca

SEQ ID NO: 4351421 - DNA, 21 bp, Homo sapiens
agcaattccaggctgagccat

SEQ ID NO: 4351422 - DNA, 13 bp, Homo sapiens
agcagacagaaac

SEQ ID NO: 4351423 - DNA, 17 bp, Homo sapiens
agcagacagaaactgga

SEQ ID NO: 4351424 - DNA, 18 bp, Homo sapiens
agcataaataaaactgaa

SEQ ID NO: 4351425 - DNA, 22 bp, Homo sapiens
agcattgcctggactgaccaca

SEQ ID NO: 4351426 - DNA, 14 bp, Homo sapiens
agccaacctggact

SEQ ID NO: 4351427 - DNA, 15 bp, Homo sapiens
agccaacctggactt

SEQ ID NO: 4351428 - DNA, 17 bp, Homo sapiens
agccaacctggacttcc

SEQ ID NO: 4351429 - DNA, 22 bp, Homo sapiens
agccagagtttttaaagccttc

SEQ ID NO: 4351430 - DNA, 23 bp, Homo sapiens
agccagagtttttaaagccttct

SEQ ID NO: 4351431 - DNA, 19 bp, Homo sapiens
agccatagacctacagacc

SEQ ID NO: 4351432 - DNA, 12 bp, Homo sapiens
agccatgaggag

SEQ ID NO: 4351433 - DNA, 20 bp, Homo sapiens
agccatgaggagcgtggact

SEQ ID NO: 4351434 - DNA, 15 bp, Homo sapiens
agccatttactttgc

SEQ ID NO: 4351435 - DNA, 20 bp, Homo sapiens
agccctgggtaccctgagcc

SEQ ID NO: 4351436 - DNA, 15 bp, Homo sapiens
agccgaggggagaga

SEQ ID NO: 4351437 - DNA, 17 bp, Homo sapiens
agccgaggggagagagg

SEQ ID NO: 4351438 - DNA, 22 bp, Homo sapiens
agcctataagaggaatttcttt

SEQ ID NO: 4351439 - DNA, 15 bp, Homo sapiens
agcctgtcaccagag

SEQ ID NO: 4351440 - DNA, 17 bp, Homo sapiens
agcctgtcaccagagct

SEQ ID NO: 4351441 - DNA, 19 bp, Homo sapiens
agcctgtcaccagagcttc

SEQ ID NO: 4351442 - DNA, 21 bp, Homo sapiens
agcctgtcaccagagcttctc

SEQ ID NO: 4351443 - DNA, 17 bp, Homo sapiens
agccttctggatccatg

SEQ ID NO: 4351444 - DNA, 12 bp, Homo sapiens
agcggcagagca

SEQ ID NO: 4351445 - DNA, 21 bp, Homo sapiens
agctaagatagaaagctggac

SEQ ID NO: 4351446 - DNA, 12 bp, Homo sapiens
agctcttctctt

SEQ ID NO: 4351447 - DNA, 17 bp, Homo sapiens
agctggactgaccaaag

SEQ ID NO: 4351448 - DNA, 14 bp, Homo sapiens
agctgggcctcctg

SEQ ID NO: 4351449 - DNA, 22 bp, Homo sapiens
agctttgagttgacttctgaca

SEQ ID NO: 4351450 - DNA, 20 bp, Homo sapiens
aggaaaggcttggctggtgt

SEQ ID NO: 4351451 - DNA, 18 bp, Homo sapiens
aggaatcattccagtgct

SEQ ID NO: 4351452 - DNA, 12 bp, Homo sapiens
aggactttgtta

SEQ ID NO: 4351453 - DNA, 13 bp, Homo sapiens
aggagaaactcta

SEQ ID NO: 4351454 - DNA, 21 bp, Homo sapiens
aggagaaactctagactgcaa

SEQ ID NO: 4351455 - DNA, 12 bp, Homo sapiens
aggagacagaaa

SEQ ID NO: 4351456 - DNA, 23 bp, Homo sapiens
aggagagacccctcccctcccac

SEQ ID NO: 4351457 - DNA, 13 bp, Homo sapiens
aggagcgtggact

SEQ ID NO: 4351458 - DNA, 14 bp, Homo sapiens
aggagcgtggactc

SEQ ID NO: 4351459 - DNA, 20 bp, Homo sapiens
aggcaagcttgaggccaaga

SEQ ID NO: 4351460 - DNA, 22 bp, Homo sapiens
aggcaagcttgaggccaagatg

SEQ ID NO: 4351461 - DNA, 22 bp, Homo sapiens
aggcacaaggttggttgctaag

SEQ ID NO: 4351462 - DNA, 23 bp, Homo sapiens
aggcagcccagctcctgaataaa

SEQ ID NO: 4351463 - DNA, 20 bp, Homo sapiens
aggcagctaagatagaaagc

SEQ ID NO: 4351464 - DNA, 22 bp, Homo sapiens
aggcagctaagatagaaagctg

SEQ ID NO: 4351465 - DNA, 23 bp, Homo sapiens
aggcatggctcagagcttgaaga

SEQ ID NO: 4351466 - DNA, 14 bp, Homo sapiens
aggccaagatggct

SEQ ID NO: 4351467 - DNA, 17 bp, Homo sapiens
aggccaagatggctgct

SEQ ID NO: 4351468 - DNA, 23 bp, Homo sapiens
aggccaagatggctgctgcctgc

SEQ ID NO: 4351469 - DNA, 13 bp, Homo sapiens
aggcctgaccagg

SEQ ID NO: 4351470 - DNA, 21 bp, Homo sapiens
aggccttcatcctcctcccca

SEQ ID NO: 4351471 - DNA, 22 bp, Homo sapiens
aggccttcatcctcctccccag

SEQ ID NO: 4351472 - DNA, 23 bp, Homo sapiens
aggctgcacctctggctagagcc

SEQ ID NO: 4351473 - DNA, 24 bp, Homo sapiens
aggctgcacctctggctagagccg

SEQ ID NO: 4351474 - DNA, 12 bp, Homo sapiens
aggctgcccctc

SEQ ID NO: 4351475 - DNA, 10 bp, Homo sapiens
aggctgggcc

SEQ ID NO: 4351476 - DNA, 18 bp, Homo sapiens
aggctgggccatgtccaa

SEQ ID NO: 4351477 - DNA, 20 bp, Homo sapiens
aggctgggccatgtccaaag

SEQ ID NO: 4351478 - DNA, 17 bp, Homo sapiens
agggaaaggcaagcttg

SEQ ID NO: 4351479 - DNA, 18 bp, Homo sapiens
agggaaaggttttgtatt

SEQ ID NO: 4351480 - DNA, 19 bp, Homo sapiens
agggaaaggttttgtattt

SEQ ID NO: 4351481 - DNA, 17 bp, Homo sapiens
agggcctgagcagctgg

SEQ ID NO: 4351482 - DNA, 15 bp, Homo sapiens
aggggagagagggac

SEQ ID NO: 4351483 - DNA, 16 bp, Homo sapiens
aggggagagagggact

SEQ ID NO: 4351484 - DNA, 21 bp, Homo sapiens
agggggtggttattggactcc

SEQ ID NO: 4351485 - DNA, 13 bp, Homo sapiens
agggtaatatcat

SEQ ID NO: 4351486 - DNA, 18 bp, Homo sapiens
agggtgtggtatgagggg

SEQ ID NO: 4351487 - DNA, 18 bp, Homo sapiens
agggttgaaaatgtgttt

SEQ ID NO: 4351488 - DNA, 21 bp, Homo sapiens
agggttgaaaatgtgtttgct

SEQ ID NO: 4351489 - DNA, 21 bp, Homo sapiens
aggtagtttggatatttttgt

SEQ ID NO: 4351490 - DNA, 13 bp, Homo sapiens
aggtccagctggg

SEQ ID NO: 4351491 - DNA, 18 bp, Homo sapiens
aggtccagctgggcctcc

SEQ ID NO: 4351492 - DNA, 18 bp, Homo sapiens
aggtggtaaattcagaca

SEQ ID NO: 4351493 - DNA, 13 bp, Homo sapiens
aggttttgtattt

SEQ ID NO: 4351494 - DNA, 22 bp, Homo sapiens
agtaactttactctgtgtttaa

SEQ ID NO: 4351495 - DNA, 15 bp, Homo sapiens
agtaagttaataatg

SEQ ID NO: 4351496 - DNA, 14 bp, Homo sapiens
agtagttgtattct

SEQ ID NO: 4351497 - DNA, 21 bp, Homo sapiens
agtagttgtattcttctgtat

SEQ ID NO: 4351498 - DNA, 18 bp, Homo sapiens
agtatctagtcagtatct

SEQ ID NO: 4351499 - DNA, 22 bp, Homo sapiens
agtattcctttatacacagtgg

SEQ ID NO: 4351500 - DNA, 17 bp, Homo sapiens
agtgatatggtgaaggg

SEQ ID NO: 4351501 - DNA, 20 bp, Homo sapiens
agtgatatggtgaagggaag

SEQ ID NO: 4351502 - DNA, 13 bp, Homo sapiens
agtgatgtgctga

SEQ ID NO: 4351503 - DNA, 20 bp, Homo sapiens
agtgctataaatgccagagc

SEQ ID NO: 4351504 - DNA, 21 bp, Homo sapiens
agtgctataaatgccagagcc

SEQ ID NO: 4351505 - DNA, 14 bp, Homo sapiens
agtggatgactgtt

SEQ ID NO: 4351506 - DNA, 16 bp, Homo sapiens
agtggatgactgttga

SEQ ID NO: 4351507 - DNA, 22 bp, Homo sapiens
agttatattagtgaagatggtt

SEQ ID NO: 4351508 - DNA, 23 bp, Homo sapiens
cagtgctataaatgccagagcca

SEQ ID NO: 4351509 - DNA, 15 bp, Homo sapiens
cataaagggttgaaa

SEQ ID NO: 4351510 - DNA, 20 bp, Homo sapiens
catacattcatactgtagaa

SEQ ID NO: 4351511 - DNA, 19 bp, Homo sapiens
catagacctacagacctgg

SEQ ID NO: 4351512 - DNA, 20 bp, Homo sapiens
catagacctacagacctggc

SEQ ID NO: 4351513 - DNA, 21 bp, Homo sapiens
catatcaattggcagtgactt

SEQ ID NO: 4351514 - DNA, 23 bp, Homo sapiens
catatcaattggcagtgactttg

SEQ ID NO: 4351515 - DNA, 15 bp, Homo sapiens
catatcccatcctta

SEQ ID NO: 4351516 - DNA, 17 bp, Homo sapiens
catcaagacttcaatcc

SEQ ID NO: 4351517 - DNA, 21 bp, Homo sapiens
catccaaaatattttttgcaa

SEQ ID NO: 4351518 - DNA, 14 bp, Homo sapiens
catccaagccagag

SEQ ID NO: 4351519 - DNA, 18 bp, Homo sapiens
catccccgtccatgctca

SEQ ID NO: 4351520 - DNA, 14 bp, Homo sapiens
catcctcctcccca

SEQ ID NO: 4351521 - DNA, 18 bp, Homo sapiens
catcctcctccccagctc

SEQ ID NO: 4351522 - DNA, 18 bp, Homo sapiens
catctcaattttttcaaa

SEQ ID NO: 4351523 - DNA, 22 bp, Homo sapiens
catctcaattttttcaaatgaa

SEQ ID NO: 4351524 - DNA, 17 bp, Homo sapiens
catctggctttttctgc

SEQ ID NO: 4351525 - DNA, 22 bp, Homo sapiens
catctggctttttctgccactg

SEQ ID NO: 4351526 - DNA, 20 bp, Homo sapiens
catgaaccatgcttacaaag

SEQ ID NO: 4351527 - DNA, 17 bp, Homo sapiens
catgcttacaaagaaag

SEQ ID NO: 4351528 - DNA, 15 bp, Homo sapiens
catggccctcggagg

SEQ ID NO: 4351529 - DNA, 20 bp, Homo sapiens
catggctcagagcttgaaga

SEQ ID NO: 4351530 - DNA, 18 bp, Homo sapiens
catgtatgttatgatatt

SEQ ID NO: 4351531 - DNA, 15 bp, Homo sapiens
catgtccaaagaggc

SEQ ID NO: 4351532 - DNA, 13 bp, Homo sapiens
cattatgatctaa

SEQ ID NO: 4351533 - DNA, 18 bp, Homo sapiens
cattatgatctaataaac

SEQ ID NO: 4351534 - DNA, 20 bp, Homo sapiens
cattatgatctaataaactt

SEQ ID NO: 4351535 - DNA, 16 bp, Homo sapiens
cattccggactggcag

SEQ ID NO: 4351536 - DNA, 19 bp, Homo sapiens
cattccggactggcagaag

SEQ ID NO: 4351537 - DNA, 14 bp, Homo sapiens
cattgcctggactg

SEQ ID NO: 4351538 - DNA, 18 bp, Homo sapiens
cattgcctggactgacca

SEQ ID NO: 4351539 - DNA, 18 bp, Homo sapiens
ccaaaatattttttgcaa

SEQ ID NO: 4351540 - DNA, 16 bp, Homo sapiens
ccaaagactgcagaac

SEQ ID NO: 4351541 - DNA, 18 bp, Homo sapiens
ccaaagactgcagaaccc

SEQ ID NO: 4351542 - DNA, 22 bp, Homo sapiens
ccaaagaggctgcccctctcac

SEQ ID NO: 4351543 - DNA, 12 bp, Homo sapiens
ccaaaggcagct

SEQ ID NO: 4351544 - DNA, 16 bp, Homo sapiens
ccaaaggcagctaaga

SEQ ID NO: 4351545 - DNA, 21 bp, Homo sapiens
ccaaaggcagctaagatagaa

SEQ ID NO: 4351546 - DNA, 17 bp, Homo sapiens
ccaaagttggagcttct

SEQ ID NO: 4351547 - DNA, 18 bp, Homo sapiens
ccaacctggacttcctgt

SEQ ID NO: 4351548 - DNA, 18 bp, Homo sapiens
ccaagatggctgctgcct

SEQ ID NO: 4351549 - DNA, 15 bp, Homo sapiens
ccaaggcaaaaaact

SEQ ID NO: 4351550 - DNA, 12 bp, Homo sapiens
ccacagccatag

SEQ ID NO: 4351551 - DNA, 21 bp, Homo sapiens
ccaccatggtcatcaccaccc

SEQ ID NO: 4351552 - DNA, 22 bp, Homo sapiens
ccaccatggtcatcaccaccct

SEQ ID NO: 4351553 - DNA, 21 bp, Homo sapiens
ccaccgggttctgcagcggca

SEQ ID NO: 4351554 - DNA, 22 bp, Homo sapiens
ccactcctttacaaccatactt

SEQ ID NO: 4351555 - DNA, 21 bp, Homo sapiens
ccactgaggagacagaaagcc

SEQ ID NO: 4351556 - DNA, 20 bp, Homo sapiens
ccagacaaaaaaatttaaaa

SEQ ID NO: 4351557 - DNA, 18 bp, Homo sapiens
ccagagccaacctggact

SEQ ID NO: 4351558 - DNA, 14 bp, Homo sapiens
ccagagcttctctg

SEQ ID NO: 4351559 - DNA, 21 bp, Homo sapiens
ccagagtttttaaagccttct

SEQ ID NO: 4351560 - DNA, 22 bp, Homo sapiens
ccagagtttttaaagccttctg

SEQ ID NO: 4351561 - DNA, 18 bp, Homo sapiens
ccagctcttctcttccta

SEQ ID NO: 4351562 - DNA, 19 bp, Homo sapiens
ccagctcttctcttcctag

SEQ ID NO: 4351563 - DNA, 22 bp, Homo sapiens
ccagctgggcctcctgcctccg

SEQ ID NO: 4351564 - DNA, 16 bp, Homo sapiens
ccagctttatttttta

SEQ ID NO: 4351565 - DNA, 16 bp, Homo sapiens
ccaggaaaggcttggc

SEQ ID NO: 4351566 - DNA, 13 bp, Homo sapiens
ccaggctgagcca

SEQ ID NO: 4351567 - DNA, 17 bp, Homo sapiens
ccaggctgagccatgag

SEQ ID NO: 4351568 - DNA, 18 bp, Homo sapiens
ccaggctgagccatgagg

SEQ ID NO: 4351569 - DNA, 13 bp, Homo sapiens
ccaggtggcctgc

SEQ ID NO: 4351570 - DNA, 13 bp, Homo sapiens
ccagtattgctga

SEQ ID NO: 4351571 - DNA, 18 bp, Homo sapiens
ccatagacctacagacct

SEQ ID NO: 4351572 - DNA, 16 bp, Homo sapiens
ccatgaggagcgtgga

SEQ ID NO: 4351573 - DNA, 14 bp, Homo sapiens
ccatggggggagaa

SEQ ID NO: 4351574 - DNA, 20 bp, Homo sapiens
ccatgtccaaagaggctgcc

SEQ ID NO: 4351575 - DNA, 12 bp, Homo sapiens
cccaccaccctg

SEQ ID NO: 4351576 - DNA, 16 bp, Homo sapiens
cccaccagctttattt

SEQ ID NO: 4351577 - DNA, 24 bp, Homo sapiens
cccagaccaggaaaggcttggctg

SEQ ID NO: 4351578 - DNA, 12 bp, Homo sapiens
cccagctcctga

SEQ ID NO: 4351579 - DNA, 16 bp, Homo sapiens
cccagctcctgaataa

SEQ ID NO: 4351580 - DNA, 18 bp, Homo sapiens
cccagctcttctcttcct

SEQ ID NO: 4351581 - DNA, 20 bp, Homo sapiens
cccatctggctttttctgcc

SEQ ID NO: 4351582 - DNA, 21 bp, Homo sapiens
cccatctggctttttctgcca

SEQ ID NO: 4351583 - DNA, 20 bp, Homo sapiens
ccccagctcttctcttccta

SEQ ID NO: 4351584 - DNA, 12 bp, Homo sapiens
cccctctcacca

SEQ ID NO: 4351585 - DNA, 17 bp, Homo sapiens
cccctgaggcagcccag

SEQ ID NO: 4351586 - DNA, 14 bp, Homo sapiens
cccgaacagggact

SEQ ID NO: 4351587 - DNA, 20 bp, Homo sapiens
ccctaacttgtgaagacaat

SEQ ID NO: 4351588 - DNA, 20 bp, Homo sapiens
ccctcggaggtccagctggg

SEQ ID NO: 4351589 - DNA, 23 bp, Homo sapiens
ccctcggaggtccagctgggcct

SEQ ID NO: 4351590 - DNA, 13 bp, Homo sapiens
cccttcccagacc

SEQ ID NO: 4351591 - DNA, 17 bp, Homo sapiens
cccttcccagaccagga

SEQ ID NO: 4351592 - DNA, 18 bp, Homo sapiens
cccttcccagaccaggaa

SEQ ID NO: 4351593 - DNA, 19 bp, Homo sapiens
ccgaggggagagagggact

SEQ ID NO: 4351594 - DNA, 23 bp, Homo sapiens
cctaatgtctcactgttctgcaa

SEQ ID NO: 4351595 - DNA, 14 bp, Homo sapiens
cctataagaggaat

SEQ ID NO: 4351596 - DNA, 15 bp, Homo sapiens
cctcaggagagaccc

SEQ ID NO: 4351597 - DNA, 13 bp, Homo sapiens
cctcccctcccac

SEQ ID NO: 4351598 - DNA, 13 bp, Homo sapiens
cctccgctgggct

SEQ ID NO: 4351599 - DNA, 17 bp, Homo sapiens
cctcgcccttcagccca

SEQ ID NO: 4351600 - DNA, 18 bp, Homo sapiens
cctcggaggtccagctgg

SEQ ID NO: 4351601 - DNA, 23 bp, Homo sapiens
cctgaccagggggcccgaacagg

SEQ ID NO: 4351602 - DNA, 13 bp, Homo sapiens
cctgagcagctgg

SEQ ID NO: 4351603 - DNA, 12 bp, Homo sapiens
cctgagcccacc

SEQ ID NO: 4351604 - DNA, 12 bp, Homo sapiens
cctgaggcagcc

SEQ ID NO: 4351605 - DNA, 15 bp, Homo sapiens
cctgaggcagcccag

SEQ ID NO: 4351606 - DNA, 22 bp, Homo sapiens
cctgcatttgatagcaatgtaa

SEQ ID NO: 4351607 - DNA, 13 bp, Homo sapiens
cctgcctccgggc

SEQ ID NO: 4351608 - DNA, 19 bp, Homo sapiens
cctgctcatggccctcgga

SEQ ID NO: 4351609 - DNA, 15 bp, Homo sapiens
cctggacttcctgtc

SEQ ID NO: 4351610 - DNA, 15 bp, Homo sapiens
cctggctctcagagg

SEQ ID NO: 4351611 - DNA, 16 bp, Homo sapiens
cctggctctcagagga

SEQ ID NO: 4351612 - DNA, 17 bp, Homo sapiens
cctggctctcagaggaa

SEQ ID NO: 4351613 - DNA, 21 bp, Homo sapiens
cctgtcaccagagcttctctg

SEQ ID NO: 4351614 - DNA, 12 bp, Homo sapiens
cctgttaaacag

SEQ ID NO: 4351615 - DNA, 21 bp, Homo sapiens
cctgttcataaaacggtgctt

SEQ ID NO: 4351616 - DNA, 21 bp, Homo sapiens
cctgtttataatctgaagata

SEQ ID NO: 4351617 - DNA, 14 bp, Homo sapiens
ccttcccagaccag

SEQ ID NO: 4351618 - DNA, 15 bp, Homo sapiens
ccttcccagaccagg

SEQ ID NO: 4351619 - DNA, 17 bp, Homo sapiens
ccttctggatccatggg

SEQ ID NO: 4351620 - DNA, 19 bp, Homo sapiens
ccttctggatccatggggg

SEQ ID NO: 4351621 - DNA, 18 bp, Homo sapiens
ccttgctcctagcagaca

SEQ ID NO: 4351622 - DNA, 20 bp, Homo sapiens
cctttacaaccatactttat

SEQ ID NO: 4351623 - DNA, 18 bp, Homo sapiens
cctttgtaaaacagccta

SEQ ID NO: 4351624 - DNA, 14 bp, Homo sapiens
cgaacagggacttg

SEQ ID NO: 4351625 - DNA, 13 bp, Homo sapiens
cgaggggagagag

SEQ ID NO: 4351626 - DNA, 22 bp, Homo sapiens
cgctgggcttcattccggactg

SEQ ID NO: 4351627 - DNA, 17 bp, Homo sapiens
cggaagccaaaggcagc

SEQ ID NO: 4351628 - DNA, 22 bp, Homo sapiens
cggaagccaaaggcagctaaga

SEQ ID NO: 4351629 - DNA, 23 bp, Homo sapiens
cggaggagaaactctagactgca

SEQ ID NO: 4351630 - DNA, 17 bp, Homo sapiens
cggaggtccagctgggc

SEQ ID NO: 4351631 - DNA, 14 bp, Homo sapiens
ctaaatataaattt

SEQ ID NO: 4351632 - DNA, 22 bp, Homo sapiens
ctaaatataaattttcagaatt

SEQ ID NO: 4351633 - DNA, 17 bp, Homo sapiens
ctaagatagaaagctgg

SEQ ID NO: 4351634 - DNA, 11 bp, Homo sapiens
ctaataaactt

SEQ ID NO: 4351635 - DNA, 19 bp, Homo sapiens
ctaatgtctcactgttctg

SEQ ID NO: 4351636 - DNA, 22 bp, Homo sapiens
ctaatgtctcactgttctgcaa

SEQ ID NO: 4351637 - DNA, 21 bp, Homo sapiens
ctacattggaagctttgagtt

SEQ ID NO: 4351638 - DNA, 13 bp, Homo sapiens
gcattcaaagtaa

SEQ ID NO: 4351639 - DNA, 23 bp, Homo sapiens
gcattcaaagtaatatatcaaat

SEQ ID NO: 4351640 - DNA, 13 bp, Homo sapiens
gcattgcctggac

SEQ ID NO: 4351641 - DNA, 14 bp, Homo sapiens
gcattgcctggact

SEQ ID NO: 4351642 - DNA, 20 bp, Homo sapiens
gccaacctggacttcctgtc

SEQ ID NO: 4351643 - DNA, 21 bp, Homo sapiens
gccaacctggacttcctgtca

SEQ ID NO: 4351644 - DNA, 14 bp, Homo sapiens
gccactgaggagac

SEQ ID NO: 4351645 - DNA, 19 bp, Homo sapiens
gccactgaggagacagaaa

SEQ ID NO: 4351646 - DNA, 15 bp, Homo sapiens
gccagagtttttaaa

SEQ ID NO: 4351647 - DNA, 17 bp, Homo sapiens
gccaggagtaagacaag

SEQ ID NO: 4351648 - DNA, 18 bp, Homo sapiens
gccatagacctacagacc

SEQ ID NO: 4351649 - DNA, 19 bp, Homo sapiens
gccatagacctacagacct

SEQ ID NO: 4351650 - DNA, 18 bp, Homo sapiens
gcccagctcctgaataaa

SEQ ID NO: 4351651 - DNA, 15 bp, Homo sapiens
gcccctctcaccaaa

SEQ ID NO: 4351652 - DNA, 18 bp, Homo sapiens
gcccctgaggcagcccag

SEQ ID NO: 4351653 - DNA, 22 bp, Homo sapiens
gccctcggaggtccagctgggc

SEQ ID NO: 4351654 - DNA, 14 bp, Homo sapiens
gcccttcagcccac

SEQ ID NO: 4351655 - DNA, 21 bp, Homo sapiens
gcccttcagcccaccaccctg

SEQ ID NO: 4351656 - DNA, 13 bp, Homo sapiens
gccgaggggagag

SEQ ID NO: 4351657 - DNA, 17 bp, Homo sapiens
gccgaggggagagaggg

SEQ ID NO: 4351658 - DNA, 20 bp, Homo sapiens
gccgaggggagagagggact

SEQ ID NO: 4351659 - DNA, 13 bp, Homo sapiens
gcctcctgcctcc

SEQ ID NO: 4351660 - DNA, 14 bp, Homo sapiens
gcctgctcatggcc

SEQ ID NO: 4351661 - DNA, 14 bp, Homo sapiens
gcctggactgacca

SEQ ID NO: 4351662 - DNA, 17 bp, Homo sapiens
gccttcatcctcctccc

SEQ ID NO: 4351663 - DNA, 20 bp, Homo sapiens
gccttctggatccatggggg

SEQ ID NO: 4351664 - DNA, 17 bp, Homo sapiens
gcgtggactctgctaga

SEQ ID NO: 4351665 - DNA, 19 bp, Homo sapiens
gctaaattctatgttaaat

SEQ ID NO: 4351666 - DNA, 22 bp, Homo sapiens
gctaaattctatgttaaatact

SEQ ID NO: 4351667 - DNA, 21 bp, Homo sapiens
gctaagatagaaagctggact

SEQ ID NO: 4351668 - DNA, 22 bp, Homo sapiens
gctaagatagaaagctggactg

SEQ ID NO: 4351669 - DNA, 16 bp, Homo sapiens
gctacactgtataact

SEQ ID NO: 4351670 - DNA, 19 bp, Homo sapiens
gctagagccgaggggagag

SEQ ID NO: 4351671 - DNA, 18 bp, Homo sapiens
gctataaatgccagagcc

SEQ ID NO: 4351672 - DNA, 21 bp, Homo sapiens
gctataaatgccagagccaac

SEQ ID NO: 4351673 - DNA, 22 bp, Homo sapiens
gctcctagcagacagaaactgg

SEQ ID NO: 4351674 - DNA, 13 bp, Homo sapiens
gctcttctcttcc

SEQ ID NO: 4351675 - DNA, 14 bp, Homo sapiens
gctgagccatgagg

SEQ ID NO: 4351676 - DNA, 16 bp, Homo sapiens
gctgagccatgaggag

SEQ ID NO: 4351677 - DNA, 13 bp, Homo sapiens
gctgcacctctgg

SEQ ID NO: 4351678 - DNA, 15 bp, Homo sapiens
gctgcccctctcacc

SEQ ID NO: 4351679 - DNA, 16 bp, Homo sapiens
gctgcccctctcacca

SEQ ID NO: 4351680 - DNA, 18 bp, Homo sapiens
gctgctaatattaaacct

SEQ ID NO: 4351681 - DNA, 16 bp, Homo sapiens
gctgctgcctgctcat

SEQ ID NO: 4351682 - DNA, 23 bp, Homo sapiens
gctggactgaccaaagactgcag

SEQ ID NO: 4351683 - DNA, 19 bp, Homo sapiens
gctgggccatgtccaaaga

SEQ ID NO: 4351684 - DNA, 21 bp, Homo sapiens
gctgtttgggttgttggtctg

SEQ ID NO: 4351685 - DNA, 22 bp, Homo sapiens
gctgtttgggttgttggtctgt

SEQ ID NO: 4351686 - DNA, 12 bp, Homo sapiens
gcttaaactaaa

SEQ ID NO: 4351687 - DNA, 18 bp, Homo sapiens
gcttacaaagaaagcact

SEQ ID NO: 4351688 - DNA, 19 bp, Homo sapiens
gcttacaaagaaagcactt

SEQ ID NO: 4351689 - DNA, 15 bp, Homo sapiens
gcttattttatgata

SEQ ID NO: 4351690 - DNA, 21 bp, Homo sapiens
gcttattttatgatagtttgt

SEQ ID NO: 4351691 - DNA, 17 bp, Homo sapiens
gcttctctgggctgaat

SEQ ID NO: 4351692 - DNA, 21 bp, Homo sapiens
gcttgaggccaagatggctgc

SEQ ID NO: 4351693 - DNA, 18 bp, Homo sapiens
gctttctgtgaaagcctt

SEQ ID NO: 4351694 - DNA, 14 bp, Homo sapiens
gctttgagttgact

SEQ ID NO: 4351695 - DNA, 17 bp, Homo sapiens
gctttgagttgacttct

SEQ ID NO: 4351696 - DNA, 18 bp, Homo sapiens
ggaaacattacagttcat

SEQ ID NO: 4351697 - DNA, 21 bp, Homo sapiens
ggaaaggcaagcttgaggcca

SEQ ID NO: 4351698 - DNA, 14 bp, Homo sapiens
ggaaaggttttgta

SEQ ID NO: 4351699 - DNA, 19 bp, Homo sapiens
ggaaaggttttgtattttt

SEQ ID NO: 4351700 - DNA, 13 bp, Homo sapiens
ggaagccaaaggc

SEQ ID NO: 4351701 - DNA, 17 bp, Homo sapiens
ggaatcattccagtgct

SEQ ID NO: 4351702 - DNA, 11 bp, Homo sapiens
ggactccaggc

SEQ ID NO: 4351703 - DNA, 18 bp, Homo sapiens
ggactctgctagactcct

SEQ ID NO: 4351704 - DNA, 18 bp, Homo sapiens
ggactgaccaaagactgc

SEQ ID NO: 4351705 - DNA, 20 bp, Homo sapiens
ggactgaccaaagactgcag

SEQ ID NO: 4351706 - DNA, 22 bp, Homo sapiens
ggactgaccaaagactgcagaa

SEQ ID NO: 4351707 - DNA, 23 bp, Homo sapiens
ggactgaccacaccaaccaggcc

SEQ ID NO: 4351708 - DNA, 23 bp, Homo sapiens
ggactggcagaagcattgcctgg

SEQ ID NO: 4351709 - DNA, 23 bp, Homo sapiens
ggagcgtggactctgctagactc

SEQ ID NO: 4351710 - DNA, 15 bp, Homo sapiens
ggaggtccagctggg

SEQ ID NO: 4351711 - DNA, 17 bp, Homo sapiens
ggagtatttgaacacag

SEQ ID NO: 4351712 - DNA, 15 bp, Homo sapiens
ggatccatgggggga

SEQ ID NO: 4351713 - DNA, 17 bp, Homo sapiens
ggattaaaacaattttt

SEQ ID NO: 4351714 - DNA, 18 bp, Homo sapiens
ggattaaaacaatttttt

SEQ ID NO: 4351715 - DNA, 19 bp, Homo sapiens
ggattctctaattagaaat

SEQ ID NO: 4351716 - DNA, 17 bp, Homo sapiens
ggcaagcttgaggccaa

SEQ ID NO: 4351717 - DNA, 19 bp, Homo sapiens
ggcaagcttgaggccaaga

SEQ ID NO: 4351718 - DNA, 18 bp, Homo sapiens
ggcaatgcttaaactaaa

SEQ ID NO: 4351719 - DNA, 22 bp, Homo sapiens
ggcagagcaattccaggctgag

SEQ ID NO: 4351720 - DNA, 12 bp, Homo sapiens
ggcagctaagat

SEQ ID NO: 4351721 - DNA, 21 bp, Homo sapiens
ggcagctaagatagaaagctg

SEQ ID NO: 4351722 - DNA, 22 bp, Homo sapiens
ggcagctaagatagaaagctgg

SEQ ID NO: 4351723 - DNA, 10 bp, Homo sapiens
ggcaggctgg

SEQ ID NO: 4351724 - DNA, 22 bp, Homo sapiens
ggcaggctgggccatgtccaaa

SEQ ID NO: 4351725 - DNA, 11 bp, Homo sapiens
ggcagtgactt

SEQ ID NO: 4351726 - DNA, 18 bp, Homo sapiens
ggcatgggtggaattaga

SEQ ID NO: 4351727 - DNA, 20 bp, Homo sapiens
ggccaagatggctgctgcct

SEQ ID NO: 4351728 - DNA, 16 bp, Homo sapiens
ggcccctgaggcagcc

SEQ ID NO: 4351729 - DNA, 12 bp, Homo sapiens
ggcctcctgcct

SEQ ID NO: 4351730 - DNA, 13 bp, Homo sapiens
ggcctgaccaggg

SEQ ID NO: 4351731 - DNA, 19 bp, Homo sapiens
ggctagagccgaggggaga

SEQ ID NO: 4351732 - DNA, 22 bp, Homo sapiens
ggctagagccgaggggagagag

SEQ ID NO: 4351733 - DNA, 16 bp, Homo sapiens
ggctgagccatgagga

SEQ ID NO: 4351734 - DNA, 23 bp, Homo sapiens
ggctgagccatgaggagcgtgga

SEQ ID NO: 4351735 - DNA, 16 bp, Homo sapiens
ggctgatgaagaaggg

SEQ ID NO: 4351736 - DNA, 16 bp, Homo sapiens
ggctgcacctctggct

SEQ ID NO: 4351737 - DNA, 22 bp, Homo sapiens
ggctgcacctctggctagagcc

SEQ ID NO: 4351738 - DNA, 13 bp, Homo sapiens
ggctgcccctctc

SEQ ID NO: 4351739 - DNA, 17 bp, Homo sapiens
ggctgggccatgtccaa

SEQ ID NO: 4351740 - DNA, 18 bp, Homo sapiens
ggcttcattccggactgg

SEQ ID NO: 4351741 - DNA, 16 bp, Homo sapiens
gggccatgtccaaaga

SEQ ID NO: 4351742 - DNA, 14 bp, Homo sapiens
gggcctcctgcctc

SEQ ID NO: 4351743 - DNA, 14 bp, Homo sapiens
gggcctgagcagct

SEQ ID NO: 4351744 - DNA, 15 bp, Homo sapiens
gggctgaatgtatgt

SEQ ID NO: 4351745 - DNA, 15 bp, Homo sapiens
ggggcaggctgggcc

SEQ ID NO: 4351746 - DNA, 16 bp, Homo sapiens
ggggcaggctgggcca

SEQ ID NO: 4351747 - DNA, 17 bp, Homo sapiens
gggtggttattggactc

SEQ ID NO: 4351748 - DNA, 21 bp, Homo sapiens
gggtggttattggactccagg

SEQ ID NO: 4351749 - DNA, 22 bp, Homo sapiens
gggtgtggtatgagggggtggt

SEQ ID NO: 4351750 - DNA, 14 bp, Homo sapiens
ggtaaattcagaca

SEQ ID NO: 4351751 - DNA, 18 bp, Homo sapiens
ggtaatattgataagcta

SEQ ID NO: 4351752 - DNA, 14 bp, Homo sapiens
ggtataatgtttaa

SEQ ID NO: 4351753 - DNA, 15 bp, Homo sapiens
ggtataatgtttaaa

SEQ ID NO: 4351754 - DNA, 17 bp, Homo sapiens
ggtccagctgggcctcc

SEQ ID NO: 4351755 - DNA, 21 bp, Homo sapiens
ggtctgtgtaacatccaagcc

SEQ ID NO: 4351756 - DNA, 13 bp, Homo sapiens
ggtgaagggaagt

SEQ ID NO: 4351757 - DNA, 16 bp, Homo sapiens
ggtgctttctgtgaaa

SEQ ID NO: 4351758 - DNA, 21 bp, Homo sapiens
ggtgctttctgtgaaagcctt

SEQ ID NO: 4351759 - DNA, 17 bp, Homo sapiens
ggtggcaatgcttaaac

SEQ ID NO: 4351760 - DNA, 14 bp, Homo sapiens
ggtggcctgcgtct

SEQ ID NO: 4351761 - DNA, 16 bp, Homo sapiens
ggtggttattggactc

SEQ ID NO: 4351762 - DNA, 17 bp, Homo sapiens
ggtggttattggactcc

SEQ ID NO: 4351763 - DNA, 18 bp, Homo sapiens
ggtggttattggactcca

SEQ ID NO: 4351764 - DNA, 20 bp, Homo sapiens
ggtggttttgtgctttaaaa

SEQ ID NO: 4351765 - DNA, 16 bp, Homo sapiens
ggtttacactgcggaa

SEQ ID NO: 4351766 - DNA, 12 bp, Homo sapiens
ggtttttatgaa

SEQ ID NO: 4351767 - DNA, 17 bp, Homo sapiens
gtaaattcagacaacat

SEQ ID NO: 4351768 - DNA, 23 bp, Homo sapiens
tcggaggtccagctgggcctcct

SEQ ID NO: 4351769 - DNA, 13 bp, Homo sapiens
tctaaaaagaaaa

SEQ ID NO: 4351770 - DNA, 20 bp, Homo sapiens
tctaaacacttcattcttta

SEQ ID NO: 4351771 - DNA, 13 bp, Homo sapiens
tctaataaacttt

SEQ ID NO: 4351772 - DNA, 15 bp, Homo sapiens
tctaataaactttat

SEQ ID NO: 4351773 - DNA, 12 bp, Homo sapiens
tctacagaataa

SEQ ID NO: 4351774 - DNA, 15 bp, Homo sapiens
tctacctttgtaaaa

SEQ ID NO: 4351775 - DNA, 22 bp, Homo sapiens
tctagactgcaagaactgtttt

SEQ ID NO: 4351776 - DNA, 15 bp, Homo sapiens
tctaggcacaaggtt

SEQ ID NO: 4351777 - DNA, 13 bp, Homo sapiens
tctatattcttta

SEQ ID NO: 4351778 - DNA, 16 bp, Homo sapiens
tctatattctttattc

SEQ ID NO: 4351779 - DNA, 17 bp, Homo sapiens
tctcaaagttaattcac

SEQ ID NO: 4351780 - DNA, 15 bp, Homo sapiens
tctcactgttctgca

SEQ ID NO: 4351781 - DNA, 16 bp, Homo sapiens
tctcactgttctgcaa

SEQ ID NO: 4351782 - DNA, 20 bp, Homo sapiens
tctcagaggaaaaatgggag

SEQ ID NO: 4351783 - DNA, 13 bp, Homo sapiens
tctcttcccttcc

SEQ ID NO: 4351784 - DNA, 18 bp, Homo sapiens
tctcttcccttcccagac

SEQ ID NO: 4351785 - DNA, 20 bp, Homo sapiens
tctcttcccttcccagacca

SEQ ID NO: 4351786 - DNA, 18 bp, Homo sapiens
tctgaagatatatttcac

SEQ ID NO: 4351787 - DNA, 20 bp, Homo sapiens
tctgaagatatatttcactt

SEQ ID NO: 4351788 - DNA, 12 bp, Homo sapiens
tctgcagcggca

SEQ ID NO: 4351789 - DNA, 20 bp, Homo sapiens
tctgccactgaggagacaga

SEQ ID NO: 4351790 - DNA, 13 bp, Homo sapiens
tctgctagactcc

SEQ ID NO: 4351791 - DNA, 16 bp, Homo sapiens
tctgctagactcctca

SEQ ID NO: 4351792 - DNA, 21 bp, Homo sapiens
tctgctagactcctcaggaga

SEQ ID NO: 4351793 - DNA, 15 bp, Homo sapiens
tctggatccatgggg

SEQ ID NO: 4351794 - DNA, 22 bp, Homo sapiens
tctggatccatggggggagaag

SEQ ID NO: 4351795 - DNA, 18 bp, Homo sapiens
tctggctttttctgccac

SEQ ID NO: 4351796 - DNA, 20 bp, Homo sapiens
tctgtaaatttggactgttt

SEQ ID NO: 4351797 - DNA, 14 bp, Homo sapiens
tctgtatttctagg

SEQ ID NO: 4351798 - DNA, 22 bp, Homo sapiens
tctgtgaaagccttaagaagat

SEQ ID NO: 4351799 - DNA, 11 bp, Homo sapiens
tcttaatctgt

SEQ ID NO: 4351800 - DNA, 14 bp, Homo sapiens
tcttcacctgttat

SEQ ID NO: 4351801 - DNA, 15 bp, Homo sapiens
tcttcacctgttatg

SEQ ID NO: 4351802 - DNA, 18 bp, Homo sapiens
tcttcacctgttatgtat

SEQ ID NO: 4351803 - DNA, 12 bp, Homo sapiens
tcttcagaactt

SEQ ID NO: 4351804 - DNA, 18 bp, Homo sapiens
tcttcccttcccagacca

SEQ ID NO: 4351805 - DNA, 22 bp, Homo sapiens
tcttctgtatttctaggcacaa

SEQ ID NO: 4351806 - DNA, 16 bp, Homo sapiens
tcttgcaacttcagtt

SEQ ID NO: 4351807 - DNA, 17 bp, Homo sapiens
tcttgcaacttcagttt

SEQ ID NO: 4351808 - DNA, 20 bp, Homo sapiens
tcttggggcaagactgcaaa

SEQ ID NO: 4351809 - DNA, 23 bp, Homo sapiens
tcttggggcaagactgcaaactt

SEQ ID NO: 4351810 - DNA, 21 bp, Homo sapiens
tctttatatatggacagcttt

SEQ ID NO: 4351811 - DNA, 21 bp, Homo sapiens
tctttattctcagtaactttt

SEQ ID NO: 4351812 - DNA, 12 bp, Homo sapiens
tgaaaatgtgtt

SEQ ID NO: 4351813 - DNA, 16 bp, Homo sapiens
tgaaaatgtgtttgct

SEQ ID NO: 4351814 - DNA, 17 bp, Homo sapiens
tgaaaatgtgtttgctg

SEQ ID NO: 4351815 - DNA, 16 bp, Homo sapiens
tgaacatacttcaaaa

SEQ ID NO: 4351816 - DNA, 22 bp, Homo sapiens
tgaacatacttcaaaaataatg

SEQ ID NO: 4351817 - DNA, 17 bp, Homo sapiens
tgaactgcatcaagact

SEQ ID NO: 4351818 - DNA, 15 bp, Homo sapiens
tgaagaagggggtgg

SEQ ID NO: 4351819 - DNA, 21 bp, Homo sapiens
tgaagaagggggtggggggag

SEQ ID NO: 4351820 - DNA, 15 bp, Homo sapiens
tgaagatggtttcaa

SEQ ID NO: 4351821 - DNA, 21 bp, Homo sapiens
tgaagattaggagaaacacat

SEQ ID NO: 4351822 - DNA, 20 bp, Homo sapiens
tgaaggaatcattccagtgc

SEQ ID NO: 4351823 - DNA, 17 bp, Homo sapiens
tgaagggaagtggggag

SEQ ID NO: 4351824 - DNA, 21 bp, Homo sapiens
tgaagtatacttttcccctgt

SEQ ID NO: 4351825 - DNA, 12 bp, Homo sapiens
tgaataaactga

SEQ ID NO: 4351826 - DNA, 13 bp, Homo sapiens
tgaataaactgaa

SEQ ID NO: 4351827 - DNA, 17 bp, Homo sapiens
tgaataaactgaatatt

SEQ ID NO: 4351828 - DNA, 14 bp, Homo sapiens
tgaatattttggaa

SEQ ID NO: 4351829 - DNA, 15 bp, Homo sapiens
tgaatattttggaaa

SEQ ID NO: 4351830 - DNA, 16 bp, Homo sapiens
tgaatattttggaaac

SEQ ID NO: 4351831 - DNA, 23 bp, Homo sapiens
tgaatattttggaaactgctaaa

SEQ ID NO: 4351832 - DNA, 14 bp, Homo sapiens
tgaattagaagaaa

SEQ ID NO: 4351833 - DNA, 20 bp, Homo sapiens
tgaattgcctgttcataaaa

SEQ ID NO: 4351834 - DNA, 16 bp, Homo sapiens
tgaccaaagactgcag

SEQ ID NO: 4351835 - DNA, 15 bp, Homo sapiens
tgaccacaccaacca

SEQ ID NO: 4351836 - DNA, 17 bp, Homo sapiens
tgactgttgatgaagta

SEQ ID NO: 4351837 - DNA, 22 bp, Homo sapiens
tgactttttttggtataatgtt

SEQ ID NO: 4351838 - DNA, 17 bp, Homo sapiens
tgagaaccttttcaaac

SEQ ID NO: 4351839 - DNA, 16 bp, Homo sapiens
tgagatagcttcccca

SEQ ID NO: 4351840 - DNA, 21 bp, Homo sapiens
tgagatttttggttttttgat

SEQ ID NO: 4351841 - DNA, 13 bp, Homo sapiens
tgagccatgagga

SEQ ID NO: 4351842 - DNA, 15 bp, Homo sapiens
tgagccatgaggagc

SEQ ID NO: 4351843 - DNA, 13 bp, Homo sapiens
tgaggagacagaa

SEQ ID NO: 4351844 - DNA, 24 bp, Homo sapiens
tgaggagcgtggactctgctagac

SEQ ID NO: 4351845 - DNA, 21 bp, Homo sapiens
tgaggccaagatggctgctgc

SEQ ID NO: 4351846 - DNA, 22 bp, Homo sapiens
tgagggggtggttattggactc

SEQ ID NO: 4351847 - DNA, 14 bp, Homo sapiens
tgatatacaaagtg

SEQ ID NO: 4351848 - DNA, 15 bp, Homo sapiens
tgatattgtttaaaa

SEQ ID NO: 4351849 - DNA, 12 bp, Homo sapiens
tgatctaataaa

SEQ ID NO: 4351850 - DNA, 16 bp, Homo sapiens
tgatctaataaacttt

SEQ ID NO: 4351851 - DNA, 19 bp, Homo sapiens
tgatctaataaactttatt

SEQ ID NO: 4351852 - DNA, 14 bp, Homo sapiens
tgatgaagaagggg

SEQ ID NO: 4351853 - DNA, 19 bp, Homo sapiens
tgatgaagaagggggtggg

SEQ ID NO: 4351854 - DNA, 17 bp, Homo sapiens
tgatgtgtgtgtgtctc

SEQ ID NO: 4351855 - DNA, 13 bp, Homo sapiens
tgatttgatgtga

SEQ ID NO: 4351856 - DNA, 17 bp, Homo sapiens
tgatttgatgtgacttt

SEQ ID NO: 4351857 - DNA, 18 bp, Homo sapiens
tgcaaacttttttatatc

SEQ ID NO: 4351858 - DNA, 13 bp, Homo sapiens
tgcaacttcagtt

SEQ ID NO: 4351859 - DNA, 23 bp, Homo sapiens
tgcaagttatattagtgaagatg

SEQ ID NO: 4351860 - DNA, 14 bp, Homo sapiens
tgcacctctggcta

SEQ ID NO: 4351861 - DNA, 19 bp, Homo sapiens
tgcacctctggctagagcc

SEQ ID NO: 4351862 - DNA, 21 bp, Homo sapiens
tgcacctctggctagagccga

SEQ ID NO: 4351863 - DNA, 22 bp, Homo sapiens
tgcacctctggctagagccgag

SEQ ID NO: 4351864 - DNA, 19 bp, Homo sapiens
tgcagaacccccaggtggc

SEQ ID NO: 4351865 - DNA, 21 bp, Homo sapiens
tgcagaacccccaggtggcct

SEQ ID NO: 4351866 - DNA, 13 bp, Homo sapiens
tgcagaataatgg

SEQ ID NO: 4351867 - DNA, 17 bp, Homo sapiens
tgcagaataatggaaac

SEQ ID NO: 4351868 - DNA, 20 bp, Homo sapiens
tgcagaataatggaaacatt

SEQ ID NO: 4351869 - DNA, 23 bp, Homo sapiens
tgcagcggcagagcaattccagg

SEQ ID NO: 4351870 - DNA, 19 bp, Homo sapiens
tgcaggctgcacctctggc

SEQ ID NO: 4351871 - DNA, 23 bp, Homo sapiens
tgccactgaggagacagaaagcc

SEQ ID NO: 4351872 - DNA, 13 bp, Homo sapiens
tgccagagccaac

SEQ ID NO: 4351873 - DNA, 12 bp, Homo sapiens
tgcccctctcac

SEQ ID NO: 4351874 - DNA, 16 bp, Homo sapiens
tgcctccgggcaggca

SEQ ID NO: 4351875 - DNA, 19 bp, Homo sapiens
tgcctccgggcaggcaagg

SEQ ID NO: 4351876 - DNA, 15 bp, Homo sapiens
tgcctggactgacca

SEQ ID NO: 4351877 - DNA, 18 bp, Homo sapiens
tgctaaattctatgttaa

SEQ ID NO: 4351878 - DNA, 16 bp, Homo sapiens
tgctagaaaatttagc

SEQ ID NO: 4351879 - DNA, 15 bp, Homo sapiens
tgctagactcctcag

SEQ ID NO: 4351880 - DNA, 16 bp, Homo sapiens
tgctataaatgccaga

SEQ ID NO: 4351881 - DNA, 18 bp, Homo sapiens
tgctataaatgccagagc

SEQ ID NO: 4351882 - DNA, 19 bp, Homo sapiens
tgctataaatgccagagcc

SEQ ID NO: 4351883 - DNA, 13 bp, Homo sapiens
tgctcctagcaga

SEQ ID NO: 4351884 - DNA, 13 bp, Homo sapiens
tgctgcctgctca

SEQ ID NO: 4351885 - DNA, 20 bp, Homo sapiens
tgctgccttgctcctagcag

SEQ ID NO: 4351886 - DNA, 10 bp, Homo sapiens
tgctgctgtt

SEQ ID NO: 4351887 - DNA, 20 bp, Homo sapiens
tgcttaaactaaataatgaa

SEQ ID NO: 4351888 - DNA, 21 bp, Homo sapiens
tgctttaaaaatgcaatatct

SEQ ID NO: 4351889 - DNA, 13 bp, Homo sapiens
tgctttctgtgaa

SEQ ID NO: 4351890 - DNA, 18 bp, Homo sapiens
tgctttctgtgaaagcct

SEQ ID NO: 4351891 - DNA, 13 bp, Homo sapiens
tgctttttaccta

SEQ ID NO: 4351892 - DNA, 16 bp, Homo sapiens
tggaaacattacagtt

SEQ ID NO: 4351893 - DNA, 18 bp, Homo sapiens
tggaaacattacagttca

SEQ ID NO: 4351894 - DNA, 17 bp, Homo sapiens
tggaaactgctaaattc

SEQ ID NO: 4351895 - DNA, 15 bp, Homo sapiens
tggacagctttattt

SEQ ID NO: 4351896 - DNA, 14 bp, Homo sapiens
tggactgaccaaag

SEQ ID NO: 4351897 - DNA, 23 bp, Homo sapiens
tggactgaccacaccaaccaggc

SEQ ID NO: 4351898 - DNA, 17 bp, Homo sapiens
tggactgttttccttca

SEQ ID NO: 4351899 - DNA, 23 bp, Homo sapiens
agccaggagtaagacaagtggga

SEQ ID NO: 4351900 - DNA, 17 bp, Homo sapiens
agccatagacctacaga

SEQ ID NO: 4351901 - DNA, 20 bp, Homo sapiens
agccatagacctacagacct

SEQ ID NO: 4351902 - DNA, 13 bp, Homo sapiens
agccatgaggagc

SEQ ID NO: 4351903 - DNA, 19 bp, Homo sapiens
agccatgaggagcgtggac

SEQ ID NO: 4351904 - DNA, 14 bp, Homo sapiens
agcccaccaccctg

SEQ ID NO: 4351905 - DNA, 19 bp, Homo sapiens
agcccaccagggacacctc

SEQ ID NO: 4351906 - DNA, 18 bp, Homo sapiens
agcccagctcctgaataa

SEQ ID NO: 4351907 - DNA, 19 bp, Homo sapiens
agcccagctcctgaataaa

SEQ ID NO: 4351908 - DNA, 12 bp, Homo sapiens
agccgaggggag

SEQ ID NO: 4351909 - DNA, 16 bp, Homo sapiens
agccgaggggagagag

SEQ ID NO: 4351910 - DNA, 16 bp, Homo sapiens
agcctccgctgggctt

SEQ ID NO: 4351911 - DNA, 18 bp, Homo sapiens
agcctgtcaccagagctt

SEQ ID NO: 4351912 - DNA, 20 bp, Homo sapiens
agcctgtcaccagagcttct

SEQ ID NO: 4351913 - DNA, 14 bp, Homo sapiens
agccttttatctgc

SEQ ID NO: 4351914 - DNA, 16 bp, Homo sapiens
agcgcagcagagatgg

SEQ ID NO: 4351915 - DNA, 13 bp, Homo sapiens
agcggcagagcaa

SEQ ID NO: 4351916 - DNA, 21 bp, Homo sapiens
agcggcagagcaattccaggc

SEQ ID NO: 4351917 - DNA, 22 bp, Homo sapiens
agcggcagagcaattccaggct

SEQ ID NO: 4351918 - DNA, 15 bp, Homo sapiens
agcgtggactctgct

SEQ ID NO: 4351919 - DNA, 17 bp, Homo sapiens
agctaagatagaaagct

SEQ ID NO: 4351920 - DNA, 15 bp, Homo sapiens
agctcttctcttcct

SEQ ID NO: 4351921 - DNA, 16 bp, Homo sapiens
agctcttctcttccta

SEQ ID NO: 4351922 - DNA, 11 bp, Homo sapiens
agctggactga

SEQ ID NO: 4351923 - DNA, 12 bp, Homo sapiens
agctggactgac

SEQ ID NO: 4351924 - DNA, 13 bp, Homo sapiens
agctggactgacc

SEQ ID NO: 4351925 - DNA, 13 bp, Homo sapiens
agctgggaacttc

SEQ ID NO: 4351926 - DNA, 14 bp, Homo sapiens
agctgggaacttct

SEQ ID NO: 4351927 - DNA, 16 bp, Homo sapiens
agctgggcctcctgcc

SEQ ID NO: 4351928 - DNA, 19 bp, Homo sapiens
agctgggcctcctgcctcc

SEQ ID NO: 4351929 - DNA, 21 bp, Homo sapiens
agctgggcctcctgcctccgg

SEQ ID NO: 4351930 - DNA, 14 bp, Homo sapiens
agcttctctgggct

SEQ ID NO: 4351931 - DNA, 15 bp, Homo sapiens
agcttctctgggctg

SEQ ID NO: 4351932 - DNA, 12 bp, Homo sapiens
agcttgaagatt

SEQ ID NO: 4351933 - DNA, 23 bp, Homo sapiens
agcttgaagattaggagaaacac

SEQ ID NO: 4351934 - DNA, 19 bp, Homo sapiens
agcttgaggccaagatggc

SEQ ID NO: 4351935 - DNA, 20 bp, Homo sapiens
agcttgaggccaagatggct

SEQ ID NO: 4351936 - DNA, 18 bp, Homo sapiens
agctttattttaaatgtg

SEQ ID NO: 4351937 - DNA, 18 bp, Homo sapiens
aggaaaaatgggagccag

SEQ ID NO: 4351938 - DNA, 19 bp, Homo sapiens
aggaaaaatgggagccagg

SEQ ID NO: 4351939 - DNA, 22 bp, Homo sapiens
aggaaaaatgggagccaggagt

SEQ ID NO: 4351940 - DNA, 23 bp, Homo sapiens
aggaagatattggtggccggtgg

SEQ ID NO: 4351941 - DNA, 21 bp, Homo sapiens
aggaatcattccagtgctaga

SEQ ID NO: 4351942 - DNA, 18 bp, Homo sapiens
aggactttgttaacttca

SEQ ID NO: 4351943 - DNA, 19 bp, Homo sapiens
aggagaaacacattcttat

SEQ ID NO: 4351944 - DNA, 13 bp, Homo sapiens
aggagacagaaag

SEQ ID NO: 4351945 - DNA, 15 bp, Homo sapiens
aggagcgtggactct

SEQ ID NO: 4351946 - DNA, 21 bp, Homo sapiens
aggagcgtggactctgctaga

SEQ ID NO: 4351947 - DNA, 17 bp, Homo sapiens
aggagtaagacaagtgg

SEQ ID NO: 4351948 - DNA, 18 bp, Homo sapiens
aggagtaagacaagtggg

SEQ ID NO: 4351949 - DNA, 15 bp, Homo sapiens
aggcaagcttgaggc

SEQ ID NO: 4351950 - DNA, 17 bp, Homo sapiens
aggcaagcttgaggcca

SEQ ID NO: 4351951 - DNA, 21 bp, Homo sapiens
aggcaagcttgaggccaagat

SEQ ID NO: 4351952 - DNA, 15 bp, Homo sapiens
aggcaaggtttacac

SEQ ID NO: 4351953 - DNA, 22 bp, Homo sapiens
aggcaaggtttacactgcggaa

SEQ ID NO: 4351954 - DNA, 23 bp, Homo sapiens
aggcagctaagatagaaagctgg

SEQ ID NO: 4351955 - DNA, 17 bp, Homo sapiens
aggcatggctcagagct

SEQ ID NO: 4351956 - DNA, 18 bp, Homo sapiens
aggcatggctcagagctt

SEQ ID NO: 4351957 - DNA, 21 bp, Homo sapiens
aggccaagatggctgctgcct

SEQ ID NO: 4351958 - DNA, 20 bp, Homo sapiens
aggcccctgaggcagcccag

SEQ ID NO: 4351959 - DNA, 15 bp, Homo sapiens
aggcctgaccagggg

SEQ ID NO: 4351960 - DNA, 11 bp, Homo sapiens
aggccttcatc

SEQ ID NO: 4351961 - DNA, 19 bp, Homo sapiens
aggccttcatcctcctccc

SEQ ID NO: 4351962 - DNA, 11 bp, Homo sapiens
aggctgagcca

SEQ ID NO: 4351963 - DNA, 13 bp, Homo sapiens
aggctgagccatg

SEQ ID NO: 4351964 - DNA, 14 bp, Homo sapiens
aggctgagccatga

SEQ ID NO: 4351965 - DNA, 15 bp, Homo sapiens
aggctgagccatgag

SEQ ID NO: 4351966 - DNA, 22 bp, Homo sapiens
aggctgggccatgtccaaagag

SEQ ID NO: 4351967 - DNA, 14 bp, Homo sapiens
agggaagtggggag

SEQ ID NO: 4351968 - DNA, 15 bp, Homo sapiens
agggaagtggggagt

SEQ ID NO: 4351969 - DNA, 17 bp, Homo sapiens
agggactcaagggaaag

SEQ ID NO: 4351970 - DNA, 22 bp, Homo sapiens
agggacttgtttagagagcctg

SEQ ID NO: 4351971 - DNA, 23 bp, Homo sapiens
agggtgtggtatgagggggtggt

SEQ ID NO: 4351972 - DNA, 14 bp, Homo sapiens
aggtagtttggata

SEQ ID NO: 4351973 - DNA, 19 bp, Homo sapiens
aggtagtttggatattttt

SEQ ID NO: 4351974 - DNA, 23 bp, Homo sapiens
aggtagtttggatatttttgtac

SEQ ID NO: 4351975 - DNA, 15 bp, Homo sapiens
aggtccagctgggcc

SEQ ID NO: 4351976 - DNA, 17 bp, Homo sapiens
aggtccagctgggcctc

SEQ ID NO: 4351977 - DNA, 24 bp, Homo sapiens
aggtccagctgggcctcctgcctc

SEQ ID NO: 4351978 - DNA, 20 bp, Homo sapiens
aggtggcaatgcttaaacta

SEQ ID NO: 4351979 - DNA, 21 bp, Homo sapiens
aggtggcaatgcttaaactaa

SEQ ID NO: 4351980 - DNA, 16 bp, Homo sapiens
agtaagttaataatgt

SEQ ID NO: 4351981 - DNA, 22 bp, Homo sapiens
agtaagttaataatgtattgta

SEQ ID NO: 4351982 - DNA, 22 bp, Homo sapiens
agtatacttttcccctgttaaa

SEQ ID NO: 4351983 - DNA, 17 bp, Homo sapiens
agtatttgaacacagtt

SEQ ID NO: 4351984 - DNA, 17 bp, Homo sapiens
agtcttcactaaccttt

SEQ ID NO: 4351985 - DNA, 14 bp, Homo sapiens
agtgactttgtata

SEQ ID NO: 4351986 - DNA, 14 bp, Homo sapiens
agtgagatagcttc

SEQ ID NO: 4351987 - DNA, 18 bp, Homo sapiens
agtgctataaatgccaga

SEQ ID NO: 4351988 - DNA, 21 bp, Homo sapiens
agtgggatttggggcctcaag

SEQ ID NO: 4351989 - DNA, 15 bp, Homo sapiens
agttgacttctgaca

SEQ ID NO: 4351990 - DNA, 17 bp, Homo sapiens
agttgcagatgtattga

SEQ ID NO: 4351991 - DNA, 16 bp, Homo sapiens
agtttggatatttttg

SEQ ID NO: 4351992 - DNA, 21 bp, Homo sapiens
agtttggatatttttgtactt

SEQ ID NO: 4351993 - DNA, 22 bp, Homo sapiens
agtttggatatttttgtacttg

SEQ ID NO: 4351994 - DNA, 22 bp, Homo sapiens
agtttgtgttgttgttgctgct

SEQ ID NO: 4351995 - DNA, 15 bp, Homo sapiens
agttttatttttgcc

SEQ ID NO: 4351996 - DNA, 20 bp, Homo sapiens
ataggtagtttggatatttt

SEQ ID NO: 4351997 - DNA, 22 bp, Homo sapiens
ataggtagtttggatatttttg

SEQ ID NO: 4351998 - DNA, 17 bp, Homo sapiens
atagtgttaactgtcag

SEQ ID NO: 4351999 - DNA, 17 bp, Homo sapiens
atatatttcacttttgt

SEQ ID NO: 4352000 - DNA, 16 bp, Homo sapiens
atatcaaatccaggac

SEQ ID NO: 4352001 - DNA, 15 bp, Homo sapiens
atatcattctacaga

SEQ ID NO: 4352002 - DNA, 20 bp, Homo sapiens
atatcattctacagaataat

SEQ ID NO: 4352003 - DNA, 16 bp, Homo sapiens
atatctgaccaagatt

SEQ ID NO: 4352004 - DNA, 14 bp, Homo sapiens
atatcttttggtta

SEQ ID NO: 4352005 - DNA, 16 bp, Homo sapiens
atatcttttggttatt

SEQ ID NO: 4352006 - DNA, 24 bp, Homo sapiens
atatggtgaagggaagtggggagt

SEQ ID NO: 4352007 - DNA, 22 bp, Homo sapiens
atatgtatatcattctacagaa

SEQ ID NO: 4352008 - DNA, 10 bp, Homo sapiens
atatgtatgc

SEQ ID NO: 4352009 - DNA, 13 bp, Homo sapiens
atatgtatgcttt

SEQ ID NO: 4352010 - DNA, 19 bp, Homo sapiens
atatgtcagagctgttata

SEQ ID NO: 4352011 - DNA, 13 bp, Homo sapiens
atatgttctggac

SEQ ID NO: 4352012 - DNA, 14 bp, Homo sapiens
atattgtttaaaat

SEQ ID NO: 4352013 - DNA, 18 bp, Homo sapiens
atatttcacttttgttct

SEQ ID NO: 4352014 - DNA, 20 bp, Homo sapiens
atatttcacttttgttctgc

SEQ ID NO: 4352015 - DNA, 19 bp, Homo sapiens
atattttggaaactgctaa

SEQ ID NO: 4352016 - DNA, 19 bp, Homo sapiens
atattttttgcaagttata

SEQ ID NO: 4352017 - DNA, 23 bp, Homo sapiens
atcaattggcagtgactttgtat

SEQ ID NO: 4352018 - DNA, 12 bp, Homo sapiens
atcaccaccctt

SEQ ID NO: 4352019 - DNA, 11 bp, Homo sapiens
atcattccagt

SEQ ID NO: 4352020 - DNA, 15 bp, Homo sapiens
atcattccagtgcta

SEQ ID NO: 4352021 - DNA, 19 bp, Homo sapiens
atcattccagtgctagaaa

SEQ ID NO: 4352022 - DNA, 15 bp, Homo sapiens
atcattctacagaat

SEQ ID NO: 4352023 - DNA, 17 bp, Homo sapiens
atcattctacagaataa

SEQ ID NO: 4352024 - DNA, 18 bp, Homo sapiens
atcattctacagaataat

SEQ ID NO: 4352025 - DNA, 14 bp, Homo sapiens
atccaaaatatttt

SEQ ID NO: 4352026 - DNA, 19 bp, Homo sapiens
atccaaaatattttttgca

SEQ ID NO: 4352027 - DNA, 13 bp, Homo sapiens
atccatgggggga

SEQ ID NO: 4352028 - DNA, 18 bp, Homo sapiens
atccatggggggagaagt

SEQ ID NO: 4352029 - DNA, 13 bp, Homo sapiens
atcctcctcccca

SEQ ID NO: 4352030 - DNA, 19 bp, Homo sapiens
atcctcctccccagctctt

SEQ ID NO: 4352031 - DNA, 22 bp, Homo sapiens
atcctgtttataatctgaagat

SEQ ID NO: 4352032 - DNA, 18 bp, Homo sapiens
atccttaagagaagaaat

SEQ ID NO: 4352033 - DNA, 15 bp, Homo sapiens
atcgatatgtatatc

SEQ ID NO: 4352034 - DNA, 22 bp, Homo sapiens
atctaataaactttatttttta

SEQ ID NO: 4352035 - DNA, 16 bp, Homo sapiens
atctcaattttttcaa

SEQ ID NO: 4352036 - DNA, 18 bp, Homo sapiens
atctcaattttttcaaat

SEQ ID NO: 4352037 - DNA, 17 bp, Homo sapiens
atctgaagatatatttc

SEQ ID NO: 4352038 - DNA, 12 bp, Homo sapiens
atctgcaggctg

SEQ ID NO: 4352039 - DNA, 12 bp, Homo sapiens
atctggcttttt

SEQ ID NO: 4352040 - DNA, 19 bp, Homo sapiens
atctggctttttctgccac

SEQ ID NO: 4352041 - DNA, 21 bp, Homo sapiens
atctggctttttctgccactg

SEQ ID NO: 4352042 - DNA, 18 bp, Homo sapiens
atctgtaaatttggactg

SEQ ID NO: 4352043 - DNA, 18 bp, Homo sapiens
atcttggggcaagactgc

SEQ ID NO: 4352044 - DNA, 19 bp, Homo sapiens
atcttggggctgatgaaga

SEQ ID NO: 4352045 - DNA, 19 bp, Homo sapiens
atgaactgcatcaagactt

SEQ ID NO: 4352046 - DNA, 22 bp, Homo sapiens
atgaactgcatcaagacttcaa

SEQ ID NO: 4352047 - DNA, 22 bp, Homo sapiens
atgaaggaatcattccagtgct

SEQ ID NO: 4352048 - DNA, 20 bp, Homo sapiens
atgaaggtaatattgataag

SEQ ID NO: 4352049 - DNA, 23 bp, Homo sapiens
atgaataaactgaatattttgga

SEQ ID NO: 4352050 - DNA, 17 bp, Homo sapiens
atgaggagcgtggactc

SEQ ID NO: 4352051 - DNA, 14 bp, Homo sapiens
atgatattgtttaa

SEQ ID NO: 4352052 - DNA, 19 bp, Homo sapiens
atgatattgtttaaaattc

SEQ ID NO: 4352053 - DNA, 21 bp, Homo sapiens
atgatattgtttaaaattcag

SEQ ID NO: 4352054 - DNA, 16 bp, Homo sapiens
atgatctaataaactt

SEQ ID NO: 4352055 - DNA, 13 bp, Homo sapiens
atgccagagccaa

SEQ ID NO: 4352056 - DNA, 15 bp, Homo sapiens
atgcttaaactaaat

SEQ ID NO: 4352057 - DNA, 19 bp, Homo sapiens
atgcttaaactaaataatg

SEQ ID NO: 4352058 - DNA, 20 bp, Homo sapiens
atgcttaaactaaataatga

SEQ ID NO: 4352059 - DNA, 13 bp, Homo sapiens
atggctgctgcct

SEQ ID NO: 4352060 - DNA, 15 bp, Homo sapiens
atggctgctgcctgc

SEQ ID NO: 4352061 - DNA, 14 bp, Homo sapiens
atgggagccaggag

SEQ ID NO: 4352062 - DNA, 18 bp, Homo sapiens
atggtggactacaaaata

SEQ ID NO: 4352063 - DNA, 14 bp, Homo sapiens
atggttcatatttt

SEQ ID NO: 4352064 - DNA, 23 bp, Homo sapiens
atgtatatcattctacagaataa

SEQ ID NO: 4352065 - DNA, 17 bp, Homo sapiens
atgtatgttatgatatt

SEQ ID NO: 4352066 - DNA, 14 bp, Homo sapiens
atgtattgactgta

SEQ ID NO: 4352067 - DNA, 19 bp, Homo sapiens
atgtattgtaatctttcat

SEQ ID NO: 4352068 - DNA, 24 bp, Homo sapiens
atgtcagtgctataaatgccagag

SEQ ID NO: 4352069 - DNA, 15 bp, Homo sapiens
atgtccaaagaggct

SEQ ID NO: 4352070 - DNA, 16 bp, Homo sapiens
atgtccaaagaggctg

SEQ ID NO: 4352071 - DNA, 19 bp, Homo sapiens
atgtccaaagaggctgccc

SEQ ID NO: 4352072 - DNA, 13 bp, Homo sapiens
atgtctcactgtt

SEQ ID NO: 4352073 - DNA, 19 bp, Homo sapiens
atgtctcactgttctgcaa

SEQ ID NO: 4352074 - DNA, 20 bp, Homo sapiens
atgtctcactgttctgcaaa

SEQ ID NO: 4352075 - DNA, 21 bp, Homo sapiens
atgtgactttttttggtataa

SEQ ID NO: 4352076 - DNA, 16 bp, Homo sapiens
atgtggtttttgatgc

SEQ ID NO: 4352077 - DNA, 23 bp, Homo sapiens
atgtgttcttctttctctgtatt

SEQ ID NO: 4352078 - DNA, 12 bp, Homo sapiens
atgttaaatact

SEQ ID NO: 4352079 - DNA, 15 bp, Homo sapiens
atgttaaatactgtg

SEQ ID NO: 4352080 - DNA, 21 bp, Homo sapiens
atgttaaatactgtgcagaat

SEQ ID NO: 4352081 - DNA, 22 bp, Homo sapiens
atgttaaatactgtgcagaata

SEQ ID NO: 4352082 - DNA, 18 bp, Homo sapiens
atgttatgatattgttta

SEQ ID NO: 4352083 - DNA, 12 bp, Homo sapiens
atgttattttgt

SEQ ID NO: 4352084 - DNA, 17 bp, Homo sapiens
atgttctatattcttta

SEQ ID NO: 4352085 - DNA, 15 bp, Homo sapiens
atgtttaaatcatgt

SEQ ID NO: 4352086 - DNA, 16 bp, Homo sapiens
atgtttaaatcatgta

SEQ ID NO: 4352087 - DNA, 18 bp, Homo sapiens
atgtttaaatcatgtatg

SEQ ID NO: 4352088 - DNA, 12 bp, Homo sapiens
attaattcttca

SEQ ID NO: 4352089 - DNA, 15 bp, Homo sapiens
attagaaatttatat

SEQ ID NO: 4352090 - DNA, 15 bp, Homo sapiens
attatgatctaataa

SEQ ID NO: 4352091 - DNA, 14 bp, Homo sapiens
attcagacaacatt

SEQ ID NO: 4352092 - DNA, 16 bp, Homo sapiens
attcagtttttgtatc

SEQ ID NO: 4352093 - DNA, 18 bp, Homo sapiens
attcagtttttgtatctt

SEQ ID NO: 4352094 - DNA, 21 bp, Homo sapiens
attcatagggaaaggttttgt

SEQ ID NO: 4352095 - DNA, 23 bp, Homo sapiens
attcatagggaaaggttttgtat

SEQ ID NO: 4352096 - DNA, 16 bp, Homo sapiens
attccaggctgagcca

SEQ ID NO: 4352097 - DNA, 23 bp, Homo sapiens
attccaggctgagccatgaggag

SEQ ID NO: 4352098 - DNA, 20 bp, Homo sapiens
attccggactggcagaagca

SEQ ID NO: 4352099 - DNA, 18 bp, Homo sapiens
caggctgggccatgtcca

SEQ ID NO: 4352100 - DNA, 23 bp, Homo sapiens
cagggacacctcgcccttcagcc

SEQ ID NO: 4352101 - DNA, 20 bp, Homo sapiens
cagggacttgtttagagagc

SEQ ID NO: 4352102 - DNA, 15 bp, Homo sapiens
cagggtgtggtatga

SEQ ID NO: 4352103 - DNA, 19 bp, Homo sapiens
cagggtgtggtatgagggg

SEQ ID NO: 4352104 - DNA, 12 bp, Homo sapiens
caggtggcctgc

SEQ ID NO: 4352105 - DNA, 16 bp, Homo sapiens
cagtagttgtattctt

SEQ ID NO: 4352106 - DNA, 23 bp, Homo sapiens
cagtattgctgattttaaaggca

SEQ ID NO: 4352107 - DNA, 22 bp, Homo sapiens
cagtgctataaatgccagagcc

SEQ ID NO: 4352108 - DNA, 15 bp, Homo sapiens
cagttttatttttgc

SEQ ID NO: 4352109 - DNA, 20 bp, Homo sapiens
cataaagggttgaaaatgtg

SEQ ID NO: 4352110 - DNA, 22 bp, Homo sapiens
cataataggtagtttggatatt

SEQ ID NO: 4352111 - DNA, 16 bp, Homo sapiens
catactttatatatgt

SEQ ID NO: 4352112 - DNA, 22 bp, Homo sapiens
catagacctacagacctggctc

SEQ ID NO: 4352113 - DNA, 22 bp, Homo sapiens
catatcaattggcagtgacttt

SEQ ID NO: 4352114 - DNA, 21 bp, Homo sapiens
catcaagacttcaatcctgat

SEQ ID NO: 4352115 - DNA, 13 bp, Homo sapiens
catcaccaccctt

SEQ ID NO: 4352116 - DNA, 19 bp, Homo sapiens
catcctcctccccagctct

SEQ ID NO: 4352117 - DNA, 14 bp, Homo sapiens
catcgatatgtata

SEQ ID NO: 4352118 - DNA, 20 bp, Homo sapiens
attcctagtggatgactgtt

SEQ ID NO: 4352119 - DNA, 14 bp, Homo sapiens
attctacctttgta

SEQ ID NO: 4352120 - DNA, 21 bp, Homo sapiens
attctatgttaaatactgtgc

SEQ ID NO: 4352121 - DNA, 23 bp, Homo sapiens
attctttatatatggacagcttt

SEQ ID NO: 4352122 - DNA, 18 bp, Homo sapiens
attctttattctcagtaa

SEQ ID NO: 4352123 - DNA, 16 bp, Homo sapiens
attgcctggactgacc

SEQ ID NO: 4352124 - DNA, 18 bp, Homo sapiens
attgcctggactgaccac

SEQ ID NO: 4352125 - DNA, 21 bp, Homo sapiens
attggactccaggcctgacca

SEQ ID NO: 4352126 - DNA, 23 bp, Homo sapiens
attggactccaggcctgaccagg

SEQ ID NO: 4352127 - DNA, 20 bp, Homo sapiens
attggtggccggtggttttg

SEQ ID NO: 4352128 - DNA, 21 bp, Homo sapiens
attggttttatcgcagatttt

SEQ ID NO: 4352129 - DNA, 20 bp, Homo sapiens
attgtcttgcaacttcagtt

SEQ ID NO: 4352130 - DNA, 10 bp, Homo sapiens
atttaaaatt

SEQ ID NO: 4352131 - DNA, 11 bp, Homo sapiens
atttaaaatta

SEQ ID NO: 4352132 - DNA, 18 bp, Homo sapiens
atttagccctttaaaacg

SEQ ID NO: 4352133 - DNA, 15 bp, Homo sapiens
atttatatgcatgca

SEQ ID NO: 4352134 - DNA, 22 bp, Homo sapiens
atttatatgtcagagctgttat

SEQ ID NO: 4352135 - DNA, 17 bp, Homo sapiens
atttatattttgtgtat

SEQ ID NO: 4352136 - DNA, 14 bp, Homo sapiens
atttatcaactgtc

SEQ ID NO: 4352137 - DNA, 18 bp, Homo sapiens
atttctaggcacaaggtt

SEQ ID NO: 4352138 - DNA, 11 bp, Homo sapiens
atttctattcc

SEQ ID NO: 4352139 - DNA, 22 bp, Homo sapiens
atttcttttccttcattcatag

SEQ ID NO: 4352140 - DNA, 20 bp, Homo sapiens
atttggactgttttccttca

SEQ ID NO: 4352141 - DNA, 21 bp, Homo sapiens
attttaccaagagtaacttta

SEQ ID NO: 4352142 - DNA, 19 bp, Homo sapiens
attttggaaactgctaaat

SEQ ID NO: 4352143 - DNA, 17 bp, Homo sapiens
attttgtgtataatgtg

SEQ ID NO: 4352144 - DNA, 20 bp, Homo sapiens
attttgtgtataatgtgctt

SEQ ID NO: 4352145 - DNA, 18 bp, Homo sapiens
attttttaaaacactaaa

SEQ ID NO: 4352146 - DNA, 16 bp, Homo sapiens
caaaaaaatttaaaat

SEQ ID NO: 4352147 - DNA, 13 bp, Homo sapiens
caaacttttttat

SEQ ID NO: 4352148 - DNA, 15 bp, Homo sapiens
caaacttttttatat

SEQ ID NO: 4352149 - DNA, 17 bp, Homo sapiens
caaacttttttatatct

SEQ ID NO: 4352150 - DNA, 14 bp, Homo sapiens
caaagaaagcactt

SEQ ID NO: 4352151 - DNA, 13 bp, Homo sapiens
caaagaggctgcc

SEQ ID NO: 4352152 - DNA, 15 bp, Homo sapiens
caaagaggctgcccc

SEQ ID NO: 4352153 - DNA, 21 bp, Homo sapiens
caaagaggctgcccctctcac

SEQ ID NO: 4352154 - DNA, 19 bp, Homo sapiens
caaaggcagctaagataga

SEQ ID NO: 4352155 - DNA, 20 bp, Homo sapiens
caaaggtggtaaattcagac

SEQ ID NO: 4352156 - DNA, 22 bp, Homo sapiens
caaaggtggtaaattcagacaa

SEQ ID NO: 4352157 - DNA, 17 bp, Homo sapiens
caaagttaattcaccta

SEQ ID NO: 4352158 - DNA, 15 bp, Homo sapiens
caaatccaggacttt

SEQ ID NO: 4352159 - DNA, 22 bp, Homo sapiens
caaccaggccttcatcctcctc

SEQ ID NO: 4352160 - DNA, 14 bp, Homo sapiens
caacctggacttcc

SEQ ID NO: 4352161 - DNA, 20 bp, Homo sapiens
caacctggacttcctgtcat

SEQ ID NO: 4352162 - DNA, 17 bp, Homo sapiens
caactgtcaaatatgtt

SEQ ID NO: 4352163 - DNA, 22 bp, Homo sapiens
caagaaatatactctcccagat

SEQ ID NO: 4352164 - DNA, 16 bp, Homo sapiens
caagagtaactttact

SEQ ID NO: 4352165 - DNA, 15 bp, Homo sapiens
caagatggctgctgc

SEQ ID NO: 4352166 - DNA, 20 bp, Homo sapiens
caagatggctgctgcctgct

SEQ ID NO: 4352167 - DNA, 22 bp, Homo sapiens
caagatggctgctgcctgctca

SEQ ID NO: 4352168 - DNA, 22 bp, Homo sapiens
caagccagagtttttaaagcct

SEQ ID NO: 4352169 - DNA, 20 bp, Homo sapiens
caagccatttactttgcaag

SEQ ID NO: 4352170 - DNA, 22 bp, Homo sapiens
caagcttgaggccaagatggct

SEQ ID NO: 4352171 - DNA, 17 bp, Homo sapiens
caaggccaaaagaagtt

SEQ ID NO: 4352172 - DNA, 21 bp, Homo sapiens
caagggaaaggcaagcttgag

SEQ ID NO: 4352173 - DNA, 16 bp, Homo sapiens
caaggttggttgctaa

SEQ ID NO: 4352174 - DNA, 17 bp, Homo sapiens
caaggtttacactgcgg

SEQ ID NO: 4352175 - DNA, 20 bp, Homo sapiens
caagttatattagtgaagat

SEQ ID NO: 4352176 - DNA, 16 bp, Homo sapiens
caagttgttattgttg

SEQ ID NO: 4352177 - DNA, 22 bp, Homo sapiens
caatcctgtttataatctgaag

SEQ ID NO: 4352178 - DNA, 13 bp, Homo sapiens
caatgcttaaact

SEQ ID NO: 4352179 - DNA, 21 bp, Homo sapiens
caatgcttaaactaaataatg

SEQ ID NO: 4352180 - DNA, 18 bp, Homo sapiens
caattccaggctgagcca

SEQ ID NO: 4352181 - DNA, 21 bp, Homo sapiens
caattccaggctgagccatga

SEQ ID NO: 4352182 - DNA, 23 bp, Homo sapiens
caattccaggctgagccatgagg

SEQ ID NO: 4352183 - DNA, 16 bp, Homo sapiens
caattggcagtgactt

SEQ ID NO: 4352184 - DNA, 17 bp, Homo sapiens
caattggcagtgacttt

SEQ ID NO: 4352185 - DNA, 21 bp, Homo sapiens
caattggcagtgactttgtat

SEQ ID NO: 4352186 - DNA, 16 bp, Homo sapiens
caattttttttttcct

SEQ ID NO: 4352187 - DNA, 20 bp, Homo sapiens
cacagacacaatatgtatgc

SEQ ID NO: 4352188 - DNA, 11 bp, Homo sapiens
cacagccatag

SEQ ID NO: 4352189 - DNA, 17 bp, Homo sapiens
cacagggtgtggtatga

SEQ ID NO: 4352190 - DNA, 15 bp, Homo sapiens
caccaaccaggcctt

SEQ ID NO: 4352191 - DNA, 13 bp, Homo sapiens
caccaccctggca

SEQ ID NO: 4352192 - DNA, 20 bp, Homo sapiens
caccagagcttctctgggct

SEQ ID NO: 4352193 - DNA, 14 bp, Homo sapiens
caccagctttattt

SEQ ID NO: 4352194 - DNA, 16 bp, Homo sapiens
cacccacagccataga

SEQ ID NO: 4352195 - DNA, 15 bp, Homo sapiens
cacctatgttatttt

SEQ ID NO: 4352196 - DNA, 22 bp, Homo sapiens
cacctatgttattttgtgtaca

SEQ ID NO: 4352197 - DNA, 19 bp, Homo sapiens
cacctctggctagagccga

SEQ ID NO: 4352198 - DNA, 11 bp, Homo sapiens
cactgaggaga

SEQ ID NO: 4352199 - DNA, 14 bp, Homo sapiens
cactgaggagacag

SEQ ID NO: 4352200 - DNA, 21 bp, Homo sapiens
cactgaggagacagaaagcct

SEQ ID NO: 4352201 - DNA, 22 bp, Homo sapiens
cactgaggagacagaaagcctc

SEQ ID NO: 4352202 - DNA, 14 bp, Homo sapiens
cactgcggaagcca

SEQ ID NO: 4352203 - DNA, 15 bp, Homo sapiens
cactgcggaagccaa

SEQ ID NO: 4352204 - DNA, 18 bp, Homo sapiens
cactgcggaagccaaagg

SEQ ID NO: 4352205 - DNA, 14 bp, Homo sapiens
cacttcattcttta

SEQ ID NO: 4352206 - DNA, 16 bp, Homo sapiens
cacttcattctttata

SEQ ID NO: 4352207 - DNA, 19 bp, Homo sapiens
cacttttgttctgctttat

SEQ ID NO: 4352208 - DNA, 15 bp, Homo sapiens
cagaaagcctccgct

SEQ ID NO: 4352209 - DNA, 22 bp, Homo sapiens
cagaaagcctccgctgggcttc

SEQ ID NO: 4352210 - DNA, 17 bp, Homo sapiens
cagaacccccaggtggc

SEQ ID NO: 4352211 - DNA, 20 bp, Homo sapiens
cagaacccccaggtggcctg

SEQ ID NO: 4352212 - DNA, 14 bp, Homo sapiens
cagaagcattgcct

SEQ ID NO: 4352213 - DNA, 11 bp, Homo sapiens
cagaataatgg

SEQ ID NO: 4352214 - DNA, 15 bp, Homo sapiens
cagaataatggaaac

SEQ ID NO: 4352215 - DNA, 18 bp, Homo sapiens
cagaataatggaaacatt

SEQ ID NO: 4352216 - DNA, 11 bp, Homo sapiens
cagacaacatt

SEQ ID NO: 4352217 - DNA, 16 bp, Homo sapiens
cagacctggctctcag

SEQ ID NO: 4352218 - DNA, 18 bp, Homo sapiens
cagagcaattccaggctg

SEQ ID NO: 4352219 - DNA, 15 bp, Homo sapiens
cagagccaacctgga

SEQ ID NO: 4352220 - DNA, 18 bp, Homo sapiens
cagagccaacctggactt

SEQ ID NO: 4352221 - DNA, 23 bp, Homo sapiens
cagagccaacctggacttcctgt

SEQ ID NO: 4352222 - DNA, 14 bp, Homo sapiens
cagagcttctctgg

SEQ ID NO: 4352223 - DNA, 17 bp, Homo sapiens
cagagcttctctgggct

SEQ ID NO: 4352224 - DNA, 20 bp, Homo sapiens
cagagcttctctgggctgaa

SEQ ID NO: 4352225 - DNA, 20 bp, Homo sapiens
cagaggaaaaatgggagcca

SEQ ID NO: 4352226 - DNA, 21 bp, Homo sapiens
cagaggaaaaatgggagccag

SEQ ID NO: 4352227 - DNA, 23 bp, Homo sapiens
cagaggaaaaatgggagccagga

SEQ ID NO: 4352228 - DNA, 19 bp, Homo sapiens
cagagtttttaaagccttc

SEQ ID NO: 4352229 - DNA, 17 bp, Homo sapiens
cagcagagatggagaaa

SEQ ID NO: 4352230 - DNA, 18 bp, Homo sapiens
cagccatagacctacaga

SEQ ID NO: 4352231 - DNA, 14 bp, Homo sapiens
cagcccaccaccct

SEQ ID NO: 4352232 - DNA, 22 bp, Homo sapiens
cagcggcagagcaattccaggc

SEQ ID NO: 4352233 - DNA, 19 bp, Homo sapiens
cagcgtcactctacctaat

SEQ ID NO: 4352234 - DNA, 19 bp, Homo sapiens
cagctaagatagaaagctg

SEQ ID NO: 4352235 - DNA, 22 bp, Homo sapiens
cagctaagatagaaagctggac

SEQ ID NO: 4352236 - DNA, 13 bp, Homo sapiens
cagctcttctctt

SEQ ID NO: 4352237 - DNA, 15 bp, Homo sapiens
cagctcttctcttcc

SEQ ID NO: 4352238 - DNA, 21 bp, Homo sapiens
cagctcttctcttcctagatc

SEQ ID NO: 4352239 - DNA, 19 bp, Homo sapiens
cagctgggcctcctgcctc

SEQ ID NO: 4352240 - DNA, 11 bp, Homo sapiens
cagctttattt

SEQ ID NO: 4352241 - DNA, 21 bp, Homo sapiens
caggaaaggcttggctggtgt

SEQ ID NO: 4352242 - DNA, 12 bp, Homo sapiens
caggagagaccc

SEQ ID NO: 4352243 - DNA, 16 bp, Homo sapiens
caggagagacccctcc

SEQ ID NO: 4352244 - DNA, 23 bp, Homo sapiens
caggagagacccctcccctccca

SEQ ID NO: 4352245 - DNA, 17 bp, Homo sapiens
caggcatggctcagagc

SEQ ID NO: 4352246 - DNA, 16 bp, Homo sapiens
caggcctgaccagggg

SEQ ID NO: 4352247 - DNA, 15 bp, Homo sapiens
caggctgagccatga

SEQ ID NO: 4352248 - DNA, 16 bp, Homo sapiens
caggctgagccatgag

SEQ ID NO: 4352249 - DNA, 17 bp, Homo sapiens
caggctgagccatgagg

SEQ ID NO: 4352250 - DNA, 11 bp, Homo sapiens
caggctgggcc

SEQ ID NO: 4352251 - DNA, 21 bp, Homo sapiens
ggtttacactgcggaagccaa

SEQ ID NO: 4352252 - DNA, 23 bp, Homo sapiens
ggtttacactgcggaagccaaag

SEQ ID NO: 4352253 - DNA, 13 bp, Homo sapiens
ggttttgtatttt

SEQ ID NO: 4352254 - DNA, 11 bp, Homo sapiens
ggtttttatga

SEQ ID NO: 4352255 - DNA, 12 bp, Homo sapiens
gtaaattcagac

SEQ ID NO: 4352256 - DNA, 15 bp, Homo sapiens
gtaaattcagacaac

SEQ ID NO: 4352257 - DNA, 18 bp, Homo sapiens
gtaaattcagacaacatt

SEQ ID NO: 4352258 - DNA, 14 bp, Homo sapiens
gtaacatccaagcc

SEQ ID NO: 4352259 - DNA, 16 bp, Homo sapiens
gtaacatccaagccag

SEQ ID NO: 4352260 - DNA, 22 bp, Homo sapiens
gtaactttactctgtgtttaaa

SEQ ID NO: 4352261 - DNA, 15 bp, Homo sapiens
gtaagacaagtggga

SEQ ID NO: 4352262 - DNA, 13 bp, Homo sapiens
gtacttgatttga

SEQ ID NO: 4352263 - DNA, 23 bp, Homo sapiens
gtacttgatttgatgtgactttt

SEQ ID NO: 4352264 - DNA, 16 bp, Homo sapiens
gtagaaaagttgcaga

SEQ ID NO: 4352265 - DNA, 18 bp, Homo sapiens
gtagcataaataaaactg

SEQ ID NO: 4352266 - DNA, 21 bp, Homo sapiens
gtagcataaataaaactgaat

SEQ ID NO: 4352267 - DNA, 21 bp, Homo sapiens
gtagctacactgtataactgt

SEQ ID NO: 4352268 - DNA, 18 bp, Homo sapiens
gtagtttggatatttttg

SEQ ID NO: 4352269 - DNA, 12 bp, Homo sapiens
gtataactgttc

SEQ ID NO: 4352270 - DNA, 22 bp, Homo sapiens
gtatatcattctacagaataat

SEQ ID NO: 4352271 - DNA, 14 bp, Homo sapiens
gtatattgagaatc

SEQ ID NO: 4352272 - DNA, 13 bp, Homo sapiens
gtattgtaatctt

SEQ ID NO: 4352273 - DNA, 17 bp, Homo sapiens
gtattttttaaaacact

SEQ ID NO: 4352274 - DNA, 24 bp, Homo sapiens
gtcaaatatgttctggacagctaa

SEQ ID NO: 4352275 - DNA, 13 bp, Homo sapiens
gtcaccagagctt

SEQ ID NO: 4352276 - DNA, 11 bp, Homo sapiens
gtccagctggg

SEQ ID NO: 4352277 - DNA, 20 bp, Homo sapiens
gtctgtgtaacatccaagcc

SEQ ID NO: 4352278 - DNA, 20 bp, Homo sapiens
gtcttagagccttttatctg

SEQ ID NO: 4352279 - DNA, 20 bp, Homo sapiens
gtgaaagccttaagaagata

SEQ ID NO: 4352280 - DNA, 21 bp, Homo sapiens
gtgaaagccttaagaagataa

SEQ ID NO: 4352281 - DNA, 18 bp, Homo sapiens
gtgaagggaagtggggag

SEQ ID NO: 4352282 - DNA, 20 bp, Homo sapiens
gtgaattcctgcatttgata

SEQ ID NO: 4352283 - DNA, 18 bp, Homo sapiens
gtgatatacaaagtgtac

SEQ ID NO: 4352284 - DNA, 21 bp, Homo sapiens
gtgcagaataatggaaacatt

SEQ ID NO: 4352285 - DNA, 13 bp, Homo sapiens
gtgcctataacca

SEQ ID NO: 4352286 - DNA, 23 bp, Homo sapiens
gtgctataaatgccagagccaac

SEQ ID NO: 4352287 - DNA, 15 bp, Homo sapiens
gtgctttctgtgaaa

SEQ ID NO: 4352288 - DNA, 12 bp, Homo sapiens
gtggaattagag

SEQ ID NO: 4352289 - DNA, 14 bp, Homo sapiens
gtggaattagagtg

SEQ ID NO: 4352290 - DNA, 13 bp, Homo sapiens
gtggatgactgtt

SEQ ID NO: 4352291 - DNA, 23 bp, Homo sapiens
gtggccggtggttttgtgcttta

SEQ ID NO: 4352292 - DNA, 21 bp, Homo sapiens
gtgggatttggggcctcaaga

SEQ ID NO: 4352293 - DNA, 15 bp, Homo sapiens
gtggtatgagggggt

SEQ ID NO: 4352294 - DNA, 17 bp, Homo sapiens
gtggtatgagggggtgg

SEQ ID NO: 4352295 - DNA, 22 bp, Homo sapiens
gtggttattggactccaggcct

SEQ ID NO: 4352296 - DNA, 15 bp, Homo sapiens
gtgtaacatccaagc

SEQ ID NO: 4352297 - DNA, 18 bp, Homo sapiens
gtgtaacatccaagccag

SEQ ID NO: 4352298 - DNA, 14 bp, Homo sapiens
gtgttgttgttgct

SEQ ID NO: 4352299 - DNA, 22 bp, Homo sapiens
gtgtttaaaaagtaagttaata

SEQ ID NO: 4352300 - DNA, 20 bp, Homo sapiens
gtgtttgctgccttgctcct

SEQ ID NO: 4352301 - DNA, 18 bp, Homo sapiens
gttatattagtgaagatg

SEQ ID NO: 4352302 - DNA, 17 bp, Homo sapiens
gttatgatattgtttaa

SEQ ID NO: 4352303 - DNA, 21 bp, Homo sapiens
gttatgatattgtttaaaatt

SEQ ID NO: 4352304 - DNA, 17 bp, Homo sapiens
gttattggactccaggc

SEQ ID NO: 4352305 - DNA, 20 bp, Homo sapiens
gttattttgtgtacaagttg

SEQ ID NO: 4352306 - DNA, 10 bp, Homo sapiens
gttctgcagc

SEQ ID NO: 4352307 - DNA, 16 bp, Homo sapiens
gttgcagatgtattga

SEQ ID NO: 4352308 - DNA, 11 bp, Homo sapiens
gttgctgctgt

SEQ ID NO: 4352309 - DNA, 15 bp, Homo sapiens
gttggggcccttaac

SEQ ID NO: 4352310 - DNA, 13 bp, Homo sapiens
gttggtctgtgta

SEQ ID NO: 4352311 - DNA, 14 bp, Homo sapiens
gttggtctgtgtaa

SEQ ID NO: 4352312 - DNA, 21 bp, Homo sapiens
gttgtattcttctgtatttct

SEQ ID NO: 4352313 - DNA, 12 bp, Homo sapiens
gttgttgctgct

SEQ ID NO: 4352314 - DNA, 11 bp, Homo sapiens
gtttaaaattc

SEQ ID NO: 4352315 - DNA, 13 bp, Homo sapiens
gtttaaaattcag

SEQ ID NO: 4352316 - DNA, 16 bp, Homo sapiens
gtttaaaattcagttt

SEQ ID NO: 4352317 - DNA, 14 bp, Homo sapiens
gtttaaatcatgta

SEQ ID NO: 4352318 - DNA, 21 bp, Homo sapiens
gtttacactgcggaagccaaa

SEQ ID NO: 4352319 - DNA, 17 bp, Homo sapiens
gtttagagagcctgtca

SEQ ID NO: 4352320 - DNA, 18 bp, Homo sapiens
gtttataatctgaagata

SEQ ID NO: 4352321 - DNA, 19 bp, Homo sapiens
gtttgggttgttggtctgt

SEQ ID NO: 4352322 - DNA, 14 bp, Homo sapiens
gtttttaaagcctt

SEQ ID NO: 4352323 - DNA, 16 bp, Homo sapiens
gtttttaaagccttct

SEQ ID NO: 4352324 - DNA, 18 bp, Homo sapiens
taaaaagaaaaagagata

SEQ ID NO: 4352325 - DNA, 10 bp, Homo sapiens
taaaacacta

SEQ ID NO: 4352326 - DNA, 21 bp, Homo sapiens
taaaacagcctatagatgatg

SEQ ID NO: 4352327 - DNA, 17 bp, Homo sapiens
taaaacggtgctttctg

SEQ ID NO: 4352328 - DNA, 21 bp, Homo sapiens
taaaacggtgctttctgtgaa

SEQ ID NO: 4352329 - DNA, 19 bp, Homo sapiens
taaaattcagtttttgtat

SEQ ID NO: 4352330 - DNA, 22 bp, Homo sapiens
taaaattcagtttttgtatctt

SEQ ID NO: 4352331 - DNA, 19 bp, Homo sapiens
taaacagtagttgtattct

SEQ ID NO: 4352332 - DNA, 16 bp, Homo sapiens
taaactaaataatgaa

SEQ ID NO: 4352333 - DNA, 23 bp, Homo sapiens
taaactttattttttaaaaatga

SEQ ID NO: 4352334 - DNA, 15 bp, Homo sapiens
taaagcatctgtaaa

SEQ ID NO: 4352335 - DNA, 21 bp, Homo sapiens
taaagccttctggatccatgg

SEQ ID NO: 4352336 - DNA, 21 bp, Homo sapiens
taaagggttgaaaatgtgttt

SEQ ID NO: 4352337 - DNA, 15 bp, Homo sapiens
taaatactgtgcaga

SEQ ID NO: 4352338 - DNA, 17 bp, Homo sapiens
taaatactgtgcagaat

SEQ ID NO: 4352339 - DNA, 22 bp, Homo sapiens
taaatactgtgcagaataatgg

SEQ ID NO: 4352340 - DNA, 15 bp, Homo sapiens
taaatcatgtatgtt

SEQ ID NO: 4352341 - DNA, 23 bp, Homo sapiens
taaatcatgtatgttatgatatt

SEQ ID NO: 4352342 - DNA, 12 bp, Homo sapiens
taaatgagcttt

SEQ ID NO: 4352343 - DNA, 17 bp, Homo sapiens
taaatgccagagccaac

SEQ ID NO: 4352344 - DNA, 12 bp, Homo sapiens
taaattcagaca

SEQ ID NO: 4352345 - DNA, 17 bp, Homo sapiens
taaattcagacaacatt

SEQ ID NO: 4352346 - DNA, 19 bp, Homo sapiens
taaattcagacaacattat

SEQ ID NO: 4352347 - DNA, 14 bp, Homo sapiens
taaattctatgtta

SEQ ID NO: 4352348 - DNA, 18 bp, Homo sapiens
taaattctatgttaaata

SEQ ID NO: 4352349 - DNA, 21 bp, Homo sapiens
taaattctatgttaaatactg

SEQ ID NO: 4352350 - DNA, 23 bp, Homo sapiens
taaattctatgttaaatactgtg

SEQ ID NO: 4352351 - DNA, 14 bp, Homo sapiens
taacatccaagcca

SEQ ID NO: 4352352 - DNA, 20 bp, Homo sapiens
taacatgaaagctgatgcca

SEQ ID NO: 4352353 - DNA, 20 bp, Homo sapiens
taacttcaggtaaaaacttc

SEQ ID NO: 4352354 - DNA, 22 bp, Homo sapiens
taacttcaggtaaaaacttcat

SEQ ID NO: 4352355 - DNA, 19 bp, Homo sapiens
taacttggttctcagactc

SEQ ID NO: 4352356 - DNA, 21 bp, Homo sapiens
taacttggttctcagactctt

SEQ ID NO: 4352357 - DNA, 22 bp, Homo sapiens
taacttggttctcagactcttt

SEQ ID NO: 4352358 - DNA, 16 bp, Homo sapiens
taactttactctgtgt

SEQ ID NO: 4352359 - DNA, 22 bp, Homo sapiens
taagaagcctataagaggaatt

SEQ ID NO: 4352360 - DNA, 19 bp, Homo sapiens
taagtgatgtgctgaattt

SEQ ID NO: 4352361 - DNA, 19 bp, Homo sapiens
taagtgggtttttatgaac

SEQ ID NO: 4352362 - DNA, 19 bp, Homo sapiens
taagttaataatgtattgt

SEQ ID NO: 4352363 - DNA, 16 bp, Homo sapiens
taataaactttatttt

SEQ ID NO: 4352364 - DNA, 14 bp, Homo sapiens
taataatgtattgt

SEQ ID NO: 4352365 - DNA, 17 bp, Homo sapiens
taataggtagtttggat

SEQ ID NO: 4352366 - DNA, 14 bp, Homo sapiens
taatatatcaaatc

SEQ ID NO: 4352367 - DNA, 24 bp, Homo sapiens
taatattaaacctttcagtactct

SEQ ID NO: 4352368 - DNA, 13 bp, Homo sapiens
taatgcattcaaa

SEQ ID NO: 4352369 - DNA, 11 bp, Homo sapiens
taatggaaaca

SEQ ID NO: 4352370 - DNA, 12 bp, Homo sapiens
taatggaaacat

SEQ ID NO: 4352371 - DNA, 16 bp, Homo sapiens
taatgtctcactgttc

SEQ ID NO: 4352372 - DNA, 18 bp, Homo sapiens
taatgtctcactgttctg

SEQ ID NO: 4352373 - DNA, 12 bp, Homo sapiens
taatgtttaaat

SEQ ID NO: 4352374 - DNA, 19 bp, Homo sapiens
tacaaagaaagcacttctt

SEQ ID NO: 4352375 - DNA, 20 bp, Homo sapiens
tacaagttgttattgttgaa

SEQ ID NO: 4352376 - DNA, 22 bp, Homo sapiens
tacaagttgttattgttgaaca

SEQ ID NO: 4352377 - DNA, 18 bp, Homo sapiens
tacactgcggaagccaaa

SEQ ID NO: 4352378 - DNA, 23 bp, Homo sapiens
tctacagaataatccagtattgc

SEQ ID NO: 4352379 - DNA, 19 bp, Homo sapiens
tctagactgcaagaactgt

SEQ ID NO: 4352380 - DNA, 21 bp, Homo sapiens
tctagactgcaagaactgttt

SEQ ID NO: 4352381 - DNA, 15 bp, Homo sapiens
tctatgttaaatact

SEQ ID NO: 4352382 - DNA, 17 bp, Homo sapiens
tctatgttaaatactgt

SEQ ID NO: 4352383 - DNA, 23 bp, Homo sapiens
tctatgttaaatactgtgcagaa

SEQ ID NO: 4352384 - DNA, 13 bp, Homo sapiens
tctcactgttctg

SEQ ID NO: 4352385 - DNA, 15 bp, Homo sapiens
tctcatacaagccat

SEQ ID NO: 4352386 - DNA, 15 bp, Homo sapiens
tctctaattagaaat

SEQ ID NO: 4352387 - DNA, 15 bp, Homo sapiens
tctcttcccttccca

SEQ ID NO: 4352388 - DNA, 14 bp, Homo sapiens
tctgccactgagga

SEQ ID NO: 4352389 - DNA, 15 bp, Homo sapiens
tctgccactgaggag

SEQ ID NO: 4352390 - DNA, 16 bp, Homo sapiens
tctgccactgaggaga

SEQ ID NO: 4352391 - DNA, 21 bp, Homo sapiens
gcagatttttatgttttgaaa

SEQ ID NO: 4352392 - DNA, 14 bp, Homo sapiens
gcagcccagctcct

SEQ ID NO: 4352393 - DNA, 12 bp, Homo sapiens
gcagcggcagag

SEQ ID NO: 4352394 - DNA, 13 bp, Homo sapiens
gcagcggcagagc

SEQ ID NO: 4352395 - DNA, 10 bp, Homo sapiens
gcaggctggg

SEQ ID NO: 4352396 - DNA, 19 bp, Homo sapiens
gcataaataaaactgaatc

SEQ ID NO: 4352397 - DNA, 13 bp, Homo sapiens
gcatcaagacttc

SEQ ID NO: 4352398 - DNA, 23 bp, Homo sapiens
gcatggctcagagcttgaagatt

SEQ ID NO: 4352399 - DNA, 15 bp, Homo sapiens
gcattgcctggactg

SEQ ID NO: 4352400 - DNA, 16 bp, Homo sapiens
gcattgcctggactga

SEQ ID NO: 4352401 - DNA, 20 bp, Homo sapiens
gcattgcctggactgaccac

SEQ ID NO: 4352402 - DNA, 17 bp, Homo sapiens
gccaagatggctgctgc

SEQ ID NO: 4352403 - DNA, 19 bp, Homo sapiens
gccaagatggctgctgcct

SEQ ID NO: 4352404 - DNA, 22 bp, Homo sapiens
gccaagatggctgctgcctgct

SEQ ID NO: 4352405 - DNA, 17 bp, Homo sapiens
gccactgaggagacaga

SEQ ID NO: 4352406 - DNA, 18 bp, Homo sapiens
gccactgaggagacagaa

SEQ ID NO: 4352407 - DNA, 13 bp, Homo sapiens
gccagagccaacc

SEQ ID NO: 4352408 - DNA, 16 bp, Homo sapiens
gccagagccaacctgg

SEQ ID NO: 4352409 - DNA, 17 bp, Homo sapiens
gccagagccaacctgga

SEQ ID NO: 4352410 - DNA, 23 bp, Homo sapiens
gccatagacctacagacctggct

SEQ ID NO: 4352411 - DNA, 15 bp, Homo sapiens
gccatgtccaaagag

SEQ ID NO: 4352412 - DNA, 18 bp, Homo sapiens
gccatgtccaaagaggct

SEQ ID NO: 4352413 - DNA, 21 bp, Homo sapiens
gccatttgaattagaagaaaa

SEQ ID NO: 4352414 - DNA, 17 bp, Homo sapiens
gcccagctcctgaataa

SEQ ID NO: 4352415 - DNA, 15 bp, Homo sapiens
gcccgaacagggact

SEQ ID NO: 4352416 - DNA, 19 bp, Homo sapiens
gccctcggaggtccagctg

SEQ ID NO: 4352417 - DNA, 14 bp, Homo sapiens
gcctccgctgggct

SEQ ID NO: 4352418 - DNA, 17 bp, Homo sapiens
gcctccgctgggcttca

SEQ ID NO: 4352419 - DNA, 17 bp, Homo sapiens
gcctcctgcctccgggc

SEQ ID NO: 4352420 - DNA, 22 bp, Homo sapiens
gcctgcgtcttttttctcttcc

SEQ ID NO: 4352421 - DNA, 12 bp, Homo sapiens
gcctggactgac

SEQ ID NO: 4352422 - DNA, 17 bp, Homo sapiens
gcctggactgaccacac

SEQ ID NO: 4352423 - DNA, 15 bp, Homo sapiens
gcctgtcaccagagc

SEQ ID NO: 4352424 - DNA, 20 bp, Homo sapiens
gcctgtcaccagagcttctc

SEQ ID NO: 4352425 - DNA, 20 bp, Homo sapiens
gccttcatcctcctccccag

SEQ ID NO: 4352426 - DNA, 23 bp, Homo sapiens
gccttcatcctcctccccagctc

SEQ ID NO: 4352427 - DNA, 15 bp, Homo sapiens
gccttctggatccat

SEQ ID NO: 4352428 - DNA, 17 bp, Homo sapiens
gcggcagagcaattcca

SEQ ID NO: 4352429 - DNA, 19 bp, Homo sapiens
gcggcagagcaattccagg

SEQ ID NO: 4352430 - DNA, 16 bp, Homo sapiens
gctaaatcatttgaga

SEQ ID NO: 4352431 - DNA, 18 bp, Homo sapiens
gctaaattctatgttaaa

SEQ ID NO: 4352432 - DNA, 23 bp, Homo sapiens
gctaaattctatgttaaatactg

SEQ ID NO: 4352433 - DNA, 18 bp, Homo sapiens
gctaagatagaaagctgg

SEQ ID NO: 4352434 - DNA, 20 bp, Homo sapiens
gctaagatagaaagctggac

SEQ ID NO: 4352435 - DNA, 23 bp, Homo sapiens
gctaagatagaaagctggactga

SEQ ID NO: 4352436 - DNA, 16 bp, Homo sapiens
gctagactcctcagga

SEQ ID NO: 4352437 - DNA, 20 bp, Homo sapiens
gctagactcctcaggagaga

SEQ ID NO: 4352438 - DNA, 18 bp, Homo sapiens
gctagagccgaggggaga

SEQ ID NO: 4352439 - DNA, 14 bp, Homo sapiens
gctataaatgccag

SEQ ID NO: 4352440 - DNA, 15 bp, Homo sapiens
gctataaatgccaga

SEQ ID NO: 4352441 - DNA, 16 bp, Homo sapiens
gctataaatgccagag

SEQ ID NO: 4352442 - DNA, 20 bp, Homo sapiens
gctataaatgccagagccaa

SEQ ID NO: 4352443 - DNA, 18 bp, Homo sapiens
gctgagccatgaggagcg

SEQ ID NO: 4352444 - DNA, 13 bp, Homo sapiens
gctgatgaagaag

SEQ ID NO: 4352445 - DNA, 18 bp, Homo sapiens
gctgcccctctcaccaaa

SEQ ID NO: 4352446 - DNA, 16 bp, Homo sapiens
gctgctgtttgggttg

SEQ ID NO: 4352447 - DNA, 13 bp, Homo sapiens
gctggactgacca

SEQ ID NO: 4352448 - DNA, 14 bp, Homo sapiens
gctggactgaccaa

SEQ ID NO: 4352449 - DNA, 19 bp, Homo sapiens
gctggactgaccaaagact

SEQ ID NO: 4352450 - DNA, 16 bp, Homo sapiens
gctgggcctcctgcct

SEQ ID NO: 4352451 - DNA, 18 bp, Homo sapiens
gctgggcctcctgcctcc

SEQ ID NO: 4352452 - DNA, 22 bp, Homo sapiens
gctggtagcataaataaaactg

SEQ ID NO: 4352453 - DNA, 17 bp, Homo sapiens
gctggtgtatgcacagg

SEQ ID NO: 4352454 - DNA, 17 bp, Homo sapiens
gcttaaactaaataatg

SEQ ID NO: 4352455 - DNA, 19 bp, Homo sapiens
gcttcattccggactggca

SEQ ID NO: 4352456 - DNA, 23 bp, Homo sapiens
gcttcattccggactggcagaag

SEQ ID NO: 4352457 - DNA, 19 bp, Homo sapiens
gcttgaggccaagatggct

SEQ ID NO: 4352458 - DNA, 12 bp, Homo sapiens
gcttggctggtg

SEQ ID NO: 4352459 - DNA, 18 bp, Homo sapiens
gcttggctggtgtatgca

SEQ ID NO: 4352460 - DNA, 16 bp, Homo sapiens
gctttatcttttcata

SEQ ID NO: 4352461 - DNA, 23 bp, Homo sapiens
gctttattttaaatgtggttttt

SEQ ID NO: 4352462 - DNA, 22 bp, Homo sapiens
gctttgagttgacttctgacaa

SEQ ID NO: 4352463 - DNA, 15 bp, Homo sapiens
gctttttctgccact

SEQ ID NO: 4352464 - DNA, 16 bp, Homo sapiens
ggaagccaaaggcagc

SEQ ID NO: 4352465 - DNA, 22 bp, Homo sapiens
ggaatcattccagtgctagaaa

SEQ ID NO: 4352466 - DNA, 23 bp, Homo sapiens
ggaatttcttttccttcattcat

SEQ ID NO: 4352467 - DNA, 12 bp, Homo sapiens
ggacacctcgcc

SEQ ID NO: 4352468 - DNA, 15 bp, Homo sapiens
ggactccaggcctga

SEQ ID NO: 4352469 - DNA, 18 bp, Homo sapiens
ggactccaggcctgacca

SEQ ID NO: 4352470 - DNA, 13 bp, Homo sapiens
ggactctgctaga

SEQ ID NO: 4352471 - DNA, 23 bp, Homo sapiens
ggactgaccaaagactgcagaac

SEQ ID NO: 4352472 - DNA, 18 bp, Homo sapiens
ggactgaccacaccaacc

SEQ ID NO: 4352473 - DNA, 16 bp, Homo sapiens
ggactggcagaagcat

SEQ ID NO: 4352474 - DNA, 17 bp, Homo sapiens
ggagagacccctcccct

SEQ ID NO: 4352475 - DNA, 12 bp, Homo sapiens
ggagccaggagt

SEQ ID NO: 4352476 - DNA, 21 bp, Homo sapiens
ggagccaggagtaagacaagt

SEQ ID NO: 4352477 - DNA, 18 bp, Homo sapiens
ggagcgtggactctgcta

SEQ ID NO: 4352478 - DNA, 17 bp, Homo sapiens
ggaggtccagctgggcc

SEQ ID NO: 4352479 - DNA, 20 bp, Homo sapiens
ggatactgcttattttatga

SEQ ID NO: 4352480 - DNA, 20 bp, Homo sapiens
ggcaagactgcaaacttttt

SEQ ID NO: 4352481 - DNA, 19 bp, Homo sapiens
ggcagaagcattgcctgga

SEQ ID NO: 4352482 - DNA, 22 bp, Homo sapiens
ggcagaagcattgcctggactg

SEQ ID NO: 4352483 - DNA, 21 bp, Homo sapiens
ggcagagcaattccaggctga

SEQ ID NO: 4352484 - DNA, 20 bp, Homo sapiens
ggcagctaagatagaaagct

SEQ ID NO: 4352485 - DNA, 15 bp, Homo sapiens
ggcaggctgggccat

SEQ ID NO: 4352486 - DNA, 17 bp, Homo sapiens
ggcatggctcagagctt

SEQ ID NO: 4352487 - DNA, 18 bp, Homo sapiens
ggccaagatggctgctgc

SEQ ID NO: 4352488 - DNA, 15 bp, Homo sapiens
ggccatgtccaaaga

SEQ ID NO: 4352489 - DNA, 16 bp, Homo sapiens
ggccatgtccaaagag

SEQ ID NO: 4352490 - DNA, 18 bp, Homo sapiens
ggcccgaacagggacttg

SEQ ID NO: 4352491 - DNA, 20 bp, Homo sapiens
ggccctcggaggtccagctg

SEQ ID NO: 4352492 - DNA, 24 bp, Homo sapiens
ggcctcctgcctccgggcaggcaa

SEQ ID NO: 4352493 - DNA, 15 bp, Homo sapiens
ggcctgaccaggggg

SEQ ID NO: 4352494 - DNA, 17 bp, Homo sapiens
ggcctgaccagggggcc

SEQ ID NO: 4352495 - DNA, 21 bp, Homo sapiens
ggctagagccgaggggagaga

SEQ ID NO: 4352496 - DNA, 22 bp, Homo sapiens
ggctgaatgtatgtcagtgcta

SEQ ID NO: 4352497 - DNA, 17 bp, Homo sapiens
ggctgatgaagaagggg

SEQ ID NO: 4352498 - DNA, 20 bp, Homo sapiens
ggctgggccatgtccaaaga

SEQ ID NO: 4352499 - DNA, 21 bp, Homo sapiens
ggctgggccatgtccaaagag

SEQ ID NO: 4352500 - DNA, 19 bp, Homo sapiens
ggcttcattccggactggc

SEQ ID NO: 4352501 - DNA, 21 bp, Homo sapiens
ggcttcattccggactggcag

SEQ ID NO: 4352502 - DNA, 23 bp, Homo sapiens
gggacttgtttagagagcctgtc

SEQ ID NO: 4352503 - DNA, 10 bp, Homo sapiens
gggagccagg

SEQ ID NO: 4352504 - DNA, 12 bp, Homo sapiens
gggcaggctggg

SEQ ID NO: 4352505 - DNA, 22 bp, Homo sapiens
gggctatcaacttaataagata

SEQ ID NO: 4352506 - DNA, 16 bp, Homo sapiens
gggctgaatgtatgtc

SEQ ID NO: 4352507 - DNA, 20 bp, Homo sapiens
gggcttcattccggactggc

SEQ ID NO: 4352508 - DNA, 14 bp, Homo sapiens
ggggcaggctgggc

SEQ ID NO: 4352509 - DNA, 22 bp, Homo sapiens
ggggtggttattggactccagg

SEQ ID NO: 4352510 - DNA, 21 bp, Homo sapiens
gggttctgcagcggcagagca

SEQ ID NO: 4352511 - DNA, 16 bp, Homo sapiens
gggttgaaaatgtgtt

SEQ ID NO: 4352512 - DNA, 22 bp, Homo sapiens
ggtaaattcagacaacattatg

SEQ ID NO: 4352513 - DNA, 23 bp, Homo sapiens
ggtaaattcagacaacattatga

SEQ ID NO: 4352514 - DNA, 21 bp, Homo sapiens
ggtagcataaataaaactgaa

SEQ ID NO: 4352515 - DNA, 23 bp, Homo sapiens
ggtctgtgtaacatccaagccag

SEQ ID NO: 4352516 - DNA, 18 bp, Homo sapiens
ggtgaagggaagtgggga

SEQ ID NO: 4352517 - DNA, 20 bp, Homo sapiens
ggtgaagggaagtggggagt

SEQ ID NO: 4352518 - DNA, 12 bp, Homo sapiens
ggtggtaaattc

SEQ ID NO: 4352519 - DNA, 21 bp, Homo sapiens
ggtggttattggactccaggc

SEQ ID NO: 4352520 - DNA, 22 bp, Homo sapiens
ggtgtatgcacagggtgtggta

SEQ ID NO: 4352521 - DNA, 18 bp, Homo sapiens
ctaacttgtgaagacaat

SEQ ID NO: 4352522 - DNA, 14 bp, Homo sapiens
ctaagatagaaagc

SEQ ID NO: 4352523 - DNA, 15 bp, Homo sapiens
ctaagatagaaagct

SEQ ID NO: 4352524 - DNA, 16 bp, Homo sapiens
ctaagatagaaagctg

SEQ ID NO: 4352525 - DNA, 11 bp, Homo sapiens
ctaagcccttt

SEQ ID NO: 4352526 - DNA, 16 bp, Homo sapiens
ctaatattaaaccttt

SEQ ID NO: 4352527 - DNA, 16 bp, Homo sapiens
ctacactgtataactg

SEQ ID NO: 4352528 - DNA, 12 bp, Homo sapiens
ctacagaataat

SEQ ID NO: 4352529 - DNA, 13 bp, Homo sapiens
ctacagaataatc

SEQ ID NO: 4352530 - DNA, 14 bp, Homo sapiens
ctacagacctggct

SEQ ID NO: 4352531 - DNA, 16 bp, Homo sapiens
ctacagacctggctct

SEQ ID NO: 4352532 - DNA, 21 bp, Homo sapiens
ctagaaaatttagccctttaa

SEQ ID NO: 4352533 - DNA, 16 bp, Homo sapiens
ctagactgcaagaact

SEQ ID NO: 4352534 - DNA, 16 bp, Homo sapiens
ctagagccgaggggag

SEQ ID NO: 4352535 - DNA, 20 bp, Homo sapiens
ctagagccgaggggagagag

SEQ ID NO: 4352536 - DNA, 13 bp, Homo sapiens
ctttatcttttca

SEQ ID NO: 4352537 - DNA, 22 bp, Homo sapiens
ctttattttaaatgtggttttt

SEQ ID NO: 4352538 - DNA, 19 bp, Homo sapiens
ctttattttttaaaaatga

SEQ ID NO: 4352539 - DNA, 16 bp, Homo sapiens
ctttgtaaaacagcct

SEQ ID NO: 4352540 - DNA, 15 bp, Homo sapiens
ctttgtatagagaat

SEQ ID NO: 4352541 - DNA, 14 bp, Homo sapiens
ctttgttaacttca

SEQ ID NO: 4352542 - DNA, 20 bp, Homo sapiens
cttttaaaagggaagttatt

SEQ ID NO: 4352543 - DNA, 23 bp, Homo sapiens
cttttaccgttggggcccttaac

SEQ ID NO: 4352544 - DNA, 19 bp, Homo sapiens
cttttacctgagactttca

SEQ ID NO: 4352545 - DNA, 21 bp, Homo sapiens
cttttacctgagactttcagt

SEQ ID NO: 4352546 - DNA, 16 bp, Homo sapiens
cttttatctgcagaac

SEQ ID NO: 4352547 - DNA, 23 bp, Homo sapiens
cttttcataaagggttgaaaatg

SEQ ID NO: 4352548 - DNA, 15 bp, Homo sapiens
cttttccttcattca

SEQ ID NO: 4352549 - DNA, 17 bp, Homo sapiens
ctttttctgccactgag

SEQ ID NO: 4352550 - DNA, 23 bp, Homo sapiens
ctttttttggtataatgtttaaa

SEQ ID NO: 4352551 - DNA, 18 bp, Homo sapiens
gaaaaatcaggcagaaat

SEQ ID NO: 4352552 - DNA, 12 bp, Homo sapiens
gaaaaatgggag

SEQ ID NO: 4352553 - DNA, 17 bp, Homo sapiens
gaaaaatgggagccagg

SEQ ID NO: 4352554 - DNA, 18 bp, Homo sapiens
gaaaaatgggagccagga

SEQ ID NO: 4352555 - DNA, 20 bp, Homo sapiens
gaaaaatgggagccaggagt

SEQ ID NO: 4352556 - DNA, 14 bp, Homo sapiens
gaaaagttgcagat

SEQ ID NO: 4352557 - DNA, 13 bp, Homo sapiens
gaaactgctaaat

SEQ ID NO: 4352558 - DNA, 14 bp, Homo sapiens
gaaactgctaaatt

SEQ ID NO: 4352559 - DNA, 20 bp, Homo sapiens
gaaactggattaaaacaatt

SEQ ID NO: 4352560 - DNA, 14 bp, Homo sapiens
gaaagctggactga

SEQ ID NO: 4352561 - DNA, 14 bp, Homo sapiens
gaaaggcaagcttg

SEQ ID NO: 4352562 - DNA, 15 bp, Homo sapiens
gaaaggcttggctgg

SEQ ID NO: 4352563 - DNA, 21 bp, Homo sapiens
gaaatatttagtatctagtca

SEQ ID NO: 4352564 - DNA, 12 bp, Homo sapiens
gaaatgttataa

SEQ ID NO: 4352565 - DNA, 22 bp, Homo sapiens
gaaatttatatgtcagagctgt

SEQ ID NO: 4352566 - DNA, 17 bp, Homo sapiens
gaagatatatttcactt

SEQ ID NO: 4352567 - DNA, 22 bp, Homo sapiens
gaagatggtttcaattcagatt

SEQ ID NO: 4352568 - DNA, 15 bp, Homo sapiens
gaagctttgagttga

SEQ ID NO: 4352569 - DNA, 18 bp, Homo sapiens
gaagtgatatggtgaagg

SEQ ID NO: 4352570 - DNA, 12 bp, Homo sapiens
gaataaactgaa

SEQ ID NO: 4352571 - DNA, 13 bp, Homo sapiens
gaataaactgaat

SEQ ID NO: 4352572 - DNA, 16 bp, Homo sapiens
gaataaactgaatatt

SEQ ID NO: 4352573 - DNA, 21 bp, Homo sapiens
gaataaactgaatattttgga

SEQ ID NO: 4352574 - DNA, 22 bp, Homo sapiens
gaataaactgaatattttggaa

SEQ ID NO: 4352575 - DNA, 14 bp, Homo sapiens
gaataatggaaaca

SEQ ID NO: 4352576 - DNA, 15 bp, Homo sapiens
gaataatggaaacat

SEQ ID NO: 4352577 - DNA, 20 bp, Homo sapiens
gaataatggaaacattacag

SEQ ID NO: 4352578 - DNA, 15 bp, Homo sapiens
gaatattttggaaac

SEQ ID NO: 4352579 - DNA, 16 bp, Homo sapiens
gaatattttggaaact

SEQ ID NO: 4352580 - DNA, 21 bp, Homo sapiens
gaatcattccagtgctagaaa

SEQ ID NO: 4352581 - DNA, 17 bp, Homo sapiens
gacaaaaaaatttaaaa

SEQ ID NO: 4352582 - DNA, 18 bp, Homo sapiens
gacaacattatgatctaa

SEQ ID NO: 4352583 - DNA, 21 bp, Homo sapiens
gacagaaactggattaaaaca

SEQ ID NO: 4352584 - DNA, 13 bp, Homo sapiens
gacagaaagcctc

SEQ ID NO: 4352585 - DNA, 21 bp, Homo sapiens
gacagctttattttaaatgtg

SEQ ID NO: 4352586 - DNA, 18 bp, Homo sapiens
gaccaaagactgcagaac

SEQ ID NO: 4352587 - DNA, 14 bp, Homo sapiens
gacctacagacctg

SEQ ID NO: 4352588 - DNA, 15 bp, Homo sapiens
gacctggctctcaga

SEQ ID NO: 4352589 - DNA, 18 bp, Homo sapiens
gacctggctctcagagga

SEQ ID NO: 4352590 - DNA, 21 bp, Homo sapiens
gactacaaaatacaatcctgt

SEQ ID NO: 4352591 - DNA, 14 bp, Homo sapiens
gactccaggcctga

SEQ ID NO: 4352592 - DNA, 19 bp, Homo sapiens
gactccaggcctgaccagg

SEQ ID NO: 4352593 - DNA, 16 bp, Homo sapiens
gactcctcaggagaga

SEQ ID NO: 4352594 - DNA, 17 bp, Homo sapiens
gactcctcaggagagac

SEQ ID NO: 4352595 - DNA, 20 bp, Homo sapiens
gactgaccaaagactgcaga

SEQ ID NO: 4352596 - DNA, 22 bp, Homo sapiens
gactgaccaaagactgcagaac

SEQ ID NO: 4352597 - DNA, 15 bp, Homo sapiens
gactgcaaacttttt

SEQ ID NO: 4352598 - DNA, 21 bp, Homo sapiens
gactgcaaacttttttatatc

SEQ ID NO: 4352599 - DNA, 18 bp, Homo sapiens
gactgcagaacccccagg

SEQ ID NO: 4352600 - DNA, 23 bp, Homo sapiens
gactgcagaacccccaggtggcc

SEQ ID NO: 4352601 - DNA, 14 bp, Homo sapiens
gactggcagaagca

SEQ ID NO: 4352602 - DNA, 15 bp, Homo sapiens
gagaaccttttcaaa

SEQ ID NO: 4352603 - DNA, 22 bp, Homo sapiens
gagaagtgatatggtgaaggga

SEQ ID NO: 4352604 - DNA, 19 bp, Homo sapiens
gagaagttctcaaagttaa

SEQ ID NO: 4352605 - DNA, 18 bp, Homo sapiens
gagaatcccttaaaatta

SEQ ID NO: 4352606 - DNA, 21 bp, Homo sapiens
gagaatttaagtagaaaagtt

SEQ ID NO: 4352607 - DNA, 21 bp, Homo sapiens
gagacagaaagcctccgctgg

SEQ ID NO: 4352608 - DNA, 20 bp, Homo sapiens
gagagacccctcccctccca

SEQ ID NO: 4352609 - DNA, 13 bp, Homo sapiens
gagagagggactc

SEQ ID NO: 4352610 - DNA, 17 bp, Homo sapiens
gagagcctgtcaccaga

SEQ ID NO: 4352611 - DNA, 19 bp, Homo sapiens
gagagcctgtcaccagagc

SEQ ID NO: 4352612 - DNA, 20 bp, Homo sapiens
gagagcctgtcaccagagct

SEQ ID NO: 4352613 - DNA, 18 bp, Homo sapiens
gagataaatgagctttcc

SEQ ID NO: 4352614 - DNA, 21 bp, Homo sapiens
gagcaattccaggctgagcca

SEQ ID NO: 4352615 - DNA, 24 bp, Homo sapiens
gagcaattccaggctgagccatga

SEQ ID NO: 4352616 - DNA, 14 bp, Homo sapiens
gagccaacctggac

SEQ ID NO: 4352617 - DNA, 19 bp, Homo sapiens
gagccaacctggacttcct

SEQ ID NO: 4352618 - DNA, 22 bp, Homo sapiens
gagccaacctggacttcctgtc

SEQ ID NO: 4352619 - DNA, 20 bp, Homo sapiens
gagccatgaggagcgtggac

SEQ ID NO: 4352620 - DNA, 20 bp, Homo sapiens
gagcccaccagggacacctc

SEQ ID NO: 4352621 - DNA, 17 bp, Homo sapiens
gagccgaggggagagag

SEQ ID NO: 4352622 - DNA, 23 bp, Homo sapiens
gagccgaggggagagagggactc

SEQ ID NO: 4352623 - DNA, 19 bp, Homo sapiens
gagcctgtcaccagagctt

SEQ ID NO: 4352624 - DNA, 16 bp, Homo sapiens
gagctgttataaattt

SEQ ID NO: 4352625 - DNA, 15 bp, Homo sapiens
gagcttctctgggct

SEQ ID NO: 4352626 - DNA, 16 bp, Homo sapiens
gagcttctctgggctg

SEQ ID NO: 4352627 - DNA, 22 bp, Homo sapiens
gaggagaaactctagactgcaa

SEQ ID NO: 4352628 - DNA, 23 bp, Homo sapiens
gaggcagcccagctcctgaataa

SEQ ID NO: 4352629 - DNA, 15 bp, Homo sapiens
gaggctgcccctctc

SEQ ID NO: 4352630 - DNA, 18 bp, Homo sapiens
gaggctgcccctctcacc

SEQ ID NO: 4352631 - DNA, 14 bp, Homo sapiens
gaggtccagctggg

SEQ ID NO: 4352632 - DNA, 17 bp, Homo sapiens
gaggtccagctgggcct

SEQ ID NO: 4352633 - DNA, 23 bp, Homo sapiens
gagtttgtgttgttgttgctgct

SEQ ID NO: 4352634 - DNA, 19 bp, Homo sapiens
gatactgcttattttatga

SEQ ID NO: 4352635 - DNA, 14 bp, Homo sapiens
gatagaaagctgga

SEQ ID NO: 4352636 - DNA, 17 bp, Homo sapiens
gatagaaagctggactg

SEQ ID NO: 4352637 - DNA, 20 bp, Homo sapiens
gatagcttccccaccagctt

SEQ ID NO: 4352638 - DNA, 23 bp, Homo sapiens
gatagcttccccaccagctttat

SEQ ID NO: 4352639 - DNA, 16 bp, Homo sapiens
gatatacaaagtgtac

SEQ ID NO: 4352640 - DNA, 17 bp, Homo sapiens
gatattgtttaaaattc

SEQ ID NO: 4352641 - DNA, 11 bp, Homo sapiens
gatatttttgt

SEQ ID NO: 4352642 - DNA, 21 bp, Homo sapiens
gatccatggggggagaagtga

SEQ ID NO: 4352643 - DNA, 15 bp, Homo sapiens
gatctaataaacttt

SEQ ID NO: 4352644 - DNA, 18 bp, Homo sapiens
gatctaataaactttatt

SEQ ID NO: 4352645 - DNA, 14 bp, Homo sapiens
gatctgcaggctgc

SEQ ID NO: 4352646 - DNA, 12 bp, Homo sapiens
gattgtcttgca

SEQ ID NO: 4352647 - DNA, 22 bp, Homo sapiens
gatttgatgtgactttttttgg

SEQ ID NO: 4352648 - DNA, 15 bp, Homo sapiens
gcaagactgcaaact

SEQ ID NO: 4352649 - DNA, 21 bp, Homo sapiens
gcaagactgcaaactttttta

SEQ ID NO: 4352650 - DNA, 20 bp, Homo sapiens
gcaagcttgaggccaagatg

SEQ ID NO: 4352651 - DNA, 13 bp, Homo sapiens
gcaattccaggct

SEQ ID NO: 4352652 - DNA, 24 bp, Homo sapiens
gcaattccaggctgagccatgagg

SEQ ID NO: 4352653 - DNA, 20 bp, Homo sapiens
gcacagggtgtggtatgagg

SEQ ID NO: 4352654 - DNA, 18 bp, Homo sapiens
gcacctctggctagagcc

SEQ ID NO: 4352655 - DNA, 21 bp, Homo sapiens
gcacctctggctagagccgag

SEQ ID NO: 4352656 - DNA, 16 bp, Homo sapiens
gcagaacccccaggtg

SEQ ID NO: 4352657 - DNA, 18 bp, Homo sapiens
gcagaacccccaggtggc

SEQ ID NO: 4352658 - DNA, 20 bp, Homo sapiens
gcagaacccccaggtggcct

SEQ ID NO: 4352659 - DNA, 16 bp, Homo sapiens
gcagagcaattccagg

SEQ ID NO: 4352660 - DNA, 19 bp, Homo sapiens
aaaaagtaagttaataatg

SEQ ID NO: 4352661 - DNA, 21 bp, Homo sapiens
aaaaagtaagttaataatgta

SEQ ID NO: 4352662 - DNA, 21 bp, Homo sapiens
aaaaatcaggcagaaatattt

SEQ ID NO: 4352663 - DNA, 17 bp, Homo sapiens
aaaatacaatcctgttt

SEQ ID NO: 4352664 - DNA, 15 bp, Homo sapiens
aaaatattttttgca

SEQ ID NO: 4352665 - DNA, 15 bp, Homo sapiens
aaaatgagagctgta

SEQ ID NO: 4352666 - DNA, 17 bp, Homo sapiens
aaaatgggagccaggag

SEQ ID NO: 4352667 - DNA, 17 bp, Homo sapiens
aaaattcagtttttgta

SEQ ID NO: 4352668 - DNA, 19 bp, Homo sapiens
aaacagtagttgtattctt

SEQ ID NO: 4352669 - DNA, 23 bp, Homo sapiens
aaacagtagttgtattcttctgt

SEQ ID NO: 4352670 - DNA, 19 bp, Homo sapiens
aaacctttcagtactctta

SEQ ID NO: 4352671 - DNA, 13 bp, Homo sapiens
aaacggtgctttc

SEQ ID NO: 4352672 - DNA, 12 bp, Homo sapiens
aaactctagact

SEQ ID NO: 4352673 - DNA, 15 bp, Homo sapiens
aaactcttaatctgt

SEQ ID NO: 4352674 - DNA, 18 bp, Homo sapiens
aaactgaatattttggaa

SEQ ID NO: 4352675 - DNA, 23 bp, Homo sapiens
aaactgctaaattctatgttaaa

SEQ ID NO: 4352676 - DNA, 21 bp, Homo sapiens
aaactggattaaaacaatttt

SEQ ID NO: 4352677 - DNA, 22 bp, Homo sapiens
aaactttattttttaaaaatga

SEQ ID NO: 4352678 - DNA, 20 bp, Homo sapiens
aaacttttttatatcttttg

SEQ ID NO: 4352679 - DNA, 15 bp, Homo sapiens
aaagccttctggatc

SEQ ID NO: 4352680 - DNA, 14 bp, Homo sapiens
aaagctggactgac

SEQ ID NO: 4352681 - DNA, 15 bp, Homo sapiens
aaagctggactgacc

SEQ ID NO: 4352682 - DNA, 14 bp, Homo sapiens
aaaggcaagcttga

SEQ ID NO: 4352683 - DNA, 20 bp, Homo sapiens
aaaggcaagcttgaggccaa

SEQ ID NO: 4352684 - DNA, 13 bp, Homo sapiens
aaaggcttggctg

SEQ ID NO: 4352685 - DNA, 15 bp, Homo sapiens
aaagggttgaaaatg

SEQ ID NO: 4352686 - DNA, 13 bp, Homo sapiens
aaaggtggtaaat

SEQ ID NO: 4352687 - DNA, 18 bp, Homo sapiens
aaaggtggtaaattcaga

SEQ ID NO: 4352688 - DNA, 12 bp, Homo sapiens
aaaggttttgta

SEQ ID NO: 4352689 - DNA, 14 bp, Homo sapiens
aaaggttttgtatt

SEQ ID NO: 4352690 - DNA, 16 bp, Homo sapiens
aaaggttttgtatttt

SEQ ID NO: 4352691 - DNA, 22 bp, Homo sapiens
aaagtaagttaataatgtattg

SEQ ID NO: 4352692 - DNA, 23 bp, Homo sapiens
aaagtaagttaataatgtattgt

SEQ ID NO: 4352693 - DNA, 13 bp, Homo sapiens
aaagtgttgtatc

SEQ ID NO: 4352694 - DNA, 13 bp, Homo sapiens
aaataaaactgaa

SEQ ID NO: 4352695 - DNA, 14 bp, Homo sapiens
aaataaaactgaat

SEQ ID NO: 4352696 - DNA, 12 bp, Homo sapiens
aaataatgaata

SEQ ID NO: 4352697 - DNA, 13 bp, Homo sapiens
aaatatgttctgg

SEQ ID NO: 4352698 - DNA, 18 bp, Homo sapiens
aaatgaacctgctactta

SEQ ID NO: 4352699 - DNA, 12 bp, Homo sapiens
aaatgccagagc

SEQ ID NO: 4352700 - DNA, 21 bp, Homo sapiens
aaatgccagagccaacctgga

SEQ ID NO: 4352701 - DNA, 22 bp, Homo sapiens
aaatgccagagccaacctggac

SEQ ID NO: 4352702 - DNA, 15 bp, Homo sapiens
aaatgggagccagga

SEQ ID NO: 4352703 - DNA, 16 bp, Homo sapiens
aaatggttcatatttt

SEQ ID NO: 4352704 - DNA, 13 bp, Homo sapiens
aaatgtgtttgct

SEQ ID NO: 4352705 - DNA, 23 bp, Homo sapiens
aaattacgtttgttattcctagt

SEQ ID NO: 4352706 - DNA, 12 bp, Homo sapiens
aaattcagacaa

SEQ ID NO: 4352707 - DNA, 19 bp, Homo sapiens
aaattcagacaacattatg

SEQ ID NO: 4352708 - DNA, 21 bp, Homo sapiens
aaattcagacaacattatgat

SEQ ID NO: 4352709 - DNA, 23 bp, Homo sapiens
aaattcagtttttgtatcttggg

SEQ ID NO: 4352710 - DNA, 12 bp, Homo sapiens
aaattctatgtt

SEQ ID NO: 4352711 - DNA, 18 bp, Homo sapiens
aaattctatgttaaatac

SEQ ID NO: 4352712 - DNA, 16 bp, Homo sapiens
aaatttaaaattacgt

SEQ ID NO: 4352713 - DNA, 19 bp, Homo sapiens
aaatttagccctttaaaac

SEQ ID NO: 4352714 - DNA, 17 bp, Homo sapiens
aacaattttttttttcc

SEQ ID NO: 4352715 - DNA, 16 bp, Homo sapiens
aacagtagttgtattc

SEQ ID NO: 4352716 - DNA, 19 bp, Homo sapiens
aacatacttcaaaaataat

SEQ ID NO: 4352717 - DNA, 17 bp, Homo sapiens
aacatccaagccagagt

SEQ ID NO: 4352718 - DNA, 18 bp, Homo sapiens
aacatgaaagctgatgcc

SEQ ID NO: 4352719 - DNA, 17 bp, Homo sapiens
aacattacagttcataa

SEQ ID NO: 4352720 - DNA, 17 bp, Homo sapiens
aacattatgatctaata

SEQ ID NO: 4352721 - DNA, 18 bp, Homo sapiens
aaccaggccttcatcctc

SEQ ID NO: 4352722 - DNA, 12 bp, Homo sapiens
aacctggacttc

SEQ ID NO: 4352723 - DNA, 15 bp, Homo sapiens
aacctggacttcctg

SEQ ID NO: 4352724 - DNA, 14 bp, Homo sapiens
aactgaatattttg

SEQ ID NO: 4352725 - DNA, 17 bp, Homo sapiens
aactgaatattttggaa

SEQ ID NO: 4352726 - DNA, 19 bp, Homo sapiens
aactgctaaattctatgtt

SEQ ID NO: 4352727 - DNA, 21 bp, Homo sapiens
aactgctaaattctatgttaa

SEQ ID NO: 4352728 - DNA, 16 bp, Homo sapiens
aactggattaaaacaa

SEQ ID NO: 4352729 - DNA, 18 bp, Homo sapiens
aactgtcaaatatgttct

SEQ ID NO: 4352730 - DNA, 19 bp, Homo sapiens
aacttcaggtaaaaacttc

SEQ ID NO: 4352731 - DNA, 18 bp, Homo sapiens
aactttactctgtgttta

SEQ ID NO: 4352732 - DNA, 18 bp, Homo sapiens
aagactgcaaactttttt

SEQ ID NO: 4352733 - DNA, 13 bp, Homo sapiens
aagactgcagaac

SEQ ID NO: 4352734 - DNA, 17 bp, Homo sapiens
aagaggctgcccctctc

SEQ ID NO: 4352735 - DNA, 22 bp, Homo sapiens
aagaggctgcccctctcaccaa

SEQ ID NO: 4352736 - DNA, 23 bp, Homo sapiens
aagagtaactttactctgtgttt

SEQ ID NO: 4352737 - DNA, 12 bp, Homo sapiens
aagataaatgag

SEQ ID NO: 4352738 - DNA, 16 bp, Homo sapiens
aagatagaaagctgga

SEQ ID NO: 4352739 - DNA, 17 bp, Homo sapiens
aagatagaaagctggac

SEQ ID NO: 4352740 - DNA, 19 bp, Homo sapiens
aagatagaaagctggactg

SEQ ID NO: 4352741 - DNA, 14 bp, Homo sapiens
aagatggctgctgc

SEQ ID NO: 4352742 - DNA, 17 bp, Homo sapiens
aagattcgccaatctca

SEQ ID NO: 4352743 - DNA, 21 bp, Homo sapiens
aagattcgccaatctcataca

SEQ ID NO: 4352744 - DNA, 16 bp, Homo sapiens
aagcattgcctggact

SEQ ID NO: 4352745 - DNA, 18 bp, Homo sapiens
aagcctccgctgggcttc

SEQ ID NO: 4352746 - DNA, 21 bp, Homo sapiens
aagccttaagaagataaatga

SEQ ID NO: 4352747 - DNA, 22 bp, Homo sapiens
aagccttaagaagataaatgag

SEQ ID NO: 4352748 - DNA, 13 bp, Homo sapiens
aagccttctggat

SEQ ID NO: 4352749 - DNA, 11 bp, Homo sapiens
aagctggactg

SEQ ID NO: 4352750 - DNA, 16 bp, Homo sapiens
aagctggactgaccaa

SEQ ID NO: 4352751 - DNA, 23 bp, Homo sapiens
aaggcaaaaaactcttaatctgt

SEQ ID NO: 4352752 - DNA, 16 bp, Homo sapiens
aaggccaaaagaagtt

SEQ ID NO: 4352753 - DNA, 14 bp, Homo sapiens
aagggaagtgggga

SEQ ID NO: 4352754 - DNA, 15 bp, Homo sapiens
aaggtggtaaattca

SEQ ID NO: 4352755 - DNA, 19 bp, Homo sapiens
aaggtggtaaattcagaca

SEQ ID NO: 4352756 - DNA, 16 bp, Homo sapiens
aaggttggttgctaag

SEQ ID NO: 4352757 - DNA, 20 bp, Homo sapiens
aagtagaaaagttgcagatg

SEQ ID NO: 4352758 - DNA, 14 bp, Homo sapiens
aagtatacttttcc

SEQ ID NO: 4352759 - DNA, 22 bp, Homo sapiens
aagtgatatggtgaagggaagt

SEQ ID NO: 4352760 - DNA, 21 bp, Homo sapiens
aagtgtaccaacataagtgtt

SEQ ID NO: 4352761 - DNA, 12 bp, Homo sapiens
aagtgttgtatc

SEQ ID NO: 4352762 - DNA, 16 bp, Homo sapiens
aagttaataatgtatt

SEQ ID NO: 4352763 - DNA, 18 bp, Homo sapiens
aagttaataatgtattgt

SEQ ID NO: 4352764 - DNA, 13 bp, Homo sapiens
aagttaattcacc

SEQ ID NO: 4352765 - DNA, 18 bp, Homo sapiens
aagttatattagtgaaga

SEQ ID NO: 4352766 - DNA, 18 bp, Homo sapiens
aagttgcagatgtattga

SEQ ID NO: 4352767 - DNA, 13 bp, Homo sapiens
aataaaactgaat

SEQ ID NO: 4352768 - DNA, 20 bp, Homo sapiens
aataataagtgatgtgctga

SEQ ID NO: 4352769 - DNA, 20 bp, Homo sapiens
aataatccagtattgctgat

SEQ ID NO: 4352770 - DNA, 19 bp, Homo sapiens
aataatgaataaactgaat

SEQ ID NO: 4352771 - DNA, 19 bp, Homo sapiens
aatacaatcctgtttataa

SEQ ID NO: 4352772 - DNA, 14 bp, Homo sapiens
aataggtagtttgg

SEQ ID NO: 4352773 - DNA, 17 bp, Homo sapiens
aataggtagtttggata

SEQ ID NO: 4352774 - DNA, 22 bp, Homo sapiens
aatatatcaaatccaggacttt

SEQ ID NO: 4352775 - DNA, 21 bp, Homo sapiens
aatattttggaaactgctaaa

SEQ ID NO: 4352776 - DNA, 13 bp, Homo sapiens
aatattttttgca

SEQ ID NO: 4352777 - DNA, 16 bp, Homo sapiens
aatattttttgcaagt

SEQ ID NO: 4352778 - DNA, 23 bp, Homo sapiens
agttgaattttttctaaaaagaa

SEQ ID NO: 4352779 - DNA, 15 bp, Homo sapiens
agtttttaaagcctt

SEQ ID NO: 4352780 - DNA, 21 bp, Homo sapiens
agtttttaaagccttctggat

SEQ ID NO: 4352781 - DNA, 13 bp, Homo sapiens
agtttttgtatct

SEQ ID NO: 4352782 - DNA, 15 bp, Homo sapiens
agtttttgtatcttg

SEQ ID NO: 4352783 - DNA, 19 bp, Homo sapiens
ataaaacggtgctttctgt

SEQ ID NO: 4352784 - DNA, 14 bp, Homo sapiens
ataaaactgaatct

SEQ ID NO: 4352785 - DNA, 17 bp, Homo sapiens
ataaactgaatattttg

SEQ ID NO: 4352786 - DNA, 22 bp, Homo sapiens
ataaactgaatattttggaaac

SEQ ID NO: 4352787 - DNA, 23 bp, Homo sapiens
ataaactgaatattttggaaact

SEQ ID NO: 4352788 - DNA, 13 bp, Homo sapiens
ataaatgccagag

SEQ ID NO: 4352789 - DNA, 21 bp, Homo sapiens
ataatgtgctttatttgcaaa

SEQ ID NO: 4352790 - DNA, 15 bp, Homo sapiens
ataatttatatgcat

SEQ ID NO: 4352791 - DNA, 18 bp, Homo sapiens
ataatttatatgcatgca

SEQ ID NO: 4352792 - DNA, 23 bp, Homo sapiens
atacaatcctgtttataatctga

SEQ ID NO: 4352793 - DNA, 16 bp, Homo sapiens
atacattcatactgta

SEQ ID NO: 4352794 - DNA, 19 bp, Homo sapiens
atactgcttattttatgat

SEQ ID NO: 4352795 - DNA, 14 bp, Homo sapiens
atactgtgcagaat

SEQ ID NO: 4352796 - DNA, 16 bp, Homo sapiens
atactgtgcagaataa

SEQ ID NO: 4352797 - DNA, 17 bp, Homo sapiens
atactgtgcagaataat

SEQ ID NO: 4352798 - DNA, 18 bp, Homo sapiens
atactgtgcagaataatg

SEQ ID NO: 4352799 - DNA, 17 bp, Homo sapiens
atacttcaaaaataatg

SEQ ID NO: 4352800 - DNA, 18 bp, Homo sapiens
atacttttcccctgttaa

SEQ ID NO: 4352801 - DNA, 20 bp, Homo sapiens
atacttttcccctgttaaac

SEQ ID NO: 4352802 - DNA, 17 bp, Homo sapiens
atagaaagctggactga

SEQ ID NO: 4352803 - DNA, 16 bp, Homo sapiens
atagacctacagacct

SEQ ID NO: 4352804 - DNA, 14 bp, Homo sapiens
atagagaatttaag

SEQ ID NO: 4352805 - DNA, 16 bp, Homo sapiens
atataaattttcagaa

SEQ ID NO: 4352806 - DNA, 21 bp, Homo sapiens
atatatcaaatccaggacttt

SEQ ID NO: 4352807 - DNA, 15 bp, Homo sapiens
atatatgtacataca

SEQ ID NO: 4352808 - DNA, 15 bp, Homo sapiens
atatatttcactttt

SEQ ID NO: 4352809 - DNA, 23 bp, Homo sapiens
atatcaaatccaggactttgtta

SEQ ID NO: 4352810 - DNA, 15 bp, Homo sapiens
atatgcatgcacagg

SEQ ID NO: 4352811 - DNA, 17 bp, Homo sapiens
atatggacagctttatt

SEQ ID NO: 4352812 - DNA, 13 bp, Homo sapiens
atatggtgaaggg

SEQ ID NO: 4352813 - DNA, 16 bp, Homo sapiens
atatggtgaagggaag

SEQ ID NO: 4352814 - DNA, 15 bp, Homo sapiens
atattaaacctttca

SEQ ID NO: 4352815 - DNA, 14 bp, Homo sapiens
atattctttattct

SEQ ID NO: 4352816 - DNA, 21 bp, Homo sapiens
atattgagaatcccttaaaat

SEQ ID NO: 4352817 - DNA, 13 bp, Homo sapiens
atattgtttaaaa

SEQ ID NO: 4352818 - DNA, 19 bp, Homo sapiens
atattgtttaaaattcagt

SEQ ID NO: 4352819 - DNA, 15 bp, Homo sapiens
atatttcacttttgt

SEQ ID NO: 4352820 - DNA, 19 bp, Homo sapiens
atatttcacttttgttctg

SEQ ID NO: 4352821 - DNA, 13 bp, Homo sapiens
atattttggaaac

SEQ ID NO: 4352822 - DNA, 22 bp, Homo sapiens
atattttgtgtataatgtgctt

SEQ ID NO: 4352823 - DNA, 13 bp, Homo sapiens
atatttttgtact

SEQ ID NO: 4352824 - DNA, 15 bp, Homo sapiens
atatttttgtacttg

SEQ ID NO: 4352825 - DNA, 12 bp, Homo sapiens
atattttttgca

SEQ ID NO: 4352826 - DNA, 19 bp, Homo sapiens
atcaaatccaggactttgt

SEQ ID NO: 4352827 - DNA, 21 bp, Homo sapiens
atcaattggcagtgactttgt

SEQ ID NO: 4352828 - DNA, 11 bp, Homo sapiens
atcatgtatgt

SEQ ID NO: 4352829 - DNA, 13 bp, Homo sapiens
atccaagccagag

SEQ ID NO: 4352830 - DNA, 14 bp, Homo sapiens
atccaagccagagt

SEQ ID NO: 4352831 - DNA, 16 bp, Homo sapiens
atcctcctccccagct

SEQ ID NO: 4352832 - DNA, 23 bp, Homo sapiens
atcctcctccccagctcttctct

SEQ ID NO: 4352833 - DNA, 20 bp, Homo sapiens
atccttaagagaagaaatgt

SEQ ID NO: 4352834 - DNA, 19 bp, Homo sapiens
atctcatacaagccattta

SEQ ID NO: 4352835 - DNA, 19 bp, Homo sapiens
atctgaagatatatttcac

SEQ ID NO: 4352836 - DNA, 13 bp, Homo sapiens
atctgcaggctgc

SEQ ID NO: 4352837 - DNA, 17 bp, Homo sapiens
atctggctttttctgcc

SEQ ID NO: 4352838 - DNA, 15 bp, Homo sapiens
atctgtgtgtatatt

SEQ ID NO: 4352839 - DNA, 20 bp, Homo sapiens
atcttggggctgatgaagaa

SEQ ID NO: 4352840 - DNA, 21 bp, Homo sapiens
atgaactgcatcaagacttca

SEQ ID NO: 4352841 - DNA, 15 bp, Homo sapiens
atgaagtatactttt

SEQ ID NO: 4352842 - DNA, 14 bp, Homo sapiens
atgaataaactgaa

SEQ ID NO: 4352843 - DNA, 17 bp, Homo sapiens
atgaataaactgaatat

SEQ ID NO: 4352844 - DNA, 18 bp, Homo sapiens
atgaataaactgaatatt

SEQ ID NO: 4352845 - DNA, 21 bp, Homo sapiens
atgaataaactgaatattttg

SEQ ID NO: 4352846 - DNA, 11 bp, Homo sapiens
atgactgttga

SEQ ID NO: 4352847 - DNA, 13 bp, Homo sapiens
atgagggggtggt

SEQ ID NO: 4352848 - DNA, 23 bp, Homo sapiens
atgagggggtggttattggactc

SEQ ID NO: 4352849 - DNA, 19 bp, Homo sapiens
atgatagtttgtcctgtgt

SEQ ID NO: 4352850 - DNA, 18 bp, Homo sapiens
atgatattgtttaaaatt

SEQ ID NO: 4352851 - DNA, 14 bp, Homo sapiens
atgatctaataaac

SEQ ID NO: 4352852 - DNA, 17 bp, Homo sapiens
atgatctaataaacttt

SEQ ID NO: 4352853 - DNA, 14 bp, Homo sapiens
atgccagagccaac

SEQ ID NO: 4352854 - DNA, 19 bp, Homo sapiens
atgccagagccaacctgga

SEQ ID NO: 4352855 - DNA, 21 bp, Homo sapiens
atgccagagccaacctggact

SEQ ID NO: 4352856 - DNA, 22 bp, Homo sapiens
atgccagagccaacctggactt

SEQ ID NO: 4352857 - DNA, 15 bp, Homo sapiens
atgcctttttttaag

SEQ ID NO: 4352858 - DNA, 17 bp, Homo sapiens
atgcttaaactaaataa

SEQ ID NO: 4352859 - DNA, 16 bp, Homo sapiens
atggaaacattacagt

SEQ ID NO: 4352860 - DNA, 15 bp, Homo sapiens
atgggagccaggagt

SEQ ID NO: 4352861 - DNA, 14 bp, Homo sapiens
atggggggagaagt

SEQ ID NO: 4352862 - DNA, 18 bp, Homo sapiens
atgggtggaattagagtg

SEQ ID NO: 4352863 - DNA, 17 bp, Homo sapiens
atggtcatcaccaccct

SEQ ID NO: 4352864 - DNA, 21 bp, Homo sapiens
atggtcatcaccacccttcca

SEQ ID NO: 4352865 - DNA, 22 bp, Homo sapiens
atggtgaagggaagtggggagt

SEQ ID NO: 4352866 - DNA, 19 bp, Homo sapiens
atgtatatcattctacaga

SEQ ID NO: 4352867 - DNA, 22 bp, Homo sapiens
atgtatgaaggaatcattccag

SEQ ID NO: 4352868 - DNA, 23 bp, Homo sapiens
atgtatgaaggaatcattccagt

SEQ ID NO: 4352869 - DNA, 18 bp, Homo sapiens
atgtcagagctgttataa

SEQ ID NO: 4352870 - DNA, 22 bp, Homo sapiens
atgtcagtgctataaatgccag

SEQ ID NO: 4352871 - DNA, 18 bp, Homo sapiens
atgtccaaagaggctgcc

SEQ ID NO: 4352872 - DNA, 22 bp, Homo sapiens
atgtccaaagaggctgcccctc

SEQ ID NO: 4352873 - DNA, 17 bp, Homo sapiens
atgtctcactgttctgc

SEQ ID NO: 4352874 - DNA, 13 bp, Homo sapiens
atgtgtttgctgc

SEQ ID NO: 4352875 - DNA, 16 bp, Homo sapiens
atgtgtttgctgcctt

SEQ ID NO: 4352876 - DNA, 23 bp, Homo sapiens
atgttaaatactgtgcagaataa

SEQ ID NO: 4352877 - DNA, 14 bp, Homo sapiens
atgttataaagtag

SEQ ID NO: 4352878 - DNA, 13 bp, Homo sapiens
atgtttaaatcat

SEQ ID NO: 4352879 - DNA, 19 bp, Homo sapiens
atgtttaaatcatgtatgt

SEQ ID NO: 4352880 - DNA, 22 bp, Homo sapiens
atgtttaaatcatgtatgttat

SEQ ID NO: 4352881 - DNA, 16 bp, Homo sapiens
atgttttgaaagacag

SEQ ID NO: 4352882 - DNA, 17 bp, Homo sapiens
attaaacctttcagtac

SEQ ID NO: 4352883 - DNA, 16 bp, Homo sapiens
attaattcttcacctg

SEQ ID NO: 4352884 - DNA, 16 bp, Homo sapiens
attaccagacaaaaaa

SEQ ID NO: 4352885 - DNA, 22 bp, Homo sapiens
attagaagaaaataatttatat

SEQ ID NO: 4352886 - DNA, 13 bp, Homo sapiens
attagtgaagatg

SEQ ID NO: 4352887 - DNA, 16 bp, Homo sapiens
attatgatctaataaa

SEQ ID NO: 4352888 - DNA, 18 bp, Homo sapiens
attatgatctaataaact

SEQ ID NO: 4352889 - DNA, 20 bp, Homo sapiens
attatgatctaataaacttt

SEQ ID NO: 4352890 - DNA, 22 bp, Homo sapiens
attatgatctaataaactttat

SEQ ID NO: 4352891 - DNA, 13 bp, Homo sapiens
attcagacaacat

SEQ ID NO: 4352892 - DNA, 15 bp, Homo sapiens
attcagacaacatta

SEQ ID NO: 4352893 - DNA, 15 bp, Homo sapiens
attcagattgtcttg

SEQ ID NO: 4352894 - DNA, 15 bp, Homo sapiens
attcagtttttgtat

SEQ ID NO: 4352895 - DNA, 22 bp, Homo sapiens
attcatagggaaaggttttgta

SEQ ID NO: 4352896 - DNA, 17 bp, Homo sapiens
attccaggctgagccat

SEQ ID NO: 4352897 - DNA, 21 bp, Homo sapiens
attccaggctgagccatgagg

SEQ ID NO: 4352898 - DNA, 13 bp, Homo sapiens
attcctgcatttg

SEQ ID NO: 4352899 - DNA, 15 bp, Homo sapiens
attctacagaataat

SEQ ID NO: 4352900 - DNA, 20 bp, Homo sapiens
attctacagaataatccagt

SEQ ID NO: 4352901 - DNA, 19 bp, Homo sapiens
attctatgttaaatactgt

SEQ ID NO: 4352902 - DNA, 20 bp, Homo sapiens
attctcagtaacttttaaaa

SEQ ID NO: 4352903 - DNA, 19 bp, Homo sapiens
attctctaattagaaattt

SEQ ID NO: 4352904 - DNA, 14 bp, Homo sapiens
attcttattaattc

SEQ ID NO: 4352905 - DNA, 17 bp, Homo sapiens
attcttctgtatttcta

SEQ ID NO: 4352906 - DNA, 22 bp, Homo sapiens
attctttattctcagtaacttt

SEQ ID NO: 4352907 - DNA, 20 bp, Homo sapiens
attgccatgaaccatgctta

SEQ ID NO: 4352908 - DNA, 23 bp, Homo sapiens
ctacattggaagctttgagttga

SEQ ID NO: 4352909 - DNA, 15 bp, Homo sapiens
ctacttaaaaaaaat

SEQ ID NO: 4352910 - DNA, 13 bp, Homo sapiens
ctagactcctcag

SEQ ID NO: 4352911 - DNA, 14 bp, Homo sapiens
ctagagccgagggg

SEQ ID NO: 4352912 - DNA, 21 bp, Homo sapiens
ctagagccgaggggagagagg

SEQ ID NO: 4352913 - DNA, 17 bp, Homo sapiens
ctagctggtagcataaa

SEQ ID NO: 4352914 - DNA, 14 bp, Homo sapiens
ctataaatgccaga

SEQ ID NO: 4352915 - DNA, 18 bp, Homo sapiens
ctataaatgccagagcca

SEQ ID NO: 4352916 - DNA, 21 bp, Homo sapiens
ctcaagatgggtccctggcca

SEQ ID NO: 4352917 - DNA, 19 bp, Homo sapiens
ctcaagggaaaggcaagct

SEQ ID NO: 4352918 - DNA, 23 bp, Homo sapiens
ctcaagggaaaggcaagcttgag

SEQ ID NO: 4352919 - DNA, 19 bp, Homo sapiens
ctcaattttttcaaatgaa

SEQ ID NO: 4352920 - DNA, 18 bp, Homo sapiens
ctcagactctttcttcac

SEQ ID NO: 4352921 - DNA, 20 bp, Homo sapiens
ctcagaggaaaaatgggagc

SEQ ID NO: 4352922 - DNA, 23 bp, Homo sapiens
ctcagaggaaaaatgggagccag

SEQ ID NO: 4352923 - DNA, 17 bp, Homo sapiens
ctcaggagagacccctc

SEQ ID NO: 4352924 - DNA, 20 bp, Homo sapiens
ctcaggagagacccctcccc

SEQ ID NO: 4352925 - DNA, 13 bp, Homo sapiens
ctccaggcctgac

SEQ ID NO: 4352926 - DNA, 17 bp, Homo sapiens
ctccaggcctgaccagg

SEQ ID NO: 4352927 - DNA, 13 bp, Homo sapiens
ctcccacccacag

SEQ ID NO: 4352928 - DNA, 20 bp, Homo sapiens
ctccccagctcttctcttcc

SEQ ID NO: 4352929 - DNA, 22 bp, Homo sapiens
ctccccagctcttctcttccta

SEQ ID NO: 4352930 - DNA, 13 bp, Homo sapiens
ctcccctcccacc

SEQ ID NO: 4352931 - DNA, 20 bp, Homo sapiens
ctcccctcccacccacagcc

SEQ ID NO: 4352932 - DNA, 12 bp, Homo sapiens
ctccgctgggct

SEQ ID NO: 4352933 - DNA, 16 bp, Homo sapiens
ctcctagcagacagaa

SEQ ID NO: 4352934 - DNA, 13 bp, Homo sapiens
ctcctccccagct

SEQ ID NO: 4352935 - DNA, 17 bp, Homo sapiens
ctcctccccagctcttc

SEQ ID NO: 4352936 - DNA, 11 bp, Homo sapiens
ctcctgaataa

SEQ ID NO: 4352937 - DNA, 19 bp, Homo sapiens
ctcctgcctccgggcaggc

SEQ ID NO: 4352938 - DNA, 21 bp, Homo sapiens
ctcctttacaaccatacttta

SEQ ID NO: 4352939 - DNA, 21 bp, Homo sapiens
ctcggaggtccagctgggcct

SEQ ID NO: 4352940 - DNA, 23 bp, Homo sapiens
ctctgctagactcctcaggagag

SEQ ID NO: 4352941 - DNA, 14 bp, Homo sapiens
ctctggctagagcc

SEQ ID NO: 4352942 - DNA, 16 bp, Homo sapiens
ctcttcccttcccaga

SEQ ID NO: 4352943 - DNA, 22 bp, Homo sapiens
ctcttcctagatctgcaggctg

SEQ ID NO: 4352944 - DNA, 19 bp, Homo sapiens
ctcttctggggcaggctgg

SEQ ID NO: 4352945 - DNA, 14 bp, Homo sapiens
ctgaagatatattt

SEQ ID NO: 4352946 - DNA, 18 bp, Homo sapiens
ctgaatattttggaaact

SEQ ID NO: 4352947 - DNA, 19 bp, Homo sapiens
ctgaatattttggaaactg

SEQ ID NO: 4352948 - DNA, 17 bp, Homo sapiens
ctgaattgcctgttcat

SEQ ID NO: 4352949 - DNA, 15 bp, Homo sapiens
ctgacaaaggtggta

SEQ ID NO: 4352950 - DNA, 18 bp, Homo sapiens
ctgaccaaagactgcaga

SEQ ID NO: 4352951 - DNA, 19 bp, Homo sapiens
ctgaggagacagaaagcct

SEQ ID NO: 4352952 - DNA, 20 bp, Homo sapiens
ctgaggagacagaaagcctc

SEQ ID NO: 4352953 - DNA, 22 bp, Homo sapiens
ctgcacctctggctagagccga

SEQ ID NO: 4352954 - DNA, 24 bp, Homo sapiens
ctgcacctctggctagagccgagg

SEQ ID NO: 4352955 - DNA, 21 bp, Homo sapiens
ctgcagaacccccaggtggcc

SEQ ID NO: 4352956 - DNA, 16 bp, Homo sapiens
ctgcagcggcagagca

SEQ ID NO: 4352957 - DNA, 17 bp, Homo sapiens
ctgcagcggcagagcaa

SEQ ID NO: 4352958 - DNA, 13 bp, Homo sapiens
ctgcaggctgcac

SEQ ID NO: 4352959 - DNA, 15 bp, Homo sapiens
ctgcaggctgcacct

SEQ ID NO: 4352960 - DNA, 14 bp, Homo sapiens
ctgccactgaggag

SEQ ID NO: 4352961 - DNA, 13 bp, Homo sapiens
ctgcccctctcac

SEQ ID NO: 4352962 - DNA, 19 bp, Homo sapiens
ctgcctgctcatggccctc

SEQ ID NO: 4352963 - DNA, 12 bp, Homo sapiens
ctgccttgctcc

SEQ ID NO: 4352964 - DNA, 18 bp, Homo sapiens
ctgccttgctcctagcag

SEQ ID NO: 4352965 - DNA, 13 bp, Homo sapiens
ctgcggaagccaa

SEQ ID NO: 4352966 - DNA, 14 bp, Homo sapiens
ctgcggaagccaaa

SEQ ID NO: 4352967 - DNA, 20 bp, Homo sapiens
ctgcggaagccaaaggcagc

SEQ ID NO: 4352968 - DNA, 17 bp, Homo sapiens
ctgctaaattctatgtt

SEQ ID NO: 4352969 - DNA, 20 bp, Homo sapiens
ctgctaaattctatgttaaa

SEQ ID NO: 4352970 - DNA, 17 bp, Homo sapiens
ctgctagactcctcagg

SEQ ID NO: 4352971 - DNA, 18 bp, Homo sapiens
ctgctagactcctcagga

SEQ ID NO: 4352972 - DNA, 14 bp, Homo sapiens
ctggactgaccaaa

SEQ ID NO: 4352973 - DNA, 15 bp, Homo sapiens
ctggactgaccaaag

SEQ ID NO: 4352974 - DNA, 19 bp, Homo sapiens
ctggactgaccaaagactg

SEQ ID NO: 4352975 - DNA, 21 bp, Homo sapiens
ctggactgaccaaagactgca

SEQ ID NO: 4352976 - DNA, 12 bp, Homo sapiens
ctggacttcctg

SEQ ID NO: 4352977 - DNA, 15 bp, Homo sapiens
ctggacttcctgtca

SEQ ID NO: 4352978 - DNA, 14 bp, Homo sapiens
ctggattaaaacaa

SEQ ID NO: 4352979 - DNA, 12 bp, Homo sapiens
ctggcagaagca

SEQ ID NO: 4352980 - DNA, 14 bp, Homo sapiens
ctggctagagccga

SEQ ID NO: 4352981 - DNA, 17 bp, Homo sapiens
ctggctagagccgaggg

SEQ ID NO: 4352982 - DNA, 12 bp, Homo sapiens
ctggctctcaga

SEQ ID NO: 4352983 - DNA, 16 bp, Homo sapiens
ctggctttttctgcca

SEQ ID NO: 4352984 - DNA, 23 bp, Homo sapiens
ctgggccatgtccaaagaggctg

SEQ ID NO: 4352985 - DNA, 13 bp, Homo sapiens
ctgggcctcctgc

SEQ ID NO: 4352986 - DNA, 16 bp, Homo sapiens
ctgggcctcctgcctc

SEQ ID NO: 4352987 - DNA, 19 bp, Homo sapiens
ctgggcttcattccggact

SEQ ID NO: 4352988 - DNA, 20 bp, Homo sapiens
ctgggcttcattccggactg

SEQ ID NO: 4352989 - DNA, 14 bp, Homo sapiens
ctggggcaggctgg

SEQ ID NO: 4352990 - DNA, 18 bp, Homo sapiens
ctggggcaggctgggcca

SEQ ID NO: 4352991 - DNA, 19 bp, Homo sapiens
ctggggcaggctgggccat

SEQ ID NO: 4352992 - DNA, 21 bp, Homo sapiens
ctggggcaggctgggccatgt

SEQ ID NO: 4352993 - DNA, 14 bp, Homo sapiens
ctgtataactgttc

SEQ ID NO: 4352994 - DNA, 12 bp, Homo sapiens
ctgtcaccagag

SEQ ID NO: 4352995 - DNA, 14 bp, Homo sapiens
ctgtcaccagagct

SEQ ID NO: 4352996 - DNA, 23 bp, Homo sapiens
ctgtcaccagagcttctctgggc

SEQ ID NO: 4352997 - DNA, 14 bp, Homo sapiens
ctgtgaaagcctta

SEQ ID NO: 4352998 - DNA, 13 bp, Homo sapiens
ctgtgcagaataa

SEQ ID NO: 4352999 - DNA, 14 bp, Homo sapiens
ctgtgcagaataat

SEQ ID NO: 4353000 - DNA, 19 bp, Homo sapiens
ctgtgtaacatccaagcca

SEQ ID NO: 4353001 - DNA, 22 bp, Homo sapiens
ctgtgtaacatccaagccagag

SEQ ID NO: 4353002 - DNA, 14 bp, Homo sapiens
ctgtgtgtatattg

SEQ ID NO: 4353003 - DNA, 16 bp, Homo sapiens
ctgtgtttaaaaagta

SEQ ID NO: 4353004 - DNA, 23 bp, Homo sapiens
ctgttaaacagtagttgtattct

SEQ ID NO: 4353005 - DNA, 19 bp, Homo sapiens
ctgttgatgaagtatactt

SEQ ID NO: 4353006 - DNA, 15 bp, Homo sapiens
ctgtttataatctga

SEQ ID NO: 4353007 - DNA, 23 bp, Homo sapiens
ctgtttgggttgttggtctgtgt

SEQ ID NO: 4353008 - DNA, 16 bp, Homo sapiens
cttaaactaaataatg

SEQ ID NO: 4353009 - DNA, 18 bp, Homo sapiens
cttaagaagataaatgag

SEQ ID NO: 4353010 - DNA, 16 bp, Homo sapiens
cttaagagaagaaatg

SEQ ID NO: 4353011 - DNA, 12 bp, Homo sapiens
cttattaattct

SEQ ID NO: 4353012 - DNA, 15 bp, Homo sapiens
cttcaaaaataatgt

SEQ ID NO: 4353013 - DNA, 16 bp, Homo sapiens
cttcacctgttatgta

SEQ ID NO: 4353014 - DNA, 17 bp, Homo sapiens
cttcagcccaccaccct

SEQ ID NO: 4353015 - DNA, 23 bp, Homo sapiens
cttcattccggactggcagaagc

SEQ ID NO: 4353016 - DNA, 10 bp, Homo sapiens
cttcccagac

SEQ ID NO: 4353017 - DNA, 17 bp, Homo sapiens
cttcccttcccagacca

SEQ ID NO: 4353018 - DNA, 16 bp, Homo sapiens
cttcctagatctgcag

SEQ ID NO: 4353019 - DNA, 23 bp, Homo sapiens
cttcctagatctgcaggctgcac

SEQ ID NO: 4353020 - DNA, 18 bp, Homo sapiens
cttctcttcctagatctg

SEQ ID NO: 4353021 - DNA, 19 bp, Homo sapiens
cttctggggcaggctgggc

SEQ ID NO: 4353022 - DNA, 22 bp, Homo sapiens
cttctggggcaggctgggccat

SEQ ID NO: 4353023 - DNA, 13 bp, Homo sapiens
cttgagaaccttt

SEQ ID NO: 4353024 - DNA, 13 bp, Homo sapiens
cttgaggccaaga

SEQ ID NO: 4353025 - DNA, 20 bp, Homo sapiens
cttgatttgatgtgactttt

SEQ ID NO: 4353026 - DNA, 16 bp, Homo sapiens
cttgtttagagagcct

SEQ ID NO: 4353027 - DNA, 21 bp, Homo sapiens
ctttaaaaatgcaatatctga

SEQ ID NO: 4353028 - DNA, 19 bp, Homo sapiens
ctttatatatggacagctt

SEQ ID NO: 4353029 - DNA, 21 bp, Homo sapiens
ctttattctcagtaactttta

SEQ ID NO: 4353030 - DNA, 16 bp, Homo sapiens
ctttattttaaatgtg

SEQ ID NO: 4353031 - DNA, 13 bp, Homo sapiens
ctttcagtactct

SEQ ID NO: 4353032 - DNA, 20 bp, Homo sapiens
ctttcagttcgtttgtattc

SEQ ID NO: 4353033 - DNA, 11 bp, Homo sapiens
ctttgcctttt

SEQ ID NO: 4353034 - DNA, 15 bp, Homo sapiens
ctttgtaaaacagcc

SEQ ID NO: 4353035 - DNA, 22 bp, Homo sapiens
cttttaccgttggggcccttaa

SEQ ID NO: 4353036 - DNA, 20 bp, Homo sapiens
cttttcataaagggttgaaa

SEQ ID NO: 4353037 - DNA, 14 bp, Homo sapiens
cttttcccctgtta

SEQ ID NO: 4353038 - DNA, 18 bp, Homo sapiens
cttttcccctgttaaaca

SEQ ID NO: 4353039 - DNA, 21 bp, Homo sapiens
gtaaattcagacaacattatg

SEQ ID NO: 4353040 - DNA, 14 bp, Homo sapiens
gtaaatttggactg

SEQ ID NO: 4353041 - DNA, 17 bp, Homo sapiens
gtaacatccaagccaga

SEQ ID NO: 4353042 - DNA, 22 bp, Homo sapiens
gtagctacactgtataactgtt

SEQ ID NO: 4353043 - DNA, 20 bp, Homo sapiens
gtagttgtattcttctgtat

SEQ ID NO: 4353044 - DNA, 17 bp, Homo sapiens
gtataatgtgctttatt

SEQ ID NO: 4353045 - DNA, 18 bp, Homo sapiens
gtataatgtttaaatcat

SEQ ID NO: 4353046 - DNA, 20 bp, Homo sapiens
gtatatcattctacagaata

SEQ ID NO: 4353047 - DNA, 21 bp, Homo sapiens
gtatatcattctacagaataa

SEQ ID NO: 4353048 - DNA, 18 bp, Homo sapiens
gtatgaaggaatcattcc

SEQ ID NO: 4353049 - DNA, 22 bp, Homo sapiens
gtatgcacagggtgtggtatga

SEQ ID NO: 4353050 - DNA, 21 bp, Homo sapiens
gtatgttatgatattgtttaa

SEQ ID NO: 4353051 - DNA, 22 bp, Homo sapiens
gtatgttatgatattgtttaaa

SEQ ID NO: 4353052 - DNA, 15 bp, Homo sapiens
gtattcttctgtatt

SEQ ID NO: 4353053 - DNA, 15 bp, Homo sapiens
gtattttttaaaaca

SEQ ID NO: 4353054 - DNA, 20 bp, Homo sapiens
gtattttttaaaacactaaa

SEQ ID NO: 4353055 - DNA, 12 bp, Homo sapiens
gtcaccagagct

SEQ ID NO: 4353056 - DNA, 21 bp, Homo sapiens
gtcaccagagcttctctgggc

SEQ ID NO: 4353057 - DNA, 22 bp, Homo sapiens
gtcaccagagcttctctgggct

SEQ ID NO: 4353058 - DNA, 23 bp, Homo sapiens
gtcaccagagcttctctgggctg

SEQ ID NO: 4353059 - DNA, 17 bp, Homo sapiens
gtcagtatctgtagcta

SEQ ID NO: 4353060 - DNA, 14 bp, Homo sapiens
gtcatcaccaccct

SEQ ID NO: 4353061 - DNA, 19 bp, Homo sapiens
gtccaaagaggctgcccct

SEQ ID NO: 4353062 - DNA, 20 bp, Homo sapiens
gtctccatgcacatgcacgc

SEQ ID NO: 4353063 - DNA, 22 bp, Homo sapiens
gtctgtgtaacatccaagccag

SEQ ID NO: 4353064 - DNA, 15 bp, Homo sapiens
gtcttagagcctttt

SEQ ID NO: 4353065 - DNA, 16 bp, Homo sapiens
gtgactttttttggta

SEQ ID NO: 4353066 - DNA, 12 bp, Homo sapiens
gtgcagaataat

SEQ ID NO: 4353067 - DNA, 18 bp, Homo sapiens
gtgcagaataatggaaac

SEQ ID NO: 4353068 - DNA, 19 bp, Homo sapiens
gtgcagaataatggaaaca

SEQ ID NO: 4353069 - DNA, 20 bp, Homo sapiens
gtgctataaatgccagagcc

SEQ ID NO: 4353070 - DNA, 21 bp, Homo sapiens
gtgctataaatgccagagcca

SEQ ID NO: 4353071 - DNA, 21 bp, Homo sapiens
gtgctttctgtgaaagcctta

SEQ ID NO: 4353072 - DNA, 21 bp, Homo sapiens
gtggcaatgcttaaactaaat

SEQ ID NO: 4353073 - DNA, 19 bp, Homo sapiens
gtggttattatttttgtca

SEQ ID NO: 4353074 - DNA, 19 bp, Homo sapiens
gtgtaacatccaagccaga

SEQ ID NO: 4353075 - DNA, 21 bp, Homo sapiens
gtgtaacatccaagccagagt

SEQ ID NO: 4353076 - DNA, 13 bp, Homo sapiens
gtgtatgcacagg

SEQ ID NO: 4353077 - DNA, 17 bp, Homo sapiens
gtgtggtatgagggggt

SEQ ID NO: 4353078 - DNA, 22 bp, Homo sapiens
gtgtgtctccatgcacatgcac

SEQ ID NO: 4353079 - DNA, 17 bp, Homo sapiens
gtgttgttgttgctgct

SEQ ID NO: 4353080 - DNA, 20 bp, Homo sapiens
gtgttgttgttgctgctgtt

SEQ ID NO: 4353081 - DNA, 12 bp, Homo sapiens
gttaaacagtag

SEQ ID NO: 4353082 - DNA, 23 bp, Homo sapiens
gttaaacagtagttgtattcttc

SEQ ID NO: 4353083 - DNA, 19 bp, Homo sapiens
gttaaatactgtgcagaat

SEQ ID NO: 4353084 - DNA, 19 bp, Homo sapiens
gttaacttggttctcagac

SEQ ID NO: 4353085 - DNA, 13 bp, Homo sapiens
gttaattcaccta

SEQ ID NO: 4353086 - DNA, 22 bp, Homo sapiens
gttatgatattgtttaaaattc

SEQ ID NO: 4353087 - DNA, 18 bp, Homo sapiens
gttattggactccaggcc

SEQ ID NO: 4353088 - DNA, 15 bp, Homo sapiens
gttcatattttatag

SEQ ID NO: 4353089 - DNA, 17 bp, Homo sapiens
gttctatattctttatt

SEQ ID NO: 4353090 - DNA, 14 bp, Homo sapiens
gttctcaaagttaa

SEQ ID NO: 4353091 - DNA, 16 bp, Homo sapiens
gttctgcagcggcaga

SEQ ID NO: 4353092 - DNA, 20 bp, Homo sapiens
gttctgcagcggcagagcaa

SEQ ID NO: 4353093 - DNA, 17 bp, Homo sapiens
gttctgctttatctttt

SEQ ID NO: 4353094 - DNA, 19 bp, Homo sapiens
gttgcagatgtattgactg

SEQ ID NO: 4353095 - DNA, 12 bp, Homo sapiens
gttgctgctgtt

SEQ ID NO: 4353096 - DNA, 13 bp, Homo sapiens
gttgtattcttct

SEQ ID NO: 4353097 - DNA, 14 bp, Homo sapiens
gttgttgctgctgt

SEQ ID NO: 4353098 - DNA, 23 bp, Homo sapiens
gtttaaaaagtaagttaataatg

SEQ ID NO: 4353099 - DNA, 10 bp, Homo sapiens
gtttaaaatt

SEQ ID NO: 4353100 - DNA, 20 bp, Homo sapiens
gtttaaaattcagtttttgt

SEQ ID NO: 4353101 - DNA, 19 bp, Homo sapiens
gtttaaagcatctgtaaat

SEQ ID NO: 4353102 - DNA, 16 bp, Homo sapiens
gtttataatctgaaga

SEQ ID NO: 4353103 - DNA, 19 bp, Homo sapiens
gtttataatctgaagatat

SEQ ID NO: 4353104 - DNA, 13 bp, Homo sapiens
gtttttgtatctt

SEQ ID NO: 4353105 - DNA, 22 bp, Homo sapiens
taaaacaattttttttttcctc

SEQ ID NO: 4353106 - DNA, 18 bp, Homo sapiens
taaaattcagtttttgta

SEQ ID NO: 4353107 - DNA, 20 bp, Homo sapiens
taaaattcagtttttgtatc

SEQ ID NO: 4353108 - DNA, 21 bp, Homo sapiens
taaacagtagttgtattcttc

SEQ ID NO: 4353109 - DNA, 18 bp, Homo sapiens
taaacctttcagtactct

SEQ ID NO: 4353110 - DNA, 14 bp, Homo sapiens
taaactaaataatg

SEQ ID NO: 4353111 - DNA, 18 bp, Homo sapiens
taaactaaataatgaata

SEQ ID NO: 4353112 - DNA, 13 bp, Homo sapiens
taaagccttctgg

SEQ ID NO: 4353113 - DNA, 12 bp, Homo sapiens
taaataaaactg

SEQ ID NO: 4353114 - DNA, 14 bp, Homo sapiens
taaataaaactgaa

SEQ ID NO: 4353115 - DNA, 15 bp, Homo sapiens
taaataaaactgaat

SEQ ID NO: 4353116 - DNA, 19 bp, Homo sapiens
taaataatgaataaactga

SEQ ID NO: 4353117 - DNA, 13 bp, Homo sapiens
taaatactgtgca

SEQ ID NO: 4353118 - DNA, 19 bp, Homo sapiens
taaatactgtgcagaataa

SEQ ID NO: 4353119 - DNA, 20 bp, Homo sapiens
taaatactgtgcagaataat

SEQ ID NO: 4353120 - DNA, 12 bp, Homo sapiens
taaatcatgtat

SEQ ID NO: 4353121 - DNA, 16 bp, Homo sapiens
taaatcatgtatgtta

SEQ ID NO: 4353122 - DNA, 12 bp, Homo sapiens
taaatgccagag

SEQ ID NO: 4353123 - DNA, 14 bp, Homo sapiens
taaatgccagagcc

SEQ ID NO: 4353124 - DNA, 20 bp, Homo sapiens
taaatgccagagccaacctg

SEQ ID NO: 4353125 - DNA, 22 bp, Homo sapiens
taaatgccagagccaacctgga

SEQ ID NO: 4353126 - DNA, 14 bp, Homo sapiens
taaatgtggttttt

SEQ ID NO: 4353127 - DNA, 22 bp, Homo sapiens
taaattcagacaacattatgat

SEQ ID NO: 4353128 - DNA, 13 bp, Homo sapiens
taaatttatcaac

SEQ ID NO: 4353129 - DNA, 15 bp, Homo sapiens
taaattttcagaatt

SEQ ID NO: 4353130 - DNA, 16 bp, Homo sapiens
taacatccaagccaga

SEQ ID NO: 4353131 - DNA, 17 bp, Homo sapiens
taacatccaagccagag

SEQ ID NO: 4353132 - DNA, 18 bp, Homo sapiens
taacatccaagccagagt

SEQ ID NO: 4353133 - DNA, 17 bp, Homo sapiens
taacttcaggtaaaaac

SEQ ID NO: 4353134 - DNA, 20 bp, Homo sapiens
taacttggttctcagactct

SEQ ID NO: 4353135 - DNA, 21 bp, Homo sapiens
taactttactctgtgtttaaa

SEQ ID NO: 4353136 - DNA, 17 bp, Homo sapiens
taacttttaaaagggaa

SEQ ID NO: 4353137 - DNA, 18 bp, Homo sapiens
taagatagaaagctggac

SEQ ID NO: 4353138 - DNA, 21 bp, Homo sapiens
taagatagaaagctggactga

SEQ ID NO: 4353139 - DNA, 17 bp, Homo sapiens
taagtgggtttttatga

SEQ ID NO: 4353140 - DNA, 19 bp, Homo sapiens
taataggtagtttggatat

SEQ ID NO: 4353141 - DNA, 20 bp, Homo sapiens
taatctgaagatatatttca

SEQ ID NO: 4353142 - DNA, 16 bp, Homo sapiens
taatgaataaactgaa

SEQ ID NO: 4353143 - DNA, 23 bp, Homo sapiens
taatgaataaactgaatattttg

SEQ ID NO: 4353144 - DNA, 17 bp, Homo sapiens
taatgtctcactgttct

SEQ ID NO: 4353145 - DNA, 19 bp, Homo sapiens
taatgtctcactgttctgc

SEQ ID NO: 4353146 - DNA, 21 bp, Homo sapiens
taatgtgctttatttgcaaat

SEQ ID NO: 4353147 - DNA, 15 bp, Homo sapiens
taattcacctatgtt

SEQ ID NO: 4353148 - DNA, 16 bp, Homo sapiens
taattcacctatgtta

SEQ ID NO: 4353149 - DNA, 17 bp, Homo sapiens
taattcacctatgttat

SEQ ID NO: 4353150 - DNA, 21 bp, Homo sapiens
taattttaccaagagtaactt

SEQ ID NO: 4353151 - DNA, 20 bp, Homo sapiens
tacaaaatacaatcctgttt

SEQ ID NO: 4353152 - DNA, 16 bp, Homo sapiens
tacaaagaaagcactt

SEQ ID NO: 4353153 - DNA, 16 bp, Homo sapiens
tacaagttgttattgt

SEQ ID NO: 4353154 - DNA, 16 bp, Homo sapiens
tacactgtataactgt

SEQ ID NO: 4353155 - DNA, 16 bp, Homo sapiens
tacagaataatccagt

SEQ ID NO: 4353156 - DNA, 15 bp, Homo sapiens
taccaagagtaactt

SEQ ID NO: 4353157 - DNA, 17 bp, Homo sapiens
taccaagagtaacttta

SEQ ID NO: 4353158 - DNA, 22 bp, Homo sapiens
taccagacaaaaaaatttaaaa

SEQ ID NO: 4353159 - DNA, 21 bp, Homo sapiens
tacctaatgtctcactgttct

SEQ ID NO: 4353160 - DNA, 22 bp, Homo sapiens
tacctaatgtctcactgttctg

SEQ ID NO: 4353161 - DNA, 12 bp, Homo sapiens
tacctcatatcc

SEQ ID NO: 4353162 - DNA, 17 bp, Homo sapiens
tacctgagactttcagt

SEQ ID NO: 4353163 - DNA, 17 bp, Homo sapiens
tacctttgtaaaacagc

SEQ ID NO: 4353164 - DNA, 12 bp, Homo sapiens
tacgtttgttat

SEQ ID NO: 4353165 - DNA, 12 bp, Homo sapiens
tactctcccaga

SEQ ID NO: 4353166 - DNA, 17 bp, Homo sapiens
tactgcttattttatga

SEQ ID NO: 4353167 - DNA, 13 bp, Homo sapiens
tactgtgcagaat

SEQ ID NO: 4353168 - DNA, 15 bp, Homo sapiens
tactgtgcagaataa

SEQ ID NO: 4353169 - DNA, 15 bp, Homo sapiens
tggacttcctgtcat

SEQ ID NO: 4353170 - DNA, 13 bp, Homo sapiens
tggattaaaacaa

SEQ ID NO: 4353171 - DNA, 13 bp, Homo sapiens
tggcagtgacttt

SEQ ID NO: 4353172 - DNA, 20 bp, Homo sapiens
tggccctcggaggtccagct

SEQ ID NO: 4353173 - DNA, 19 bp, Homo sapiens
tggctagagccgaggggag

SEQ ID NO: 4353174 - DNA, 19 bp, Homo sapiens
tggctcagagcttgaagat

SEQ ID NO: 4353175 - DNA, 20 bp, Homo sapiens
tggctcagagcttgaagatt

SEQ ID NO: 4353176 - DNA, 13 bp, Homo sapiens
tggctctcagagg

SEQ ID NO: 4353177 - DNA, 16 bp, Homo sapiens
tggctgctgcctgctc

SEQ ID NO: 4353178 - DNA, 19 bp, Homo sapiens
tggctggtgtatgcacagg

SEQ ID NO: 4353179 - DNA, 23 bp, Homo sapiens
tggctttttctgccactgaggag

SEQ ID NO: 4353180 - DNA, 11 bp, Homo sapiens
tgggagccagg

SEQ ID NO: 4353181 - DNA, 13 bp, Homo sapiens
tgggagccaggag

SEQ ID NO: 4353182 - DNA, 23 bp, Homo sapiens
tgggatactgcttattttatgat

SEQ ID NO: 4353183 - DNA, 14 bp, Homo sapiens
tgggccatgtccaa

SEQ ID NO: 4353184 - DNA, 19 bp, Homo sapiens
tgggccatgtccaaagagg

SEQ ID NO: 4353185 - DNA, 15 bp, Homo sapiens
tgggcttcattccgg

SEQ ID NO: 4353186 - DNA, 24 bp, Homo sapiens
tgggcttcattccggactggcaga

SEQ ID NO: 4353187 - DNA, 15 bp, Homo sapiens
tggggcaggctgggc

SEQ ID NO: 4353188 - DNA, 20 bp, Homo sapiens
tggggcaggctgggccatgt

SEQ ID NO: 4353189 - DNA, 14 bp, Homo sapiens
tggggcctcaagaa

SEQ ID NO: 4353190 - DNA, 17 bp, Homo sapiens
tggggctgatgaagaag

SEQ ID NO: 4353191 - DNA, 21 bp, Homo sapiens
tggtaaattcagacaacatta

SEQ ID NO: 4353192 - DNA, 21 bp, Homo sapiens
tggtagcataaataaaactga

SEQ ID NO: 4353193 - DNA, 22 bp, Homo sapiens
tggtataatgtttaaatcatgt

SEQ ID NO: 4353194 - DNA, 21 bp, Homo sapiens
tggtctgtgtaacatccaagc

SEQ ID NO: 4353195 - DNA, 13 bp, Homo sapiens
tggttattatttt

SEQ ID NO: 4353196 - DNA, 18 bp, Homo sapiens
tggttattatttttgtca

SEQ ID NO: 4353197 - DNA, 19 bp, Homo sapiens
tggttattctaagcccttt

SEQ ID NO: 4353198 - DNA, 14 bp, Homo sapiens
tggttattggactc

SEQ ID NO: 4353199 - DNA, 18 bp, Homo sapiens
tggttattggactccagg

SEQ ID NO: 4353200 - DNA, 16 bp, Homo sapiens
tgtaacatccaagcca

SEQ ID NO: 4353201 - DNA, 18 bp, Homo sapiens
tgtaacatccaagccaga

SEQ ID NO: 4353202 - DNA, 20 bp, Homo sapiens
tgtaatctttcatccaaaat

SEQ ID NO: 4353203 - DNA, 15 bp, Homo sapiens
tgtacaagttgttat

SEQ ID NO: 4353204 - DNA, 22 bp, Homo sapiens
tgtacaagttgttattgttgaa

SEQ ID NO: 4353205 - DNA, 23 bp, Homo sapiens
tgtacaagttgttattgttgaac

SEQ ID NO: 4353206 - DNA, 21 bp, Homo sapiens
tgtacatacattcatactgta

SEQ ID NO: 4353207 - DNA, 15 bp, Homo sapiens
tgtaccacagacaca

SEQ ID NO: 4353208 - DNA, 16 bp, Homo sapiens
tgtagaaaccagctca

SEQ ID NO: 4353209 - DNA, 15 bp, Homo sapiens
tgtataatgtgcttt

SEQ ID NO: 4353210 - DNA, 17 bp, Homo sapiens
tgtatatcattctacag

SEQ ID NO: 4353211 - DNA, 21 bp, Homo sapiens
tgtatatcattctacagaata

SEQ ID NO: 4353212 - DNA, 21 bp, Homo sapiens
tgtatgaaggaatcattccag

SEQ ID NO: 4353213 - DNA, 16 bp, Homo sapiens
tgtattgactgtacca

SEQ ID NO: 4353214 - DNA, 18 bp, Homo sapiens
tgtattttttaaaacact

SEQ ID NO: 4353215 - DNA, 22 bp, Homo sapiens
tgtcagtgctataaatgccaga

SEQ ID NO: 4353216 - DNA, 19 bp, Homo sapiens
tgtccaaagaggctgcccc

SEQ ID NO: 4353217 - DNA, 20 bp, Homo sapiens
tgtccaaagaggctgcccct

SEQ ID NO: 4353218 - DNA, 13 bp, Homo sapiens
tgtctcactgttc

SEQ ID NO: 4353219 - DNA, 18 bp, Homo sapiens
tgtctcactgttctgcaa

SEQ ID NO: 4353220 - DNA, 12 bp, Homo sapiens
tgtgactttttt

SEQ ID NO: 4353221 - DNA, 17 bp, Homo sapiens
tgtgactttttttggta

SEQ ID NO: 4353222 - DNA, 12 bp, Homo sapiens
tgtgcagaataa

SEQ ID NO: 4353223 - DNA, 20 bp, Homo sapiens
tgtggtttttgatgcctttt

SEQ ID NO: 4353224 - DNA, 15 bp, Homo sapiens
tgtgtaacatccaag

SEQ ID NO: 4353225 - DNA, 22 bp, Homo sapiens
tgtgtaacatccaagccagagt

SEQ ID NO: 4353226 - DNA, 16 bp, Homo sapiens
tgtgtataatgtgctt

SEQ ID NO: 4353227 - DNA, 12 bp, Homo sapiens
tgttaaatactg

SEQ ID NO: 4353228 - DNA, 15 bp, Homo sapiens
tgttaaatactgtgc

SEQ ID NO: 4353229 - DNA, 16 bp, Homo sapiens
tgttaaatactgtgca

SEQ ID NO: 4353230 - DNA, 18 bp, Homo sapiens
tgttaaatactgtgcaga

SEQ ID NO: 4353231 - DNA, 23 bp, Homo sapiens
tgttaacttggttctcagactct

SEQ ID NO: 4353232 - DNA, 15 bp, Homo sapiens
tgttatgatattgtt

SEQ ID NO: 4353233 - DNA, 18 bp, Homo sapiens
tgttatgatattgtttaa

SEQ ID NO: 4353234 - DNA, 17 bp, Homo sapiens
tgttatgtatgaaggaa

SEQ ID NO: 4353235 - DNA, 22 bp, Homo sapiens
tgttctgctttatcttttcata

SEQ ID NO: 4353236 - DNA, 14 bp, Homo sapiens
tgttggtctgtgta

SEQ ID NO: 4353237 - DNA, 16 bp, Homo sapiens
tgttgttgctgctgtt

SEQ ID NO: 4353238 - DNA, 16 bp, Homo sapiens
tgttgttgttgctgct

SEQ ID NO: 4353239 - DNA, 14 bp, Homo sapiens
tgtttaaatcatgt

SEQ ID NO: 4353240 - DNA, 14 bp, Homo sapiens
tgtttagagagcct

SEQ ID NO: 4353241 - DNA, 19 bp, Homo sapiens
tgtttagagagcctgtcac

SEQ ID NO: 4353242 - DNA, 23 bp, Homo sapiens
tgtttagagagcctgtcaccaga

SEQ ID NO: 4353243 - DNA, 16 bp, Homo sapiens
tgtttataatctgaag

SEQ ID NO: 4353244 - DNA, 19 bp, Homo sapiens
tgtttataatctgaagata

SEQ ID NO: 4353245 - DNA, 22 bp, Homo sapiens
tgtttgggttgttggtctgtgt

SEQ ID NO: 4353246 - DNA, 15 bp, Homo sapiens
ttaaaacactaaaag

SEQ ID NO: 4353247 - DNA, 21 bp, Homo sapiens
ttaaaattcagtttttgtatc

SEQ ID NO: 4353248 - DNA, 23 bp, Homo sapiens
ttaaaattcagtttttgtatctt

SEQ ID NO: 4353249 - DNA, 21 bp, Homo sapiens
ttaaacagtagttgtattctt

SEQ ID NO: 4353250 - DNA, 23 bp, Homo sapiens
ttaaacagtagttgtattcttct

SEQ ID NO: 4353251 - DNA, 20 bp, Homo sapiens
ttaaactaaataatgaataa

SEQ ID NO: 4353252 - DNA, 15 bp, Homo sapiens
ttaaagcatctgtaa

SEQ ID NO: 4353253 - DNA, 18 bp, Homo sapiens
ttaaatactgtgcagaat

SEQ ID NO: 4353254 - DNA, 16 bp, Homo sapiens
ttaaatcatgtatgtt

SEQ ID NO: 4353255 - DNA, 19 bp, Homo sapiens
ttaacttggttctcagact

SEQ ID NO: 4353256 - DNA, 16 bp, Homo sapiens
ttaagagaagaaatgt

SEQ ID NO: 4353257 - DNA, 18 bp, Homo sapiens
ttaatctgtgtgtatatt

SEQ ID NO: 4353258 - DNA, 20 bp, Homo sapiens
ttaatctgtgtgtatattga

SEQ ID NO: 4353259 - DNA, 21 bp, Homo sapiens
ttaattcttcacctgttatgt

SEQ ID NO: 4353260 - DNA, 23 bp, Homo sapiens
ttacaaccatactttatatatgt

SEQ ID NO: 4353261 - DNA, 19 bp, Homo sapiens
ttacactgcggaagccaaa

SEQ ID NO: 4353262 - DNA, 17 bp, Homo sapiens
ttaccaagagtaacttt

SEQ ID NO: 4353263 - DNA, 15 bp, Homo sapiens
ttaccagacaaaaaa

SEQ ID NO: 4353264 - DNA, 15 bp, Homo sapiens
ttagaaatttatatg

SEQ ID NO: 4353265 - DNA, 22 bp, Homo sapiens
ttagaagaaaataatttatatg

SEQ ID NO: 4353266 - DNA, 17 bp, Homo sapiens
ttagagagcctgtcacc

SEQ ID NO: 4353267 - DNA, 20 bp, Homo sapiens
ttagagagcctgtcaccaga

SEQ ID NO: 4353268 - DNA, 21 bp, Homo sapiens
ttagagagcctgtcaccagag

SEQ ID NO: 4353269 - DNA, 23 bp, Homo sapiens
ttagagagcctgtcaccagagct

SEQ ID NO: 4353270 - DNA, 12 bp, Homo sapiens
ttagtgaagatg

SEQ ID NO: 4353271 - DNA, 18 bp, Homo sapiens
ttataaataaaatcatgt

SEQ ID NO: 4353272 - DNA, 19 bp, Homo sapiens
ttatatatggacagcttta

SEQ ID NO: 4353273 - DNA, 12 bp, Homo sapiens
ttatatgcatgc

SEQ ID NO: 4353274 - DNA, 20 bp, Homo sapiens
ttatcaactgtcaaatatgt

SEQ ID NO: 4353275 - DNA, 12 bp, Homo sapiens
ttatcttttcat

SEQ ID NO: 4353276 - DNA, 19 bp, Homo sapiens
ttatgatattgtttaaaat

SEQ ID NO: 4353277 - DNA, 17 bp, Homo sapiens
ttatgatctaataaact

SEQ ID NO: 4353278 - DNA, 18 bp, Homo sapiens
ttatgatctaataaactt

SEQ ID NO: 4353279 - DNA, 19 bp, Homo sapiens
ttatgatctaataaacttt

SEQ ID NO: 4353280 - DNA, 18 bp, Homo sapiens
ttattaggatacaagctg

SEQ ID NO: 4353281 - DNA, 20 bp, Homo sapiens
ttattctaagccctttgcca

SEQ ID NO: 4353282 - DNA, 15 bp, Homo sapiens
ttattggactccagg

SEQ ID NO: 4353283 - DNA, 18 bp, Homo sapiens
ttattggactccaggcct

SEQ ID NO: 4353284 - DNA, 20 bp, Homo sapiens
ttattggactccaggcctga

SEQ ID NO: 4353285 - DNA, 12 bp, Homo sapiens
ttcaaaaataat

SEQ ID NO: 4353286 - DNA, 14 bp, Homo sapiens
ttcaataaaatggt

SEQ ID NO: 4353287 - DNA, 18 bp, Homo sapiens
ttcacctgttatgtatga

SEQ ID NO: 4353288 - DNA, 14 bp, Homo sapiens
ttcactaacctttt

SEQ ID NO: 4353289 - DNA, 21 bp, Homo sapiens
ttcagacaacattatgatcta

SEQ ID NO: 4353290 - DNA, 15 bp, Homo sapiens
ttcagtttttgtatc

SEQ ID NO: 4353291 - DNA, 16 bp, Homo sapiens
ttcagtttttgtatct

SEQ ID NO: 4353292 - DNA, 19 bp, Homo sapiens
ttcataaaacggtgctttc

SEQ ID NO: 4353293 - DNA, 21 bp, Homo sapiens
ttcataataggtagtttggat

SEQ ID NO: 4353294 - DNA, 23 bp, Homo sapiens
ttcatagggaaaggttttgtatt

SEQ ID NO: 4353295 - DNA, 20 bp, Homo sapiens
ttcatcctcctccccagctc

SEQ ID NO: 4353296 - DNA, 22 bp, Homo sapiens
ttcatcctcctccccagctctt

SEQ ID NO: 4353297 - DNA, 15 bp, Homo sapiens
ttccaggctgagcca

SEQ ID NO: 4353298 - DNA, 20 bp, Homo sapiens
aatcattccagtgctagaaa

SEQ ID NO: 4353299 - DNA, 13 bp, Homo sapiens
aatcatttgagat

SEQ ID NO: 4353300 - DNA, 15 bp, Homo sapiens
aatctgtgtgtatat

SEQ ID NO: 4353301 - DNA, 15 bp, Homo sapiens
aatcttggggctgat

SEQ ID NO: 4353302 - DNA, 23 bp, Homo sapiens
aatgaaaaatcaggcagaaatat

SEQ ID NO: 4353303 - DNA, 11 bp, Homo sapiens
aatgccagagc

SEQ ID NO: 4353304 - DNA, 15 bp, Homo sapiens
aatgcttaaactaaa

SEQ ID NO: 4353305 - DNA, 13 bp, Homo sapiens
aatgggagccagg

SEQ ID NO: 4353306 - DNA, 14 bp, Homo sapiens
aatgggagccagga

SEQ ID NO: 4353307 - DNA, 17 bp, Homo sapiens
aatgtatgtcagtgcta

SEQ ID NO: 4353308 - DNA, 15 bp, Homo sapiens
aatgtctcactgttc

SEQ ID NO: 4353309 - DNA, 19 bp, Homo sapiens
aatgtctcactgttctgca

SEQ ID NO: 4353310 - DNA, 15 bp, Homo sapiens
aatgtgtttgctgcc

SEQ ID NO: 4353311 - DNA, 16 bp, Homo sapiens
aatgtttaaatcatgt

SEQ ID NO: 4353312 - DNA, 20 bp, Homo sapiens
aatgtttaaatcatgtatgt

SEQ ID NO: 4353313 - DNA, 22 bp, Homo sapiens
aatgtttaaatcatgtatgtta

SEQ ID NO: 4353314 - DNA, 14 bp, Homo sapiens
aattaatgcattca

SEQ ID NO: 4353315 - DNA, 19 bp, Homo sapiens
aattacgtttgttattcct

SEQ ID NO: 4353316 - DNA, 14 bp, Homo sapiens
aattcacctatgtt

SEQ ID NO: 4353317 - DNA, 21 bp, Homo sapiens
aattcacctatgttattttgt

SEQ ID NO: 4353318 - DNA, 18 bp, Homo sapiens
aattcagacaacattatg

SEQ ID NO: 4353319 - DNA, 16 bp, Homo sapiens
aattcagattgtcttg

SEQ ID NO: 4353320 - DNA, 20 bp, Homo sapiens
aattcagtttttgtatcttg

SEQ ID NO: 4353321 - DNA, 17 bp, Homo sapiens
aattccaggctgagcca

SEQ ID NO: 4353322 - DNA, 14 bp, Homo sapiens
aattctatgttaaa

SEQ ID NO: 4353323 - DNA, 17 bp, Homo sapiens
aattctatgttaaatac

SEQ ID NO: 4353324 - DNA, 21 bp, Homo sapiens
aattctatgttaaatactgtg

SEQ ID NO: 4353325 - DNA, 15 bp, Homo sapiens
aattgcctgttcata

SEQ ID NO: 4353326 - DNA, 16 bp, Homo sapiens
aattggcagtgacttt

SEQ ID NO: 4353327 - DNA, 16 bp, Homo sapiens
aatttaaaattacgtt

SEQ ID NO: 4353328 - DNA, 12 bp, Homo sapiens
aatttcttttcc

SEQ ID NO: 4353329 - DNA, 23 bp, Homo sapiens
aatttcttttccttcattcatag

SEQ ID NO: 4353330 - DNA, 21 bp, Homo sapiens
aattttttttttcctcttcag

SEQ ID NO: 4353331 - DNA, 15 bp, Homo sapiens
acaaaggtggtaaat

SEQ ID NO: 4353332 - DNA, 17 bp, Homo sapiens
acaaaggtggtaaattc

SEQ ID NO: 4353333 - DNA, 20 bp, Homo sapiens
acaaaggtggtaaattcaga

SEQ ID NO: 4353334 - DNA, 15 bp, Homo sapiens
acaacattatgatct

SEQ ID NO: 4353335 - DNA, 17 bp, Homo sapiens
acaagttgttattgttg

SEQ ID NO: 4353336 - DNA, 21 bp, Homo sapiens
acaatcctgtttataatctga

SEQ ID NO: 4353337 - DNA, 17 bp, Homo sapiens
acaattttttttttcct

SEQ ID NO: 4353338 - DNA, 15 bp, Homo sapiens
acacaatatgtatgc

SEQ ID NO: 4353339 - DNA, 18 bp, Homo sapiens
acacaatatgtatgcttt

SEQ ID NO: 4353340 - DNA, 22 bp, Homo sapiens
acacaatatgtatgctttttac

SEQ ID NO: 4353341 - DNA, 21 bp, Homo sapiens
acacctcgcccttcagcccac

SEQ ID NO: 4353342 - DNA, 23 bp, Homo sapiens
acactaaaagcagcgtcactcta

SEQ ID NO: 4353343 - DNA, 16 bp, Homo sapiens
acactgcggaagccaa

SEQ ID NO: 4353344 - DNA, 16 bp, Homo sapiens
acacttcattctttat

SEQ ID NO: 4353345 - DNA, 13 bp, Homo sapiens
acagacctggctc

SEQ ID NO: 4353346 - DNA, 14 bp, Homo sapiens
acagacctggctct

SEQ ID NO: 4353347 - DNA, 19 bp, Homo sapiens
acagccatagacctacaga

SEQ ID NO: 4353348 - DNA, 19 bp, Homo sapiens
acagctaaatcatttgaga

SEQ ID NO: 4353349 - DNA, 20 bp, Homo sapiens
acagctttattttaaatgtg

SEQ ID NO: 4353350 - DNA, 15 bp, Homo sapiens
acaggaagatattgg

SEQ ID NO: 4353351 - DNA, 21 bp, Homo sapiens
acagggacttgtttagagagc

SEQ ID NO: 4353352 - DNA, 22 bp, Homo sapiens
acagggacttgtttagagagcc

SEQ ID NO: 4353353 - DNA, 23 bp, Homo sapiens
acagggacttgtttagagagcct

SEQ ID NO: 4353354 - DNA, 16 bp, Homo sapiens
acatacattcatactg

SEQ ID NO: 4353355 - DNA, 15 bp, Homo sapiens
acatccaagccagag

SEQ ID NO: 4353356 - DNA, 16 bp, Homo sapiens
acatccaagccagagt

SEQ ID NO: 4353357 - DNA, 14 bp, Homo sapiens
acatcgatatgtat

SEQ ID NO: 4353358 - DNA, 17 bp, Homo sapiens
acattacagttcataat

SEQ ID NO: 4353359 - DNA, 16 bp, Homo sapiens
acattatgatctaata

SEQ ID NO: 4353360 - DNA, 18 bp, Homo sapiens
acattatgatctaataaa

SEQ ID NO: 4353361 - DNA, 20 bp, Homo sapiens
acattatgatctaataaact

SEQ ID NO: 4353362 - DNA, 18 bp, Homo sapiens
accaaagactgcagaacc

SEQ ID NO: 4353363 - DNA, 18 bp, Homo sapiens
accacaccaaccaggcct

SEQ ID NO: 4353364 - DNA, 22 bp, Homo sapiens
accacagacacaatatgtatgc

SEQ ID NO: 4353365 - DNA, 21 bp, Homo sapiens
accagacaaaaaaatttaaaa

SEQ ID NO: 4353366 - DNA, 15 bp, Homo sapiens
accagagcttctctg

SEQ ID NO: 4353367 - DNA, 14 bp, Homo sapiens
accaggaaaggctt

SEQ ID NO: 4353368 - DNA, 19 bp, Homo sapiens
accaggccttcatcctcct

SEQ ID NO: 4353369 - DNA, 22 bp, Homo sapiens
accatggtcatcaccacccttc

SEQ ID NO: 4353370 - DNA, 18 bp, Homo sapiens
acccccaggtggcctgcg

SEQ ID NO: 4353371 - DNA, 23 bp, Homo sapiens
accgggttctgcagcggcagagc

SEQ ID NO: 4353372 - DNA, 14 bp, Homo sapiens
acctacagacctgg

SEQ ID NO: 4353373 - DNA, 23 bp, Homo sapiens
acctatgttattttgtgtacaag

SEQ ID NO: 4353374 - DNA, 18 bp, Homo sapiens
acctctggctagagccga

SEQ ID NO: 4353375 - DNA, 17 bp, Homo sapiens
acctggacttcctgtca

SEQ ID NO: 4353376 - DNA, 15 bp, Homo sapiens
acctgttatgtatga

SEQ ID NO: 4353377 - DNA, 16 bp, Homo sapiens
accttatcaggatggt

SEQ ID NO: 4353378 - DNA, 17 bp, Homo sapiens
acctttcagtactctta

SEQ ID NO: 4353379 - DNA, 22 bp, Homo sapiens
actaaataatgaataaactgaa

SEQ ID NO: 4353380 - DNA, 19 bp, Homo sapiens
actccaggcctgaccaggg

SEQ ID NO: 4353381 - DNA, 20 bp, Homo sapiens
actccaggcctgaccagggg

SEQ ID NO: 4353382 - DNA, 18 bp, Homo sapiens
actcctcaggagagaccc

SEQ ID NO: 4353383 - DNA, 21 bp, Homo sapiens
actctgctagactcctcagga

SEQ ID NO: 4353384 - DNA, 13 bp, Homo sapiens
actctgtgtttaa

SEQ ID NO: 4353385 - DNA, 22 bp, Homo sapiens
actcttattaggatacaagctg

SEQ ID NO: 4353386 - DNA, 17 bp, Homo sapiens
actgaatattttggaaa

SEQ ID NO: 4353387 - DNA, 18 bp, Homo sapiens
actgaatattttggaaac

SEQ ID NO: 4353388 - DNA, 20 bp, Homo sapiens
actgaccaaagactgcagaa

SEQ ID NO: 4353389 - DNA, 18 bp, Homo sapiens
actgaggagacagaaagc

SEQ ID NO: 4353390 - DNA, 21 bp, Homo sapiens
actgaggagacagaaagcctc

SEQ ID NO: 4353391 - DNA, 22 bp, Homo sapiens
actgaggagacagaaagcctcc

SEQ ID NO: 4353392 - DNA, 18 bp, Homo sapiens
actgcaaacttttttata

SEQ ID NO: 4353393 - DNA, 14 bp, Homo sapiens
actgcaagaactgt

SEQ ID NO: 4353394 - DNA, 19 bp, Homo sapiens
actgcagaacccccaggtg

SEQ ID NO: 4353395 - DNA, 21 bp, Homo sapiens
actgcagaacccccaggtggc

SEQ ID NO: 4353396 - DNA, 17 bp, Homo sapiens
actgcggaagccaaagg

SEQ ID NO: 4353397 - DNA, 15 bp, Homo sapiens
actgctaaattctat

SEQ ID NO: 4353398 - DNA, 21 bp, Homo sapiens
actgctaaattctatgttaaa

SEQ ID NO: 4353399 - DNA, 15 bp, Homo sapiens
actgtgcagaataat

SEQ ID NO: 4353400 - DNA, 16 bp, Homo sapiens
actgttgatgaagtat

SEQ ID NO: 4353401 - DNA, 23 bp, Homo sapiens
acttcaggtaaaaacttcattag

SEQ ID NO: 4353402 - DNA, 19 bp, Homo sapiens
acttcagttttatttttgc

SEQ ID NO: 4353403 - DNA, 15 bp, Homo sapiens
acttctaaacacttc

SEQ ID NO: 4353404 - DNA, 17 bp, Homo sapiens
acttctgacaaaggtgg

SEQ ID NO: 4353405 - DNA, 15 bp, Homo sapiens
acttcttattgaagt

SEQ ID NO: 4353406 - DNA, 12 bp, Homo sapiens
acttgatttgat

SEQ ID NO: 4353407 - DNA, 16 bp, Homo sapiens
acttgatttgatgtga

SEQ ID NO: 4353408 - DNA, 16 bp, Homo sapiens
acttgtcaggcatggc

SEQ ID NO: 4353409 - DNA, 15 bp, Homo sapiens
acttgtttagagagc

SEQ ID NO: 4353410 - DNA, 23 bp, Homo sapiens
acttgtttagagagcctgtcacc

SEQ ID NO: 4353411 - DNA, 15 bp, Homo sapiens
actttgttaacttca

SEQ ID NO: 4353412 - DNA, 19 bp, Homo sapiens
agaaactggattaaaacaa

SEQ ID NO: 4353413 - DNA, 13 bp, Homo sapiens
agaaagctggact

SEQ ID NO: 4353414 - DNA, 15 bp, Homo sapiens
agaaagctggactga

SEQ ID NO: 4353415 - DNA, 21 bp, Homo sapiens
agaaagctggactgaccaaag

SEQ ID NO: 4353416 - DNA, 14 bp, Homo sapiens
agaacccccaggtg

SEQ ID NO: 4353417 - DNA, 22 bp, Homo sapiens
agaactaaatataaattttcag

SEQ ID NO: 4353418 - DNA, 17 bp, Homo sapiens
agaagggggtgggggga

SEQ ID NO: 4353419 - DNA, 11 bp, Homo sapiens
agaagtgatat

SEQ ID NO: 4353420 - DNA, 17 bp, Homo sapiens
agaagtgatatggtgaa

SEQ ID NO: 4353421 - DNA, 22 bp, Homo sapiens
agaataatccagtattgctgat

SEQ ID NO: 4353422 - DNA, 13 bp, Homo sapiens
agaataatggaaa

SEQ ID NO: 4353423 - DNA, 15 bp, Homo sapiens
agaataatggaaaca

SEQ ID NO: 4353424 - DNA, 16 bp, Homo sapiens
agaataatggaaacat

SEQ ID NO: 4353425 - DNA, 17 bp, Homo sapiens
agaataatggaaacatt

SEQ ID NO: 4353426 - DNA, 23 bp, Homo sapiens
agaataatggaaacattacagtt

SEQ ID NO: 4353427 - DNA, 20 bp, Homo sapiens
agaatttaagtagaaaagtt

SEQ ID NO: 4353428 - DNA, 15 bp, Homo sapiens
attgcctggactgac

SEQ ID NO: 4353429 - DNA, 19 bp, Homo sapiens
attgcctggactgaccaca

SEQ ID NO: 4353430 - DNA, 16 bp, Homo sapiens
attgcctgttcataaa

SEQ ID NO: 4353431 - DNA, 14 bp, Homo sapiens
attggactccaggc

SEQ ID NO: 4353432 - DNA, 17 bp, Homo sapiens
attggcagtgactttgt

SEQ ID NO: 4353433 - DNA, 19 bp, Homo sapiens
attggcagtgactttgtat

SEQ ID NO: 4353434 - DNA, 17 bp, Homo sapiens
attgtcttgcaacttca

SEQ ID NO: 4353435 - DNA, 19 bp, Homo sapiens
attgtttaaaattcagttt

SEQ ID NO: 4353436 - DNA, 22 bp, Homo sapiens
atttaagtagaaaagttgcaga

SEQ ID NO: 4353437 - DNA, 14 bp, Homo sapiens
atttagccctttaa

SEQ ID NO: 4353438 - DNA, 18 bp, Homo sapiens
atttcacttttgttctgc

SEQ ID NO: 4353439 - DNA, 19 bp, Homo sapiens
atttcacttttgttctgct

SEQ ID NO: 4353440 - DNA, 15 bp, Homo sapiens
atttgatgtgacttt

SEQ ID NO: 4353441 - DNA, 14 bp, Homo sapiens
attttaaaggcaga

SEQ ID NO: 4353442 - DNA, 20 bp, Homo sapiens
attttaccaagagtaacttt

SEQ ID NO: 4353443 - DNA, 12 bp, Homo sapiens
attttggaaact

SEQ ID NO: 4353444 - DNA, 23 bp, Homo sapiens
attttggaaactgctaaattcta

SEQ ID NO: 4353445 - DNA, 23 bp, Homo sapiens
attttgtgtacaagttgttattg

SEQ ID NO: 4353446 - DNA, 23 bp, Homo sapiens
atttttatgttttgaaagacaga

SEQ ID NO: 4353447 - DNA, 21 bp, Homo sapiens
atttttgtacttgatttgatg

SEQ ID NO: 4353448 - DNA, 19 bp, Homo sapiens
atttttgtcacggaaagca

SEQ ID NO: 4353449 - DNA, 20 bp, Homo sapiens
atttttgtcacggaaagcat

SEQ ID NO: 4353450 - DNA, 16 bp, Homo sapiens
attttttaaaacacta

SEQ ID NO: 4353451 - DNA, 18 bp, Homo sapiens
caaaaaaatttaaaatta

SEQ ID NO: 4353452 - DNA, 20 bp, Homo sapiens
caaaaaaatttaaaattacg

SEQ ID NO: 4353453 - DNA, 12 bp, Homo sapiens
caaaaataatgt

SEQ ID NO: 4353454 - DNA, 16 bp, Homo sapiens
caaaagaagtttaaag

SEQ ID NO: 4353455 - DNA, 16 bp, Homo sapiens
caaaatacaatcctgt

SEQ ID NO: 4353456 - DNA, 22 bp, Homo sapiens
caaaatacaatcctgtttataa

SEQ ID NO: 4353457 - DNA, 20 bp, Homo sapiens
caaaatattttttgcaagtt

SEQ ID NO: 4353458 - DNA, 21 bp, Homo sapiens
caaaatattttttgcaagtta

SEQ ID NO: 4353459 - DNA, 19 bp, Homo sapiens
caaacttttttatatcttt

SEQ ID NO: 4353460 - DNA, 16 bp, Homo sapiens
caaagaggctgcccct

SEQ ID NO: 4353461 - DNA, 17 bp, Homo sapiens
caaaggtggcaatgctt

SEQ ID NO: 4353462 - DNA, 17 bp, Homo sapiens
caaatccaggactttgt

SEQ ID NO: 4353463 - DNA, 19 bp, Homo sapiens
caaatccaggactttgtta

SEQ ID NO: 4353464 - DNA, 18 bp, Homo sapiens
caacattatgatctaata

SEQ ID NO: 4353465 - DNA, 19 bp, Homo sapiens
caacattatgatctaataa

SEQ ID NO: 4353466 - DNA, 20 bp, Homo sapiens
caaccaggccttcatcctcc

SEQ ID NO: 4353467 - DNA, 21 bp, Homo sapiens
caaccaggccttcatcctcct

SEQ ID NO: 4353468 - DNA, 15 bp, Homo sapiens
caaccatactttata

SEQ ID NO: 4353469 - DNA, 13 bp, Homo sapiens
caacctggacttc

SEQ ID NO: 4353470 - DNA, 21 bp, Homo sapiens
caactgtcaaatatgttctgg

SEQ ID NO: 4353471 - DNA, 11 bp, Homo sapiens
caagccagagt

SEQ ID NO: 4353472 - DNA, 17 bp, Homo sapiens
caagccatttactttgc

SEQ ID NO: 4353473 - DNA, 16 bp, Homo sapiens
caagctgggaacttct

SEQ ID NO: 4353474 - DNA, 17 bp, Homo sapiens
caagctgggaacttcta

SEQ ID NO: 4353475 - DNA, 17 bp, Homo sapiens
caagggaaaggcaagct

SEQ ID NO: 4353476 - DNA, 23 bp, Homo sapiens
caagggaaaggcaagcttgaggc

SEQ ID NO: 4353477 - DNA, 18 bp, Homo sapiens
caagttgttattgttgaa

SEQ ID NO: 4353478 - DNA, 21 bp, Homo sapiens
caataataagtgatgtgctga

SEQ ID NO: 4353479 - DNA, 15 bp, Homo sapiens
caatatgtatgcttt

SEQ ID NO: 4353480 - DNA, 11 bp, Homo sapiens
caatgcttaaa

SEQ ID NO: 4353481 - DNA, 12 bp, Homo sapiens
caattccaggct

SEQ ID NO: 4353482 - DNA, 14 bp, Homo sapiens
caattccaggctga

SEQ ID NO: 4353483 - DNA, 14 bp, Homo sapiens
caattttttcaaat

SEQ ID NO: 4353484 - DNA, 21 bp, Homo sapiens
caattttttttttcctcttca

SEQ ID NO: 4353485 - DNA, 16 bp, Homo sapiens
cacaatcttggggctg

SEQ ID NO: 4353486 - DNA, 14 bp, Homo sapiens
cacacccatttaaa

SEQ ID NO: 4353487 - DNA, 19 bp, Homo sapiens
cacagacacaatatgtatg

SEQ ID NO: 4353488 - DNA, 17 bp, Homo sapiens
caccagagcttctctgg

SEQ ID NO: 4353489 - DNA, 22 bp, Homo sapiens
caccagagcttctctgggctga

SEQ ID NO: 4353490 - DNA, 13 bp, Homo sapiens
caccagctttatt

SEQ ID NO: 4353491 - DNA, 15 bp, Homo sapiens
cacccacagccatag

SEQ ID NO: 4353492 - DNA, 14 bp, Homo sapiens
cacccactccttta

SEQ ID NO: 4353493 - DNA, 21 bp, Homo sapiens
cacccttccagggcctgagca

SEQ ID NO: 4353494 - DNA, 20 bp, Homo sapiens
caccgggttctgcagcggca

SEQ ID NO: 4353495 - DNA, 13 bp, Homo sapiens
cacctatgttatt

SEQ ID NO: 4353496 - DNA, 16 bp, Homo sapiens
cacctatgttattttg

SEQ ID NO: 4353497 - DNA, 17 bp, Homo sapiens
cacctcgcccttcagcc

SEQ ID NO: 4353498 - DNA, 19 bp, Homo sapiens
cacctcgcccttcagccca

SEQ ID NO: 4353499 - DNA, 20 bp, Homo sapiens
cacctcgcccttcagcccac

SEQ ID NO: 4353500 - DNA, 14 bp, Homo sapiens
cactgtataactgt

SEQ ID NO: 4353501 - DNA, 18 bp, Homo sapiens
cactgtataactgttctt

SEQ ID NO: 4353502 - DNA, 22 bp, Homo sapiens
cactgtataactgttcttcaat

SEQ ID NO: 4353503 - DNA, 17 bp, Homo sapiens
cacttcattctttatat

SEQ ID NO: 4353504 - DNA, 18 bp, Homo sapiens
cagaacatcgatatgtat

SEQ ID NO: 4353505 - DNA, 19 bp, Homo sapiens
cagaacatcgatatgtata

SEQ ID NO: 4353506 - DNA, 22 bp, Homo sapiens
cagaacccccaggtggcctgcg

SEQ ID NO: 4353507 - DNA, 14 bp, Homo sapiens
cagaataatccagt

SEQ ID NO: 4353508 - DNA, 23 bp, Homo sapiens
cagaataatggaaacattacagt

SEQ ID NO: 4353509 - DNA, 14 bp, Homo sapiens
cagacaacattatg

SEQ ID NO: 4353510 - DNA, 18 bp, Homo sapiens
cagacaacattatgatct

SEQ ID NO: 4353511 - DNA, 21 bp, Homo sapiens
cagacagaaactggattaaaa

SEQ ID NO: 4353512 - DNA, 16 bp, Homo sapiens
cagaccaggaaaggct

SEQ ID NO: 4353513 - DNA, 21 bp, Homo sapiens
cagacctggctctcagaggaa

SEQ ID NO: 4353514 - DNA, 17 bp, Homo sapiens
cagagcaattccaggct

SEQ ID NO: 4353515 - DNA, 20 bp, Homo sapiens
cagagcaattccaggctgag

SEQ ID NO: 4353516 - DNA, 23 bp, Homo sapiens
cagagcaattccaggctgagcca

SEQ ID NO: 4353517 - DNA, 20 bp, Homo sapiens
cagagccaacctggacttcc

SEQ ID NO: 4353518 - DNA, 22 bp, Homo sapiens
cagagccaacctggacttcctg

SEQ ID NO: 4353519 - DNA, 15 bp, Homo sapiens
cagagctgttataaa

SEQ ID NO: 4353520 - DNA, 18 bp, Homo sapiens
cagagctgttataaattt

SEQ ID NO: 4353521 - DNA, 22 bp, Homo sapiens
cagagtttttaaagccttctgg

SEQ ID NO: 4353522 - DNA, 18 bp, Homo sapiens
cagattgtcttgcaactt

SEQ ID NO: 4353523 - DNA, 23 bp, Homo sapiens
cagccatagacctacagacctgg

SEQ ID NO: 4353524 - DNA, 13 bp, Homo sapiens
cagcccaccaccc

SEQ ID NO: 4353525 - DNA, 17 bp, Homo sapiens
cagcccaccaccctggc

SEQ ID NO: 4353526 - DNA, 18 bp, Homo sapiens
cagcccaccaccctggca

SEQ ID NO: 4353527 - DNA, 19 bp, Homo sapiens
cagcccagctcctgaataa

SEQ ID NO: 4353528 - DNA, 13 bp, Homo sapiens
cagcggcagagca

SEQ ID NO: 4353529 - DNA, 18 bp, Homo sapiens
cagctaagatagaaagct

SEQ ID NO: 4353530 - DNA, 23 bp, Homo sapiens
cagctaagatagaaagctggact

SEQ ID NO: 4353531 - DNA, 16 bp, Homo sapiens
cagctgggcctcctgc

SEQ ID NO: 4353532 - DNA, 21 bp, Homo sapiens
cagctgggcctcctgcctccg

SEQ ID NO: 4353533 - DNA, 14 bp, Homo sapiens
caggagagacccct

SEQ ID NO: 4353534 - DNA, 20 bp, Homo sapiens
caggagagacccctcccctc

SEQ ID NO: 4353535 - DNA, 22 bp, Homo sapiens
caggagtaagacaagtgggatt

SEQ ID NO: 4353536 - DNA, 23 bp, Homo sapiens
caggcaaggtttacactgcggaa

SEQ ID NO: 4353537 - DNA, 18 bp, Homo sapiens
caggcctgaccagggggc

SEQ ID NO: 4353538 - DNA, 16 bp, Homo sapiens
caggccttcatcctcc

SEQ ID NO: 4353539 - DNA, 22 bp, Homo sapiens
caggccttcatcctcctcccca

SEQ ID NO: 4353540 - DNA, 12 bp, Homo sapiens
caggctgagcca

SEQ ID NO: 4353541 - DNA, 13 bp, Homo sapiens
caggctgagccat

SEQ ID NO: 4353542 - DNA, 19 bp, Homo sapiens
caggctgagccatgaggag

SEQ ID NO: 4353543 - DNA, 20 bp, Homo sapiens
caggctgagccatgaggagc

SEQ ID NO: 4353544 - DNA, 23 bp, Homo sapiens
caggctgcacctctggctagagc

SEQ ID NO: 4353545 - DNA, 12 bp, Homo sapiens
caggctgggcca

SEQ ID NO: 4353546 - DNA, 13 bp, Homo sapiens
caggctgggccat

SEQ ID NO: 4353547 - DNA, 17 bp, Homo sapiens
caggctgggccatgtcc

SEQ ID NO: 4353548 - DNA, 23 bp, Homo sapiens
caggctgggccatgtccaaagag

SEQ ID NO: 4353549 - DNA, 22 bp, Homo sapiens
cagggacttgtttagagagcct

SEQ ID NO: 4353550 - DNA, 16 bp, Homo sapiens
cagggcctgagcagct

SEQ ID NO: 4353551 - DNA, 17 bp, Homo sapiens
cagggcctgagcagctg

SEQ ID NO: 4353552 - DNA, 22 bp, Homo sapiens
cagggggcccgaacagggactt

SEQ ID NO: 4353553 - DNA, 13 bp, Homo sapiens
cagtattgctgat

SEQ ID NO: 4353554 - DNA, 11 bp, Homo sapiens
cagtgactttg

SEQ ID NO: 4353555 - DNA, 20 bp, Homo sapiens
cagtgctataaatgccagag

SEQ ID NO: 4353556 - DNA, 21 bp, Homo sapiens
cagtgctataaatgccagagc

SEQ ID NO: 4353557 - DNA, 19 bp, Homo sapiens
cttttcccctgttaaacag

SEQ ID NO: 4353558 - DNA, 21 bp, Homo sapiens
cttttcccctgttaaacagta

SEQ ID NO: 4353559 - DNA, 20 bp, Homo sapiens
gaaaagttgcagatgtattg

SEQ ID NO: 4353560 - DNA, 19 bp, Homo sapiens
gaaaatgtgtttgctgcct

SEQ ID NO: 4353561 - DNA, 18 bp, Homo sapiens
gaaaatttagccctttaa

SEQ ID NO: 4353562 - DNA, 22 bp, Homo sapiens
gaaaatttagccctttaaaacg

SEQ ID NO: 4353563 - DNA, 16 bp, Homo sapiens
gaaacattacagttca

SEQ ID NO: 4353564 - DNA, 17 bp, Homo sapiens
gaaactggattaaaaca

SEQ ID NO: 4353565 - DNA, 19 bp, Homo sapiens
gaaagcctccgctgggctt

SEQ ID NO: 4353566 - DNA, 15 bp, Homo sapiens
gaaagctggactgac

SEQ ID NO: 4353567 - DNA, 17 bp, Homo sapiens
gaaagctggactgacca

SEQ ID NO: 4353568 - DNA, 13 bp, Homo sapiens
gaaatgttataaa

SEQ ID NO: 4353569 - DNA, 17 bp, Homo sapiens
gaaatttatatgtcaga

SEQ ID NO: 4353570 - DNA, 22 bp, Homo sapiens
gaacagggacttgtttagagag

SEQ ID NO: 4353571 - DNA, 21 bp, Homo sapiens
gaacatacttcaaaaataatg

SEQ ID NO: 4353572 - DNA, 12 bp, Homo sapiens
gaacccccaggt

SEQ ID NO: 4353573 - DNA, 19 bp, Homo sapiens
gaactaaatataaattttc

SEQ ID NO: 4353574 - DNA, 22 bp, Homo sapiens
gaactaaatataaattttcaga

SEQ ID NO: 4353575 - DNA, 19 bp, Homo sapiens
gaagattaggagaaacaca

SEQ ID NO: 4353576 - DNA, 20 bp, Homo sapiens
gaagattaggagaaacacat

SEQ ID NO: 4353577 - DNA, 17 bp, Homo sapiens
gaagcattgcctggact

SEQ ID NO: 4353578 - DNA, 20 bp, Homo sapiens
gaagcattgcctggactgac

SEQ ID NO: 4353579 - DNA, 20 bp, Homo sapiens
gaaggaatcattccagtgct

SEQ ID NO: 4353580 - DNA, 13 bp, Homo sapiens
gaagggaagtggg

SEQ ID NO: 4353581 - DNA, 16 bp, Homo sapiens
gaagggggtgggggga

SEQ ID NO: 4353582 - DNA, 20 bp, Homo sapiens
gaagttctcaaagttaattc

SEQ ID NO: 4353583 - DNA, 14 bp, Homo sapiens
gaataaactgaata

SEQ ID NO: 4353584 - DNA, 19 bp, Homo sapiens
gaatattttggaaactgct

SEQ ID NO: 4353585 - DNA, 20 bp, Homo sapiens
gaatattttggaaactgcta

SEQ ID NO: 4353586 - DNA, 15 bp, Homo sapiens
gaatcccttaaaatt

SEQ ID NO: 4353587 - DNA, 16 bp, Homo sapiens
gaatcccttaaaatta

SEQ ID NO: 4353588 - DNA, 17 bp, Homo sapiens
gaattagagtggaataa

SEQ ID NO: 4353589 - DNA, 22 bp, Homo sapiens
gaatttcttttccttcattcat

SEQ ID NO: 4353590 - DNA, 18 bp, Homo sapiens
gacaaaggtggtaaattc

SEQ ID NO: 4353591 - DNA, 19 bp, Homo sapiens
gacaacattatgatctaat

SEQ ID NO: 4353592 - DNA, 23 bp, Homo sapiens
gacaacattatgatctaataaac

SEQ ID NO: 4353593 - DNA, 14 bp, Homo sapiens
gacagaaactggat

SEQ ID NO: 4353594 - DNA, 22 bp, Homo sapiens
gacagaaagcctccgctgggct

SEQ ID NO: 4353595 - DNA, 16 bp, Homo sapiens
gaccaaagactgcaga

SEQ ID NO: 4353596 - DNA, 17 bp, Homo sapiens
gaccaaagactgcagaa

SEQ ID NO: 4353597 - DNA, 19 bp, Homo sapiens
gaccacaccaaccaggcct

SEQ ID NO: 4353598 - DNA, 23 bp, Homo sapiens
gacccctcccctcccacccacag

SEQ ID NO: 4353599 - DNA, 21 bp, Homo sapiens
gactcaagggaaaggcaagct

SEQ ID NO: 4353600 - DNA, 12 bp, Homo sapiens
gactccaggcct

SEQ ID NO: 4353601 - DNA, 16 bp, Homo sapiens
gactccaggcctgacc

SEQ ID NO: 4353602 - DNA, 17 bp, Homo sapiens
gactccaggcctgacca

SEQ ID NO: 4353603 - DNA, 19 bp, Homo sapiens
gactcctcaggagagaccc

SEQ ID NO: 4353604 - DNA, 14 bp, Homo sapiens
gactgaccaaagac

SEQ ID NO: 4353605 - DNA, 19 bp, Homo sapiens
gactgaccaaagactgcag

SEQ ID NO: 4353606 - DNA, 21 bp, Homo sapiens
gactgaccacaccaaccaggc

SEQ ID NO: 4353607 - DNA, 16 bp, Homo sapiens
gactgcaaactttttt

SEQ ID NO: 4353608 - DNA, 13 bp, Homo sapiens
gactgcagaaccc

SEQ ID NO: 4353609 - DNA, 20 bp, Homo sapiens
gactgcagaacccccaggtg

SEQ ID NO: 4353610 - DNA, 17 bp, Homo sapiens
gacttgtttagagagcc

SEQ ID NO: 4353611 - DNA, 19 bp, Homo sapiens
gagacccctcccctcccac

SEQ ID NO: 4353612 - DNA, 23 bp, Homo sapiens
gagagagggactcaagggaaagg

SEQ ID NO: 4353613 - DNA, 15 bp, Homo sapiens
gagagggactcaagg

SEQ ID NO: 4353614 - DNA, 20 bp, Homo sapiens
gagagggactcaagggaaag

SEQ ID NO: 4353615 - DNA, 16 bp, Homo sapiens
gagatggagaaataga

SEQ ID NO: 4353616 - DNA, 17 bp, Homo sapiens
gagcaattccaggctga

SEQ ID NO: 4353617 - DNA, 18 bp, Homo sapiens
gagcaattccaggctgag

SEQ ID NO: 4353618 - DNA, 13 bp, Homo sapiens
gagccaacctgga

SEQ ID NO: 4353619 - DNA, 18 bp, Homo sapiens
gagccaacctggacttcc

SEQ ID NO: 4353620 - DNA, 21 bp, Homo sapiens
gagccaacctggacttcctgt

SEQ ID NO: 4353621 - DNA, 11 bp, Homo sapiens
gagccaggagt

SEQ ID NO: 4353622 - DNA, 14 bp, Homo sapiens
gagccgaggggaga

SEQ ID NO: 4353623 - DNA, 17 bp, Homo sapiens
gagcctgtcaccagagc

SEQ ID NO: 4353624 - DNA, 18 bp, Homo sapiens
gagcctgtcaccagagct

SEQ ID NO: 4353625 - DNA, 24 bp, Homo sapiens
gagcctgtcaccagagcttctctg

SEQ ID NO: 4353626 - DNA, 20 bp, Homo sapiens
gagccttttatctgcagaac

SEQ ID NO: 4353627 - DNA, 13 bp, Homo sapiens
gagcttgaagatt

SEQ ID NO: 4353628 - DNA, 20 bp, Homo sapiens
gaggaaaaatgggagccagg

SEQ ID NO: 4353629 - DNA, 23 bp, Homo sapiens
gaggaaaaatgggagccaggagt

SEQ ID NO: 4353630 - DNA, 16 bp, Homo sapiens
gaggagacagaaagcc

SEQ ID NO: 4353631 - DNA, 15 bp, Homo sapiens
gaggccaagatggct

SEQ ID NO: 4353632 - DNA, 20 bp, Homo sapiens
gaggccaagatggctgctgc

SEQ ID NO: 4353633 - DNA, 12 bp, Homo sapiens
gaggggagagag

SEQ ID NO: 4353634 - DNA, 19 bp, Homo sapiens
gaggggagagagggactca

SEQ ID NO: 4353635 - DNA, 16 bp, Homo sapiens
gaggtccagctgggcc

SEQ ID NO: 4353636 - DNA, 20 bp, Homo sapiens
gaggtccagctgggcctcct

SEQ ID NO: 4353637 - DNA, 17 bp, Homo sapiens
gagtaagacaagtggga

SEQ ID NO: 4353638 - DNA, 20 bp, Homo sapiens
gatactgcttattttatgat

SEQ ID NO: 4353639 - DNA, 18 bp, Homo sapiens
gatagaaagctggactga

SEQ ID NO: 4353640 - DNA, 23 bp, Homo sapiens
gatagccctgggtaccctgagcc

SEQ ID NO: 4353641 - DNA, 21 bp, Homo sapiens
gatattgtttaaaattcagtt

SEQ ID NO: 4353642 - DNA, 21 bp, Homo sapiens
gatatttttgtacttgatttg

SEQ ID NO: 4353643 - DNA, 16 bp, Homo sapiens
gatgaagaagggggtg

SEQ ID NO: 4353644 - DNA, 15 bp, Homo sapiens
gatgaagtatacttt

SEQ ID NO: 4353645 - DNA, 21 bp, Homo sapiens
gatggtggactacaaaataca

SEQ ID NO: 4353646 - DNA, 23 bp, Homo sapiens
gatgttaacttggttctcagact

SEQ ID NO: 4353647 - DNA, 14 bp, Homo sapiens
gattaaaacaattt

SEQ ID NO: 4353648 - DNA, 20 bp, Homo sapiens
gattaggagaaacacattct

SEQ ID NO: 4353649 - DNA, 16 bp, Homo sapiens
gattgtcttgcaactt

SEQ ID NO: 4353650 - DNA, 14 bp, Homo sapiens
gatttgatgtgact

SEQ ID NO: 4353651 - DNA, 15 bp, Homo sapiens
gatttgatgtgactt

SEQ ID NO: 4353652 - DNA, 22 bp, Homo sapiens
gcaaaaaactcttaatctgtgt

SEQ ID NO: 4353653 - DNA, 23 bp, Homo sapiens
gcaaaaaactcttaatctgtgtg

SEQ ID NO: 4353654 - DNA, 23 bp, Homo sapiens
gcaacttcagttttatttttgcc

SEQ ID NO: 4353655 - DNA, 15 bp, Homo sapiens
gcaagcttgaggcca

SEQ ID NO: 4353656 - DNA, 18 bp, Homo sapiens
gcaagcttgaggccaaga

SEQ ID NO: 4353657 - DNA, 19 bp, Homo sapiens
gcaaggtttacactgcgga

SEQ ID NO: 4353658 - DNA, 22 bp, Homo sapiens
gcaaggtttacactgcggaagc

SEQ ID NO: 4353659 - DNA, 17 bp, Homo sapiens
gcaatgcttaaactaaa

SEQ ID NO: 4353660 - DNA, 18 bp, Homo sapiens
gcaatgcttaaactaaat

SEQ ID NO: 4353661 - DNA, 16 bp, Homo sapiens
gcaattccaggctgag

SEQ ID NO: 4353662 - DNA, 22 bp, Homo sapiens
gcaattccaggctgagccatga

SEQ ID NO: 4353663 - DNA, 16 bp, Homo sapiens
gcacctctggctagag

SEQ ID NO: 4353664 - DNA, 19 bp, Homo sapiens
gcacctctggctagagccg

SEQ ID NO: 4353665 - DNA, 20 bp, Homo sapiens
gcagaaatatttagtatcta

SEQ ID NO: 4353666 - DNA, 19 bp, Homo sapiens
gcagaacccccaggtggcc

SEQ ID NO: 4353667 - DNA, 18 bp, Homo sapiens
gcagaagcattgcctgga

SEQ ID NO: 4353668 - DNA, 20 bp, Homo sapiens
gcagaagcattgcctggact

SEQ ID NO: 4353669 - DNA, 21 bp, Homo sapiens
gcagaagcattgcctggactg

SEQ ID NO: 4353670 - DNA, 22 bp, Homo sapiens
gcagaagcattgcctggactga

SEQ ID NO: 4353671 - DNA, 15 bp, Homo sapiens
gcagacagaaactgg

SEQ ID NO: 4353672 - DNA, 15 bp, Homo sapiens
gcagagaagttctca

SEQ ID NO: 4353673 - DNA, 17 bp, Homo sapiens
gcagagcaattccaggc

SEQ ID NO: 4353674 - DNA, 22 bp, Homo sapiens
gcagagcaattccaggctgagc

SEQ ID NO: 4353675 - DNA, 18 bp, Homo sapiens
gcagatgtattgactgta

SEQ ID NO: 4353676 - DNA, 19 bp, Homo sapiens
gcagcagagatggagaaat

SEQ ID NO: 4353677 - DNA, 14 bp, Homo sapiens
gcagcggcagagca

SEQ ID NO: 4353678 - DNA, 21 bp, Homo sapiens
gcagcggcagagcaattccag

SEQ ID NO: 4353679 - DNA, 22 bp, Homo sapiens
gcagctaagatagaaagctgga

SEQ ID NO: 4353680 - DNA, 19 bp, Homo sapiens
gcaggctgcacctctggct

SEQ ID NO: 4353681 - DNA, 12 bp, Homo sapiens
gcaggctgggcc

SEQ ID NO: 4353682 - DNA, 13 bp, Homo sapiens
gcaggctgggcca

SEQ ID NO: 4353683 - DNA, 15 bp, Homo sapiens
gcaggctgggccatg

SEQ ID NO: 4353684 - DNA, 12 bp, Homo sapiens
gcagtgactttg

SEQ ID NO: 4353685 - DNA, 14 bp, Homo sapiens
gcagtgactttgta

SEQ ID NO: 4353686 - DNA, 20 bp, Homo sapiens
tactgtgcagaataatggaa

SEQ ID NO: 4353687 - DNA, 23 bp, Homo sapiens
tactgtgcagaataatggaaaca

SEQ ID NO: 4353688 - DNA, 21 bp, Homo sapiens
tactttgcaagtgagatagct

SEQ ID NO: 4353689 - DNA, 17 bp, Homo sapiens
tacttttcccctgttaa

SEQ ID NO: 4353690 - DNA, 18 bp, Homo sapiens
tacttttcccctgttaaa

SEQ ID NO: 4353691 - DNA, 22 bp, Homo sapiens
tacttttcccctgttaaacagt

SEQ ID NO: 4353692 - DNA, 16 bp, Homo sapiens
tagaaaccagctcatg

SEQ ID NO: 4353693 - DNA, 12 bp, Homo sapiens
tagaaagctgga

SEQ ID NO: 4353694 - DNA, 14 bp, Homo sapiens
tagaaagctggact

SEQ ID NO: 4353695 - DNA, 15 bp, Homo sapiens
tagaaagctggactg

SEQ ID NO: 4353696 - DNA, 19 bp, Homo sapiens
tagaaagctggactgacca

SEQ ID NO: 4353697 - DNA, 20 bp, Homo sapiens
tagaactaaatataaatttt

SEQ ID NO: 4353698 - DNA, 14 bp, Homo sapiens
tagagagcctgtca

SEQ ID NO: 4353699 - DNA, 20 bp, Homo sapiens
tagagagcctgtcaccagag

SEQ ID NO: 4353700 - DNA, 23 bp, Homo sapiens
tagagagcctgtcaccagagctt

SEQ ID NO: 4353701 - DNA, 17 bp, Homo sapiens
tagagccgaggggagag

SEQ ID NO: 4353702 - DNA, 21 bp, Homo sapiens
tagagccgaggggagagaggg

SEQ ID NO: 4353703 - DNA, 14 bp, Homo sapiens
tagatctgcaggct

SEQ ID NO: 4353704 - DNA, 19 bp, Homo sapiens
tagatctgcaggctgcacc

SEQ ID NO: 4353705 - DNA, 18 bp, Homo sapiens
tagcagacagaaactgga

SEQ ID NO: 4353706 - DNA, 20 bp, Homo sapiens
tagcagacagaaactggatt

SEQ ID NO: 4353707 - DNA, 16 bp, Homo sapiens
tagcataaataaaact

SEQ ID NO: 4353708 - DNA, 17 bp, Homo sapiens
tagggaaaggttttgta

SEQ ID NO: 4353709 - DNA, 16 bp, Homo sapiens
taggtagtttggatat

SEQ ID NO: 4353710 - DNA, 14 bp, Homo sapiens
tagtggatgactgt

SEQ ID NO: 4353711 - DNA, 21 bp, Homo sapiens
tataaataaaatcatgtagtt

SEQ ID NO: 4353712 - DNA, 15 bp, Homo sapiens
tataaccatgttcta

SEQ ID NO: 4353713 - DNA, 23 bp, Homo sapiens
tataatgtgctttatttgcaaat

SEQ ID NO: 4353714 - DNA, 17 bp, Homo sapiens
tataatgtttaaatcat

SEQ ID NO: 4353715 - DNA, 19 bp, Homo sapiens
tataatgtttaaatcatgt

SEQ ID NO: 4353716 - DNA, 13 bp, Homo sapiens
tatactctcccag

SEQ ID NO: 4353717 - DNA, 14 bp, Homo sapiens
tatactctcccaga

SEQ ID NO: 4353718 - DNA, 22 bp, Homo sapiens
tatacttttcccctgttaaaca

SEQ ID NO: 4353719 - DNA, 23 bp, Homo sapiens
tatacttttcccctgttaaacag

SEQ ID NO: 4353720 - DNA, 16 bp, Homo sapiens
tatagatgatgatgtg

SEQ ID NO: 4353721 - DNA, 14 bp, Homo sapiens
tatatatgtacata

SEQ ID NO: 4353722 - DNA, 15 bp, Homo sapiens
tatatcaaatccagg

SEQ ID NO: 4353723 - DNA, 16 bp, Homo sapiens
tatatcattctacaga

SEQ ID NO: 4353724 - DNA, 14 bp, Homo sapiens
tatatcttttggtt

SEQ ID NO: 4353725 - DNA, 15 bp, Homo sapiens
tatatgcatgcacag

SEQ ID NO: 4353726 - DNA, 15 bp, Homo sapiens
tatattagtgaagat

SEQ ID NO: 4353727 - DNA, 16 bp, Homo sapiens
tatattagtgaagatg

SEQ ID NO: 4353728 - DNA, 22 bp, Homo sapiens
tatattagtgaagatggtttca

SEQ ID NO: 4353729 - DNA, 14 bp, Homo sapiens
tatattttgtgtat

SEQ ID NO: 4353730 - DNA, 16 bp, Homo sapiens
tatcaattggcagtga

SEQ ID NO: 4353731 - DNA, 18 bp, Homo sapiens
tatcattctacagaataa

SEQ ID NO: 4353732 - DNA, 19 bp, Homo sapiens
tatcttggggcaagactgc

SEQ ID NO: 4353733 - DNA, 13 bp, Homo sapiens
tatgatctaataa

SEQ ID NO: 4353734 - DNA, 15 bp, Homo sapiens
tatgatctaataaac

SEQ ID NO: 4353735 - DNA, 17 bp, Homo sapiens
tatgatctaataaactt

SEQ ID NO: 4353736 - DNA, 19 bp, Homo sapiens
tatgatctaataaacttta

SEQ ID NO: 4353737 - DNA, 23 bp, Homo sapiens
tatgtcagtgctataaatgccag

SEQ ID NO: 4353738 - DNA, 19 bp, Homo sapiens
tatgttaaatactgtgcag

SEQ ID NO: 4353739 - DNA, 21 bp, Homo sapiens
tatgttaaatactgtgcagaa

SEQ ID NO: 4353740 - DNA, 13 bp, Homo sapiens
tattaattcttca

SEQ ID NO: 4353741 - DNA, 14 bp, Homo sapiens
tattagtgaagatg

SEQ ID NO: 4353742 - DNA, 21 bp, Homo sapiens
tattagtgaagatggtttcaa

SEQ ID NO: 4353743 - DNA, 22 bp, Homo sapiens
tattcctttatacacagtggat

SEQ ID NO: 4353744 - DNA, 13 bp, Homo sapiens
tattctttattct

SEQ ID NO: 4353745 - DNA, 22 bp, Homo sapiens
tattgactgtaccacagacaca

SEQ ID NO: 4353746 - DNA, 17 bp, Homo sapiens
tattggactccaggcct

SEQ ID NO: 4353747 - DNA, 12 bp, Homo sapiens
tattgtttaaaa

SEQ ID NO: 4353748 - DNA, 16 bp, Homo sapiens
tattgtttaaaattca

SEQ ID NO: 4353749 - DNA, 19 bp, Homo sapiens
tatttatgcactgtgggat

SEQ ID NO: 4353750 - DNA, 12 bp, Homo sapiens
tattttggaaac

SEQ ID NO: 4353751 - DNA, 15 bp, Homo sapiens
tattttggaaactgc

SEQ ID NO: 4353752 - DNA, 15 bp, Homo sapiens
tattttgtgtacaag

SEQ ID NO: 4353753 - DNA, 17 bp, Homo sapiens
tattttgtgtacaagtt

SEQ ID NO: 4353754 - DNA, 16 bp, Homo sapiens
tattttttaaaaatga

SEQ ID NO: 4353755 - DNA, 15 bp, Homo sapiens
tcaaatatgttctgg

SEQ ID NO: 4353756 - DNA, 13 bp, Homo sapiens
tcaaccaccattt

SEQ ID NO: 4353757 - DNA, 21 bp, Homo sapiens
tcaactgtcaaatatgttctg

SEQ ID NO: 4353758 - DNA, 18 bp, Homo sapiens
tcaattcagattgtcttg

SEQ ID NO: 4353759 - DNA, 19 bp, Homo sapiens
tcaattggcagtgactttg

SEQ ID NO: 4353760 - DNA, 17 bp, Homo sapiens
tcacaatcttggggctg

SEQ ID NO: 4353761 - DNA, 21 bp, Homo sapiens
tcacaatcttggggctgatga

SEQ ID NO: 4353762 - DNA, 14 bp, Homo sapiens
tcaccacccttcca

SEQ ID NO: 4353763 - DNA, 16 bp, Homo sapiens
tcaccagagcttctct

SEQ ID NO: 4353764 - DNA, 14 bp, Homo sapiens
tcacttttgttctg

SEQ ID NO: 4353765 - DNA, 15 bp, Homo sapiens
tcacttttgttctgc

SEQ ID NO: 4353766 - DNA, 16 bp, Homo sapiens
tcacttttgttctgct

SEQ ID NO: 4353767 - DNA, 17 bp, Homo sapiens
tcacttttgttctgctt

SEQ ID NO: 4353768 - DNA, 19 bp, Homo sapiens
tcacttttgttctgcttta

SEQ ID NO: 4353769 - DNA, 15 bp, Homo sapiens
tcagacaacattatg

SEQ ID NO: 4353770 - DNA, 20 bp, Homo sapiens
tcagacaacattatgatcta

SEQ ID NO: 4353771 - DNA, 22 bp, Homo sapiens
tcagacaacattatgatctaat

SEQ ID NO: 4353772 - DNA, 14 bp, Homo sapiens
tcagattgtcttgc

SEQ ID NO: 4353773 - DNA, 18 bp, Homo sapiens
tcagattgtcttgcaact

SEQ ID NO: 4353774 - DNA, 17 bp, Homo sapiens
tcaggcatggctcagag

SEQ ID NO: 4353775 - DNA, 21 bp, Homo sapiens
tcagtgctataaatgccagag

SEQ ID NO: 4353776 - DNA, 22 bp, Homo sapiens
tcagtgctataaatgccagagc

SEQ ID NO: 4353777 - DNA, 21 bp, Homo sapiens
tcataaaacggtgctttctgt

SEQ ID NO: 4353778 - DNA, 21 bp, Homo sapiens
tcataataggtagtttggata

SEQ ID NO: 4353779 - DNA, 14 bp, Homo sapiens
tcatacaagccatt

SEQ ID NO: 4353780 - DNA, 13 bp, Homo sapiens
tcatattttatag

SEQ ID NO: 4353781 - DNA, 19 bp, Homo sapiens
tcatccaaaatattttttg

SEQ ID NO: 4353782 - DNA, 16 bp, Homo sapiens
tcatcctcctccccag

SEQ ID NO: 4353783 - DNA, 11 bp, Homo sapiens
tcatgtgtacc

SEQ ID NO: 4353784 - DNA, 22 bp, Homo sapiens
tcattctacagaataatccagt

SEQ ID NO: 4353785 - DNA, 13 bp, Homo sapiens
tccaaagaggctg

SEQ ID NO: 4353786 - DNA, 15 bp, Homo sapiens
tccaaagaggctgcc

SEQ ID NO: 4353787 - DNA, 12 bp, Homo sapiens
tccaagccagag

SEQ ID NO: 4353788 - DNA, 20 bp, Homo sapiens
tccagctgggcctcctgcct

SEQ ID NO: 4353789 - DNA, 21 bp, Homo sapiens
tccagctgggcctcctgcctc

SEQ ID NO: 4353790 - DNA, 13 bp, Homo sapiens
tccaggcctgacc

SEQ ID NO: 4353791 - DNA, 14 bp, Homo sapiens
tccaggcctgacca

SEQ ID NO: 4353792 - DNA, 17 bp, Homo sapiens
tccaggctgagccatga

SEQ ID NO: 4353793 - DNA, 18 bp, Homo sapiens
tccaggctgagccatgag

SEQ ID NO: 4353794 - DNA, 13 bp, Homo sapiens
tccagtattgctg

SEQ ID NO: 4353795 - DNA, 15 bp, Homo sapiens
tccatgcacatgcac

SEQ ID NO: 4353796 - DNA, 15 bp, Homo sapiens
tccatggggggagaa

SEQ ID NO: 4353797 - DNA, 13 bp, Homo sapiens
tcccatctggctt

SEQ ID NO: 4353798 - DNA, 21 bp, Homo sapiens
tcccatctggctttttctgcc

SEQ ID NO: 4353799 - DNA, 17 bp, Homo sapiens
tcccctcccacccacag

SEQ ID NO: 4353800 - DNA, 17 bp, Homo sapiens
tcccttcccagaccagg

SEQ ID NO: 4353801 - DNA, 19 bp, Homo sapiens
tcccttcccagaccaggaa

SEQ ID NO: 4353802 - DNA, 18 bp, Homo sapiens
tcctagatctgcaggctg

SEQ ID NO: 4353803 - DNA, 22 bp, Homo sapiens
tcctagtggatgactgttgatg

SEQ ID NO: 4353804 - DNA, 13 bp, Homo sapiens
tcctccccagctc

SEQ ID NO: 4353805 - DNA, 19 bp, Homo sapiens
tcctccccagctcttctct

SEQ ID NO: 4353806 - DNA, 15 bp, Homo sapiens
tcctcctccccagct

SEQ ID NO: 4353807 - DNA, 16 bp, Homo sapiens
tcctctgctgccattt

SEQ ID NO: 4353808 - DNA, 11 bp, Homo sapiens
tcctcttcaga

SEQ ID NO: 4353809 - DNA, 11 bp, Homo sapiens
tcctgaataaa

SEQ ID NO: 4353810 - DNA, 21 bp, Homo sapiens
tcctgcatttgatagcaatgt

SEQ ID NO: 4353811 - DNA, 14 bp, Homo sapiens
tcctgcctccgggc

SEQ ID NO: 4353812 - DNA, 17 bp, Homo sapiens
tcctgtttataatctga

SEQ ID NO: 4353813 - DNA, 22 bp, Homo sapiens
tcctgtttataatctgaagata

SEQ ID NO: 4353814 - DNA, 15 bp, Homo sapiens
tccttcattcatagg

SEQ ID NO: 4353815 - DNA, 19 bp, Homo sapiens
tcctttacaaccatacttt

SEQ ID NO: 4353816 - DNA, 15 bp, Homo sapiens
tcgcccttcagccca

SEQ ID NO: 4353817 - DNA, 21 bp, Homo sapiens
ttccatagtgttaactgtcag

SEQ ID NO: 4353818 - DNA, 11 bp, Homo sapiens
ttcccagacca

SEQ ID NO: 4353819 - DNA, 18 bp, Homo sapiens
ttcccatctggctttttc

SEQ ID NO: 4353820 - DNA, 18 bp, Homo sapiens
ttccctaacttgtgaaga

SEQ ID NO: 4353821 - DNA, 19 bp, Homo sapiens
ttccctaacttgtgaagac

SEQ ID NO: 4353822 - DNA, 18 bp, Homo sapiens
ttcccttcccagaccagg

SEQ ID NO: 4353823 - DNA, 22 bp, Homo sapiens
ttcctagatctgcaggctgcac

SEQ ID NO: 4353824 - DNA, 21 bp, Homo sapiens
ttcctagtggatgactgttga

SEQ ID NO: 4353825 - DNA, 16 bp, Homo sapiens
ttcgccaatctcatac

SEQ ID NO: 4353826 - DNA, 21 bp, Homo sapiens
ttcgccaatctcatacaagcc

SEQ ID NO: 4353827 - DNA, 14 bp, Homo sapiens
ttctacagaataat

SEQ ID NO: 4353828 - DNA, 16 bp, Homo sapiens
ttctatgttaaatact

SEQ ID NO: 4353829 - DNA, 18 bp, Homo sapiens
ttctatgttaaatactgt

SEQ ID NO: 4353830 - DNA, 19 bp, Homo sapiens
ttctattgccatgaaccat

SEQ ID NO: 4353831 - DNA, 22 bp, Homo sapiens
ttctcaaagttaattcacctat

SEQ ID NO: 4353832 - DNA, 12 bp, Homo sapiens
ttctcagactct

SEQ ID NO: 4353833 - DNA, 16 bp, Homo sapiens
ttctgccactgaggag

SEQ ID NO: 4353834 - DNA, 17 bp, Homo sapiens
ttctgctttatcttttc

SEQ ID NO: 4353835 - DNA, 17 bp, Homo sapiens
ttctggggcaggctggg

SEQ ID NO: 4353836 - DNA, 19 bp, Homo sapiens
ttctggggcaggctgggcc

SEQ ID NO: 4353837 - DNA, 21 bp, Homo sapiens
ttctggggcaggctgggccat

SEQ ID NO: 4353838 - DNA, 21 bp, Homo sapiens
ttcttattaattcttcacctg

SEQ ID NO: 4353839 - DNA, 22 bp, Homo sapiens
ttcttattaattcttcacctgt

SEQ ID NO: 4353840 - DNA, 21 bp, Homo sapiens
ttgaggccaagatggctgctg

SEQ ID NO: 4353841 - DNA, 21 bp, Homo sapiens
ttgatgtgactttttttggta

SEQ ID NO: 4353842 - DNA, 15 bp, Homo sapiens
ttgcagatgtattga

SEQ ID NO: 4353843 - DNA, 20 bp, Homo sapiens
ttgcagatgtattgactgta

SEQ ID NO: 4353844 - DNA, 23 bp, Homo sapiens
ttgcctggactgaccacaccaac

SEQ ID NO: 4353845 - DNA, 14 bp, Homo sapiens
ttgctcctagcaga

SEQ ID NO: 4353846 - DNA, 11 bp, Homo sapiens
ttgctgctgtt

SEQ ID NO: 4353847 - DNA, 13 bp, Homo sapiens
ttggactccaggc

SEQ ID NO: 4353848 - DNA, 14 bp, Homo sapiens
ttgggatactgctt

SEQ ID NO: 4353849 - DNA, 17 bp, Homo sapiens
ttgtggttattattttt

SEQ ID NO: 4353850 - DNA, 23 bp, Homo sapiens
ttgttaacttcaggtaaaaactt

SEQ ID NO: 4353851 - DNA, 13 bp, Homo sapiens
ttgttattcctag

SEQ ID NO: 4353852 - DNA, 16 bp, Homo sapiens
ttgttgaacatacttc

SEQ ID NO: 4353853 - DNA, 16 bp, Homo sapiens
ttgttgctgctgtttg

SEQ ID NO: 4353854 - DNA, 16 bp, Homo sapiens
ttgttgttgctgctgt

SEQ ID NO: 4353855 - DNA, 13 bp, Homo sapiens
tttaaaattcagt

SEQ ID NO: 4353856 - DNA, 13 bp, Homo sapiens
tttaaaggcagag

SEQ ID NO: 4353857 - DNA, 20 bp, Homo sapiens
tttaaatcatgtatgttatg

SEQ ID NO: 4353858 - DNA, 23 bp, Homo sapiens
tttaagtagaaaagttgcagatg

SEQ ID NO: 4353859 - DNA, 22 bp, Homo sapiens
tttacaaccatactttatatat

SEQ ID NO: 4353860 - DNA, 22 bp, Homo sapiens
tttacctagctggtagcataaa

SEQ ID NO: 4353861 - DNA, 15 bp, Homo sapiens
tttactctgtgttta

SEQ ID NO: 4353862 - DNA, 20 bp, Homo sapiens
tttataaataaaatcatgta

SEQ ID NO: 4353863 - DNA, 14 bp, Homo sapiens
tttataatctgaag

SEQ ID NO: 4353864 - DNA, 13 bp, Homo sapiens
tttatatatgtac

SEQ ID NO: 4353865 - DNA, 12 bp, Homo sapiens
tttatatctttt

SEQ ID NO: 4353866 - DNA, 16 bp, Homo sapiens
tttatcaactgtcaaa

SEQ ID NO: 4353867 - DNA, 15 bp, Homo sapiens
tttatctgcagaaca

SEQ ID NO: 4353868 - DNA, 21 bp, Homo sapiens
tttattttttaacatgaaagc

SEQ ID NO: 4353869 - DNA, 12 bp, Homo sapiens
tttcaattcaga

SEQ ID NO: 4353870 - DNA, 22 bp, Homo sapiens
tttcaattcagattgtcttgca

SEQ ID NO: 4353871 - DNA, 16 bp, Homo sapiens
tttcacttttgttctg

SEQ ID NO: 4353872 - DNA, 15 bp, Homo sapiens
tttcataaagggttg

SEQ ID NO: 4353873 - DNA, 13 bp, Homo sapiens
tttcccctgttaa

SEQ ID NO: 4353874 - DNA, 12 bp, Homo sapiens
tttctgtgaaag

SEQ ID NO: 4353875 - DNA, 16 bp, Homo sapiens
tttctgtgaaagcctt

SEQ ID NO: 4353876 - DNA, 14 bp, Homo sapiens
tttgaattagaaga

SEQ ID NO: 4353877 - DNA, 14 bp, Homo sapiens
tttgatgtgacttt

SEQ ID NO: 4353878 - DNA, 21 bp, Homo sapiens
tttgtattctacctttgtaaa

SEQ ID NO: 4353879 - DNA, 14 bp, Homo sapiens
tttgttattcctag

SEQ ID NO: 4353880 - DNA, 12 bp, Homo sapiens
ttttaaaaatga

SEQ ID NO: 4353881 - DNA, 14 bp, Homo sapiens
ttttaaaacactaa

SEQ ID NO: 4353882 - DNA, 19 bp, Homo sapiens
ttttaaaacactaaaagca

SEQ ID NO: 4353883 - DNA, 14 bp, Homo sapiens
ttttaaagccttct

SEQ ID NO: 4353884 - DNA, 22 bp, Homo sapiens
ttttaccgttggggcccttaac

SEQ ID NO: 4353885 - DNA, 19 bp, Homo sapiens
ttttctgccactgaggaga

SEQ ID NO: 4353886 - DNA, 13 bp, Homo sapiens
ttttggaaactgc

SEQ ID NO: 4353887 - DNA, 18 bp, Homo sapiens
ttttgtattttttaaaac

SEQ ID NO: 4353888 - DNA, 13 bp, Homo sapiens
tttttaaagcctt

SEQ ID NO: 4353889 - DNA, 21 bp, Homo sapiens
tttttaaagccttctggatcc

SEQ ID NO: 4353890 - DNA, 19 bp, Homo sapiens
tttttggtataatgtttaa

SEQ ID NO: 4353891 - DNA, 13 bp, Homo sapiens
ttttttggtataa

SEQ ID NO: 4353892 - DNA, 18 bp, Homo sapiens
tgaccagcactgtctcag

SEQ ID NO: 4353893 - DNA, 14 bp, Homo sapiens
tgacccacactgcc

SEQ ID NO: 4353894 - DNA, 14 bp, Homo sapiens
tgacccagcctgaa

SEQ ID NO: 4353895 - DNA, 17 bp, Homo sapiens
tgacctctgtgaccaac

SEQ ID NO: 4353896 - DNA, 12 bp, Homo sapiens
tgacctgtcacc

SEQ ID NO: 4353897 - DNA, 15 bp, Homo sapiens
tgacctgtgaccagc

SEQ ID NO: 4353898 - DNA, 18 bp, Homo sapiens
tgacgcttgtgacagtgc

SEQ ID NO: 4353899 - DNA, 19 bp, Homo sapiens
tgacgcttgtgacagtgcc

SEQ ID NO: 4353900 - DNA, 23 bp, Homo sapiens
tgactcaacatgttactgaccag

SEQ ID NO: 4353901 - DNA, 18 bp, Homo sapiens
tgactggaagttgtggat

SEQ ID NO: 4353902 - DNA, 15 bp, Homo sapiens
tgagaaatgaataat

SEQ ID NO: 4353903 - DNA, 14 bp, Homo sapiens
tgagatattaaaga

SEQ ID NO: 4353904 - DNA, 12 bp, Homo sapiens
tgagcagaacag

SEQ ID NO: 4353905 - DNA, 16 bp, Homo sapiens
tgagcagaacaggtag

SEQ ID NO: 4353906 - DNA, 14 bp, Homo sapiens
tgagcgccacctct

SEQ ID NO: 4353907 - DNA, 20 bp, Homo sapiens
tgagctggatagacttggga

SEQ ID NO: 4353908 - DNA, 21 bp, Homo sapiens
tgagctggatagacttgggat

SEQ ID NO: 4353909 - DNA, 10 bp, Homo sapiens
tgaggacaga

SEQ ID NO: 4353910 - DNA, 15 bp, Homo sapiens
tgaggacagaggccg

SEQ ID NO: 4353911 - DNA, 15 bp, Homo sapiens
tgaggagttgcctga

SEQ ID NO: 4353912 - DNA, 20 bp, Homo sapiens
tgaggagttgcctgactcct

SEQ ID NO: 4353913 - DNA, 18 bp, Homo sapiens
tgaggtctcttgagggag

SEQ ID NO: 4353914 - DNA, 16 bp, Homo sapiens
tgagtgacagctttct

SEQ ID NO: 4353915 - DNA, 20 bp, Homo sapiens
tgagtgacagctttctggga

SEQ ID NO: 4353916 - DNA, 14 bp, Homo sapiens
tgagtggataatca

SEQ ID NO: 4353917 - DNA, 15 bp, Homo sapiens
tgagtgggctgggcc

SEQ ID NO: 4353918 - DNA, 18 bp, Homo sapiens
tgagttgggggagggaag

SEQ ID NO: 4353919 - DNA, 23 bp, Homo sapiens
tgagttgggggagggaagaccag

SEQ ID NO: 4353920 - DNA, 18 bp, Homo sapiens
tgataaatcgggaaattt

SEQ ID NO: 4353921 - DNA, 14 bp, Homo sapiens
tgataatacttgac

SEQ ID NO: 4353922 - DNA, 18 bp, Homo sapiens
tgatattccatgaatgta

SEQ ID NO: 4353923 - DNA, 16 bp, Homo sapiens
tgatcaataaaatgtg

SEQ ID NO: 4353924 - DNA, 18 bp, Homo sapiens
tgatcaataaaatgtgat

SEQ ID NO: 4353925 - DNA, 18 bp, Homo sapiens
tgatgccacacagagtgg

SEQ ID NO: 4353926 - DNA, 16 bp, Homo sapiens
tgattaaaaatgcttt

SEQ ID NO: 4353927 - DNA, 18 bp, Homo sapiens
tgattgggaggtgcgtgt

SEQ ID NO: 4353928 - DNA, 16 bp, Homo sapiens
tgcaataatttgtaca

SEQ ID NO: 4353929 - DNA, 20 bp, Homo sapiens
tgcaatataagcataaaaga

SEQ ID NO: 4353930 - DNA, 13 bp, Homo sapiens
tgcacacaggaca

SEQ ID NO: 4353931 - DNA, 17 bp, Homo sapiens
tgcacacaggacagcgg

SEQ ID NO: 4353932 - DNA, 20 bp, Homo sapiens
tgcacaggcacacagggccc

SEQ ID NO: 4353933 - DNA, 13 bp, Homo sapiens
tgcacccacctgt

SEQ ID NO: 4353934 - DNA, 15 bp, Homo sapiens
tgcactgatgttgtg

SEQ ID NO: 4353935 - DNA, 21 bp, Homo sapiens
tgcactgatgttgtgttttta

SEQ ID NO: 4353936 - DNA, 21 bp, Homo sapiens
tgcactgtggtttcagatgtg

SEQ ID NO: 4353937 - DNA, 14 bp, Homo sapiens
tgcagacctcatgc

SEQ ID NO: 4353938 - DNA, 15 bp, Homo sapiens
tgcagacctcatgcc

SEQ ID NO: 4353939 - DNA, 18 bp, Homo sapiens
tgcagacctcatgcccag

SEQ ID NO: 4353940 - DNA, 22 bp, Homo sapiens
tgcagacctcatgcccagctct

SEQ ID NO: 4353941 - DNA, 13 bp, Homo sapiens
tgcagcatgacct

SEQ ID NO: 4353942 - DNA, 17 bp, Homo sapiens
tgcagcatgacctgtga

SEQ ID NO: 4353943 - DNA, 19 bp, Homo sapiens
tgcagcatgacctgtgacc

SEQ ID NO: 4353944 - DNA, 14 bp, Homo sapiens
tgcagccctctcca

SEQ ID NO: 4353945 - DNA, 13 bp, Homo sapiens
tgcaggaaatata

SEQ ID NO: 4353946 - DNA, 14 bp, Homo sapiens
tgcaggacattaat

SEQ ID NO: 4353947 - DNA, 13 bp, Homo sapiens
tgcaggaggtgga

SEQ ID NO: 4353948 - DNA, 14 bp, Homo sapiens
tgcaggaggtggag

SEQ ID NO: 4353949 - DNA, 16 bp, Homo sapiens
tgcagtagagtcatct

SEQ ID NO: 4353950 - DNA, 22 bp, Homo sapiens
tgcagtagagtcatctccatca

SEQ ID NO: 4353951 - DNA, 14 bp, Homo sapiens
tgcagtccagacag

SEQ ID NO: 4353952 - DNA, 13 bp, Homo sapiens
tgcagtgggcagt

SEQ ID NO: 4353953 - DNA, 15 bp, Homo sapiens
tgcagtgtggagttc

SEQ ID NO: 4353954 - DNA, 14 bp, Homo sapiens
tgcagtttggccct

SEQ ID NO: 4353955 - DNA, 15 bp, Homo sapiens
tgcagtttggccctg

SEQ ID NO: 4353956 - DNA, 19 bp, Homo sapiens
tgcagtttggccctggagc

SEQ ID NO: 4353957 - DNA, 20 bp, Homo sapiens
tgcagttttttggaagaaaa

SEQ ID NO: 4353958 - DNA, 22 bp, Homo sapiens
tgcatacggctatattggttta

SEQ ID NO: 4353959 - DNA, 21 bp, Homo sapiens
tgcatgtacttgaaggatgga

SEQ ID NO: 4353960 - DNA, 11 bp, Homo sapiens
tgcattgctgg

SEQ ID NO: 4353961 - DNA, 15 bp, Homo sapiens
tgcattgctggtaga

SEQ ID NO: 4353962 - DNA, 16 bp, Homo sapiens
tgcattgctggtagag

SEQ ID NO: 4353963 - DNA, 21 bp, Homo sapiens
tgccaaaagctggaggaacca

SEQ ID NO: 4353964 - DNA, 19 bp, Homo sapiens
tgccaagggggtgactgga

SEQ ID NO: 4353965 - DNA, 13 bp, Homo sapiens
tgccacacagagt

SEQ ID NO: 4353966 - DNA, 23 bp, Homo sapiens
tgccacacagagtggtctttctg

SEQ ID NO: 4353967 - DNA, 22 bp, Homo sapiens
tgccacatggtgtctcccaaca

SEQ ID NO: 4353968 - DNA, 23 bp, Homo sapiens
tgccactgccccccgaggctgct

SEQ ID NO: 4353969 - DNA, 19 bp, Homo sapiens
tgccagaagagaattcagt

SEQ ID NO: 4353970 - DNA, 20 bp, Homo sapiens
tgcccacatttgggctcagg

SEQ ID NO: 4353971 - DNA, 22 bp, Homo sapiens
tgcccacatttgggctcagggt

SEQ ID NO: 4353972 - DNA, 18 bp, Homo sapiens
tgcccagacccctctggc

SEQ ID NO: 4353973 - DNA, 19 bp, Homo sapiens
tgcccagacccctctggcc

SEQ ID NO: 4353974 - DNA, 17 bp, Homo sapiens
tgcccccgcctgccacc

SEQ ID NO: 4353975 - DNA, 17 bp, Homo sapiens
tgcccggcgccgggcac

SEQ ID NO: 4353976 - DNA, 18 bp, Homo sapiens
tgccctcttaagatctga

SEQ ID NO: 4353977 - DNA, 20 bp, Homo sapiens
tgccctcttaagatctgact

SEQ ID NO: 4353978 - DNA, 16 bp, Homo sapiens
tgccggtgggaccctg

SEQ ID NO: 4353979 - DNA, 21 bp, Homo sapiens
tgcctcatagcatagccagca

SEQ ID NO: 4353980 - DNA, 21 bp, Homo sapiens
tgcctcccccgcctccagtca

SEQ ID NO: 4353981 - DNA, 18 bp, Homo sapiens
tgcctctgggtaggaaaa

SEQ ID NO: 4353982 - DNA, 12 bp, Homo sapiens
tgcctcttccag

SEQ ID NO: 4353983 - DNA, 16 bp, Homo sapiens
tgcctcttccagtgaa

SEQ ID NO: 4353984 - DNA, 18 bp, Homo sapiens
tgcctcttccagtgaaca

SEQ ID NO: 4353985 - DNA, 13 bp, Homo sapiens
tgcctgaggagga

SEQ ID NO: 4353986 - DNA, 14 bp, Homo sapiens
tgcctgtgccaccc

SEQ ID NO: 4353987 - DNA, 16 bp, Homo sapiens
tgcctgtgccacccac

SEQ ID NO: 4353988 - DNA, 15 bp, Homo sapiens
tgccttaagcagaac

SEQ ID NO: 4353989 - DNA, 20 bp, Homo sapiens
tgccttaagcagaacaaatg

SEQ ID NO: 4353990 - DNA, 16 bp, Homo sapiens
tgccttaataaatatg

SEQ ID NO: 4353991 - DNA, 13 bp, Homo sapiens
tgccttcagccct

SEQ ID NO: 4353992 - DNA, 16 bp, Homo sapiens
tgctaaatacaacact

SEQ ID NO: 4353993 - DNA, 19 bp, Homo sapiens
tgctaaatacaacactgat

SEQ ID NO: 4353994 - DNA, 15 bp, Homo sapiens
tgctacaatggaaac

SEQ ID NO: 4353995 - DNA, 16 bp, Homo sapiens
tgctacaatggaaacc

SEQ ID NO: 4353996 - DNA, 15 bp, Homo sapiens
tgctagttctgctgc

SEQ ID NO: 4353997 - DNA, 18 bp, Homo sapiens
tgctagttctgctgccct

SEQ ID NO: 4353998 - DNA, 17 bp, Homo sapiens
tgctccagattctgatg

SEQ ID NO: 4353999 - DNA, 19 bp, Homo sapiens
tgctcctcacccctgtagg

SEQ ID NO: 4354000 - DNA, 13 bp, Homo sapiens
tgctctcctccac

SEQ ID NO: 4354001 - DNA, 15 bp, Homo sapiens
tgctgaggcccagtg

SEQ ID NO: 4354002 - DNA, 18 bp, Homo sapiens
tgctgaggcccagtgcat

SEQ ID NO: 4354003 - DNA, 20 bp, Homo sapiens
tgctgcagcttctaactggt

SEQ ID NO: 4354004 - DNA, 17 bp, Homo sapiens
tgctgcaggacattaat

SEQ ID NO: 4354005 - DNA, 15 bp, Homo sapiens
tgctgcctccctggg

SEQ ID NO: 4354006 - DNA, 14 bp, Homo sapiens
tgctgctctcagcc

SEQ ID NO: 4354007 - DNA, 14 bp, Homo sapiens
tgctgggccaggga

SEQ ID NO: 4354008 - DNA, 18 bp, Homo sapiens
tgctggtagagaccccca

SEQ ID NO: 4354009 - DNA, 19 bp, Homo sapiens
tgctggtagagacccccag

SEQ ID NO: 4354010 - DNA, 17 bp, Homo sapiens
tgctgtgttaagaggac

SEQ ID NO: 4354011 - DNA, 14 bp, Homo sapiens
tgcttaaataaaaa

SEQ ID NO: 4354012 - DNA, 15 bp, Homo sapiens
tgctttccctgagga

SEQ ID NO: 4354013 - DNA, 19 bp, Homo sapiens
tggaagggcgttctaggta

SEQ ID NO: 4354014 - DNA, 21 bp, Homo sapiens
tggaagggcgttctaggtagg

SEQ ID NO: 4354015 - DNA, 15 bp, Homo sapiens
tggaagttgtggata

SEQ ID NO: 4354016 - DNA, 15 bp, Homo sapiens
tggaatgtgttgtaa

SEQ ID NO: 4354017 - DNA, 14 bp, Homo sapiens
tggactagaaaatc

SEQ ID NO: 4354018 - DNA, 18 bp, Homo sapiens
tggactgaagcctgcagg

SEQ ID NO: 4354019 - DNA, 20 bp, Homo sapiens
tggactgtgatgccacacag

SEQ ID NO: 4354020 - DNA, 14 bp, Homo sapiens
tggacttacaaaat

SEQ ID NO: 4354021 - DNA, 19 bp, Homo sapiens
tggagaaaattggaactct

SEQ ID NO: 4354022 - DNA, 19 bp, Homo sapiens
tggagactcctggtctgtg

SEQ ID NO: 4354023 - DNA, 20 bp, Homo sapiens
tggagactcctggtctgtga

SEQ ID NO: 4354024 - DNA, 20 bp, Homo sapiens
tggagagagaggctgcctca

SEQ ID NO: 4354025 - DNA, 23 bp, Homo sapiens
tggagagagaggctgcctcagcc

SEQ ID NO: 4354026 - DNA, 19 bp, Homo sapiens
tggagagcagcaggtgctg

SEQ ID NO: 4354027 - DNA, 21 bp, Homo sapiens
tggagaggagagtggcaggtg

SEQ ID NO: 4354028 - DNA, 16 bp, Homo sapiens
tggagccagggcagag

SEQ ID NO: 4354029 - DNA, 14 bp, Homo sapiens
tggagttcaccttg

SEQ ID NO: 4354030 - DNA, 17 bp, Homo sapiens
tggagttcaccttggaa

SEQ ID NO: 4354031 - DNA, 20 bp, Homo sapiens
tggataatcaggaaaaatga

SEQ ID NO: 4354032 - DNA, 15 bp, Homo sapiens
tggatagacttggga

SEQ ID NO: 4354033 - DNA, 18 bp, Homo sapiens
tggatagacttgggatgg

SEQ ID NO: 4354034 - DNA, 15 bp, Homo sapiens
tggatatgacccaca

SEQ ID NO: 4354035 - DNA, 15 bp, Homo sapiens
tggatcagagcattt

SEQ ID NO: 4354036 - DNA, 16 bp, Homo sapiens
tggatcttctatcatt

SEQ ID NO: 4354037 - DNA, 19 bp, Homo sapiens
tggcagaatgaaaatcagc

SEQ ID NO: 4354038 - DNA, 14 bp, Homo sapiens
tggcaggtgggctg

SEQ ID NO: 4354039 - DNA, 20 bp, Homo sapiens
tggcagtctaagtgtaaatg

SEQ ID NO: 4354040 - DNA, 16 bp, Homo sapiens
tggccatgcaggaggt

SEQ ID NO: 4354041 - DNA, 22 bp, Homo sapiens
tggccatttgctagttctgctg

SEQ ID NO: 4354042 - DNA, 13 bp, Homo sapiens
tggccctggagcc

SEQ ID NO: 4354043 - DNA, 17 bp, Homo sapiens
tggccctggagccaggg

SEQ ID NO: 4354044 - DNA, 19 bp, Homo sapiens
tggcctggttgtttccgta

SEQ ID NO: 4354045 - DNA, 21 bp, Homo sapiens
tggctgctcccagcctcttgc

SEQ ID NO: 4354046 - DNA, 16 bp, Homo sapiens
tggcttaagtgagcag

SEQ ID NO: 4354047 - DNA, 19 bp, Homo sapiens
tggcttaagtgagcagaac

SEQ ID NO: 4354048 - DNA, 20 bp, Homo sapiens
tggcttaagtgagcagaaca

SEQ ID NO: 4354049 - DNA, 22 bp, Homo sapiens
tgggaatgtattattctgcagc

SEQ ID NO: 4354050 - DNA, 22 bp, Homo sapiens
tgggaccctgtccggcccagtg

SEQ ID NO: 4354051 - DNA, 13 bp, Homo sapiens
tgggagggatcag

SEQ ID NO: 4354052 - DNA, 17 bp, Homo sapiens
tgggagggatcagcccc

SEQ ID NO: 4354053 - DNA, 14 bp, Homo sapiens
tgggaggtgcgtgt

SEQ ID NO: 4354054 - DNA, 21 bp, Homo sapiens
tgggaggtgcgtgttcagcag

SEQ ID NO: 4354055 - DNA, 23 bp, Homo sapiens
tgggatggcatttggtctcaggc

SEQ ID NO: 4354056 - DNA, 12 bp, Homo sapiens
tgggatggggag

SEQ ID NO: 4354057 - DNA, 13 bp, Homo sapiens
tgggccagggaaa

SEQ ID NO: 4354058 - DNA, 17 bp, Homo sapiens
tgggccagtccccgagg

SEQ ID NO: 4354059 - DNA, 18 bp, Homo sapiens
tgggccagtccccgagga

SEQ ID NO: 4354060 - DNA, 17 bp, Homo sapiens
tgggccctctgtccaca

SEQ ID NO: 4354061 - DNA, 20 bp, Homo sapiens
tgggctcagggttggccatt

SEQ ID NO: 4354062 - DNA, 22 bp, Homo sapiens
tgggctgtgagtgtaagtgtga

SEQ ID NO: 4354063 - DNA, 23 bp, Homo sapiens
tggggaaaatggccatgcaggag

SEQ ID NO: 4354064 - DNA, 14 bp, Homo sapiens
tggggaccaggagc

SEQ ID NO: 4354065 - DNA, 15 bp, Homo sapiens
tggggagcagagaca

SEQ ID NO: 4354066 - DNA, 12 bp, Homo sapiens
tggggccaggac

SEQ ID NO: 4354067 - DNA, 16 bp, Homo sapiens
tgggggagggaagacc

SEQ ID NO: 4354068 - DNA, 17 bp, Homo sapiens
tggggggcgggccaggg

SEQ ID NO: 4354069 - DNA, 15 bp, Homo sapiens
tggggtacaggcagt

SEQ ID NO: 4354070 - DNA, 19 bp, Homo sapiens
tggggtccatccccttccc

SEQ ID NO: 4354071 - DNA, 17 bp, Homo sapiens
tggggtctgtgactgga

SEQ ID NO: 4354072 - DNA, 14 bp, Homo sapiens
tggggtgaggacca

SEQ ID NO: 4354073 - DNA, 19 bp, Homo sapiens
tgggtgcgtctccagtcat

SEQ ID NO: 4354074 - DNA, 14 bp, Homo sapiens
tgggtgctggctgc

SEQ ID NO: 4354075 - DNA, 18 bp, Homo sapiens
tggtaaaaagatccaggg

SEQ ID NO: 4354076 - DNA, 17 bp, Homo sapiens
tggtaaaaatgctgctc

SEQ ID NO: 4354077 - DNA, 18 bp, Homo sapiens
tggtaaaaatgctgctct

SEQ ID NO: 4354078 - DNA, 18 bp, Homo sapiens
tggtacatggtgtttgtg

SEQ ID NO: 4354079 - DNA, 16 bp, Homo sapiens
tggtagagacccccag

SEQ ID NO: 4354080 - DNA, 19 bp, Homo sapiens
tggtagagacccccaggcc

SEQ ID NO: 4354081 - DNA, 21 bp, Homo sapiens
tggtaggggagggcaggcttg

SEQ ID NO: 4354082 - DNA, 19 bp, Homo sapiens
tggtcctgactcaacatgt

SEQ ID NO: 4354083 - DNA, 22 bp, Homo sapiens
tggtcctgactcaacatgttac

SEQ ID NO: 4354084 - DNA, 16 bp, Homo sapiens
tggtctgatttcagga

SEQ ID NO: 4354085 - DNA, 20 bp, Homo sapiens
tggtgaattttccaagaaca

SEQ ID NO: 4354086 - DNA, 21 bp, Homo sapiens
tggtgagtcttggttctaaag

SEQ ID NO: 4354087 - DNA, 17 bp, Homo sapiens
tggtgcccgtgcccgca

SEQ ID NO: 4354088 - DNA, 20 bp, Homo sapiens
tggtggcagaatgaaaatca

SEQ ID NO: 4354089 - DNA, 22 bp, Homo sapiens
tggtgtctcccaacatgggagg

SEQ ID NO: 4354090 - DNA, 14 bp, Homo sapiens
tggttctaaaggta

SEQ ID NO: 4354091 - DNA, 17 bp, Homo sapiens
tggttgcctcccccgcc

SEQ ID NO: 4354092 - DNA, 23 bp, Homo sapiens
tggttgtcatttttgcagtagag

SEQ ID NO: 4354093 - DNA, 17 bp, Homo sapiens
tggtttcagatgtgcaa

SEQ ID NO: 4354094 - DNA, 20 bp, Homo sapiens
tggtttcagatgtgcaataa

SEQ ID NO: 4354095 - DNA, 16 bp, Homo sapiens
tgtaaagtgtaaatcc

SEQ ID NO: 4354096 - DNA, 11 bp, Homo sapiens
tgtaacagctg

SEQ ID NO: 4354097 - DNA, 17 bp, Homo sapiens
tgtaagaagagactggg

SEQ ID NO: 4354098 - DNA, 18 bp, Homo sapiens
tgtaagagcttgctccag

SEQ ID NO: 4354099 - DNA, 12 bp, Homo sapiens
tgtaagtgtgag

SEQ ID NO: 4354100 - DNA, 12 bp, Homo sapiens
tgtaatataaat

SEQ ID NO: 4354101 - DNA, 14 bp, Homo sapiens
tgtacaataagtta

SEQ ID NO: 4354102 - DNA, 15 bp, Homo sapiens
tgtacaataagttac

SEQ ID NO: 4354103 - DNA, 21 bp, Homo sapiens
tgtacaatggtttattcccaa

SEQ ID NO: 4354104 - DNA, 15 bp, Homo sapiens
tgtacactgaatatt

SEQ ID NO: 4354105 - DNA, 20 bp, Homo sapiens
tgtacactgaatatttatat

SEQ ID NO: 4354106 - DNA, 16 bp, Homo sapiens
tgtagaaagcaaacaa

SEQ ID NO: 4354107 - DNA, 16 bp, Homo sapiens
tgtagctttaaaacca

SEQ ID NO: 4354108 - DNA, 19 bp, Homo sapiens
tgtagggcctgcatggaga

SEQ ID NO: 4354109 - DNA, 19 bp, Homo sapiens
tgtagtttttatatgttgt

SEQ ID NO: 4354110 - DNA, 21 bp, Homo sapiens
tgtatcaggaaatatatatgt

SEQ ID NO: 4354111 - DNA, 17 bp, Homo sapiens
tgtatcatttgaacaac

SEQ ID NO: 4354112 - DNA, 22 bp, Homo sapiens
tgtatgtttgcacacttgtgtg

SEQ ID NO: 4354113 - DNA, 23 bp, Homo sapiens
tgtattgatgcaatataagcata

SEQ ID NO: 4354114 - DNA, 14 bp, Homo sapiens
tgtattttgcatac

SEQ ID NO: 4354115 - DNA, 22 bp, Homo sapiens
tgtattttgcatactcaaggtg

SEQ ID NO: 4354116 - DNA, 16 bp, Homo sapiens
tgtcacaataaagttt

SEQ ID NO: 4354117 - DNA, 17 bp, Homo sapiens
tgtcacaataaagttta

SEQ ID NO: 4354118 - DNA, 19 bp, Homo sapiens
tgtcacagtccaaccagaa

SEQ ID NO: 4354119 - DNA, 14 bp, Homo sapiens
tgtcacttgccaca

SEQ ID NO: 4354120 - DNA, 19 bp, Homo sapiens
tgtccggcccagtgccact

SEQ ID NO: 4354121 - DNA, 15 bp, Homo sapiens
tgtcctttttcactt

SEQ ID NO: 4354122 - DNA, 16 bp, Homo sapiens
tgtcgtgggatggcat

SEQ ID NO: 4354123 - DNA, 19 bp, Homo sapiens
tgtctaggactgcagtgtg

SEQ ID NO: 4354124 - DNA, 20 bp, Homo sapiens
tgtctaggactgcagtgtgg

SEQ ID NO: 4354125 - DNA, 10 bp, Homo sapiens
tgtctcccaa

SEQ ID NO: 4354126 - DNA, 18 bp, Homo sapiens
tgtctccctcccctctca

SEQ ID NO: 4354127 - DNA, 23 bp, Homo sapiens
tgtctccctcccctctcagaaca

SEQ ID NO: 4354128 - DNA, 21 bp, Homo sapiens
tgtctcgatgccataatcaga

SEQ ID NO: 4354129 - DNA, 16 bp, Homo sapiens
tgtctgccaaacacat

SEQ ID NO: 4354130 - DNA, 20 bp, Homo sapiens
tgtctggactagaaaatctg

SEQ ID NO: 4354131 - DNA, 21 bp, Homo sapiens
tgtctggactagaaaatctga

SEQ ID NO: 4354132 - DNA, 20 bp, Homo sapiens
tgtcttccgatcaacattta

SEQ ID NO: 4354133 - DNA, 18 bp, Homo sapiens
tgtctttcaatgcagttt

SEQ ID NO: 4354134 - DNA, 19 bp, Homo sapiens
tgtctttcaatgcagtttt

SEQ ID NO: 4354135 - DNA, 23 bp, Homo sapiens
tgtctttttctggactgaagcct

SEQ ID NO: 4354136 - DNA, 14 bp, Homo sapiens
tgtgaccagcactg

SEQ ID NO: 4354137 - DNA, 17 bp, Homo sapiens
tgtgaccagcactgtct

SEQ ID NO: 4354138 - DNA, 12 bp, Homo sapiens
tgtgactggatc

SEQ ID NO: 4354139 - DNA, 17 bp, Homo sapiens
tgtgatgccacacagag

SEQ ID NO: 4354140 - DNA, 12 bp, Homo sapiens
tgtgcacatgta

SEQ ID NO: 4354141 - DNA, 16 bp, Homo sapiens
tgtgccacccaccagg

SEQ ID NO: 4354142 - DNA, 16 bp, Homo sapiens
tgtgcctctcatcttt

SEQ ID NO: 4354143 - DNA, 22 bp, Homo sapiens
tgtgcttggatttgcatattta

SEQ ID NO: 4354144 - DNA, 22 bp, Homo sapiens
tgtggagttcaccttggaaggg

SEQ ID NO: 4354145 - DNA, 22 bp, Homo sapiens
tgtggatatcagggtataaatt

SEQ ID NO: 4354146 - DNA, 16 bp, Homo sapiens
tgtggccccaagaggg

SEQ ID NO: 4354147 - DNA, 17 bp, Homo sapiens
tgtggccccaagagggg

SEQ ID NO: 4354148 - DNA, 12 bp, Homo sapiens
tgtggggccagg

SEQ ID NO: 4354149 - DNA, 12 bp, Homo sapiens
tgtgggtcccgc

SEQ ID NO: 4354150 - DNA, 16 bp, Homo sapiens
tgtggtacatggtgtt

SEQ ID NO: 4354151 - DNA, 21 bp, Homo sapiens
tgtgtattgatgcaatataag

SEQ ID NO: 4354152 - DNA, 16 bp, Homo sapiens
tgtgtggactgtgatg

SEQ ID NO: 4354153 - DNA, 19 bp, Homo sapiens
tgtgtggactgtgatgcca

SEQ ID NO: 4354154 - DNA, 14 bp, Homo sapiens
tgtgtgtgtatgtt

SEQ ID NO: 4354155 - DNA, 20 bp, Homo sapiens
tgttagaagaagaggaagaa

SEQ ID NO: 4354156 - DNA, 20 bp, Homo sapiens
tgttaggcatgtcccaccca

SEQ ID NO: 4354157 - DNA, 16 bp, Homo sapiens
tgttatgaacagctgt

SEQ ID NO: 4354158 - DNA, 20 bp, Homo sapiens
tgttatgaacagctgtgtct

SEQ ID NO: 4354159 - DNA, 16 bp, Homo sapiens
tgttatgcactgtggt

SEQ ID NO: 4354160 - DNA, 14 bp, Homo sapiens
tgttcttgggagaa

SEQ ID NO: 4354161 - DNA, 18 bp, Homo sapiens
tgttcttgtttgtatcat

SEQ ID NO: 4354162 - DNA, 17 bp, Homo sapiens
tgttgctatcctgcagg

SEQ ID NO: 4354163 - DNA, 16 bp, Homo sapiens
tgtttaaatagcctaa

SEQ ID NO: 4354164 - DNA, 17 bp, Homo sapiens
tgtttaaatagcctaaa

SEQ ID NO: 4354165 - DNA, 18 bp, Homo sapiens
tgtttcagataaatttca

SEQ ID NO: 4354166 - DNA, 19 bp, Homo sapiens
tgtttcgcattaagcacac

SEQ ID NO: 4354167 - DNA, 20 bp, Homo sapiens
tgtttggtgtttgtctgtgt

SEQ ID NO: 4354168 - DNA, 17 bp, Homo sapiens
tgttttctgaaacacac

SEQ ID NO: 4354169 - DNA, 23 bp, Homo sapiens
tgttttgggcctccatgccccag

SEQ ID NO: 4354170 - DNA, 19 bp, Homo sapiens
ttaaagattggaatgtgtt

SEQ ID NO: 4354171 - DNA, 17 bp, Homo sapiens
ttaaatccttttcccat

SEQ ID NO: 4354172 - DNA, 16 bp, Homo sapiens
ttaactgaactgtgaa

SEQ ID NO: 4354173 - DNA, 22 bp, Homo sapiens
ttaagcaaacgtctattttgta

SEQ ID NO: 4354174 - DNA, 11 bp, Homo sapiens
ttaagcacaca

SEQ ID NO: 4354175 - DNA, 14 bp, Homo sapiens
ttaagcacacacat

SEQ ID NO: 4354176 - DNA, 15 bp, Homo sapiens
ttaaggcaaataaag

SEQ ID NO: 4354177 - DNA, 13 bp, Homo sapiens
ttaagttaatgaa

SEQ ID NO: 4354178 - DNA, 15 bp, Homo sapiens
ttaataaatatgtaa

SEQ ID NO: 4354179 - DNA, 21 bp, Homo sapiens
ttaatctcaaagagattcgaa

SEQ ID NO: 4354180 - DNA, 12 bp, Homo sapiens
ttaatgaaataa

SEQ ID NO: 4354181 - DNA, 13 bp, Homo sapiens
ttaatgaaataaa

SEQ ID NO: 4354182 - DNA, 13 bp, Homo sapiens
ttacaaaatgcca

SEQ ID NO: 4354183 - DNA, 21 bp, Homo sapiens
ttacaccaccggccccctccc

SEQ ID NO: 4354184 - DNA, 19 bp, Homo sapiens
ttacatcagaagtttgcat

SEQ ID NO: 4354185 - DNA, 20 bp, Homo sapiens
ttacatcagaagtttgcatc

SEQ ID NO: 4354186 - DNA, 22 bp, Homo sapiens
ttaccctcaggcataggcctgg

SEQ ID NO: 4354187 - DNA, 22 bp, Homo sapiens
ttaccctttggccccactttga

SEQ ID NO: 4354188 - DNA, 12 bp, Homo sapiens
ttacttgaaata

SEQ ID NO: 4354189 - DNA, 13 bp, Homo sapiens
ttacttgaaataa

SEQ ID NO: 4354190 - DNA, 21 bp, Homo sapiens
ttacttttcacactgtcttcc

SEQ ID NO: 4354191 - DNA, 15 bp, Homo sapiens
ttagaaatagacagt

SEQ ID NO: 4354192 - DNA, 21 bp, Homo sapiens
ttagaagaagaggaagaaatt

SEQ ID NO: 4354193 - DNA, 17 bp, Homo sapiens
ttagcaacaacatgcta

SEQ ID NO: 4354194 - DNA, 21 bp, Homo sapiens
ttagcatttttatgcagacag

SEQ ID NO: 4354195 - DNA, 11 bp, Homo sapiens
ttatgaacagc

SEQ ID NO: 4354196 - DNA, 18 bp, Homo sapiens
ttatgatgttagaagaag

SEQ ID NO: 4354197 - DNA, 17 bp, Homo sapiens
ttatgcagacagtctgt

SEQ ID NO: 4354198 - DNA, 23 bp, Homo sapiens
ttatgcagacagtctgttatgca

SEQ ID NO: 4354199 - DNA, 14 bp, Homo sapiens
ttcaaactgctgca

SEQ ID NO: 4354200 - DNA, 12 bp, Homo sapiens
ttcaaatgcaaa

SEQ ID NO: 4354201 - DNA, 13 bp, Homo sapiens
ttcacagtttttc

SEQ ID NO: 4354202 - DNA, 10 bp, Homo sapiens
ttcactttga

SEQ ID NO: 4354203 - DNA, 16 bp, Homo sapiens
ttcagaagacactgca

SEQ ID NO: 4354204 - DNA, 22 bp, Homo sapiens
ttcagataaatttcaattagat

SEQ ID NO: 4354205 - DNA, 16 bp, Homo sapiens
ttcagatatatttttc

SEQ ID NO: 4354206 - DNA, 16 bp, Homo sapiens
ttcagcagaacctgca

SEQ ID NO: 4354207 - DNA, 16 bp, Homo sapiens
ttcatccaatcctcac

SEQ ID NO: 4354208 - DNA, 22 bp, Homo sapiens
ttcattccgttaggaataacac

SEQ ID NO: 4354209 - DNA, 18 bp, Homo sapiens
ttccaattctaaatccga

SEQ ID NO: 4354210 - DNA, 22 bp, Homo sapiens
ttccagcagtgaatgctagaca

SEQ ID NO: 4354211 - DNA, 15 bp, Homo sapiens
ttccatgaatgtatc

SEQ ID NO: 4354212 - DNA, 15 bp, Homo sapiens
ttcccaagtatgcct

SEQ ID NO: 4354213 - DNA, 18 bp, Homo sapiens
ttcccaagtatgccttaa

SEQ ID NO: 4354214 - DNA, 16 bp, Homo sapiens
ttcccccatccctacc

SEQ ID NO: 4354215 - DNA, 14 bp, Homo sapiens
ttcccctttcccca

SEQ ID NO: 4354216 - DNA, 21 bp, Homo sapiens
ttccctctctcataccctccc

SEQ ID NO: 4354217 - DNA, 20 bp, Homo sapiens
ttccctggaaaccttccacc

SEQ ID NO: 4354218 - DNA, 23 bp, Homo sapiens
ttccctggaaaccttccacccag

SEQ ID NO: 4354219 - DNA, 23 bp, Homo sapiens
ttccgggtctcgcagcctgaagc

SEQ ID NO: 4354220 - DNA, 10 bp, Homo sapiens
ttcctgcagc

SEQ ID NO: 4354221 - DNA, 17 bp, Homo sapiens
ttccttaaactgtgtgg

SEQ ID NO: 4354222 - DNA, 12 bp, Homo sapiens
ttccttgcctta

SEQ ID NO: 4354223 - DNA, 19 bp, Homo sapiens
ttctaaatccgacttgaat

SEQ ID NO: 4354224 - DNA, 17 bp, Homo sapiens
ttctaggtaggaagagc

SEQ ID NO: 4354225 - DNA, 22 bp, Homo sapiens
ttctatatagttccttgcctta

SEQ ID NO: 4354226 - DNA, 23 bp, Homo sapiens
ttctatatagttccttgccttaa

SEQ ID NO: 4354227 - DNA, 21 bp, Homo sapiens
ttctatcattccaattctaaa

SEQ ID NO: 4354228 - DNA, 19 bp, Homo sapiens
ttctccagacccaccacac

SEQ ID NO: 4354229 - DNA, 22 bp, Homo sapiens
ttctctatgacatgaaatgaaa

SEQ ID NO: 4354230 - DNA, 17 bp, Homo sapiens
ttctctttaccttctaa

SEQ ID NO: 4354231 - DNA, 15 bp, Homo sapiens
ttctgaaacacacga

SEQ ID NO: 4354232 - DNA, 18 bp, Homo sapiens
ttctgaaacacacgagca

SEQ ID NO: 4354233 - DNA, 17 bp, Homo sapiens
ttctgaataaagcaatt

SEQ ID NO: 4354234 - DNA, 20 bp, Homo sapiens
ttctgcagcatgacctgtga

SEQ ID NO: 4354235 - DNA, 11 bp, Homo sapiens
ttctgccctgc

SEQ ID NO: 4354236 - DNA, 22 bp, Homo sapiens
ttctgccctgcctgaggaggag

SEQ ID NO: 4354237 - DNA, 15 bp, Homo sapiens
ttctgggatgtcaca

SEQ ID NO: 4354238 - DNA, 19 bp, Homo sapiens
ttctgggatgtcacagtcc

SEQ ID NO: 4354239 - DNA, 15 bp, Homo sapiens
ttcttcttcagaaga

SEQ ID NO: 4354240 - DNA, 16 bp, Homo sapiens
ttcttgggagaaaatc

SEQ ID NO: 4354241 - DNA, 16 bp, Homo sapiens
ttgaaaagttggaagg

SEQ ID NO: 4354242 - DNA, 16 bp, Homo sapiens
ttgaagggcaagaaat

SEQ ID NO: 4354243 - DNA, 13 bp, Homo sapiens
ttgaagggtcctg

SEQ ID NO: 4354244 - DNA, 14 bp, Homo sapiens
ttgacaaggaaaat

SEQ ID NO: 4354245 - DNA, 14 bp, Homo sapiens
ttgacagtgaaaca

SEQ ID NO: 4354246 - DNA, 15 bp, Homo sapiens
ttgacagtgaaacaa

SEQ ID NO: 4354247 - DNA, 16 bp, Homo sapiens
ttgacctctgtgacca

SEQ ID NO: 4354248 - DNA, 16 bp, Homo sapiens
ttgagaccaaaattta

SEQ ID NO: 4354249 - DNA, 21 bp, Homo sapiens
ttgagtgacagctttctggga

SEQ ID NO: 4354250 - DNA, 16 bp, Homo sapiens
ttgcatgatttcccaa

SEQ ID NO: 4354251 - DNA, 17 bp, Homo sapiens
ttgccttaataaatatg

SEQ ID NO: 4354252 - DNA, 22 bp, Homo sapiens
ttgccttaataaatatgtaata

SEQ ID NO: 4354253 - DNA, 11 bp, Homo sapiens
ttgccttcagc

SEQ ID NO: 4354254 - DNA, 13 bp, Homo sapiens
ttgctgggccagg

SEQ ID NO: 4354255 - DNA, 22 bp, Homo sapiens
ttggaactctactcaacccatt

SEQ ID NO: 4354256 - DNA, 18 bp, Homo sapiens
ttggaaggatctgctgag

SEQ ID NO: 4354257 - DNA, 16 bp, Homo sapiens
ttggaagttttcagga

SEQ ID NO: 4354258 - DNA, 22 bp, Homo sapiens
ttggagagagaggctgcctcag

SEQ ID NO: 4354259 - DNA, 15 bp, Homo sapiens
ttggagagcagcagg

SEQ ID NO: 4354260 - DNA, 14 bp, Homo sapiens
ttggccctggagcc

SEQ ID NO: 4354261 - DNA, 11 bp, Homo sapiens
ttgggaggtgc

SEQ ID NO: 4354262 - DNA, 15 bp, Homo sapiens
ttgggcctccatgcc

SEQ ID NO: 4354263 - DNA, 14 bp, Homo sapiens
ttgggctcagggtt

SEQ ID NO: 4354264 - DNA, 14 bp, Homo sapiens
ttgggggagggaag

SEQ ID NO: 4354265 - DNA, 19 bp, Homo sapiens
ttggtaaaaatgctgctct

SEQ ID NO: 4354266 - DNA, 22 bp, Homo sapiens
ttggtgagtcttggttctaaag

SEQ ID NO: 4354267 - DNA, 20 bp, Homo sapiens
ttggttctaaaggtaccaaa

SEQ ID NO: 4354268 - DNA, 12 bp, Homo sapiens
ttgtacaatggt

SEQ ID NO: 4354269 - DNA, 21 bp, Homo sapiens
ttgtacaatggtttattccca

SEQ ID NO: 4354270 - DNA, 22 bp, Homo sapiens
ttgtacaatggtttattcccaa

SEQ ID NO: 4354271 - DNA, 14 bp, Homo sapiens
ttgtattttgcata

SEQ ID NO: 4354272 - DNA, 14 bp, Homo sapiens
ttgtcacttgccac

SEQ ID NO: 4354273 - DNA, 21 bp, Homo sapiens
ttgtctgtctccctcccctct

SEQ ID NO: 4354274 - DNA, 12 bp, Homo sapiens
ttgtgacagtgc

SEQ ID NO: 4354275 - DNA, 15 bp, Homo sapiens
ttgtgacagtgcctc

SEQ ID NO: 4354276 - DNA, 16 bp, Homo sapiens
ttgtgcacatgtacat

SEQ ID NO: 4354277 - DNA, 14 bp, Homo sapiens
ttgtgcattctgga

SEQ ID NO: 4354278 - DNA, 22 bp, Homo sapiens
ttgttaagtctaaatatttcct

SEQ ID NO: 4354279 - DNA, 21 bp, Homo sapiens
ttgttcttgggagaaaatcaa

SEQ ID NO: 4354280 - DNA, 14 bp, Homo sapiens
tttaaatagcctaa

SEQ ID NO: 4354281 - DNA, 15 bp, Homo sapiens
tttaaatagcctaaa

SEQ ID NO: 4354282 - DNA, 16 bp, Homo sapiens
tttaaatagcctaaat

SEQ ID NO: 4354283 - DNA, 19 bp, Homo sapiens
tttaaggaacttctgaaga

SEQ ID NO: 4354284 - DNA, 16 bp, Homo sapiens
tttaagttaatgaaat

SEQ ID NO: 4354285 - DNA, 17 bp, Homo sapiens
tttaagttaatgaaata

SEQ ID NO: 4354286 - DNA, 19 bp, Homo sapiens
tttaataatgttgccttgg

SEQ ID NO: 4354287 - DNA, 19 bp, Homo sapiens
tttacattgtcctgtagct

SEQ ID NO: 4354288 - DNA, 19 bp, Homo sapiens
tttaccttctaaaagccat

SEQ ID NO: 4354289 - DNA, 18 bp, Homo sapiens
tttacttttcacactgtc

SEQ ID NO: 4354290 - DNA, 19 bp, Homo sapiens
tttacttttcacactgtct

SEQ ID NO: 4354291 - DNA, 22 bp, Homo sapiens
tttacttttcacactgtcttcc

SEQ ID NO: 4354292 - DNA, 19 bp, Homo sapiens
tttagcatttttatgcaga

SEQ ID NO: 4354293 - DNA, 13 bp, Homo sapiens
tttatatgttgta

SEQ ID NO: 4354294 - DNA, 16 bp, Homo sapiens
tttattatgcattata

SEQ ID NO: 4354295 - DNA, 17 bp, Homo sapiens
tttattatgcattatat

SEQ ID NO: 4354296 - DNA, 19 bp, Homo sapiens
tttattcccaagtatgcct

SEQ ID NO: 4354297 - DNA, 23 bp, Homo sapiens
tttattttggggaggaaaacagt

SEQ ID NO: 4354298 - DNA, 19 bp, Homo sapiens
tttcaattagatttaaaat

SEQ ID NO: 4354299 - DNA, 21 bp, Homo sapiens
tttcaattagatttaaaataa

SEQ ID NO: 4354300 - DNA, 19 bp, Homo sapiens
tttcacactgtcttcccga

SEQ ID NO: 4354301 - DNA, 15 bp, Homo sapiens
tttcacagtttttcc

SEQ ID NO: 4354302 - DNA, 16 bp, Homo sapiens
tttcactttgaaaagt

SEQ ID NO: 4354303 - DNA, 16 bp, Homo sapiens
tttcagataaatttca

SEQ ID NO: 4354304 - DNA, 18 bp, Homo sapiens
tttcagataaatttcaat

SEQ ID NO: 4354305 - DNA, 22 bp, Homo sapiens
tttcagatgtgcaataatttgt

SEQ ID NO: 4354306 - DNA, 12 bp, Homo sapiens
tttccctgagga

SEQ ID NO: 4354307 - DNA, 16 bp, Homo sapiens
tttccttaaactgtgt

SEQ ID NO: 4354308 - DNA, 16 bp, Homo sapiens
tttctatatagttcct

SEQ ID NO: 4354309 - DNA, 22 bp, Homo sapiens
tttctatatagttccttgcctt

SEQ ID NO: 4354310 - DNA, 19 bp, Homo sapiens
tttctgggatgtcacagtc

SEQ ID NO: 4354311 - DNA, 21 bp, Homo sapiens
tttcttgctggttgtcatttt

SEQ ID NO: 4354312 - DNA, 14 bp, Homo sapiens
tttgaaaagttgga

SEQ ID NO: 4354313 - DNA, 17 bp, Homo sapiens
tttgaaaagttggaagg

SEQ ID NO: 4354314 - DNA, 13 bp, Homo sapiens
tttgagtgacagc

SEQ ID NO: 4354315 - DNA, 16 bp, Homo sapiens
tttgcatcatttaact

SEQ ID NO: 4354316 - DNA, 11 bp, Homo sapiens
tttgcctgtgc

SEQ ID NO: 4354317 - DNA, 13 bp, Homo sapiens
tttggaagaaaat

SEQ ID NO: 4354318 - DNA, 22 bp, Homo sapiens
tttggaagcagccccctgtggc

SEQ ID NO: 4354319 - DNA, 19 bp, Homo sapiens
tttggccctggagccaggg

SEQ ID NO: 4354320 - DNA, 14 bp, Homo sapiens
tttggtaaaaatgc

SEQ ID NO: 4354321 - DNA, 19 bp, Homo sapiens
tttggtaaaaatgctgctc

SEQ ID NO: 4354322 - DNA, 16 bp, Homo sapiens
tttggtgtttgtctgt

SEQ ID NO: 4354323 - DNA, 18 bp, Homo sapiens
tttgtaaactacaaagta

SEQ ID NO: 4354324 - DNA, 23 bp, Homo sapiens
tttgtatcggagggaaacagaag

SEQ ID NO: 4354325 - DNA, 15 bp, Homo sapiens
tttgtattttgcata

SEQ ID NO: 4354326 - DNA, 22 bp, Homo sapiens
tttgtcctttttcactttgaaa

SEQ ID NO: 4354327 - DNA, 20 bp, Homo sapiens
tttgtctggactagaaaatc

SEQ ID NO: 4354328 - DNA, 13 bp, Homo sapiens
tttgtttgcatca

SEQ ID NO: 4354329 - DNA, 22 bp, Homo sapiens
ttttaaatggacaatggactgt

SEQ ID NO: 4354330 - DNA, 12 bp, Homo sapiens
ttttaagttaat

SEQ ID NO: 4354331 - DNA, 17 bp, Homo sapiens
ttttactgtctatatat

SEQ ID NO: 4354332 - DNA, 12 bp, Homo sapiens
ttttatgcagac

SEQ ID NO: 4354333 - DNA, 14 bp, Homo sapiens
ttttcaaactgctg

SEQ ID NO: 4354334 - DNA, 13 bp, Homo sapiens
ttttcaagaaatg

SEQ ID NO: 4354335 - DNA, 15 bp, Homo sapiens
ttttcacactgtctt

SEQ ID NO: 4354336 - DNA, 16 bp, Homo sapiens
ttttgaaatttactgt

SEQ ID NO: 4354337 - DNA, 15 bp, Homo sapiens
tttttattatgcatt

SEQ ID NO: 4354338 - DNA, 16 bp, Homo sapiens
tttttgtatgcttaaa

SEQ ID NO: 4354339 - DNA, 21 bp, Homo sapiens
aaaaactagtaatactgtctt

SEQ ID NO: 4354340 - DNA, 16 bp, Homo sapiens
aaaaactgtactgtgt

SEQ ID NO: 4354341 - DNA, 15 bp, Homo sapiens
aaaaatcaaagaaca

SEQ ID NO: 4354342 - DNA, 16 bp, Homo sapiens
aaaaattcataaccaa

SEQ ID NO: 4354343 - DNA, 20 bp, Homo sapiens
aaaacatgtttaaatagcct

SEQ ID NO: 4354344 - DNA, 17 bp, Homo sapiens
aaaaccacagctgggca

SEQ ID NO: 4354345 - DNA, 18 bp, Homo sapiens
aaaactattgagccttgc

SEQ ID NO: 4354346 - DNA, 15 bp, Homo sapiens
aaaactgtactgtgt

SEQ ID NO: 4354347 - DNA, 18 bp, Homo sapiens
aaaagccattattatgat

SEQ ID NO: 4354348 - DNA, 23 bp, Homo sapiens
aaaagggcagggcatctcctgtg

SEQ ID NO: 4354349 - DNA, 13 bp, Homo sapiens
aaaagtacagttt

SEQ ID NO: 4354350 - DNA, 22 bp, Homo sapiens
aaaagttggaaggatctgctga

SEQ ID NO: 4354351 - DNA, 16 bp, Homo sapiens
aaaatcaaagaacaga

SEQ ID NO: 4354352 - DNA, 18 bp, Homo sapiens
aaaatcaaagaacagatg

SEQ ID NO: 4354353 - DNA, 15 bp, Homo sapiens
aaaatcgatgagcgc

SEQ ID NO: 4354354 - DNA, 12 bp, Homo sapiens
aaaatctatatt

SEQ ID NO: 4354355 - DNA, 17 bp, Homo sapiens
aaaatgaggaatccaaa

SEQ ID NO: 4354356 - DNA, 23 bp, Homo sapiens
aaaatgccaagggggtgactgga

SEQ ID NO: 4354357 - DNA, 12 bp, Homo sapiens
aaaatgctgctc

SEQ ID NO: 4354358 - DNA, 20 bp, Homo sapiens
aaaattagttttaaaatact

SEQ ID NO: 4354359 - DNA, 20 bp, Homo sapiens
aaaattgagttctcatttaa

SEQ ID NO: 4354360 - DNA, 12 bp, Homo sapiens
aaacaaggaagc

SEQ ID NO: 4354361 - DNA, 14 bp, Homo sapiens
aaacacacgagcaa

SEQ ID NO: 4354362 - DNA, 15 bp, Homo sapiens
aaacagaagcttttt

SEQ ID NO: 4354363 - DNA, 14 bp, Homo sapiens
aaacagcttaaatt

SEQ ID NO: 4354364 - DNA, 21 bp, Homo sapiens
aaacatgtttaaatagcctaa

SEQ ID NO: 4354365 - DNA, 18 bp, Homo sapiens
aaaccaagccattaatga

SEQ ID NO: 4354366 - DNA, 13 bp, Homo sapiens
aaacccagaggtg

SEQ ID NO: 4354367 - DNA, 23 bp, Homo sapiens
aaaccttccacccagtgctgaat

SEQ ID NO: 4354368 - DNA, 17 bp, Homo sapiens
aaaccttggagaggaga

SEQ ID NO: 4354369 - DNA, 16 bp, Homo sapiens
aaacgtctattttgta

SEQ ID NO: 4354370 - DNA, 12 bp, Homo sapiens
aaagaacagatg

SEQ ID NO: 4354371 - DNA, 21 bp, Homo sapiens
aaagacaaaaatcaaagaaca

SEQ ID NO: 4354372 - DNA, 13 bp, Homo sapiens
aaagagattcgaa

SEQ ID NO: 4354373 - DNA, 22 bp, Homo sapiens
aaagataacaagatctttcagg

SEQ ID NO: 4354374 - DNA, 17 bp, Homo sapiens
aaagatccagggatgga

SEQ ID NO: 4354375 - DNA, 22 bp, Homo sapiens
aaagatgacctgtggtaagcaa

SEQ ID NO: 4354376 - DNA, 13 bp, Homo sapiens
aaagcaaatgaga

SEQ ID NO: 4354377 - DNA, 13 bp, Homo sapiens
aaagcatgtctca

SEQ ID NO: 4354378 - DNA, 23 bp, Homo sapiens
aaagctggaggaaccattgtgct

SEQ ID NO: 4354379 - DNA, 23 bp, Homo sapiens
aaaggcagccctcacctctgagg

SEQ ID NO: 4354380 - DNA, 15 bp, Homo sapiens
aaagggattgaggag

SEQ ID NO: 4354381 - DNA, 21 bp, Homo sapiens
aaagggattgaggagttgcct

SEQ ID NO: 4354382 - DNA, 13 bp, Homo sapiens
aaaggtgcctcat

SEQ ID NO: 4354383 - DNA, 20 bp, Homo sapiens
aaagttggaaggatctgctg

SEQ ID NO: 4354384 - DNA, 11 bp, Homo sapiens
aaagtttttta

SEQ ID NO: 4354385 - DNA, 12 bp, Homo sapiens
aaataaaattat

SEQ ID NO: 4354386 - DNA, 17 bp, Homo sapiens
aaataaatcatcctcat

SEQ ID NO: 4354387 - DNA, 23 bp, Homo sapiens
aaataatactttaggaaatacgt

SEQ ID NO: 4354388 - DNA, 15 bp, Homo sapiens
aaatagacagtatat

SEQ ID NO: 4354389 - DNA, 15 bp, Homo sapiens
aaatagcctaaatga

SEQ ID NO: 4354390 - DNA, 12 bp, Homo sapiens
aagttaagaatt

SEQ ID NO: 4354391 - DNA, 15 bp, Homo sapiens
aagttaatgaaataa

SEQ ID NO: 4354392 - DNA, 16 bp, Homo sapiens
aagttaatgaaataaa

SEQ ID NO: 4354393 - DNA, 15 bp, Homo sapiens
aagttacttgaaata

SEQ ID NO: 4354394 - DNA, 16 bp, Homo sapiens
aagttacttgaaataa

SEQ ID NO: 4354395 - DNA, 14 bp, Homo sapiens
aagttcccaactga

SEQ ID NO: 4354396 - DNA, 20 bp, Homo sapiens
aagttccttggccatgcaga

SEQ ID NO: 4354397 - DNA, 12 bp, Homo sapiens
aagttggaagga

SEQ ID NO: 4354398 - DNA, 14 bp, Homo sapiens
aagttggaaggatc

SEQ ID NO: 4354399 - DNA, 17 bp, Homo sapiens
aagttgtggatatcagg

SEQ ID NO: 4354400 - DNA, 15 bp, Homo sapiens
aataaaatttgaaac

SEQ ID NO: 4354401 - DNA, 13 bp, Homo sapiens
aataaagtttatt

SEQ ID NO: 4354402 - DNA, 20 bp, Homo sapiens
aataaatatgtaatataaat

SEQ ID NO: 4354403 - DNA, 16 bp, Homo sapiens
aataaatcatcctcat

SEQ ID NO: 4354404 - DNA, 19 bp, Homo sapiens
aataacactgcagccctct

SEQ ID NO: 4354405 - DNA, 21 bp, Homo sapiens
aataacactgcagccctctcc

SEQ ID NO: 4354406 - DNA, 16 bp, Homo sapiens
aataagttacttgaaa

SEQ ID NO: 4354407 - DNA, 18 bp, Homo sapiens
aataagttacttgaaata

SEQ ID NO: 4354408 - DNA, 21 bp, Homo sapiens
aataatactttaggaaatacg

SEQ ID NO: 4354409 - DNA, 15 bp, Homo sapiens
aataatttgtacaat

SEQ ID NO: 4354410 - DNA, 20 bp, Homo sapiens
aatactatattaaattctga

SEQ ID NO: 4354411 - DNA, 18 bp, Homo sapiens
aatacttgacctctgtga

SEQ ID NO: 4354412 - DNA, 11 bp, Homo sapiens
aatagcctaaa

SEQ ID NO: 4354413 - DNA, 14 bp, Homo sapiens
aatataagcataaa

SEQ ID NO: 4354414 - DNA, 19 bp, Homo sapiens
aatatggatcagagcattt

SEQ ID NO: 4354415 - DNA, 15 bp, Homo sapiens
aatatgtaatataaa

SEQ ID NO: 4354416 - DNA, 13 bp, Homo sapiens
aatattaaagata

SEQ ID NO: 4354417 - DNA, 14 bp, Homo sapiens
aatatttttaaatg

SEQ ID NO: 4354418 - DNA, 16 bp, Homo sapiens
aatcaggaaaaatgag

SEQ ID NO: 4354419 - DNA, 17 bp, Homo sapiens
aatcaggtaagatcata

SEQ ID NO: 4354420 - DNA, 15 bp, Homo sapiens
aatccaaaagacaaa

SEQ ID NO: 4354421 - DNA, 19 bp, Homo sapiens
aatccatgttagtttttac

SEQ ID NO: 4354422 - DNA, 22 bp, Homo sapiens
aatccatgttagtttttacttt

SEQ ID NO: 4354423 - DNA, 18 bp, Homo sapiens
aatccccaacatgcactg

SEQ ID NO: 4354424 - DNA, 13 bp, Homo sapiens
aatccgacttgaa

SEQ ID NO: 4354425 - DNA, 22 bp, Homo sapiens
aatccttttcccataaataaaa

SEQ ID NO: 4354426 - DNA, 18 bp, Homo sapiens
aatctatatttgtcttcc

SEQ ID NO: 4354427 - DNA, 14 bp, Homo sapiens
aatgaacattttgt

SEQ ID NO: 4354428 - DNA, 12 bp, Homo sapiens
aatgaccaaaga

SEQ ID NO: 4354429 - DNA, 24 bp, Homo sapiens
aatgacggtaagtgttctcatgaa

SEQ ID NO: 4354430 - DNA, 13 bp, Homo sapiens
aatgagacatcca

SEQ ID NO: 4354431 - DNA, 15 bp, Homo sapiens
aatgagacatccagc

SEQ ID NO: 4354432 - DNA, 17 bp, Homo sapiens
aatgagatcccgcctct

SEQ ID NO: 4354433 - DNA, 20 bp, Homo sapiens
aatgagatgttattactgtt

SEQ ID NO: 4354434 - DNA, 20 bp, Homo sapiens
aatgattcaaattgctgctt

SEQ ID NO: 4354435 - DNA, 22 bp, Homo sapiens
aatgattcaaattgctgcttgg

SEQ ID NO: 4354436 - DNA, 14 bp, Homo sapiens
aatgcacctcccca

SEQ ID NO: 4354437 - DNA, 19 bp, Homo sapiens
aatgccaagggggtgactg

SEQ ID NO: 4354438 - DNA, 21 bp, Homo sapiens
aatgccaagggggtgactgga

SEQ ID NO: 4354439 - DNA, 12 bp, Homo sapiens
aatgcctcctcc

SEQ ID NO: 4354440 - DNA, 20 bp, Homo sapiens
aatggactgtacaataagtt

SEQ ID NO: 4354441 - DNA, 14 bp, Homo sapiens
aatggcgtctgctc

SEQ ID NO: 4354442 - DNA, 17 bp, Homo sapiens
aatggcgtctgctctgg

SEQ ID NO: 4354443 - DNA, 18 bp, Homo sapiens
aatggggggcgggccagg

SEQ ID NO: 4354444 - DNA, 16 bp, Homo sapiens
aatggtattgtaacta

SEQ ID NO: 4354445 - DNA, 14 bp, Homo sapiens
aatggtttattccc

SEQ ID NO: 4354446 - DNA, 20 bp, Homo sapiens
aatgtacaattttatataat

SEQ ID NO: 4354447 - DNA, 22 bp, Homo sapiens
aatgtacgctgctgcaggacat

SEQ ID NO: 4354448 - DNA, 22 bp, Homo sapiens
aatgtagggcctgcatggagaa

SEQ ID NO: 4354449 - DNA, 18 bp, Homo sapiens
aatgtatcaggaaatata

SEQ ID NO: 4354450 - DNA, 18 bp, Homo sapiens
aatgtattattctgcagc

SEQ ID NO: 4354451 - DNA, 23 bp, Homo sapiens
aatgtatttgtgcacatgtacat

SEQ ID NO: 4354452 - DNA, 16 bp, Homo sapiens
aattaaaccgcatgtg

SEQ ID NO: 4354453 - DNA, 19 bp, Homo sapiens
aattaagttttaaataaac

SEQ ID NO: 4354454 - DNA, 20 bp, Homo sapiens
aattcagatatatttttcac

SEQ ID NO: 4354455 - DNA, 16 bp, Homo sapiens
aattcataaccaaaga

SEQ ID NO: 4354456 - DNA, 18 bp, Homo sapiens
aattccctgaaaaactag

SEQ ID NO: 4354457 - DNA, 22 bp, Homo sapiens
aattccctgaaaaactagtaat

SEQ ID NO: 4354458 - DNA, 18 bp, Homo sapiens
aattcccttgaattgtgt

SEQ ID NO: 4354459 - DNA, 18 bp, Homo sapiens
aattctgggagaatgaaa

SEQ ID NO: 4354460 - DNA, 22 bp, Homo sapiens
aattgagcagttctgttgcatg

SEQ ID NO: 4354461 - DNA, 18 bp, Homo sapiens
aattgtgtattgatgcaa

SEQ ID NO: 4354462 - DNA, 22 bp, Homo sapiens
aattgtgtattgatgcaatata

SEQ ID NO: 4354463 - DNA, 23 bp, Homo sapiens
aattgttcttgggagaaaatcaa

SEQ ID NO: 4354464 - DNA, 17 bp, Homo sapiens
aatttacatcagaagtt

SEQ ID NO: 4354465 - DNA, 19 bp, Homo sapiens
aatttcccaattaggaagt

SEQ ID NO: 4354466 - DNA, 18 bp, Homo sapiens
aatttggtaaaaatgctg

SEQ ID NO: 4354467 - DNA, 14 bp, Homo sapiens
aatttgtacaatgg

SEQ ID NO: 4354468 - DNA, 18 bp, Homo sapiens
aatttgtacaatggttta

SEQ ID NO: 4354469 - DNA, 19 bp, Homo sapiens
aatttgtacaatggtttat

SEQ ID NO: 4354470 - DNA, 13 bp, Homo sapiens
acaaaagttacta

SEQ ID NO: 4354471 - DNA, 13 bp, Homo sapiens
acaaaggagcctt

SEQ ID NO: 4354472 - DNA, 15 bp, Homo sapiens
acaaaggagccttga

SEQ ID NO: 4354473 - DNA, 14 bp, Homo sapiens
acaaagtaaaatga

SEQ ID NO: 4354474 - DNA, 16 bp, Homo sapiens
acaaatgtgtttttct

SEQ ID NO: 4354475 - DNA, 18 bp, Homo sapiens
acaaatgtgtttttctat

SEQ ID NO: 4354476 - DNA, 20 bp, Homo sapiens
acaaatgtgtttttctatat

SEQ ID NO: 4354477 - DNA, 22 bp, Homo sapiens
acaaatgtgtttttctatatag

SEQ ID NO: 4354478 - DNA, 17 bp, Homo sapiens
acaaccctgttttatac

SEQ ID NO: 4354479 - DNA, 20 bp, Homo sapiens
acaagagcccagcagggcct

SEQ ID NO: 4354480 - DNA, 23 bp, Homo sapiens
acaagaggcttccctagtttaca

SEQ ID NO: 4354481 - DNA, 14 bp, Homo sapiens
acaagatctttcag

SEQ ID NO: 4354482 - DNA, 15 bp, Homo sapiens
acaataaagtttatt

SEQ ID NO: 4354483 - DNA, 17 bp, Homo sapiens
acaataaagtttattat

SEQ ID NO: 4354484 - DNA, 19 bp, Homo sapiens
acaataagttacttgaaat

SEQ ID NO: 4354485 - DNA, 12 bp, Homo sapiens
acaatcaggtaa

SEQ ID NO: 4354486 - DNA, 18 bp, Homo sapiens
acaatggtttattcccaa

SEQ ID NO: 4354487 - DNA, 16 bp, Homo sapiens
acacacatctggccct

SEQ ID NO: 4354488 - DNA, 19 bp, Homo sapiens
acacacgagcaaacccaga

SEQ ID NO: 4354489 - DNA, 20 bp, Homo sapiens
acacacgagcaaacccagag

SEQ ID NO: 4354490 - DNA, 21 bp, Homo sapiens
acacagagtggtctttctgga

SEQ ID NO: 4354491 - DNA, 13 bp, Homo sapiens
acacgagcaaacc

SEQ ID NO: 4354492 - DNA, 17 bp, Homo sapiens
acacgagcaaacccaga

SEQ ID NO: 4354493 - DNA, 15 bp, Homo sapiens
acacgattgagaact

SEQ ID NO: 4354494 - DNA, 13 bp, Homo sapiens
acactagcctctc

SEQ ID NO: 4354495 - DNA, 16 bp, Homo sapiens
acactgggtgcgtctc

SEQ ID NO: 4354496 - DNA, 19 bp, Homo sapiens
acactgggtgcgtctccag

SEQ ID NO: 4354497 - DNA, 13 bp, Homo sapiens
acactgtcttccc

SEQ ID NO: 4354498 - DNA, 15 bp, Homo sapiens
acactgtcttcccga

SEQ ID NO: 4354499 - DNA, 19 bp, Homo sapiens
acactgtcttcccgatgag

SEQ ID NO: 4354500 - DNA, 13 bp, Homo sapiens
acacttgtgtgtg

SEQ ID NO: 4354501 - DNA, 18 bp, Homo sapiens
acacttgtgtgtgggctg

SEQ ID NO: 4354502 - DNA, 22 bp, Homo sapiens
acacttgtgtgtgggctgtgag

SEQ ID NO: 4354503 - DNA, 16 bp, Homo sapiens
acagaaaccaagccat

SEQ ID NO: 4354504 - DNA, 19 bp, Homo sapiens
acagaaaccaagccattaa

SEQ ID NO: 4354505 - DNA, 24 bp, Homo sapiens
acagagtggtctttctggagaggt

SEQ ID NO: 4354506 - DNA, 22 bp, Homo sapiens
acagatggggtctgtgactgga

SEQ ID NO: 4354507 - DNA, 23 bp, Homo sapiens
acagatggggtctgtgactggat

SEQ ID NO: 4354508 - DNA, 16 bp, Homo sapiens
acagcacaagggcaca

SEQ ID NO: 4354509 - DNA, 15 bp, Homo sapiens
acagcatatagaata

SEQ ID NO: 4354510 - DNA, 22 bp, Homo sapiens
actgtacaataagttacttgaa

SEQ ID NO: 4354511 - DNA, 18 bp, Homo sapiens
actgtacttaataaattc

SEQ ID NO: 4354512 - DNA, 18 bp, Homo sapiens
actgtctcagtttcactt

SEQ ID NO: 4354513 - DNA, 13 bp, Homo sapiens
actgtgatgccac

SEQ ID NO: 4354514 - DNA, 18 bp, Homo sapiens
actgtgtggactgtgatg

SEQ ID NO: 4354515 - DNA, 19 bp, Homo sapiens
actgtgtttcgcattaagc

SEQ ID NO: 4354516 - DNA, 22 bp, Homo sapiens
actgtgtttcgcattaagcaca

SEQ ID NO: 4354517 - DNA, 13 bp, Homo sapiens
actgttttgggcc

SEQ ID NO: 4354518 - DNA, 17 bp, Homo sapiens
actgttttgggcctcca

SEQ ID NO: 4354519 - DNA, 19 bp, Homo sapiens
acttaatgcagtgggcagt

SEQ ID NO: 4354520 - DNA, 14 bp, Homo sapiens
acttacaaaatgcc

SEQ ID NO: 4354521 - DNA, 15 bp, Homo sapiens
acttacaaaatgcca

SEQ ID NO: 4354522 - DNA, 23 bp, Homo sapiens
acttacaaaatgccaagggggtg

SEQ ID NO: 4354523 - DNA, 21 bp, Homo sapiens
acttcagggcagggctctgat

SEQ ID NO: 4354524 - DNA, 14 bp, Homo sapiens
acttctgtacagta

SEQ ID NO: 4354525 - DNA, 21 bp, Homo sapiens
acttctttagcatttttatgc

SEQ ID NO: 4354526 - DNA, 22 bp, Homo sapiens
acttctttagcatttttatgca

SEQ ID NO: 4354527 - DNA, 23 bp, Homo sapiens
acttctttagcatttttatgcag

SEQ ID NO: 4354528 - DNA, 14 bp, Homo sapiens
acttgaaataagtt

SEQ ID NO: 4354529 - DNA, 17 bp, Homo sapiens
acttgaaggatggatga

SEQ ID NO: 4354530 - DNA, 16 bp, Homo sapiens
acttggagactcctgg

SEQ ID NO: 4354531 - DNA, 21 bp, Homo sapiens
acttggagactcctggtctgt

SEQ ID NO: 4354532 - DNA, 22 bp, Homo sapiens
acttggagactcctggtctgtg

SEQ ID NO: 4354533 - DNA, 15 bp, Homo sapiens
acttgtctttttctg

SEQ ID NO: 4354534 - DNA, 16 bp, Homo sapiens
acttgtctttttctgg

SEQ ID NO: 4354535 - DNA, 17 bp, Homo sapiens
acttgtctttttctgga

SEQ ID NO: 4354536 - DNA, 23 bp, Homo sapiens
acttgtgtgtgggctgtgagtgt

SEQ ID NO: 4354537 - DNA, 17 bp, Homo sapiens
actttcacatagatgtc

SEQ ID NO: 4354538 - DNA, 20 bp, Homo sapiens
actttcacatagatgtccct

SEQ ID NO: 4354539 - DNA, 21 bp, Homo sapiens
actttcacatagatgtccctt

SEQ ID NO: 4354540 - DNA, 19 bp, Homo sapiens
actttctgttgccacaacc

SEQ ID NO: 4354541 - DNA, 14 bp, Homo sapiens
actttgaagggcaa

SEQ ID NO: 4354542 - DNA, 21 bp, Homo sapiens
actttgaagggcaagaaatgg

SEQ ID NO: 4354543 - DNA, 22 bp, Homo sapiens
agaaacacccctctgtctagga

SEQ ID NO: 4354544 - DNA, 15 bp, Homo sapiens
agaaagaattcctgc

SEQ ID NO: 4354545 - DNA, 22 bp, Homo sapiens
agaaagaattcctgcagcagtt

SEQ ID NO: 4354546 - DNA, 15 bp, Homo sapiens
agaaagcaaacaaaa

SEQ ID NO: 4354547 - DNA, 19 bp, Homo sapiens
agaaagcatccctcaccca

SEQ ID NO: 4354548 - DNA, 14 bp, Homo sapiens
agaaaggtctctgg

SEQ ID NO: 4354549 - DNA, 18 bp, Homo sapiens
agaaatagacagtatatt

SEQ ID NO: 4354550 - DNA, 12 bp, Homo sapiens
agaaatgaataa

SEQ ID NO: 4354551 - DNA, 14 bp, Homo sapiens
agaaattcaggtac

SEQ ID NO: 4354552 - DNA, 13 bp, Homo sapiens
agaacaaatgtgt

SEQ ID NO: 4354553 - DNA, 15 bp, Homo sapiens
agaacaaatgtgttt

SEQ ID NO: 4354554 - DNA, 21 bp, Homo sapiens
agaacctgcacacaggacagc

SEQ ID NO: 4354555 - DNA, 15 bp, Homo sapiens
agaagaaatagcaga

SEQ ID NO: 4354556 - DNA, 11 bp, Homo sapiens
agaagaagagg

SEQ ID NO: 4354557 - DNA, 15 bp, Homo sapiens
agaagaagaggaaga

SEQ ID NO: 4354558 - DNA, 18 bp, Homo sapiens
agaagaagaggaagaaat

SEQ ID NO: 4354559 - DNA, 15 bp, Homo sapiens
agaagagaattcagt

SEQ ID NO: 4354560 - DNA, 15 bp, Homo sapiens
agaagctagatgccc

SEQ ID NO: 4354561 - DNA, 21 bp, Homo sapiens
agaagctagatgcccctgcag

SEQ ID NO: 4354562 - DNA, 16 bp, Homo sapiens
agaatcccacattagc

SEQ ID NO: 4354563 - DNA, 14 bp, Homo sapiens
agaatgagacatcc

SEQ ID NO: 4354564 - DNA, 23 bp, Homo sapiens
agacaaaaatcaaagaacagatg

SEQ ID NO: 4354565 - DNA, 21 bp, Homo sapiens
agacacgattgagaactgaca

SEQ ID NO: 4354566 - DNA, 22 bp, Homo sapiens
agacactaacgacttcagggca

SEQ ID NO: 4354567 - DNA, 15 bp, Homo sapiens
agacagaaaccaagc

SEQ ID NO: 4354568 - DNA, 19 bp, Homo sapiens
agacagcttgactgctttt

SEQ ID NO: 4354569 - DNA, 17 bp, Homo sapiens
agacagtctgttatgca

SEQ ID NO: 4354570 - DNA, 21 bp, Homo sapiens
agacagtctgttatgcactgt

SEQ ID NO: 4354571 - DNA, 13 bp, Homo sapiens
agacccccaggcc

SEQ ID NO: 4354572 - DNA, 15 bp, Homo sapiens
agacccccaggcctg

SEQ ID NO: 4354573 - DNA, 14 bp, Homo sapiens
agacccctctggcc

SEQ ID NO: 4354574 - DNA, 21 bp, Homo sapiens
agacccctctggccaggatgg

SEQ ID NO: 4354575 - DNA, 22 bp, Homo sapiens
agacccctctggccaggatgga

SEQ ID NO: 4354576 - DNA, 15 bp, Homo sapiens
agacctcatgcccag

SEQ ID NO: 4354577 - DNA, 19 bp, Homo sapiens
agacctcatgcccagctct

SEQ ID NO: 4354578 - DNA, 20 bp, Homo sapiens
agacctcatgcccagctctc

SEQ ID NO: 4354579 - DNA, 22 bp, Homo sapiens
agacctcatgcccagctctctg

SEQ ID NO: 4354580 - DNA, 15 bp, Homo sapiens
agactccaaggagct

SEQ ID NO: 4354581 - DNA, 22 bp, Homo sapiens
agactctttttttgagtgacag

SEQ ID NO: 4354582 - DNA, 22 bp, Homo sapiens
agactgggaagataggctctgc

SEQ ID NO: 4354583 - DNA, 23 bp, Homo sapiens
agactgggaagataggctctgca

SEQ ID NO: 4354584 - DNA, 20 bp, Homo sapiens
agacttgggatggggaggga

SEQ ID NO: 4354585 - DNA, 16 bp, Homo sapiens
agactttatgtagttt

SEQ ID NO: 4354586 - DNA, 22 bp, Homo sapiens
agagaatcccacattagcttgt

SEQ ID NO: 4354587 - DNA, 18 bp, Homo sapiens
agagagaggctgcctcag

SEQ ID NO: 4354588 - DNA, 18 bp, Homo sapiens
agagccggtggtgcccgt

SEQ ID NO: 4354589 - DNA, 22 bp, Homo sapiens
agagcttgctccagattctgat

SEQ ID NO: 4354590 - DNA, 11 bp, Homo sapiens
agagctttgtc

SEQ ID NO: 4354591 - DNA, 12 bp, Homo sapiens
agagctttgtca

SEQ ID NO: 4354592 - DNA, 13 bp, Homo sapiens
agagctttgtcac

SEQ ID NO: 4354593 - DNA, 12 bp, Homo sapiens
agaggaagaaat

SEQ ID NO: 4354594 - DNA, 10 bp, Homo sapiens
agaggaatgt

SEQ ID NO: 4354595 - DNA, 13 bp, Homo sapiens
agaggctgcctca

SEQ ID NO: 4354596 - DNA, 16 bp, Homo sapiens
agaggctgcctcagcc

SEQ ID NO: 4354597 - DNA, 13 bp, Homo sapiens
agaggggcgggct

SEQ ID NO: 4354598 - DNA, 20 bp, Homo sapiens
agaggggcgggctcagagct

SEQ ID NO: 4354599 - DNA, 15 bp, Homo sapiens
agagggtgcagtcca

SEQ ID NO: 4354600 - DNA, 19 bp, Homo sapiens
agaggtgtcgggacatggt

SEQ ID NO: 4354601 - DNA, 19 bp, Homo sapiens
agagtcatctccatcagct

SEQ ID NO: 4354602 - DNA, 20 bp, Homo sapiens
agagtggcaggtgggctgcc

SEQ ID NO: 4354603 - DNA, 21 bp, Homo sapiens
agataacaagatctttcagga

SEQ ID NO: 4354604 - DNA, 16 bp, Homo sapiens
agataggctctgcaca

SEQ ID NO: 4354605 - DNA, 16 bp, Homo sapiens
agatcaccttgtattc

SEQ ID NO: 4354606 - DNA, 15 bp, Homo sapiens
agatcccgcctcttc

SEQ ID NO: 4354607 - DNA, 14 bp, Homo sapiens
agatctgactgcca

SEQ ID NO: 4354608 - DNA, 23 bp, Homo sapiens
agatgaggaggtacaaaagttac

SEQ ID NO: 4354609 - DNA, 22 bp, Homo sapiens
agatgtccctttcttggccagt

SEQ ID NO: 4354610 - DNA, 19 bp, Homo sapiens
agatgtgcaataatttgta

SEQ ID NO: 4354611 - DNA, 22 bp, Homo sapiens
agatgtgcaataatttgtacaa

SEQ ID NO: 4354612 - DNA, 16 bp, Homo sapiens
agatgttattactgtt

SEQ ID NO: 4354613 - DNA, 17 bp, Homo sapiens
agatgttattactgttt

SEQ ID NO: 4354614 - DNA, 14 bp, Homo sapiens
agattctgatgcat

SEQ ID NO: 4354615 - DNA, 12 bp, Homo sapiens
agatttaaaata

SEQ ID NO: 4354616 - DNA, 14 bp, Homo sapiens
agcaaacaaaattg

SEQ ID NO: 4354617 - DNA, 13 bp, Homo sapiens
agcaaacccagag

SEQ ID NO: 4354618 - DNA, 19 bp, Homo sapiens
agcaaacgtctattttgta

SEQ ID NO: 4354619 - DNA, 13 bp, Homo sapiens
agcaacctgggca

SEQ ID NO: 4354620 - DNA, 14 bp, Homo sapiens
agcaacttctagca

SEQ ID NO: 4354621 - DNA, 15 bp, Homo sapiens
agcaacttgtctttt

SEQ ID NO: 4354622 - DNA, 17 bp, Homo sapiens
agcaatccatgttagtt

SEQ ID NO: 4354623 - DNA, 22 bp, Homo sapiens
agcaatccatgttagtttttac

SEQ ID NO: 4354624 - DNA, 22 bp, Homo sapiens
agcacacacaaacctactgccc

SEQ ID NO: 4354625 - DNA, 17 bp, Homo sapiens
agcacacacatctggcc

SEQ ID NO: 4354626 - DNA, 19 bp, Homo sapiens
agcacacacatctggccct

SEQ ID NO: 4354627 - DNA, 21 bp, Homo sapiens
agcacacacatctggccctga

SEQ ID NO: 4354628 - DNA, 23 bp, Homo sapiens
agcacacccttcacactgttatc

SEQ ID NO: 4354629 - DNA, 13 bp, Homo sapiens
agcaccacactgg

SEQ ID NO: 4354630 - DNA, 15 bp, Homo sapiens
atatttatagtcaca

SEQ ID NO: 4354631 - DNA, 21 bp, Homo sapiens
atatttccttaaactgtgtgg

SEQ ID NO: 4354632 - DNA, 17 bp, Homo sapiens
atcaataaaatgtgatt

SEQ ID NO: 4354633 - DNA, 15 bp, Homo sapiens
atcactctaatataa

SEQ ID NO: 4354634 - DNA, 16 bp, Homo sapiens
atcagaagtttgcatc

SEQ ID NO: 4354635 - DNA, 21 bp, Homo sapiens
atcagcaacttctagcatata

SEQ ID NO: 4354636 - DNA, 20 bp, Homo sapiens
atcagccccgcctgtcacaa

SEQ ID NO: 4354637 - DNA, 22 bp, Homo sapiens
atcagccccgcctgtcacaata

SEQ ID NO: 4354638 - DNA, 20 bp, Homo sapiens
atcaggaaatatatatgtgt

SEQ ID NO: 4354639 - DNA, 20 bp, Homo sapiens
atcatcggagttgacagtga

SEQ ID NO: 4354640 - DNA, 17 bp, Homo sapiens
atcatttgaacaactag

SEQ ID NO: 4354641 - DNA, 14 bp, Homo sapiens
atccaatcctcact

SEQ ID NO: 4354642 - DNA, 19 bp, Homo sapiens
atccatgttagtttttact

SEQ ID NO: 4354643 - DNA, 13 bp, Homo sapiens
atccccaccccac

SEQ ID NO: 4354644 - DNA, 14 bp, Homo sapiens
atccccaccccacc

SEQ ID NO: 4354645 - DNA, 19 bp, Homo sapiens
atccccttcccccatccct

SEQ ID NO: 4354646 - DNA, 12 bp, Homo sapiens
atccctaccact

SEQ ID NO: 4354647 - DNA, 14 bp, Homo sapiens
atcctcactgggtg

SEQ ID NO: 4354648 - DNA, 15 bp, Homo sapiens
atcctcactgggtgg

SEQ ID NO: 4354649 - DNA, 18 bp, Homo sapiens
atcctgcaggaaatataa

SEQ ID NO: 4354650 - DNA, 18 bp, Homo sapiens
atccttgctgcagcttct

SEQ ID NO: 4354651 - DNA, 18 bp, Homo sapiens
atcctttttctttataaa

SEQ ID NO: 4354652 - DNA, 19 bp, Homo sapiens
atcgttatagagagcaatt

SEQ ID NO: 4354653 - DNA, 15 bp, Homo sapiens
atctgctataaactt

SEQ ID NO: 4354654 - DNA, 13 bp, Homo sapiens
atctgctgaggcc

SEQ ID NO: 4354655 - DNA, 21 bp, Homo sapiens
atctgtaagagcttgctccag

SEQ ID NO: 4354656 - DNA, 16 bp, Homo sapiens
atcttgtggggccagg

SEQ ID NO: 4354657 - DNA, 12 bp, Homo sapiens
atctttcaggaa

SEQ ID NO: 4354658 - DNA, 21 bp, Homo sapiens
atgaaataaaatttgaaactg

SEQ ID NO: 4354659 - DNA, 14 bp, Homo sapiens
atgaaatactgcct

SEQ ID NO: 4354660 - DNA, 12 bp, Homo sapiens
atgaacagctgt

SEQ ID NO: 4354661 - DNA, 13 bp, Homo sapiens
atgaagcaggagg

SEQ ID NO: 4354662 - DNA, 15 bp, Homo sapiens
atgaatgcacactag

SEQ ID NO: 4354663 - DNA, 13 bp, Homo sapiens
atgaatttgctaa

SEQ ID NO: 4354664 - DNA, 16 bp, Homo sapiens
atgacccacactgcca

SEQ ID NO: 4354665 - DNA, 21 bp, Homo sapiens
atgacccacactgccagaaga

SEQ ID NO: 4354666 - DNA, 18 bp, Homo sapiens
atgacggtaagtgttctc

SEQ ID NO: 4354667 - DNA, 19 bp, Homo sapiens
atgagatcccgcctcttct

SEQ ID NO: 4354668 - DNA, 14 bp, Homo sapiens
atgaggaatccaaa

SEQ ID NO: 4354669 - DNA, 20 bp, Homo sapiens
atgaggaggtacaaaagtta

SEQ ID NO: 4354670 - DNA, 19 bp, Homo sapiens
atgatgtaaaaaatattaa

SEQ ID NO: 4354671 - DNA, 23 bp, Homo sapiens
atgcaacgggattgaagggtcct

SEQ ID NO: 4354672 - DNA, 18 bp, Homo sapiens
atgcaatgtatagtgtct

SEQ ID NO: 4354673 - DNA, 18 bp, Homo sapiens
atgcactgtggtttcaga

SEQ ID NO: 4354674 - DNA, 16 bp, Homo sapiens
atgcagacagtctgtt

SEQ ID NO: 4354675 - DNA, 21 bp, Homo sapiens
atgcagacagtctgttatgca

SEQ ID NO: 4354676 - DNA, 19 bp, Homo sapiens
atgcaggaggtggagaaaa

SEQ ID NO: 4354677 - DNA, 22 bp, Homo sapiens
atgcaggaggtggagaaaattg

SEQ ID NO: 4354678 - DNA, 20 bp, Homo sapiens
atgcagttttttggaagaaa

SEQ ID NO: 4354679 - DNA, 20 bp, Homo sapiens
atgccaagggggtgactgga

SEQ ID NO: 4354680 - DNA, 12 bp, Homo sapiens
atgcccagctct

SEQ ID NO: 4354681 - DNA, 17 bp, Homo sapiens
atgcccagctctctgac

SEQ ID NO: 4354682 - DNA, 18 bp, Homo sapiens
atgcccagctctctgacg

SEQ ID NO: 4354683 - DNA, 15 bp, Homo sapiens
atgccccagctctgg

SEQ ID NO: 4354684 - DNA, 21 bp, Homo sapiens
atgcccctgcagtttggccct

SEQ ID NO: 4354685 - DNA, 15 bp, Homo sapiens
atgccttaagcagaa

SEQ ID NO: 4354686 - DNA, 21 bp, Homo sapiens
atgccttaagcagaacaaatg

SEQ ID NO: 4354687 - DNA, 17 bp, Homo sapiens
atgctttccctgaggaa

SEQ ID NO: 4354688 - DNA, 20 bp, Homo sapiens
atggaggggtggtcctgact

SEQ ID NO: 4354689 - DNA, 23 bp, Homo sapiens
atggcatttggtctcaggcagca

SEQ ID NO: 4354690 - DNA, 16 bp, Homo sapiens
atggccatgcaggagg

SEQ ID NO: 4354691 - DNA, 17 bp, Homo sapiens
atggccatgcaggaggt

SEQ ID NO: 4354692 - DNA, 20 bp, Homo sapiens
atggccatgcaggaggtgga

SEQ ID NO: 4354693 - DNA, 14 bp, Homo sapiens
atggcgtctgctct

SEQ ID NO: 4354694 - DNA, 19 bp, Homo sapiens
atggcgtctgctctggtgg

SEQ ID NO: 4354695 - DNA, 17 bp, Homo sapiens
atggggggcgggccagg

SEQ ID NO: 4354696 - DNA, 18 bp, Homo sapiens
atggggtctgtgactgga

SEQ ID NO: 4354697 - DNA, 19 bp, Homo sapiens
atggggtctgtgactggat

SEQ ID NO: 4354698 - DNA, 20 bp, Homo sapiens
atggtcaagttcccaactga

SEQ ID NO: 4354699 - DNA, 12 bp, Homo sapiens
atggtgtctccc

SEQ ID NO: 4354700 - DNA, 16 bp, Homo sapiens
atggttgggggaatgc

SEQ ID NO: 4354701 - DNA, 22 bp, Homo sapiens
atggtttattcccaagtatgcc

SEQ ID NO: 4354702 - DNA, 14 bp, Homo sapiens
atgtaaggcactgt

SEQ ID NO: 4354703 - DNA, 23 bp, Homo sapiens
atgtaaggcactgtcaggaatgg

SEQ ID NO: 4354704 - DNA, 14 bp, Homo sapiens
atgtaatataaatt

SEQ ID NO: 4354705 - DNA, 19 bp, Homo sapiens
atgtacttgaaggatggat

SEQ ID NO: 4354706 - DNA, 14 bp, Homo sapiens
atgtatagtgtcta

SEQ ID NO: 4354707 - DNA, 14 bp, Homo sapiens
atgtattattctgc

SEQ ID NO: 4354708 - DNA, 20 bp, Homo sapiens
atgtattattctgcagcatg

SEQ ID NO: 4354709 - DNA, 23 bp, Homo sapiens
atgtcacagtccaaccagaaaca

SEQ ID NO: 4354710 - DNA, 14 bp, Homo sapiens
atgtcccacccacc

SEQ ID NO: 4354711 - DNA, 13 bp, Homo sapiens
atgtcccctgcgg

SEQ ID NO: 4354712 - DNA, 20 bp, Homo sapiens
atgtctcaatagtaaaagat

SEQ ID NO: 4354713 - DNA, 15 bp, Homo sapiens
atgtgatttttctga

SEQ ID NO: 4354714 - DNA, 14 bp, Homo sapiens
atgtgcaataattt

SEQ ID NO: 4354715 - DNA, 17 bp, Homo sapiens
atgtgcaataatttgta

SEQ ID NO: 4354716 - DNA, 16 bp, Homo sapiens
atgtggggacagggct

SEQ ID NO: 4354717 - DNA, 22 bp, Homo sapiens
atgtgtttttctatatagttcc

SEQ ID NO: 4354718 - DNA, 16 bp, Homo sapiens
atgttaaaaatagcag

SEQ ID NO: 4354719 - DNA, 23 bp, Homo sapiens
atgttactgtctgactacaacat

SEQ ID NO: 4354720 - DNA, 17 bp, Homo sapiens
atgttatgaacagctgt

SEQ ID NO: 4354721 - DNA, 13 bp, Homo sapiens
atgttattactgt

SEQ ID NO: 4354722 - DNA, 22 bp, Homo sapiens
atgttattactgttttgggcct

SEQ ID NO: 4354723 - DNA, 17 bp, Homo sapiens
atgttgtaatatttctt

SEQ ID NO: 4354724 - DNA, 19 bp, Homo sapiens
atgttgtaatatttcttca

SEQ ID NO: 4354725 - DNA, 15 bp, Homo sapiens
atgttgtgtttttaa

SEQ ID NO: 4354726 - DNA, 19 bp, Homo sapiens
atgtttaaatagcctaaat

SEQ ID NO: 4354727 - DNA, 17 bp, Homo sapiens
attaaacttaaaacttt

SEQ ID NO: 4354728 - DNA, 19 bp, Homo sapiens
attaaacttaaaactttgt

SEQ ID NO: 4354729 - DNA, 17 bp, Homo sapiens
attaaagattggaatgt

SEQ ID NO: 4354730 - DNA, 23 bp, Homo sapiens
attaaatatccagccagtacagt

SEQ ID NO: 4354731 - DNA, 12 bp, Homo sapiens
attaagcacaca

SEQ ID NO: 4354732 - DNA, 21 bp, Homo sapiens
attacaccaccggccccctcc

SEQ ID NO: 4354733 - DNA, 18 bp, Homo sapiens
attactgttttgggcctc

SEQ ID NO: 4354734 - DNA, 14 bp, Homo sapiens
attagttttaaaat

SEQ ID NO: 4354735 - DNA, 16 bp, Homo sapiens
attagttttaaaatac

SEQ ID NO: 4354736 - DNA, 17 bp, Homo sapiens
attagttttaaaatact

SEQ ID NO: 4354737 - DNA, 23 bp, Homo sapiens
attatcacattaatctcaaagag

SEQ ID NO: 4354738 - DNA, 12 bp, Homo sapiens
attcagcacaca

SEQ ID NO: 4354739 - DNA, 13 bp, Homo sapiens
attccaattctaa

SEQ ID NO: 4354740 - DNA, 15 bp, Homo sapiens
attccaattctaaat

SEQ ID NO: 4354741 - DNA, 15 bp, Homo sapiens
attccatgaatgtat

SEQ ID NO: 4354742 - DNA, 16 bp, Homo sapiens
attccctgaaaaacta

SEQ ID NO: 4354743 - DNA, 18 bp, Homo sapiens
attcctaagagtggagga

SEQ ID NO: 4354744 - DNA, 12 bp, Homo sapiens
attcctggactt

SEQ ID NO: 4354745 - DNA, 13 bp, Homo sapiens
attctgcagcatg

SEQ ID NO: 4354746 - DNA, 16 bp, Homo sapiens
attgacagcatataga

SEQ ID NO: 4354747 - DNA, 12 bp, Homo sapiens
attgagaactga

SEQ ID NO: 4354748 - DNA, 18 bp, Homo sapiens
attgatgcaatataagca

SEQ ID NO: 4354749 - DNA, 14 bp, Homo sapiens
attgcattgctggt

SEQ ID NO: 4354750 - DNA, 14 bp, Homo sapiens
cacctctgattaca

SEQ ID NO: 4354751 - DNA, 18 bp, Homo sapiens
cacctctttaaaaactca

SEQ ID NO: 4354752 - DNA, 22 bp, Homo sapiens
cacctctttaaaaactcactta

SEQ ID NO: 4354753 - DNA, 13 bp, Homo sapiens
caccttggaaggg

SEQ ID NO: 4354754 - DNA, 19 bp, Homo sapiens
caccttttaagttaatgaa

SEQ ID NO: 4354755 - DNA, 22 bp, Homo sapiens
cacgagcaaacccagaggtgga

SEQ ID NO: 4354756 - DNA, 13 bp, Homo sapiens
cactctgccccca

SEQ ID NO: 4354757 - DNA, 14 bp, Homo sapiens
cactgaatggaaat

SEQ ID NO: 4354758 - DNA, 16 bp, Homo sapiens
cactgaatggaaataa

SEQ ID NO: 4354759 - DNA, 21 bp, Homo sapiens
cactgccagaagagaattcag

SEQ ID NO: 4354760 - DNA, 19 bp, Homo sapiens
cactgggtgcgtctccagt

SEQ ID NO: 4354761 - DNA, 18 bp, Homo sapiens
cactgggtggggtgagga

SEQ ID NO: 4354762 - DNA, 19 bp, Homo sapiens
cactgggtggggtgaggac

SEQ ID NO: 4354763 - DNA, 21 bp, Homo sapiens
cactgggtggggtgaggacca

SEQ ID NO: 4354764 - DNA, 15 bp, Homo sapiens
cactgtcaggaatgg

SEQ ID NO: 4354765 - DNA, 16 bp, Homo sapiens
cactgtggtttcagat

SEQ ID NO: 4354766 - DNA, 17 bp, Homo sapiens
cacttacgtttgtcctt

SEQ ID NO: 4354767 - DNA, 14 bp, Homo sapiens
cacttgccacatgg

SEQ ID NO: 4354768 - DNA, 13 bp, Homo sapiens
cactttaaactta

SEQ ID NO: 4354769 - DNA, 12 bp, Homo sapiens
cactttgaaaag

SEQ ID NO: 4354770 - DNA, 20 bp, Homo sapiens
cactttgaaaagttggaagg

SEQ ID NO: 4354771 - DNA, 17 bp, Homo sapiens
cagaaacacccctctgt

SEQ ID NO: 4354772 - DNA, 15 bp, Homo sapiens
cagaaaccaagccat

SEQ ID NO: 4354773 - DNA, 12 bp, Homo sapiens
cagaacaaatgt

SEQ ID NO: 4354774 - DNA, 14 bp, Homo sapiens
cagaacaaatgtgt

SEQ ID NO: 4354775 - DNA, 20 bp, Homo sapiens
cagaacacactttttttcct

SEQ ID NO: 4354776 - DNA, 21 bp, Homo sapiens
cagaatgagacatccagcaga

SEQ ID NO: 4354777 - DNA, 21 bp, Homo sapiens
cagaattcccttgaattgtgt

SEQ ID NO: 4354778 - DNA, 14 bp, Homo sapiens
cagacagtctgtta

SEQ ID NO: 4354779 - DNA, 23 bp, Homo sapiens
cagacagtctgttatgcactgtg

SEQ ID NO: 4354780 - DNA, 22 bp, Homo sapiens
cagacagtggatatgacccaca

SEQ ID NO: 4354781 - DNA, 18 bp, Homo sapiens
cagacccctctggccagg

SEQ ID NO: 4354782 - DNA, 22 bp, Homo sapiens
cagacccctctggccaggatgg

SEQ ID NO: 4354783 - DNA, 13 bp, Homo sapiens
cagacctcatgcc

SEQ ID NO: 4354784 - DNA, 17 bp, Homo sapiens
cagacctcatgcccagc

SEQ ID NO: 4354785 - DNA, 22 bp, Homo sapiens
cagactctttttttgagtgaca

SEQ ID NO: 4354786 - DNA, 13 bp, Homo sapiens
cagacttctccag

SEQ ID NO: 4354787 - DNA, 21 bp, Homo sapiens
cagagcatttattttggggag

SEQ ID NO: 4354788 - DNA, 14 bp, Homo sapiens
cagagctttgtcac

SEQ ID NO: 4354789 - DNA, 15 bp, Homo sapiens
cagagctttgtcact

SEQ ID NO: 4354790 - DNA, 16 bp, Homo sapiens
cagagctttgtcactt

SEQ ID NO: 4354791 - DNA, 18 bp, Homo sapiens
cagaggaatgtagggcct

SEQ ID NO: 4354792 - DNA, 19 bp, Homo sapiens
cagaggaatgtagggcctg

SEQ ID NO: 4354793 - DNA, 22 bp, Homo sapiens
cagaggtggatgttatgaacag

SEQ ID NO: 4354794 - DNA, 15 bp, Homo sapiens
cagagtggtctttct

SEQ ID NO: 4354795 - DNA, 21 bp, Homo sapiens
cagagtggtctttctggagag

SEQ ID NO: 4354796 - DNA, 22 bp, Homo sapiens
cagatggatttgcctgtgccac

SEQ ID NO: 4354797 - DNA, 18 bp, Homo sapiens
cagatggggtctgtgact

SEQ ID NO: 4354798 - DNA, 12 bp, Homo sapiens
cagattctgatg

SEQ ID NO: 4354799 - DNA, 14 bp, Homo sapiens
cagatttccagcct

SEQ ID NO: 4354800 - DNA, 20 bp, Homo sapiens
cagcaacttctagcatatag

SEQ ID NO: 4354801 - DNA, 19 bp, Homo sapiens
cagcaacttgtctttttct

SEQ ID NO: 4354802 - DNA, 14 bp, Homo sapiens
cagcacaagggcac

SEQ ID NO: 4354803 - DNA, 15 bp, Homo sapiens
cagcacaagggcaca

SEQ ID NO: 4354804 - DNA, 22 bp, Homo sapiens
cagcaccacactgggtgcgtct

SEQ ID NO: 4354805 - DNA, 15 bp, Homo sapiens
cagcactgtctcagt

SEQ ID NO: 4354806 - DNA, 18 bp, Homo sapiens
cagcagaacctgcacaca

SEQ ID NO: 4354807 - DNA, 21 bp, Homo sapiens
cagcaggagaagttaagaatt

SEQ ID NO: 4354808 - DNA, 16 bp, Homo sapiens
cagcaggcctctggtt

SEQ ID NO: 4354809 - DNA, 14 bp, Homo sapiens
cagcagggcctcaa

SEQ ID NO: 4354810 - DNA, 15 bp, Homo sapiens
cagcagggcctcaaa

SEQ ID NO: 4354811 - DNA, 21 bp, Homo sapiens
cagcagtgaatgctagacaga

SEQ ID NO: 4354812 - DNA, 15 bp, Homo sapiens
cagcatatagaatat

SEQ ID NO: 4354813 - DNA, 17 bp, Homo sapiens
cagcatatagaatatat

SEQ ID NO: 4354814 - DNA, 16 bp, Homo sapiens
cagccagtggcacagg

SEQ ID NO: 4354815 - DNA, 21 bp, Homo sapiens
cagccatggggtccatcccct

SEQ ID NO: 4354816 - DNA, 23 bp, Homo sapiens
cagcccagccccgccccgttgtg

SEQ ID NO: 4354817 - DNA, 15 bp, Homo sapiens
cagccccgcctgtca

SEQ ID NO: 4354818 - DNA, 18 bp, Homo sapiens
cagccccgcctgtcacaa

SEQ ID NO: 4354819 - DNA, 16 bp, Homo sapiens
cagccctcacctctga

SEQ ID NO: 4354820 - DNA, 20 bp, Homo sapiens
cagccctcacctctgaggac

SEQ ID NO: 4354821 - DNA, 12 bp, Homo sapiens
cagcctcccaca

SEQ ID NO: 4354822 - DNA, 13 bp, Homo sapiens
cagcctcccacaa

SEQ ID NO: 4354823 - DNA, 21 bp, Homo sapiens
cagcctcgttggagagcagca

SEQ ID NO: 4354824 - DNA, 18 bp, Homo sapiens
cagcctgaaagatacagg

SEQ ID NO: 4354825 - DNA, 23 bp, Homo sapiens
cagcctgaaagatacaggggatc

SEQ ID NO: 4354826 - DNA, 15 bp, Homo sapiens
cagcctgaagcctgg

SEQ ID NO: 4354827 - DNA, 14 bp, Homo sapiens
cagcggccccccgc

SEQ ID NO: 4354828 - DNA, 12 bp, Homo sapiens
cagctctctgac

SEQ ID NO: 4354829 - DNA, 18 bp, Homo sapiens
cagctctctgacgcttgt

SEQ ID NO: 4354830 - DNA, 20 bp, Homo sapiens
cagctgaggtctcttgaggg

SEQ ID NO: 4354831 - DNA, 15 bp, Homo sapiens
caggaaatatatatg

SEQ ID NO: 4354832 - DNA, 16 bp, Homo sapiens
caggaaatatatatgt

SEQ ID NO: 4354833 - DNA, 17 bp, Homo sapiens
caggaaatatatatgtg

SEQ ID NO: 4354834 - DNA, 15 bp, Homo sapiens
caggaactgggctgg

SEQ ID NO: 4354835 - DNA, 22 bp, Homo sapiens
caggaatggggggcgggccagg

SEQ ID NO: 4354836 - DNA, 12 bp, Homo sapiens
caggaccacaaa

SEQ ID NO: 4354837 - DNA, 20 bp, Homo sapiens
caggagactccaaggagcta

SEQ ID NO: 4354838 - DNA, 19 bp, Homo sapiens
caggagctagcccagtccc

SEQ ID NO: 4354839 - DNA, 15 bp, Homo sapiens
caggaggtggagaaa

SEQ ID NO: 4354840 - DNA, 17 bp, Homo sapiens
caggatactctgtcaga

SEQ ID NO: 4354841 - DNA, 18 bp, Homo sapiens
caggatactctgtcagat

SEQ ID NO: 4354842 - DNA, 23 bp, Homo sapiens
caggatactctgtcagatgggaa

SEQ ID NO: 4354843 - DNA, 16 bp, Homo sapiens
caggcacacagggccc

SEQ ID NO: 4354844 - DNA, 20 bp, Homo sapiens
caggcagcaccacactgggt

SEQ ID NO: 4354845 - DNA, 18 bp, Homo sapiens
caggcctgtccaccctgc

SEQ ID NO: 4354846 - DNA, 13 bp, Homo sapiens
caggcttggggaa

SEQ ID NO: 4354847 - DNA, 20 bp, Homo sapiens
caggcttggggaaaatggcc

SEQ ID NO: 4354848 - DNA, 15 bp, Homo sapiens
cagggcagaggaatg

SEQ ID NO: 4354849 - DNA, 19 bp, Homo sapiens
cagggcagaggaatgtagg

SEQ ID NO: 4354850 - DNA, 19 bp, Homo sapiens
cagggcagggctctgatat

SEQ ID NO: 4354851 - DNA, 14 bp, Homo sapiens
cagggcatctcctg

SEQ ID NO: 4354852 - DNA, 15 bp, Homo sapiens
cagggccatgcagac

SEQ ID NO: 4354853 - DNA, 22 bp, Homo sapiens
cagggccatgcagacctcatgc

SEQ ID NO: 4354854 - DNA, 15 bp, Homo sapiens
cagggcccggccaca

SEQ ID NO: 4354855 - DNA, 17 bp, Homo sapiens
cagggcccggccacacc

SEQ ID NO: 4354856 - DNA, 20 bp, Homo sapiens
cagggcccggccacacccag

SEQ ID NO: 4354857 - DNA, 22 bp, Homo sapiens
cagggcccggccacacccagcg

SEQ ID NO: 4354858 - DNA, 15 bp, Homo sapiens
cagggtataaattat

SEQ ID NO: 4354859 - DNA, 15 bp, Homo sapiens
cagggtgagaagcta

SEQ ID NO: 4354860 - DNA, 14 bp, Homo sapiens
caggtaatatacct

SEQ ID NO: 4354861 - DNA, 20 bp, Homo sapiens
caggtaatatacctggttta

SEQ ID NO: 4354862 - DNA, 16 bp, Homo sapiens
caggtgggctgcctgc

SEQ ID NO: 4354863 - DNA, 13 bp, Homo sapiens
cagtatatttata

SEQ ID NO: 4354864 - DNA, 22 bp, Homo sapiens
cagtatatttatagtcacaaga

SEQ ID NO: 4354865 - DNA, 19 bp, Homo sapiens
cagtatgctttccctgagg

SEQ ID NO: 4354866 - DNA, 12 bp, Homo sapiens
cagtcatggtac

SEQ ID NO: 4354867 - DNA, 18 bp, Homo sapiens
cagtcatggtactacccc

SEQ ID NO: 4354868 - DNA, 21 bp, Homo sapiens
cagtccaggtggtgaattttc

SEQ ID NO: 4354869 - DNA, 20 bp, Homo sapiens
cagtccccgaggagctgggc

SEQ ID NO: 4354870 - DNA, 16 bp, Homo sapiens
ccgcctgtcacaataa

SEQ ID NO: 4354871 - DNA, 15 bp, Homo sapiens
ccgcgaactgggttc

SEQ ID NO: 4354872 - DNA, 14 bp, Homo sapiens
ccggccacacccag

SEQ ID NO: 4354873 - DNA, 22 bp, Homo sapiens
ccggccccctccccccagactc

SEQ ID NO: 4354874 - DNA, 13 bp, Homo sapiens
ccggcgccgggca

SEQ ID NO: 4354875 - DNA, 13 bp, Homo sapiens
ccggtggtgcccg

SEQ ID NO: 4354876 - DNA, 15 bp, Homo sapiens
ccgtcatgttcctca

SEQ ID NO: 4354877 - DNA, 16 bp, Homo sapiens
ccgtcatgttcctcaa

SEQ ID NO: 4354878 - DNA, 17 bp, Homo sapiens
ccgtcatgttcctcaaa

SEQ ID NO: 4354879 - DNA, 20 bp, Homo sapiens
ccgtgcccccgcctgccacc

SEQ ID NO: 4354880 - DNA, 16 bp, Homo sapiens
ccgtgcccgcaggaac

SEQ ID NO: 4354881 - DNA, 23 bp, Homo sapiens
ccgtgggcgcaaaggtgcctcat

SEQ ID NO: 4354882 - DNA, 16 bp, Homo sapiens
ccgtggggtgctgccc

SEQ ID NO: 4354883 - DNA, 20 bp, Homo sapiens
ccgttaggaataacactgca

SEQ ID NO: 4354884 - DNA, 16 bp, Homo sapiens
cctaaatgatggtgct

SEQ ID NO: 4354885 - DNA, 19 bp, Homo sapiens
cctaacatagtgtctgctg

SEQ ID NO: 4354886 - DNA, 11 bp, Homo sapiens
cctaaccaagt

SEQ ID NO: 4354887 - DNA, 15 bp, Homo sapiens
cctaagagtggagga

SEQ ID NO: 4354888 - DNA, 19 bp, Homo sapiens
cctaagagtggaggaggag

SEQ ID NO: 4354889 - DNA, 22 bp, Homo sapiens
cctaccactgtggccccaagag

SEQ ID NO: 4354890 - DNA, 18 bp, Homo sapiens
cctaccctaaccaagttc

SEQ ID NO: 4354891 - DNA, 13 bp, Homo sapiens
cctactgcccaca

SEQ ID NO: 4354892 - DNA, 13 bp, Homo sapiens
cctcaactgaagg

SEQ ID NO: 4354893 - DNA, 15 bp, Homo sapiens
cctcacccctgtagg

SEQ ID NO: 4354894 - DNA, 15 bp, Homo sapiens
cctcacctctgagga

SEQ ID NO: 4354895 - DNA, 18 bp, Homo sapiens
cctcacctctgaggacag

SEQ ID NO: 4354896 - DNA, 14 bp, Homo sapiens
cctcactgggtggg

SEQ ID NO: 4354897 - DNA, 22 bp, Homo sapiens
cctcatagcatagccagcattc

SEQ ID NO: 4354898 - DNA, 16 bp, Homo sapiens
cctcatgcccagctct

SEQ ID NO: 4354899 - DNA, 17 bp, Homo sapiens
cctcatgcccagctctc

SEQ ID NO: 4354900 - DNA, 16 bp, Homo sapiens
cctccagtcatggtac

SEQ ID NO: 4354901 - DNA, 23 bp, Homo sapiens
cctcccacaattaaaccgcatgt

SEQ ID NO: 4354902 - DNA, 16 bp, Homo sapiens
cctcccctctcagaac

SEQ ID NO: 4354903 - DNA, 18 bp, Homo sapiens
cctccctggggaccagga

SEQ ID NO: 4354904 - DNA, 21 bp, Homo sapiens
cctccctggggaccaggagct

SEQ ID NO: 4354905 - DNA, 23 bp, Homo sapiens
cctccctggggaccaggagctag

SEQ ID NO: 4354906 - DNA, 18 bp, Homo sapiens
cctccggccagcgagtgg

SEQ ID NO: 4354907 - DNA, 14 bp, Homo sapiens
cctcggggacacca

SEQ ID NO: 4354908 - DNA, 18 bp, Homo sapiens
cctcggggacaccagagc

SEQ ID NO: 4354909 - DNA, 18 bp, Homo sapiens
cctcgttggagagcagca

SEQ ID NO: 4354910 - DNA, 19 bp, Homo sapiens
cctctcagaacatactgat

SEQ ID NO: 4354911 - DNA, 20 bp, Homo sapiens
cctctcagaacatactgatt

SEQ ID NO: 4354912 - DNA, 15 bp, Homo sapiens
cctctcggccaggca

SEQ ID NO: 4354913 - DNA, 13 bp, Homo sapiens
cctctgaggacag

SEQ ID NO: 4354914 - DNA, 14 bp, Homo sapiens
cctctgaggacaga

SEQ ID NO: 4354915 - DNA, 12 bp, Homo sapiens
cctctggccagg

SEQ ID NO: 4354916 - DNA, 14 bp, Homo sapiens
cctctgtctaggac

SEQ ID NO: 4354917 - DNA, 19 bp, Homo sapiens
cctctgtgaccaactgttg

SEQ ID NO: 4354918 - DNA, 17 bp, Homo sapiens
cctcttcttcttcagaa

SEQ ID NO: 4354919 - DNA, 17 bp, Homo sapiens
cctcttgctcagagcta

SEQ ID NO: 4354920 - DNA, 22 bp, Homo sapiens
cctcttgctcagagctaggccc

SEQ ID NO: 4354921 - DNA, 14 bp, Homo sapiens
cctgaactccagag

SEQ ID NO: 4354922 - DNA, 12 bp, Homo sapiens
cctgaagcctgg

SEQ ID NO: 4354923 - DNA, 14 bp, Homo sapiens
cctgaagcctggat

SEQ ID NO: 4354924 - DNA, 10 bp, Homo sapiens
cctgactcaa

SEQ ID NO: 4354925 - DNA, 13 bp, Homo sapiens
cctgactcctggg

SEQ ID NO: 4354926 - DNA, 14 bp, Homo sapiens
cctgactcctgggt

SEQ ID NO: 4354927 - DNA, 16 bp, Homo sapiens
cctgactcctgggtgg

SEQ ID NO: 4354928 - DNA, 15 bp, Homo sapiens
cctgacttctggaga

SEQ ID NO: 4354929 - DNA, 16 bp, Homo sapiens
cctgacttctggagat

SEQ ID NO: 4354930 - DNA, 12 bp, Homo sapiens
cctgaggaatga

SEQ ID NO: 4354931 - DNA, 18 bp, Homo sapiens
cctgaggaggaggacaca

SEQ ID NO: 4354932 - DNA, 22 bp, Homo sapiens
cctgaggaggaggacacagcac

SEQ ID NO: 4354933 - DNA, 16 bp, Homo sapiens
cctgcacacaggacag

SEQ ID NO: 4354934 - DNA, 17 bp, Homo sapiens
cctgcacaggcacacag

SEQ ID NO: 4354935 - DNA, 16 bp, Homo sapiens
cctgcagtttggccct

SEQ ID NO: 4354936 - DNA, 19 bp, Homo sapiens
cctgcagtttggccctgga

SEQ ID NO: 4354937 - DNA, 21 bp, Homo sapiens
cctgcagtttggccctggagc

SEQ ID NO: 4354938 - DNA, 18 bp, Homo sapiens
cctgccaagactcctcag

SEQ ID NO: 4354939 - DNA, 16 bp, Homo sapiens
cctgccggtgggaccc

SEQ ID NO: 4354940 - DNA, 16 bp, Homo sapiens
cctgcctgaggaggag

SEQ ID NO: 4354941 - DNA, 18 bp, Homo sapiens
cctgctggctgcggcccc

SEQ ID NO: 4354942 - DNA, 12 bp, Homo sapiens
cctggagccagg

SEQ ID NO: 4354943 - DNA, 15 bp, Homo sapiens
cctggagccagggca

SEQ ID NO: 4354944 - DNA, 13 bp, Homo sapiens
cctggagctgtcc

SEQ ID NO: 4354945 - DNA, 18 bp, Homo sapiens
cctggagctgtccttcat

SEQ ID NO: 4354946 - DNA, 23 bp, Homo sapiens
cctggattccagcagtgaatgct

SEQ ID NO: 4354947 - DNA, 16 bp, Homo sapiens
cctggctctcagaagg

SEQ ID NO: 4354948 - DNA, 13 bp, Homo sapiens
cctgggcagaaag

SEQ ID NO: 4354949 - DNA, 23 bp, Homo sapiens
cctgggtgctggctgcccagacc

SEQ ID NO: 4354950 - DNA, 21 bp, Homo sapiens
cctgtacactgaatatttata

SEQ ID NO: 4354951 - DNA, 11 bp, Homo sapiens
cctgtcacaat

SEQ ID NO: 4354952 - DNA, 14 bp, Homo sapiens
cctgtccggcccag

SEQ ID NO: 4354953 - DNA, 16 bp, Homo sapiens
cctgtccggcccagtg

SEQ ID NO: 4354954 - DNA, 21 bp, Homo sapiens
cctgtccggcccagtgccact

SEQ ID NO: 4354955 - DNA, 14 bp, Homo sapiens
cctgtttctggcac

SEQ ID NO: 4354956 - DNA, 13 bp, Homo sapiens
cctgttttctgaa

SEQ ID NO: 4354957 - DNA, 20 bp, Homo sapiens
ccttaagcagaacaaatgtg

SEQ ID NO: 4354958 - DNA, 16 bp, Homo sapiens
ccttaataaatatgta

SEQ ID NO: 4354959 - DNA, 20 bp, Homo sapiens
ccttccatcttgtggggcca

SEQ ID NO: 4354960 - DNA, 20 bp, Homo sapiens
ccttctatacccacccagaa

SEQ ID NO: 4354961 - DNA, 18 bp, Homo sapiens
ccttgccttaataaatat

SEQ ID NO: 4354962 - DNA, 13 bp, Homo sapiens
ccttgctgcagct

SEQ ID NO: 4354963 - DNA, 12 bp, Homo sapiens
ccttgctgggcc

SEQ ID NO: 4354964 - DNA, 13 bp, Homo sapiens
ccttgctgggcca

SEQ ID NO: 4354965 - DNA, 17 bp, Homo sapiens
ccttgctgggccaggga

SEQ ID NO: 4354966 - DNA, 19 bp, Homo sapiens
ccttgctgggccagggaaa

SEQ ID NO: 4354967 - DNA, 22 bp, Homo sapiens
ccttggagagagaggctgcctc

SEQ ID NO: 4354968 - DNA, 16 bp, Homo sapiens
ccttggagaggagagt

SEQ ID NO: 4354969 - DNA, 15 bp, Homo sapiens
ccttggccatgcaga

SEQ ID NO: 4354970 - DNA, 17 bp, Homo sapiens
ccttggccatgcagaaa

SEQ ID NO: 4354971 - DNA, 13 bp, Homo sapiens
ccttgtcgtggga

SEQ ID NO: 4354972 - DNA, 13 bp, Homo sapiens
cctttcttggcca

SEQ ID NO: 4354973 - DNA, 22 bp, Homo sapiens
ccttttaagttaatgaaataaa

SEQ ID NO: 4354974 - DNA, 21 bp, Homo sapiens
ccttttagcctagttcatcca

SEQ ID NO: 4354975 - DNA, 16 bp, Homo sapiens
cgaacgacaatagctt

SEQ ID NO: 4354976 - DNA, 22 bp, Homo sapiens
cgacttgaatattcctggactt

SEQ ID NO: 4354977 - DNA, 19 bp, Homo sapiens
cgacttggagactcctggt

SEQ ID NO: 4354978 - DNA, 15 bp, Homo sapiens
cgaggagctgggccc

SEQ ID NO: 4354979 - DNA, 11 bp, Homo sapiens
cgaggctgcta

SEQ ID NO: 4354980 - DNA, 22 bp, Homo sapiens
cgatcaacatttatgacctaag

SEQ ID NO: 4354981 - DNA, 18 bp, Homo sapiens
cgattgagaactgacaaa

SEQ ID NO: 4354982 - DNA, 14 bp, Homo sapiens
cgcactctgccccc

SEQ ID NO: 4354983 - DNA, 19 bp, Homo sapiens
cgcagtgcttctctacaga

SEQ ID NO: 4354984 - DNA, 16 bp, Homo sapiens
cgcattaagcacacac

SEQ ID NO: 4354985 - DNA, 15 bp, Homo sapiens
cgcctcccacggcac

SEQ ID NO: 4354986 - DNA, 15 bp, Homo sapiens
cgcctgccaccggag

SEQ ID NO: 4354987 - DNA, 15 bp, Homo sapiens
cgcttgtgacagtgc

SEQ ID NO: 4354988 - DNA, 19 bp, Homo sapiens
cgcttgtgacagtgcctct

SEQ ID NO: 4354989 - DNA, 17 bp, Homo sapiens
cggaggtcactccacca

SEQ ID NO: 4354990 - DNA, 16 bp, Homo sapiens
cggcattttattaaac

SEQ ID NO: 4354991 - DNA, 22 bp, Homo sapiens
cttccctagtttacaagtcaga

SEQ ID NO: 4354992 - DNA, 22 bp, Homo sapiens
cttccctggaaaccttccaccc

SEQ ID NO: 4354993 - DNA, 21 bp, Homo sapiens
cttccgggtctcgcagcctga

SEQ ID NO: 4354994 - DNA, 15 bp, Homo sapiens
cttctatacccaccc

SEQ ID NO: 4354995 - DNA, 17 bp, Homo sapiens
cttctatacccacccag

SEQ ID NO: 4354996 - DNA, 22 bp, Homo sapiens
cttctatcattccaattctaaa

SEQ ID NO: 4354997 - DNA, 17 bp, Homo sapiens
cttctggagatggatcc

SEQ ID NO: 4354998 - DNA, 14 bp, Homo sapiens
cttctgtacagtaa

SEQ ID NO: 4354999 - DNA, 15 bp, Homo sapiens
cttctttagcatttt

SEQ ID NO: 4355000 - DNA, 20 bp, Homo sapiens
cttctttagcatttttatgc

SEQ ID NO: 4355001 - DNA, 15 bp, Homo sapiens
cttgaaataagttgt

SEQ ID NO: 4355002 - DNA, 16 bp, Homo sapiens
cttgaatattcctgga

SEQ ID NO: 4355003 - DNA, 22 bp, Homo sapiens
cttgaatattcctggacttaca

SEQ ID NO: 4355004 - DNA, 22 bp, Homo sapiens
cttgaattgtgtattgatgcaa

SEQ ID NO: 4355005 - DNA, 14 bp, Homo sapiens
cttgacctctgtga

SEQ ID NO: 4355006 - DNA, 16 bp, Homo sapiens
cttgagggagcttagc

SEQ ID NO: 4355007 - DNA, 15 bp, Homo sapiens
cttgataatacttga

SEQ ID NO: 4355008 - DNA, 16 bp, Homo sapiens
cttgataatacttgac

SEQ ID NO: 4355009 - DNA, 22 bp, Homo sapiens
cttgccacatggtgtctcccaa

SEQ ID NO: 4355010 - DNA, 16 bp, Homo sapiens
cttgctccagattctg

SEQ ID NO: 4355011 - DNA, 14 bp, Homo sapiens
cttgctgggccagg

SEQ ID NO: 4355012 - DNA, 22 bp, Homo sapiens
cttgctgggccagggaaacaaa

SEQ ID NO: 4355013 - DNA, 12 bp, Homo sapiens
cttggaagggcg

SEQ ID NO: 4355014 - DNA, 19 bp, Homo sapiens
cttggagactcctggtctg

SEQ ID NO: 4355015 - DNA, 20 bp, Homo sapiens
cttggagactcctggtctgt

SEQ ID NO: 4355016 - DNA, 21 bp, Homo sapiens
cttggagagagaggctgcctc

SEQ ID NO: 4355017 - DNA, 24 bp, Homo sapiens
cttggagagagaggctgcctcagc

SEQ ID NO: 4355018 - DNA, 15 bp, Homo sapiens
cttggccatgcagaa

SEQ ID NO: 4355019 - DNA, 20 bp, Homo sapiens
cttggggaaaatggccatgc

SEQ ID NO: 4355020 - DNA, 14 bp, Homo sapiens
cttggtgagtcttg

SEQ ID NO: 4355021 - DNA, 17 bp, Homo sapiens
cttggtggcagaatgaa

SEQ ID NO: 4355022 - DNA, 12 bp, Homo sapiens
cttggttctaaa

SEQ ID NO: 4355023 - DNA, 20 bp, Homo sapiens
cttgtattctctttaccttc

SEQ ID NO: 4355024 - DNA, 15 bp, Homo sapiens
cttgtgacagtgcct

SEQ ID NO: 4355025 - DNA, 17 bp, Homo sapiens
cttgtgacagtgcctct

SEQ ID NO: 4355026 - DNA, 17 bp, Homo sapiens
cttgtgagtggataatc

SEQ ID NO: 4355027 - DNA, 19 bp, Homo sapiens
cttgtgagtggataatcag

SEQ ID NO: 4355028 - DNA, 14 bp, Homo sapiens
cttgtggggccagg

SEQ ID NO: 4355029 - DNA, 19 bp, Homo sapiens
cttgtgtgtgggctgtgag

SEQ ID NO: 4355030 - DNA, 22 bp, Homo sapiens
ctttatcatcggagttgacagt

SEQ ID NO: 4355031 - DNA, 20 bp, Homo sapiens
ctttatgtagtttttatatg

SEQ ID NO: 4355032 - DNA, 13 bp, Homo sapiens
ctttctccctcaa

SEQ ID NO: 4355033 - DNA, 19 bp, Homo sapiens
ctttctccctcaactgaag

SEQ ID NO: 4355034 - DNA, 18 bp, Homo sapiens
ctttctgggatgtcacag

SEQ ID NO: 4355035 - DNA, 13 bp, Homo sapiens
ctttgaaaagttg

SEQ ID NO: 4355036 - DNA, 18 bp, Homo sapiens
ctttgaaaagttggaagg

SEQ ID NO: 4355037 - DNA, 19 bp, Homo sapiens
ctttgaaaagttggaagga

SEQ ID NO: 4355038 - DNA, 22 bp, Homo sapiens
ctttgacaaggaaaatctatat

SEQ ID NO: 4355039 - DNA, 19 bp, Homo sapiens
ctttggccccactttgaag

SEQ ID NO: 4355040 - DNA, 21 bp, Homo sapiens
ctttggccccactttgaaggg

SEQ ID NO: 4355041 - DNA, 16 bp, Homo sapiens
ctttgtagaaagcaaa

SEQ ID NO: 4355042 - DNA, 15 bp, Homo sapiens
ctttgtcacttgcca

SEQ ID NO: 4355043 - DNA, 13 bp, Homo sapiens
ctttgtgcattct

SEQ ID NO: 4355044 - DNA, 16 bp, Homo sapiens
cttttaagttaatgaa

SEQ ID NO: 4355045 - DNA, 13 bp, Homo sapiens
cttttagattaaa

SEQ ID NO: 4355046 - DNA, 18 bp, Homo sapiens
cttttcccataaataaaa

SEQ ID NO: 4355047 - DNA, 13 bp, Homo sapiens
cttttgaattaaa

SEQ ID NO: 4355048 - DNA, 23 bp, Homo sapiens
cttttgtgtacagtgtgtaaagt

SEQ ID NO: 4355049 - DNA, 15 bp, Homo sapiens
ctttttcactttgaa

SEQ ID NO: 4355050 - DNA, 16 bp, Homo sapiens
ctttttcactttgaaa

SEQ ID NO: 4355051 - DNA, 14 bp, Homo sapiens
ctttttgtttgcat

SEQ ID NO: 4355052 - DNA, 17 bp, Homo sapiens
ctttttgtttgcatcat

SEQ ID NO: 4355053 - DNA, 23 bp, Homo sapiens
gaaaaagggattgaggagttgcc

SEQ ID NO: 4355054 - DNA, 19 bp, Homo sapiens
gaaaaatgaggaatccaaa

SEQ ID NO: 4355055 - DNA, 15 bp, Homo sapiens
gaaaacaagcgttta

SEQ ID NO: 4355056 - DNA, 19 bp, Homo sapiens
gaaaactattgagccttgc

SEQ ID NO: 4355057 - DNA, 24 bp, Homo sapiens
gaaaactattgagccttgcatgta

SEQ ID NO: 4355058 - DNA, 14 bp, Homo sapiens
gaaaagttggaagg

SEQ ID NO: 4355059 - DNA, 17 bp, Homo sapiens
gaaaatatttttaaatg

SEQ ID NO: 4355060 - DNA, 16 bp, Homo sapiens
gaaacacccctctgtc

SEQ ID NO: 4355061 - DNA, 21 bp, Homo sapiens
gaaacacccctctgtctagga

SEQ ID NO: 4355062 - DNA, 23 bp, Homo sapiens
gaaacagaagctttttgtttgca

SEQ ID NO: 4355063 - DNA, 22 bp, Homo sapiens
gaaacaggaccacaaaaatgaa

SEQ ID NO: 4355064 - DNA, 17 bp, Homo sapiens
gaaacatgttgatttag

SEQ ID NO: 4355065 - DNA, 21 bp, Homo sapiens
gaaacatttttgagatattaa

SEQ ID NO: 4355066 - DNA, 12 bp, Homo sapiens
gaaaccttggag

SEQ ID NO: 4355067 - DNA, 15 bp, Homo sapiens
gaaaccttggagagg

SEQ ID NO: 4355068 - DNA, 19 bp, Homo sapiens
gaaaccttggagaggagag

SEQ ID NO: 4355069 - DNA, 21 bp, Homo sapiens
gaaacttcctgccctctctgt

SEQ ID NO: 4355070 - DNA, 19 bp, Homo sapiens
gaaagcaaacaaaattgtt

SEQ ID NO: 4355071 - DNA, 21 bp, Homo sapiens
gaaagcactacaatcatggtc

SEQ ID NO: 4355072 - DNA, 21 bp, Homo sapiens
gaaaggcagccctcacctctg

SEQ ID NO: 4355073 - DNA, 12 bp, Homo sapiens
gaaataaaattt

SEQ ID NO: 4355074 - DNA, 14 bp, Homo sapiens
gaaatatatatgtg

SEQ ID NO: 4355075 - DNA, 23 bp, Homo sapiens
gaaatatatatgtgtgtgtatgt

SEQ ID NO: 4355076 - DNA, 13 bp, Homo sapiens
gaaatgaataatt

SEQ ID NO: 4355077 - DNA, 21 bp, Homo sapiens
gaaatgattcaaattgctgct

SEQ ID NO: 4355078 - DNA, 22 bp, Homo sapiens
gaaatgattcaaattgctgctt

SEQ ID NO: 4355079 - DNA, 22 bp, Homo sapiens
gaaatggcgtctgctctggtgg

SEQ ID NO: 4355080 - DNA, 15 bp, Homo sapiens
gaaatgttactgtct

SEQ ID NO: 4355081 - DNA, 15 bp, Homo sapiens
gaacaaatgtgtttt

SEQ ID NO: 4355082 - DNA, 22 bp, Homo sapiens
gaacaaatgtgtttttctatat

SEQ ID NO: 4355083 - DNA, 21 bp, Homo sapiens
gaacaactaggcttcagcata

SEQ ID NO: 4355084 - DNA, 15 bp, Homo sapiens
gaacagctgtgtctg

SEQ ID NO: 4355085 - DNA, 19 bp, Homo sapiens
gaacagctgtgtctgccaa

SEQ ID NO: 4355086 - DNA, 18 bp, Homo sapiens
gaacatgacccagcctga

SEQ ID NO: 4355087 - DNA, 18 bp, Homo sapiens
gaacattcccagcccagc

SEQ ID NO: 4355088 - DNA, 20 bp, Homo sapiens
gaacctgcacacaggacagc

SEQ ID NO: 4355089 - DNA, 19 bp, Homo sapiens
gaactgacaaaggagcctt

SEQ ID NO: 4355090 - DNA, 15 bp, Homo sapiens
gaactgggctgggcc

SEQ ID NO: 4355091 - DNA, 20 bp, Homo sapiens
gaagaaaatatttttaaatg

SEQ ID NO: 4355092 - DNA, 20 bp, Homo sapiens
gaagaaatctttctccctca

SEQ ID NO: 4355093 - DNA, 22 bp, Homo sapiens
gaagaaattcaggtacagaaaa

SEQ ID NO: 4355094 - DNA, 19 bp, Homo sapiens
gaagaccagaattcccttg

SEQ ID NO: 4355095 - DNA, 22 bp, Homo sapiens
gaagaccagaattcccttgaat

SEQ ID NO: 4355096 - DNA, 16 bp, Homo sapiens
gaagagactgggaaga

SEQ ID NO: 4355097 - DNA, 23 bp, Homo sapiens
gaagagcccgcagggccatgcag

SEQ ID NO: 4355098 - DNA, 18 bp, Homo sapiens
gaagaggaagaaattcag

SEQ ID NO: 4355099 - DNA, 16 bp, Homo sapiens
gaagataggctctgca

SEQ ID NO: 4355100 - DNA, 19 bp, Homo sapiens
gaagccccttggagagaga

SEQ ID NO: 4355101 - DNA, 20 bp, Homo sapiens
gaagcctggattccagcagt

SEQ ID NO: 4355102 - DNA, 16 bp, Homo sapiens
gaagctgttgtgtgag

SEQ ID NO: 4355103 - DNA, 18 bp, Homo sapiens
gaagctttttgtttgcat

SEQ ID NO: 4355104 - DNA, 19 bp, Homo sapiens
gaaggagcccagccagaaa

SEQ ID NO: 4355105 - DNA, 22 bp, Homo sapiens
gaaggagcccagccagaaagca

SEQ ID NO: 4355106 - DNA, 14 bp, Homo sapiens
gaaggatctgctga

SEQ ID NO: 4355107 - DNA, 15 bp, Homo sapiens
gaaggatctgctgag

SEQ ID NO: 4355108 - DNA, 22 bp, Homo sapiens
gaaggatctgctgaggcccagt

SEQ ID NO: 4355109 - DNA, 19 bp, Homo sapiens
gaaggcaaaaactgtactg

SEQ ID NO: 4355110 - DNA, 13 bp, Homo sapiens
gccccttggagag

SEQ ID NO: 4355111 - DNA, 21 bp, Homo sapiens
gccccttggagagagaggctg

SEQ ID NO: 4355112 - DNA, 23 bp, Homo sapiens
gcccgcaggaactgggctgggcc

SEQ ID NO: 4355113 - DNA, 22 bp, Homo sapiens
gcccgcagggccatgcagacct

SEQ ID NO: 4355114 - DNA, 18 bp, Homo sapiens
gcccgtcatgttcctcaa

SEQ ID NO: 4355115 - DNA, 14 bp, Homo sapiens
gccctcacctctga

SEQ ID NO: 4355116 - DNA, 15 bp, Homo sapiens
gccctcacctctgag

SEQ ID NO: 4355117 - DNA, 17 bp, Homo sapiens
gccctcacctctgagga

SEQ ID NO: 4355118 - DNA, 18 bp, Homo sapiens
gccctcacctctgaggac

SEQ ID NO: 4355119 - DNA, 20 bp, Homo sapiens
gccctcacctctgaggacag

SEQ ID NO: 4355120 - DNA, 19 bp, Homo sapiens
gccctcttaagatctgact

SEQ ID NO: 4355121 - DNA, 17 bp, Homo sapiens
gccctgacttctggaga

SEQ ID NO: 4355122 - DNA, 14 bp, Homo sapiens
gccctgcctgagga

SEQ ID NO: 4355123 - DNA, 18 bp, Homo sapiens
gccctgcctgaggaggag

SEQ ID NO: 4355124 - DNA, 19 bp, Homo sapiens
gccctgcctgaggaggagg

SEQ ID NO: 4355125 - DNA, 13 bp, Homo sapiens
gccctggagccag

SEQ ID NO: 4355126 - DNA, 14 bp, Homo sapiens
gccctggagccagg

SEQ ID NO: 4355127 - DNA, 23 bp, Homo sapiens
gccctggagccagggcagaggaa

SEQ ID NO: 4355128 - DNA, 17 bp, Homo sapiens
gccgaagccccttggag

SEQ ID NO: 4355129 - DNA, 18 bp, Homo sapiens
gccgaagccccttggaga

SEQ ID NO: 4355130 - DNA, 23 bp, Homo sapiens
gccgcgaactgggttctttggaa

SEQ ID NO: 4355131 - DNA, 18 bp, Homo sapiens
gccggtgggaccctgtcc

SEQ ID NO: 4355132 - DNA, 20 bp, Homo sapiens
gccggtgggaccctgtccgg

SEQ ID NO: 4355133 - DNA, 17 bp, Homo sapiens
gcctattttggtgaggt

SEQ ID NO: 4355134 - DNA, 21 bp, Homo sapiens
gcctcagccagtggcacagga

SEQ ID NO: 4355135 - DNA, 18 bp, Homo sapiens
gcctccagtcatggtact

SEQ ID NO: 4355136 - DNA, 14 bp, Homo sapiens
gcctccatgcccca

SEQ ID NO: 4355137 - DNA, 15 bp, Homo sapiens
gcctccatgccccag

SEQ ID NO: 4355138 - DNA, 23 bp, Homo sapiens
gcctccatgccccagctctggat

SEQ ID NO: 4355139 - DNA, 21 bp, Homo sapiens
gcctccctggggaccaggagc

SEQ ID NO: 4355140 - DNA, 14 bp, Homo sapiens
gcctcgttggagag

SEQ ID NO: 4355141 - DNA, 17 bp, Homo sapiens
gcctctggaaaactatt

SEQ ID NO: 4355142 - DNA, 16 bp, Homo sapiens
gcctcttcttcttcag

SEQ ID NO: 4355143 - DNA, 14 bp, Homo sapiens
gcctgaaagataca

SEQ ID NO: 4355144 - DNA, 14 bp, Homo sapiens
gcctgaagcctgga

SEQ ID NO: 4355145 - DNA, 15 bp, Homo sapiens
gcctgaagcctggat

SEQ ID NO: 4355146 - DNA, 12 bp, Homo sapiens
gcctgaggagga

SEQ ID NO: 4355147 - DNA, 13 bp, Homo sapiens
gcctgaggaggag

SEQ ID NO: 4355148 - DNA, 13 bp, Homo sapiens
gcctgcatggaga

SEQ ID NO: 4355149 - DNA, 16 bp, Homo sapiens
gcctgccaccggaggt

SEQ ID NO: 4355150 - DNA, 18 bp, Homo sapiens
gcctgctggctgcggccc

SEQ ID NO: 4355151 - DNA, 20 bp, Homo sapiens
gcctgctgtgttaagaggac

SEQ ID NO: 4355152 - DNA, 14 bp, Homo sapiens
gcctggattccagc

SEQ ID NO: 4355153 - DNA, 19 bp, Homo sapiens
gcctggattccagcagtga

SEQ ID NO: 4355154 - DNA, 14 bp, Homo sapiens
gcctggctagaaaa

SEQ ID NO: 4355155 - DNA, 14 bp, Homo sapiens
gcctgggtgctggc

SEQ ID NO: 4355156 - DNA, 21 bp, Homo sapiens
gcctgggtgctggctgcccag

SEQ ID NO: 4355157 - DNA, 15 bp, Homo sapiens
gcctgtccaccctgc

SEQ ID NO: 4355158 - DNA, 19 bp, Homo sapiens
gcctgtgccacccaccagg

SEQ ID NO: 4355159 - DNA, 15 bp, Homo sapiens
gccttaagcagaaca

SEQ ID NO: 4355160 - DNA, 16 bp, Homo sapiens
gccttaataaatatgt

SEQ ID NO: 4355161 - DNA, 19 bp, Homo sapiens
gccttaataaatatgtaat

SEQ ID NO: 4355162 - DNA, 15 bp, Homo sapiens
gccttgctgggccag

SEQ ID NO: 4355163 - DNA, 15 bp, Homo sapiens
gccttggaaacattt

SEQ ID NO: 4355164 - DNA, 21 bp, Homo sapiens
gccttggctagagtttgaaaa

SEQ ID NO: 4355165 - DNA, 13 bp, Homo sapiens
gcgaactgggttc

SEQ ID NO: 4355166 - DNA, 16 bp, Homo sapiens
gcgcgggcagccaccc

SEQ ID NO: 4355167 - DNA, 17 bp, Homo sapiens
gcgcgggcagccaccca

SEQ ID NO: 4355168 - DNA, 11 bp, Homo sapiens
gcgggccaggg

SEQ ID NO: 4355169 - DNA, 12 bp, Homo sapiens
gcgggccagggt

SEQ ID NO: 4355170 - DNA, 15 bp, Homo sapiens
gcgggccagggtggg

SEQ ID NO: 4355171 - DNA, 12 bp, Homo sapiens
gcgggctcagag

SEQ ID NO: 4355172 - DNA, 16 bp, Homo sapiens
gcgtctgctctggtgg

SEQ ID NO: 4355173 - DNA, 19 bp, Homo sapiens
gctagacagaaaccaagcc

SEQ ID NO: 4355174 - DNA, 15 bp, Homo sapiens
gctagttctgctgcc

SEQ ID NO: 4355175 - DNA, 16 bp, Homo sapiens
gctagttctgctgccc

SEQ ID NO: 4355176 - DNA, 19 bp, Homo sapiens
gctagttctgctgccctct

SEQ ID NO: 4355177 - DNA, 24 bp, Homo sapiens
gctcacttctaataactgcagtgt

SEQ ID NO: 4355178 - DNA, 23 bp, Homo sapiens
gctcagagctttgtcacttgcca

SEQ ID NO: 4355179 - DNA, 14 bp, Homo sapiens
gctccagattctga

SEQ ID NO: 4355180 - DNA, 17 bp, Homo sapiens
gctccagattctgatgc

SEQ ID NO: 4355181 - DNA, 20 bp, Homo sapiens
gctccagattctgatgcata

SEQ ID NO: 4355182 - DNA, 14 bp, Homo sapiens
gctcctcacccctg

SEQ ID NO: 4355183 - DNA, 18 bp, Homo sapiens
gctcctcacccctgtagg

SEQ ID NO: 4355184 - DNA, 11 bp, Homo sapiens
gctctcagaag

SEQ ID NO: 4355185 - DNA, 12 bp, Homo sapiens
gctctcagaagg

SEQ ID NO: 4355186 - DNA, 15 bp, Homo sapiens
gctctgcacagatgg

SEQ ID NO: 4355187 - DNA, 21 bp, Homo sapiens
gctgacatgaagctgttgtgt

SEQ ID NO: 4355188 - DNA, 17 bp, Homo sapiens
gctgaggcccagtgcat

SEQ ID NO: 4355189 - DNA, 19 bp, Homo sapiens
gctgaggcccagtgcatat

SEQ ID NO: 4355190 - DNA, 22 bp, Homo sapiens
gctgagtggggggtcgtgggcc

SEQ ID NO: 4355191 - DNA, 16 bp, Homo sapiens
gctgcatactttgaca

SEQ ID NO: 4355192 - DNA, 20 bp, Homo sapiens
gctgccatccttgctgcagc

SEQ ID NO: 4355193 - DNA, 19 bp, Homo sapiens
gctgccctcttaagatctg

SEQ ID NO: 4355194 - DNA, 18 bp, Homo sapiens
gctgccgacttggagact

SEQ ID NO: 4355195 - DNA, 16 bp, Homo sapiens
gctgctcccagcctct

SEQ ID NO: 4355196 - DNA, 19 bp, Homo sapiens
gctggatagacttgggatg

SEQ ID NO: 4355197 - DNA, 20 bp, Homo sapiens
gctggatagacttgggatgg

SEQ ID NO: 4355198 - DNA, 19 bp, Homo sapiens
gctggctgcccagacccct

SEQ ID NO: 4355199 - DNA, 13 bp, Homo sapiens
gctggctgcggcc

SEQ ID NO: 4355200 - DNA, 13 bp, Homo sapiens
gctgggcagggtg

SEQ ID NO: 4355201 - DNA, 12 bp, Homo sapiens
gctgggccaggg

SEQ ID NO: 4355202 - DNA, 14 bp, Homo sapiens
gctgggccagggaa

SEQ ID NO: 4355203 - DNA, 13 bp, Homo sapiens
gctgggcccctgc

SEQ ID NO: 4355204 - DNA, 17 bp, Homo sapiens
gctgggcccctgcacag

SEQ ID NO: 4355205 - DNA, 15 bp, Homo sapiens
gctgggccctctgtc

SEQ ID NO: 4355206 - DNA, 19 bp, Homo sapiens
gctggtagagacccccagg

SEQ ID NO: 4355207 - DNA, 19 bp, Homo sapiens
gctgtgtctgccaaacaca

SEQ ID NO: 4355208 - DNA, 18 bp, Homo sapiens
gcttaagtgagcagaaca

SEQ ID NO: 4355209 - DNA, 19 bp, Homo sapiens
gcttaagtgagcagaacag

SEQ ID NO: 4355210 - DNA, 20 bp, Homo sapiens
gcttaagtgagcagaacagg

SEQ ID NO: 4355211 - DNA, 23 bp, Homo sapiens
gcttacttttactgtctatatat

SEQ ID NO: 4355212 - DNA, 20 bp, Homo sapiens
gcttgctccagattctgatg

SEQ ID NO: 4355213 - DNA, 23 bp, Homo sapiens
gctttaaaaccacagctgggcag

SEQ ID NO: 4355214 - DNA, 17 bp, Homo sapiens
gctttataaagcagtta

SEQ ID NO: 4355215 - DNA, 13 bp, Homo sapiens
gctttccctgagg

SEQ ID NO: 4355216 - DNA, 15 bp, Homo sapiens
gctttccctgaggaa

SEQ ID NO: 4355217 - DNA, 20 bp, Homo sapiens
gctttctgggatgtcacagt

SEQ ID NO: 4355218 - DNA, 14 bp, Homo sapiens
gctttcttgctggt

SEQ ID NO: 4355219 - DNA, 19 bp, Homo sapiens
gctttgtcacttgccacat

SEQ ID NO: 4355220 - DNA, 20 bp, Homo sapiens
ggaaaactattgagccttgc

SEQ ID NO: 4355221 - DNA, 22 bp, Homo sapiens
ggaaaatctatatttgtcttcc

SEQ ID NO: 4355222 - DNA, 16 bp, Homo sapiens
ggaaaatggccatgca

SEQ ID NO: 4355223 - DNA, 15 bp, Homo sapiens
ggaaacaggaccaca

SEQ ID NO: 4355224 - DNA, 13 bp, Homo sapiens
ggaaaccttggag

SEQ ID NO: 4355225 - DNA, 14 bp, Homo sapiens
ggaaatatatatgt

SEQ ID NO: 4355226 - DNA, 14 bp, Homo sapiens
ggaaatgttactgt

SEQ ID NO: 4355227 - DNA, 16 bp, Homo sapiens
ggaacatgacccagcc

SEQ ID NO: 4355228 - DNA, 18 bp, Homo sapiens
ggaacatgacccagcctg

SEQ ID NO: 4355229 - DNA, 19 bp, Homo sapiens
ggaacatgacccagcctga

SEQ ID NO: 4355230 - DNA, 12 bp, Homo sapiens
ggaactgggctg

SEQ ID NO: 4355231 - DNA, 17 bp, Homo sapiens
gggtcccccctgagtgg

SEQ ID NO: 4355232 - DNA, 18 bp, Homo sapiens
gggtcccccctgagtggg

SEQ ID NO: 4355233 - DNA, 16 bp, Homo sapiens
gggtctcgcagcctga

SEQ ID NO: 4355234 - DNA, 19 bp, Homo sapiens
gggtctcgcagcctgaagc

SEQ ID NO: 4355235 - DNA, 17 bp, Homo sapiens
gggtctgtgactggatc

SEQ ID NO: 4355236 - DNA, 20 bp, Homo sapiens
gggtctgtgactggatcttc

SEQ ID NO: 4355237 - DNA, 13 bp, Homo sapiens
gggtgaagggaga

SEQ ID NO: 4355238 - DNA, 18 bp, Homo sapiens
ggtaagtgttctcatgaa

SEQ ID NO: 4355239 - DNA, 19 bp, Homo sapiens
ggtacagaaaacatgttta

SEQ ID NO: 4355240 - DNA, 12 bp, Homo sapiens
ggtagagacccc

SEQ ID NO: 4355241 - DNA, 14 bp, Homo sapiens
ggtagagaccccca

SEQ ID NO: 4355242 - DNA, 16 bp, Homo sapiens
ggtagagacccccagg

SEQ ID NO: 4355243 - DNA, 19 bp, Homo sapiens
ggtagagacccccaggcct

SEQ ID NO: 4355244 - DNA, 13 bp, Homo sapiens
ggtcactcctggg

SEQ ID NO: 4355245 - DNA, 14 bp, Homo sapiens
ggtcccccctgagt

SEQ ID NO: 4355246 - DNA, 20 bp, Homo sapiens
ggtctcgcagcctgaagcct

SEQ ID NO: 4355247 - DNA, 22 bp, Homo sapiens
ggtctcttctgaataaagcaat

SEQ ID NO: 4355248 - DNA, 15 bp, Homo sapiens
ggtctcttgagggag

SEQ ID NO: 4355249 - DNA, 21 bp, Homo sapiens
ggtctcttgagggagcttagc

SEQ ID NO: 4355250 - DNA, 15 bp, Homo sapiens
ggtctgtgactggat

SEQ ID NO: 4355251 - DNA, 11 bp, Homo sapiens
ggtgactggaa

SEQ ID NO: 4355252 - DNA, 15 bp, Homo sapiens
ggtgaggaccactcc

SEQ ID NO: 4355253 - DNA, 23 bp, Homo sapiens
ggtgagtcttggttctaaaggta

SEQ ID NO: 4355254 - DNA, 17 bp, Homo sapiens
ggtgcacccacctgttt

SEQ ID NO: 4355255 - DNA, 21 bp, Homo sapiens
ggtgcctcatagcatagccag

SEQ ID NO: 4355256 - DNA, 23 bp, Homo sapiens
ggtgcctcatagcatagccagca

SEQ ID NO: 4355257 - DNA, 21 bp, Homo sapiens
ggtgcgtgttcagcagaacct

SEQ ID NO: 4355258 - DNA, 18 bp, Homo sapiens
ggtggcttaagtgagcag

SEQ ID NO: 4355259 - DNA, 19 bp, Homo sapiens
ggtggtcctgactcaacat

SEQ ID NO: 4355260 - DNA, 18 bp, Homo sapiens
ggtgtctcccaacatggg

SEQ ID NO: 4355261 - DNA, 19 bp, Homo sapiens
ggtgtggctgctcccagcc

SEQ ID NO: 4355262 - DNA, 22 bp, Homo sapiens
ggtgttaggcatgtcccaccca

SEQ ID NO: 4355263 - DNA, 14 bp, Homo sapiens
ggttagaaaggcag

SEQ ID NO: 4355264 - DNA, 16 bp, Homo sapiens
ggttctgccctgcctg

SEQ ID NO: 4355265 - DNA, 20 bp, Homo sapiens
ggttctgccctgcctgagga

SEQ ID NO: 4355266 - DNA, 23 bp, Homo sapiens
ggttctgccctgcctgaggagga

SEQ ID NO: 4355267 - DNA, 16 bp, Homo sapiens
ggttgggggaatgcac

SEQ ID NO: 4355268 - DNA, 20 bp, Homo sapiens
ggttgggggaatgcacctcc

SEQ ID NO: 4355269 - DNA, 22 bp, Homo sapiens
ggtttattcccaagtatgcctt

SEQ ID NO: 4355270 - DNA, 19 bp, Homo sapiens
ggtttcagatgtgcaataa

SEQ ID NO: 4355271 - DNA, 13 bp, Homo sapiens
gtaaaaaatatta

SEQ ID NO: 4355272 - DNA, 15 bp, Homo sapiens
gtaaaaatgctgctc

SEQ ID NO: 4355273 - DNA, 18 bp, Homo sapiens
gtaaaaatgctgctctca

SEQ ID NO: 4355274 - DNA, 15 bp, Homo sapiens
gtaaactacaaagta

SEQ ID NO: 4355275 - DNA, 15 bp, Homo sapiens
gtaagagacatgaat

SEQ ID NO: 4355276 - DNA, 17 bp, Homo sapiens
gtaagagcttgctccag

SEQ ID NO: 4355277 - DNA, 20 bp, Homo sapiens
gtaatataaatttaagcaaa

SEQ ID NO: 4355278 - DNA, 21 bp, Homo sapiens
gtacaaaagttactattgctc

SEQ ID NO: 4355279 - DNA, 14 bp, Homo sapiens
gtacaatggtttat

SEQ ID NO: 4355280 - DNA, 19 bp, Homo sapiens
gtacaatggtttattccca

SEQ ID NO: 4355281 - DNA, 15 bp, Homo sapiens
gtaccaaacaaggaa

SEQ ID NO: 4355282 - DNA, 20 bp, Homo sapiens
gtaccccagcctcgttggag

SEQ ID NO: 4355283 - DNA, 15 bp, Homo sapiens
gtactttactgggct

SEQ ID NO: 4355284 - DNA, 21 bp, Homo sapiens
gtagaaagcaaacaaaattgt

SEQ ID NO: 4355285 - DNA, 14 bp, Homo sapiens
gtaggaaaagatgt

SEQ ID NO: 4355286 - DNA, 15 bp, Homo sapiens
gtaggaaaagatgta

SEQ ID NO: 4355287 - DNA, 20 bp, Homo sapiens
gtagggaaaccttggagagg

SEQ ID NO: 4355288 - DNA, 13 bp, Homo sapiens
gtagggcctgcat

SEQ ID NO: 4355289 - DNA, 16 bp, Homo sapiens
gtaggggagggcaggc

SEQ ID NO: 4355290 - DNA, 19 bp, Homo sapiens
gtatcatgaagaaaactga

SEQ ID NO: 4355291 - DNA, 19 bp, Homo sapiens
gtatgctttccctgaggaa

SEQ ID NO: 4355292 - DNA, 16 bp, Homo sapiens
gtattattctgcagca

SEQ ID NO: 4355293 - DNA, 20 bp, Homo sapiens
gtattccttttgtgtacagt

SEQ ID NO: 4355294 - DNA, 18 bp, Homo sapiens
gtattgatgcaatataag

SEQ ID NO: 4355295 - DNA, 17 bp, Homo sapiens
gtatttgtgcacatgta

SEQ ID NO: 4355296 - DNA, 14 bp, Homo sapiens
gtattttgcatact

SEQ ID NO: 4355297 - DNA, 15 bp, Homo sapiens
gtcacaataaagttt

SEQ ID NO: 4355298 - DNA, 21 bp, Homo sapiens
gtcacagtccaaccagaaaca

SEQ ID NO: 4355299 - DNA, 19 bp, Homo sapiens
gtcactccaccatccccac

SEQ ID NO: 4355300 - DNA, 21 bp, Homo sapiens
gtcactccaccatccccaccc

SEQ ID NO: 4355301 - DNA, 13 bp, Homo sapiens
gtcactcctgggg

SEQ ID NO: 4355302 - DNA, 18 bp, Homo sapiens
gtcactgttcgtcactca

SEQ ID NO: 4355303 - DNA, 23 bp, Homo sapiens
gtcaggtaatatacctggtttac

SEQ ID NO: 4355304 - DNA, 17 bp, Homo sapiens
gtcatctccatcagctg

SEQ ID NO: 4355305 - DNA, 17 bp, Homo sapiens
gtcatctgtaagagctt

SEQ ID NO: 4355306 - DNA, 21 bp, Homo sapiens
gtcatcttgtgagtggataat

SEQ ID NO: 4355307 - DNA, 20 bp, Homo sapiens
gtccaccttttaagttaatg

SEQ ID NO: 4355308 - DNA, 18 bp, Homo sapiens
gtccaggcccgtgggcgc

SEQ ID NO: 4355309 - DNA, 19 bp, Homo sapiens
gtccaggcccgtgggcgca

SEQ ID NO: 4355310 - DNA, 13 bp, Homo sapiens
gtcccacccaccc

SEQ ID NO: 4355311 - DNA, 12 bp, Homo sapiens
gtcccccctgag

SEQ ID NO: 4355312 - DNA, 15 bp, Homo sapiens
gtcccccctgagtgg

SEQ ID NO: 4355313 - DNA, 17 bp, Homo sapiens
gtccccgaggagctggg

SEQ ID NO: 4355314 - DNA, 23 bp, Homo sapiens
gtccccgaggagctgggcccctg

SEQ ID NO: 4355315 - DNA, 12 bp, Homo sapiens
gtcccctgcggg

SEQ ID NO: 4355316 - DNA, 13 bp, Homo sapiens
gtccctggagctg

SEQ ID NO: 4355317 - DNA, 13 bp, Homo sapiens
gtccggcccagtg

SEQ ID NO: 4355318 - DNA, 19 bp, Homo sapiens
gtccgttcacatgtgtggt

SEQ ID NO: 4355319 - DNA, 12 bp, Homo sapiens
gtccttgcctga

SEQ ID NO: 4355320 - DNA, 16 bp, Homo sapiens
gtctaggactgcagtg

SEQ ID NO: 4355321 - DNA, 12 bp, Homo sapiens
gtctatatatat

SEQ ID NO: 4355322 - DNA, 13 bp, Homo sapiens
gtctcaggcagca

SEQ ID NO: 4355323 - DNA, 20 bp, Homo sapiens
gtctccctcccctctcagaa

SEQ ID NO: 4355324 - DNA, 15 bp, Homo sapiens
gtctcgcagcctgaa

SEQ ID NO: 4355325 - DNA, 16 bp, Homo sapiens
gtctcgcagcctgaag

SEQ ID NO: 4355326 - DNA, 19 bp, Homo sapiens
gtctcgcagcctgaagcct

SEQ ID NO: 4355327 - DNA, 19 bp, Homo sapiens
gtctcttctgaataaagca

SEQ ID NO: 4355328 - DNA, 21 bp, Homo sapiens
gtctgctgctgcctccctggg

SEQ ID NO: 4355329 - DNA, 15 bp, Homo sapiens
gtctggactagaaaa

SEQ ID NO: 4355330 - DNA, 17 bp, Homo sapiens
gtctgtgactggatctt

SEQ ID NO: 4355331 - DNA, 16 bp, Homo sapiens
gtctgttatgcactgt

SEQ ID NO: 4355332 - DNA, 19 bp, Homo sapiens
gtgacagctttctgggatg

SEQ ID NO: 4355333 - DNA, 18 bp, Homo sapiens
gtgacagtgcctcttcca

SEQ ID NO: 4355334 - DNA, 18 bp, Homo sapiens
gtgagaagctagatgccc

SEQ ID NO: 4355335 - DNA, 14 bp, Homo sapiens
gtgagcagaacagg

SEQ ID NO: 4355336 - DNA, 23 bp, Homo sapiens
gtgagctggatagacttgggatg

SEQ ID NO: 4355337 - DNA, 13 bp, Homo sapiens
gtgagtggataat

SEQ ID NO: 4355338 - DNA, 16 bp, Homo sapiens
gtgatcaataaaatgt

SEQ ID NO: 4355339 - DNA, 17 bp, Homo sapiens
gtgatcaataaaatgtg

SEQ ID NO: 4355340 - DNA, 15 bp, Homo sapiens
gtgcaataatttgta

SEQ ID NO: 4355341 - DNA, 21 bp, Homo sapiens
gtgcaataatttgtacaatgg

SEQ ID NO: 4355342 - DNA, 18 bp, Homo sapiens
gtgcatgggtgaagggag

SEQ ID NO: 4355343 - DNA, 17 bp, Homo sapiens
gtgcccccgcctgccac

SEQ ID NO: 4355344 - DNA, 19 bp, Homo sapiens
gtgcccccgcctgccaccg

SEQ ID NO: 4355345 - DNA, 19 bp, Homo sapiens
gtgcctcttccagtgaaca

SEQ ID NO: 4355346 - DNA, 16 bp, Homo sapiens
gtgcgtctccagtcat

SEQ ID NO: 4355347 - DNA, 15 bp, Homo sapiens
gtgctggctgcccag

SEQ ID NO: 4355348 - DNA, 17 bp, Homo sapiens
gtggagaaaattggaac

SEQ ID NO: 4355349 - DNA, 20 bp, Homo sapiens
gtggaggaggaggaggagcc

SEQ ID NO: 4355350 - DNA, 21 bp, Homo sapiens
gtggaggaggaggaggagcct

SEQ ID NO: 4355351 - DNA, 16 bp, Homo sapiens
tcacagtccaaccaga

SEQ ID NO: 4355352 - DNA, 20 bp, Homo sapiens
tcacagtccaaccagaaaca

SEQ ID NO: 4355353 - DNA, 16 bp, Homo sapiens
tcacctctgaggacag

SEQ ID NO: 4355354 - DNA, 17 bp, Homo sapiens
tcacctctgaggacaga

SEQ ID NO: 4355355 - DNA, 16 bp, Homo sapiens
tcaccttggaagggcg

SEQ ID NO: 4355356 - DNA, 19 bp, Homo sapiens
tcactcaaatgaatttgct

SEQ ID NO: 4355357 - DNA, 16 bp, Homo sapiens
tcactcagtaaaacat

SEQ ID NO: 4355358 - DNA, 14 bp, Homo sapiens
tcactccaccatcc

SEQ ID NO: 4355359 - DNA, 21 bp, Homo sapiens
tcactccaccatccccacccc

SEQ ID NO: 4355360 - DNA, 11 bp, Homo sapiens
tcactcctggg

SEQ ID NO: 4355361 - DNA, 20 bp, Homo sapiens
tcactgggtggggtgaggac

SEQ ID NO: 4355362 - DNA, 11 bp, Homo sapiens
tcactttgaaa

SEQ ID NO: 4355363 - DNA, 14 bp, Homo sapiens
tcactttgaaaagt

SEQ ID NO: 4355364 - DNA, 16 bp, Homo sapiens
tcagaacatactgatt

SEQ ID NO: 4355365 - DNA, 16 bp, Homo sapiens
tcagacacgattgaga

SEQ ID NO: 4355366 - DNA, 14 bp, Homo sapiens
tcagagctttgtca

SEQ ID NO: 4355367 - DNA, 23 bp, Homo sapiens
tcagatatatttttcacagtttt

SEQ ID NO: 4355368 - DNA, 18 bp, Homo sapiens
tcagatgggaagacatga

SEQ ID NO: 4355369 - DNA, 14 bp, Homo sapiens
tcagatgtgcaata

SEQ ID NO: 4355370 - DNA, 17 bp, Homo sapiens
tcagcagaacctgcaca

SEQ ID NO: 4355371 - DNA, 18 bp, Homo sapiens
tcagccagtggcacagga

SEQ ID NO: 4355372 - DNA, 20 bp, Homo sapiens
tcagccagtggcacaggaga

SEQ ID NO: 4355373 - DNA, 22 bp, Homo sapiens
tcagccccgcctgtcacaataa

SEQ ID NO: 4355374 - DNA, 20 bp, Homo sapiens
tcagctgtaagaagagactg

SEQ ID NO: 4355375 - DNA, 23 bp, Homo sapiens
tcaggaaaaatgaggaatccaaa

SEQ ID NO: 4355376 - DNA, 18 bp, Homo sapiens
tcaggaaatatatatgtg

SEQ ID NO: 4355377 - DNA, 21 bp, Homo sapiens
tcaggaaatatatatgtgtgt

SEQ ID NO: 4355378 - DNA, 15 bp, Homo sapiens
tcaggcagcaccaca

SEQ ID NO: 4355379 - DNA, 16 bp, Homo sapiens
tcagggcagggctctg

SEQ ID NO: 4355380 - DNA, 13 bp, Homo sapiens
tcagggtataaat

SEQ ID NO: 4355381 - DNA, 21 bp, Homo sapiens
tcaggtaatatacctggttta

SEQ ID NO: 4355382 - DNA, 20 bp, Homo sapiens
tcaggtacagaaaacatgtt

SEQ ID NO: 4355383 - DNA, 13 bp, Homo sapiens
tcagtatttttta

SEQ ID NO: 4355384 - DNA, 15 bp, Homo sapiens
tcagtattttttact

SEQ ID NO: 4355385 - DNA, 18 bp, Homo sapiens
tcatccaatcctcactgg

SEQ ID NO: 4355386 - DNA, 22 bp, Homo sapiens
tcatccaatcctcactgggtgg

SEQ ID NO: 4355387 - DNA, 21 bp, Homo sapiens
tcatcggagttgacagtgaaa

SEQ ID NO: 4355388 - DNA, 23 bp, Homo sapiens
tcatcggagttgacagtgaaaca

SEQ ID NO: 4355389 - DNA, 15 bp, Homo sapiens
tcatgcccagctctc

SEQ ID NO: 4355390 - DNA, 18 bp, Homo sapiens
tcatgcccagctctctga

SEQ ID NO: 4355391 - DNA, 16 bp, Homo sapiens
tcattccaattctaaa

SEQ ID NO: 4355392 - DNA, 15 bp, Homo sapiens
tcattccgttaggaa

SEQ ID NO: 4355393 - DNA, 17 bp, Homo sapiens
tcattccgttaggaata

SEQ ID NO: 4355394 - DNA, 17 bp, Homo sapiens
tccaattctaaatccga

SEQ ID NO: 4355395 - DNA, 22 bp, Homo sapiens
tccaattctaaatccgacttga

SEQ ID NO: 4355396 - DNA, 19 bp, Homo sapiens
tccaccatccccaccccac

SEQ ID NO: 4355397 - DNA, 13 bp, Homo sapiens
tccagattctgat

SEQ ID NO: 4355398 - DNA, 14 bp, Homo sapiens
tccagattctgatg

SEQ ID NO: 4355399 - DNA, 15 bp, Homo sapiens
tccagattctgatgc

SEQ ID NO: 4355400 - DNA, 22 bp, Homo sapiens
tccagcagatttccagccttct

SEQ ID NO: 4355401 - DNA, 18 bp, Homo sapiens
tccaggtggtgaattttc

SEQ ID NO: 4355402 - DNA, 21 bp, Homo sapiens
tccatccccttcccccatccc

SEQ ID NO: 4355403 - DNA, 21 bp, Homo sapiens
tccatcttgtggggccaggac

SEQ ID NO: 4355404 - DNA, 21 bp, Homo sapiens
tccatgaatgtatcaggaaat

SEQ ID NO: 4355405 - DNA, 18 bp, Homo sapiens
tccatgccccagctctgg

SEQ ID NO: 4355406 - DNA, 13 bp, Homo sapiens
tccatttaaatgc

SEQ ID NO: 4355407 - DNA, 12 bp, Homo sapiens
tcccaacatggg

SEQ ID NO: 4355408 - DNA, 16 bp, Homo sapiens
tcccaacatgggaggg

SEQ ID NO: 4355409 - DNA, 21 bp, Homo sapiens
tcccaacatgggagggatcag

SEQ ID NO: 4355410 - DNA, 22 bp, Homo sapiens
tcccaagtatgccttaagcaga

SEQ ID NO: 4355411 - DNA, 23 bp, Homo sapiens
tcccaagtatgccttaagcagaa

SEQ ID NO: 4355412 - DNA, 14 bp, Homo sapiens
tcccacccacccgc

SEQ ID NO: 4355413 - DNA, 23 bp, Homo sapiens
tcccacccacccgccgcctccca

SEQ ID NO: 4355414 - DNA, 22 bp, Homo sapiens
tcccagacagtggatatgaccc

SEQ ID NO: 4355415 - DNA, 22 bp, Homo sapiens
tcccagcctcttgctcagagct

SEQ ID NO: 4355416 - DNA, 20 bp, Homo sapiens
tcccataaataaaagtacag

SEQ ID NO: 4355417 - DNA, 18 bp, Homo sapiens
tcccccatccctaccact

SEQ ID NO: 4355418 - DNA, 21 bp, Homo sapiens
tccccgatgtcccctgcgggc

SEQ ID NO: 4355419 - DNA, 13 bp, Homo sapiens
tcccctctcagaa

SEQ ID NO: 4355420 - DNA, 13 bp, Homo sapiens
tccccttccccca

SEQ ID NO: 4355421 - DNA, 21 bp, Homo sapiens
tccccttcccccatccctacc

SEQ ID NO: 4355422 - DNA, 16 bp, Homo sapiens
tcccgcactctgcccc

SEQ ID NO: 4355423 - DNA, 19 bp, Homo sapiens
tccctaccctaaccaagtt

SEQ ID NO: 4355424 - DNA, 12 bp, Homo sapiens
tccctcacccat

SEQ ID NO: 4355425 - DNA, 14 bp, Homo sapiens
tccctcacccatcc

SEQ ID NO: 4355426 - DNA, 14 bp, Homo sapiens
tccctgaggaatga

SEQ ID NO: 4355427 - DNA, 23 bp, Homo sapiens
tccctgcacgcattttctctgta

SEQ ID NO: 4355428 - DNA, 20 bp, Homo sapiens
tccctggaaaccttccaccc

SEQ ID NO: 4355429 - DNA, 20 bp, Homo sapiens
tccctggagctgtccttcat

SEQ ID NO: 4355430 - DNA, 16 bp, Homo sapiens
tccctggctctcagaa

SEQ ID NO: 4355431 - DNA, 19 bp, Homo sapiens
tccctggctctcagaaggt

SEQ ID NO: 4355432 - DNA, 16 bp, Homo sapiens
tccctgggcagaaagt

SEQ ID NO: 4355433 - DNA, 19 bp, Homo sapiens
tccctggggaccaggagct

SEQ ID NO: 4355434 - DNA, 17 bp, Homo sapiens
tccctttcttggccagt

SEQ ID NO: 4355435 - DNA, 16 bp, Homo sapiens
tccggcccagtgccac

SEQ ID NO: 4355436 - DNA, 23 bp, Homo sapiens
tccgggtctcgcagcctgaagcc

SEQ ID NO: 4355437 - DNA, 21 bp, Homo sapiens
tccgtgcttaaccaaagaagc

SEQ ID NO: 4355438 - DNA, 19 bp, Homo sapiens
tcctccctgggcagaaagt

SEQ ID NO: 4355439 - DNA, 18 bp, Homo sapiens
tcctgctcctcacccctg

SEQ ID NO: 4355440 - DNA, 22 bp, Homo sapiens
tcctgctcctcacccctgtagg

SEQ ID NO: 4355441 - DNA, 20 bp, Homo sapiens
tcctggacttacaaaatgcc

SEQ ID NO: 4355442 - DNA, 15 bp, Homo sapiens
tcctggggcctcttg

SEQ ID NO: 4355443 - DNA, 22 bp, Homo sapiens
tcctgggtgggtggggtacagg

SEQ ID NO: 4355444 - DNA, 21 bp, Homo sapiens
tcctgtacactgaatatttat

SEQ ID NO: 4355445 - DNA, 24 bp, Homo sapiens
tcctgtagctttaaaaccacagct

SEQ ID NO: 4355446 - DNA, 16 bp, Homo sapiens
tcctgtgcatgggtga

SEQ ID NO: 4355447 - DNA, 14 bp, Homo sapiens
tccttaaactgtgt

SEQ ID NO: 4355448 - DNA, 16 bp, Homo sapiens
tccttaaactgtgtgg

SEQ ID NO: 4355449 - DNA, 23 bp, Homo sapiens
tccttaaactgtgtggactgtga

SEQ ID NO: 4355450 - DNA, 13 bp, Homo sapiens
tccttccatcttg

SEQ ID NO: 4355451 - DNA, 17 bp, Homo sapiens
tccttccatcttgtggg

SEQ ID NO: 4355452 - DNA, 22 bp, Homo sapiens
tccttccatcttgtggggccag

SEQ ID NO: 4355453 - DNA, 13 bp, Homo sapiens
tccttgctgcagc

SEQ ID NO: 4355454 - DNA, 17 bp, Homo sapiens
tccttgctgcagcttct

SEQ ID NO: 4355455 - DNA, 16 bp, Homo sapiens
tccttggccatgcaga

SEQ ID NO: 4355456 - DNA, 13 bp, Homo sapiens
tccttttagccta

SEQ ID NO: 4355457 - DNA, 14 bp, Homo sapiens
tccttttagcctag

SEQ ID NO: 4355458 - DNA, 17 bp, Homo sapiens
tccttttgtgtacagtg

SEQ ID NO: 4355459 - DNA, 18 bp, Homo sapiens
tccttttgtgtacagtgt

SEQ ID NO: 4355460 - DNA, 14 bp, Homo sapiens
tcctttttctttat

SEQ ID NO: 4355461 - DNA, 18 bp, Homo sapiens
tcgcagcctgaagcctgg

SEQ ID NO: 4355462 - DNA, 19 bp, Homo sapiens
tcgcagcctgaagcctgga

SEQ ID NO: 4355463 - DNA, 15 bp, Homo sapiens
tcgcattaagcacac

SEQ ID NO: 4355464 - DNA, 22 bp, Homo sapiens
tctaaaggtaccaaacaaggaa

SEQ ID NO: 4355465 - DNA, 23 bp, Homo sapiens
tctaaatatttccttaaactgtg

SEQ ID NO: 4355466 - DNA, 17 bp, Homo sapiens
tctaagagcaattctgg

SEQ ID NO: 4355467 - DNA, 17 bp, Homo sapiens
tctacagacttctccag

SEQ ID NO: 4355468 - DNA, 16 bp, Homo sapiens
tctactaaataatact

SEQ ID NO: 4355469 - DNA, 22 bp, Homo sapiens
tctactcaacccattgttgtca

SEQ ID NO: 4355470 - DNA, 15 bp, Homo sapiens
tggccctggagccag

SEQ ID NO: 4355471 - DNA, 18 bp, Homo sapiens
tggccctggagccagggc

SEQ ID NO: 4355472 - DNA, 18 bp, Homo sapiens
tggccgaagccccttgga

SEQ ID NO: 4355473 - DNA, 19 bp, Homo sapiens
tggccgaagccccttggag

SEQ ID NO: 4355474 - DNA, 22 bp, Homo sapiens
tggccgaagccccttggagaga

SEQ ID NO: 4355475 - DNA, 20 bp, Homo sapiens
tggcgtctgctctggtggct

SEQ ID NO: 4355476 - DNA, 16 bp, Homo sapiens
tggctctcagaaggta

SEQ ID NO: 4355477 - DNA, 21 bp, Homo sapiens
tggctgcccagacccctctgg

SEQ ID NO: 4355478 - DNA, 20 bp, Homo sapiens
tggctgggaacatgacccag

SEQ ID NO: 4355479 - DNA, 21 bp, Homo sapiens
tggcttaagtgagcagaacag

SEQ ID NO: 4355480 - DNA, 13 bp, Homo sapiens
tgggaagacatga

SEQ ID NO: 4355481 - DNA, 17 bp, Homo sapiens
tgggaagataggctctg

SEQ ID NO: 4355482 - DNA, 22 bp, Homo sapiens
tgggaaggttagaaaggcagcc

SEQ ID NO: 4355483 - DNA, 23 bp, Homo sapiens
tgggaccctgtccggcccagtgc

SEQ ID NO: 4355484 - DNA, 16 bp, Homo sapiens
tgggagaaaatcaact

SEQ ID NO: 4355485 - DNA, 21 bp, Homo sapiens
tgggagcagcggtttggggag

SEQ ID NO: 4355486 - DNA, 15 bp, Homo sapiens
tgggagggatcagcc

SEQ ID NO: 4355487 - DNA, 18 bp, Homo sapiens
tgggagggatcagccccg

SEQ ID NO: 4355488 - DNA, 20 bp, Homo sapiens
tgggagggatcagccccgcc

SEQ ID NO: 4355489 - DNA, 22 bp, Homo sapiens
tgggaggtgcgtgttcagcaga

SEQ ID NO: 4355490 - DNA, 14 bp, Homo sapiens
tgggatgtcacagt

SEQ ID NO: 4355491 - DNA, 18 bp, Homo sapiens
tgggatgtcacagtccaa

SEQ ID NO: 4355492 - DNA, 22 bp, Homo sapiens
tgggatgtcacagtccaaccag

SEQ ID NO: 4355493 - DNA, 15 bp, Homo sapiens
tgggcctccatgccc

SEQ ID NO: 4355494 - DNA, 22 bp, Homo sapiens
tgggcctccatgccccagctct

SEQ ID NO: 4355495 - DNA, 23 bp, Homo sapiens
tgggcctccatgccccagctctg

SEQ ID NO: 4355496 - DNA, 16 bp, Homo sapiens
tgggcgcaaaggtgcc

SEQ ID NO: 4355497 - DNA, 20 bp, Homo sapiens
tgggcgcaaaggtgcctcat

SEQ ID NO: 4355498 - DNA, 14 bp, Homo sapiens
tgggctcagggttg

SEQ ID NO: 4355499 - DNA, 15 bp, Homo sapiens
tgggctgcctgctgt

SEQ ID NO: 4355500 - DNA, 12 bp, Homo sapiens
tgggctgtgagt

SEQ ID NO: 4355501 - DNA, 13 bp, Homo sapiens
tggggaaaatggc

SEQ ID NO: 4355502 - DNA, 21 bp, Homo sapiens
tggggaaaatggccatgcagg

SEQ ID NO: 4355503 - DNA, 22 bp, Homo sapiens
tggggaaaatggccatgcagga

SEQ ID NO: 4355504 - DNA, 17 bp, Homo sapiens
tggggaccaggagctag

SEQ ID NO: 4355505 - DNA, 17 bp, Homo sapiens
tggggagcagagacact

SEQ ID NO: 4355506 - DNA, 17 bp, Homo sapiens
tggggcaggctggctgg

SEQ ID NO: 4355507 - DNA, 13 bp, Homo sapiens
tggggtacaggca

SEQ ID NO: 4355508 - DNA, 19 bp, Homo sapiens
tggggtctgtgactggatc

SEQ ID NO: 4355509 - DNA, 14 bp, Homo sapiens
tggggtgctgccct

SEQ ID NO: 4355510 - DNA, 18 bp, Homo sapiens
tgggtcccgcactctgcc

SEQ ID NO: 4355511 - DNA, 18 bp, Homo sapiens
tgggtgctggctgcccag

SEQ ID NO: 4355512 - DNA, 15 bp, Homo sapiens
tgggtggggtgagga

SEQ ID NO: 4355513 - DNA, 16 bp, Homo sapiens
tgggttctttggaagc

SEQ ID NO: 4355514 - DNA, 12 bp, Homo sapiens
tggtaaaaatgc

SEQ ID NO: 4355515 - DNA, 15 bp, Homo sapiens
tggtacatggtgttt

SEQ ID NO: 4355516 - DNA, 16 bp, Homo sapiens
tggtactaccccagcc

SEQ ID NO: 4355517 - DNA, 17 bp, Homo sapiens
tggtaggggagggcagg

SEQ ID NO: 4355518 - DNA, 23 bp, Homo sapiens
tggtaggggagggcaggcttggg

SEQ ID NO: 4355519 - DNA, 15 bp, Homo sapiens
tggtataattatttt

SEQ ID NO: 4355520 - DNA, 15 bp, Homo sapiens
tggtcaagttcccaa

SEQ ID NO: 4355521 - DNA, 12 bp, Homo sapiens
tggtcctgactc

SEQ ID NO: 4355522 - DNA, 17 bp, Homo sapiens
tggtctcaggcagcacc

SEQ ID NO: 4355523 - DNA, 20 bp, Homo sapiens
tggtctcaggcagcaccaca

SEQ ID NO: 4355524 - DNA, 14 bp, Homo sapiens
tggtctttctggag

SEQ ID NO: 4355525 - DNA, 14 bp, Homo sapiens
tggtctttctgtgc

SEQ ID NO: 4355526 - DNA, 13 bp, Homo sapiens
tggtgaattttcc

SEQ ID NO: 4355527 - DNA, 19 bp, Homo sapiens
tggtggcttaagtgagcag

SEQ ID NO: 4355528 - DNA, 22 bp, Homo sapiens
tggtggcttaagtgagcagaac

SEQ ID NO: 4355529 - DNA, 11 bp, Homo sapiens
tggtgtctccc

SEQ ID NO: 4355530 - DNA, 17 bp, Homo sapiens
tggttgagaaatgaata

SEQ ID NO: 4355531 - DNA, 20 bp, Homo sapiens
tggtttattcccaagtatgc

SEQ ID NO: 4355532 - DNA, 12 bp, Homo sapiens
tgtaaatgttaa

SEQ ID NO: 4355533 - DNA, 19 bp, Homo sapiens
tgtaagaagagactgggaa

SEQ ID NO: 4355534 - DNA, 15 bp, Homo sapiens
tgtaagagcttgctc

SEQ ID NO: 4355535 - DNA, 21 bp, Homo sapiens
tgtaagtgtgagtaagagctg

SEQ ID NO: 4355536 - DNA, 20 bp, Homo sapiens
tgtaatataaatttaagcaa

SEQ ID NO: 4355537 - DNA, 22 bp, Homo sapiens
tgtaatataaatttaagcaaac

SEQ ID NO: 4355538 - DNA, 17 bp, Homo sapiens
tgtaatatttcttcaaa

SEQ ID NO: 4355539 - DNA, 21 bp, Homo sapiens
tgtaattttaaataaaagtga

SEQ ID NO: 4355540 - DNA, 11 bp, Homo sapiens
tgtacaataag

SEQ ID NO: 4355541 - DNA, 23 bp, Homo sapiens
tgtacaataagttacttgaaata

SEQ ID NO: 4355542 - DNA, 14 bp, Homo sapiens
tgtacaatggttta

SEQ ID NO: 4355543 - DNA, 12 bp, Homo sapiens
tgtacactgaat

SEQ ID NO: 4355544 - DNA, 17 bp, Homo sapiens
tgtacactgaatattta

SEQ ID NO: 4355545 - DNA, 21 bp, Homo sapiens
tgtacactgaatatttatatt

SEQ ID NO: 4355546 - DNA, 17 bp, Homo sapiens
tgtacagtgtgtaaagt

SEQ ID NO: 4355547 - DNA, 19 bp, Homo sapiens
tgtacagtgtgtaaagtgt

SEQ ID NO: 4355548 - DNA, 16 bp, Homo sapiens
tgtacatatggaaatg

SEQ ID NO: 4355549 - DNA, 22 bp, Homo sapiens
tgtacttaataaattcagatat

SEQ ID NO: 4355550 - DNA, 20 bp, Homo sapiens
tgtagctttaaaaccacagc

SEQ ID NO: 4355551 - DNA, 16 bp, Homo sapiens
tgtagggaaaccttgg

SEQ ID NO: 4355552 - DNA, 18 bp, Homo sapiens
tgtagggaaaccttggag

SEQ ID NO: 4355553 - DNA, 21 bp, Homo sapiens
tgtataactaaactaacaaga

SEQ ID NO: 4355554 - DNA, 21 bp, Homo sapiens
tgtatagtgtctattatcaca

SEQ ID NO: 4355555 - DNA, 14 bp, Homo sapiens
tgtatgttcttgtt

SEQ ID NO: 4355556 - DNA, 16 bp, Homo sapiens
tgtatgtttgcacact

SEQ ID NO: 4355557 - DNA, 22 bp, Homo sapiens
tgtattctctttaccttctaaa

SEQ ID NO: 4355558 - DNA, 23 bp, Homo sapiens
tgtattctctttaccttctaaaa

SEQ ID NO: 4355559 - DNA, 20 bp, Homo sapiens
tgtcacagtccaaccagaaa

SEQ ID NO: 4355560 - DNA, 22 bp, Homo sapiens
tgtcacagtccaaccagaaaca

SEQ ID NO: 4355561 - DNA, 23 bp, Homo sapiens
tgtcaccgtgagcagctttggaa

SEQ ID NO: 4355562 - DNA, 17 bp, Homo sapiens
tgtccaccttttaagtt

SEQ ID NO: 4355563 - DNA, 14 bp, Homo sapiens
tgtcccctgcgggc

SEQ ID NO: 4355564 - DNA, 16 bp, Homo sapiens
tgtccctttcttggcc

SEQ ID NO: 4355565 - DNA, 16 bp, Homo sapiens
tgtctcccaacatggg

SEQ ID NO: 4355566 - DNA, 17 bp, Homo sapiens
tgtctcccaacatggga

SEQ ID NO: 4355567 - DNA, 20 bp, Homo sapiens
tgtctcccaacatgggaggg

SEQ ID NO: 4355568 - DNA, 22 bp, Homo sapiens
tgtctcccaacatgggagggat

SEQ ID NO: 4355569 - DNA, 21 bp, Homo sapiens
tgtctccctcccctctcagaa

SEQ ID NO: 4355570 - DNA, 18 bp, Homo sapiens
tgtcttccgatcaacatt

SEQ ID NO: 4355571 - DNA, 23 bp, Homo sapiens
tgtcttccgatcaacatttatga

SEQ ID NO: 4355572 - DNA, 15 bp, Homo sapiens
tgtgacagtgcctct

SEQ ID NO: 4355573 - DNA, 14 bp, Homo sapiens
tgtgaccaactgtt

SEQ ID NO: 4355574 - DNA, 23 bp, Homo sapiens
tgtgaggcccatggttgagaaat

SEQ ID NO: 4355575 - DNA, 19 bp, Homo sapiens
tgtgagtggataatcagga

SEQ ID NO: 4355576 - DNA, 16 bp, Homo sapiens
tgtgagtgtaagtgtg

SEQ ID NO: 4355577 - DNA, 15 bp, Homo sapiens
tgtgatgccacacag

SEQ ID NO: 4355578 - DNA, 19 bp, Homo sapiens
tgtgcaataatttgtacaa

SEQ ID NO: 4355579 - DNA, 15 bp, Homo sapiens
tgtgcattctggatt

SEQ ID NO: 4355580 - DNA, 20 bp, Homo sapiens
tgtgccacccaccagggcga

SEQ ID NO: 4355581 - DNA, 15 bp, Homo sapiens
tgtggactgtgatgc

SEQ ID NO: 4355582 - DNA, 21 bp, Homo sapiens
tgtggagttcaccttggaagg

SEQ ID NO: 4355583 - DNA, 20 bp, Homo sapiens
tgtggctgctcccagcctct

SEQ ID NO: 4355584 - DNA, 16 bp, Homo sapiens
tgtggggccaggacca

SEQ ID NO: 4355585 - DNA, 19 bp, Homo sapiens
tgtggtacatggtgtttgt

SEQ ID NO: 4355586 - DNA, 16 bp, Homo sapiens
tgtggtctactaaata

SEQ ID NO: 4355587 - DNA, 13 bp, Homo sapiens
tgtgtgtgtatgt

SEQ ID NO: 4355588 - DNA, 15 bp, Homo sapiens
tgttactgaccagca

SEQ ID NO: 4355589 - DNA, 23 bp, Homo sapiens
tgggaggtgcgtgttcagcagaa

SEQ ID NO: 4355590 - DNA, 15 bp, Homo sapiens
tgggatggggaggga

SEQ ID NO: 4355591 - DNA, 13 bp, Homo sapiens
tgggcccctgcac

SEQ ID NO: 4355592 - DNA, 18 bp, Homo sapiens
tgggcctccatgccccag

SEQ ID NO: 4355593 - DNA, 15 bp, Homo sapiens
tgggctcagggttgg

SEQ ID NO: 4355594 - DNA, 16 bp, Homo sapiens
tgggctgcctgctgtg

SEQ ID NO: 4355595 - DNA, 15 bp, Homo sapiens
tgggctgtgagtgta

SEQ ID NO: 4355596 - DNA, 15 bp, Homo sapiens
tggggaccaggagct

SEQ ID NO: 4355597 - DNA, 11 bp, Homo sapiens
tggggccagga

SEQ ID NO: 4355598 - DNA, 18 bp, Homo sapiens
tgggggaatgcacctccc

SEQ ID NO: 4355599 - DNA, 16 bp, Homo sapiens
tggggggcgggccagg

SEQ ID NO: 4355600 - DNA, 16 bp, Homo sapiens
tggggtcccccctgag

SEQ ID NO: 4355601 - DNA, 21 bp, Homo sapiens
tggggtcccccctgagtgggc

SEQ ID NO: 4355602 - DNA, 18 bp, Homo sapiens
tggggtctgtgactggat

SEQ ID NO: 4355603 - DNA, 20 bp, Homo sapiens
tggggtctgtgactggatct

SEQ ID NO: 4355604 - DNA, 17 bp, Homo sapiens
tggggtgaggaccactc

SEQ ID NO: 4355605 - DNA, 15 bp, Homo sapiens
tgggtgaagggagag

SEQ ID NO: 4355606 - DNA, 22 bp, Homo sapiens
tggtaaaaagatccagggatgg

SEQ ID NO: 4355607 - DNA, 16 bp, Homo sapiens
tggtaaaaatgctgct

SEQ ID NO: 4355608 - DNA, 22 bp, Homo sapiens
tggtaggggagggcaggcttgg

SEQ ID NO: 4355609 - DNA, 16 bp, Homo sapiens
tggtcaagttcccaac

SEQ ID NO: 4355610 - DNA, 14 bp, Homo sapiens
tggtctcaggcagc

SEQ ID NO: 4355611 - DNA, 15 bp, Homo sapiens
tggtctgtgaagagc

SEQ ID NO: 4355612 - DNA, 15 bp, Homo sapiens
tggtctttctggaga

SEQ ID NO: 4355613 - DNA, 16 bp, Homo sapiens
tggtgtttgtctgtgt

SEQ ID NO: 4355614 - DNA, 14 bp, Homo sapiens
tgtaaaaaatatta

SEQ ID NO: 4355615 - DNA, 16 bp, Homo sapiens
tgtaaaaaatattaaa

SEQ ID NO: 4355616 - DNA, 12 bp, Homo sapiens
tgtaaatccttt

SEQ ID NO: 4355617 - DNA, 14 bp, Homo sapiens
tgtaaatgttaaca

SEQ ID NO: 4355618 - DNA, 14 bp, Homo sapiens
tgtaacagctgagg

SEQ ID NO: 4355619 - DNA, 21 bp, Homo sapiens
tgtaagaagagactgggaaga

SEQ ID NO: 4355620 - DNA, 19 bp, Homo sapiens
tgtaagagcttgctccaga

SEQ ID NO: 4355621 - DNA, 19 bp, Homo sapiens
tgtaatataaatttaagca

SEQ ID NO: 4355622 - DNA, 13 bp, Homo sapiens
tgtaatgtacaat

SEQ ID NO: 4355623 - DNA, 14 bp, Homo sapiens
tgtaatgtacaatt

SEQ ID NO: 4355624 - DNA, 17 bp, Homo sapiens
tgtacaataagttactt

SEQ ID NO: 4355625 - DNA, 21 bp, Homo sapiens
tgtacaataagttacttgaaa

SEQ ID NO: 4355626 - DNA, 17 bp, Homo sapiens
tgtacaatggtttattc

SEQ ID NO: 4355627 - DNA, 20 bp, Homo sapiens
tgtacaatggtttattccca

SEQ ID NO: 4355628 - DNA, 18 bp, Homo sapiens
tgtacaattttatataat

SEQ ID NO: 4355629 - DNA, 14 bp, Homo sapiens
tgtacactgaatat

SEQ ID NO: 4355630 - DNA, 18 bp, Homo sapiens
tgtacatatggaaatgtt

SEQ ID NO: 4355631 - DNA, 21 bp, Homo sapiens
tgtacttaataaattcagata

SEQ ID NO: 4355632 - DNA, 21 bp, Homo sapiens
tgtagaatgccgcgaactggg

SEQ ID NO: 4355633 - DNA, 19 bp, Homo sapiens
tgtagggaaaccttggaga

SEQ ID NO: 4355634 - DNA, 15 bp, Homo sapiens
tgtagtcagttgcat

SEQ ID NO: 4355635 - DNA, 14 bp, Homo sapiens
tgtatcatgaagaa

SEQ ID NO: 4355636 - DNA, 14 bp, Homo sapiens
tgtatgtttgcaca

SEQ ID NO: 4355637 - DNA, 16 bp, Homo sapiens
tgtattgatgcaatat

SEQ ID NO: 4355638 - DNA, 17 bp, Homo sapiens
tgtattgatgcaatata

SEQ ID NO: 4355639 - DNA, 15 bp, Homo sapiens
tgtattttgcatact

SEQ ID NO: 4355640 - DNA, 13 bp, Homo sapiens
tgtcaaggaagaa

SEQ ID NO: 4355641 - DNA, 14 bp, Homo sapiens
tgtcaaggaagaag

SEQ ID NO: 4355642 - DNA, 15 bp, Homo sapiens
tgtcaatctgtccgt

SEQ ID NO: 4355643 - DNA, 18 bp, Homo sapiens
tgtcacaataaagtttat

SEQ ID NO: 4355644 - DNA, 19 bp, Homo sapiens
tgtcacttgccacatggtg

SEQ ID NO: 4355645 - DNA, 12 bp, Homo sapiens
tgtcaggaatgg

SEQ ID NO: 4355646 - DNA, 18 bp, Homo sapiens
tgtccaccttttaagtta

SEQ ID NO: 4355647 - DNA, 18 bp, Homo sapiens
tgtccacgtttttggaaa

SEQ ID NO: 4355648 - DNA, 12 bp, Homo sapiens
tgtcccacccac

SEQ ID NO: 4355649 - DNA, 17 bp, Homo sapiens
tgtccctttcttggcca

SEQ ID NO: 4355650 - DNA, 18 bp, Homo sapiens
tgtccctttcttggccag

SEQ ID NO: 4355651 - DNA, 15 bp, Homo sapiens
tgtccggcccagtgc

SEQ ID NO: 4355652 - DNA, 13 bp, Homo sapiens
tgtcctgtagctt

SEQ ID NO: 4355653 - DNA, 22 bp, Homo sapiens
tgtccttcattccgttaggaat

SEQ ID NO: 4355654 - DNA, 23 bp, Homo sapiens
tgtcctttttcactttgaaaagt

SEQ ID NO: 4355655 - DNA, 13 bp, Homo sapiens
tgtcgtgggatgg

SEQ ID NO: 4355656 - DNA, 18 bp, Homo sapiens
tgtctaggactgcagtgt

SEQ ID NO: 4355657 - DNA, 12 bp, Homo sapiens
tgtctatatata

SEQ ID NO: 4355658 - DNA, 12 bp, Homo sapiens
tgtctgtctccc

SEQ ID NO: 4355659 - DNA, 15 bp, Homo sapiens
tgtctgtctccctcc

SEQ ID NO: 4355660 - DNA, 21 bp, Homo sapiens
tgtctgtctccctcccctctc

SEQ ID NO: 4355661 - DNA, 21 bp, Homo sapiens
tgtgacagtgcctcttccagt

SEQ ID NO: 4355662 - DNA, 11 bp, Homo sapiens
tgtgagctgga

SEQ ID NO: 4355663 - DNA, 22 bp, Homo sapiens
tgtgagctggatagacttggga

SEQ ID NO: 4355664 - DNA, 15 bp, Homo sapiens
tgtgagtaagagctg

SEQ ID NO: 4355665 - DNA, 19 bp, Homo sapiens
tgtgagtaagagctggtgt

SEQ ID NO: 4355666 - DNA, 14 bp, Homo sapiens
tgtgagtggataat

SEQ ID NO: 4355667 - DNA, 17 bp, Homo sapiens
tgtgagtggataatcag

SEQ ID NO: 4355668 - DNA, 20 bp, Homo sapiens
tgtgagtgtaagtgtgagta

SEQ ID NO: 4355669 - DNA, 18 bp, Homo sapiens
tgtgatgtaaggcactgt

SEQ ID NO: 4355670 - DNA, 14 bp, Homo sapiens
tgtgcaataatttg

SEQ ID NO: 4355671 - DNA, 22 bp, Homo sapiens
tgtgcaataatttgtacaatgg

SEQ ID NO: 4355672 - DNA, 23 bp, Homo sapiens
tgtgcaataatttgtacaatggt

SEQ ID NO: 4355673 - DNA, 13 bp, Homo sapiens
tgtgcatgggtga

SEQ ID NO: 4355674 - DNA, 14 bp, Homo sapiens
tgtggactgtgatg

SEQ ID NO: 4355675 - DNA, 18 bp, Homo sapiens
tgtggagttcaccttgga

SEQ ID NO: 4355676 - DNA, 13 bp, Homo sapiens
tgtgggctgtgag

SEQ ID NO: 4355677 - DNA, 14 bp, Homo sapiens
tgtgggtcccgcac

SEQ ID NO: 4355678 - DNA, 15 bp, Homo sapiens
tgtggtttcagatgt

SEQ ID NO: 4355679 - DNA, 21 bp, Homo sapiens
tgtggtttcagatgtgcaata

SEQ ID NO: 4355680 - DNA, 22 bp, Homo sapiens
tgtggtttcagatgtgcaataa

SEQ ID NO: 4355681 - DNA, 21 bp, Homo sapiens
tgtgtaaagtgtaaatccttt

SEQ ID NO: 4355682 - DNA, 16 bp, Homo sapiens
tgtgtattgatgcaat

SEQ ID NO: 4355683 - DNA, 18 bp, Homo sapiens
tgtgtattgatgcaatat

SEQ ID NO: 4355684 - DNA, 18 bp, Homo sapiens
tgtgtctgccaaacacat

SEQ ID NO: 4355685 - DNA, 21 bp, Homo sapiens
tgtgtctgccaaacacattta

SEQ ID NO: 4355686 - DNA, 19 bp, Homo sapiens
tgtgtgtatgtttgcacac

SEQ ID NO: 4355687 - DNA, 16 bp, Homo sapiens
tgtgtttttctatata

SEQ ID NO: 4355688 - DNA, 19 bp, Homo sapiens
tgttaaaaatagcagtatt

SEQ ID NO: 4355689 - DNA, 19 bp, Homo sapiens
tgttatgcactgtggtttc

SEQ ID NO: 4355690 - DNA, 20 bp, Homo sapiens
tgttatgcactgtggtttca

SEQ ID NO: 4355691 - DNA, 16 bp, Homo sapiens
tgttcagcagaacctg

SEQ ID NO: 4355692 - DNA, 18 bp, Homo sapiens
tgttcagcagaacctgca

SEQ ID NO: 4355693 - DNA, 22 bp, Homo sapiens
tgttcagcagaacctgcacaca

SEQ ID NO: 4355694 - DNA, 17 bp, Homo sapiens
tgttctcatgaagcagg

SEQ ID NO: 4355695 - DNA, 21 bp, Homo sapiens
tgttctcatgaagcaggaggc

SEQ ID NO: 4355696 - DNA, 14 bp, Homo sapiens
ttaaaaaaatttta

SEQ ID NO: 4355697 - DNA, 16 bp, Homo sapiens
ttaaaaactcacttac

SEQ ID NO: 4355698 - DNA, 23 bp, Homo sapiens
ttaaaaagggcagggcatctcct

SEQ ID NO: 4355699 - DNA, 21 bp, Homo sapiens
ttaaaataaacattttgtcca

SEQ ID NO: 4355700 - DNA, 21 bp, Homo sapiens
ttaaactgtgtggactgtgat

SEQ ID NO: 4355701 - DNA, 13 bp, Homo sapiens
ttaaataaaccta

SEQ ID NO: 4355702 - DNA, 13 bp, Homo sapiens
ttaaattctgaat

SEQ ID NO: 4355703 - DNA, 15 bp, Homo sapiens
ttaaattctgaatgc

SEQ ID NO: 4355704 - DNA, 15 bp, Homo sapiens
ttaactgaactgtga

SEQ ID NO: 4355705 - DNA, 18 bp, Homo sapiens
ttaagtgagcagaacagg

SEQ ID NO: 4355706 - DNA, 22 bp, Homo sapiens
ttaataaatatgtaatataaat

SEQ ID NO: 4355707 - DNA, 15 bp, Homo sapiens
ttaataatgttgcct

SEQ ID NO: 4355708 - DNA, 17 bp, Homo sapiens
ttacaaaatgccaaggg

SEQ ID NO: 4355709 - DNA, 15 bp, Homo sapiens
ttacatcagaagttt

SEQ ID NO: 4355710 - DNA, 17 bp, Homo sapiens
ttacattgtcctgtagc

SEQ ID NO: 4355711 - DNA, 13 bp, Homo sapiens
ttacgtttgtcct

SEQ ID NO: 4355712 - DNA, 17 bp, Homo sapiens
tcattccaattctaaat

SEQ ID NO: 4355713 - DNA, 23 bp, Homo sapiens
tcattccaattctaaatccgact

SEQ ID NO: 4355714 - DNA, 19 bp, Homo sapiens
tcatttaactgaactgtga

SEQ ID NO: 4355715 - DNA, 16 bp, Homo sapiens
tcatttgaacaactag

SEQ ID NO: 4355716 - DNA, 13 bp, Homo sapiens
tccaaaagacaaa

SEQ ID NO: 4355717 - DNA, 14 bp, Homo sapiens
tccaatcctcactg

SEQ ID NO: 4355718 - DNA, 16 bp, Homo sapiens
tccaatcctcactggg

SEQ ID NO: 4355719 - DNA, 18 bp, Homo sapiens
tccaatcctcactgggtg

SEQ ID NO: 4355720 - DNA, 21 bp, Homo sapiens
tccacatgtggggacagggct

SEQ ID NO: 4355721 - DNA, 17 bp, Homo sapiens
tccaccttttaagttaa

SEQ ID NO: 4355722 - DNA, 17 bp, Homo sapiens
tccagattctgatgcat

SEQ ID NO: 4355723 - DNA, 17 bp, Homo sapiens
tccagggatggagatgg

SEQ ID NO: 4355724 - DNA, 23 bp, Homo sapiens
tccagtcatctgtaagagcttgc

SEQ ID NO: 4355725 - DNA, 23 bp, Homo sapiens
tccagtgaacattcccagcccag

SEQ ID NO: 4355726 - DNA, 15 bp, Homo sapiens
tccatccccttcccc

SEQ ID NO: 4355727 - DNA, 18 bp, Homo sapiens
tccatcttgtggggccag

SEQ ID NO: 4355728 - DNA, 19 bp, Homo sapiens
tccatcttgtggggccagg

SEQ ID NO: 4355729 - DNA, 13 bp, Homo sapiens
tccatgaatgtat

SEQ ID NO: 4355730 - DNA, 14 bp, Homo sapiens
tccatgaatgtatc

SEQ ID NO: 4355731 - DNA, 16 bp, Homo sapiens
tccatgaatgtatcag

SEQ ID NO: 4355732 - DNA, 15 bp, Homo sapiens
tccatgccccagctc

SEQ ID NO: 4355733 - DNA, 16 bp, Homo sapiens
tccatgccccagctct

SEQ ID NO: 4355734 - DNA, 17 bp, Homo sapiens
tccatgccccagctctg

SEQ ID NO: 4355735 - DNA, 19 bp, Homo sapiens
tccatgttagtttttactt

SEQ ID NO: 4355736 - DNA, 14 bp, Homo sapiens
tcccaacatgggag

SEQ ID NO: 4355737 - DNA, 20 bp, Homo sapiens
tcccaacatgggagggatca

SEQ ID NO: 4355738 - DNA, 16 bp, Homo sapiens
tcccaagtatgcctta

SEQ ID NO: 4355739 - DNA, 14 bp, Homo sapiens
tcccaattaggaag

SEQ ID NO: 4355740 - DNA, 20 bp, Homo sapiens
tcccaattaggaagtgtaac

SEQ ID NO: 4355741 - DNA, 15 bp, Homo sapiens
tcccacccacccgcc

SEQ ID NO: 4355742 - DNA, 21 bp, Homo sapiens
tcccagacagtggatatgacc

SEQ ID NO: 4355743 - DNA, 18 bp, Homo sapiens
tcccattttggaagtttt

SEQ ID NO: 4355744 - DNA, 19 bp, Homo sapiens
tcccattttggaagttttc

SEQ ID NO: 4355745 - DNA, 13 bp, Homo sapiens
tcccccatcccta

SEQ ID NO: 4355746 - DNA, 22 bp, Homo sapiens
tcccccatccctaccactgtgg

SEQ ID NO: 4355747 - DNA, 17 bp, Homo sapiens
tccccgaggagctgggc

SEQ ID NO: 4355748 - DNA, 14 bp, Homo sapiens
tcccctctcagaac

SEQ ID NO: 4355749 - DNA, 16 bp, Homo sapiens
tcccctctcagaacat

SEQ ID NO: 4355750 - DNA, 15 bp, Homo sapiens
tcccgatgagggaag

SEQ ID NO: 4355751 - DNA, 17 bp, Homo sapiens
tcccgcactctgccccc

SEQ ID NO: 4355752 - DNA, 18 bp, Homo sapiens
tcccgcactctgccccca

SEQ ID NO: 4355753 - DNA, 21 bp, Homo sapiens
tcccgcctcttcttcttcaga

SEQ ID NO: 4355754 - DNA, 20 bp, Homo sapiens
tcccgtcacccctgtttctg

SEQ ID NO: 4355755 - DNA, 14 bp, Homo sapiens
tccctaccactgtg

SEQ ID NO: 4355756 - DNA, 19 bp, Homo sapiens
tccctaccactgtggcccc

SEQ ID NO: 4355757 - DNA, 17 bp, Homo sapiens
tccctcccctctcagaa

SEQ ID NO: 4355758 - DNA, 21 bp, Homo sapiens
tccctcccctctcagaacata

SEQ ID NO: 4355759 - DNA, 23 bp, Homo sapiens
tccctggaaaccttccacccagt

SEQ ID NO: 4355760 - DNA, 13 bp, Homo sapiens
tccctggagctgt

SEQ ID NO: 4355761 - DNA, 19 bp, Homo sapiens
tccctggagctgtccttca

SEQ ID NO: 4355762 - DNA, 15 bp, Homo sapiens
tccctggctctcaga

SEQ ID NO: 4355763 - DNA, 20 bp, Homo sapiens
tccctggctctcagaaggta

SEQ ID NO: 4355764 - DNA, 16 bp, Homo sapiens
tccctttcttggccag

SEQ ID NO: 4355765 - DNA, 13 bp, Homo sapiens
tccgatcaacatt

SEQ ID NO: 4355766 - DNA, 15 bp, Homo sapiens
tccgatcaacattta

SEQ ID NO: 4355767 - DNA, 18 bp, Homo sapiens
tccgatcaacatttatga

SEQ ID NO: 4355768 - DNA, 20 bp, Homo sapiens
tccgatcaacatttatgacc

SEQ ID NO: 4355769 - DNA, 22 bp, Homo sapiens
tccggcccagtgccactgcccc

SEQ ID NO: 4355770 - DNA, 16 bp, Homo sapiens
tccgggtctcgcagcc

SEQ ID NO: 4355771 - DNA, 17 bp, Homo sapiens
tcctaagagtggaggag

SEQ ID NO: 4355772 - DNA, 14 bp, Homo sapiens
tcctcactgggtgg

SEQ ID NO: 4355773 - DNA, 17 bp, Homo sapiens
tcctccacctcaactcc

SEQ ID NO: 4355774 - DNA, 16 bp, Homo sapiens
tcctcctgctcctcac

SEQ ID NO: 4355775 - DNA, 17 bp, Homo sapiens
tcctgcaggaaatataa

SEQ ID NO: 4355776 - DNA, 21 bp, Homo sapiens
tcctgtagctttaaaaccaca

SEQ ID NO: 4355777 - DNA, 15 bp, Homo sapiens
tcctgtgcatgggtg

SEQ ID NO: 4355778 - DNA, 18 bp, Homo sapiens
tcctgtgcatgggtgaag

SEQ ID NO: 4355779 - DNA, 21 bp, Homo sapiens
tccttgcctgaactccagagg

SEQ ID NO: 4355780 - DNA, 17 bp, Homo sapiens
tccttggccatgcagaa

SEQ ID NO: 4355781 - DNA, 19 bp, Homo sapiens
tcctttttctttataaact

SEQ ID NO: 4355782 - DNA, 17 bp, Homo sapiens
tcgcagcctgaagcctg

SEQ ID NO: 4355783 - DNA, 22 bp, Homo sapiens
tcgcattaagcacacacatctg

SEQ ID NO: 4355784 - DNA, 19 bp, Homo sapiens
tcggccaggcattggctca

SEQ ID NO: 4355785 - DNA, 24 bp, Homo sapiens
tcgtcactcaaatgaatttgctaa

SEQ ID NO: 4355786 - DNA, 13 bp, Homo sapiens
tctaaatatttcc

SEQ ID NO: 4355787 - DNA, 21 bp, Homo sapiens
tctaaatccgacttgaatatt

SEQ ID NO: 4355788 - DNA, 16 bp, Homo sapiens
tctacagacttctcca

SEQ ID NO: 4355789 - DNA, 22 bp, Homo sapiens
tctagcatatagactatataat

SEQ ID NO: 4355790 - DNA, 20 bp, Homo sapiens
tctaggactgcagtgtggag

SEQ ID NO: 4355791 - DNA, 14 bp, Homo sapiens
tctaggtaggaaga

SEQ ID NO: 4355792 - DNA, 20 bp, Homo sapiens
tctaggtaggaagagcccgc

SEQ ID NO: 4355793 - DNA, 16 bp, Homo sapiens
tctatacccacccaga

SEQ ID NO: 4355794 - DNA, 16 bp, Homo sapiens
tctatatttgtcttcc

SEQ ID NO: 4355795 - DNA, 21 bp, Homo sapiens
tctatcattccaattctaaat

SEQ ID NO: 4355796 - DNA, 17 bp, Homo sapiens
tctattgtcaagatgct

SEQ ID NO: 4355797 - DNA, 19 bp, Homo sapiens
tctcaatggtattgtaact

SEQ ID NO: 4355798 - DNA, 19 bp, Homo sapiens
tctcaattccctgaaaaac

SEQ ID NO: 4355799 - DNA, 11 bp, Homo sapiens
tctcagaacat

SEQ ID NO: 4355800 - DNA, 19 bp, Homo sapiens
tctcagaaggtattccttt

SEQ ID NO: 4355801 - DNA, 23 bp, Homo sapiens
tctccaccctccggccagcgagt

SEQ ID NO: 4355802 - DNA, 13 bp, Homo sapiens
tctccatcagctg

SEQ ID NO: 4355803 - DNA, 17 bp, Homo sapiens
tctccatcagctgtaag

SEQ ID NO: 4355804 - DNA, 14 bp, Homo sapiens
tctcccaacatggg

SEQ ID NO: 4355805 - DNA, 17 bp, Homo sapiens
tctcccaacatgggagg

SEQ ID NO: 4355806 - DNA, 18 bp, Homo sapiens
tctcccaacatgggaggg

SEQ ID NO: 4355807 - DNA, 23 bp, Homo sapiens
tctccctcccctctcagaacata

SEQ ID NO: 4355808 - DNA, 17 bp, Homo sapiens
tctcctgtgcatgggtg

SEQ ID NO: 4355809 - DNA, 13 bp, Homo sapiens
tctcgcagcctga

SEQ ID NO: 4355810 - DNA, 16 bp, Homo sapiens
tctcgcagcctgaagc

SEQ ID NO: 4355811 - DNA, 22 bp, Homo sapiens
tctcgcagcctgaagcctggat

SEQ ID NO: 4355812 - DNA, 20 bp, Homo sapiens
tctctacagacttctccaga

SEQ ID NO: 4355813 - DNA, 18 bp, Homo sapiens
tctctgacgcttgtgaca

SEQ ID NO: 4355814 - DNA, 20 bp, Homo sapiens
tctctgacgcttgtgacagt

SEQ ID NO: 4355815 - DNA, 13 bp, Homo sapiens
tctcttgagggag

SEQ ID NO: 4355816 - DNA, 21 bp, Homo sapiens
tctctttaccttctaaaagcc

SEQ ID NO: 4355817 - DNA, 14 bp, Homo sapiens
tctgaaacacacga

SEQ ID NO: 4355818 - DNA, 13 bp, Homo sapiens
tctgacgcttgtg

SEQ ID NO: 4355819 - DNA, 12 bp, Homo sapiens
tctgactgccaa

SEQ ID NO: 4355820 - DNA, 16 bp, Homo sapiens
tctgactgccaaataa

SEQ ID NO: 4355821 - DNA, 20 bp, Homo sapiens
tctgatattccatgaatgta

SEQ ID NO: 4355822 - DNA, 22 bp, Homo sapiens
tctgatattccatgaatgtatc

SEQ ID NO: 4355823 - DNA, 10 bp, Homo sapiens
tctgcacaga

SEQ ID NO: 4355824 - DNA, 16 bp, Homo sapiens
tctgcagcatgacctg

SEQ ID NO: 4355825 - DNA, 17 bp, Homo sapiens
ctccctcccctctcaga

SEQ ID NO: 4355826 - DNA, 16 bp, Homo sapiens
ctccctggctctcaga

SEQ ID NO: 4355827 - DNA, 20 bp, Homo sapiens
ctccctggctctcagaaggt

SEQ ID NO: 4355828 - DNA, 18 bp, Homo sapiens
ctccctggggaccaggag

SEQ ID NO: 4355829 - DNA, 22 bp, Homo sapiens
ctccctggggaccaggagctag

SEQ ID NO: 4355830 - DNA, 14 bp, Homo sapiens
ctcctccacctcaa

SEQ ID NO: 4355831 - DNA, 17 bp, Homo sapiens
ctcctgtgcatgggtga

SEQ ID NO: 4355832 - DNA, 13 bp, Homo sapiens
ctcggccaggcat

SEQ ID NO: 4355833 - DNA, 16 bp, Homo sapiens
ctcggccaggcattgg

SEQ ID NO: 4355834 - DNA, 18 bp, Homo sapiens
ctcggggacaccagagct

SEQ ID NO: 4355835 - DNA, 15 bp, Homo sapiens
ctctatgacatgaaa

SEQ ID NO: 4355836 - DNA, 21 bp, Homo sapiens
ctctatgacatgaaatgaaaa

SEQ ID NO: 4355837 - DNA, 16 bp, Homo sapiens
ctctcagcctcccaca

SEQ ID NO: 4355838 - DNA, 15 bp, Homo sapiens
ctctcataccctccc

SEQ ID NO: 4355839 - DNA, 21 bp, Homo sapiens
ctctctcataccctccctccc

SEQ ID NO: 4355840 - DNA, 23 bp, Homo sapiens
ctctctgacgcttgtgacagtgc

SEQ ID NO: 4355841 - DNA, 14 bp, Homo sapiens
ctctgacgcttgtg

SEQ ID NO: 4355842 - DNA, 20 bp, Homo sapiens
ctctgaggacagaggccggg

SEQ ID NO: 4355843 - DNA, 19 bp, Homo sapiens
ctctgatattccatgaatg

SEQ ID NO: 4355844 - DNA, 13 bp, Homo sapiens
ctctgattacatg

SEQ ID NO: 4355845 - DNA, 14 bp, Homo sapiens
ctctgcacagatgg

SEQ ID NO: 4355846 - DNA, 17 bp, Homo sapiens
ctctggatgaaggcaaa

SEQ ID NO: 4355847 - DNA, 19 bp, Homo sapiens
ctctggatgaaggcaaaaa

SEQ ID NO: 4355848 - DNA, 19 bp, Homo sapiens
ctctggccaggatggaggg

SEQ ID NO: 4355849 - DNA, 23 bp, Homo sapiens
ctctggtggcttaagtgagcaga

SEQ ID NO: 4355850 - DNA, 13 bp, Homo sapiens
ctctgtctaggac

SEQ ID NO: 4355851 - DNA, 21 bp, Homo sapiens
ctctgtctaggactgcagtgt

SEQ ID NO: 4355852 - DNA, 22 bp, Homo sapiens
ctctgtctaggactgcagtgtg

SEQ ID NO: 4355853 - DNA, 23 bp, Homo sapiens
ctctgtctaggactgcagtgtgg

SEQ ID NO: 4355854 - DNA, 16 bp, Homo sapiens
ctcttctgaataaagc

SEQ ID NO: 4355855 - DNA, 15 bp, Homo sapiens
ctcttcttcttcaga

SEQ ID NO: 4355856 - DNA, 18 bp, Homo sapiens
ctcttcttcttcagaaga

SEQ ID NO: 4355857 - DNA, 14 bp, Homo sapiens
ctcttgagggagct

SEQ ID NO: 4355858 - DNA, 15 bp, Homo sapiens
ctctttaaaaactca

SEQ ID NO: 4355859 - DNA, 18 bp, Homo sapiens
ctctttaaaaactcactt

SEQ ID NO: 4355860 - DNA, 13 bp, Homo sapiens
ctctttttttgag

SEQ ID NO: 4355861 - DNA, 22 bp, Homo sapiens
ctctttttttgagtgacagctt

SEQ ID NO: 4355862 - DNA, 13 bp, Homo sapiens
ctgaagcctgcag

SEQ ID NO: 4355863 - DNA, 15 bp, Homo sapiens
ctgaagcctgcagga

SEQ ID NO: 4355864 - DNA, 19 bp, Homo sapiens
ctgaatatcagtcactgtt

SEQ ID NO: 4355865 - DNA, 17 bp, Homo sapiens
ctgaatggaaataaata

SEQ ID NO: 4355866 - DNA, 13 bp, Homo sapiens
ctgaatttccctc

SEQ ID NO: 4355867 - DNA, 19 bp, Homo sapiens
ctgacaaaggagccttgat

SEQ ID NO: 4355868 - DNA, 18 bp, Homo sapiens
ctgacgcttgtgacagtg

SEQ ID NO: 4355869 - DNA, 21 bp, Homo sapiens
ctgacgcttgtgacagtgcct

SEQ ID NO: 4355870 - DNA, 22 bp, Homo sapiens
ctgacgcttgtgacagtgcctc

SEQ ID NO: 4355871 - DNA, 15 bp, Homo sapiens
gcttgatgttatatt

SEQ ID NO: 4355872 - DNA, 12 bp, Homo sapiens
gcttgctccaga

SEQ ID NO: 4355873 - DNA, 12 bp, Homo sapiens
gcttgtgacagt

SEQ ID NO: 4355874 - DNA, 18 bp, Homo sapiens
gctttccctgaggaatga

SEQ ID NO: 4355875 - DNA, 14 bp, Homo sapiens
gctttctgggatgt

SEQ ID NO: 4355876 - DNA, 13 bp, Homo sapiens
gctttgtcacttg

SEQ ID NO: 4355877 - DNA, 19 bp, Homo sapiens
ggaaaatctatatttgtct

SEQ ID NO: 4355878 - DNA, 23 bp, Homo sapiens
ggaaaatctatatttgtcttccg

SEQ ID NO: 4355879 - DNA, 23 bp, Homo sapiens
ggaaacaaagtttacattgtcct

SEQ ID NO: 4355880 - DNA, 16 bp, Homo sapiens
ggaaaccttggagagg

SEQ ID NO: 4355881 - DNA, 20 bp, Homo sapiens
ggaaatataaacttaaaata

SEQ ID NO: 4355882 - DNA, 17 bp, Homo sapiens
ggaagaaattcaggtac

SEQ ID NO: 4355883 - DNA, 18 bp, Homo sapiens
ggaagaaattcaggtaca

SEQ ID NO: 4355884 - DNA, 22 bp, Homo sapiens
ggaagaagaaatctttctccct

SEQ ID NO: 4355885 - DNA, 23 bp, Homo sapiens
ggaagccaaagttttcaaactgc

SEQ ID NO: 4355886 - DNA, 19 bp, Homo sapiens
ggaaggatctgctgaggcc

SEQ ID NO: 4355887 - DNA, 22 bp, Homo sapiens
ggaaggatctgctgaggcccag

SEQ ID NO: 4355888 - DNA, 16 bp, Homo sapiens
ggaagtgtaacagctg

SEQ ID NO: 4355889 - DNA, 13 bp, Homo sapiens
ggaagttgtggat

SEQ ID NO: 4355890 - DNA, 16 bp, Homo sapiens
ggaatgcacctcccca

SEQ ID NO: 4355891 - DNA, 20 bp, Homo sapiens
ggaatggggggcgggccagg

SEQ ID NO: 4355892 - DNA, 21 bp, Homo sapiens
ggaatggggggcgggccaggg

SEQ ID NO: 4355893 - DNA, 20 bp, Homo sapiens
ggacacagcacaagggcaca

SEQ ID NO: 4355894 - DNA, 21 bp, Homo sapiens
ggacacagcacaagggcacat

SEQ ID NO: 4355895 - DNA, 13 bp, Homo sapiens
ggacaccagagct

SEQ ID NO: 4355896 - DNA, 12 bp, Homo sapiens
ggaccaggagct

SEQ ID NO: 4355897 - DNA, 17 bp, Homo sapiens
taccaaacaaggaagcc

SEQ ID NO: 4355898 - DNA, 20 bp, Homo sapiens
taccaaacaaggaagccaaa

SEQ ID NO: 4355899 - DNA, 23 bp, Homo sapiens
taccaaacaaggaagccaaagtt

SEQ ID NO: 4355900 - DNA, 23 bp, Homo sapiens
taccccagcctcgttggagagca

SEQ ID NO: 4355901 - DNA, 22 bp, Homo sapiens
tacctggtttacttctttagca

SEQ ID NO: 4355902 - DNA, 16 bp, Homo sapiens
taccttctaaaagcca

SEQ ID NO: 4355903 - DNA, 24 bp, Homo sapiens
taccttctaaaagccattattatg

SEQ ID NO: 4355904 - DNA, 12 bp, Homo sapiens
tactaagtgaca

SEQ ID NO: 4355905 - DNA, 12 bp, Homo sapiens
tactatattaaa

SEQ ID NO: 4355906 - DNA, 13 bp, Homo sapiens
tactatattaaat

SEQ ID NO: 4355907 - DNA, 14 bp, Homo sapiens
tactatattaaatt

SEQ ID NO: 4355908 - DNA, 18 bp, Homo sapiens
tactatattaaattctga

SEQ ID NO: 4355909 - DNA, 16 bp, Homo sapiens
tactcctcctgctcct

SEQ ID NO: 4355910 - DNA, 16 bp, Homo sapiens
tactgattgggaggtg

SEQ ID NO: 4355911 - DNA, 17 bp, Homo sapiens
tactgattgggaggtgc

SEQ ID NO: 4355912 - DNA, 18 bp, Homo sapiens
tactgtaactgtcagtgt

SEQ ID NO: 4355913 - DNA, 14 bp, Homo sapiens
tactgtacttaata

SEQ ID NO: 4355914 - DNA, 13 bp, Homo sapiens
tactgtctgacta

SEQ ID NO: 4355915 - DNA, 14 bp, Homo sapiens
tactgttttgggcc

SEQ ID NO: 4355916 - DNA, 14 bp, Homo sapiens
tacttaataaattc

SEQ ID NO: 4355917 - DNA, 17 bp, Homo sapiens
tacttgacctctgtgac

SEQ ID NO: 4355918 - DNA, 13 bp, Homo sapiens
tactttaggaaat

SEQ ID NO: 4355919 - DNA, 17 bp, Homo sapiens
tactttgacaaggaaaa

SEQ ID NO: 4355920 - DNA, 21 bp, Homo sapiens
tagaaagcaaacaaaattgtt

SEQ ID NO: 4355921 - DNA, 15 bp, Homo sapiens
tagaagaagaggaag

SEQ ID NO: 4355922 - DNA, 14 bp, Homo sapiens
tagatgtaaataaa

SEQ ID NO: 4355923 - DNA, 14 bp, Homo sapiens
tagcatagccagca

SEQ ID NO: 4355924 - DNA, 14 bp, Homo sapiens
tagcatttttatgc

SEQ ID NO: 4355925 - DNA, 21 bp, Homo sapiens
tagcatttttatgcagacagt

SEQ ID NO: 4355926 - DNA, 20 bp, Homo sapiens
tagcttgttagtaatgctct

SEQ ID NO: 4355927 - DNA, 14 bp, Homo sapiens
tagctttaccctca

SEQ ID NO: 4355928 - DNA, 13 bp, Homo sapiens
tagctttataaag

SEQ ID NO: 4355929 - DNA, 21 bp, Homo sapiens
taggaagagcccgcagggcca

SEQ ID NO: 4355930 - DNA, 18 bp, Homo sapiens
taggaagtgtaacagctg

SEQ ID NO: 4355931 - DNA, 21 bp, Homo sapiens
taggaagtgtaacagctgagg

SEQ ID NO: 4355932 - DNA, 16 bp, Homo sapiens
taggcatgtcccaccc

SEQ ID NO: 4355933 - DNA, 20 bp, Homo sapiens
taggcctgggtgctggctgc

SEQ ID NO: 4355934 - DNA, 15 bp, Homo sapiens
taggtcactcctggg

SEQ ID NO: 4355935 - DNA, 18 bp, Homo sapiens
tagtaatgctctgaccaa

SEQ ID NO: 4355936 - DNA, 15 bp, Homo sapiens
tagtattacaccacc

SEQ ID NO: 4355937 - DNA, 18 bp, Homo sapiens
tagttcatccaatcctca

SEQ ID NO: 4355938 - DNA, 20 bp, Homo sapiens
tagttcatccaatcctcact

SEQ ID NO: 4355939 - DNA, 16 bp, Homo sapiens
tagttccttgccttaa

SEQ ID NO: 4355940 - DNA, 15 bp, Homo sapiens
tagttctgctgccct

SEQ ID NO: 4355941 - DNA, 22 bp, Homo sapiens
tataaagtaacccataatctgc

SEQ ID NO: 4355942 - DNA, 15 bp, Homo sapiens
tataaatttaagcaa

SEQ ID NO: 4355943 - DNA, 17 bp, Homo sapiens
tataattctgaaatgtt

SEQ ID NO: 4355944 - DNA, 13 bp, Homo sapiens
tatacctggttta

SEQ ID NO: 4355945 - DNA, 16 bp, Homo sapiens
tatacctggtttactt

SEQ ID NO: 4355946 - DNA, 17 bp, Homo sapiens
tataggtcactcctggg

SEQ ID NO: 4355947 - DNA, 14 bp, Homo sapiens
tatatatgtgtgtg

SEQ ID NO: 4355948 - DNA, 14 bp, Homo sapiens
tatattatcagaca

SEQ ID NO: 4355949 - DNA, 22 bp, Homo sapiens
tatatttgtaaactacaaagta

SEQ ID NO: 4355950 - DNA, 23 bp, Homo sapiens
tatcattccaattctaaatccga

SEQ ID NO: 4355951 - DNA, 16 bp, Homo sapiens
tatctgctataaactt

SEQ ID NO: 4355952 - DNA, 20 bp, Homo sapiens
tatgcaatgtatagtgtcta

SEQ ID NO: 4355953 - DNA, 21 bp, Homo sapiens
tatgcactgtggtttcagatg

SEQ ID NO: 4355954 - DNA, 14 bp, Homo sapiens
tatgcattatatca

SEQ ID NO: 4355955 - DNA, 21 bp, Homo sapiens
tatgctttccctgaggaatga

SEQ ID NO: 4355956 - DNA, 18 bp, Homo sapiens
tatggtaggggagggcag

SEQ ID NO: 4355957 - DNA, 18 bp, Homo sapiens
tatggttctacttcctgt

SEQ ID NO: 4355958 - DNA, 17 bp, Homo sapiens
tatgtaatataaattta

SEQ ID NO: 4355959 - DNA, 19 bp, Homo sapiens
tatgtttgcacacttgtgt

SEQ ID NO: 4355960 - DNA, 18 bp, Homo sapiens
tattaaagattggaatgt

SEQ ID NO: 4355961 - DNA, 17 bp, Homo sapiens
tattactgttttgggcc

SEQ ID NO: 4355962 - DNA, 18 bp, Homo sapiens
tattactgttttgggcct

SEQ ID NO: 4355963 - DNA, 16 bp, Homo sapiens
tattagggactgtggt

SEQ ID NO: 4355964 - DNA, 13 bp, Homo sapiens
tattattctgcag

SEQ ID NO: 4355965 - DNA, 17 bp, Homo sapiens
tattccatgaatgtatc

SEQ ID NO: 4355966 - DNA, 20 bp, Homo sapiens
tattccttttgtgtacagtg

SEQ ID NO: 4355967 - DNA, 21 bp, Homo sapiens
tattccttttgtgtacagtgt

SEQ ID NO: 4355968 - DNA, 23 bp, Homo sapiens
tattgatgcaatataagcataaa

SEQ ID NO: 4355969 - DNA, 22 bp, Homo sapiens
tatttattgcattgctggtaga

SEQ ID NO: 4355970 - DNA, 19 bp, Homo sapiens
tatttccttaaactgtgtg

SEQ ID NO: 4355971 - DNA, 12 bp, Homo sapiens
tatttgtcttcc

SEQ ID NO: 4355972 - DNA, 13 bp, Homo sapiens
tatttgtcttccg

SEQ ID NO: 4355973 - DNA, 21 bp, Homo sapiens
tatttgtgcacatgtacatat

SEQ ID NO: 4355974 - DNA, 13 bp, Homo sapiens
tattttgcatact

SEQ ID NO: 4355975 - DNA, 22 bp, Homo sapiens
tattttgcctctgggtaggaaa

SEQ ID NO: 4355976 - DNA, 17 bp, Homo sapiens
tcaaagcggagaaacat

SEQ ID NO: 4355977 - DNA, 14 bp, Homo sapiens
tcaacatttatgac

SEQ ID NO: 4355978 - DNA, 22 bp, Homo sapiens
tcaacccattgttgtcaaggaa

SEQ ID NO: 4355979 - DNA, 22 bp, Homo sapiens
tcaaggtgagaattaagtttta

SEQ ID NO: 4355980 - DNA, 14 bp, Homo sapiens
tcaataaaatgtga

SEQ ID NO: 4355981 - DNA, 15 bp, Homo sapiens
tcaataaaatgtgat

SEQ ID NO: 4355982 - DNA, 16 bp, Homo sapiens
tcaataaaatgtgatt

SEQ ID NO: 4355983 - DNA, 11 bp, Homo sapiens
tcacactgtct

SEQ ID NO: 4355984 - DNA, 14 bp, Homo sapiens
tcacactgtcttcc

SEQ ID NO: 4355985 - DNA, 17 bp, Homo sapiens
tcacatagatgtccctt

SEQ ID NO: 4355986 - DNA, 13 bp, Homo sapiens
tcaccttggaagg

SEQ ID NO: 4355987 - DNA, 17 bp, Homo sapiens
tcactcagtaaaacata

SEQ ID NO: 4355988 - DNA, 19 bp, Homo sapiens
tcactccaccatccccacc

SEQ ID NO: 4355989 - DNA, 13 bp, Homo sapiens
tcactcctggggc

SEQ ID NO: 4355990 - DNA, 14 bp, Homo sapiens
tcacttgccacatg

SEQ ID NO: 4355991 - DNA, 20 bp, Homo sapiens
tcagaacatactgattggga

SEQ ID NO: 4355992 - DNA, 18 bp, Homo sapiens
tcagatatatttttcaca

SEQ ID NO: 4355993 - DNA, 18 bp, Homo sapiens
tcagattgacagcatata

SEQ ID NO: 4355994 - DNA, 21 bp, Homo sapiens
tcagcagaacctgcacacagg

SEQ ID NO: 4355995 - DNA, 17 bp, Homo sapiens
tcagcatcaagtatgtg

SEQ ID NO: 4355996 - DNA, 19 bp, Homo sapiens
tcagccccgcctgtcacaa

SEQ ID NO: 4355997 - DNA, 21 bp, Homo sapiens
tcagccccgcctgtcacaata

SEQ ID NO: 4355998 - DNA, 23 bp, Homo sapiens
tcagccccgcctgtcacaataaa

SEQ ID NO: 4355999 - DNA, 23 bp, Homo sapiens
tcagctgtaagaagagactggga

SEQ ID NO: 4356000 - DNA, 13 bp, Homo sapiens
tcaggaaaaatga

SEQ ID NO: 4356001 - DNA, 18 bp, Homo sapiens
tcaggatactctgtcaga

SEQ ID NO: 4356002 - DNA, 20 bp, Homo sapiens
tcaggatactctgtcagatg

SEQ ID NO: 4356003 - DNA, 20 bp, Homo sapiens
tcaggcagcaccacactggg

SEQ ID NO: 4356004 - DNA, 22 bp, Homo sapiens
tcaggcagcaccacactgggtg

SEQ ID NO: 4356005 - DNA, 16 bp, Homo sapiens
tcaggcataggcctgg

SEQ ID NO: 4356006 - DNA, 17 bp, Homo sapiens
tcaggcataggcctggg

SEQ ID NO: 4356007 - DNA, 22 bp, Homo sapiens
gaagagcccgcagggccatgca

SEQ ID NO: 4356008 - DNA, 21 bp, Homo sapiens
gaagaggaagaaattcaggta

SEQ ID NO: 4356009 - DNA, 15 bp, Homo sapiens
gaagataggctctgc

SEQ ID NO: 4356010 - DNA, 17 bp, Homo sapiens
gaagataggctctgcac

SEQ ID NO: 4356011 - DNA, 18 bp, Homo sapiens
gaagataggctctgcaca

SEQ ID NO: 4356012 - DNA, 20 bp, Homo sapiens
gaagataggctctgcacaga

SEQ ID NO: 4356013 - DNA, 14 bp, Homo sapiens
gaagccccttggag

SEQ ID NO: 4356014 - DNA, 15 bp, Homo sapiens
gaagccccttggaga

SEQ ID NO: 4356015 - DNA, 15 bp, Homo sapiens
gaagcctgcaggagt

SEQ ID NO: 4356016 - DNA, 14 bp, Homo sapiens
gaagcctggattcc

SEQ ID NO: 4356017 - DNA, 23 bp, Homo sapiens
gaagggaatttggctcaacttca

SEQ ID NO: 4356018 - DNA, 13 bp, Homo sapiens
gaagggttctgcc

SEQ ID NO: 4356019 - DNA, 16 bp, Homo sapiens
gaagggttctgccctg

SEQ ID NO: 4356020 - DNA, 18 bp, Homo sapiens
gaagggttctgccctgcc

SEQ ID NO: 4356021 - DNA, 22 bp, Homo sapiens
gaagggttctgccctgcctgag

SEQ ID NO: 4356022 - DNA, 23 bp, Homo sapiens
gaagggttctgccctgcctgagg

SEQ ID NO: 4356023 - DNA, 11 bp, Homo sapiens
gaataaagcaa

SEQ ID NO: 4356024 - DNA, 12 bp, Homo sapiens
gaataacactgc

SEQ ID NO: 4356025 - DNA, 21 bp, Homo sapiens
gaataatttcccaattaggaa

SEQ ID NO: 4356026 - DNA, 19 bp, Homo sapiens
gaataccaggatagcttta

SEQ ID NO: 4356027 - DNA, 22 bp, Homo sapiens
gaatattcctggacttacaaaa

SEQ ID NO: 4356028 - DNA, 24 bp, Homo sapiens
gaatattcctggacttacaaaatg

SEQ ID NO: 4356029 - DNA, 22 bp, Homo sapiens
gaatgaaaggaagtataaagta

SEQ ID NO: 4356030 - DNA, 13 bp, Homo sapiens
gaatgagacatcc

SEQ ID NO: 4356031 - DNA, 15 bp, Homo sapiens
gaatgagacatccag

SEQ ID NO: 4356032 - DNA, 14 bp, Homo sapiens
gaatgcacctcccc

SEQ ID NO: 4356033 - DNA, 20 bp, Homo sapiens
gaatggggggcgggccaggg

SEQ ID NO: 4356034 - DNA, 17 bp, Homo sapiens
gaatgtattattctgca

SEQ ID NO: 4356035 - DNA, 17 bp, Homo sapiens
gaattcctgcagcagtt

SEQ ID NO: 4356036 - DNA, 21 bp, Homo sapiens
gaatttgctaaatacaacact

SEQ ID NO: 4356037 - DNA, 22 bp, Homo sapiens
gacaaaaatcaaagaacagatg

SEQ ID NO: 4356038 - DNA, 18 bp, Homo sapiens
gacaaaggagccttgata

SEQ ID NO: 4356039 - DNA, 12 bp, Homo sapiens
gacaaggaaaat

SEQ ID NO: 4356040 - DNA, 16 bp, Homo sapiens
gacacagcacaagggc

SEQ ID NO: 4356041 - DNA, 19 bp, Homo sapiens
gacagaggccggggtccag

SEQ ID NO: 4356042 - DNA, 15 bp, Homo sapiens
gacagcgggaaaaat

SEQ ID NO: 4356043 - DNA, 15 bp, Homo sapiens
gacagctttctggga

SEQ ID NO: 4356044 - DNA, 17 bp, Homo sapiens
gacagctttctgggatg

SEQ ID NO: 4356045 - DNA, 20 bp, Homo sapiens
gacagctttctgggatgtca

SEQ ID NO: 4356046 - DNA, 23 bp, Homo sapiens
gacagctttctgggatgtcacag

SEQ ID NO: 4356047 - DNA, 15 bp, Homo sapiens
gacagtctgttatgc

SEQ ID NO: 4356048 - DNA, 16 bp, Homo sapiens
gacagtctgttatgca

SEQ ID NO: 4356049 - DNA, 22 bp, Homo sapiens
gacagtgcctcttccagtgaac

SEQ ID NO: 4356050 - DNA, 13 bp, Homo sapiens
gacagtgcctggg

SEQ ID NO: 4356051 - DNA, 22 bp, Homo sapiens
gacatccagcagatttccagcc

SEQ ID NO: 4356052 - DNA, 16 bp, Homo sapiens
gacatgaagctgttgt

SEQ ID NO: 4356053 - DNA, 16 bp, Homo sapiens
gacatgaatgcacact

SEQ ID NO: 4356054 - DNA, 16 bp, Homo sapiens
gacatggttgggggaa

SEQ ID NO: 4356055 - DNA, 18 bp, Homo sapiens
gacattaataaagttgct

SEQ ID NO: 4356056 - DNA, 23 bp, Homo sapiens
gacattcctaagagtggaggagg

SEQ ID NO: 4356057 - DNA, 15 bp, Homo sapiens
gaccaggagctagcc

SEQ ID NO: 4356058 - DNA, 22 bp, Homo sapiens
gaccaggagctagcccagtccc

SEQ ID NO: 4356059 - DNA, 12 bp, Homo sapiens
gacccagcctga

SEQ ID NO: 4356060 - DNA, 14 bp, Homo sapiens
gacccccaggcctg

SEQ ID NO: 4356061 - DNA, 24 bp, Homo sapiens
gacccccaggcctgtccaccctgc

SEQ ID NO: 4356062 - DNA, 18 bp, Homo sapiens
gacccctctggccaggat

SEQ ID NO: 4356063 - DNA, 15 bp, Homo sapiens
gaccctacaggagag

SEQ ID NO: 4356064 - DNA, 17 bp, Homo sapiens
gaccctgtccggcccag

SEQ ID NO: 4356065 - DNA, 21 bp, Homo sapiens
gaccctgtccggcccagtgcc

SEQ ID NO: 4356066 - DNA, 21 bp, Homo sapiens
gacctaagtcaggtaatatac

SEQ ID NO: 4356067 - DNA, 16 bp, Homo sapiens
gacgcttgtgacagtg

SEQ ID NO: 4356068 - DNA, 21 bp, Homo sapiens
gacgcttgtgacagtgcctct

SEQ ID NO: 4356069 - DNA, 22 bp, Homo sapiens
gactcaacatgttactgaccag

SEQ ID NO: 4356070 - DNA, 18 bp, Homo sapiens
gactccaaggagctactg

SEQ ID NO: 4356071 - DNA, 16 bp, Homo sapiens
gactctttttttgagt

SEQ ID NO: 4356072 - DNA, 20 bp, Homo sapiens
gactctttttttgagtgaca

SEQ ID NO: 4356073 - DNA, 16 bp, Homo sapiens
gactgaagcctgcagg

SEQ ID NO: 4356074 - DNA, 12 bp, Homo sapiens
gactgcagtgtg

SEQ ID NO: 4356075 - DNA, 16 bp, Homo sapiens
gactgcttttaaatga

SEQ ID NO: 4356076 - DNA, 21 bp, Homo sapiens
gactggaaggtccttgcctga

SEQ ID NO: 4356077 - DNA, 22 bp, Homo sapiens
gactggaagttgtggatatcag

SEQ ID NO: 4356078 - DNA, 18 bp, Homo sapiens
gactggatcttctatcat

SEQ ID NO: 4356079 - DNA, 14 bp, Homo sapiens
gacttcagggcagg

SEQ ID NO: 4356080 - DNA, 20 bp, Homo sapiens
gacttgaatattcctggact

SEQ ID NO: 4356081 - DNA, 21 bp, Homo sapiens
gacttgaatattcctggactt

SEQ ID NO: 4356082 - DNA, 22 bp, Homo sapiens
gagaaaattggaactctactca

SEQ ID NO: 4356083 - DNA, 20 bp, Homo sapiens
gagaagaaatagcagagcct

SEQ ID NO: 4356084 - DNA, 18 bp, Homo sapiens
gagaagggttctgccctg

SEQ ID NO: 4356085 - DNA, 22 bp, Homo sapiens
gagaagggttctgccctgcctg

SEQ ID NO: 4356086 - DNA, 22 bp, Homo sapiens
gagaattaagttttaaataaac

SEQ ID NO: 4356087 - DNA, 21 bp, Homo sapiens
gagaattgtatcatttgaaca

SEQ ID NO: 4356088 - DNA, 12 bp, Homo sapiens
gagacatgaatg

SEQ ID NO: 4356089 - DNA, 14 bp, Homo sapiens
gagacccccaggcc

SEQ ID NO: 4356090 - DNA, 15 bp, Homo sapiens
gagactcctggtctg

SEQ ID NO: 4356091 - DNA, 14 bp, Homo sapiens
gagagaggctgcct

SEQ ID NO: 4356092 - DNA, 17 bp, Homo sapiens
gagagcagcaggtgctg

SEQ ID NO: 4356093 - DNA, 15 bp, Homo sapiens
gagaggctgcctcag

SEQ ID NO: 4356094 - DNA, 21 bp, Homo sapiens
gagaggctgcctcagccagtg

SEQ ID NO: 4356095 - DNA, 22 bp, Homo sapiens
gagagtggcaggtgggctgcct

SEQ ID NO: 4356096 - DNA, 12 bp, Homo sapiens
gagatgggaagg

SEQ ID NO: 4356097 - DNA, 19 bp, Homo sapiens
gagcaaacccagaggtgga

SEQ ID NO: 4356098 - DNA, 15 bp, Homo sapiens
gagcagaacaggtag

SEQ ID NO: 4356099 - DNA, 16 bp, Homo sapiens
gagcagaacaggtagt

SEQ ID NO: 4356100 - DNA, 12 bp, Homo sapiens
gagcagagacac

SEQ ID NO: 4356101 - DNA, 13 bp, Homo sapiens
gagcagagacact

SEQ ID NO: 4356102 - DNA, 13 bp, Homo sapiens
gagcagcaggtgc

SEQ ID NO: 4356103 - DNA, 18 bp, Homo sapiens
gagcagcggtttggggag

SEQ ID NO: 4356104 - DNA, 20 bp, Homo sapiens
gagcccagccagaaagcact

SEQ ID NO: 4356105 - DNA, 21 bp, Homo sapiens
gagcccgcagggccatgcaga

SEQ ID NO: 4356106 - DNA, 22 bp, Homo sapiens
gagcccgcagggccatgcagac

SEQ ID NO: 4356107 - DNA, 21 bp, Homo sapiens
gagcccttctatacccaccca

SEQ ID NO: 4356108 - DNA, 21 bp, Homo sapiens
gagccttgataatacttgacc

SEQ ID NO: 4356109 - DNA, 14 bp, Homo sapiens
gagccttgcatgta

SEQ ID NO: 4356110 - DNA, 20 bp, Homo sapiens
gagccttgcatgtacttgaa

SEQ ID NO: 4356111 - DNA, 18 bp, Homo sapiens
gagccttgctgggccagg

SEQ ID NO: 4356112 - DNA, 19 bp, Homo sapiens
gagccttgctgggccaggg

SEQ ID NO: 4356113 - DNA, 12 bp, Homo sapiens
gagcgccacctc

SEQ ID NO: 4356114 - DNA, 19 bp, Homo sapiens
gagctgccgacttggagac

SEQ ID NO: 4356115 - DNA, 12 bp, Homo sapiens
gagctgggcccc

SEQ ID NO: 4356116 - DNA, 13 bp, Homo sapiens
gagcttgctccag

SEQ ID NO: 4356117 - DNA, 17 bp, Homo sapiens
gagctttgtcacttgcc

SEQ ID NO: 4356118 - DNA, 19 bp, Homo sapiens
gaggaatccaaaagacaaa

SEQ ID NO: 4356119 - DNA, 14 bp, Homo sapiens
gaggacacagcaca

SEQ ID NO: 4356120 - DNA, 15 bp, Homo sapiens
gaggacacagcacaa

SEQ ID NO: 4356121 - DNA, 23 bp, Homo sapiens
gaggacacagcacaagggcacat

SEQ ID NO: 4356122 - DNA, 13 bp, Homo sapiens
gaggaccactcct

SEQ ID NO: 4356123 - DNA, 22 bp, Homo sapiens
gaggaccactcctgtacactga

SEQ ID NO: 4356124 - DNA, 19 bp, Homo sapiens
gaggagccttgctgggcca

SEQ ID NO: 4356125 - DNA, 21 bp, Homo sapiens
gaggagccttgctgggccagg

SEQ ID NO: 4356126 - DNA, 12 bp, Homo sapiens
gaggcccttgtc

SEQ ID NO: 4356127 - DNA, 18 bp, Homo sapiens
gaggcccttgtcgtggga

SEQ ID NO: 4356128 - DNA, 15 bp, Homo sapiens
gaggctgcctcagcc

SEQ ID NO: 4356129 - DNA, 16 bp, Homo sapiens
gaggctgcctcagcca

SEQ ID NO: 4356130 - DNA, 13 bp, Homo sapiens
gagggaaggagcc

SEQ ID NO: 4356131 - DNA, 13 bp, Homo sapiens
gagggatcagccc

SEQ ID NO: 4356132 - DNA, 14 bp, Homo sapiens
gagggatcagcccc

SEQ ID NO: 4356133 - DNA, 13 bp, Homo sapiens
gagggcaggcttg

SEQ ID NO: 4356134 - DNA, 14 bp, Homo sapiens
gagggcaggcttgg

SEQ ID NO: 4356135 - DNA, 18 bp, Homo sapiens
gaggtctcttgagggagc

SEQ ID NO: 4356136 - DNA, 24 bp, Homo sapiens
gaggtgcgtgttcagcagaacctg

SEQ ID NO: 4356137 - DNA, 12 bp, Homo sapiens
gaggtggagaaa

SEQ ID NO: 4356138 - DNA, 15 bp, Homo sapiens
gaggtggagaaaatt

SEQ ID NO: 4356139 - DNA, 22 bp, Homo sapiens
gaggtggatgttatgaacagct

SEQ ID NO: 4356140 - DNA, 22 bp, Homo sapiens
gaggttataggtcactcctggg

SEQ ID NO: 4356141 - DNA, 12 bp, Homo sapiens
gagtaagagctg

SEQ ID NO: 4356142 - DNA, 17 bp, Homo sapiens
gagtcttggttctaaag

SEQ ID NO: 4356143 - DNA, 19 bp, Homo sapiens
gagtgacagctttctggga

SEQ ID NO: 4356144 - DNA, 21 bp, Homo sapiens
gagtgacagctttctgggatg

SEQ ID NO: 4356145 - DNA, 17 bp, Homo sapiens
gagtggcaggtgggctg

SEQ ID NO: 4356146 - DNA, 17 bp, Homo sapiens
gagtgtaagtgtgagta

SEQ ID NO: 4356147 - DNA, 17 bp, Homo sapiens
gagttcaccttggaagg

SEQ ID NO: 4356148 - DNA, 19 bp, Homo sapiens
gagttcaccttggaagggc

SEQ ID NO: 4356149 - DNA, 20 bp, Homo sapiens
gagttcaccttggaagggcg

SEQ ID NO: 4356150 - DNA, 20 bp, Homo sapiens
gagtttgaaaaactaattga

SEQ ID NO: 4356151 - DNA, 13 bp, Homo sapiens
gataatcaggaaa

SEQ ID NO: 4356152 - DNA, 12 bp, Homo sapiens
gataggctctgc

SEQ ID NO: 4356153 - DNA, 14 bp, Homo sapiens
gataggctctgcac

SEQ ID NO: 4356154 - DNA, 20 bp, Homo sapiens
gataggctctgcacagatgg

SEQ ID NO: 4356155 - DNA, 18 bp, Homo sapiens
gatatcagggtataaatt

SEQ ID NO: 4356156 - DNA, 22 bp, Homo sapiens
gatattaaagattggaatgtgt

SEQ ID NO: 4356157 - DNA, 14 bp, Homo sapiens
gatcaataaaatgt

SEQ ID NO: 4356158 - DNA, 15 bp, Homo sapiens
gatcagagcatttat

SEQ ID NO: 4356159 - DNA, 19 bp, Homo sapiens
gatcagccccgcctgtcac

SEQ ID NO: 4356160 - DNA, 13 bp, Homo sapiens
gatccagggatgg

SEQ ID NO: 4356161 - DNA, 18 bp, Homo sapiens
gatccagggatggagatg

SEQ ID NO: 4356162 - DNA, 17 bp, Homo sapiens
gatctgctgaggcccag

SEQ ID NO: 4356163 - DNA, 18 bp, Homo sapiens
gatcttctatcattccaa

SEQ ID NO: 4356164 - DNA, 19 bp, Homo sapiens
gatcttctatcattccaat

SEQ ID NO: 4356165 - DNA, 12 bp, Homo sapiens
gatctttcagga

SEQ ID NO: 4356166 - DNA, 12 bp, Homo sapiens
gatgcaatataa

SEQ ID NO: 4356167 - DNA, 20 bp, Homo sapiens
gatgccataatcagaacaca

SEQ ID NO: 4356168 - DNA, 23 bp, Homo sapiens
gatgcccctgcagtttggccctg

SEQ ID NO: 4356169 - DNA, 15 bp, Homo sapiens
gatggaaacttcctg

SEQ ID NO: 4356170 - DNA, 23 bp, Homo sapiens
gatgtaaaaaatattaaagatat

SEQ ID NO: 4356171 - DNA, 15 bp, Homo sapiens
gatgtcccctgcggg

SEQ ID NO: 4356172 - DNA, 16 bp, Homo sapiens
gatgtcccctgcgggc

SEQ ID NO: 4356173 - DNA, 15 bp, Homo sapiens
gatgttattactgtt

SEQ ID NO: 4356174 - DNA, 23 bp, Homo sapiens
gatgttattactgttttgggcct

SEQ ID NO: 4356175 - DNA, 18 bp, Homo sapiens
gattccagcagtgaatgc

SEQ ID NO: 4356176 - DNA, 15 bp, Homo sapiens
gattctgatgcatac

SEQ ID NO: 4356177 - DNA, 13 bp, Homo sapiens
gattgagaactga

SEQ ID NO: 4356178 - DNA, 14 bp, Homo sapiens
gattgagaactgac

SEQ ID NO: 4356179 - DNA, 15 bp, Homo sapiens
gattgagaactgaca

SEQ ID NO: 4356180 - DNA, 19 bp, Homo sapiens
gattgaggagttgcctgac

SEQ ID NO: 4356181 - DNA, 22 bp, Homo sapiens
gattgcattagaaatagacagt

SEQ ID NO: 4356182 - DNA, 21 bp, Homo sapiens
gattgttaagtctaaatattt

SEQ ID NO: 4356183 - DNA, 15 bp, Homo sapiens
gatttccagccttct

SEQ ID NO: 4356184 - DNA, 15 bp, Homo sapiens
gatttgcctgtgcca

SEQ ID NO: 4356185 - DNA, 18 bp, Homo sapiens
gcaaaaactgtactgtgt

SEQ ID NO: 4356186 - DNA, 16 bp, Homo sapiens
gcaaacgtctattttg

SEQ ID NO: 4356187 - DNA, 21 bp, Homo sapiens
gcaaacgtctattttgtatat

SEQ ID NO: 4356188 - DNA, 22 bp, Homo sapiens
gcaacgggattgaagggtcctg

SEQ ID NO: 4356189 - DNA, 19 bp, Homo sapiens
gcaacttgtctttttctgg

SEQ ID NO: 4356190 - DNA, 23 bp, Homo sapiens
gcaacttgtctttttctggactg

SEQ ID NO: 4356191 - DNA, 17 bp, Homo sapiens
gcaagaaatggcgtctg

SEQ ID NO: 4356192 - DNA, 21 bp, Homo sapiens
gcaagaaatggcgtctgctct

SEQ ID NO: 4356193 - DNA, 17 bp, Homo sapiens
gcaataatttgtacaat

SEQ ID NO: 4356194 - DNA, 13 bp, Homo sapiens
gcaatccatgtta

SEQ ID NO: 4356195 - DNA, 20 bp, Homo sapiens
gcaatccatgttagttttta

SEQ ID NO: 4356196 - DNA, 14 bp, Homo sapiens
gcaatgtatagtgt

SEQ ID NO: 4356197 - DNA, 14 bp, Homo sapiens
gcacaagggcacat

SEQ ID NO: 4356198 - DNA, 15 bp, Homo sapiens
gcacaagggcacatt

SEQ ID NO: 4356199 - DNA, 21 bp, Homo sapiens
gcacacacaaacctactgccc

SEQ ID NO: 4356200 - DNA, 22 bp, Homo sapiens
gcacacacaaacctactgccca

SEQ ID NO: 4356201 - DNA, 14 bp, Homo sapiens
gcacacacatctgg

SEQ ID NO: 4356202 - DNA, 20 bp, Homo sapiens
gcacacacatctggccctga

SEQ ID NO: 4356203 - DNA, 19 bp, Homo sapiens
gcacacagggcccggccac

SEQ ID NO: 4356204 - DNA, 13 bp, Homo sapiens
gcacagatggatt

SEQ ID NO: 4356205 - DNA, 16 bp, Homo sapiens
gcacaggagactccaa

SEQ ID NO: 4356206 - DNA, 19 bp, Homo sapiens
gcacatgactacatagtaa

SEQ ID NO: 4356207 - DNA, 22 bp, Homo sapiens
gcacattgcccatggctgggaa

SEQ ID NO: 4356208 - DNA, 13 bp, Homo sapiens
gcaccacactggg

SEQ ID NO: 4356209 - DNA, 22 bp, Homo sapiens
gcacccacctgttttctgaaac

SEQ ID NO: 4356210 - DNA, 14 bp, Homo sapiens
gcacctcggggaca

SEQ ID NO: 4356211 - DNA, 20 bp, Homo sapiens
gcactgatgttgtgttttta

SEQ ID NO: 4356212 - DNA, 17 bp, Homo sapiens
gcagaacaaatgtgttt

SEQ ID NO: 4356213 - DNA, 23 bp, Homo sapiens
gcagaacaggtagtattacacca

SEQ ID NO: 4356214 - DNA, 18 bp, Homo sapiens
gcagaacctgcacacagg

SEQ ID NO: 4356215 - DNA, 13 bp, Homo sapiens
gcagcaccacact

SEQ ID NO: 4356216 - DNA, 14 bp, Homo sapiens
gcagcaccacactg

SEQ ID NO: 4356217 - DNA, 23 bp, Homo sapiens
gcagcaggcctctggttgcctcc

SEQ ID NO: 4356218 - DNA, 11 bp, Homo sapiens
gcagccaccca

SEQ ID NO: 4356219 - DNA, 20 bp, Homo sapiens
gcagccacccaagcctgctg

SEQ ID NO: 4356220 - DNA, 23 bp, Homo sapiens
gcagccacccaagcctgctggct

SEQ ID NO: 4356221 - DNA, 13 bp, Homo sapiens
gcagccctcacct

SEQ ID NO: 4356222 - DNA, 14 bp, Homo sapiens
gcagcctgaagcct

SEQ ID NO: 4356223 - DNA, 16 bp, Homo sapiens
gcagcctgaagcctgg

SEQ ID NO: 4356224 - DNA, 17 bp, Homo sapiens
gcagcctgaagcctgga

SEQ ID NO: 4356225 - DNA, 18 bp, Homo sapiens
gcaggaactgggctgggc

SEQ ID NO: 4356226 - DNA, 20 bp, Homo sapiens
gcaggaactgggctgggcct

SEQ ID NO: 4356227 - DNA, 22 bp, Homo sapiens
gcaggaggcccttgtcgtggga

SEQ ID NO: 4356228 - DNA, 22 bp, Homo sapiens
gcaggcctctggttgcctcccc

SEQ ID NO: 4356229 - DNA, 19 bp, Homo sapiens
gcagggcatctcctgtgca

SEQ ID NO: 4356230 - DNA, 21 bp, Homo sapiens
gcagggcatctcctgtgcatg

SEQ ID NO: 4356231 - DNA, 22 bp, Homo sapiens
gcagggcatctcctgtgcatgg

SEQ ID NO: 4356232 - DNA, 15 bp, Homo sapiens
gcagggccatgcaga

SEQ ID NO: 4356233 - DNA, 21 bp, Homo sapiens
gcagggccatgcagacctcat

SEQ ID NO: 4356234 - DNA, 14 bp, Homo sapiens
gcagggtgagaagc

SEQ ID NO: 4356235 - DNA, 15 bp, Homo sapiens
gcaggtgggctgcct

SEQ ID NO: 4356236 - DNA, 18 bp, Homo sapiens
gcaggtgggctgcctgct

SEQ ID NO: 4356237 - DNA, 18 bp, Homo sapiens
gcagtagagtcatctcca

SEQ ID NO: 4356238 - DNA, 15 bp, Homo sapiens
gcagtccctggagaa

SEQ ID NO: 4356239 - DNA, 22 bp, Homo sapiens
gcagtgtttcccgccttgggct

SEQ ID NO: 4356240 - DNA, 18 bp, Homo sapiens
gcatactttgacaaggaa

SEQ ID NO: 4356241 - DNA, 19 bp, Homo sapiens
gcatactttgacaaggaaa

SEQ ID NO: 4356242 - DNA, 17 bp, Homo sapiens
gcataggcctgggtgct

SEQ ID NO: 4356243 - DNA, 22 bp, Homo sapiens
gcataggcctgggtgctggctg

SEQ ID NO: 4356244 - DNA, 18 bp, Homo sapiens
gcatatagactatataat

SEQ ID NO: 4356245 - DNA, 22 bp, Homo sapiens
gcatatttattgcattgctggt

SEQ ID NO: 4356246 - DNA, 17 bp, Homo sapiens
gcatgacctgtgaccag

SEQ ID NO: 4356247 - DNA, 22 bp, Homo sapiens
gcatgacctgtgaccagcactg

SEQ ID NO: 4356248 - DNA, 13 bp, Homo sapiens
gcatgtacttgaa

SEQ ID NO: 4356249 - DNA, 15 bp, Homo sapiens
gcatgtcccacccac

SEQ ID NO: 4356250 - DNA, 16 bp, Homo sapiens
gcattttctctgtagt

SEQ ID NO: 4356251 - DNA, 18 bp, Homo sapiens
gccaaagttttcaaactg

SEQ ID NO: 4356252 - DNA, 15 bp, Homo sapiens
gccaagactcctcag

SEQ ID NO: 4356253 - DNA, 17 bp, Homo sapiens
gccaagactcctcaggc

SEQ ID NO: 4356254 - DNA, 22 bp, Homo sapiens
gccacatggtgtctcccaacat

SEQ ID NO: 4356255 - DNA, 16 bp, Homo sapiens
gccacccaagcctgct

SEQ ID NO: 4356256 - DNA, 22 bp, Homo sapiens
gccacccaagcctgctggctgc

SEQ ID NO: 4356257 - DNA, 20 bp, Homo sapiens
gccaccggaggtcactccac

SEQ ID NO: 4356258 - DNA, 15 bp, Homo sapiens
gccactgccccccga

SEQ ID NO: 4356259 - DNA, 18 bp, Homo sapiens
gccactgccccccgaggc

SEQ ID NO: 4356260 - DNA, 23 bp, Homo sapiens
gccactgccccccgaggctgcta

SEQ ID NO: 4356261 - DNA, 13 bp, Homo sapiens
gccagaaagcact

SEQ ID NO: 4356262 - DNA, 18 bp, Homo sapiens
gccagcattcagcacaca

SEQ ID NO: 4356263 - DNA, 13 bp, Homo sapiens
gccagggcagagg

SEQ ID NO: 4356264 - DNA, 15 bp, Homo sapiens
gccagtccccgagga

SEQ ID NO: 4356265 - DNA, 17 bp, Homo sapiens
gccataatcagaacaca

SEQ ID NO: 4356266 - DNA, 14 bp, Homo sapiens
gccatgcagacctc

SEQ ID NO: 4356267 - DNA, 17 bp, Homo sapiens
gccatgcaggaggtgga

SEQ ID NO: 4356268 - DNA, 19 bp, Homo sapiens
gccatggggtccatcccct

SEQ ID NO: 4356269 - DNA, 14 bp, Homo sapiens
gcccaacctcctga

SEQ ID NO: 4356270 - DNA, 20 bp, Homo sapiens
gcccacatttgggctcaggg

SEQ ID NO: 4356271 - DNA, 21 bp, Homo sapiens
gcccacatttgggctcagggt

SEQ ID NO: 4356272 - DNA, 20 bp, Homo sapiens
gcccagacccctctggccag

SEQ ID NO: 4356273 - DNA, 21 bp, Homo sapiens
gcccagacccctctggccagg

SEQ ID NO: 4356274 - DNA, 17 bp, Homo sapiens
gcccagctctctgacgc

SEQ ID NO: 4356275 - DNA, 18 bp, Homo sapiens
gcccagtccctggagctg

SEQ ID NO: 4356276 - DNA, 24 bp, Homo sapiens
gcccagtccctggagctgtccttc

SEQ ID NO: 4356277 - DNA, 15 bp, Homo sapiens
gcccatggctgggaa

SEQ ID NO: 4356278 - DNA, 21 bp, Homo sapiens
gcccatggttgagaaatgaat

SEQ ID NO: 4356279 - DNA, 18 bp, Homo sapiens
gcccccaaattgccttca

SEQ ID NO: 4356280 - DNA, 19 bp, Homo sapiens
gcccccaaattgccttcag

SEQ ID NO: 4356281 - DNA, 20 bp, Homo sapiens
ctgtcttatctgctataaac

SEQ ID NO: 4356282 - DNA, 21 bp, Homo sapiens
ctgtgaagagccggtggtgcc

SEQ ID NO: 4356283 - DNA, 23 bp, Homo sapiens
ctgtgaagagccggtggtgcccg

SEQ ID NO: 4356284 - DNA, 14 bp, Homo sapiens
ctgtgaccagcact

SEQ ID NO: 4356285 - DNA, 16 bp, Homo sapiens
ctgtgactggatcttc

SEQ ID NO: 4356286 - DNA, 22 bp, Homo sapiens
ctgtgactggatcttctatcat

SEQ ID NO: 4356287 - DNA, 17 bp, Homo sapiens
ctgtgatgccacacaga

SEQ ID NO: 4356288 - DNA, 15 bp, Homo sapiens
ctgtggtttcagatg

SEQ ID NO: 4356289 - DNA, 16 bp, Homo sapiens
ctgtggtttcagatgt

SEQ ID NO: 4356290 - DNA, 18 bp, Homo sapiens
ctgtggtttcagatgtgc

SEQ ID NO: 4356291 - DNA, 12 bp, Homo sapiens
ctgtgtacttta

SEQ ID NO: 4356292 - DNA, 21 bp, Homo sapiens
ctgtgtttcgcattaagcaca

SEQ ID NO: 4356293 - DNA, 21 bp, Homo sapiens
ctgttatgcactgtggtttca

SEQ ID NO: 4356294 - DNA, 14 bp, Homo sapiens
ctgttttgggcctc

SEQ ID NO: 4356295 - DNA, 16 bp, Homo sapiens
ctgttttgggcctcca

SEQ ID NO: 4356296 - DNA, 22 bp, Homo sapiens
ctgttttgggcctccatgcccc

SEQ ID NO: 4356297 - DNA, 20 bp, Homo sapiens
cttaaaataaaattatatac

SEQ ID NO: 4356298 - DNA, 14 bp, Homo sapiens
cttaaactgtgtgg

SEQ ID NO: 4356299 - DNA, 23 bp, Homo sapiens
cttaaactgtgtggactgtgatg

SEQ ID NO: 4356300 - DNA, 17 bp, Homo sapiens
cttaagatctgactgcc

SEQ ID NO: 4356301 - DNA, 18 bp, Homo sapiens
cttaagatctgactgcca

SEQ ID NO: 4356302 - DNA, 18 bp, Homo sapiens
cttaagcagaacaaatgt

SEQ ID NO: 4356303 - DNA, 14 bp, Homo sapiens
cttaagtgagcaga

SEQ ID NO: 4356304 - DNA, 16 bp, Homo sapiens
cttaagtgagcagaac

SEQ ID NO: 4356305 - DNA, 18 bp, Homo sapiens
cttaagtgagcagaacag

SEQ ID NO: 4356306 - DNA, 20 bp, Homo sapiens
cttaagtgagcagaacaggt

SEQ ID NO: 4356307 - DNA, 22 bp, Homo sapiens
cttaagtgagcagaacaggtag

SEQ ID NO: 4356308 - DNA, 14 bp, Homo sapiens
cttaataaatatgt

SEQ ID NO: 4356309 - DNA, 17 bp, Homo sapiens
cttaataaattcagata

SEQ ID NO: 4356310 - DNA, 13 bp, Homo sapiens
cttacaaaatgcc

SEQ ID NO: 4356311 - DNA, 17 bp, Homo sapiens
cttacttttactgtcta

SEQ ID NO: 4356312 - DNA, 17 bp, Homo sapiens
cttcagaagacactgca

SEQ ID NO: 4356313 - DNA, 16 bp, Homo sapiens
cttcattccgttagga

SEQ ID NO: 4356314 - DNA, 12 bp, Homo sapiens
cttccacccagt

SEQ ID NO: 4356315 - DNA, 14 bp, Homo sapiens
cttccagtgaacat

SEQ ID NO: 4356316 - DNA, 23 bp, Homo sapiens
cttccatcttgtggggccaggac

SEQ ID NO: 4356317 - DNA, 16 bp, Homo sapiens
cttcccccatccctac

SEQ ID NO: 4356318 - DNA, 23 bp, Homo sapiens
cttcccccatccctaccactgtg

SEQ ID NO: 4356319 - DNA, 13 bp, Homo sapiens
cttcccctttccc

SEQ ID NO: 4356320 - DNA, 23 bp, Homo sapiens
cttccctggaaaccttccaccca

SEQ ID NO: 4356321 - DNA, 19 bp, Homo sapiens
cttccgatcaacatttatg

SEQ ID NO: 4356322 - DNA, 11 bp, Homo sapiens
cttctctacag

SEQ ID NO: 4356323 - DNA, 21 bp, Homo sapiens
cttctgaagatttgtccacct

SEQ ID NO: 4356324 - DNA, 15 bp, Homo sapiens
cttctgaataaagca

SEQ ID NO: 4356325 - DNA, 16 bp, Homo sapiens
cttctgaataaagcaa

SEQ ID NO: 4356326 - DNA, 14 bp, Homo sapiens
cttcttcttcagaa

SEQ ID NO: 4356327 - DNA, 21 bp, Homo sapiens
cttctttagcatttttatgca

SEQ ID NO: 4356328 - DNA, 14 bp, Homo sapiens
cttcttttttaaac

SEQ ID NO: 4356329 - DNA, 14 bp, Homo sapiens
cttgaaataagttg

SEQ ID NO: 4356330 - DNA, 16 bp, Homo sapiens
cttgcatgtacttgaa

SEQ ID NO: 4356331 - DNA, 21 bp, Homo sapiens
cttgcatgtacttgaaggatg

SEQ ID NO: 4356332 - DNA, 16 bp, Homo sapiens
cttgcctgaactccag

SEQ ID NO: 4356333 - DNA, 18 bp, Homo sapiens
cttgcctgaactccagag

SEQ ID NO: 4356334 - DNA, 17 bp, Homo sapiens
cttgccttaataaatat

SEQ ID NO: 4356335 - DNA, 16 bp, Homo sapiens
cttgctcagagctagg

SEQ ID NO: 4356336 - DNA, 19 bp, Homo sapiens
cttgctccagattctgatg

SEQ ID NO: 4356337 - DNA, 20 bp, Homo sapiens
cttgctccagattctgatgc

SEQ ID NO: 4356338 - DNA, 12 bp, Homo sapiens
cttgctgggcca

SEQ ID NO: 4356339 - DNA, 11 bp, Homo sapiens
cttggaaacat

SEQ ID NO: 4356340 - DNA, 22 bp, Homo sapiens
cttggaaacatttttgagatat

SEQ ID NO: 4356341 - DNA, 18 bp, Homo sapiens
cttggagaggagagtggc

SEQ ID NO: 4356342 - DNA, 18 bp, Homo sapiens
cttggccatgcagaaagc

SEQ ID NO: 4356343 - DNA, 21 bp, Homo sapiens
cttggggaaaatggccatgca

SEQ ID NO: 4356344 - DNA, 20 bp, Homo sapiens
cttggtctgatttcaggata

SEQ ID NO: 4356345 - DNA, 21 bp, Homo sapiens
cttgtgagtggataatcagga

SEQ ID NO: 4356346 - DNA, 20 bp, Homo sapiens
cttgtgtgtgggctgtgagt

SEQ ID NO: 4356347 - DNA, 13 bp, Homo sapiens
ctttaaggtcaaa

SEQ ID NO: 4356348 - DNA, 21 bp, Homo sapiens
ctttagcatttttatgcagac

SEQ ID NO: 4356349 - DNA, 22 bp, Homo sapiens
ctttagcatttttatgcagaca

SEQ ID NO: 4356350 - DNA, 20 bp, Homo sapiens
ctttatggttctacttcctg

SEQ ID NO: 4356351 - DNA, 13 bp, Homo sapiens
ctttcaatgcagt

SEQ ID NO: 4356352 - DNA, 21 bp, Homo sapiens
ctttctgggatgtcacagtcc

SEQ ID NO: 4356353 - DNA, 22 bp, Homo sapiens
ctttctgggatgtcacagtcca

SEQ ID NO: 4356354 - DNA, 12 bp, Homo sapiens
ctttgaagggca

SEQ ID NO: 4356355 - DNA, 14 bp, Homo sapiens
ctttgacaaggaaa

SEQ ID NO: 4356356 - DNA, 13 bp, Homo sapiens
ctttggaagcagc

SEQ ID NO: 4356357 - DNA, 14 bp, Homo sapiens
ctttggaagcagcc

SEQ ID NO: 4356358 - DNA, 14 bp, Homo sapiens
ctttgtagaaagca

SEQ ID NO: 4356359 - DNA, 14 bp, Homo sapiens
ctttgtgcattctg

SEQ ID NO: 4356360 - DNA, 19 bp, Homo sapiens
cttttactgtctatatata

SEQ ID NO: 4356361 - DNA, 14 bp, Homo sapiens
cttttagattaaaa

SEQ ID NO: 4356362 - DNA, 13 bp, Homo sapiens
cttttagcctagt

SEQ ID NO: 4356363 - DNA, 15 bp, Homo sapiens
cttttcacactgtct

SEQ ID NO: 4356364 - DNA, 18 bp, Homo sapiens
cttttcacactgtcttcc

SEQ ID NO: 4356365 - DNA, 17 bp, Homo sapiens
cttttcccataaataaa

SEQ ID NO: 4356366 - DNA, 14 bp, Homo sapiens
cttttgtgtacagt

SEQ ID NO: 4356367 - DNA, 22 bp, Homo sapiens
ctttttctggactgaagcctgc

SEQ ID NO: 4356368 - DNA, 12 bp, Homo sapiens
ctttttctttat

SEQ ID NO: 4356369 - DNA, 20 bp, Homo sapiens
cttttttaggctacagtgtc

SEQ ID NO: 4356370 - DNA, 20 bp, Homo sapiens
ctttttttgagtgacagctt

SEQ ID NO: 4356371 - DNA, 20 bp, Homo sapiens
gaaaactattgagccttgca

SEQ ID NO: 4356372 - DNA, 15 bp, Homo sapiens
gaaaagatgtatgtt

SEQ ID NO: 4356373 - DNA, 15 bp, Homo sapiens
gaaaatcaactttta

SEQ ID NO: 4356374 - DNA, 18 bp, Homo sapiens
gaaaatcagcaacttcta

SEQ ID NO: 4356375 - DNA, 18 bp, Homo sapiens
gaaaatggccatgcagga

SEQ ID NO: 4356376 - DNA, 17 bp, Homo sapiens
gaaaatgtattttgcct

SEQ ID NO: 4356377 - DNA, 22 bp, Homo sapiens
gaaacacccctctgtctaggac

SEQ ID NO: 4356378 - DNA, 21 bp, Homo sapiens
gaaagacggattgcattagaa

SEQ ID NO: 4356379 - DNA, 18 bp, Homo sapiens
gaaagatacaggggatca

SEQ ID NO: 4356380 - DNA, 22 bp, Homo sapiens
gaaaggcagccctcacctctga

SEQ ID NO: 4356381 - DNA, 18 bp, Homo sapiens
gaaaggtctctggaggga

SEQ ID NO: 4356382 - DNA, 19 bp, Homo sapiens
gaaataaaatttgaaactg

SEQ ID NO: 4356383 - DNA, 17 bp, Homo sapiens
gaaataaatagatgtaa

SEQ ID NO: 4356384 - DNA, 20 bp, Homo sapiens
gaaatacgtgattaatatgc

SEQ ID NO: 4356385 - DNA, 18 bp, Homo sapiens
gaaatagacagtatattt

SEQ ID NO: 4356386 - DNA, 19 bp, Homo sapiens
gaaatagacagtatattta

SEQ ID NO: 4356387 - DNA, 14 bp, Homo sapiens
gaaatagcagagcc

SEQ ID NO: 4356388 - DNA, 15 bp, Homo sapiens
gaaatagcagagcct

SEQ ID NO: 4356389 - DNA, 17 bp, Homo sapiens
gaaatatatatgtgtgt

SEQ ID NO: 4356390 - DNA, 19 bp, Homo sapiens
gaaatgaataatttcccaa

SEQ ID NO: 4356391 - DNA, 20 bp, Homo sapiens
gaaatgattcaaattgctgc

SEQ ID NO: 4356392 - DNA, 17 bp, Homo sapiens
gaaatggcgtctgctct

SEQ ID NO: 4356393 - DNA, 11 bp, Homo sapiens
gaacagctgtg

SEQ ID NO: 4356394 - DNA, 13 bp, Homo sapiens
gaacagctgtgtc

SEQ ID NO: 4356395 - DNA, 17 bp, Homo sapiens
gaacatactgattggga

SEQ ID NO: 4356396 - DNA, 17 bp, Homo sapiens
gaacatgacccagcctg

SEQ ID NO: 4356397 - DNA, 19 bp, Homo sapiens
gaacatgacccagcctgaa

SEQ ID NO: 4356398 - DNA, 15 bp, Homo sapiens
gaacattttgtggag

SEQ ID NO: 4356399 - DNA, 20 bp, Homo sapiens
gaactgacaaaggagccttg

SEQ ID NO: 4356400 - DNA, 17 bp, Homo sapiens
gaactgggctgggcctc

SEQ ID NO: 4356401 - DNA, 17 bp, Homo sapiens
gaagaagaaatctttct

SEQ ID NO: 4356402 - DNA, 21 bp, Homo sapiens
gaagagaagaaatagcagagc

SEQ ID NO: 4356403 - DNA, 20 bp, Homo sapiens
cgactaaaacaagtgtataa

SEQ ID NO: 4356404 - DNA, 15 bp, Homo sapiens
cgagcaaacccagag

SEQ ID NO: 4356405 - DNA, 23 bp, Homo sapiens
cgagcaaacccagaggtggatgt

SEQ ID NO: 4356406 - DNA, 11 bp, Homo sapiens
cgaggagctgg

SEQ ID NO: 4356407 - DNA, 14 bp, Homo sapiens
cgaggagctgggcc

SEQ ID NO: 4356408 - DNA, 12 bp, Homo sapiens
cgaggctgctag

SEQ ID NO: 4356409 - DNA, 19 bp, Homo sapiens
cgatgccataatcagaaca

SEQ ID NO: 4356410 - DNA, 12 bp, Homo sapiens
cgcacagccacc

SEQ ID NO: 4356411 - DNA, 15 bp, Homo sapiens
cgcacagccacccgt

SEQ ID NO: 4356412 - DNA, 17 bp, Homo sapiens
cgcacagccacccgtgg

SEQ ID NO: 4356413 - DNA, 14 bp, Homo sapiens
cgcagcctgaagcc

SEQ ID NO: 4356414 - DNA, 18 bp, Homo sapiens
cgcagcctgaagcctgga

SEQ ID NO: 4356415 - DNA, 20 bp, Homo sapiens
cgcaggaactgggctgggcc

SEQ ID NO: 4356416 - DNA, 21 bp, Homo sapiens
cgcaggaactgggctgggcct

SEQ ID NO: 4356417 - DNA, 14 bp, Homo sapiens
cgcagggccatgca

SEQ ID NO: 4356418 - DNA, 16 bp, Homo sapiens
cgcagggccatgcaga

SEQ ID NO: 4356419 - DNA, 18 bp, Homo sapiens
cgcagggccatgcagacc

SEQ ID NO: 4356420 - DNA, 14 bp, Homo sapiens
cgcattaagcacac

SEQ ID NO: 4356421 - DNA, 15 bp, Homo sapiens
cgcattaagcacaca

SEQ ID NO: 4356422 - DNA, 19 bp, Homo sapiens
cgccccgttgtgagctgga

SEQ ID NO: 4356423 - DNA, 18 bp, Homo sapiens
cgccgcctcccacggcac

SEQ ID NO: 4356424 - DNA, 19 bp, Homo sapiens
cgcctcttcttcttcagaa

SEQ ID NO: 4356425 - DNA, 11 bp, Homo sapiens
cgcctgccacc

SEQ ID NO: 4356426 - DNA, 19 bp, Homo sapiens
cgcctgtcacaataaagtt

SEQ ID NO: 4356427 - DNA, 14 bp, Homo sapiens
cgcgaactgggttc

SEQ ID NO: 4356428 - DNA, 15 bp, Homo sapiens
cgcgggcagccaccc

SEQ ID NO: 4356429 - DNA, 20 bp, Homo sapiens
cgcttatcaactaatgattt

SEQ ID NO: 4356430 - DNA, 13 bp, Homo sapiens
cgcttgtgacagt

SEQ ID NO: 4356431 - DNA, 14 bp, Homo sapiens
cgcttgtgacagtg

SEQ ID NO: 4356432 - DNA, 17 bp, Homo sapiens
cgcttgtgacagtgcct

SEQ ID NO: 4356433 - DNA, 18 bp, Homo sapiens
cggcccagtgccactgcc

SEQ ID NO: 4356434 - DNA, 21 bp, Homo sapiens
cggccccccgcacagccaccc

SEQ ID NO: 4356435 - DNA, 21 bp, Homo sapiens
cgggattgaagggtcctgccg

SEQ ID NO: 4356436 - DNA, 15 bp, Homo sapiens
cgggcagccacccaa

SEQ ID NO: 4356437 - DNA, 19 bp, Homo sapiens
cgggcagccacccaagcct

SEQ ID NO: 4356438 - DNA, 11 bp, Homo sapiens
cgggccagggt

SEQ ID NO: 4356439 - DNA, 12 bp, Homo sapiens
cgggccagggtg

SEQ ID NO: 4356440 - DNA, 15 bp, Homo sapiens
cgggccagggtggga

SEQ ID NO: 4356441 - DNA, 17 bp, Homo sapiens
cgggctcagagctttgt

SEQ ID NO: 4356442 - DNA, 16 bp, Homo sapiens
cggggacaccagagct

SEQ ID NO: 4356443 - DNA, 16 bp, Homo sapiens
cgggtctcgcagcctg

SEQ ID NO: 4356444 - DNA, 17 bp, Homo sapiens
cgggtctcgcagcctga

SEQ ID NO: 4356445 - DNA, 13 bp, Homo sapiens
cggtaagtgttct

SEQ ID NO: 4356446 - DNA, 20 bp, Homo sapiens
cggtaagtgttctcatgaag

SEQ ID NO: 4356447 - DNA, 22 bp, Homo sapiens
cggtggtgcccgtgcccgcagg

SEQ ID NO: 4356448 - DNA, 21 bp, Homo sapiens
cggtttggggagcagagacac

SEQ ID NO: 4356449 - DNA, 21 bp, Homo sapiens
cgtcacccctgtttctggcac

SEQ ID NO: 4356450 - DNA, 21 bp, Homo sapiens
cgtgattaatatgcaagtgaa

SEQ ID NO: 4356451 - DNA, 23 bp, Homo sapiens
cgtgggccagtccccgaggagct

SEQ ID NO: 4356452 - DNA, 22 bp, Homo sapiens
cgtgggcgcaaaggtgcctcat

SEQ ID NO: 4356453 - DNA, 16 bp, Homo sapiens
ccagtccctggagctg

SEQ ID NO: 4356454 - DNA, 15 bp, Homo sapiens
ccagtgaacattccc

SEQ ID NO: 4356455 - DNA, 18 bp, Homo sapiens
ccagtgaacattcccagc

SEQ ID NO: 4356456 - DNA, 21 bp, Homo sapiens
ccagtgaacattcccagccca

SEQ ID NO: 4356457 - DNA, 22 bp, Homo sapiens
ccagtgaacattcccagcccag

SEQ ID NO: 4356458 - DNA, 13 bp, Homo sapiens
ccagtgccactgc

SEQ ID NO: 4356459 - DNA, 17 bp, Homo sapiens
ccagtgccactgccccc

SEQ ID NO: 4356460 - DNA, 18 bp, Homo sapiens
ccagtgccactgcccccc

SEQ ID NO: 4356461 - DNA, 22 bp, Homo sapiens
ccagtgctgaatttccctctct

SEQ ID NO: 4356462 - DNA, 20 bp, Homo sapiens
ccagtggggtcccccctgag

SEQ ID NO: 4356463 - DNA, 16 bp, Homo sapiens
ccatccctaccactgt

SEQ ID NO: 4356464 - DNA, 19 bp, Homo sapiens
ccatgaatgtatcaggaaa

SEQ ID NO: 4356465 - DNA, 14 bp, Homo sapiens
ccatgcagaaagca

SEQ ID NO: 4356466 - DNA, 12 bp, Homo sapiens
ccatgcagacct

SEQ ID NO: 4356467 - DNA, 18 bp, Homo sapiens
ccatgcagacctcatgcc

SEQ ID NO: 4356468 - DNA, 13 bp, Homo sapiens
ccatgcaggaggt

SEQ ID NO: 4356469 - DNA, 16 bp, Homo sapiens
ccatgccccagctctg

SEQ ID NO: 4356470 - DNA, 17 bp, Homo sapiens
ccatgccccagctctgg

SEQ ID NO: 4356471 - DNA, 14 bp, Homo sapiens
ccatggttgagaaa

SEQ ID NO: 4356472 - DNA, 23 bp, Homo sapiens
ccatgtttggtgtttgtctgtgt

SEQ ID NO: 4356473 - DNA, 23 bp, Homo sapiens
cccaaagcagcaggcctctggtt

SEQ ID NO: 4356474 - DNA, 15 bp, Homo sapiens
cccaaattgccttca

SEQ ID NO: 4356475 - DNA, 16 bp, Homo sapiens
cccaacctcctgacct

SEQ ID NO: 4356476 - DNA, 21 bp, Homo sapiens
cccaagaggggcgggctcaga

SEQ ID NO: 4356477 - DNA, 15 bp, Homo sapiens
cccaagcctgctggc

SEQ ID NO: 4356478 - DNA, 15 bp, Homo sapiens
cccaattaggaagtg

SEQ ID NO: 4356479 - DNA, 19 bp, Homo sapiens
cccaattaggaagtgtaac

SEQ ID NO: 4356480 - DNA, 16 bp, Homo sapiens
cccacctgttttctga

SEQ ID NO: 4356481 - DNA, 18 bp, Homo sapiens
cccagacccctctggcca

SEQ ID NO: 4356482 - DNA, 21 bp, Homo sapiens
cccagacccctctggccagga

SEQ ID NO: 4356483 - DNA, 12 bp, Homo sapiens
cccagccagaaa

SEQ ID NO: 4356484 - DNA, 13 bp, Homo sapiens
cccagccagaaag

SEQ ID NO: 4356485 - DNA, 14 bp, Homo sapiens
cccagccagaaagc

SEQ ID NO: 4356486 - DNA, 12 bp, Homo sapiens
cccagcctgaaa

SEQ ID NO: 4356487 - DNA, 18 bp, Homo sapiens
cccagcctgaaagataca

SEQ ID NO: 4356488 - DNA, 19 bp, Homo sapiens
cccagcctgaaagatacag

SEQ ID NO: 4356489 - DNA, 17 bp, Homo sapiens
cccagcggccccccgca

SEQ ID NO: 4356490 - DNA, 16 bp, Homo sapiens
cccagctctctgacgc

SEQ ID NO: 4356491 - DNA, 13 bp, Homo sapiens
cccagctctggat

SEQ ID NO: 4356492 - DNA, 17 bp, Homo sapiens
cccagtgccactgcccc

SEQ ID NO: 4356493 - DNA, 16 bp, Homo sapiens
ccccaaattgccttca

SEQ ID NO: 4356494 - DNA, 19 bp, Homo sapiens
ccccaaattgccttcagcc

SEQ ID NO: 4356495 - DNA, 18 bp, Homo sapiens
ccccaagaggggcgggct

SEQ ID NO: 4356496 - DNA, 17 bp, Homo sapiens
ccccaccccaccccacc

SEQ ID NO: 4356497 - DNA, 23 bp, Homo sapiens
ccccaggcctgtccaccctgcca

SEQ ID NO: 4356498 - DNA, 13 bp, Homo sapiens
ccccatccctacc

SEQ ID NO: 4356499 - DNA, 16 bp, Homo sapiens
cccccgcacagccacc

SEQ ID NO: 4356500 - DNA, 14 bp, Homo sapiens
cccccgcctgccac

SEQ ID NO: 4356501 - DNA, 15 bp, Homo sapiens
ccccctccccccaga

SEQ ID NO: 4356502 - DNA, 11 bp, Homo sapiens
ccccctgagtg

SEQ ID NO: 4356503 - DNA, 17 bp, Homo sapiens
ccccgatgtcccctgcg

SEQ ID NO: 4356504 - DNA, 19 bp, Homo sapiens
ccccgatgtcccctgcggg

SEQ ID NO: 4356505 - DNA, 13 bp, Homo sapiens
ccccgcacagcca

SEQ ID NO: 4356506 - DNA, 15 bp, Homo sapiens
ccccgcacagccacc

SEQ ID NO: 4356507 - DNA, 14 bp, Homo sapiens
cccctccccccaga

SEQ ID NO: 4356508 - DNA, 18 bp, Homo sapiens
cccctccccccagactct

SEQ ID NO: 4356509 - DNA, 13 bp, Homo sapiens
cccctctcagaac

SEQ ID NO: 4356510 - DNA, 11 bp, Homo sapiens
cccctgcacag

SEQ ID NO: 4356511 - DNA, 15 bp, Homo sapiens
cccgaggagctgggc

SEQ ID NO: 4356512 - DNA, 16 bp, Homo sapiens
cccgaggagctgggcc

SEQ ID NO: 4356513 - DNA, 21 bp, Homo sapiens
cccgaggagctgggcccctgc

SEQ ID NO: 4356514 - DNA, 15 bp, Homo sapiens
cccgaggctgctaga

SEQ ID NO: 4356515 - DNA, 15 bp, Homo sapiens
cccgatgtcccctgc

SEQ ID NO: 4356516 - DNA, 15 bp, Homo sapiens
cccgcactctgcccc

SEQ ID NO: 4356517 - DNA, 22 bp, Homo sapiens
catagtgtctgctgctgcctcc

SEQ ID NO: 4356518 - DNA, 22 bp, Homo sapiens
catatggaaatgttactgtctg

SEQ ID NO: 4356519 - DNA, 19 bp, Homo sapiens
catcagctgtaagaagaga

SEQ ID NO: 4356520 - DNA, 12 bp, Homo sapiens
catcatttaact

SEQ ID NO: 4356521 - DNA, 22 bp, Homo sapiens
catcatttaactgaactgtgaa

SEQ ID NO: 4356522 - DNA, 17 bp, Homo sapiens
catccaatcctcactgg

SEQ ID NO: 4356523 - DNA, 21 bp, Homo sapiens
catccccttcccccatcccta

SEQ ID NO: 4356524 - DNA, 14 bp, Homo sapiens
catccctaccactg

SEQ ID NO: 4356525 - DNA, 15 bp, Homo sapiens
catccctaccactgt

SEQ ID NO: 4356526 - DNA, 20 bp, Homo sapiens
catccctcacccatcctaga

SEQ ID NO: 4356527 - DNA, 17 bp, Homo sapiens
catccgtattctttgtg

SEQ ID NO: 4356528 - DNA, 16 bp, Homo sapiens
catctccatcagctgt

SEQ ID NO: 4356529 - DNA, 20 bp, Homo sapiens
catctcctgtgcatgggtga

SEQ ID NO: 4356530 - DNA, 13 bp, Homo sapiens
catctggccctga

SEQ ID NO: 4356531 - DNA, 14 bp, Homo sapiens
catgaagcaggagg

SEQ ID NO: 4356532 - DNA, 19 bp, Homo sapiens
catgaagcaggaggccctt

SEQ ID NO: 4356533 - DNA, 23 bp, Homo sapiens
catgaagcaggaggcccttgtcg

SEQ ID NO: 4356534 - DNA, 15 bp, Homo sapiens
catgacccagcctga

SEQ ID NO: 4356535 - DNA, 17 bp, Homo sapiens
catgacctgtgaccagc

SEQ ID NO: 4356536 - DNA, 20 bp, Homo sapiens
catgatgtaaaaaatattaa

SEQ ID NO: 4356537 - DNA, 22 bp, Homo sapiens
catgatgtaaaaaatattaaag

SEQ ID NO: 4356538 - DNA, 15 bp, Homo sapiens
catgcactgatgttg

SEQ ID NO: 4356539 - DNA, 21 bp, Homo sapiens
catgcagacctcatgcccagc

SEQ ID NO: 4356540 - DNA, 14 bp, Homo sapiens
catgcccagctctc

SEQ ID NO: 4356541 - DNA, 17 bp, Homo sapiens
catgcccagctctctga

SEQ ID NO: 4356542 - DNA, 19 bp, Homo sapiens
catgcccagctctctgacg

SEQ ID NO: 4356543 - DNA, 15 bp, Homo sapiens
catgccccagctctg

SEQ ID NO: 4356544 - DNA, 20 bp, Homo sapiens
catgccccagctctggatga

SEQ ID NO: 4356545 - DNA, 23 bp, Homo sapiens
catggagaagggttctgccctgc

SEQ ID NO: 4356546 - DNA, 21 bp, Homo sapiens
catggggtccatccccttccc

SEQ ID NO: 4356547 - DNA, 23 bp, Homo sapiens
catgggtgaagggagagccagct

SEQ ID NO: 4356548 - DNA, 14 bp, Homo sapiens
catggtactacccc

SEQ ID NO: 4356549 - DNA, 15 bp, Homo sapiens
catggtactacccca

SEQ ID NO: 4356550 - DNA, 18 bp, Homo sapiens
catggtactaccccagcc

SEQ ID NO: 4356551 - DNA, 18 bp, Homo sapiens
catggtcaagttcccaac

SEQ ID NO: 4356552 - DNA, 19 bp, Homo sapiens
catggtgtctcccaacatg

SEQ ID NO: 4356553 - DNA, 13 bp, Homo sapiens
catggttggggga

SEQ ID NO: 4356554 - DNA, 13 bp, Homo sapiens
catgtacttgaag

SEQ ID NO: 4356555 - DNA, 19 bp, Homo sapiens
catgtacttgaaggatgga

SEQ ID NO: 4356556 - DNA, 14 bp, Homo sapiens
catgtcccacccac

SEQ ID NO: 4356557 - DNA, 17 bp, Homo sapiens
catgtcccacccacccg

SEQ ID NO: 4356558 - DNA, 17 bp, Homo sapiens
catgttactgaccagca

SEQ ID NO: 4356559 - DNA, 21 bp, Homo sapiens
catgttcctcaaaagcaccct

SEQ ID NO: 4356560 - DNA, 20 bp, Homo sapiens
catgtttaaatagcctaaat

SEQ ID NO: 4356561 - DNA, 24 bp, Homo sapiens
cattaagcacacacatctggccct

SEQ ID NO: 4356562 - DNA, 16 bp, Homo sapiens
cattaataaagttgct

SEQ ID NO: 4356563 - DNA, 18 bp, Homo sapiens
cattaataaagttgcttt

SEQ ID NO: 4356564 - DNA, 15 bp, Homo sapiens
cattattatgatgtt

SEQ ID NO: 4356565 - DNA, 22 bp, Homo sapiens
cattcctaagagtggaggagga

SEQ ID NO: 4356566 - DNA, 17 bp, Homo sapiens
cattgctggtagagacc

SEQ ID NO: 4356567 - DNA, 20 bp, Homo sapiens
cattgctggtagagaccccc

SEQ ID NO: 4356568 - DNA, 23 bp, Homo sapiens
cattgctggtagagacccccagg

SEQ ID NO: 4356569 - DNA, 13 bp, Homo sapiens
cattgttgtcaag

SEQ ID NO: 4356570 - DNA, 16 bp, Homo sapiens
cattgttgtcaaggaa

SEQ ID NO: 4356571 - DNA, 20 bp, Homo sapiens
catttaactgaactgtgaac

SEQ ID NO: 4356572 - DNA, 14 bp, Homo sapiens
catttatgacctaa

SEQ ID NO: 4356573 - DNA, 22 bp, Homo sapiens
catttgctagttctgctgccct

SEQ ID NO: 4356574 - DNA, 14 bp, Homo sapiens
catttggtctcagg

SEQ ID NO: 4356575 - DNA, 23 bp, Homo sapiens
cagaattcccttgaattgtgtat

SEQ ID NO: 4356576 - DNA, 14 bp, Homo sapiens
cagacagcttgact

SEQ ID NO: 4356577 - DNA, 20 bp, Homo sapiens
cagacagcttgactgctttt

SEQ ID NO: 4356578 - DNA, 20 bp, Homo sapiens
cagacccctctggccaggat

SEQ ID NO: 4356579 - DNA, 22 bp, Homo sapiens
cagactggatggaaacttcctg

SEQ ID NO: 4356580 - DNA, 13 bp, Homo sapiens
cagagctaggccc

SEQ ID NO: 4356581 - DNA, 14 bp, Homo sapiens
cagagctaggcccc

SEQ ID NO: 4356582 - DNA, 19 bp, Homo sapiens
cagagctttgtcacttgcc

SEQ ID NO: 4356583 - DNA, 20 bp, Homo sapiens
cagagctttgtcacttgcca

SEQ ID NO: 4356584 - DNA, 21 bp, Homo sapiens
cagaggaatgtagggcctgca

SEQ ID NO: 4356585 - DNA, 22 bp, Homo sapiens
cagaggccggggtccaggcccg

SEQ ID NO: 4356586 - DNA, 13 bp, Homo sapiens
cagaggtggatgt

SEQ ID NO: 4356587 - DNA, 15 bp, Homo sapiens
cagatatatttttca

SEQ ID NO: 4356588 - DNA, 19 bp, Homo sapiens
cagatatatttttcacagt

SEQ ID NO: 4356589 - DNA, 21 bp, Homo sapiens
cagatggatttgcctgtgcca

SEQ ID NO: 4356590 - DNA, 16 bp, Homo sapiens
cagatggggtctgtga

SEQ ID NO: 4356591 - DNA, 20 bp, Homo sapiens
cagatggggtctgtgactgg

SEQ ID NO: 4356592 - DNA, 21 bp, Homo sapiens
cagatggggtctgtgactgga

SEQ ID NO: 4356593 - DNA, 22 bp, Homo sapiens
cagatggggtctgtgactggat

SEQ ID NO: 4356594 - DNA, 20 bp, Homo sapiens
cagatgtgcaataatttgta

SEQ ID NO: 4356595 - DNA, 21 bp, Homo sapiens
cagatgtgcaataatttgtac

SEQ ID NO: 4356596 - DNA, 22 bp, Homo sapiens
cagcacaagggcacattgccca

SEQ ID NO: 4356597 - DNA, 17 bp, Homo sapiens
cagcaccacactgggtg

SEQ ID NO: 4356598 - DNA, 17 bp, Homo sapiens
cagcagaacctgcacac

SEQ ID NO: 4356599 - DNA, 24 bp, Homo sapiens
cagcagaacctgcacacaggacag

SEQ ID NO: 4356600 - DNA, 15 bp, Homo sapiens
cagcaggcctctggt

SEQ ID NO: 4356601 - DNA, 20 bp, Homo sapiens
cagcaggcctctggttgcct

SEQ ID NO: 4356602 - DNA, 12 bp, Homo sapiens
cagcatatttat

SEQ ID NO: 4356603 - DNA, 18 bp, Homo sapiens
cagcatatttatagcaat

SEQ ID NO: 4356604 - DNA, 15 bp, Homo sapiens
cagcattcagcacac

SEQ ID NO: 4356605 - DNA, 19 bp, Homo sapiens
cagccacccaagcctgctg

SEQ ID NO: 4356606 - DNA, 22 bp, Homo sapiens
cagccagaaagcactacaatca

SEQ ID NO: 4356607 - DNA, 13 bp, Homo sapiens
cagccccctgtgg

SEQ ID NO: 4356608 - DNA, 15 bp, Homo sapiens
cagccctcacctctg

SEQ ID NO: 4356609 - DNA, 18 bp, Homo sapiens
cagcctcgttggagagca

SEQ ID NO: 4356610 - DNA, 19 bp, Homo sapiens
cagcctcgttggagagcag

SEQ ID NO: 4356611 - DNA, 14 bp, Homo sapiens
cagcctgaagcctg

SEQ ID NO: 4356612 - DNA, 16 bp, Homo sapiens
cagcctgaagcctgga

SEQ ID NO: 4356613 - DNA, 23 bp, Homo sapiens
cagcctgaagcctggattccagc

SEQ ID NO: 4356614 - DNA, 16 bp, Homo sapiens
cagccttctactgctc

SEQ ID NO: 4356615 - DNA, 15 bp, Homo sapiens
cagcggtttggggag

SEQ ID NO: 4356616 - DNA, 18 bp, Homo sapiens
cagctaaagcccaacctc

SEQ ID NO: 4356617 - DNA, 13 bp, Homo sapiens
cagctctctgacg

SEQ ID NO: 4356618 - DNA, 15 bp, Homo sapiens
cagctctctgacgct

SEQ ID NO: 4356619 - DNA, 16 bp, Homo sapiens
cagctctctgacgctt

SEQ ID NO: 4356620 - DNA, 18 bp, Homo sapiens
cagctctggatgaaggca

SEQ ID NO: 4356621 - DNA, 13 bp, Homo sapiens
cagctgggcaggg

SEQ ID NO: 4356622 - DNA, 19 bp, Homo sapiens
cagctgtaagaagagactg

SEQ ID NO: 4356623 - DNA, 20 bp, Homo sapiens
cagctgtaagaagagactgg

SEQ ID NO: 4356624 - DNA, 14 bp, Homo sapiens
cagcttaaattctt

SEQ ID NO: 4356625 - DNA, 17 bp, Homo sapiens
cagcttcaaatgcaaat

SEQ ID NO: 4356626 - DNA, 16 bp, Homo sapiens
cagcttgactgctttt

SEQ ID NO: 4356627 - DNA, 19 bp, Homo sapiens
caggaaaaatgaggaatcc

SEQ ID NO: 4356628 - DNA, 22 bp, Homo sapiens
caggaaatataaacttaaaata

SEQ ID NO: 4356629 - DNA, 14 bp, Homo sapiens
caaaagacaaaaat

SEQ ID NO: 4356630 - DNA, 19 bp, Homo sapiens
caaacaaaattgttcttgg

SEQ ID NO: 4356631 - DNA, 11 bp, Homo sapiens
caaacaaggaa

SEQ ID NO: 4356632 - DNA, 21 bp, Homo sapiens
caaacccagaggtggatgtta

SEQ ID NO: 4356633 - DNA, 14 bp, Homo sapiens
caaagaacagatgg

SEQ ID NO: 4356634 - DNA, 20 bp, Homo sapiens
caaagagaatcccacattag

SEQ ID NO: 4356635 - DNA, 14 bp, Homo sapiens
caaagagattcgaa

SEQ ID NO: 4356636 - DNA, 13 bp, Homo sapiens
caaaggagccttg

SEQ ID NO: 4356637 - DNA, 15 bp, Homo sapiens
caaaggagccttgat

SEQ ID NO: 4356638 - DNA, 15 bp, Homo sapiens
caaagtgagaaatga

SEQ ID NO: 4356639 - DNA, 21 bp, Homo sapiens
caaatgtgtttttctatatag

SEQ ID NO: 4356640 - DNA, 15 bp, Homo sapiens
caacatgcactgatg

SEQ ID NO: 4356641 - DNA, 18 bp, Homo sapiens
caacatgggagggatcag

SEQ ID NO: 4356642 - DNA, 20 bp, Homo sapiens
caacatgggagggatcagcc

SEQ ID NO: 4356643 - DNA, 22 bp, Homo sapiens
caacatgggagggatcagcccc

SEQ ID NO: 4356644 - DNA, 17 bp, Homo sapiens
caaccctgttttatact

SEQ ID NO: 4356645 - DNA, 21 bp, Homo sapiens
caacgggattgaagggtcctg

SEQ ID NO: 4356646 - DNA, 14 bp, Homo sapiens
caactgaaggggtg

SEQ ID NO: 4356647 - DNA, 23 bp, Homo sapiens
caactgaaggggtgcacccacct

SEQ ID NO: 4356648 - DNA, 13 bp, Homo sapiens
caacttttagatt

SEQ ID NO: 4356649 - DNA, 22 bp, Homo sapiens
caagaaatggcgtctgctctgg

SEQ ID NO: 4356650 - DNA, 15 bp, Homo sapiens
caagactcctcaggc

SEQ ID NO: 4356651 - DNA, 13 bp, Homo sapiens
caagagcccagca

SEQ ID NO: 4356652 - DNA, 21 bp, Homo sapiens
caagaggggcgggctcagagc

SEQ ID NO: 4356653 - DNA, 12 bp, Homo sapiens
caagatctttca

SEQ ID NO: 4356654 - DNA, 15 bp, Homo sapiens
caagatctttcagga

SEQ ID NO: 4356655 - DNA, 13 bp, Homo sapiens
caagcctgctggc

SEQ ID NO: 4356656 - DNA, 19 bp, Homo sapiens
caaggaagaagaaatcttt

SEQ ID NO: 4356657 - DNA, 14 bp, Homo sapiens
caaggagctactga

SEQ ID NO: 4356658 - DNA, 20 bp, Homo sapiens
caaggagctactgacattcc

SEQ ID NO: 4356659 - DNA, 16 bp, Homo sapiens
caagggggtgactgga

SEQ ID NO: 4356660 - DNA, 15 bp, Homo sapiens
caagtatgccttaag

SEQ ID NO: 4356661 - DNA, 18 bp, Homo sapiens
caagtatgccttaagcag

SEQ ID NO: 4356662 - DNA, 22 bp, Homo sapiens
caagtatgccttaagcagaaca

SEQ ID NO: 4356663 - DNA, 23 bp, Homo sapiens
caagtatgccttaagcagaacaa

SEQ ID NO: 4356664 - DNA, 14 bp, Homo sapiens
caagtctccttccc

SEQ ID NO: 4356665 - DNA, 15 bp, Homo sapiens
caagttcccaactga

SEQ ID NO: 4356666 - DNA, 15 bp, Homo sapiens
caataaaatgtgatt

SEQ ID NO: 4356667 - DNA, 16 bp, Homo sapiens
caataaaatgtgattt

SEQ ID NO: 4356668 - DNA, 20 bp, Homo sapiens
caataaaatgtgatttttct

SEQ ID NO: 4356669 - DNA, 22 bp, Homo sapiens
caataaaatgtgatttttctga

SEQ ID NO: 4356670 - DNA, 18 bp, Homo sapiens
caataagttacttgaaat

SEQ ID NO: 4356671 - DNA, 17 bp, Homo sapiens
caataatttgtacaatg

SEQ ID NO: 4356672 - DNA, 22 bp, Homo sapiens
caataatttgtacaatggttta

SEQ ID NO: 4356673 - DNA, 22 bp, Homo sapiens
caatcatggtcaagttcccaac

SEQ ID NO: 4356674 - DNA, 17 bp, Homo sapiens
caattaaaccgcatgtg

SEQ ID NO: 4356675 - DNA, 16 bp, Homo sapiens
caattaggaagtgtaa

SEQ ID NO: 4356676 - DNA, 20 bp, Homo sapiens
caattaggaagtgtaacagc

SEQ ID NO: 4356677 - DNA, 13 bp, Homo sapiens
caatttggtaaaa

SEQ ID NO: 4356678 - DNA, 19 bp, Homo sapiens
cacaattaaaccgcatgtg

SEQ ID NO: 4356679 - DNA, 18 bp, Homo sapiens
cacacaaacctactgccc

SEQ ID NO: 4356680 - DNA, 18 bp, Homo sapiens
agtggtctttctggagag

SEQ ID NO: 4356681 - DNA, 21 bp, Homo sapiens
agtgtaaatcctttttcttta

SEQ ID NO: 4356682 - DNA, 14 bp, Homo sapiens
agtgtaacagctga

SEQ ID NO: 4356683 - DNA, 15 bp, Homo sapiens
agtgtaacagctgag

SEQ ID NO: 4356684 - DNA, 19 bp, Homo sapiens
agtgtgagtaagagctggt

SEQ ID NO: 4356685 - DNA, 14 bp, Homo sapiens
agttacagaattcc

SEQ ID NO: 4356686 - DNA, 15 bp, Homo sapiens
agttacagaattcct

SEQ ID NO: 4356687 - DNA, 14 bp, Homo sapiens
agttacttgaaata

SEQ ID NO: 4356688 - DNA, 15 bp, Homo sapiens
agttacttgaaataa

SEQ ID NO: 4356689 - DNA, 16 bp, Homo sapiens
agttcatccaatcctc

SEQ ID NO: 4356690 - DNA, 15 bp, Homo sapiens
agttccttgccttaa

SEQ ID NO: 4356691 - DNA, 20 bp, Homo sapiens
agttccttgccttaataaat

SEQ ID NO: 4356692 - DNA, 15 bp, Homo sapiens
agttctgctgccctc

SEQ ID NO: 4356693 - DNA, 21 bp, Homo sapiens
agttgcctgactcctgggtgg

SEQ ID NO: 4356694 - DNA, 12 bp, Homo sapiens
agttggaaggat

SEQ ID NO: 4356695 - DNA, 15 bp, Homo sapiens
agttggaaggatctg

SEQ ID NO: 4356696 - DNA, 18 bp, Homo sapiens
agttgtggatatcagggt

SEQ ID NO: 4356697 - DNA, 17 bp, Homo sapiens
agtttacattgtcctgt

SEQ ID NO: 4356698 - DNA, 15 bp, Homo sapiens
agtttgaaaaactaa

SEQ ID NO: 4356699 - DNA, 13 bp, Homo sapiens
agtttggccctgg

SEQ ID NO: 4356700 - DNA, 16 bp, Homo sapiens
agtttggccctggagc

SEQ ID NO: 4356701 - DNA, 19 bp, Homo sapiens
agtttggccctggagccag

SEQ ID NO: 4356702 - DNA, 14 bp, Homo sapiens
agtttgtattttgc

SEQ ID NO: 4356703 - DNA, 15 bp, Homo sapiens
agtttgtattttgca

SEQ ID NO: 4356704 - DNA, 19 bp, Homo sapiens
agtttgtattttgcatact

SEQ ID NO: 4356705 - DNA, 14 bp, Homo sapiens
agttttcaaactgc

SEQ ID NO: 4356706 - DNA, 23 bp, Homo sapiens
agttttcttggtggcagaatgaa

SEQ ID NO: 4356707 - DNA, 12 bp, Homo sapiens
agttttgtctgt

SEQ ID NO: 4356708 - DNA, 17 bp, Homo sapiens
agtttttatatgttgta

SEQ ID NO: 4356709 - DNA, 20 bp, Homo sapiens
ataaaatgtgatttttctga

SEQ ID NO: 4356710 - DNA, 13 bp, Homo sapiens
ataaaatttgaaa

SEQ ID NO: 4356711 - DNA, 14 bp, Homo sapiens
ataaataaaagtac

SEQ ID NO: 4356712 - DNA, 14 bp, Homo sapiens
ataaatatgtaata

SEQ ID NO: 4356713 - DNA, 16 bp, Homo sapiens
ataaatcgggaaattt

SEQ ID NO: 4356714 - DNA, 13 bp, Homo sapiens
ataaattcagata

SEQ ID NO: 4356715 - DNA, 17 bp, Homo sapiens
ataacaagatctttcag

SEQ ID NO: 4356716 - DNA, 17 bp, Homo sapiens
ataagttacttgaaata

SEQ ID NO: 4356717 - DNA, 13 bp, Homo sapiens
ataagttgtttca

SEQ ID NO: 4356718 - DNA, 13 bp, Homo sapiens
ataatcaggaaaa

SEQ ID NO: 4356719 - DNA, 20 bp, Homo sapiens
ataatgttgccttggaaaca

SEQ ID NO: 4356720 - DNA, 21 bp, Homo sapiens
ataatgttgccttggaaacat

SEQ ID NO: 4356721 - DNA, 16 bp, Homo sapiens
ataattctgaaatgtt

SEQ ID NO: 4356722 - DNA, 14 bp, Homo sapiens
ataatttgtacaat

SEQ ID NO: 4356723 - DNA, 21 bp, Homo sapiens
ataatttgtacaatggtttat

SEQ ID NO: 4356724 - DNA, 20 bp, Homo sapiens
atacactgaatggaaataaa

SEQ ID NO: 4356725 - DNA, 16 bp, Homo sapiens
ataccctccctcccta

SEQ ID NO: 4356726 - DNA, 20 bp, Homo sapiens
atactatattaaattctgaa

SEQ ID NO: 4356727 - DNA, 16 bp, Homo sapiens
atactctgtcagatgg

SEQ ID NO: 4356728 - DNA, 22 bp, Homo sapiens
atactgattgggaggtgcgtgt

SEQ ID NO: 4356729 - DNA, 18 bp, Homo sapiens
atactttgacaaggaaaa

SEQ ID NO: 4356730 - DNA, 20 bp, Homo sapiens
atagagagcaatttgtctgg

SEQ ID NO: 4356731 - DNA, 22 bp, Homo sapiens
atagatgtccctttcttggcca

SEQ ID NO: 4356732 - DNA, 23 bp, Homo sapiens
atagatgtccctttcttggccag

SEQ ID NO: 4356733 - DNA, 21 bp, Homo sapiens
atagccagcattcagcacaca

SEQ ID NO: 4356734 - DNA, 23 bp, Homo sapiens
atagccagcattcagcacacaca

SEQ ID NO: 4356735 - DNA, 14 bp, Homo sapiens
ataggcctgggtgc

SEQ ID NO: 4356736 - DNA, 14 bp, Homo sapiens
ataggctctgcaca

SEQ ID NO: 4356737 - DNA, 15 bp, Homo sapiens
ataggctctgcacag

SEQ ID NO: 4356738 - DNA, 19 bp, Homo sapiens
ataggctctgcacagatgg

SEQ ID NO: 4356739 - DNA, 16 bp, Homo sapiens
ataggtcactcctggg

SEQ ID NO: 4356740 - DNA, 15 bp, Homo sapiens
atataaatttaagca

SEQ ID NO: 4356741 - DNA, 19 bp, Homo sapiens
atataaatttaagcaaacg

SEQ ID NO: 4356742 - DNA, 16 bp, Homo sapiens
atataagcataaaaga

SEQ ID NO: 4356743 - DNA, 19 bp, Homo sapiens
atataagcataaaagatca

SEQ ID NO: 4356744 - DNA, 22 bp, Homo sapiens
atatagactatataatcagatt

SEQ ID NO: 4356745 - DNA, 19 bp, Homo sapiens
atatagttccttgccttaa

SEQ ID NO: 4356746 - DNA, 16 bp, Homo sapiens
atatgacccacactgc

SEQ ID NO: 4356747 - DNA, 22 bp, Homo sapiens
atatgacccacactgccagaag

SEQ ID NO: 4356748 - DNA, 14 bp, Homo sapiens
atatggaaatgtta

SEQ ID NO: 4356749 - DNA, 21 bp, Homo sapiens
atatgtaatataaatttaagc

SEQ ID NO: 4356750 - DNA, 22 bp, Homo sapiens
atatgtaatataaatttaagca

SEQ ID NO: 4356751 - DNA, 22 bp, Homo sapiens
atattagggactgtggtataat

SEQ ID NO: 4356752 - DNA, 15 bp, Homo sapiens
atattccatgaatgt

SEQ ID NO: 4356753 - DNA, 20 bp, Homo sapiens
atattcctggacttacaaaa

SEQ ID NO: 4356754 - DNA, 15 bp, Homo sapiens
atatttatatttcac

SEQ ID NO: 4356755 - DNA, 13 bp, Homo sapiens
atatttgtcttcc

SEQ ID NO: 4356756 - DNA, 13 bp, Homo sapiens
atcaaagaacaga

SEQ ID NO: 4356757 - DNA, 14 bp, Homo sapiens
atcaaagaacagat

SEQ ID NO: 4356758 - DNA, 20 bp, Homo sapiens
atcaaatctaccactgtatg

SEQ ID NO: 4356759 - DNA, 16 bp, Homo sapiens
atcaacatttatgacc

SEQ ID NO: 4356760 - DNA, 15 bp, Homo sapiens
atcaataaaatgtga

SEQ ID NO: 4356761 - DNA, 17 bp, Homo sapiens
atcacattaatctcaaa

SEQ ID NO: 4356762 - DNA, 23 bp, Homo sapiens
atcagagcatttattttggggag

SEQ ID NO: 4356763 - DNA, 23 bp, Homo sapiens
atcagcaacttctagcatataga

SEQ ID NO: 4356764 - DNA, 18 bp, Homo sapiens
atcagcatcaagtatgtg

SEQ ID NO: 4356765 - DNA, 13 bp, Homo sapiens
atcagccccgcct

SEQ ID NO: 4356766 - DNA, 21 bp, Homo sapiens
atcagccccgcctgtcacaat

SEQ ID NO: 4356767 - DNA, 18 bp, Homo sapiens
atcattccaattctaaat

SEQ ID NO: 4356768 - DNA, 20 bp, Homo sapiens
atccaaaagacaaaaatcaa

SEQ ID NO: 4356769 - DNA, 17 bp, Homo sapiens
atccaatcctcactggg

SEQ ID NO: 4356770 - DNA, 18 bp, Homo sapiens
atccatgttagtttttac

SEQ ID NO: 4356771 - DNA, 15 bp, Homo sapiens
atccccaccccaccc

SEQ ID NO: 4356772 - DNA, 20 bp, Homo sapiens
atccccttcccccatcccta

SEQ ID NO: 4356773 - DNA, 21 bp, Homo sapiens
atccccttcccccatccctac

SEQ ID NO: 4356774 - DNA, 19 bp, Homo sapiens
atcccttccttttagccta

SEQ ID NO: 4356775 - DNA, 16 bp, Homo sapiens
atcctgcaggaaatat

SEQ ID NO: 4356776 - DNA, 22 bp, Homo sapiens
atcctgcaggaaatataaactt

SEQ ID NO: 4356777 - DNA, 23 bp, Homo sapiens
atccttccatcttgtggggccag

SEQ ID NO: 4356778 - DNA, 15 bp, Homo sapiens
atcctttttctttat

SEQ ID NO: 4356779 - DNA, 20 bp, Homo sapiens
atctatatttgtcttccgat

SEQ ID NO: 4356780 - DNA, 15 bp, Homo sapiens
atctcctgtgcatgg

SEQ ID NO: 4356781 - DNA, 18 bp, Homo sapiens
atctcctgtgcatgggtg

SEQ ID NO: 4356782 - DNA, 22 bp, Homo sapiens
atctgcctctggaaaactattg

SEQ ID NO: 4356783 - DNA, 14 bp, Homo sapiens
atctgctataaact

SEQ ID NO: 4356784 - DNA, 22 bp, Homo sapiens
atctgctataaactttacatat

SEQ ID NO: 4356785 - DNA, 13 bp, Homo sapiens
atctggccctgac

SEQ ID NO: 4356786 - DNA, 20 bp, Homo sapiens
atctgtaagagcttgctcca

SEQ ID NO: 4356787 - DNA, 22 bp, Homo sapiens
atcttgtgagtggataatcagg

SEQ ID NO: 4356788 - DNA, 23 bp, Homo sapiens
atctttctccctcaactgaaggg

SEQ ID NO: 4356789 - DNA, 21 bp, Homo sapiens
atgaaaatcagcaacttctag

SEQ ID NO: 4356790 - DNA, 15 bp, Homo sapiens
atgaaataaaatttg

SEQ ID NO: 4356791 - DNA, 15 bp, Homo sapiens
atgaacagctgtgtc

SEQ ID NO: 4356792 - DNA, 23 bp, Homo sapiens
atgaacattttgtggagtttgta

SEQ ID NO: 4356793 - DNA, 14 bp, Homo sapiens
atgaagcaggaggc

SEQ ID NO: 4356794 - DNA, 12 bp, Homo sapiens
atgaagctgcca

SEQ ID NO: 4356795 - DNA, 21 bp, Homo sapiens
atgaagctgccatccttgctg

SEQ ID NO: 4356796 - DNA, 21 bp, Homo sapiens
atgaaggcaaaaactgtactg

SEQ ID NO: 4356797 - DNA, 22 bp, Homo sapiens
atgaaggcaaaaactgtactgt

SEQ ID NO: 4356798 - DNA, 22 bp, Homo sapiens
atgaataatttcccaattagga

SEQ ID NO: 4356799 - DNA, 18 bp, Homo sapiens
atgaatttgctaaataca

SEQ ID NO: 4356800 - DNA, 15 bp, Homo sapiens
atgacatgaaatgaa

SEQ ID NO: 4356801 - DNA, 14 bp, Homo sapiens
atgacccacactgc

SEQ ID NO: 4356802 - DNA, 20 bp, Homo sapiens
atgacccacactgccagaag

SEQ ID NO: 4356803 - DNA, 21 bp, Homo sapiens
atgacctgtgaccagcactgt

SEQ ID NO: 4356804 - DNA, 22 bp, Homo sapiens
atgacggtaagtgttctcatga

SEQ ID NO: 4356805 - DNA, 14 bp, Homo sapiens
atgactacatagta

SEQ ID NO: 4356806 - DNA, 13 bp, Homo sapiens
atgagtcagacac

SEQ ID NO: 4356807 - DNA, 21 bp, Homo sapiens
atgattcaaattgctgcttgg

SEQ ID NO: 4356808 - DNA, 17 bp, Homo sapiens
atgcaagtgaacaaagt

SEQ ID NO: 4356809 - DNA, 14 bp, Homo sapiens
atgcactgtggttt

SEQ ID NO: 4356810 - DNA, 21 bp, Homo sapiens
atgcactgtggtttcagatgt

SEQ ID NO: 4356811 - DNA, 23 bp, Homo sapiens
atgcactgtggtttcagatgtgc

SEQ ID NO: 4356812 - DNA, 19 bp, Homo sapiens
atgcagacctcatgcccag

SEQ ID NO: 4356813 - DNA, 20 bp, Homo sapiens
atgcagacctcatgcccagc

SEQ ID NO: 4356814 - DNA, 21 bp, Homo sapiens
atgcagacctcatgcccagct

SEQ ID NO: 4356815 - DNA, 14 bp, Homo sapiens
atgcaggaggtgga

SEQ ID NO: 4356816 - DNA, 18 bp, Homo sapiens
atgcattatatcaaatct

SEQ ID NO: 4356817 - DNA, 15 bp, Homo sapiens
atgccacacagagtg

SEQ ID NO: 4356818 - DNA, 18 bp, Homo sapiens
atgccacacagagtggtc

SEQ ID NO: 4356819 - DNA, 20 bp, Homo sapiens
atgccaccctgttttcagct

SEQ ID NO: 4356820 - DNA, 22 bp, Homo sapiens
atgcccctgcagtttggccctg

SEQ ID NO: 4356821 - DNA, 16 bp, Homo sapiens
atgccgtataaaagaa

SEQ ID NO: 4356822 - DNA, 17 bp, Homo sapiens
atggaaaccatttctgg

SEQ ID NO: 4356823 - DNA, 15 bp, Homo sapiens
atggagaagggttct

SEQ ID NO: 4356824 - DNA, 18 bp, Homo sapiens
atggagaagggttctgcc

SEQ ID NO: 4356825 - DNA, 15 bp, Homo sapiens
atggagatgggaagg

SEQ ID NO: 4356826 - DNA, 22 bp, Homo sapiens
atggaggggtggtcctgactca

SEQ ID NO: 4356827 - DNA, 15 bp, Homo sapiens
atggccatgcaggag

SEQ ID NO: 4356828 - DNA, 22 bp, Homo sapiens
atggccccaggcatctgcctct

SEQ ID NO: 4356829 - DNA, 17 bp, Homo sapiens
atggcgtctgctctggt

SEQ ID NO: 4356830 - DNA, 14 bp, Homo sapiens
atgggaagacatga

SEQ ID NO: 4356831 - DNA, 16 bp, Homo sapiens
atggggagggagggag

SEQ ID NO: 4356832 - DNA, 21 bp, Homo sapiens
atggggggcgggccagggtgg

SEQ ID NO: 4356833 - DNA, 22 bp, Homo sapiens
atggggggcgggccagggtggg

SEQ ID NO: 4356834 - DNA, 22 bp, Homo sapiens
atgggtgaagggagagccagct

SEQ ID NO: 4356835 - DNA, 13 bp, Homo sapiens
atggtaggggagg

SEQ ID NO: 4356836 - DNA, 16 bp, Homo sapiens
atggtaggggagggca

SEQ ID NO: 4356837 - DNA, 17 bp, Homo sapiens
atggtcaagttcccaac

SEQ ID NO: 4356838 - DNA, 19 bp, Homo sapiens
atggtgtctcccaacatgg

SEQ ID NO: 4356839 - DNA, 20 bp, Homo sapiens
atggttgggggaatgcacct

SEQ ID NO: 4356840 - DNA, 23 bp, Homo sapiens
atggtttattcccaagtatgcct

SEQ ID NO: 4356841 - DNA, 16 bp, Homo sapiens
atgtaaaaaatattaa

SEQ ID NO: 4356842 - DNA, 21 bp, Homo sapiens
atgtaaaaaatattaaagata

SEQ ID NO: 4356843 - DNA, 12 bp, Homo sapiens
atgtaaggcact

SEQ ID NO: 4356844 - DNA, 15 bp, Homo sapiens
atgtaaggcactgtc

SEQ ID NO: 4356845 - DNA, 21 bp, Homo sapiens
atgtatcaggaaatatatatg

SEQ ID NO: 4356846 - DNA, 19 bp, Homo sapiens
agctttgtcacttgccaca

SEQ ID NO: 4356847 - DNA, 13 bp, Homo sapiens
aggaaaaatgagg

SEQ ID NO: 4356848 - DNA, 22 bp, Homo sapiens
aggaagaaattcaggtacagaa

SEQ ID NO: 4356849 - DNA, 19 bp, Homo sapiens
aggaagagcccgcagggcc

SEQ ID NO: 4356850 - DNA, 12 bp, Homo sapiens
aggaagccaaag

SEQ ID NO: 4356851 - DNA, 17 bp, Homo sapiens
aggaagtgtaacagctg

SEQ ID NO: 4356852 - DNA, 18 bp, Homo sapiens
aggaagtgtaacagctga

SEQ ID NO: 4356853 - DNA, 15 bp, Homo sapiens
aggaatgtagggcct

SEQ ID NO: 4356854 - DNA, 13 bp, Homo sapiens
aggacacagcaca

SEQ ID NO: 4356855 - DNA, 17 bp, Homo sapiens
aggacagaggccggggt

SEQ ID NO: 4356856 - DNA, 13 bp, Homo sapiens
aggagagtggcag

SEQ ID NO: 4356857 - DNA, 18 bp, Homo sapiens
aggagagtggcaggtggg

SEQ ID NO: 4356858 - DNA, 18 bp, Homo sapiens
aggagcccagccagaaag

SEQ ID NO: 4356859 - DNA, 20 bp, Homo sapiens
aggagcccagccagaaagca

SEQ ID NO: 4356860 - DNA, 17 bp, Homo sapiens
aggagccttgctgggcc

SEQ ID NO: 4356861 - DNA, 18 bp, Homo sapiens
aggagctagcccagtccc

SEQ ID NO: 4356862 - DNA, 24 bp, Homo sapiens
aggagctagcccagtccctggagc

SEQ ID NO: 4356863 - DNA, 12 bp, Homo sapiens
aggagctgggcc

SEQ ID NO: 4356864 - DNA, 22 bp, Homo sapiens
aggaggagccttgctgggccag

SEQ ID NO: 4356865 - DNA, 13 bp, Homo sapiens
aggaggaggagcc

SEQ ID NO: 4356866 - DNA, 15 bp, Homo sapiens
aggaggtacaaaagt

SEQ ID NO: 4356867 - DNA, 13 bp, Homo sapiens
aggaggtggagaa

SEQ ID NO: 4356868 - DNA, 21 bp, Homo sapiens
aggatctgctgaggcccagtg

SEQ ID NO: 4356869 - DNA, 15 bp, Homo sapiens
aggcaaataaagatg

SEQ ID NO: 4356870 - DNA, 21 bp, Homo sapiens
aggcagcaccacactgggtgc

SEQ ID NO: 4356871 - DNA, 15 bp, Homo sapiens
aggcataggcctggg

SEQ ID NO: 4356872 - DNA, 20 bp, Homo sapiens
aggcataggcctgggtgctg

SEQ ID NO: 4356873 - DNA, 18 bp, Homo sapiens
aggcatgttcccagaaag

SEQ ID NO: 4356874 - DNA, 20 bp, Homo sapiens
aggcccccaaattgccttca

SEQ ID NO: 4356875 - DNA, 11 bp, Homo sapiens
aggcctctggt

SEQ ID NO: 4356876 - DNA, 18 bp, Homo sapiens
aggcctctggttgcctcc

SEQ ID NO: 4356877 - DNA, 12 bp, Homo sapiens
aggcctgggtgc

SEQ ID NO: 4356878 - DNA, 15 bp, Homo sapiens
aggcctgtccaccct

SEQ ID NO: 4356879 - DNA, 13 bp, Homo sapiens
aggctaaaattag

SEQ ID NO: 4356880 - DNA, 17 bp, Homo sapiens
aggctctgcacagatgg

SEQ ID NO: 4356881 - DNA, 12 bp, Homo sapiens
aggctgcctcag

SEQ ID NO: 4356882 - DNA, 18 bp, Homo sapiens
aggctgcctcagccagtg

SEQ ID NO: 4356883 - DNA, 19 bp, Homo sapiens
aggcttggggaaaatggcc

SEQ ID NO: 4356884 - DNA, 12 bp, Homo sapiens
agggaagaccag

SEQ ID NO: 4356885 - DNA, 14 bp, Homo sapiens
agggaagagtgcat

SEQ ID NO: 4356886 - DNA, 13 bp, Homo sapiens
agggaaggagccc

SEQ ID NO: 4356887 - DNA, 23 bp, Homo sapiens
aaatatatatgtgtgtgtatgtt

SEQ ID NO: 4356888 - DNA, 23 bp, Homo sapiens
aaatatgtaatataaatttaagc

SEQ ID NO: 4356889 - DNA, 13 bp, Homo sapiens
aaatattaaagat

SEQ ID NO: 4356890 - DNA, 12 bp, Homo sapiens
aaatatttcctt

SEQ ID NO: 4356891 - DNA, 13 bp, Homo sapiens
aaatcaaagaaca

SEQ ID NO: 4356892 - DNA, 15 bp, Homo sapiens
aaatccgacttgaat

SEQ ID NO: 4356893 - DNA, 22 bp, Homo sapiens
aaatccgacttgaatattcctg

SEQ ID NO: 4356894 - DNA, 19 bp, Homo sapiens
aaatcctttttctttataa

SEQ ID NO: 4356895 - DNA, 21 bp, Homo sapiens
aaatcgatgagcgccacctct

SEQ ID NO: 4356896 - DNA, 13 bp, Homo sapiens
aaatctaccactg

SEQ ID NO: 4356897 - DNA, 17 bp, Homo sapiens
aaatctaccactgtatg

SEQ ID NO: 4356898 - DNA, 12 bp, Homo sapiens
aaatctgagttt

SEQ ID NO: 4356899 - DNA, 18 bp, Homo sapiens
aaatgaaagcatgtctca

SEQ ID NO: 4356900 - DNA, 17 bp, Homo sapiens
aaatgaataatttccca

SEQ ID NO: 4356901 - DNA, 15 bp, Homo sapiens
aaatgaccaaagatg

SEQ ID NO: 4356902 - DNA, 22 bp, Homo sapiens
aaatgaggaatccaaaagacaa

SEQ ID NO: 4356903 - DNA, 20 bp, Homo sapiens
aaatgccaagggggtgactg

SEQ ID NO: 4356904 - DNA, 23 bp, Homo sapiens
aaatgccaagggggtgactggaa

SEQ ID NO: 4356905 - DNA, 18 bp, Homo sapiens
aaatggccatgcaggagg

SEQ ID NO: 4356906 - DNA, 20 bp, Homo sapiens
aaattagttttaaaatacta

SEQ ID NO: 4356907 - DNA, 13 bp, Homo sapiens
aaattatatccgt

SEQ ID NO: 4356908 - DNA, 19 bp, Homo sapiens
aaattatatccgtgagttg

SEQ ID NO: 4356909 - DNA, 16 bp, Homo sapiens
aaattctgaatgcaat

SEQ ID NO: 4356910 - DNA, 13 bp, Homo sapiens
aaattgccttcag

SEQ ID NO: 4356911 - DNA, 21 bp, Homo sapiens
aaattgttcttgggagaaaat

SEQ ID NO: 4356912 - DNA, 21 bp, Homo sapiens
aaatttacatcagaagtttgc

SEQ ID NO: 4356913 - DNA, 22 bp, Homo sapiens
aacaaatgtgtttttctatata

SEQ ID NO: 4356914 - DNA, 22 bp, Homo sapiens
aacaaatttacatcagaagttt

SEQ ID NO: 4356915 - DNA, 16 bp, Homo sapiens
aacaactaggcttcag

SEQ ID NO: 4356916 - DNA, 17 bp, Homo sapiens
aacaagattaaatatcc

SEQ ID NO: 4356917 - DNA, 14 bp, Homo sapiens
aacaagcgtttatt

SEQ ID NO: 4356918 - DNA, 20 bp, Homo sapiens
aacacacgagcaaacccaga

SEQ ID NO: 4356919 - DNA, 22 bp, Homo sapiens
aacagatggggtctgtgactgg

SEQ ID NO: 4356920 - DNA, 23 bp, Homo sapiens
aacagctgtgtctgccaaacaca

SEQ ID NO: 4356921 - DNA, 20 bp, Homo sapiens
aacaggaccacaaaaatgaa

SEQ ID NO: 4356922 - DNA, 18 bp, Homo sapiens
aacatagtttaagttgat

SEQ ID NO: 4356923 - DNA, 17 bp, Homo sapiens
aacatgggagggatcag

SEQ ID NO: 4356924 - DNA, 21 bp, Homo sapiens
aacatgggagggatcagcccc

SEQ ID NO: 4356925 - DNA, 16 bp, Homo sapiens
aacatgttactgacca

SEQ ID NO: 4356926 - DNA, 23 bp, Homo sapiens
aacatgttgatttagtcttcttt

SEQ ID NO: 4356927 - DNA, 13 bp, Homo sapiens
aacatttatgacc

SEQ ID NO: 4356928 - DNA, 23 bp, Homo sapiens
aacattttgtggagtttgtattt

SEQ ID NO: 4356929 - DNA, 17 bp, Homo sapiens
aacatttttgagatatt

SEQ ID NO: 4356930 - DNA, 10 bp, Homo sapiens
aaccaagttc

SEQ ID NO: 4356931 - DNA, 12 bp, Homo sapiens
aaccacagctgg

SEQ ID NO: 4356932 - DNA, 22 bp, Homo sapiens
aaccctgttttatactgtactt

SEQ ID NO: 4356933 - DNA, 23 bp, Homo sapiens
aaccctgttttatactgtactta

SEQ ID NO: 4356934 - DNA, 15 bp, Homo sapiens
aacctgcacacagga

SEQ ID NO: 4356935 - DNA, 21 bp, Homo sapiens
aaccttggagaggagagtggc

SEQ ID NO: 4356936 - DNA, 18 bp, Homo sapiens
aactacaaagtaaaatga

SEQ ID NO: 4356937 - DNA, 11 bp, Homo sapiens
aactagtaata

SEQ ID NO: 4356938 - DNA, 17 bp, Homo sapiens
aactgaaggggtgcacc

SEQ ID NO: 4356939 - DNA, 19 bp, Homo sapiens
aactgacaaaggagccttg

SEQ ID NO: 4356940 - DNA, 21 bp, Homo sapiens
aactgacaaaggagccttgat

SEQ ID NO: 4356941 - DNA, 21 bp, Homo sapiens
aactgagtcatcttgtgagtg

SEQ ID NO: 4356942 - DNA, 17 bp, Homo sapiens
aactgctgcatactttg

SEQ ID NO: 4356943 - DNA, 15 bp, Homo sapiens
aactgggctgggcct

SEQ ID NO: 4356944 - DNA, 23 bp, Homo sapiens
aactgggttctttggaagcagcc

SEQ ID NO: 4356945 - DNA, 14 bp, Homo sapiens
aactgtactgtgtt

SEQ ID NO: 4356946 - DNA, 22 bp, Homo sapiens
aactgtcagtgtacacgtctgg

SEQ ID NO: 4356947 - DNA, 18 bp, Homo sapiens
aactgttggattcagaaa

SEQ ID NO: 4356948 - DNA, 19 bp, Homo sapiens
aacttaaaactttgtagaa

SEQ ID NO: 4356949 - DNA, 16 bp, Homo sapiens
aacttaaaataaaatt

SEQ ID NO: 4356950 - DNA, 19 bp, Homo sapiens
aacttctagcatatagact

SEQ ID NO: 4356951 - DNA, 22 bp, Homo sapiens
aactttgtagaaagcaaacaaa

SEQ ID NO: 4356952 - DNA, 19 bp, Homo sapiens
aagaaaatatttttaaatg

SEQ ID NO: 4356953 - DNA, 21 bp, Homo sapiens
aagaaatgattcaaattgctg

SEQ ID NO: 4356954 - DNA, 11 bp, Homo sapiens
aagaaatggcg

SEQ ID NO: 4356955 - DNA, 20 bp, Homo sapiens
aagaaatggcgtctgctctg

SEQ ID NO: 4356956 - DNA, 21 bp, Homo sapiens
aagaaatggcgtctgctctgg

SEQ ID NO: 4356957 - DNA, 15 bp, Homo sapiens
aagaaattcaggtac

SEQ ID NO: 4356958 - DNA, 20 bp, Homo sapiens
aagaaattcaggtacagaaa

SEQ ID NO: 4356959 - DNA, 12 bp, Homo sapiens
aagaacagatgg

SEQ ID NO: 4356960 - DNA, 16 bp, Homo sapiens
aagaattgagcagttc

SEQ ID NO: 4356961 - DNA, 18 bp, Homo sapiens
aagacaaaaatcaaagaa

SEQ ID NO: 4356962 - DNA, 22 bp, Homo sapiens
aagacaaaaatcaaagaacaga

SEQ ID NO: 4356963 - DNA, 23 bp, Homo sapiens
aagaccagaattcccttgaattg

SEQ ID NO: 4356964 - DNA, 17 bp, Homo sapiens
aagagaattcagtattt

SEQ ID NO: 4356965 - DNA, 15 bp, Homo sapiens
aagagccggtggtgc

SEQ ID NO: 4356966 - DNA, 17 bp, Homo sapiens
aagagcttgctccagat

SEQ ID NO: 4356967 - DNA, 20 bp, Homo sapiens
aagagcttgctccagattct

SEQ ID NO: 4356968 - DNA, 18 bp, Homo sapiens
aagaggaagaaattcagg

SEQ ID NO: 4356969 - DNA, 19 bp, Homo sapiens
aagaggaagaaattcaggt

SEQ ID NO: 4356970 - DNA, 18 bp, Homo sapiens
aagaggggcgggctcaga

SEQ ID NO: 4356971 - DNA, 12 bp, Homo sapiens
aagagtggagga

SEQ ID NO: 4356972 - DNA, 21 bp, Homo sapiens
aagataacaagatctttcagg

SEQ ID NO: 4356973 - DNA, 16 bp, Homo sapiens
aagataggctctgcac

SEQ ID NO: 4356974 - DNA, 17 bp, Homo sapiens
aagataggctctgcaca

SEQ ID NO: 4356975 - DNA, 18 bp, Homo sapiens
aagataggctctgcacag

SEQ ID NO: 4356976 - DNA, 20 bp, Homo sapiens
aagatgctacaatggaaacc

SEQ ID NO: 4356977 - DNA, 15 bp, Homo sapiens
aagatgtatgttgct

SEQ ID NO: 4356978 - DNA, 18 bp, Homo sapiens
aagcacacacatctggcc

SEQ ID NO: 4356979 - DNA, 16 bp, Homo sapiens
aagcataaaagatcac

SEQ ID NO: 4356980 - DNA, 13 bp, Homo sapiens
aagcatccctcac

SEQ ID NO: 4356981 - DNA, 23 bp, Homo sapiens
aagccaaagttttcaaactgctg

SEQ ID NO: 4356982 - DNA, 15 bp, Homo sapiens
aagcctgctggctgc

SEQ ID NO: 4356983 - DNA, 20 bp, Homo sapiens
aagcctggattccagcagtg

SEQ ID NO: 4356984 - DNA, 17 bp, Homo sapiens
aaggaaaatctatattt

SEQ ID NO: 4356985 - DNA, 12 bp, Homo sapiens
aaggatctgctg

SEQ ID NO: 4356986 - DNA, 16 bp, Homo sapiens
aaggatctgctgaggc

SEQ ID NO: 4356987 - DNA, 20 bp, Homo sapiens
aaggatctgctgaggcccag

SEQ ID NO: 4356988 - DNA, 11 bp, Homo sapiens
aaggcactgtc

SEQ ID NO: 4356989 - DNA, 19 bp, Homo sapiens
aaggcactgtcaggaatgg

SEQ ID NO: 4356990 - DNA, 12 bp, Homo sapiens
aaggcagccctc

SEQ ID NO: 4356991 - DNA, 21 bp, Homo sapiens
aaggcagccctcacctctgag

SEQ ID NO: 4356992 - DNA, 19 bp, Homo sapiens
aaggcatgttcccagaaag

SEQ ID NO: 4356993 - DNA, 17 bp, Homo sapiens
aaggtgagaattaagtt

SEQ ID NO: 4356994 - DNA, 20 bp, Homo sapiens
aaggtgcctcatagcatagc

SEQ ID NO: 4356995 - DNA, 15 bp, Homo sapiens
aagtaaaatgaacat

SEQ ID NO: 4356996 - DNA, 16 bp, Homo sapiens
aagtatgccttaagca

SEQ ID NO: 4356997 - DNA, 18 bp, Homo sapiens
aagtatgccttaagcaga

SEQ ID NO: 4356998 - DNA, 21 bp, Homo sapiens
aagtcaatctatcttcagttt

SEQ ID NO: 4356999 - DNA, 16 bp, Homo sapiens
aagtctaaatatttcc

SEQ ID NO: 4357000 - DNA, 17 bp, Homo sapiens
aagtgagcagaacaggt

SEQ ID NO: 4357001 - DNA, 14 bp, Homo sapiens
aagtgatcaataaa

SEQ ID NO: 4357002 - DNA, 23 bp, Homo sapiens
aagtgatcaataaaatgtgattt

SEQ ID NO: 4357003 - DNA, 15 bp, Homo sapiens
aagtgtaaatgttaa

SEQ ID NO: 4357004 - DNA, 16 bp, Homo sapiens
aagtgtaacagctgag

SEQ ID NO: 4357005 - DNA, 20 bp, Homo sapiens
aagtgttctcatgaagcagg

SEQ ID NO: 4357006 - DNA, 14 bp, Homo sapiens
agcaccacactggg

SEQ ID NO: 4357007 - DNA, 16 bp, Homo sapiens
agcactacaatcatgg

SEQ ID NO: 4357008 - DNA, 20 bp, Homo sapiens
agcactgtctcagtttcact

SEQ ID NO: 4357009 - DNA, 16 bp, Homo sapiens
agcactttaaacttaa

SEQ ID NO: 4357010 - DNA, 13 bp, Homo sapiens
agcagaacaaatg

SEQ ID NO: 4357011 - DNA, 21 bp, Homo sapiens
agcagaacaaatgtgtttttc

SEQ ID NO: 4357012 - DNA, 18 bp, Homo sapiens
agcagaacctgcacacag

SEQ ID NO: 4357013 - DNA, 20 bp, Homo sapiens
agcaggcctctggttgcctc

SEQ ID NO: 4357014 - DNA, 21 bp, Homo sapiens
agcaggcctctggttgcctcc

SEQ ID NO: 4357015 - DNA, 22 bp, Homo sapiens
agcagttattcccttacctgaa

SEQ ID NO: 4357016 - DNA, 22 bp, Homo sapiens
agcatagccagcattcagcaca

SEQ ID NO: 4357017 - DNA, 16 bp, Homo sapiens
agcatatagactatat

SEQ ID NO: 4357018 - DNA, 18 bp, Homo sapiens
agcatgacctgtgaccag

SEQ ID NO: 4357019 - DNA, 22 bp, Homo sapiens
agcatgacctgtgaccagcact

SEQ ID NO: 4357020 - DNA, 14 bp, Homo sapiens
agcattcagcacac

SEQ ID NO: 4357021 - DNA, 15 bp, Homo sapiens
agcattcagcacaca

SEQ ID NO: 4357022 - DNA, 14 bp, Homo sapiens
agcatttttatgca

SEQ ID NO: 4357023 - DNA, 16 bp, Homo sapiens
agcatttttatgcaga

SEQ ID NO: 4357024 - DNA, 18 bp, Homo sapiens
agcatttttatgcagaca

SEQ ID NO: 4357025 - DNA, 19 bp, Homo sapiens
agcatttttatgcagacag

SEQ ID NO: 4357026 - DNA, 21 bp, Homo sapiens
agccaaagttttcaaactgct

SEQ ID NO: 4357027 - DNA, 21 bp, Homo sapiens
agccacccaagcctgctggct

SEQ ID NO: 4357028 - DNA, 21 bp, Homo sapiens
agccacccgtggggtgctgcc

SEQ ID NO: 4357029 - DNA, 23 bp, Homo sapiens
agccacccgtggggtgctgccct

SEQ ID NO: 4357030 - DNA, 17 bp, Homo sapiens
agccagcattcagcaca

SEQ ID NO: 4357031 - DNA, 19 bp, Homo sapiens
agccagggcagaggaatgt

SEQ ID NO: 4357032 - DNA, 12 bp, Homo sapiens
agccattaatga

SEQ ID NO: 4357033 - DNA, 20 bp, Homo sapiens
agcccagcagggcctcaaag

SEQ ID NO: 4357034 - DNA, 21 bp, Homo sapiens
agcccagtccctggagctgtc

SEQ ID NO: 4357035 - DNA, 14 bp, Homo sapiens
agccccgcctgtca

SEQ ID NO: 4357036 - DNA, 16 bp, Homo sapiens
agccccgcctgtcaca

SEQ ID NO: 4357037 - DNA, 13 bp, Homo sapiens
agccccttggaga

SEQ ID NO: 4357038 - DNA, 14 bp, Homo sapiens
agcccgcagggcca

SEQ ID NO: 4357039 - DNA, 20 bp, Homo sapiens
agcccgcagggccatgcaga

SEQ ID NO: 4357040 - DNA, 18 bp, Homo sapiens
agccctaacatagtgtct

SEQ ID NO: 4357041 - DNA, 14 bp, Homo sapiens
agccctcacctctg

SEQ ID NO: 4357042 - DNA, 21 bp, Homo sapiens
agccctcacctctgaggacag

SEQ ID NO: 4357043 - DNA, 23 bp, Homo sapiens
agccctcacctctgaggacagag

SEQ ID NO: 4357044 - DNA, 16 bp, Homo sapiens
agccctctccaccctc

SEQ ID NO: 4357045 - DNA, 22 bp, Homo sapiens
agcccttctatacccacccaga

SEQ ID NO: 4357046 - DNA, 20 bp, Homo sapiens
agcctagttcatccaatcct

SEQ ID NO: 4357047 - DNA, 20 bp, Homo sapiens
agcctcgttggagagcagca

SEQ ID NO: 4357048 - DNA, 14 bp, Homo sapiens
agcctctccaggaa

SEQ ID NO: 4357049 - DNA, 17 bp, Homo sapiens
agcctgaaagatacagg

SEQ ID NO: 4357050 - DNA, 11 bp, Homo sapiens
agcctgctggc

SEQ ID NO: 4357051 - DNA, 14 bp, Homo sapiens
agcctgctggctgc

SEQ ID NO: 4357052 - DNA, 19 bp, Homo sapiens
agcctgctggctgcggccc

SEQ ID NO: 4357053 - DNA, 18 bp, Homo sapiens
agccttgataatacttga

SEQ ID NO: 4357054 - DNA, 17 bp, Homo sapiens
agccttgcatgtacttg

SEQ ID NO: 4357055 - DNA, 15 bp, Homo sapiens
agccttgctgggcca

SEQ ID NO: 4357056 - DNA, 16 bp, Homo sapiens
agccttgctgggccag

SEQ ID NO: 4357057 - DNA, 14 bp, Homo sapiens
agcggtttggggag

SEQ ID NO: 4357058 - DNA, 20 bp, Homo sapiens
agctctaagagcaattctgg

SEQ ID NO: 4357059 - DNA, 13 bp, Homo sapiens
agctctctgacgc

SEQ ID NO: 4357060 - DNA, 22 bp, Homo sapiens
agctctctgacgcttgtgacag

SEQ ID NO: 4357061 - DNA, 15 bp, Homo sapiens
agctgaagaaaatga

SEQ ID NO: 4357062 - DNA, 14 bp, Homo sapiens
agctgggcccctgc

SEQ ID NO: 4357063 - DNA, 22 bp, Homo sapiens
agctgggcccctgcacaggcac

SEQ ID NO: 4357064 - DNA, 18 bp, Homo sapiens
agctgtaagaagagactg

SEQ ID NO: 4357065 - DNA, 13 bp, Homo sapiens
agctgtgtctgcc

SEQ ID NO: 4357066 - DNA, 14 bp, Homo sapiens
agcttcaaatgcaa

SEQ ID NO: 4357067 - DNA, 17 bp, Homo sapiens
agctttgtcacttgcca

SEQ ID NO: 4357068 - DNA, 20 bp, Homo sapiens
aggaaaaatgaggaatccaa

SEQ ID NO: 4357069 - DNA, 13 bp, Homo sapiens
aggaactgggctg

SEQ ID NO: 4357070 - DNA, 18 bp, Homo sapiens
aggaactgggctgggcct

SEQ ID NO: 4357071 - DNA, 19 bp, Homo sapiens
aggaagaaattcaggtaca

SEQ ID NO: 4357072 - DNA, 20 bp, Homo sapiens
aggaagaagaaatctttctc

SEQ ID NO: 4357073 - DNA, 16 bp, Homo sapiens
aggaagtgtaacagct

SEQ ID NO: 4357074 - DNA, 17 bp, Homo sapiens
aggaataacactgcagc

SEQ ID NO: 4357075 - DNA, 24 bp, Homo sapiens
aggaatgcctcctccctgggcaga

SEQ ID NO: 4357076 - DNA, 21 bp, Homo sapiens
aggaatggggggcgggccagg

SEQ ID NO: 4357077 - DNA, 22 bp, Homo sapiens
aggacacagcacaagggcacat

SEQ ID NO: 4357078 - DNA, 22 bp, Homo sapiens
aggaccactcctgtacactgaa

SEQ ID NO: 4357079 - DNA, 16 bp, Homo sapiens
aggactgcagtgtgga

SEQ ID NO: 4357080 - DNA, 16 bp, Homo sapiens
aggagcccagccagaa

SEQ ID NO: 4357081 - DNA, 11 bp, Homo sapiens
aggagccttga

SEQ ID NO: 4357082 - DNA, 14 bp, Homo sapiens
aggagccttgctgg

SEQ ID NO: 4357083 - DNA, 21 bp, Homo sapiens
aggagccttgctgggccaggg

SEQ ID NO: 4357084 - DNA, 19 bp, Homo sapiens
aggagctagcccagtccct

SEQ ID NO: 4357085 - DNA, 17 bp, Homo sapiens
aggaggacacagcacaa

SEQ ID NO: 4357086 - DNA, 11 bp, Homo sapiens
aggaggagcct

SEQ ID NO: 4357087 - DNA, 19 bp, Homo sapiens
aggaggagccttgctgggc

SEQ ID NO: 4357088 - DNA, 23 bp, Homo sapiens
aggaggagccttgctgggccagg

SEQ ID NO: 4357089 - DNA, 23 bp, Homo sapiens
aggaggcccttgtcgtgggatgg

SEQ ID NO: 4357090 - DNA, 22 bp, Homo sapiens
aggagttgcctgactcctgggt

SEQ ID NO: 4357091 - DNA, 16 bp, Homo sapiens
aggatctgctgaggcc

SEQ ID NO: 4357092 - DNA, 19 bp, Homo sapiens
aggatctgctgaggcccag

SEQ ID NO: 4357093 - DNA, 22 bp, Homo sapiens
aggatctgctgaggcccagtgc

SEQ ID NO: 4357094 - DNA, 23 bp, Homo sapiens
aggatctgctgaggcccagtgca

SEQ ID NO: 4357095 - DNA, 21 bp, Homo sapiens
aggatggatgagtcagacacg

SEQ ID NO: 4357096 - DNA, 17 bp, Homo sapiens
aggcaaaaactgtactg

SEQ ID NO: 4357097 - DNA, 16 bp, Homo sapiens
aggcagcaccacactg

SEQ ID NO: 4357098 - DNA, 22 bp, Homo sapiens
aggcagccctcacctctgagga

SEQ ID NO: 4357099 - DNA, 23 bp, Homo sapiens
aggcagccctcacctctgaggac

SEQ ID NO: 4357100 - DNA, 16 bp, Homo sapiens
aggcagttaggtgctg

SEQ ID NO: 4357101 - DNA, 14 bp, Homo sapiens
aggcataggcctgg

SEQ ID NO: 4357102 - DNA, 17 bp, Homo sapiens
aggcataggcctgggtg

SEQ ID NO: 4357103 - DNA, 18 bp, Homo sapiens
aggcataggcctgggtgc

SEQ ID NO: 4357104 - DNA, 15 bp, Homo sapiens
aggcatgtcccaccc

SEQ ID NO: 4357105 - DNA, 16 bp, Homo sapiens
aggcatgtcccaccca

SEQ ID NO: 4357106 - DNA, 18 bp, Homo sapiens
aggcatgtcccacccacc

SEQ ID NO: 4357107 - DNA, 21 bp, Homo sapiens
aggcccccaaattgccttcag

SEQ ID NO: 4357108 - DNA, 16 bp, Homo sapiens
aggcccgtgggcgcaa

SEQ ID NO: 4357109 - DNA, 15 bp, Homo sapiens
aggccggggtccagg

SEQ ID NO: 4357110 - DNA, 19 bp, Homo sapiens
aggcctctggttgcctccc

SEQ ID NO: 4357111 - DNA, 16 bp, Homo sapiens
aggcctgtccaccctg

SEQ ID NO: 4357112 - DNA, 18 bp, Homo sapiens
aggcctgtccaccctgcc

SEQ ID NO: 4357113 - DNA, 15 bp, Homo sapiens
aggctgcctcagcca

SEQ ID NO: 4357114 - DNA, 16 bp, Homo sapiens
aggctgcctcagccag

SEQ ID NO: 4357115 - DNA, 17 bp, Homo sapiens
aggctgcctcagccagt

SEQ ID NO: 4357116 - DNA, 20 bp, Homo sapiens
aggcttcagcatatttatag

SEQ ID NO: 4357117 - DNA, 16 bp, Homo sapiens
agggaaaccttggaga

SEQ ID NO: 4357118 - DNA, 18 bp, Homo sapiens
agggaaaccttggagagg

SEQ ID NO: 4357119 - DNA, 16 bp, Homo sapiens
agggagttttgtctgt

SEQ ID NO: 4357120 - DNA, 21 bp, Homo sapiens
agggatcagccccgcctgtca

SEQ ID NO: 4357121 - DNA, 16 bp, Homo sapiens
agggattgaggagttg

SEQ ID NO: 4357122 - DNA, 14 bp, Homo sapiens
agggcaagaaatgg

SEQ ID NO: 4357123 - DNA, 23 bp, Homo sapiens
agggcagaggaatgtagggcctg

SEQ ID NO: 4357124 - DNA, 19 bp, Homo sapiens
agggcaggcttggggaaaa

SEQ ID NO: 4357125 - DNA, 21 bp, Homo sapiens
attgcccatggctgggaacat

SEQ ID NO: 4357126 - DNA, 13 bp, Homo sapiens
attgctgcttgga

SEQ ID NO: 4357127 - DNA, 21 bp, Homo sapiens
attgctggtagagacccccag

SEQ ID NO: 4357128 - DNA, 20 bp, Homo sapiens
attgtgcagtactttgtgca

SEQ ID NO: 4357129 - DNA, 20 bp, Homo sapiens
attgttcttgggagaaaatc

SEQ ID NO: 4357130 - DNA, 12 bp, Homo sapiens
atttaactgaac

SEQ ID NO: 4357131 - DNA, 18 bp, Homo sapiens
atttaagcaaacgtctat

SEQ ID NO: 4357132 - DNA, 17 bp, Homo sapiens
atttacatcagaagttt

SEQ ID NO: 4357133 - DNA, 20 bp, Homo sapiens
atttaccctttggccccact

SEQ ID NO: 4357134 - DNA, 15 bp, Homo sapiens
atttactcctcctgc

SEQ ID NO: 4357135 - DNA, 18 bp, Homo sapiens
atttatgacctaagtcag

SEQ ID NO: 4357136 - DNA, 16 bp, Homo sapiens
atttattgcattgctg

SEQ ID NO: 4357137 - DNA, 19 bp, Homo sapiens
atttcaggatactctgtca

SEQ ID NO: 4357138 - DNA, 22 bp, Homo sapiens
atttcaggatactctgtcagat

SEQ ID NO: 4357139 - DNA, 18 bp, Homo sapiens
atttcccaattaggaagt

SEQ ID NO: 4357140 - DNA, 18 bp, Homo sapiens
atttccttaaactgtgtg

SEQ ID NO: 4357141 - DNA, 22 bp, Homo sapiens
atttgctagttctgctgccctc

SEQ ID NO: 4357142 - DNA, 13 bp, Homo sapiens
atttgggctcagg

SEQ ID NO: 4357143 - DNA, 17 bp, Homo sapiens
atttgtacaatggttta

SEQ ID NO: 4357144 - DNA, 18 bp, Homo sapiens
atttgtacaatggtttat

SEQ ID NO: 4357145 - DNA, 15 bp, Homo sapiens
atttgtcttccgatc

SEQ ID NO: 4357146 - DNA, 23 bp, Homo sapiens
atttgtcttccgatcaacattta

SEQ ID NO: 4357147 - DNA, 20 bp, Homo sapiens
attttaaataaaagtgatca

SEQ ID NO: 4357148 - DNA, 21 bp, Homo sapiens
attttaaataaaagtgatcaa

SEQ ID NO: 4357149 - DNA, 19 bp, Homo sapiens
attttaatgcattgttata

SEQ ID NO: 4357150 - DNA, 20 bp, Homo sapiens
attttggaagttttcaggac

SEQ ID NO: 4357151 - DNA, 19 bp, Homo sapiens
attttggggaggaaaacag

SEQ ID NO: 4357152 - DNA, 16 bp, Homo sapiens
atttttatgcagacag

SEQ ID NO: 4357153 - DNA, 15 bp, Homo sapiens
attttttaaggcaaa

SEQ ID NO: 4357154 - DNA, 15 bp, Homo sapiens
caaaaactgtactgt

SEQ ID NO: 4357155 - DNA, 16 bp, Homo sapiens
caaaaactgtactgtg

SEQ ID NO: 4357156 - DNA, 15 bp, Homo sapiens
caaaagacaaaaatc

SEQ ID NO: 4357157 - DNA, 12 bp, Homo sapiens
caaaatgccaag

SEQ ID NO: 4357158 - DNA, 20 bp, Homo sapiens
caaaatttaagttaactgtt

SEQ ID NO: 4357159 - DNA, 12 bp, Homo sapiens
caaacaaggaag

SEQ ID NO: 4357160 - DNA, 14 bp, Homo sapiens
caaacaaggaagcc

SEQ ID NO: 4357161 - DNA, 17 bp, Homo sapiens
caaacaaggaagccaaa

SEQ ID NO: 4357162 - DNA, 13 bp, Homo sapiens
caaacctactgcc

SEQ ID NO: 4357163 - DNA, 14 bp, Homo sapiens
caaacctactgccc

SEQ ID NO: 4357164 - DNA, 18 bp, Homo sapiens
caaacgtctattttgtat

SEQ ID NO: 4357165 - DNA, 23 bp, Homo sapiens
caaaggcgcagtgcttctctaca

SEQ ID NO: 4357166 - DNA, 13 bp, Homo sapiens
caaaggtgcctca

SEQ ID NO: 4357167 - DNA, 14 bp, Homo sapiens
caaaggtgcctcat

SEQ ID NO: 4357168 - DNA, 13 bp, Homo sapiens
caaagtaaaatga

SEQ ID NO: 4357169 - DNA, 17 bp, Homo sapiens
caaagtttacattgtcc

SEQ ID NO: 4357170 - DNA, 23 bp, Homo sapiens
caaagtttacattgtcctgtagc

SEQ ID NO: 4357171 - DNA, 12 bp, Homo sapiens
caaatgtgtttt

SEQ ID NO: 4357172 - DNA, 20 bp, Homo sapiens
caaatgtgtttttctatata

SEQ ID NO: 4357173 - DNA, 13 bp, Homo sapiens
caaattgccttca

SEQ ID NO: 4357174 - DNA, 14 bp, Homo sapiens
caaattgccttcag

SEQ ID NO: 4357175 - DNA, 18 bp, Homo sapiens
caaattgtgcagtacttt

SEQ ID NO: 4357176 - DNA, 14 bp, Homo sapiens
caaatttacatcag

SEQ ID NO: 4357177 - DNA, 10 bp, Homo sapiens
caacatggga

SEQ ID NO: 4357178 - DNA, 14 bp, Homo sapiens
caacatgggaggga

SEQ ID NO: 4357179 - DNA, 17 bp, Homo sapiens
caacatgggagggatca

SEQ ID NO: 4357180 - DNA, 17 bp, Homo sapiens
caactaggcttcagcat

SEQ ID NO: 4357181 - DNA, 22 bp, Homo sapiens
caacttgtctttttctggactg

SEQ ID NO: 4357182 - DNA, 15 bp, Homo sapiens
caagaaagaattcct

SEQ ID NO: 4357183 - DNA, 17 bp, Homo sapiens
caagaaagaattcctgc

SEQ ID NO: 4357184 - DNA, 18 bp, Homo sapiens
caagaaatggcgtctgct

SEQ ID NO: 4357185 - DNA, 18 bp, Homo sapiens
caagactcctcaggcagc

SEQ ID NO: 4357186 - DNA, 19 bp, Homo sapiens
caagagcccagcagggcct

SEQ ID NO: 4357187 - DNA, 19 bp, Homo sapiens
caagaggggcgggctcaga

SEQ ID NO: 4357188 - DNA, 22 bp, Homo sapiens
caagaggggcgggctcagagct

SEQ ID NO: 4357189 - DNA, 16 bp, Homo sapiens
caaggaaaatctatat

SEQ ID NO: 4357190 - DNA, 22 bp, Homo sapiens
caaggaaaatctatatttgtct

SEQ ID NO: 4357191 - DNA, 17 bp, Homo sapiens
caaggaagaagaaatct

SEQ ID NO: 4357192 - DNA, 18 bp, Homo sapiens
caaggaagccaaagtttt

SEQ ID NO: 4357193 - DNA, 14 bp, Homo sapiens
caagggggtgactg

SEQ ID NO: 4357194 - DNA, 17 bp, Homo sapiens
caagggggtgactggaa

SEQ ID NO: 4357195 - DNA, 19 bp, Homo sapiens
caaggtgagaattaagttt

SEQ ID NO: 4357196 - DNA, 13 bp, Homo sapiens
caagtatgcctta

SEQ ID NO: 4357197 - DNA, 20 bp, Homo sapiens
caagtatggtaggggagggc

SEQ ID NO: 4357198 - DNA, 14 bp, Homo sapiens
caagtgaacaaagt

SEQ ID NO: 4357199 - DNA, 17 bp, Homo sapiens
caagtgaacaaagtgag

SEQ ID NO: 4357200 - DNA, 15 bp, Homo sapiens
caataatttgtacaa

SEQ ID NO: 4357201 - DNA, 23 bp, Homo sapiens
caatagctttaccctcaggcata

SEQ ID NO: 4357202 - DNA, 17 bp, Homo sapiens
caatcatggtcaagttc

SEQ ID NO: 4357203 - DNA, 22 bp, Homo sapiens
caatccatgttagtttttactt

SEQ ID NO: 4357204 - DNA, 14 bp, Homo sapiens
caatcctcactggg

SEQ ID NO: 4357205 - DNA, 18 bp, Homo sapiens
caatcctcactgggtggg

SEQ ID NO: 4357206 - DNA, 18 bp, Homo sapiens
caatggtttattcccaag

SEQ ID NO: 4357207 - DNA, 22 bp, Homo sapiens
caattagatttaaaataaacat

SEQ ID NO: 4357208 - DNA, 22 bp, Homo sapiens
caatttgtctggactagaaaat

SEQ ID NO: 4357209 - DNA, 12 bp, Homo sapiens
cacaaaaatgaa

SEQ ID NO: 4357210 - DNA, 20 bp, Homo sapiens
cacaagagcccagcagggcc

SEQ ID NO: 4357211 - DNA, 16 bp, Homo sapiens
cacaagggcacattgc

SEQ ID NO: 4357212 - DNA, 14 bp, Homo sapiens
cacacatctggccc

SEQ ID NO: 4357213 - DNA, 16 bp, Homo sapiens
cacacatctggccctg

SEQ ID NO: 4357214 - DNA, 17 bp, Homo sapiens
cacacatctggccctga

SEQ ID NO: 4357215 - DNA, 19 bp, Homo sapiens
cacacgagcaaacccagag

SEQ ID NO: 4357216 - DNA, 13 bp, Homo sapiens
cacactgtcttcc

SEQ ID NO: 4357217 - DNA, 21 bp, Homo sapiens
cacacttgtgtgtgggctgtg

SEQ ID NO: 4357218 - DNA, 18 bp, Homo sapiens
cacagagtggtctttctg

SEQ ID NO: 4357219 - DNA, 19 bp, Homo sapiens
cacagatggatttgcctgt

SEQ ID NO: 4357220 - DNA, 20 bp, Homo sapiens
cacagatggatttgcctgtg

SEQ ID NO: 4357221 - DNA, 23 bp, Homo sapiens
cacagatggatttgcctgtgcca

SEQ ID NO: 4357222 - DNA, 22 bp, Homo sapiens
cacagccacccgtggggtgctg

SEQ ID NO: 4357223 - DNA, 18 bp, Homo sapiens
cacagctgggcagggtga

SEQ ID NO: 4357224 - DNA, 22 bp, Homo sapiens
cacagggcccggccacacccag

SEQ ID NO: 4357225 - DNA, 16 bp, Homo sapiens
cacagtccaaccagaa

SEQ ID NO: 4357226 - DNA, 15 bp, Homo sapiens
cacatctggccctga

SEQ ID NO: 4357227 - DNA, 14 bp, Homo sapiens
cacatgtacatatg

SEQ ID NO: 4357228 - DNA, 12 bp, Homo sapiens
cacatgtgtggt

SEQ ID NO: 4357229 - DNA, 19 bp, Homo sapiens
cacattaatctcaaagaga

SEQ ID NO: 4357230 - DNA, 17 bp, Homo sapiens
cacatttgggctcaggg

SEQ ID NO: 4357231 - DNA, 18 bp, Homo sapiens
cacatttgggctcagggt

SEQ ID NO: 4357232 - DNA, 20 bp, Homo sapiens
cacatttgggctcagggttg

SEQ ID NO: 4357233 - DNA, 15 bp, Homo sapiens
caccacactgggtgc

SEQ ID NO: 4357234 - DNA, 13 bp, Homo sapiens
caccagagctgcc

SEQ ID NO: 4357235 - DNA, 14 bp, Homo sapiens
cacccaagcctgct

SEQ ID NO: 4357236 - DNA, 20 bp, Homo sapiens
cacccaagcctgctggctgc

SEQ ID NO: 4357237 - DNA, 24 bp, Homo sapiens
cacccacccgccgcctcccacggc

SEQ ID NO: 4357238 - DNA, 16 bp, Homo sapiens
caccccaccccacccc

SEQ ID NO: 4357239 - DNA, 23 bp, Homo sapiens
cacccctctgtctaggactgcag

SEQ ID NO: 4357240 - DNA, 20 bp, Homo sapiens
cacccgtggggtgctgccct

SEQ ID NO: 4357241 - DNA, 12 bp, Homo sapiens
cacctccccaaa

SEQ ID NO: 4357242 - DNA, 18 bp, Homo sapiens
cacctcggggacaccaga

SEQ ID NO: 4357243 - DNA, 20 bp, Homo sapiens
cacctcggggacaccagagc

SEQ ID NO: 4357244 - DNA, 12 bp, Homo sapiens
cacctctgagga

SEQ ID NO: 4357245 - DNA, 21 bp, Homo sapiens
ccagatacttcccattttgga

SEQ ID NO: 4357246 - DNA, 13 bp, Homo sapiens
ccagattctgatg

SEQ ID NO: 4357247 - DNA, 15 bp, Homo sapiens
ccagattctgatgca

SEQ ID NO: 4357248 - DNA, 15 bp, Homo sapiens
ccagcactgtctcag

SEQ ID NO: 4357249 - DNA, 18 bp, Homo sapiens
ccagcctgaaagatacag

SEQ ID NO: 4357250 - DNA, 15 bp, Homo sapiens
ccagcgagtggtcaa

SEQ ID NO: 4357251 - DNA, 20 bp, Homo sapiens
ccagcggccccccgcacagc

SEQ ID NO: 4357252 - DNA, 21 bp, Homo sapiens
ccagcggccccccgcacagcc

SEQ ID NO: 4357253 - DNA, 22 bp, Homo sapiens
ccagcggccccccgcacagcca

SEQ ID NO: 4357254 - DNA, 14 bp, Homo sapiens
ccagctctctgacg

SEQ ID NO: 4357255 - DNA, 23 bp, Homo sapiens
ccagctctctgacgcttgtgaca

SEQ ID NO: 4357256 - DNA, 22 bp, Homo sapiens
ccaggaacacccgactcctcaa

SEQ ID NO: 4357257 - DNA, 19 bp, Homo sapiens
ccaggaatgcctcctccct

SEQ ID NO: 4357258 - DNA, 17 bp, Homo sapiens
ccaggcccgtgggcgca

SEQ ID NO: 4357259 - DNA, 15 bp, Homo sapiens
ccaggcctgtccacc

SEQ ID NO: 4357260 - DNA, 15 bp, Homo sapiens
ccagggcagaggaat

SEQ ID NO: 4357261 - DNA, 17 bp, Homo sapiens
ccagggcagaggaatgt

SEQ ID NO: 4357262 - DNA, 18 bp, Homo sapiens
ccagggtgggaagagaag

SEQ ID NO: 4357263 - DNA, 22 bp, Homo sapiens
ccagtcatggtactaccccagc

SEQ ID NO: 4357264 - DNA, 12 bp, Homo sapiens
ccagtccctgga

SEQ ID NO: 4357265 - DNA, 15 bp, Homo sapiens
ccagtccctggagct

SEQ ID NO: 4357266 - DNA, 17 bp, Homo sapiens
ccagtccctggagctgt

SEQ ID NO: 4357267 - DNA, 15 bp, Homo sapiens
ccagtggcacaggag

SEQ ID NO: 4357268 - DNA, 14 bp, Homo sapiens
ccagtggggtcccc

SEQ ID NO: 4357269 - DNA, 24 bp, Homo sapiens
ccatcagctgtaagaagagactgg

SEQ ID NO: 4357270 - DNA, 14 bp, Homo sapiens
ccatccccttcccc

SEQ ID NO: 4357271 - DNA, 22 bp, Homo sapiens
ccatccccttcccccatcccta

SEQ ID NO: 4357272 - DNA, 15 bp, Homo sapiens
ccatccctaccactg

SEQ ID NO: 4357273 - DNA, 18 bp, Homo sapiens
ccatcttgtggggccagg

SEQ ID NO: 4357274 - DNA, 11 bp, Homo sapiens
ccatgcagaaa

SEQ ID NO: 4357275 - DNA, 12 bp, Homo sapiens
ccatgcaggagg

SEQ ID NO: 4357276 - DNA, 15 bp, Homo sapiens
ccatggggtccatcc

SEQ ID NO: 4357277 - DNA, 17 bp, Homo sapiens
ccatggggtccatcccc

SEQ ID NO: 4357278 - DNA, 20 bp, Homo sapiens
ccatttgctagttctgctgc

SEQ ID NO: 4357279 - DNA, 22 bp, Homo sapiens
ccatttgctagttctgctgccc

SEQ ID NO: 4357280 - DNA, 12 bp, Homo sapiens
cccaacatggga

SEQ ID NO: 4357281 - DNA, 19 bp, Homo sapiens
cccaacatgggagggatca

SEQ ID NO: 4357282 - DNA, 23 bp, Homo sapiens
cccaagaggggcgggctcagagc

SEQ ID NO: 4357283 - DNA, 17 bp, Homo sapiens
cccaagcctgctggctg

SEQ ID NO: 4357284 - DNA, 17 bp, Homo sapiens
cccaagtatgccttaag

SEQ ID NO: 4357285 - DNA, 19 bp, Homo sapiens
cccacatttgggctcaggg

SEQ ID NO: 4357286 - DNA, 17 bp, Homo sapiens
cccaccccaccccaccc

SEQ ID NO: 4357287 - DNA, 17 bp, Homo sapiens
cccacctgttttctgaa

SEQ ID NO: 4357288 - DNA, 23 bp, Homo sapiens
cccacctgttttctgaaacacac

SEQ ID NO: 4357289 - DNA, 12 bp, Homo sapiens
cccagaatgaga

SEQ ID NO: 4357290 - DNA, 18 bp, Homo sapiens
cccagaatgagacatcca

SEQ ID NO: 4357291 - DNA, 20 bp, Homo sapiens
cccagaatgagacatccagc

SEQ ID NO: 4357292 - DNA, 22 bp, Homo sapiens
cccagacagtggatatgaccca

SEQ ID NO: 4357293 - DNA, 19 bp, Homo sapiens
cccagacccctctggccag

SEQ ID NO: 4357294 - DNA, 13 bp, Homo sapiens
cccagactctttt

SEQ ID NO: 4357295 - DNA, 12 bp, Homo sapiens
cccagaggtgga

SEQ ID NO: 4357296 - DNA, 22 bp, Homo sapiens
cccagccccgccccgttgtgag

SEQ ID NO: 4357297 - DNA, 21 bp, Homo sapiens
cccagcctcttgctcagagct

SEQ ID NO: 4357298 - DNA, 19 bp, Homo sapiens
cccagcggccccccgcaca

SEQ ID NO: 4357299 - DNA, 13 bp, Homo sapiens
cccagctctctga

SEQ ID NO: 4357300 - DNA, 17 bp, Homo sapiens
cccaggcatctgcctct

SEQ ID NO: 4357301 - DNA, 14 bp, Homo sapiens
cccaggcctgtcca

SEQ ID NO: 4357302 - DNA, 18 bp, Homo sapiens
cccataaataaaagtaca

SEQ ID NO: 4357303 - DNA, 12 bp, Homo sapiens
cccatccctacc

SEQ ID NO: 4357304 - DNA, 14 bp, Homo sapiens
cccatcctagaggc

SEQ ID NO: 4357305 - DNA, 21 bp, Homo sapiens
cccattgttgtcaaggaagaa

SEQ ID NO: 4357306 - DNA, 22 bp, Homo sapiens
cccattttggaagttttcagga

SEQ ID NO: 4357307 - DNA, 21 bp, Homo sapiens
ccccaaagcagcaggcctctg

SEQ ID NO: 4357308 - DNA, 17 bp, Homo sapiens
ccccaaattgccttcag

SEQ ID NO: 4357309 - DNA, 23 bp, Homo sapiens
ccccactccctggctctcagaag

SEQ ID NO: 4357310 - DNA, 13 bp, Homo sapiens
ccccagctctgga

SEQ ID NO: 4357311 - DNA, 15 bp, Homo sapiens
ccccaggcctgtcca

SEQ ID NO: 4357312 - DNA, 16 bp, Homo sapiens
ccccaggcctgtccac

SEQ ID NO: 4357313 - DNA, 18 bp, Homo sapiens
ccccatccctaccactgt

SEQ ID NO: 4357314 - DNA, 22 bp, Homo sapiens
ccccccagactctttttttgag

SEQ ID NO: 4357315 - DNA, 18 bp, Homo sapiens
cccccgcacagccacccg

SEQ ID NO: 4357316 - DNA, 13 bp, Homo sapiens
ccccgaggctgct

SEQ ID NO: 4357317 - DNA, 14 bp, Homo sapiens
ccccgatgtcccct

SEQ ID NO: 4357318 - DNA, 13 bp, Homo sapiens
ccccgcctgccac

SEQ ID NO: 4357319 - DNA, 12 bp, Homo sapiens
ccccgcctgtca

SEQ ID NO: 4357320 - DNA, 13 bp, Homo sapiens
cccctctggccag

SEQ ID NO: 4357321 - DNA, 16 bp, Homo sapiens
cccctctggccaggat

SEQ ID NO: 4357322 - DNA, 22 bp, Homo sapiens
cccctgcgggcgcgggcagcca

SEQ ID NO: 4357323 - DNA, 22 bp, Homo sapiens
cccctgtagggaaaccttggag

SEQ ID NO: 4357324 - DNA, 12 bp, Homo sapiens
cccgactcctca

SEQ ID NO: 4357325 - DNA, 22 bp, Homo sapiens
cccgaggagctgggcccctgca

SEQ ID NO: 4357326 - DNA, 22 bp, Homo sapiens
cccgatgagggaaggagcccag

SEQ ID NO: 4357327 - DNA, 15 bp, Homo sapiens
cccgcacagccaccc

SEQ ID NO: 4357328 - DNA, 17 bp, Homo sapiens
cccgcactctgccccca

SEQ ID NO: 4357329 - DNA, 22 bp, Homo sapiens
cccgcaggaactgggctgggcc

SEQ ID NO: 4357330 - DNA, 12 bp, Homo sapiens
cccgcctgccac

SEQ ID NO: 4357331 - DNA, 14 bp, Homo sapiens
cccgcctgccaccg

SEQ ID NO: 4357332 - DNA, 14 bp, Homo sapiens
cccgcctgtcacaa

SEQ ID NO: 4357333 - DNA, 18 bp, Homo sapiens
cccggccacacccagcgg

SEQ ID NO: 4357334 - DNA, 14 bp, Homo sapiens
cccggcgccgggca

SEQ ID NO: 4357335 - DNA, 18 bp, Homo sapiens
cccgtcatgttcctcaaa

SEQ ID NO: 4357336 - DNA, 22 bp, Homo sapiens
cccgtgcccccgcctgccaccg

SEQ ID NO: 4357337 - DNA, 15 bp, Homo sapiens
ccctcaactgaaggg

SEQ ID NO: 4357338 - DNA, 11 bp, Homo sapiens
ccctcacccat

SEQ ID NO: 4357339 - DNA, 17 bp, Homo sapiens
ccctcacctctgaggac

SEQ ID NO: 4357340 - DNA, 13 bp, Homo sapiens
ccctgaggaatga

SEQ ID NO: 4357341 - DNA, 18 bp, Homo sapiens
ccctgagtgggctgggcc

SEQ ID NO: 4357342 - DNA, 19 bp, Homo sapiens
ccctgcagtttggccctgg

SEQ ID NO: 4357343 - DNA, 22 bp, Homo sapiens
ccctgcagtttggccctggagc

SEQ ID NO: 4357344 - DNA, 16 bp, Homo sapiens
ccctgcctgaggagga

SEQ ID NO: 4357345 - DNA, 15 bp, Homo sapiens
ccctggaaaccttcc

SEQ ID NO: 4357346 - DNA, 16 bp, Homo sapiens
ccctggaaaccttcca

SEQ ID NO: 4357347 - DNA, 22 bp, Homo sapiens
ccctggagccagggcagaggaa

SEQ ID NO: 4357348 - DNA, 14 bp, Homo sapiens
ccctggagctgtcc

SEQ ID NO: 4357349 - DNA, 17 bp, Homo sapiens
ccctggggaccaggagc

SEQ ID NO: 4357350 - DNA, 18 bp, Homo sapiens
ccctggggaccaggagct

SEQ ID NO: 4357351 - DNA, 20 bp, Homo sapiens
ccctggggaccaggagctag

SEQ ID NO: 4357352 - DNA, 21 bp, Homo sapiens
ccctgtagggaaaccttggag

SEQ ID NO: 4357353 - DNA, 21 bp, Homo sapiens
cccttcccccatccctaccac

SEQ ID NO: 4357354 - DNA, 23 bp, Homo sapiens
cccttgacgtcaagtctccttcc

SEQ ID NO: 4357355 - DNA, 17 bp, Homo sapiens
cccttggagagagaggc

SEQ ID NO: 4357356 - DNA, 14 bp, Homo sapiens
ccctttcttggcca

SEQ ID NO: 4357357 - DNA, 15 bp, Homo sapiens
ccctttcttggccag

SEQ ID NO: 4357358 - DNA, 21 bp, Homo sapiens
ccctttggccccactttgaag

SEQ ID NO: 4357359 - DNA, 23 bp, Homo sapiens
ccgacggtgggcatttgtgaggc

SEQ ID NO: 4357360 - DNA, 22 bp, Homo sapiens
ccgacttgaatattcctggact

SEQ ID NO: 4357361 - DNA, 24 bp, Homo sapiens
ccgacttggagactcctggtctgt

SEQ ID NO: 4357362 - DNA, 23 bp, Homo sapiens
ccgaggagctgggcccctgcaca

SEQ ID NO: 4357363 - DNA, 12 bp, Homo sapiens
ccgcactctgcc

SEQ ID NO: 4357364 - DNA, 14 bp, Homo sapiens
ccgccgcctcccac

SEQ ID NO: 4357365 - DNA, 17 bp, Homo sapiens
ctgaggcccagtgcata

SEQ ID NO: 4357366 - DNA, 16 bp, Homo sapiens
ctgaggtctcttgagg

SEQ ID NO: 4357367 - DNA, 19 bp, Homo sapiens
ctgaggtctcttgagggag

SEQ ID NO: 4357368 - DNA, 18 bp, Homo sapiens
ctgagtgggctgggccct

SEQ ID NO: 4357369 - DNA, 18 bp, Homo sapiens
ctgatattccatgaatgt

SEQ ID NO: 4357370 - DNA, 12 bp, Homo sapiens
ctgatgttgtgt

SEQ ID NO: 4357371 - DNA, 11 bp, Homo sapiens
ctgcacacagg

SEQ ID NO: 4357372 - DNA, 18 bp, Homo sapiens
ctgcacacaggacagcgg

SEQ ID NO: 4357373 - DNA, 20 bp, Homo sapiens
ctgcacaggcacacagggcc

SEQ ID NO: 4357374 - DNA, 22 bp, Homo sapiens
ctgcacaggcacacagggcccg

SEQ ID NO: 4357375 - DNA, 15 bp, Homo sapiens
ctgcacatgactaca

SEQ ID NO: 4357376 - DNA, 16 bp, Homo sapiens
ctgcagtttggccctg

SEQ ID NO: 4357377 - DNA, 19 bp, Homo sapiens
ctgcagtttggccctggag

SEQ ID NO: 4357378 - DNA, 20 bp, Homo sapiens
ctgcagtttggccctggagc

SEQ ID NO: 4357379 - DNA, 21 bp, Homo sapiens
ctgcagtttggccctggagcc

SEQ ID NO: 4357380 - DNA, 13 bp, Homo sapiens
ctgcatactttga

SEQ ID NO: 4357381 - DNA, 22 bp, Homo sapiens
ctgcatactttgacaaggaaaa

SEQ ID NO: 4357382 - DNA, 16 bp, Homo sapiens
ctgccaagactcctca

SEQ ID NO: 4357383 - DNA, 19 bp, Homo sapiens
ctgccaagactcctcaggc

SEQ ID NO: 4357384 - DNA, 23 bp, Homo sapiens
ctgcccagacccctctggccagg

SEQ ID NO: 4357385 - DNA, 19 bp, Homo sapiens
ctgccctcttaagatctga

SEQ ID NO: 4357386 - DNA, 15 bp, Homo sapiens
ctgccctgcctgagg

SEQ ID NO: 4357387 - DNA, 17 bp, Homo sapiens
ctgccgacttggagact

SEQ ID NO: 4357388 - DNA, 18 bp, Homo sapiens
ctgccggtgggaccctgt

SEQ ID NO: 4357389 - DNA, 22 bp, Homo sapiens
ctgccggtgggaccctgtccgg

SEQ ID NO: 4357390 - DNA, 17 bp, Homo sapiens
ctgcctcagccagtggc

SEQ ID NO: 4357391 - DNA, 22 bp, Homo sapiens
ctgcctccctggggaccaggag

SEQ ID NO: 4357392 - DNA, 22 bp, Homo sapiens
ctgcctgaggaggaggacacag

SEQ ID NO: 4357393 - DNA, 23 bp, Homo sapiens
ctgcgggcgcgggcagccaccca

SEQ ID NO: 4357394 - DNA, 14 bp, Homo sapiens
ctgctataaacttt

SEQ ID NO: 4357395 - DNA, 18 bp, Homo sapiens
ctgctcccagcctcttgc

SEQ ID NO: 4357396 - DNA, 14 bp, Homo sapiens
ctgctgaggcccag

SEQ ID NO: 4357397 - DNA, 15 bp, Homo sapiens
ctgctgaggcccagt

SEQ ID NO: 4357398 - DNA, 18 bp, Homo sapiens
ctgctgcaggacattaat

SEQ ID NO: 4357399 - DNA, 13 bp, Homo sapiens
ctgctgcatactt

SEQ ID NO: 4357400 - DNA, 17 bp, Homo sapiens
ctgctgcctccctgggg

SEQ ID NO: 4357401 - DNA, 18 bp, Homo sapiens
ctgctgcctccctgggga

SEQ ID NO: 4357402 - DNA, 11 bp, Homo sapiens
ctgctggctgc

SEQ ID NO: 4357403 - DNA, 17 bp, Homo sapiens
ctggaagttgtggatat

SEQ ID NO: 4357404 - DNA, 19 bp, Homo sapiens
ctggaccccgtttcatttt

SEQ ID NO: 4357405 - DNA, 16 bp, Homo sapiens
ctggactagaaaatct

SEQ ID NO: 4357406 - DNA, 19 bp, Homo sapiens
ctggacttacaaaatgcca

SEQ ID NO: 4357407 - DNA, 20 bp, Homo sapiens
ctggacttacaaaatgccaa

SEQ ID NO: 4357408 - DNA, 21 bp, Homo sapiens
ctggagaggttataggtcact

SEQ ID NO: 4357409 - DNA, 12 bp, Homo sapiens
ctggagccaggg

SEQ ID NO: 4357410 - DNA, 14 bp, Homo sapiens
ctggagccagggca

SEQ ID NO: 4357411 - DNA, 16 bp, Homo sapiens
ctggagccagggcaga

SEQ ID NO: 4357412 - DNA, 14 bp, Homo sapiens
ctggatgaaggcaa

SEQ ID NO: 4357413 - DNA, 18 bp, Homo sapiens
ctggcccgtcatgttcct

SEQ ID NO: 4357414 - DNA, 11 bp, Homo sapiens
ctggccctgac

SEQ ID NO: 4357415 - DNA, 12 bp, Homo sapiens
ctggctgcccag

SEQ ID NO: 4357416 - DNA, 18 bp, Homo sapiens
ctgggaacatgacccagc

SEQ ID NO: 4357417 - DNA, 22 bp, Homo sapiens
ctgggaacatgacccagcctga

SEQ ID NO: 4357418 - DNA, 17 bp, Homo sapiens
ctgggaagataggctct

SEQ ID NO: 4357419 - DNA, 19 bp, Homo sapiens
ctgggaatgtattattctg

SEQ ID NO: 4357420 - DNA, 11 bp, Homo sapiens
ctgggccaggg

SEQ ID NO: 4357421 - DNA, 12 bp, Homo sapiens
ctgggccaggga

SEQ ID NO: 4357422 - DNA, 16 bp, Homo sapiens
ctgggcccctgcacag

SEQ ID NO: 4357423 - DNA, 20 bp, Homo sapiens
ctgggcctcgtgcgcccgtg

SEQ ID NO: 4357424 - DNA, 21 bp, Homo sapiens
ctgggcctcgtgcgcccgtgg

SEQ ID NO: 4357425 - DNA, 15 bp, Homo sapiens
ctggggaccaggagc

SEQ ID NO: 4357426 - DNA, 18 bp, Homo sapiens
ctggggaccaggagctag

SEQ ID NO: 4357427 - DNA, 12 bp, Homo sapiens
ctggggcctctt

SEQ ID NO: 4357428 - DNA, 16 bp, Homo sapiens
ctgggtgcgtctccag

SEQ ID NO: 4357429 - DNA, 18 bp, Homo sapiens
ctggtaaaaagatccagg

SEQ ID NO: 4357430 - DNA, 20 bp, Homo sapiens
ctggtaaaaagatccaggga

SEQ ID NO: 4357431 - DNA, 15 bp, Homo sapiens
ctggtagagaccccc

SEQ ID NO: 4357432 - DNA, 19 bp, Homo sapiens
ctggtagagacccccaggc

SEQ ID NO: 4357433 - DNA, 20 bp, Homo sapiens
ctggtagagacccccaggcc

SEQ ID NO: 4357434 - DNA, 22 bp, Homo sapiens
ctggtctgtgaagagccggtgg

SEQ ID NO: 4357435 - DNA, 23 bp, Homo sapiens
ctggtggcttaagtgagcagaac

SEQ ID NO: 4357436 - DNA, 13 bp, Homo sapiens
ctggttgtcattt

SEQ ID NO: 4357437 - DNA, 18 bp, Homo sapiens
ctgtacaataagttactt

SEQ ID NO: 4357438 - DNA, 23 bp, Homo sapiens
ctgtacaataagttacttgaaat

SEQ ID NO: 4357439 - DNA, 12 bp, Homo sapiens
ctgtcacaataa

SEQ ID NO: 4357440 - DNA, 21 bp, Homo sapiens
ctgtcagatgggaagacatga

SEQ ID NO: 4357441 - DNA, 22 bp, Homo sapiens
ctgtcagatgggaagacatgaa

SEQ ID NO: 4357442 - DNA, 20 bp, Homo sapiens
ctgtcagtgtacacgtctgg

SEQ ID NO: 4357443 - DNA, 18 bp, Homo sapiens
ctgtccggcccagtgcca

SEQ ID NO: 4357444 - DNA, 22 bp, Homo sapiens
ctgtccggcccagtgccactgc

SEQ ID NO: 4357445 - DNA, 22 bp, Homo sapiens
ctgtccttcattccgttaggaa

SEQ ID NO: 4357446 - DNA, 13 bp, Homo sapiens
ctgtctaggactg

SEQ ID NO: 4357447 - DNA, 20 bp, Homo sapiens
ctgtctaggactgcagtgtg

SEQ ID NO: 4357448 - DNA, 17 bp, Homo sapiens
ctgtctcagtttcactt

SEQ ID NO: 4357449 - DNA, 20 bp, Homo sapiens
ctgtctccctcccctctcag

SEQ ID NO: 4357450 - DNA, 23 bp, Homo sapiens
ctgtctccctcccctctcagaac

SEQ ID NO: 4357451 - DNA, 17 bp, Homo sapiens
ctgtgaccaactgttgg

SEQ ID NO: 4357452 - DNA, 19 bp, Homo sapiens
ctgtgagtgtaagtgtgag

SEQ ID NO: 4357453 - DNA, 20 bp, Homo sapiens
ctgtgagtgtaagtgtgagt

SEQ ID NO: 4357454 - DNA, 21 bp, Homo sapiens
ctgtgagtgtaagtgtgagta

SEQ ID NO: 4357455 - DNA, 14 bp, Homo sapiens
ctgtgatgccacac

SEQ ID NO: 4357456 - DNA, 14 bp, Homo sapiens
ctgtgcatgggtga

SEQ ID NO: 4357457 - DNA, 20 bp, Homo sapiens
ctgtgcatgggtgaagggag

SEQ ID NO: 4357458 - DNA, 18 bp, Homo sapiens
ctgtgccacccaccaggg

SEQ ID NO: 4357459 - DNA, 22 bp, Homo sapiens
ctgtgcttggatttgcatattt

SEQ ID NO: 4357460 - DNA, 15 bp, Homo sapiens
ctgtggccccaagag

SEQ ID NO: 4357461 - DNA, 18 bp, Homo sapiens
ctgtgtctgccaaacaca

SEQ ID NO: 4357462 - DNA, 16 bp, Homo sapiens
ctgtgtggactgtgat

SEQ ID NO: 4357463 - DNA, 18 bp, Homo sapiens
ctgtgtggactgtgatgc

SEQ ID NO: 4357464 - DNA, 15 bp, Homo sapiens
ctgtgttaagaggac

SEQ ID NO: 4357465 - DNA, 12 bp, Homo sapiens
ctgttttctgaa

SEQ ID NO: 4357466 - DNA, 13 bp, Homo sapiens
ctgttttctgaaa

SEQ ID NO: 4357467 - DNA, 15 bp, Homo sapiens
ctgttttctgaaaca

SEQ ID NO: 4357468 - DNA, 17 bp, Homo sapiens
ctgttttctgaaacaca

SEQ ID NO: 4357469 - DNA, 20 bp, Homo sapiens
ctgttttctgaaacacacga

SEQ ID NO: 4357470 - DNA, 12 bp, Homo sapiens
ctgttttgggcc

SEQ ID NO: 4357471 - DNA, 21 bp, Homo sapiens
cttaagatctgactgccaaat

SEQ ID NO: 4357472 - DNA, 21 bp, Homo sapiens
cttaagcagaacaaatgtgtt

SEQ ID NO: 4357473 - DNA, 17 bp, Homo sapiens
cttaagtgagcagaaca

SEQ ID NO: 4357474 - DNA, 13 bp, Homo sapiens
cttaataaatatg

SEQ ID NO: 4357475 - DNA, 22 bp, Homo sapiens
cttagtttgtgatgtaaggcac

SEQ ID NO: 4357476 - DNA, 18 bp, Homo sapiens
cttcagcatatttatagc

SEQ ID NO: 4357477 - DNA, 17 bp, Homo sapiens
cttcagggcagggctct

SEQ ID NO: 4357478 - DNA, 19 bp, Homo sapiens
cttcagggcagggctctga

SEQ ID NO: 4357479 - DNA, 20 bp, Homo sapiens
cttcagggcagggctctgat

SEQ ID NO: 4357480 - DNA, 15 bp, Homo sapiens
cttccagtgaacatt

SEQ ID NO: 4357481 - DNA, 21 bp, Homo sapiens
cttccagtgaacattcccagc

SEQ ID NO: 4357482 - DNA, 22 bp, Homo sapiens
cttccatcttgtggggccagga

SEQ ID NO: 4357483 - DNA, 14 bp, Homo sapiens
cttcccccatccct

SEQ ID NO: 4357484 - DNA, 15 bp, Homo sapiens
cttcccccatcccta

SEQ ID NO: 4357485 - DNA, 16 bp, Homo sapiens
ggaagaaattcaggta

SEQ ID NO: 4357486 - DNA, 23 bp, Homo sapiens
ggaagagaagaaatagcagagcc

SEQ ID NO: 4357487 - DNA, 21 bp, Homo sapiens
ggaagataggctctgcacaga

SEQ ID NO: 4357488 - DNA, 13 bp, Homo sapiens
ggaaggatctgct

SEQ ID NO: 4357489 - DNA, 18 bp, Homo sapiens
ggaaggatctgctgaggc

SEQ ID NO: 4357490 - DNA, 19 bp, Homo sapiens
ggaaggttagaaaggcagc

SEQ ID NO: 4357491 - DNA, 19 bp, Homo sapiens
ggaagtgtaacagctgagg

SEQ ID NO: 4357492 - DNA, 14 bp, Homo sapiens
ggaataacactgca

SEQ ID NO: 4357493 - DNA, 17 bp, Homo sapiens
ggaataacactgcagcc

SEQ ID NO: 4357494 - DNA, 14 bp, Homo sapiens
ggaatgcacctccc

SEQ ID NO: 4357495 - DNA, 17 bp, Homo sapiens
ggaatgcacctccccaa

SEQ ID NO: 4357496 - DNA, 15 bp, Homo sapiens
ggacagcgggaaaaa

SEQ ID NO: 4357497 - DNA, 22 bp, Homo sapiens
ggacatggttgggggaatgcac

SEQ ID NO: 4357498 - DNA, 22 bp, Homo sapiens
ggaccacaaaaatgaaagcatg

SEQ ID NO: 4357499 - DNA, 20 bp, Homo sapiens
ggaccccgtttcatttttac

SEQ ID NO: 4357500 - DNA, 21 bp, Homo sapiens
ggaccctgtccggcccagtgc

SEQ ID NO: 4357501 - DNA, 22 bp, Homo sapiens
ggaccctgtccggcccagtgcc

SEQ ID NO: 4357502 - DNA, 23 bp, Homo sapiens
ggaccctgtccggcccagtgcca

SEQ ID NO: 4357503 - DNA, 14 bp, Homo sapiens
ggactgaagcctgc

SEQ ID NO: 4357504 - DNA, 16 bp, Homo sapiens
ggactgaagcctgcag

SEQ ID NO: 4357505 - DNA, 12 bp, Homo sapiens
ggactgcagtgt

SEQ ID NO: 4357506 - DNA, 23 bp, Homo sapiens
ggagaaaattggaactctactca

SEQ ID NO: 4357507 - DNA, 21 bp, Homo sapiens
ggagaagttaagaattgagca

SEQ ID NO: 4357508 - DNA, 15 bp, Homo sapiens
ggagagtggcaggtg

SEQ ID NO: 4357509 - DNA, 13 bp, Homo sapiens
ggagatgggaagg

SEQ ID NO: 4357510 - DNA, 20 bp, Homo sapiens
ggagccttgataatacttga

SEQ ID NO: 4357511 - DNA, 18 bp, Homo sapiens
ggagccttgctgggccag

SEQ ID NO: 4357512 - DNA, 19 bp, Homo sapiens
ggagccttgctgggccagg

SEQ ID NO: 4357513 - DNA, 17 bp, Homo sapiens
ggagctagcccagtccc

SEQ ID NO: 4357514 - DNA, 17 bp, Homo sapiens
ggagctgggcccctgca

SEQ ID NO: 4357515 - DNA, 18 bp, Homo sapiens
ggaggagccttgctgggc

SEQ ID NO: 4357516 - DNA, 22 bp, Homo sapiens
ggaggagccttgctgggccagg

SEQ ID NO: 4357517 - DNA, 23 bp, Homo sapiens
ggaggagccttgctgggccaggg

SEQ ID NO: 4357518 - DNA, 16 bp, Homo sapiens
ggaggcccttgtcgtg

SEQ ID NO: 4357519 - DNA, 11 bp, Homo sapiens
ggagggatcag

SEQ ID NO: 4357520 - DNA, 15 bp, Homo sapiens
ggagggatcagcccc

SEQ ID NO: 4357521 - DNA, 16 bp, Homo sapiens
ggagggatcagccccg

SEQ ID NO: 4357522 - DNA, 14 bp, Homo sapiens
ggagtatttaaatc

SEQ ID NO: 4357523 - DNA, 18 bp, Homo sapiens
ggatatgacccacactgc

SEQ ID NO: 4357524 - DNA, 21 bp, Homo sapiens
ggatcagccccgcctgtcaca

SEQ ID NO: 4357525 - DNA, 21 bp, Homo sapiens
ggatctgctgaggcccagtgc

SEQ ID NO: 4357526 - DNA, 19 bp, Homo sapiens
ggatggaggggtggtcctg

SEQ ID NO: 4357527 - DNA, 20 bp, Homo sapiens
ggatggcatttggtctcagg

SEQ ID NO: 4357528 - DNA, 19 bp, Homo sapiens
ggatgttatgaacagctgt

SEQ ID NO: 4357529 - DNA, 16 bp, Homo sapiens
ggatttgcatatttat

SEQ ID NO: 4357530 - DNA, 18 bp, Homo sapiens
ggcacattgcccatggct

SEQ ID NO: 4357531 - DNA, 18 bp, Homo sapiens
ggcagccctcacctctga

SEQ ID NO: 4357532 - DNA, 21 bp, Homo sapiens
ggcagccctcacctctgagga

SEQ ID NO: 4357533 - DNA, 12 bp, Homo sapiens
ggcaggcttggg

SEQ ID NO: 4357534 - DNA, 16 bp, Homo sapiens
ggcaggcttggggaaa

SEQ ID NO: 4357535 - DNA, 15 bp, Homo sapiens
ggcagggcatctcct

SEQ ID NO: 4357536 - DNA, 16 bp, Homo sapiens
ggcagggtgagaagct

SEQ ID NO: 4357537 - DNA, 16 bp, Homo sapiens
ggcaggtgggctgcct

SEQ ID NO: 4357538 - DNA, 15 bp, Homo sapiens
ggcagttaggtgctg

SEQ ID NO: 4357539 - DNA, 15 bp, Homo sapiens
ggcataggcctgggt

SEQ ID NO: 4357540 - DNA, 14 bp, Homo sapiens
ggcatctcctgtgc

SEQ ID NO: 4357541 - DNA, 16 bp, Homo sapiens
ggcatgtcccacccac

SEQ ID NO: 4357542 - DNA, 16 bp, Homo sapiens
ggccacacccagcggc

SEQ ID NO: 4357543 - DNA, 19 bp, Homo sapiens
ggccagcgagtggtcaagg

SEQ ID NO: 4357544 - DNA, 23 bp, Homo sapiens
ggccagggaaacaaagtttacat

SEQ ID NO: 4357545 - DNA, 19 bp, Homo sapiens
ggccagtccccgaggagct

SEQ ID NO: 4357546 - DNA, 12 bp, Homo sapiens
ggccatgcagac

SEQ ID NO: 4357547 - DNA, 15 bp, Homo sapiens
ggccatgcagacctc

SEQ ID NO: 4357548 - DNA, 23 bp, Homo sapiens
ggccatgcaggaggtggagaaaa

SEQ ID NO: 4357549 - DNA, 18 bp, Homo sapiens
ggccatttgctagttctg

SEQ ID NO: 4357550 - DNA, 22 bp, Homo sapiens
ggccatttgctagttctgctgc

SEQ ID NO: 4357551 - DNA, 23 bp, Homo sapiens
ggccatttgctagttctgctgcc

SEQ ID NO: 4357552 - DNA, 16 bp, Homo sapiens
ggcccagtgccactgc

SEQ ID NO: 4357553 - DNA, 23 bp, Homo sapiens
ggccccaagaggggcgggctcag

SEQ ID NO: 4357554 - DNA, 19 bp, Homo sapiens
ggccccactttgaagggca

SEQ ID NO: 4357555 - DNA, 19 bp, Homo sapiens
ggccccccgcacagccacc

SEQ ID NO: 4357556 - DNA, 14 bp, Homo sapiens
ggcccggccacacc

SEQ ID NO: 4357557 - DNA, 20 bp, Homo sapiens
ggcccggccacacccagcgg

SEQ ID NO: 4357558 - DNA, 21 bp, Homo sapiens
ggcccggccacacccagcggc

SEQ ID NO: 4357559 - DNA, 15 bp, Homo sapiens
ggccctctgtccaca

SEQ ID NO: 4357560 - DNA, 17 bp, Homo sapiens
ggccctgacttctggag

SEQ ID NO: 4357561 - DNA, 18 bp, Homo sapiens
ggccctggagccagggca

SEQ ID NO: 4357562 - DNA, 19 bp, Homo sapiens
ggccgaagccccttggaga

SEQ ID NO: 4357563 - DNA, 20 bp, Homo sapiens
ggccgaagccccttggagag

SEQ ID NO: 4357564 - DNA, 22 bp, Homo sapiens
ggcctccatgccccagctctgg

SEQ ID NO: 4357565 - DNA, 18 bp, Homo sapiens
ggcctctggttgcctccc

SEQ ID NO: 4357566 - DNA, 15 bp, Homo sapiens
ggcctgcatggagaa

SEQ ID NO: 4357567 - DNA, 16 bp, Homo sapiens
ggcctgcatggagaag

SEQ ID NO: 4357568 - DNA, 17 bp, Homo sapiens
ggcctgcatggagaagg

SEQ ID NO: 4357569 - DNA, 12 bp, Homo sapiens
ggcgggccaggg

SEQ ID NO: 4357570 - DNA, 22 bp, Homo sapiens
ggcgggccagggtgggaagaga

SEQ ID NO: 4357571 - DNA, 20 bp, Homo sapiens
ggcgggctcagagctttgtc

SEQ ID NO: 4357572 - DNA, 15 bp, Homo sapiens
ggcgtctgctctggt

SEQ ID NO: 4357573 - DNA, 15 bp, Homo sapiens
ggctcagagctttgt

SEQ ID NO: 4357574 - DNA, 14 bp, Homo sapiens
ggctctccctgcac

SEQ ID NO: 4357575 - DNA, 15 bp, Homo sapiens
ggctgcctcagccag

SEQ ID NO: 4357576 - DNA, 12 bp, Homo sapiens
ggctgcggcccc

SEQ ID NO: 4357577 - DNA, 14 bp, Homo sapiens
ggctgcggccccct

SEQ ID NO: 4357578 - DNA, 23 bp, Homo sapiens
ggcttggggaaaatggccatgca

SEQ ID NO: 4357579 - DNA, 22 bp, Homo sapiens
gggaaaatggccatgcaggagg

SEQ ID NO: 4357580 - DNA, 14 bp, Homo sapiens
gggaagagaagaaa

SEQ ID NO: 4357581 - DNA, 12 bp, Homo sapiens
gggaccaggagc

SEQ ID NO: 4357582 - DNA, 13 bp, Homo sapiens
gggaccaggagct

SEQ ID NO: 4357583 - DNA, 12 bp, Homo sapiens
gggagagccagc

SEQ ID NO: 4357584 - DNA, 15 bp, Homo sapiens
gggagagccagctcc

SEQ ID NO: 4357585 - DNA, 21 bp, Homo sapiens
gggcagaggaatgtagggcct

SEQ ID NO: 4357586 - DNA, 23 bp, Homo sapiens
gggcagccacccaagcctgctgg

SEQ ID NO: 4357587 - DNA, 20 bp, Homo sapiens
gggcagggcatctcctgtgc

SEQ ID NO: 4357588 - DNA, 18 bp, Homo sapiens
gggccagggtgggaagag

SEQ ID NO: 4357589 - DNA, 14 bp, Homo sapiens
gggccctctgtcca

SEQ ID NO: 4357590 - DNA, 18 bp, Homo sapiens
gggcctccatgccccagc

SEQ ID NO: 4357591 - DNA, 23 bp, Homo sapiens
gggcctccatgccccagctctgg

SEQ ID NO: 4357592 - DNA, 16 bp, Homo sapiens
gggcgcaaaggtgcct

SEQ ID NO: 4357593 - DNA, 13 bp, Homo sapiens
gggctcagagctt

SEQ ID NO: 4357594 - DNA, 20 bp, Homo sapiens
gggctcagagctttgtcact

SEQ ID NO: 4357595 - DNA, 22 bp, Homo sapiens
gggctcagagctttgtcacttg

SEQ ID NO: 4357596 - DNA, 23 bp, Homo sapiens
gggctcagagctttgtcacttgc

SEQ ID NO: 4357597 - DNA, 13 bp, Homo sapiens
gggctcagggttg

SEQ ID NO: 4357598 - DNA, 23 bp, Homo sapiens
ggggaaaatggccatgcaggagg

SEQ ID NO: 4357599 - DNA, 14 bp, Homo sapiens
ggggagcagagaca

SEQ ID NO: 4357600 - DNA, 13 bp, Homo sapiens
ggggcgggctcag

SEQ ID NO: 4357601 - DNA, 12 bp, Homo sapiens
gggggagggaag

SEQ ID NO: 4357602 - DNA, 14 bp, Homo sapiens
ggggtccaggcccg

SEQ ID NO: 4357603 - DNA, 15 bp, Homo sapiens
ggggtccatcccctt

SEQ ID NO: 4357604 - DNA, 14 bp, Homo sapiens
gggtccaggcccgt

SEQ ID NO: 4357605 - DNA, 14 bp, Homo sapiens
tacaaaatgccaag

SEQ ID NO: 4357606 - DNA, 21 bp, Homo sapiens
tacaataagttacttgaaata

SEQ ID NO: 4357607 - DNA, 12 bp, Homo sapiens
tacaatggaaac

SEQ ID NO: 4357608 - DNA, 17 bp, Homo sapiens
tacaatggaaaccattt

SEQ ID NO: 4357609 - DNA, 22 bp, Homo sapiens
tacaatggtttattcccaagta

SEQ ID NO: 4357610 - DNA, 21 bp, Homo sapiens
tacaattttatataattctga

SEQ ID NO: 4357611 - DNA, 23 bp, Homo sapiens
tacaattttatataattctgaaa

SEQ ID NO: 4357612 - DNA, 17 bp, Homo sapiens
tacactgaatatttata

SEQ ID NO: 4357613 - DNA, 16 bp, Homo sapiens
tacactgaatggaaat

SEQ ID NO: 4357614 - DNA, 22 bp, Homo sapiens
tacagaattcctaccaaacagc

SEQ ID NO: 4357615 - DNA, 16 bp, Homo sapiens
tacaggctaaaattag

SEQ ID NO: 4357616 - DNA, 16 bp, Homo sapiens
tacatagtaagtacag

SEQ ID NO: 4357617 - DNA, 13 bp, Homo sapiens
tacatcagaagtt

SEQ ID NO: 4357618 - DNA, 15 bp, Homo sapiens
tacatggtgtttgtg

SEQ ID NO: 4357619 - DNA, 17 bp, Homo sapiens
tacatttaggataatct

SEQ ID NO: 4357620 - DNA, 21 bp, Homo sapiens
taccaaacaaggaagccaaag

SEQ ID NO: 4357621 - DNA, 20 bp, Homo sapiens
taccactgtggccccaagag

SEQ ID NO: 4357622 - DNA, 16 bp, Homo sapiens
taccctaaccaagttc

SEQ ID NO: 4357623 - DNA, 21 bp, Homo sapiens
tacctgaaggcttcaatcatt

SEQ ID NO: 4357624 - DNA, 21 bp, Homo sapiens
tacggctatattggtttatgt

SEQ ID NO: 4357625 - DNA, 17 bp, Homo sapiens
tacgtgattaatatgca

SEQ ID NO: 4357626 - DNA, 20 bp, Homo sapiens
tactcacagctgaagaaaat

SEQ ID NO: 4357627 - DNA, 15 bp, Homo sapiens
tactctgtcagatgg

SEQ ID NO: 4357628 - DNA, 15 bp, Homo sapiens
tactgcccacatttg

SEQ ID NO: 4357629 - DNA, 15 bp, Homo sapiens
tactgtctatatata

SEQ ID NO: 4357630 - DNA, 22 bp, Homo sapiens
tactgtctgactacaacatgca

SEQ ID NO: 4357631 - DNA, 15 bp, Homo sapiens
tactgttttgggcct

SEQ ID NO: 4357632 - DNA, 17 bp, Homo sapiens
tacttaataaattcaga

SEQ ID NO: 4357633 - DNA, 16 bp, Homo sapiens
tacttctttagcattt

SEQ ID NO: 4357634 - DNA, 12 bp, Homo sapiens
tacttgaaataa

SEQ ID NO: 4357635 - DNA, 13 bp, Homo sapiens
tacttgaaataag

SEQ ID NO: 4357636 - DNA, 22 bp, Homo sapiens
tacttgacctctgtgaccaact

SEQ ID NO: 4357637 - DNA, 15 bp, Homo sapiens
tactttgtgcattct

SEQ ID NO: 4357638 - DNA, 20 bp, Homo sapiens
tagaaaatctgagttttaca

SEQ ID NO: 4357639 - DNA, 21 bp, Homo sapiens
tagacagaaaccaagccatta

SEQ ID NO: 4357640 - DNA, 22 bp, Homo sapiens
tagacttgggatggggagggag

SEQ ID NO: 4357641 - DNA, 21 bp, Homo sapiens
tagagtcatctccatcagctg

SEQ ID NO: 4357642 - DNA, 18 bp, Homo sapiens
tagatgtccctttcttgg

SEQ ID NO: 4357643 - DNA, 21 bp, Homo sapiens
tagatgtccctttcttggcca

SEQ ID NO: 4357644 - DNA, 23 bp, Homo sapiens
tagatgtccctttcttggccagt

SEQ ID NO: 4357645 - DNA, 16 bp, Homo sapiens
tagattaaaaaaattt

SEQ ID NO: 4357646 - DNA, 14 bp, Homo sapiens
tagatttaaaataa

SEQ ID NO: 4357647 - DNA, 13 bp, Homo sapiens
tagcagagcctat

SEQ ID NO: 4357648 - DNA, 15 bp, Homo sapiens
tagcatttttatgca

SEQ ID NO: 4357649 - DNA, 19 bp, Homo sapiens
tagccagcattcagcacac

SEQ ID NO: 4357650 - DNA, 20 bp, Homo sapiens
tagccagcattcagcacaca

SEQ ID NO: 4357651 - DNA, 21 bp, Homo sapiens
tagccagcattcagcacacac

SEQ ID NO: 4357652 - DNA, 19 bp, Homo sapiens
tagcccagtccctggagct

SEQ ID NO: 4357653 - DNA, 17 bp, Homo sapiens
tagctttaaaaccacag

SEQ ID NO: 4357654 - DNA, 19 bp, Homo sapiens
taggaagtgtaacagctga

SEQ ID NO: 4357655 - DNA, 16 bp, Homo sapiens
taggaataacactgca

SEQ ID NO: 4357656 - DNA, 14 bp, Homo sapiens
taggactgcagtgt

SEQ ID NO: 4357657 - DNA, 21 bp, Homo sapiens
taggcatgtcccacccacccg

SEQ ID NO: 4357658 - DNA, 21 bp, Homo sapiens
taggcccccaaattgccttca

SEQ ID NO: 4357659 - DNA, 16 bp, Homo sapiens
taggcctgggtgctgg

SEQ ID NO: 4357660 - DNA, 15 bp, Homo sapiens
taggctctgcacaga

SEQ ID NO: 4357661 - DNA, 18 bp, Homo sapiens
taggctctgcacagatgg

SEQ ID NO: 4357662 - DNA, 16 bp, Homo sapiens
tagggaaaccttggag

SEQ ID NO: 4357663 - DNA, 14 bp, Homo sapiens
taggtaggaagagc

SEQ ID NO: 4357664 - DNA, 20 bp, Homo sapiens
tagtatatggcatatgaata

SEQ ID NO: 4357665 - DNA, 15 bp, Homo sapiens
tagttccttgcctta

SEQ ID NO: 4357666 - DNA, 16 bp, Homo sapiens
tagttctgctgccctc

SEQ ID NO: 4357667 - DNA, 19 bp, Homo sapiens
tagttctgctgccctctta

SEQ ID NO: 4357668 - DNA, 23 bp, Homo sapiens
tagtttgtgatgtaaggcactgt

SEQ ID NO: 4357669 - DNA, 15 bp, Homo sapiens
tataaactttagagt

SEQ ID NO: 4357670 - DNA, 21 bp, Homo sapiens
tataaactttagagtagcatg

SEQ ID NO: 4357671 - DNA, 11 bp, Homo sapiens
tataaagtaac

SEQ ID NO: 4357672 - DNA, 21 bp, Homo sapiens
tataatatggatcagagcatt

SEQ ID NO: 4357673 - DNA, 22 bp, Homo sapiens
tataatatggatcagagcattt

SEQ ID NO: 4357674 - DNA, 15 bp, Homo sapiens
tatacctggtttact

SEQ ID NO: 4357675 - DNA, 17 bp, Homo sapiens
tatacctggtttacttc

SEQ ID NO: 4357676 - DNA, 16 bp, Homo sapiens
tatactgtacttaata

SEQ ID NO: 4357677 - DNA, 13 bp, Homo sapiens
tatagcaatccat

SEQ ID NO: 4357678 - DNA, 22 bp, Homo sapiens
tatatgtgtgtgtatgtttgca

SEQ ID NO: 4357679 - DNA, 16 bp, Homo sapiens
tatatttcactatttt

SEQ ID NO: 4357680 - DNA, 17 bp, Homo sapiens
tatatttgtcttccgat

SEQ ID NO: 4357681 - DNA, 23 bp, Homo sapiens
tatcatcggagttgacagtgaaa

SEQ ID NO: 4357682 - DNA, 16 bp, Homo sapiens
tatcattccaattcta

SEQ ID NO: 4357683 - DNA, 17 bp, Homo sapiens
tatcattccaattctaa

SEQ ID NO: 4357684 - DNA, 19 bp, Homo sapiens
tatccagccagtacagtat

SEQ ID NO: 4357685 - DNA, 13 bp, Homo sapiens
tatgaacagctgt

SEQ ID NO: 4357686 - DNA, 14 bp, Homo sapiens
tatgaacagctgtg

SEQ ID NO: 4357687 - DNA, 22 bp, Homo sapiens
tatgcactgtggtttcagatgt

SEQ ID NO: 4357688 - DNA, 23 bp, Homo sapiens
tatgcactgtggtttcagatgtg

SEQ ID NO: 4357689 - DNA, 16 bp, Homo sapiens
tatgcagacagtctgt

SEQ ID NO: 4357690 - DNA, 19 bp, Homo sapiens
tatgcagacagtctgttat

SEQ ID NO: 4357691 - DNA, 22 bp, Homo sapiens
tatgcagacagtctgttatgca

SEQ ID NO: 4357692 - DNA, 16 bp, Homo sapiens
tatgcattatatcaaa

SEQ ID NO: 4357693 - DNA, 13 bp, Homo sapiens
tatgccttaagca

SEQ ID NO: 4357694 - DNA, 17 bp, Homo sapiens
tatgccttaagcagaac

SEQ ID NO: 4357695 - DNA, 22 bp, Homo sapiens
tatgccttaagcagaacaaatg

SEQ ID NO: 4357696 - DNA, 17 bp, Homo sapiens
tatgctttccctgagga

SEQ ID NO: 4357697 - DNA, 14 bp, Homo sapiens
tatgtttgcacact

SEQ ID NO: 4357698 - DNA, 19 bp, Homo sapiens
tattaaattctgaatgcaa

SEQ ID NO: 4357699 - DNA, 18 bp, Homo sapiens
tattatcagacaagatga

SEQ ID NO: 4357700 - DNA, 23 bp, Homo sapiens
tattccatgaatgtatcaggaaa

SEQ ID NO: 4357701 - DNA, 18 bp, Homo sapiens
tattcctggacttacaaa

SEQ ID NO: 4357702 - DNA, 14 bp, Homo sapiens
tattgatgcaatat

SEQ ID NO: 4357703 - DNA, 22 bp, Homo sapiens
tattgatgcaatataagcataa

SEQ ID NO: 4357704 - DNA, 14 bp, Homo sapiens
tatttatatttcac

SEQ ID NO: 4357705 - DNA, 14 bp, Homo sapiens
tatttattgcattg

SEQ ID NO: 4357706 - DNA, 16 bp, Homo sapiens
tatttgtcttccgatc

SEQ ID NO: 4357707 - DNA, 14 bp, Homo sapiens
tatttttaaatgga

SEQ ID NO: 4357708 - DNA, 15 bp, Homo sapiens
tatttttcacagttt

SEQ ID NO: 4357709 - DNA, 20 bp, Homo sapiens
tattttttaaggcaaataaa

SEQ ID NO: 4357710 - DNA, 17 bp, Homo sapiens
tcaaactgctgcatact

SEQ ID NO: 4357711 - DNA, 15 bp, Homo sapiens
tcaaagaacagatgg

SEQ ID NO: 4357712 - DNA, 16 bp, Homo sapiens
tcaaagagattcgaat

SEQ ID NO: 4357713 - DNA, 20 bp, Homo sapiens
tcaaatctaccactgtatga

SEQ ID NO: 4357714 - DNA, 12 bp, Homo sapiens
tcaaattgctgc

SEQ ID NO: 4357715 - DNA, 22 bp, Homo sapiens
tcaaattgtgcagtactttgtg

SEQ ID NO: 4357716 - DNA, 22 bp, Homo sapiens
tcaacatgttactgaccagcaa

SEQ ID NO: 4357717 - DNA, 16 bp, Homo sapiens
tcaacatttatgacct

SEQ ID NO: 4357718 - DNA, 12 bp, Homo sapiens
tcaactgaaggg

SEQ ID NO: 4357719 - DNA, 20 bp, Homo sapiens
tcaagatgctacaatggaaa

SEQ ID NO: 4357720 - DNA, 23 bp, Homo sapiens
tcaagatgctacaatggaaacca

SEQ ID NO: 4357721 - DNA, 22 bp, Homo sapiens
tcaataaaatgtgatttttctg

SEQ ID NO: 4357722 - DNA, 22 bp, Homo sapiens
tcaattagatttaaaataaaca

SEQ ID NO: 4357723 - DNA, 17 bp, Homo sapiens
tcacaagagcccagcag

SEQ ID NO: 4357724 - DNA, 22 bp, Homo sapiens
tgatgttagaagaagaggaaga

SEQ ID NO: 4357725 - DNA, 22 bp, Homo sapiens
tgattagctcaccttgagataa

SEQ ID NO: 4357726 - DNA, 21 bp, Homo sapiens
tgatttcccaaatgaaatact

SEQ ID NO: 4357727 - DNA, 19 bp, Homo sapiens
tgcaacgggattgaagggt

SEQ ID NO: 4357728 - DNA, 14 bp, Homo sapiens
tgcaataatttgta

SEQ ID NO: 4357729 - DNA, 15 bp, Homo sapiens
tgcaataatttgtac

SEQ ID NO: 4357730 - DNA, 17 bp, Homo sapiens
tgcaatgtatagtgtct

SEQ ID NO: 4357731 - DNA, 14 bp, Homo sapiens
tgcacacaggacag

SEQ ID NO: 4357732 - DNA, 21 bp, Homo sapiens
tgcacacttgtgtgtgggctg

SEQ ID NO: 4357733 - DNA, 21 bp, Homo sapiens
tgcacatgtacatatggaaat

SEQ ID NO: 4357734 - DNA, 16 bp, Homo sapiens
tgcacccacctgtttt

SEQ ID NO: 4357735 - DNA, 21 bp, Homo sapiens
tgcacccacctgttttctgaa

SEQ ID NO: 4357736 - DNA, 13 bp, Homo sapiens
tgcactgatgttg

SEQ ID NO: 4357737 - DNA, 13 bp, Homo sapiens
tgcagaaagcatc

SEQ ID NO: 4357738 - DNA, 20 bp, Homo sapiens
tgcagaaagcatccctcacc

SEQ ID NO: 4357739 - DNA, 23 bp, Homo sapiens
tgcagcatgacctgtgaccagca

SEQ ID NO: 4357740 - DNA, 19 bp, Homo sapiens
tgcaggaaatataaactta

SEQ ID NO: 4357741 - DNA, 15 bp, Homo sapiens
tgcaggaggtggaga

SEQ ID NO: 4357742 - DNA, 23 bp, Homo sapiens
tgcaggagttaaaaagggcaggg

SEQ ID NO: 4357743 - DNA, 17 bp, Homo sapiens
tgcagtactttgtgcat

SEQ ID NO: 4357744 - DNA, 22 bp, Homo sapiens
tgcagtttggccctggagccag

SEQ ID NO: 4357745 - DNA, 23 bp, Homo sapiens
tgcagtttggccctggagccagg

SEQ ID NO: 4357746 - DNA, 22 bp, Homo sapiens
tgcatgtacttgaaggatggat

SEQ ID NO: 4357747 - DNA, 16 bp, Homo sapiens
tgcattctggatttta

SEQ ID NO: 4357748 - DNA, 14 bp, Homo sapiens
tgcattgttataat

SEQ ID NO: 4357749 - DNA, 18 bp, Homo sapiens
tgccaagggggtgactgg

SEQ ID NO: 4357750 - DNA, 12 bp, Homo sapiens
tgccacccacca

SEQ ID NO: 4357751 - DNA, 18 bp, Homo sapiens
tgccactgccccccgagg

SEQ ID NO: 4357752 - DNA, 10 bp, Homo sapiens
tgccagaaga

SEQ ID NO: 4357753 - DNA, 13 bp, Homo sapiens
tgccagaagagaa

SEQ ID NO: 4357754 - DNA, 17 bp, Homo sapiens
tgccagaagagaattca

SEQ ID NO: 4357755 - DNA, 21 bp, Homo sapiens
tgccagaagagaattcagtat

SEQ ID NO: 4357756 - DNA, 23 bp, Homo sapiens
tgccatccttgctgcagcttcta

SEQ ID NO: 4357757 - DNA, 22 bp, Homo sapiens
tgcccagacccctctggccagg

SEQ ID NO: 4357758 - DNA, 15 bp, Homo sapiens
tgcccagctctctga

SEQ ID NO: 4357759 - DNA, 14 bp, Homo sapiens
tgcccatggctggg

SEQ ID NO: 4357760 - DNA, 16 bp, Homo sapiens
tgcccatggctgggaa

SEQ ID NO: 4357761 - DNA, 15 bp, Homo sapiens
tgccccagctctgga

SEQ ID NO: 4357762 - DNA, 18 bp, Homo sapiens
tgccccccgaggctgcta

SEQ ID NO: 4357763 - DNA, 19 bp, Homo sapiens
tgccccccgaggctgctag

SEQ ID NO: 4357764 - DNA, 16 bp, Homo sapiens
tgcccccgcctgccac

SEQ ID NO: 4357765 - DNA, 22 bp, Homo sapiens
tgcccctgcagtttggccctgg

SEQ ID NO: 4357766 - DNA, 17 bp, Homo sapiens
tgcccgtgcccgcagga

SEQ ID NO: 4357767 - DNA, 21 bp, Homo sapiens
tgccctcttaagatctgactg

SEQ ID NO: 4357768 - DNA, 12 bp, Homo sapiens
tgccctgcctga

SEQ ID NO: 4357769 - DNA, 16 bp, Homo sapiens
tgccctgcctgaggag

SEQ ID NO: 4357770 - DNA, 19 bp, Homo sapiens
tgccgacttggagactcct

SEQ ID NO: 4357771 - DNA, 22 bp, Homo sapiens
tgcctcagccagtggcacagga

SEQ ID NO: 4357772 - DNA, 23 bp, Homo sapiens
tgcctccctggggaccaggagct

SEQ ID NO: 4357773 - DNA, 18 bp, Homo sapiens
tgcctctggaaaactatt

SEQ ID NO: 4357774 - DNA, 19 bp, Homo sapiens
tgcctgaggaggaggacac

SEQ ID NO: 4357775 - DNA, 21 bp, Homo sapiens
tgcctgaggaggaggacacag

SEQ ID NO: 4357776 - DNA, 16 bp, Homo sapiens
tgcctggctagaaaac

SEQ ID NO: 4357777 - DNA, 15 bp, Homo sapiens
tgcctgggaatgtat

SEQ ID NO: 4357778 - DNA, 16 bp, Homo sapiens
tgcctgggaatgtatt

SEQ ID NO: 4357779 - DNA, 20 bp, Homo sapiens
tgcctgtgccacccaccagg

SEQ ID NO: 4357780 - DNA, 14 bp, Homo sapiens
tgccttaagcagaa

SEQ ID NO: 4357781 - DNA, 21 bp, Homo sapiens
tgccttaagcagaacaaatgt

SEQ ID NO: 4357782 - DNA, 18 bp, Homo sapiens
tgccttaataaatatgta

SEQ ID NO: 4357783 - DNA, 21 bp, Homo sapiens
tgccttaataaatatgtaata

SEQ ID NO: 4357784 - DNA, 23 bp, Homo sapiens
tgccttaataaatatgtaatata

SEQ ID NO: 4357785 - DNA, 15 bp, Homo sapiens
tgccttcagccctaa

SEQ ID NO: 4357786 - DNA, 13 bp, Homo sapiens
tgccttggaaaca

SEQ ID NO: 4357787 - DNA, 23 bp, Homo sapiens
tgcggccccctctcggccaggca

SEQ ID NO: 4357788 - DNA, 22 bp, Homo sapiens
tgcgggcgcgggcagccaccca

SEQ ID NO: 4357789 - DNA, 23 bp, Homo sapiens
tgcgggcgcgggcagccacccaa

SEQ ID NO: 4357790 - DNA, 18 bp, Homo sapiens
tgcgtgttcagcagaacc

SEQ ID NO: 4357791 - DNA, 16 bp, Homo sapiens
tgctagacagaaacca

SEQ ID NO: 4357792 - DNA, 21 bp, Homo sapiens
tgctagacagaaaccaagcca

SEQ ID NO: 4357793 - DNA, 19 bp, Homo sapiens
tgctatcctgcaggaaata

SEQ ID NO: 4357794 - DNA, 20 bp, Homo sapiens
tgctatcctgcaggaaatat

SEQ ID NO: 4357795 - DNA, 16 bp, Homo sapiens
tgctccagattctgat

SEQ ID NO: 4357796 - DNA, 17 bp, Homo sapiens
tgctctcagcctcccac

SEQ ID NO: 4357797 - DNA, 18 bp, Homo sapiens
tgctctcagcctcccaca

SEQ ID NO: 4357798 - DNA, 19 bp, Homo sapiens
tgctctcagcctcccacaa

SEQ ID NO: 4357799 - DNA, 22 bp, Homo sapiens
tgctgcatactttgacaaggaa

SEQ ID NO: 4357800 - DNA, 12 bp, Homo sapiens
tgctgctctcag

SEQ ID NO: 4357801 - DNA, 21 bp, Homo sapiens
tgctggctgcccagacccctc

SEQ ID NO: 4357802 - DNA, 12 bp, Homo sapiens
tgctgggccagg

SEQ ID NO: 4357803 - DNA, 14 bp, Homo sapiens
tgctggtagagacc

SEQ ID NO: 4357804 - DNA, 14 bp, Homo sapiens
tgcttctctacaga

SEQ ID NO: 4357805 - DNA, 19 bp, Homo sapiens
tgctttccctgaggaatga

SEQ ID NO: 4357806 - DNA, 21 bp, Homo sapiens
tggaaaactattgagccttgc

SEQ ID NO: 4357807 - DNA, 14 bp, Homo sapiens
tggaaacaggacca

SEQ ID NO: 4357808 - DNA, 21 bp, Homo sapiens
tggaaacatttttgagatatt

SEQ ID NO: 4357809 - DNA, 15 bp, Homo sapiens
tggaaaccatttctg

SEQ ID NO: 4357810 - DNA, 19 bp, Homo sapiens
tggaactctactcaaccca

SEQ ID NO: 4357811 - DNA, 21 bp, Homo sapiens
tggaaggatctgctgaggccc

SEQ ID NO: 4357812 - DNA, 13 bp, Homo sapiens
tggaagttttcag

SEQ ID NO: 4357813 - DNA, 18 bp, Homo sapiens
tggagaaaattggaactc

SEQ ID NO: 4357814 - DNA, 20 bp, Homo sapiens
tggagaagggttctgccctg

SEQ ID NO: 4357815 - DNA, 22 bp, Homo sapiens
tggagaagggttctgccctgcc

SEQ ID NO: 4357816 - DNA, 21 bp, Homo sapiens
tggagagagaggctgcctcag

SEQ ID NO: 4357817 - DNA, 12 bp, Homo sapiens
tggagaggagag

SEQ ID NO: 4357818 - DNA, 14 bp, Homo sapiens
tggagatggatcct

SEQ ID NO: 4357819 - DNA, 18 bp, Homo sapiens
tggagccagggcagagga

SEQ ID NO: 4357820 - DNA, 19 bp, Homo sapiens
tggagccagggcagaggaa

SEQ ID NO: 4357821 - DNA, 14 bp, Homo sapiens
tggaggaggaggag

SEQ ID NO: 4357822 - DNA, 20 bp, Homo sapiens
tggaggggtggtcctgactc

SEQ ID NO: 4357823 - DNA, 19 bp, Homo sapiens
tggagttcaccttggaagg

SEQ ID NO: 4357824 - DNA, 14 bp, Homo sapiens
tggagtttgtattt

SEQ ID NO: 4357825 - DNA, 20 bp, Homo sapiens
tggagtttgtattttgcata

SEQ ID NO: 4357826 - DNA, 16 bp, Homo sapiens
tggataatcaggaaaa

SEQ ID NO: 4357827 - DNA, 22 bp, Homo sapiens
tggatagacttgggatggggag

SEQ ID NO: 4357828 - DNA, 21 bp, Homo sapiens
tggatatcagggtataaatta

SEQ ID NO: 4357829 - DNA, 19 bp, Homo sapiens
tggatatgacccacactgc

SEQ ID NO: 4357830 - DNA, 19 bp, Homo sapiens
tggatcagagcatttattt

SEQ ID NO: 4357831 - DNA, 20 bp, Homo sapiens
tggatcagagcatttatttt

SEQ ID NO: 4357832 - DNA, 14 bp, Homo sapiens
tggatccttccatc

SEQ ID NO: 4357833 - DNA, 13 bp, Homo sapiens
tggatgaaggcaa

SEQ ID NO: 4357834 - DNA, 15 bp, Homo sapiens
tggatgagtcagaca

SEQ ID NO: 4357835 - DNA, 18 bp, Homo sapiens
tggatgttatgaacagct

SEQ ID NO: 4357836 - DNA, 18 bp, Homo sapiens
tggatttgcctgtgccac

SEQ ID NO: 4357837 - DNA, 21 bp, Homo sapiens
tggcatttggtctcaggcagc

SEQ ID NO: 4357838 - DNA, 14 bp, Homo sapiens
tggccaggatggag

SEQ ID NO: 4357839 - DNA, 18 bp, Homo sapiens
tggccatgcaggaggtgg

SEQ ID NO: 4357840 - DNA, 21 bp, Homo sapiens
tggccatgcaggaggtggaga

SEQ ID NO: 4357841 - DNA, 19 bp, Homo sapiens
tggccatttgctagttctg

SEQ ID NO: 4357842 - DNA, 12 bp, Homo sapiens
tggccctggagc

SEQ ID NO: 4357843 - DNA, 15 bp, Homo sapiens
ttgctgggccaggga

SEQ ID NO: 4357844 - DNA, 14 bp, Homo sapiens
ttggaactctactc

SEQ ID NO: 4357845 - DNA, 13 bp, Homo sapiens
ttggagaggagag

SEQ ID NO: 4357846 - DNA, 17 bp, Homo sapiens
ttggccatttgctagtt

SEQ ID NO: 4357847 - DNA, 20 bp, Homo sapiens
ttggccccactttgaagggc

SEQ ID NO: 4357848 - DNA, 13 bp, Homo sapiens
ttggccctggagc

SEQ ID NO: 4357849 - DNA, 15 bp, Homo sapiens
ttggccctggagcca

SEQ ID NO: 4357850 - DNA, 18 bp, Homo sapiens
ttggccctggagccaggg

SEQ ID NO: 4357851 - DNA, 22 bp, Homo sapiens
ttggccctggagccagggcaga

SEQ ID NO: 4357852 - DNA, 17 bp, Homo sapiens
ttggctcagcccgctga

SEQ ID NO: 4357853 - DNA, 22 bp, Homo sapiens
ttgggcctccatgccccagctc

SEQ ID NO: 4357854 - DNA, 20 bp, Homo sapiens
ttgggctcagggttggccat

SEQ ID NO: 4357855 - DNA, 21 bp, Homo sapiens
ttgggctcagggttggccatt

SEQ ID NO: 4357856 - DNA, 21 bp, Homo sapiens
ttgggggaatgcacctcccca

SEQ ID NO: 4357857 - DNA, 18 bp, Homo sapiens
ttggtaaaaatgctgctc

SEQ ID NO: 4357858 - DNA, 15 bp, Homo sapiens
ttgtacaatggttta

SEQ ID NO: 4357859 - DNA, 19 bp, Homo sapiens
ttgtagtccatttaaatgc

SEQ ID NO: 4357860 - DNA, 12 bp, Homo sapiens
ttgtattttgca

SEQ ID NO: 4357861 - DNA, 16 bp, Homo sapiens
ttgtcacttgccacat

SEQ ID NO: 4357862 - DNA, 20 bp, Homo sapiens
ttgtcacttgccacatggtg

SEQ ID NO: 4357863 - DNA, 13 bp, Homo sapiens
ttgtcctgtagct

SEQ ID NO: 4357864 - DNA, 21 bp, Homo sapiens
ttgtcctttttcactttgaaa

SEQ ID NO: 4357865 - DNA, 19 bp, Homo sapiens
ttgtctttcaatgcagttt

SEQ ID NO: 4357866 - DNA, 12 bp, Homo sapiens
ttgtgagctgga

SEQ ID NO: 4357867 - DNA, 13 bp, Homo sapiens
ttgtgagctggat

SEQ ID NO: 4357868 - DNA, 13 bp, Homo sapiens
ttgtggggccagg

SEQ ID NO: 4357869 - DNA, 15 bp, Homo sapiens
ttgtgtacagtgtgt

SEQ ID NO: 4357870 - DNA, 14 bp, Homo sapiens
tttaaggcaaataa

SEQ ID NO: 4357871 - DNA, 18 bp, Homo sapiens
tttaagttaatgaaataa

SEQ ID NO: 4357872 - DNA, 23 bp, Homo sapiens
tttacaccaatttggtaaaaatg

SEQ ID NO: 4357873 - DNA, 22 bp, Homo sapiens
tttaccctttggccccactttg

SEQ ID NO: 4357874 - DNA, 17 bp, Homo sapiens
tttactgtctatatata

SEQ ID NO: 4357875 - DNA, 17 bp, Homo sapiens
tttacttttcacactgt

SEQ ID NO: 4357876 - DNA, 18 bp, Homo sapiens
tttagagtagcatgagag

SEQ ID NO: 4357877 - DNA, 17 bp, Homo sapiens
tttagcatttttatgca

SEQ ID NO: 4357878 - DNA, 21 bp, Homo sapiens
tttatgacctaagtcaggtaa

SEQ ID NO: 4357879 - DNA, 18 bp, Homo sapiens
tttatgcagacagtctgt

SEQ ID NO: 4357880 - DNA, 14 bp, Homo sapiens
tttattcccaagta

SEQ ID NO: 4357881 - DNA, 22 bp, Homo sapiens
tttcaattagatttaaaataaa

SEQ ID NO: 4357882 - DNA, 14 bp, Homo sapiens
tttcacactgtctt

SEQ ID NO: 4357883 - DNA, 17 bp, Homo sapiens
tttcacactgtcttccc

SEQ ID NO: 4357884 - DNA, 15 bp, Homo sapiens
tttcactttgaaaag

SEQ ID NO: 4357885 - DNA, 16 bp, Homo sapiens
tttcagatgtgcaata

SEQ ID NO: 4357886 - DNA, 20 bp, Homo sapiens
tttcaggatactctgtcaga

SEQ ID NO: 4357887 - DNA, 17 bp, Homo sapiens
tttctcccagcttcaaa

SEQ ID NO: 4357888 - DNA, 21 bp, Homo sapiens
tttctcccagcttcaaatgca

SEQ ID NO: 4357889 - DNA, 11 bp, Homo sapiens
tttcttgctgg

SEQ ID NO: 4357890 - DNA, 20 bp, Homo sapiens
tttcttggtggcagaatgaa

SEQ ID NO: 4357891 - DNA, 22 bp, Homo sapiens
tttgaacaactaggcttcagca

SEQ ID NO: 4357892 - DNA, 17 bp, Homo sapiens
tttgacaaggaaaatct

SEQ ID NO: 4357893 - DNA, 21 bp, Homo sapiens
tttgcagtagagtcatctcca

SEQ ID NO: 4357894 - DNA, 16 bp, Homo sapiens
tttggccccactttga

SEQ ID NO: 4357895 - DNA, 12 bp, Homo sapiens
tttggccctgga

SEQ ID NO: 4357896 - DNA, 17 bp, Homo sapiens
tttgtattttgcatact

SEQ ID NO: 4357897 - DNA, 20 bp, Homo sapiens
ttttaaggcaaataaagatg

SEQ ID NO: 4357898 - DNA, 19 bp, Homo sapiens
ttttaagttaatgaaataa

SEQ ID NO: 4357899 - DNA, 14 bp, Homo sapiens
ttttaggctacagt

SEQ ID NO: 4357900 - DNA, 12 bp, Homo sapiens
ttttatactgta

SEQ ID NO: 4357901 - DNA, 15 bp, Homo sapiens
ttttatactgtactt

SEQ ID NO: 4357902 - DNA, 21 bp, Homo sapiens
ttttctctgtagttacattta

SEQ ID NO: 4357903 - DNA, 12 bp, Homo sapiens
ttttctgaaaca

SEQ ID NO: 4357904 - DNA, 22 bp, Homo sapiens
ttttgcagtagagtcatctcca

SEQ ID NO: 4357905 - DNA, 10 bp, Homo sapiens
ttttgtctgt

SEQ ID NO: 4357906 - DNA, 13 bp, Homo sapiens
ttttgtgtacagt

SEQ ID NO: 4357907 - DNA, 17 bp, Homo sapiens
tttttatgcagacagtc

SEQ ID NO: 4357908 - DNA, 14 bp, Homo sapiens
tttttattatgcat

SEQ ID NO: 4357909 - DNA, 22 bp, Homo sapiens
tgcagccctctccaccctccgg

SEQ ID NO: 4357910 - DNA, 23 bp, Homo sapiens
tgcagccctctccaccctccggc

SEQ ID NO: 4357911 - DNA, 16 bp, Homo sapiens
tgcaggaggtggagaa

SEQ ID NO: 4357912 - DNA, 18 bp, Homo sapiens
tgcagtactttgtgcatt

SEQ ID NO: 4357913 - DNA, 19 bp, Homo sapiens
tgcagtagagtcatctcca

SEQ ID NO: 4357914 - DNA, 12 bp, Homo sapiens
tgcagtgtggag

SEQ ID NO: 4357915 - DNA, 16 bp, Homo sapiens
tgcagtttggccctgg

SEQ ID NO: 4357916 - DNA, 20 bp, Homo sapiens
tgcagtttggccctggagcc

SEQ ID NO: 4357917 - DNA, 20 bp, Homo sapiens
tgcatactcaaggtgagaat

SEQ ID NO: 4357918 - DNA, 21 bp, Homo sapiens
tgcatactttgacaaggaaaa

SEQ ID NO: 4357919 - DNA, 14 bp, Homo sapiens
tgcatatgcaatgt

SEQ ID NO: 4357920 - DNA, 18 bp, Homo sapiens
tgcatatttattgcattg

SEQ ID NO: 4357921 - DNA, 22 bp, Homo sapiens
tgcatatttattgcattgctgg

SEQ ID NO: 4357922 - DNA, 22 bp, Homo sapiens
tgcatgatttcccaaatgaaat

SEQ ID NO: 4357923 - DNA, 23 bp, Homo sapiens
tgcatgatttcccaaatgaaata

SEQ ID NO: 4357924 - DNA, 12 bp, Homo sapiens
tgcatggagaag

SEQ ID NO: 4357925 - DNA, 16 bp, Homo sapiens
tgcatgggtgaaggga

SEQ ID NO: 4357926 - DNA, 17 bp, Homo sapiens
tgcatgggtgaagggag

SEQ ID NO: 4357927 - DNA, 13 bp, Homo sapiens
tgcatgtacttga

SEQ ID NO: 4357928 - DNA, 21 bp, Homo sapiens
tgccaaataaatcatcctcat

SEQ ID NO: 4357929 - DNA, 18 bp, Homo sapiens
tgccacatggtgtctccc

SEQ ID NO: 4357930 - DNA, 20 bp, Homo sapiens
tgccacatggtgtctcccaa

SEQ ID NO: 4357931 - DNA, 21 bp, Homo sapiens
tgccaccggaggtcactccac

SEQ ID NO: 4357932 - DNA, 14 bp, Homo sapiens
tgccactgcccccc

SEQ ID NO: 4357933 - DNA, 14 bp, Homo sapiens
tgccataatcagaa

SEQ ID NO: 4357934 - DNA, 18 bp, Homo sapiens
tgccataatcagaacaca

SEQ ID NO: 4357935 - DNA, 17 bp, Homo sapiens
tgcccacatttgggctc

SEQ ID NO: 4357936 - DNA, 21 bp, Homo sapiens
tgcccacatttgggctcaggg

SEQ ID NO: 4357937 - DNA, 14 bp, Homo sapiens
tgcccagctctctg

SEQ ID NO: 4357938 - DNA, 16 bp, Homo sapiens
tgcccagctctctgac

SEQ ID NO: 4357939 - DNA, 18 bp, Homo sapiens
tgcccagctctctgacgc

SEQ ID NO: 4357940 - DNA, 17 bp, Homo sapiens
tgcccatggctgggaac

SEQ ID NO: 4357941 - DNA, 13 bp, Homo sapiens
tgccccagctctg

SEQ ID NO: 4357942 - DNA, 16 bp, Homo sapiens
tgccccagctctggat

SEQ ID NO: 4357943 - DNA, 14 bp, Homo sapiens
tgcccccgcctgcc

SEQ ID NO: 4357944 - DNA, 16 bp, Homo sapiens
tgcccctgcagtttgg

SEQ ID NO: 4357945 - DNA, 20 bp, Homo sapiens
tgcccctgcagtttggccct

SEQ ID NO: 4357946 - DNA, 21 bp, Homo sapiens
tgcccctgcagtttggccctg

SEQ ID NO: 4357947 - DNA, 15 bp, Homo sapiens
tgcccgtgcccgcag

SEQ ID NO: 4357948 - DNA, 14 bp, Homo sapiens
tgccctgcctgagg

SEQ ID NO: 4357949 - DNA, 15 bp, Homo sapiens
tgccctgcctgagga

SEQ ID NO: 4357950 - DNA, 19 bp, Homo sapiens
tgccggtgggaccctgtcc

SEQ ID NO: 4357951 - DNA, 22 bp, Homo sapiens
tgcctccctggggaccaggagc

SEQ ID NO: 4357952 - DNA, 11 bp, Homo sapiens
tgcctgaggag

SEQ ID NO: 4357953 - DNA, 23 bp, Homo sapiens
tgcctgaggaggaggacacagca

SEQ ID NO: 4357954 - DNA, 21 bp, Homo sapiens
tgcctgctgtgttaagaggac

SEQ ID NO: 4357955 - DNA, 14 bp, Homo sapiens
tgcctgggaatgta

SEQ ID NO: 4357956 - DNA, 12 bp, Homo sapiens
tgccttaagcag

SEQ ID NO: 4357957 - DNA, 13 bp, Homo sapiens
tgccttaagcaga

SEQ ID NO: 4357958 - DNA, 15 bp, Homo sapiens
tgccttaataaatat

SEQ ID NO: 4357959 - DNA, 20 bp, Homo sapiens
tgccttaataaatatgtaat

SEQ ID NO: 4357960 - DNA, 13 bp, Homo sapiens
tgcgtctccagtc

SEQ ID NO: 4357961 - DNA, 15 bp, Homo sapiens
tgcgtctccagtcat

SEQ ID NO: 4357962 - DNA, 17 bp, Homo sapiens
tgcgtctccagtcatct

SEQ ID NO: 4357963 - DNA, 14 bp, Homo sapiens
tgcgtgttcagcag

SEQ ID NO: 4357964 - DNA, 16 bp, Homo sapiens
tgcgtgttcagcagaa

SEQ ID NO: 4357965 - DNA, 20 bp, Homo sapiens
tgcgtgttcagcagaacctg

SEQ ID NO: 4357966 - DNA, 14 bp, Homo sapiens
tgctatcctgcagg

SEQ ID NO: 4357967 - DNA, 18 bp, Homo sapiens
tgctatcctgcaggaaat

SEQ ID NO: 4357968 - DNA, 22 bp, Homo sapiens
tgctatcctgcaggaaatataa

SEQ ID NO: 4357969 - DNA, 13 bp, Homo sapiens
tgctccagattct

SEQ ID NO: 4357970 - DNA, 18 bp, Homo sapiens
tgctccagattctgatgc

SEQ ID NO: 4357971 - DNA, 15 bp, Homo sapiens
tgctctcagcctccc

SEQ ID NO: 4357972 - DNA, 16 bp, Homo sapiens
tgctctcagcctccca

SEQ ID NO: 4357973 - DNA, 22 bp, Homo sapiens
tgctctggtggcttaagtgagc

SEQ ID NO: 4357974 - DNA, 14 bp, Homo sapiens
tgctgcatactttg

SEQ ID NO: 4357975 - DNA, 15 bp, Homo sapiens
tgctgcatactttga

SEQ ID NO: 4357976 - DNA, 13 bp, Homo sapiens
tgctgctgcctcc

SEQ ID NO: 4357977 - DNA, 14 bp, Homo sapiens
tgctggctgcggcc

SEQ ID NO: 4357978 - DNA, 13 bp, Homo sapiens
tgctgggccaggg

SEQ ID NO: 4357979 - DNA, 16 bp, Homo sapiens
tgctgggccagggaaa

SEQ ID NO: 4357980 - DNA, 18 bp, Homo sapiens
tgctgggccagggaaaca

SEQ ID NO: 4357981 - DNA, 14 bp, Homo sapiens
tgctggtgtggtct

SEQ ID NO: 4357982 - DNA, 16 bp, Homo sapiens
tgcttctctacagact

SEQ ID NO: 4357983 - DNA, 16 bp, Homo sapiens
tgctttccctgaggaa

SEQ ID NO: 4357984 - DNA, 12 bp, Homo sapiens
tgcttttagaat

SEQ ID NO: 4357985 - DNA, 16 bp, Homo sapiens
tggaaaccttccaccc

SEQ ID NO: 4357986 - DNA, 15 bp, Homo sapiens
tggaaggatctgctg

SEQ ID NO: 4357987 - DNA, 19 bp, Homo sapiens
tggaaggatctgctgaggc

SEQ ID NO: 4357988 - DNA, 15 bp, Homo sapiens
tggaagttttcagga

SEQ ID NO: 4357989 - DNA, 15 bp, Homo sapiens
tggactgaagcctgc

SEQ ID NO: 4357990 - DNA, 19 bp, Homo sapiens
tggactgaagcctgcagga

SEQ ID NO: 4357991 - DNA, 17 bp, Homo sapiens
tggacttacaaaatgcc

SEQ ID NO: 4357992 - DNA, 19 bp, Homo sapiens
tggacttacaaaatgccaa

SEQ ID NO: 4357993 - DNA, 21 bp, Homo sapiens
tggagaagggttctgccctgc

SEQ ID NO: 4357994 - DNA, 15 bp, Homo sapiens
tggagagagaggctg

SEQ ID NO: 4357995 - DNA, 14 bp, Homo sapiens
tggagagcagcagg

SEQ ID NO: 4357996 - DNA, 15 bp, Homo sapiens
tggagagcagcaggt

SEQ ID NO: 4357997 - DNA, 22 bp, Homo sapiens
tggagaggttataggtcactcc

SEQ ID NO: 4357998 - DNA, 20 bp, Homo sapiens
tggaggaggaggaggagcct

SEQ ID NO: 4357999 - DNA, 19 bp, Homo sapiens
tggaggggtggtcctgact

SEQ ID NO: 4358000 - DNA, 14 bp, Homo sapiens
tggatatcagggta

SEQ ID NO: 4358001 - DNA, 20 bp, Homo sapiens
tggatatcagggtataaatt

SEQ ID NO: 4358002 - DNA, 12 bp, Homo sapiens
tggatatgaccc

SEQ ID NO: 4358003 - DNA, 16 bp, Homo sapiens
tggatgttatgaacag

SEQ ID NO: 4358004 - DNA, 17 bp, Homo sapiens
tggatgttatgaacagc

SEQ ID NO: 4358005 - DNA, 21 bp, Homo sapiens
tggatgttatgaacagctgtg

SEQ ID NO: 4358006 - DNA, 15 bp, Homo sapiens
tggatttgcatattt

SEQ ID NO: 4358007 - DNA, 15 bp, Homo sapiens
tggcagaatgaaaat

SEQ ID NO: 4358008 - DNA, 16 bp, Homo sapiens
tggcagaatgaaaatc

SEQ ID NO: 4358009 - DNA, 15 bp, Homo sapiens
tggcaggtgggctgc

SEQ ID NO: 4358010 - DNA, 18 bp, Homo sapiens
tggcatttggtctcaggc

SEQ ID NO: 4358011 - DNA, 22 bp, Homo sapiens
tggcatttggtctcaggcagca

SEQ ID NO: 4358012 - DNA, 12 bp, Homo sapiens
tggccaggatgg

SEQ ID NO: 4358013 - DNA, 16 bp, Homo sapiens
tggccagttatccctt

SEQ ID NO: 4358014 - DNA, 15 bp, Homo sapiens
tggccatgcaggagg

SEQ ID NO: 4358015 - DNA, 20 bp, Homo sapiens
tggccatttgctagttctgc

SEQ ID NO: 4358016 - DNA, 21 bp, Homo sapiens
tggccccaagaggggcgggct

SEQ ID NO: 4358017 - DNA, 16 bp, Homo sapiens
tggccccactttgaag

SEQ ID NO: 4358018 - DNA, 17 bp, Homo sapiens
tggccctgacttctgga

SEQ ID NO: 4358019 - DNA, 14 bp, Homo sapiens
tggccctggagcca

SEQ ID NO: 4358020 - DNA, 16 bp, Homo sapiens
tggccctggagccagg

SEQ ID NO: 4358021 - DNA, 13 bp, Homo sapiens
tggcggccttccg

SEQ ID NO: 4358022 - DNA, 18 bp, Homo sapiens
tggcgtctgctctggtgg

SEQ ID NO: 4358023 - DNA, 19 bp, Homo sapiens
tggcgtctgctctggtggc

SEQ ID NO: 4358024 - DNA, 23 bp, Homo sapiens
tggctgcccagacccctctggcc

SEQ ID NO: 4358025 - DNA, 22 bp, Homo sapiens
tggcttaagtgagcagaacagg

SEQ ID NO: 4358026 - DNA, 18 bp, Homo sapiens
tgggaacatgacccagcc

SEQ ID NO: 4358027 - DNA, 21 bp, Homo sapiens
tgggaacatgacccagcctga

SEQ ID NO: 4358028 - DNA, 21 bp, Homo sapiens
tgggaaggttagaaaggcagc

SEQ ID NO: 4358029 - DNA, 18 bp, Homo sapiens
tgggaggtgcgtgttcag

SEQ ID NO: 4358030 - DNA, 15 bp, Homo sapiens
tctgctataaacttt

SEQ ID NO: 4358031 - DNA, 14 bp, Homo sapiens
tctggaaaactatt

SEQ ID NO: 4358032 - DNA, 21 bp, Homo sapiens
tctggaaaactattgagcctt

SEQ ID NO: 4358033 - DNA, 23 bp, Homo sapiens
tctggaaaactattgagccttgc

SEQ ID NO: 4358034 - DNA, 17 bp, Homo sapiens
tctggactgaagcctgc

SEQ ID NO: 4358035 - DNA, 21 bp, Homo sapiens
tctggactgaagcctgcagga

SEQ ID NO: 4358036 - DNA, 22 bp, Homo sapiens
tctggagaggttataggtcact

SEQ ID NO: 4358037 - DNA, 12 bp, Homo sapiens
tctggttgcctc

SEQ ID NO: 4358038 - DNA, 16 bp, Homo sapiens
tctgtaagagcttgct

SEQ ID NO: 4358039 - DNA, 20 bp, Homo sapiens
tctgtaagagcttgctccag

SEQ ID NO: 4358040 - DNA, 14 bp, Homo sapiens
tctgtagttacatt

SEQ ID NO: 4358041 - DNA, 14 bp, Homo sapiens
tctgtctaggactg

SEQ ID NO: 4358042 - DNA, 23 bp, Homo sapiens
tctgtctaggactgcagtgtgga

SEQ ID NO: 4358043 - DNA, 23 bp, Homo sapiens
tctgtctccctcccctctcagaa

SEQ ID NO: 4358044 - DNA, 17 bp, Homo sapiens
tctgtgaccaactgttg

SEQ ID NO: 4358045 - DNA, 12 bp, Homo sapiens
tctgtgactgga

SEQ ID NO: 4358046 - DNA, 13 bp, Homo sapiens
tctgtgactggat

SEQ ID NO: 4358047 - DNA, 12 bp, Homo sapiens
tctgttatgcac

SEQ ID NO: 4358048 - DNA, 18 bp, Homo sapiens
tctgttgccacaaccctg

SEQ ID NO: 4358049 - DNA, 18 bp, Homo sapiens
tcttcagaagacactgca

SEQ ID NO: 4358050 - DNA, 17 bp, Homo sapiens
tcttctgaataaagcaa

SEQ ID NO: 4358051 - DNA, 16 bp, Homo sapiens
tcttgtggggccagga

SEQ ID NO: 4358052 - DNA, 18 bp, Homo sapiens
tctttaccttctaaaagc

SEQ ID NO: 4358053 - DNA, 18 bp, Homo sapiens
tctttgtgttgataagct

SEQ ID NO: 4358054 - DNA, 17 bp, Homo sapiens
tctttttttgagtgaca

SEQ ID NO: 4358055 - DNA, 19 bp, Homo sapiens
tgaaacaaatttacatcag

SEQ ID NO: 4358056 - DNA, 15 bp, Homo sapiens
tgaaaggaagtataa

SEQ ID NO: 4358057 - DNA, 17 bp, Homo sapiens
tgaaataagttgtttca

SEQ ID NO: 4358058 - DNA, 17 bp, Homo sapiens
tgaaatgaaaattttaa

SEQ ID NO: 4358059 - DNA, 17 bp, Homo sapiens
tgaaatgtttttaatgt

SEQ ID NO: 4358060 - DNA, 17 bp, Homo sapiens
tgaacaaagtgagaaat

SEQ ID NO: 4358061 - DNA, 18 bp, Homo sapiens
tgaacaaagtgagaaatg

SEQ ID NO: 4358062 - DNA, 20 bp, Homo sapiens
tgaacagctgtgtctgccaa

SEQ ID NO: 4358063 - DNA, 13 bp, Homo sapiens
tgaacattcccag

SEQ ID NO: 4358064 - DNA, 17 bp, Homo sapiens
tgaacattcccagccca

SEQ ID NO: 4358065 - DNA, 18 bp, Homo sapiens
tgaacattcccagcccag

SEQ ID NO: 4358066 - DNA, 11 bp, Homo sapiens
tgaactccaga

SEQ ID NO: 4358067 - DNA, 12 bp, Homo sapiens
tgaagcaggagg

SEQ ID NO: 4358068 - DNA, 15 bp, Homo sapiens
tgaagcaggaggccc

SEQ ID NO: 4358069 - DNA, 17 bp, Homo sapiens
tgaagcctggattccag

SEQ ID NO: 4358070 - DNA, 22 bp, Homo sapiens
tgaagcctggattccagcagtg

SEQ ID NO: 4358071 - DNA, 21 bp, Homo sapiens
tgaaggcaaaaactgtactgt

SEQ ID NO: 4358072 - DNA, 19 bp, Homo sapiens
tgaagggagagccagctcc

SEQ ID NO: 4358073 - DNA, 19 bp, Homo sapiens
tgaagggcaagaaatggcg

SEQ ID NO: 4358074 - DNA, 14 bp, Homo sapiens
tgaagggtcctgcc

SEQ ID NO: 4358075 - DNA, 15 bp, Homo sapiens
tgaataatttcccaa

SEQ ID NO: 4358076 - DNA, 22 bp, Homo sapiens
tgaataatttcccaattaggaa

SEQ ID NO: 4358077 - DNA, 18 bp, Homo sapiens
tgaatattcctggactta

SEQ ID NO: 4358078 - DNA, 16 bp, Homo sapiens
tgaatgctagacagaa

SEQ ID NO: 4358079 - DNA, 15 bp, Homo sapiens
tgaatggaaataaat

SEQ ID NO: 4358080 - DNA, 12 bp, Homo sapiens
tgaatgtgaata

SEQ ID NO: 4358081 - DNA, 17 bp, Homo sapiens
tgaatgtgaatagtgtt

SEQ ID NO: 4358082 - DNA, 20 bp, Homo sapiens
tgaattgtgtattgatgcaa

SEQ ID NO: 4358083 - DNA, 16 bp, Homo sapiens
tgacaaaggagccttg

SEQ ID NO: 4358084 - DNA, 15 bp, Homo sapiens
tgacaaggaaaatct

SEQ ID NO: 4358085 - DNA, 16 bp, Homo sapiens
tgacaaggaaaatcta

SEQ ID NO: 4358086 - DNA, 22 bp, Homo sapiens
tgacagtgcctcttccagtgaa

SEQ ID NO: 4358087 - DNA, 15 bp, Homo sapiens
tgacatgaagctgtt

SEQ ID NO: 4358088 - DNA, 13 bp, Homo sapiens
tgacccagcctga

SEQ ID NO: 4358089 - DNA, 15 bp, Homo sapiens
tgacccagcctgaaa

SEQ ID NO: 4358090 - DNA, 16 bp, Homo sapiens
tgacccagcctgaaag

SEQ ID NO: 4358091 - DNA, 21 bp, Homo sapiens
tgacctaagtcaggtaatata

SEQ ID NO: 4358092 - DNA, 20 bp, Homo sapiens
tgacctctgtgaccaactgt

SEQ ID NO: 4358093 - DNA, 22 bp, Homo sapiens
tgacctctgtgaccaactgttg

SEQ ID NO: 4358094 - DNA, 13 bp, Homo sapiens
tgacctgtgacca

SEQ ID NO: 4358095 - DNA, 17 bp, Homo sapiens
tgacctgtggtaagcaa

SEQ ID NO: 4358096 - DNA, 16 bp, Homo sapiens
tgacgcttgtgacagt

SEQ ID NO: 4358097 - DNA, 20 bp, Homo sapiens
tgacgcttgtgacagtgcct

SEQ ID NO: 4358098 - DNA, 17 bp, Homo sapiens
tgacggtaagtgttctc

SEQ ID NO: 4358099 - DNA, 15 bp, Homo sapiens
tgactcaacatgtta

SEQ ID NO: 4358100 - DNA, 21 bp, Homo sapiens
tgactggatcttctatcattc

SEQ ID NO: 4358101 - DNA, 23 bp, Homo sapiens
tgacttacaggctaaaattagtt

SEQ ID NO: 4358102 - DNA, 20 bp, Homo sapiens
tgagaaatgaataatttccc

SEQ ID NO: 4358103 - DNA, 19 bp, Homo sapiens
tgagaattaagttttaaat

SEQ ID NO: 4358104 - DNA, 19 bp, Homo sapiens
tgagagaattgtatcattt

SEQ ID NO: 4358105 - DNA, 18 bp, Homo sapiens
tgagataacaatcaggta

SEQ ID NO: 4358106 - DNA, 12 bp, Homo sapiens
tgagatattaaa

SEQ ID NO: 4358107 - DNA, 22 bp, Homo sapiens
tgagatattaaagattggaatg

SEQ ID NO: 4358108 - DNA, 20 bp, Homo sapiens
tgagatgttattactgtttt

SEQ ID NO: 4358109 - DNA, 20 bp, Homo sapiens
tgagcctgtgcctggctaga

SEQ ID NO: 4358110 - DNA, 22 bp, Homo sapiens
tgagccttgcatgtacttgaag

SEQ ID NO: 4358111 - DNA, 13 bp, Homo sapiens
tgagcgccacctc

SEQ ID NO: 4358112 - DNA, 18 bp, Homo sapiens
tgaggaggaggacacagc

SEQ ID NO: 4358113 - DNA, 15 bp, Homo sapiens
tgaggcccagtgcat

SEQ ID NO: 4358114 - DNA, 13 bp, Homo sapiens
tgagtaagagctg

SEQ ID NO: 4358115 - DNA, 22 bp, Homo sapiens
tgagtcagacacgattgagaac

SEQ ID NO: 4358116 - DNA, 17 bp, Homo sapiens
tgagtcttggttctaaa

SEQ ID NO: 4358117 - DNA, 20 bp, Homo sapiens
tgagtcttggttctaaaggt

SEQ ID NO: 4358118 - DNA, 15 bp, Homo sapiens
tgagtgacagctttc

SEQ ID NO: 4358119 - DNA, 19 bp, Homo sapiens
tgagttgggggagggaaga

SEQ ID NO: 4358120 - DNA, 19 bp, Homo sapiens
tgataaatcgggaaattta

SEQ ID NO: 4358121 - DNA, 19 bp, Homo sapiens
tgataatacttgacctctg

SEQ ID NO: 4358122 - DNA, 20 bp, Homo sapiens
tgatacactgaatggaaata

SEQ ID NO: 4358123 - DNA, 19 bp, Homo sapiens
tgatattccatgaatgtat

SEQ ID NO: 4358124 - DNA, 11 bp, Homo sapiens
tgatgcaatat

SEQ ID NO: 4358125 - DNA, 18 bp, Homo sapiens
tgatgtaaaaaatattaa

SEQ ID NO: 4358126 - DNA, 23 bp, Homo sapiens
tgatgttagaagaagaggaagaa

SEQ ID NO: 4358127 - DNA, 20 bp, Homo sapiens
tgattaaaaatgcttttaga

SEQ ID NO: 4358128 - DNA, 21 bp, Homo sapiens
tgattaatatgcaagtgaaca

SEQ ID NO: 4358129 - DNA, 18 bp, Homo sapiens
tgattcaaattgctgctt

SEQ ID NO: 4358130 - DNA, 20 bp, Homo sapiens
tgattctctatgacatgaaa

SEQ ID NO: 4358131 - DNA, 11 bp, Homo sapiens
tgatttcagga

SEQ ID NO: 4358132 - DNA, 19 bp, Homo sapiens
tgatttcaggatactctgt

SEQ ID NO: 4358133 - DNA, 17 bp, Homo sapiens
tgatttcccaaatgaaa

SEQ ID NO: 4358134 - DNA, 17 bp, Homo sapiens
tgcaataatttgtacaa

SEQ ID NO: 4358135 - DNA, 18 bp, Homo sapiens
tgcaataatttgtacaat

SEQ ID NO: 4358136 - DNA, 22 bp, Homo sapiens
tgcaataatttgtacaatggtt

SEQ ID NO: 4358137 - DNA, 12 bp, Homo sapiens
tgcacacaggac

SEQ ID NO: 4358138 - DNA, 23 bp, Homo sapiens
tgcacacttgtgtgtgggctgtg

SEQ ID NO: 4358139 - DNA, 19 bp, Homo sapiens
tgcacagatggatttgcct

SEQ ID NO: 4358140 - DNA, 23 bp, Homo sapiens
tgcacagatggatttgcctgtgc

SEQ ID NO: 4358141 - DNA, 18 bp, Homo sapiens
tgcacaggcacacagggc

SEQ ID NO: 4358142 - DNA, 19 bp, Homo sapiens
tgcacaggcacacagggcc

SEQ ID NO: 4358143 - DNA, 13 bp, Homo sapiens
tgcacctccccaa

SEQ ID NO: 4358144 - DNA, 15 bp, Homo sapiens
tgcactgtggtttca

SEQ ID NO: 4358145 - DNA, 14 bp, Homo sapiens
tgcagacagtctgt

SEQ ID NO: 4358146 - DNA, 18 bp, Homo sapiens
gtgaacaaagtgagaaat

SEQ ID NO: 4358147 - DNA, 15 bp, Homo sapiens
gtgaagagccggtgg

SEQ ID NO: 4358148 - DNA, 16 bp, Homo sapiens
gtgaatgctagacaga

SEQ ID NO: 4358149 - DNA, 20 bp, Homo sapiens
gtgaattttccaagaacata

SEQ ID NO: 4358150 - DNA, 15 bp, Homo sapiens
gtgacagtgcctggg

SEQ ID NO: 4358151 - DNA, 19 bp, Homo sapiens
gtgactggaagttgtggat

SEQ ID NO: 4358152 - DNA, 19 bp, Homo sapiens
gtgagaattaagttttaaa

SEQ ID NO: 4358153 - DNA, 13 bp, Homo sapiens
gtgagcagaacag

SEQ ID NO: 4358154 - DNA, 16 bp, Homo sapiens
gtgagcagaacaggta

SEQ ID NO: 4358155 - DNA, 19 bp, Homo sapiens
gtgagctggatagacttgg

SEQ ID NO: 4358156 - DNA, 18 bp, Homo sapiens
gtgagtcttggttctaaa

SEQ ID NO: 4358157 - DNA, 16 bp, Homo sapiens
gtgagtgtaagtgtga

SEQ ID NO: 4358158 - DNA, 20 bp, Homo sapiens
gtgatacactgaatggaaat

SEQ ID NO: 4358159 - DNA, 19 bp, Homo sapiens
gtgatcaataaaatgtgat

SEQ ID NO: 4358160 - DNA, 17 bp, Homo sapiens
gtgatgccacacagagt

SEQ ID NO: 4358161 - DNA, 13 bp, Homo sapiens
gtgcacccacctg

SEQ ID NO: 4358162 - DNA, 15 bp, Homo sapiens
gtgcacccacctgtt

SEQ ID NO: 4358163 - DNA, 23 bp, Homo sapiens
gtgccactgccccccgaggctgc

SEQ ID NO: 4358164 - DNA, 16 bp, Homo sapiens
gtgcccgcaggaactg

SEQ ID NO: 4358165 - DNA, 16 bp, Homo sapiens
gtgcctgggaatgtat

SEQ ID NO: 4358166 - DNA, 18 bp, Homo sapiens
gtgctggctgcccagacc

SEQ ID NO: 4358167 - DNA, 11 bp, Homo sapiens
gtggaggagga

SEQ ID NO: 4358168 - DNA, 20 bp, Homo sapiens
gtggataatcaggaaaaatg

SEQ ID NO: 4358169 - DNA, 20 bp, Homo sapiens
gtggatatgacccacactgc

SEQ ID NO: 4358170 - DNA, 15 bp, Homo sapiens
gtggatgttatgaac

SEQ ID NO: 4358171 - DNA, 17 bp, Homo sapiens
gtggatgttatgaacag

SEQ ID NO: 4358172 - DNA, 19 bp, Homo sapiens
gtggctgctcccagcctct

SEQ ID NO: 4358173 - DNA, 12 bp, Homo sapiens
gtgggaagagaa

SEQ ID NO: 4358174 - DNA, 16 bp, Homo sapiens
gtgggcgcaaaggtgc

SEQ ID NO: 4358175 - DNA, 15 bp, Homo sapiens
gtgggctgggccctc

SEQ ID NO: 4358176 - DNA, 14 bp, Homo sapiens
gtgggctgtgagtg

SEQ ID NO: 4358177 - DNA, 14 bp, Homo sapiens
gtggggacagggct

SEQ ID NO: 4358178 - DNA, 12 bp, Homo sapiens
gtggggccagga

SEQ ID NO: 4358179 - DNA, 14 bp, Homo sapiens
gtggggccaggacc

SEQ ID NO: 4358180 - DNA, 17 bp, Homo sapiens
gtggggtgaggaccact

SEQ ID NO: 4358181 - DNA, 17 bp, Homo sapiens
gtgtattgatgcaatat

SEQ ID NO: 4358182 - DNA, 20 bp, Homo sapiens
gtgtattgatgcaatataag

SEQ ID NO: 4358183 - DNA, 15 bp, Homo sapiens
gtgtcatttataact

SEQ ID NO: 4358184 - DNA, 18 bp, Homo sapiens
gtgtctcccaacatggga

SEQ ID NO: 4358185 - DNA, 22 bp, Homo sapiens
gtgtggagttcaccttggaagg

SEQ ID NO: 4358186 - DNA, 13 bp, Homo sapiens
gtgtggctgctcc

SEQ ID NO: 4358187 - DNA, 13 bp, Homo sapiens
gtgtgggtcccgc

SEQ ID NO: 4358188 - DNA, 20 bp, Homo sapiens
gtgttctcatgaagcaggag

SEQ ID NO: 4358189 - DNA, 21 bp, Homo sapiens
gtgttctcatgaagcaggagg

SEQ ID NO: 4358190 - DNA, 24 bp, Homo sapiens
gtgttgataagctgcacatgacta

SEQ ID NO: 4358191 - DNA, 13 bp, Homo sapiens
gttacttgaaata

SEQ ID NO: 4358192 - DNA, 15 bp, Homo sapiens
gttacttgaaataag

SEQ ID NO: 4358193 - DNA, 17 bp, Homo sapiens
gttaggaataacactgc

SEQ ID NO: 4358194 - DNA, 20 bp, Homo sapiens
gttatattagggactgtggt

SEQ ID NO: 4358195 - DNA, 15 bp, Homo sapiens
gttatgaacagctgt

SEQ ID NO: 4358196 - DNA, 19 bp, Homo sapiens
gttatgcactgtggtttca

SEQ ID NO: 4358197 - DNA, 22 bp, Homo sapiens
gttatgcactgtggtttcagat

SEQ ID NO: 4358198 - DNA, 20 bp, Homo sapiens
gttatttactcctcctgctc

SEQ ID NO: 4358199 - DNA, 15 bp, Homo sapiens
gttcaccttggaagg

SEQ ID NO: 4358200 - DNA, 19 bp, Homo sapiens
gttcatccaatcctcactg

SEQ ID NO: 4358201 - DNA, 20 bp, Homo sapiens
gttcatccaatcctcactgg

SEQ ID NO: 4358202 - DNA, 15 bp, Homo sapiens
gttccttgccttaat

SEQ ID NO: 4358203 - DNA, 23 bp, Homo sapiens
gttccttgccttaataaatatgt

SEQ ID NO: 4358204 - DNA, 19 bp, Homo sapiens
gttctcatgaagcaggagg

SEQ ID NO: 4358205 - DNA, 15 bp, Homo sapiens
gttctgccctgcctg

SEQ ID NO: 4358206 - DNA, 17 bp, Homo sapiens
gttctgccctgcctgag

SEQ ID NO: 4358207 - DNA, 18 bp, Homo sapiens
gttctgccctgcctgagg

SEQ ID NO: 4358208 - DNA, 15 bp, Homo sapiens
gttgacagtgaaaca

SEQ ID NO: 4358209 - DNA, 19 bp, Homo sapiens
gttggaaggatctgctgag

SEQ ID NO: 4358210 - DNA, 14 bp, Homo sapiens
gttgggggaatgca

SEQ ID NO: 4358211 - DNA, 22 bp, Homo sapiens
gttgggggaatgcacctcccca

SEQ ID NO: 4358212 - DNA, 12 bp, Homo sapiens
gttgtatgtgtc

SEQ ID NO: 4358213 - DNA, 15 bp, Homo sapiens
gttgtcaaggaagaa

SEQ ID NO: 4358214 - DNA, 13 bp, Homo sapiens
gtttattcccaag

SEQ ID NO: 4358215 - DNA, 21 bp, Homo sapiens
gtttattcccaagtatgcctt

SEQ ID NO: 4358216 - DNA, 11 bp, Homo sapiens
gtttggccctg

SEQ ID NO: 4358217 - DNA, 12 bp, Homo sapiens
gtttggccctgg

SEQ ID NO: 4358218 - DNA, 15 bp, Homo sapiens
gtttggccctggagc

SEQ ID NO: 4358219 - DNA, 16 bp, Homo sapiens
gtttggccctggagcc

SEQ ID NO: 4358220 - DNA, 19 bp, Homo sapiens
gtttggccctggagccagg

SEQ ID NO: 4358221 - DNA, 21 bp, Homo sapiens
gtttgtcctttttcactttga

SEQ ID NO: 4358222 - DNA, 23 bp, Homo sapiens
taaaaagatccagggatggagat

SEQ ID NO: 4358223 - DNA, 21 bp, Homo sapiens
taaaacaagtgtataactaaa

SEQ ID NO: 4358224 - DNA, 20 bp, Homo sapiens
taaaagtacagttttcttgg

SEQ ID NO: 4358225 - DNA, 15 bp, Homo sapiens
taaaagtgatcaata

SEQ ID NO: 4358226 - DNA, 17 bp, Homo sapiens
taaactaacaagattaa

SEQ ID NO: 4358227 - DNA, 18 bp, Homo sapiens
taaactacaaagtaaaat

SEQ ID NO: 4358228 - DNA, 23 bp, Homo sapiens
taaactacaaagtaaaatgaaca

SEQ ID NO: 4358229 - DNA, 15 bp, Homo sapiens
taaacttaaaataaa

SEQ ID NO: 4358230 - DNA, 14 bp, Homo sapiens
taaatagcctaaat

SEQ ID NO: 4358231 - DNA, 17 bp, Homo sapiens
taaatagcctaaatgat

SEQ ID NO: 4358232 - DNA, 13 bp, Homo sapiens
taaatatgtaata

SEQ ID NO: 4358233 - DNA, 12 bp, Homo sapiens
taaatatttcct

SEQ ID NO: 4358234 - DNA, 15 bp, Homo sapiens
taaatatttccttaa

SEQ ID NO: 4358235 - DNA, 21 bp, Homo sapiens
taaatccttttcccataaata

SEQ ID NO: 4358236 - DNA, 17 bp, Homo sapiens
taaatcgggaaatttac

SEQ ID NO: 4358237 - DNA, 20 bp, Homo sapiens
taaattcagatatatttttc

SEQ ID NO: 4358238 - DNA, 16 bp, Homo sapiens
taacaagatctttcag

SEQ ID NO: 4358239 - DNA, 19 bp, Homo sapiens
taacatagtgtctgctgct

SEQ ID NO: 4358240 - DNA, 14 bp, Homo sapiens
taacgacttcaggg

SEQ ID NO: 4358241 - DNA, 12 bp, Homo sapiens
taagaagagact

SEQ ID NO: 4358242 - DNA, 14 bp, Homo sapiens
taagagctggtgtc

SEQ ID NO: 4358243 - DNA, 13 bp, Homo sapiens
taagatcataaca

SEQ ID NO: 4358244 - DNA, 22 bp, Homo sapiens
taagcacacacatctggccctg

SEQ ID NO: 4358245 - DNA, 17 bp, Homo sapiens
taagcagaacaaatgtg

SEQ ID NO: 4358246 - DNA, 21 bp, Homo sapiens
taagcagaacaaatgtgtttt

SEQ ID NO: 4358247 - DNA, 15 bp, Homo sapiens
taagcataaaagatc

SEQ ID NO: 4358248 - DNA, 20 bp, Homo sapiens
taagtcaggtaatatacctg

SEQ ID NO: 4358249 - DNA, 18 bp, Homo sapiens
taagtctaaatatttcct

SEQ ID NO: 4358250 - DNA, 21 bp, Homo sapiens
taagtgtgagtaagagctggt

SEQ ID NO: 4358251 - DNA, 14 bp, Homo sapiens
taagtgttctcatg

SEQ ID NO: 4358252 - DNA, 14 bp, Homo sapiens
taagttaatgaaat

SEQ ID NO: 4358253 - DNA, 19 bp, Homo sapiens
taagttaatgaaataaaat

SEQ ID NO: 4358254 - DNA, 18 bp, Homo sapiens
taagttacttgaaataag

SEQ ID NO: 4358255 - DNA, 19 bp, Homo sapiens
taagttgtttcagataaat

SEQ ID NO: 4358256 - DNA, 23 bp, Homo sapiens
taagttttaaataaacctataat

SEQ ID NO: 4358257 - DNA, 17 bp, Homo sapiens
taataaatatgtaatat

SEQ ID NO: 4358258 - DNA, 17 bp, Homo sapiens
taatatacctggtttac

SEQ ID NO: 4358259 - DNA, 21 bp, Homo sapiens
taatatggatcagagcattta

SEQ ID NO: 4358260 - DNA, 15 bp, Homo sapiens
taatcaggaaaaatg

SEQ ID NO: 4358261 - DNA, 21 bp, Homo sapiens
taatctcaaagagattcgaat

SEQ ID NO: 4358262 - DNA, 22 bp, Homo sapiens
taatgttgccttggaaacattt

SEQ ID NO: 4358263 - DNA, 19 bp, Homo sapiens
taatttgtacaatggttta

SEQ ID NO: 4358264 - DNA, 16 bp, Homo sapiens
taatttgtatcggagg

SEQ ID NO: 4358265 - DNA, 13 bp, Homo sapiens
taattttaaataa

SEQ ID NO: 4358266 - DNA, 15 bp, Homo sapiens
tacaaagtaaaatga

SEQ ID NO: 4358267 - DNA, 22 bp, Homo sapiens
tacaataagttacttgaaataa

SEQ ID NO: 4358268 - DNA, 23 bp, Homo sapiens
tacaataagttacttgaaataag

SEQ ID NO: 4358269 - DNA, 13 bp, Homo sapiens
ggtcccccctgag

SEQ ID NO: 4358270 - DNA, 20 bp, Homo sapiens
ggtccttgcctgaactccag

SEQ ID NO: 4358271 - DNA, 14 bp, Homo sapiens
ggtctcgcagcctg

SEQ ID NO: 4358272 - DNA, 16 bp, Homo sapiens
ggtctcgcagcctgaa

SEQ ID NO: 4358273 - DNA, 17 bp, Homo sapiens
ggtctcgcagcctgaag

SEQ ID NO: 4358274 - DNA, 21 bp, Homo sapiens
ggtctcgcagcctgaagcctg

SEQ ID NO: 4358275 - DNA, 18 bp, Homo sapiens
ggtgaagggagagccagc

SEQ ID NO: 4358276 - DNA, 18 bp, Homo sapiens
ggtgaggaccactcctgt

SEQ ID NO: 4358277 - DNA, 16 bp, Homo sapiens
ggtgctgaatgaagct

SEQ ID NO: 4358278 - DNA, 14 bp, Homo sapiens
ggtgggctgcctgc

SEQ ID NO: 4358279 - DNA, 14 bp, Homo sapiens
ggtggtgcccgtgc

SEQ ID NO: 4358280 - DNA, 17 bp, Homo sapiens
ggtggtgcccgtgcccg

SEQ ID NO: 4358281 - DNA, 19 bp, Homo sapiens
ggtgtctcccaacatggga

SEQ ID NO: 4358282 - DNA, 15 bp, Homo sapiens
ggttagaaaggcagc

SEQ ID NO: 4358283 - DNA, 18 bp, Homo sapiens
ggttagaaaggcagccct

SEQ ID NO: 4358284 - DNA, 17 bp, Homo sapiens
ggttctgccctgcctga

SEQ ID NO: 4358285 - DNA, 19 bp, Homo sapiens
ggttctgccctgcctgagg

SEQ ID NO: 4358286 - DNA, 20 bp, Homo sapiens
ggtttatgtagtcagttgca

SEQ ID NO: 4358287 - DNA, 12 bp, Homo sapiens
gtaatactgtct

SEQ ID NO: 4358288 - DNA, 15 bp, Homo sapiens
gtaatatacctggtt

SEQ ID NO: 4358289 - DNA, 21 bp, Homo sapiens
gtaatgtacaattttatataa

SEQ ID NO: 4358290 - DNA, 21 bp, Homo sapiens
gtacaataagttacttgaaat

SEQ ID NO: 4358291 - DNA, 22 bp, Homo sapiens
gtacaataagttacttgaaata

SEQ ID NO: 4358292 - DNA, 13 bp, Homo sapiens
gtacaatggttta

SEQ ID NO: 4358293 - DNA, 17 bp, Homo sapiens
gtacaatggtttattcc

SEQ ID NO: 4358294 - DNA, 20 bp, Homo sapiens
gtacaatggtttattcccaa

SEQ ID NO: 4358295 - DNA, 21 bp, Homo sapiens
gtacaatggtttattcccaag

SEQ ID NO: 4358296 - DNA, 16 bp, Homo sapiens
gtacaattttatataa

SEQ ID NO: 4358297 - DNA, 15 bp, Homo sapiens
gtacactgaatattt

SEQ ID NO: 4358298 - DNA, 14 bp, Homo sapiens
gtacagaaaacatg

SEQ ID NO: 4358299 - DNA, 16 bp, Homo sapiens
gtacagttttcttggt

SEQ ID NO: 4358300 - DNA, 18 bp, Homo sapiens
gtacatatggaaatgtta

SEQ ID NO: 4358301 - DNA, 17 bp, Homo sapiens
gtaccaaacaaggaagc

SEQ ID NO: 4358302 - DNA, 18 bp, Homo sapiens
gtaccaaacaaggaagcc

SEQ ID NO: 4358303 - DNA, 23 bp, Homo sapiens
gtagaaagcaaacaaaattgttc

SEQ ID NO: 4358304 - DNA, 15 bp, Homo sapiens
gtagagtcatctcca

SEQ ID NO: 4358305 - DNA, 20 bp, Homo sapiens
gtagctttaaaaccacagct

SEQ ID NO: 4358306 - DNA, 21 bp, Homo sapiens
gtaggggagggcaggcttggg

SEQ ID NO: 4358307 - DNA, 13 bp, Homo sapiens
gtagttacattta

SEQ ID NO: 4358308 - DNA, 18 bp, Homo sapiens
gtatcagcatcaagtatg

SEQ ID NO: 4358309 - DNA, 13 bp, Homo sapiens
gtatcatgaagaa

SEQ ID NO: 4358310 - DNA, 14 bp, Homo sapiens
gtatgccttaagca

SEQ ID NO: 4358311 - DNA, 17 bp, Homo sapiens
gtatgctttccctgagg

SEQ ID NO: 4358312 - DNA, 14 bp, Homo sapiens
gtatgtttgcacac

SEQ ID NO: 4358313 - DNA, 23 bp, Homo sapiens
gtattccttttgtgtacagtgtg

SEQ ID NO: 4358314 - DNA, 16 bp, Homo sapiens
gtattctctttacctt

SEQ ID NO: 4358315 - DNA, 21 bp, Homo sapiens
gtattctctttaccttctaaa

SEQ ID NO: 4358316 - DNA, 13 bp, Homo sapiens
gtattctttgtgt

SEQ ID NO: 4358317 - DNA, 17 bp, Homo sapiens
gtattttgcctctgggt

SEQ ID NO: 4358318 - DNA, 23 bp, Homo sapiens
gtattttttacttttcacactgt

SEQ ID NO: 4358319 - DNA, 23 bp, Homo sapiens
gtcaagatgctacaatggaaacc

SEQ ID NO: 4358320 - DNA, 12 bp, Homo sapiens
gtcaagttccca

SEQ ID NO: 4358321 - DNA, 13 bp, Homo sapiens
gtcaagttcccaa

SEQ ID NO: 4358322 - DNA, 17 bp, Homo sapiens
gtcacaagagcccagca

SEQ ID NO: 4358323 - DNA, 13 bp, Homo sapiens
gtcacaataaagt

SEQ ID NO: 4358324 - DNA, 21 bp, Homo sapiens
gtcactcctggggcctcttgg

SEQ ID NO: 4358325 - DNA, 13 bp, Homo sapiens
gtcacttgccaca

SEQ ID NO: 4358326 - DNA, 14 bp, Homo sapiens
gtcacttgccacat

SEQ ID NO: 4358327 - DNA, 15 bp, Homo sapiens
gtcacttgccacatg

SEQ ID NO: 4358328 - DNA, 17 bp, Homo sapiens
gtcagacacgattgaga

SEQ ID NO: 4358329 - DNA, 18 bp, Homo sapiens
gtcagatgggaagacatg

SEQ ID NO: 4358330 - DNA, 17 bp, Homo sapiens
gtcaggtaatatacctg

SEQ ID NO: 4358331 - DNA, 19 bp, Homo sapiens
gtcatctccatcagctgta

SEQ ID NO: 4358332 - DNA, 23 bp, Homo sapiens
gtcatctgtaagagcttgctcca

SEQ ID NO: 4358333 - DNA, 18 bp, Homo sapiens
gtcatttataacttctgt

SEQ ID NO: 4358334 - DNA, 11 bp, Homo sapiens
gtccaccctgc

SEQ ID NO: 4358335 - DNA, 14 bp, Homo sapiens
gtccaccctgccaa

SEQ ID NO: 4358336 - DNA, 18 bp, Homo sapiens
gtccacgtttttggaaaa

SEQ ID NO: 4358337 - DNA, 19 bp, Homo sapiens
gtcccccctgagtgggctg

SEQ ID NO: 4358338 - DNA, 14 bp, Homo sapiens
gtccccgaggagct

SEQ ID NO: 4358339 - DNA, 16 bp, Homo sapiens
gtccccgaggagctgg

SEQ ID NO: 4358340 - DNA, 14 bp, Homo sapiens
gtccctggagctgt

SEQ ID NO: 4358341 - DNA, 17 bp, Homo sapiens
gtccctttcttggccag

SEQ ID NO: 4358342 - DNA, 22 bp, Homo sapiens
gtccctttcttggccagttatc

SEQ ID NO: 4358343 - DNA, 16 bp, Homo sapiens
gtccggcccagtgcca

SEQ ID NO: 4358344 - DNA, 17 bp, Homo sapiens
gtcctgccggtgggacc

SEQ ID NO: 4358345 - DNA, 14 bp, Homo sapiens
gtcgtgggatggca

SEQ ID NO: 4358346 - DNA, 16 bp, Homo sapiens
gtctaagtgtaaatgt

SEQ ID NO: 4358347 - DNA, 20 bp, Homo sapiens
gtctactaaataatacttta

SEQ ID NO: 4358348 - DNA, 15 bp, Homo sapiens
gtctaggactgcagt

SEQ ID NO: 4358349 - DNA, 17 bp, Homo sapiens
gtctattatcacattaa

SEQ ID NO: 4358350 - DNA, 20 bp, Homo sapiens
gtctattttgtatatttgta

SEQ ID NO: 4358351 - DNA, 12 bp, Homo sapiens
gtctcaggcagc

SEQ ID NO: 4358352 - DNA, 19 bp, Homo sapiens
gtctcaggcagcaccacac

SEQ ID NO: 4358353 - DNA, 15 bp, Homo sapiens
gtctcagtttcactt

SEQ ID NO: 4358354 - DNA, 18 bp, Homo sapiens
gtctccctcccctctcag

SEQ ID NO: 4358355 - DNA, 20 bp, Homo sapiens
gtctcgatgccataatcaga

SEQ ID NO: 4358356 - DNA, 13 bp, Homo sapiens
gtctcgcagcctg

SEQ ID NO: 4358357 - DNA, 17 bp, Homo sapiens
gtctcgcagcctgaagc

SEQ ID NO: 4358358 - DNA, 18 bp, Homo sapiens
gtctcgcagcctgaagcc

SEQ ID NO: 4358359 - DNA, 20 bp, Homo sapiens
gtctcttctgaataaagcaa

SEQ ID NO: 4358360 - DNA, 23 bp, Homo sapiens
gtctcttctgaataaagcaatta

SEQ ID NO: 4358361 - DNA, 22 bp, Homo sapiens
gtctgatttcaggatactctgt

SEQ ID NO: 4358362 - DNA, 14 bp, Homo sapiens
gtctgccaaacaca

SEQ ID NO: 4358363 - DNA, 15 bp, Homo sapiens
gtctgccaaacacat

SEQ ID NO: 4358364 - DNA, 14 bp, Homo sapiens
gtctgctctggtgg

SEQ ID NO: 4358365 - DNA, 13 bp, Homo sapiens
gtctggaccccgt

SEQ ID NO: 4358366 - DNA, 23 bp, Homo sapiens
gtctgtctccctcccctctcaga

SEQ ID NO: 4358367 - DNA, 14 bp, Homo sapiens
gtctgtgactggat

SEQ ID NO: 4358368 - DNA, 23 bp, Homo sapiens
gtcttccgatcaacatttatgac

SEQ ID NO: 4358369 - DNA, 13 bp, Homo sapiens
gtctttctggaga

SEQ ID NO: 4358370 - DNA, 19 bp, Homo sapiens
tttaaataaacctataata

SEQ ID NO: 4358371 - DNA, 20 bp, Homo sapiens
tttaagttaatgaaataaaa

SEQ ID NO: 4358372 - DNA, 13 bp, Homo sapiens
tttaagttgatta

SEQ ID NO: 4358373 - DNA, 13 bp, Homo sapiens
tttacatcagaag

SEQ ID NO: 4358374 - DNA, 17 bp, Homo sapiens
tttacatcagaagtttg

SEQ ID NO: 4358375 - DNA, 13 bp, Homo sapiens
tttaccttctaaa

SEQ ID NO: 4358376 - DNA, 13 bp, Homo sapiens
tttataaagcagt

SEQ ID NO: 4358377 - DNA, 14 bp, Homo sapiens
tttataaagcagtt

SEQ ID NO: 4358378 - DNA, 12 bp, Homo sapiens
tttatgacctaa

SEQ ID NO: 4358379 - DNA, 12 bp, Homo sapiens
tttatgcagaca

SEQ ID NO: 4358380 - DNA, 16 bp, Homo sapiens
acagctgggcagggtg

SEQ ID NO: 4358381 - DNA, 20 bp, Homo sapiens
acagcttaaattcttcaaga

SEQ ID NO: 4358382 - DNA, 18 bp, Homo sapiens
acagggcccggccacacc

SEQ ID NO: 4358383 - DNA, 15 bp, Homo sapiens
acagtctgttatgca

SEQ ID NO: 4358384 - DNA, 17 bp, Homo sapiens
acagtctgttatgcact

SEQ ID NO: 4358385 - DNA, 18 bp, Homo sapiens
acagtctgttatgcactg

SEQ ID NO: 4358386 - DNA, 16 bp, Homo sapiens
acagtgaaacaaattt

SEQ ID NO: 4358387 - DNA, 12 bp, Homo sapiens
acagtgcctctt

SEQ ID NO: 4358388 - DNA, 21 bp, Homo sapiens
acagtgcctgggaatgtatta

SEQ ID NO: 4358389 - DNA, 13 bp, Homo sapiens
acatagatgtccc

SEQ ID NO: 4358390 - DNA, 15 bp, Homo sapiens
acatagatgtccctt

SEQ ID NO: 4358391 - DNA, 17 bp, Homo sapiens
acatatggaaatgttac

SEQ ID NO: 4358392 - DNA, 12 bp, Homo sapiens
acatccagcaga

SEQ ID NO: 4358393 - DNA, 12 bp, Homo sapiens
acatctggccct

SEQ ID NO: 4358394 - DNA, 13 bp, Homo sapiens
acatctggccctg

SEQ ID NO: 4358395 - DNA, 15 bp, Homo sapiens
acatgaatgcacact

SEQ ID NO: 4358396 - DNA, 21 bp, Homo sapiens
acatgaatggagacttctaat

SEQ ID NO: 4358397 - DNA, 16 bp, Homo sapiens
acatgacccagcctga

SEQ ID NO: 4358398 - DNA, 17 bp, Homo sapiens
acatgacccagcctgaa

SEQ ID NO: 4358399 - DNA, 20 bp, Homo sapiens
acatgacccagcctgaaaga

SEQ ID NO: 4358400 - DNA, 16 bp, Homo sapiens
acatgggagggatcag

SEQ ID NO: 4358401 - DNA, 17 bp, Homo sapiens
acatgggagggatcagc

SEQ ID NO: 4358402 - DNA, 16 bp, Homo sapiens
acatggtgtctcccaa

SEQ ID NO: 4358403 - DNA, 22 bp, Homo sapiens
acatggtgtctcccaacatggg

SEQ ID NO: 4358404 - DNA, 19 bp, Homo sapiens
acatggttgggggaatgca

SEQ ID NO: 4358405 - DNA, 20 bp, Homo sapiens
acatggttgggggaatgcac

SEQ ID NO: 4358406 - DNA, 18 bp, Homo sapiens
acatgtacatatggaaat

SEQ ID NO: 4358407 - DNA, 12 bp, Homo sapiens
acatgtcaatct

SEQ ID NO: 4358408 - DNA, 15 bp, Homo sapiens
acatgtcaatctgtc

SEQ ID NO: 4358409 - DNA, 15 bp, Homo sapiens
acattaatctcaaag

SEQ ID NO: 4358410 - DNA, 16 bp, Homo sapiens
acattcccagcccagc

SEQ ID NO: 4358411 - DNA, 20 bp, Homo sapiens
acattcctaagagtggagga

SEQ ID NO: 4358412 - DNA, 23 bp, Homo sapiens
acattcctaagagtggaggagga

SEQ ID NO: 4358413 - DNA, 15 bp, Homo sapiens
acattgtcctgtagc

SEQ ID NO: 4358414 - DNA, 13 bp, Homo sapiens
acatttaggataa

SEQ ID NO: 4358415 - DNA, 17 bp, Homo sapiens
acatttaggataatctt

SEQ ID NO: 4358416 - DNA, 20 bp, Homo sapiens
acatttttgagatattaaag

SEQ ID NO: 4358417 - DNA, 22 bp, Homo sapiens
acatttttgagatattaaagat

SEQ ID NO: 4358418 - DNA, 14 bp, Homo sapiens
accaaacaaggaag

SEQ ID NO: 4358419 - DNA, 19 bp, Homo sapiens
accaaacaaggaagccaaa

SEQ ID NO: 4358420 - DNA, 21 bp, Homo sapiens
accaatttggtaaaaatgctg

SEQ ID NO: 4358421 - DNA, 22 bp, Homo sapiens
accaatttggtaaaaatgctgc

SEQ ID NO: 4358422 - DNA, 14 bp, Homo sapiens
accacagctgggca

SEQ ID NO: 4358423 - DNA, 14 bp, Homo sapiens
accaccggccccct

SEQ ID NO: 4358424 - DNA, 16 bp, Homo sapiens
accagaattcccttga

SEQ ID NO: 4358425 - DNA, 15 bp, Homo sapiens
accagcactgtctca

SEQ ID NO: 4358426 - DNA, 16 bp, Homo sapiens
accagcactgtctcag

SEQ ID NO: 4358427 - DNA, 22 bp, Homo sapiens
accagggcgaacgacaatagct

SEQ ID NO: 4358428 - DNA, 16 bp, Homo sapiens
acccaagcctgctggc

SEQ ID NO: 4358429 - DNA, 17 bp, Homo sapiens
acccaagcctgctggct

SEQ ID NO: 4358430 - DNA, 11 bp, Homo sapiens
acccacactgc

SEQ ID NO: 4358431 - DNA, 18 bp, Homo sapiens
acccacctgttttctgaa

SEQ ID NO: 4358432 - DNA, 22 bp, Homo sapiens
acccattgttgtcaaggaagaa

SEQ ID NO: 4358433 - DNA, 23 bp, Homo sapiens
acccattgttgtcaaggaagaag

SEQ ID NO: 4358434 - DNA, 14 bp, Homo sapiens
acccctctggccag

SEQ ID NO: 4358435 - DNA, 13 bp, Homo sapiens
acccctgtttctg

SEQ ID NO: 4358436 - DNA, 19 bp, Homo sapiens
acccgccgcctcccacggc

SEQ ID NO: 4358437 - DNA, 21 bp, Homo sapiens
acccgccgcctcccacggcac

SEQ ID NO: 4358438 - DNA, 16 bp, Homo sapiens
acccgctttcttgctg

SEQ ID NO: 4358439 - DNA, 18 bp, Homo sapiens
acccgtggggtgctgccc

SEQ ID NO: 4358440 - DNA, 19 bp, Homo sapiens
accctcaggcataggcctg

SEQ ID NO: 4358441 - DNA, 17 bp, Homo sapiens
accctccctccctaccc

SEQ ID NO: 4358442 - DNA, 20 bp, Homo sapiens
accctgccaagactcctcag

SEQ ID NO: 4358443 - DNA, 22 bp, Homo sapiens
accctgccaagactcctcaggc

SEQ ID NO: 4358444 - DNA, 19 bp, Homo sapiens
accctgtccggcccagtgc

SEQ ID NO: 4358445 - DNA, 19 bp, Homo sapiens
acctaagtcaggtaatata

SEQ ID NO: 4358446 - DNA, 14 bp, Homo sapiens
acctactgcccaca

SEQ ID NO: 4358447 - DNA, 17 bp, Homo sapiens
acctactgcccacattt

SEQ ID NO: 4358448 - DNA, 15 bp, Homo sapiens
acctcatgcccagct

SEQ ID NO: 4358449 - DNA, 18 bp, Homo sapiens
acctcggggacaccagag

SEQ ID NO: 4358450 - DNA, 21 bp, Homo sapiens
acctctgaggacagaggccgg

SEQ ID NO: 4358451 - DNA, 15 bp, Homo sapiens
acctctgtgaccaac

SEQ ID NO: 4358452 - DNA, 16 bp, Homo sapiens
acctgcacacaggaca

SEQ ID NO: 4358453 - DNA, 17 bp, Homo sapiens
acctgcacacaggacag

SEQ ID NO: 4358454 - DNA, 21 bp, Homo sapiens
acctgcacacaggacagcggg

SEQ ID NO: 4358455 - DNA, 15 bp, Homo sapiens
acctgtaactctcaa

SEQ ID NO: 4358456 - DNA, 14 bp, Homo sapiens
acctgttttctgaa

SEQ ID NO: 4358457 - DNA, 16 bp, Homo sapiens
acctgttttctgaaac

SEQ ID NO: 4358458 - DNA, 21 bp, Homo sapiens
acctgttttctgaaacacacg

SEQ ID NO: 4358459 - DNA, 18 bp, Homo sapiens
accttctaaaagccatta

SEQ ID NO: 4358460 - DNA, 11 bp, Homo sapiens
accttggaagg

SEQ ID NO: 4358461 - DNA, 19 bp, Homo sapiens
acgagaccctacaggagag

SEQ ID NO: 4358462 - DNA, 15 bp, Homo sapiens
acgattgagaactga

SEQ ID NO: 4358463 - DNA, 17 bp, Homo sapiens
acgcttgtgacagtgcc

SEQ ID NO: 4358464 - DNA, 18 bp, Homo sapiens
acgcttgtgacagtgcct

SEQ ID NO: 4358465 - DNA, 23 bp, Homo sapiens
acggcacctcggggacaccagag

SEQ ID NO: 4358466 - DNA, 18 bp, Homo sapiens
acggtaagtgttctcatg

SEQ ID NO: 4358467 - DNA, 18 bp, Homo sapiens
actaacaagattaaatat

SEQ ID NO: 4358468 - DNA, 11 bp, Homo sapiens
actacaaagta

SEQ ID NO: 4358469 - DNA, 13 bp, Homo sapiens
actagaaaatctg

SEQ ID NO: 4358470 - DNA, 22 bp, Homo sapiens
actcaacatgttactgaccagc

SEQ ID NO: 4358471 - DNA, 20 bp, Homo sapiens
actcagtatgctttccctga

SEQ ID NO: 4358472 - DNA, 17 bp, Homo sapiens
actccctggctctcaga

SEQ ID NO: 4358473 - DNA, 20 bp, Homo sapiens
actccgtgcttaaccaaaga

SEQ ID NO: 4358474 - DNA, 20 bp, Homo sapiens
actcctcaaaagcaaatgag

SEQ ID NO: 4358475 - DNA, 15 bp, Homo sapiens
actcctcctgctcct

SEQ ID NO: 4358476 - DNA, 23 bp, Homo sapiens
actcctgggtgggtggggtacag

SEQ ID NO: 4358477 - DNA, 13 bp, Homo sapiens
actcctgtacact

SEQ ID NO: 4358478 - DNA, 18 bp, Homo sapiens
actcctgtacactgaata

SEQ ID NO: 4358479 - DNA, 20 bp, Homo sapiens
actctcaattccctgaaaaa

SEQ ID NO: 4358480 - DNA, 22 bp, Homo sapiens
actctttttttgagtgacagct

SEQ ID NO: 4358481 - DNA, 15 bp, Homo sapiens
actgaagcctgcagg

SEQ ID NO: 4358482 - DNA, 16 bp, Homo sapiens
actgaagcctgcagga

SEQ ID NO: 4358483 - DNA, 23 bp, Homo sapiens
actgaaggggtgcacccacctgt

SEQ ID NO: 4358484 - DNA, 13 bp, Homo sapiens
actgatgttgtgt

SEQ ID NO: 4358485 - DNA, 17 bp, Homo sapiens
actgatgttgtgttttt

SEQ ID NO: 4358486 - DNA, 15 bp, Homo sapiens
actgcaaaggcgcag

SEQ ID NO: 4358487 - DNA, 14 bp, Homo sapiens
actgcagccctctc

SEQ ID NO: 4358488 - DNA, 23 bp, Homo sapiens
actgcagccctctccaccctccg

SEQ ID NO: 4358489 - DNA, 13 bp, Homo sapiens
actggaagttgtg

SEQ ID NO: 4358490 - DNA, 21 bp, Homo sapiens
actggaagttgtggatatcag

SEQ ID NO: 4358491 - DNA, 16 bp, Homo sapiens
actggatcttctatca

SEQ ID NO: 4358492 - DNA, 22 bp, Homo sapiens
actgggaagataggctctgcac

SEQ ID NO: 4358493 - DNA, 19 bp, Homo sapiens
actgggctctccctgcacg

SEQ ID NO: 4358494 - DNA, 19 bp, Homo sapiens
actgggtgcgtctccagtc

SEQ ID NO: 4358495 - DNA, 20 bp, Homo sapiens
actgggtggggtgaggacca

SEQ ID NO: 4358496 - DNA, 16 bp, Homo sapiens
actgggttctttggaa

SEQ ID NO: 4358497 - DNA, 24 bp, Homo sapiens
actggtaaaaagatccagggatgg

SEQ ID NO: 4358498 - DNA, 15 bp, Homo sapiens
actgtacaataagtt

SEQ ID NO: 4358499 - DNA, 17 bp, Homo sapiens
actgtacaataagttac

SEQ ID NO: 4358500 - DNA, 14 bp, Homo sapiens
agggcatctcctgt

SEQ ID NO: 4358501 - DNA, 19 bp, Homo sapiens
agggcctgcatggagaagg

SEQ ID NO: 4358502 - DNA, 22 bp, Homo sapiens
agggcgttctaggtaggaagag

SEQ ID NO: 4358503 - DNA, 23 bp, Homo sapiens
aggggatcatgttaaaaatagca

SEQ ID NO: 4358504 - DNA, 14 bp, Homo sapiens
aggggcgggctcag

SEQ ID NO: 4358505 - DNA, 17 bp, Homo sapiens
aggggcgggctcagagc

SEQ ID NO: 4358506 - DNA, 14 bp, Homo sapiens
agggggtgactgga

SEQ ID NO: 4358507 - DNA, 20 bp, Homo sapiens
agggtcctgccggtgggacc

SEQ ID NO: 4358508 - DNA, 18 bp, Homo sapiens
agggttctgccctgcctg

SEQ ID NO: 4358509 - DNA, 21 bp, Homo sapiens
agggttctgccctgcctgagg

SEQ ID NO: 4358510 - DNA, 22 bp, Homo sapiens
agggttctgccctgcctgagga

SEQ ID NO: 4358511 - DNA, 23 bp, Homo sapiens
agggttctgccctgcctgaggag

SEQ ID NO: 4358512 - DNA, 13 bp, Homo sapiens
aggtaatatacct

SEQ ID NO: 4358513 - DNA, 14 bp, Homo sapiens
aggtacagaaaaca

SEQ ID NO: 4358514 - DNA, 18 bp, Homo sapiens
aggtaccaaacaaggaag

SEQ ID NO: 4358515 - DNA, 20 bp, Homo sapiens
aggtagtattacaccaccgg

SEQ ID NO: 4358516 - DNA, 11 bp, Homo sapiens
aggtgcctcat

SEQ ID NO: 4358517 - DNA, 18 bp, Homo sapiens
aggtgctgaatgaagctg

SEQ ID NO: 4358518 - DNA, 17 bp, Homo sapiens
aggtggagaaaattgga

SEQ ID NO: 4358519 - DNA, 20 bp, Homo sapiens
aggtggatgttatgaacagc

SEQ ID NO: 4358520 - DNA, 14 bp, Homo sapiens
aggtgggctgcctg

SEQ ID NO: 4358521 - DNA, 16 bp, Homo sapiens
aggtgggctgcctgct

SEQ ID NO: 4358522 - DNA, 23 bp, Homo sapiens
agtaaaatgaacattttgtggag

SEQ ID NO: 4358523 - DNA, 14 bp, Homo sapiens
agtaagagctggtg

SEQ ID NO: 4358524 - DNA, 14 bp, Homo sapiens
agtagagtcatctc

SEQ ID NO: 4358525 - DNA, 14 bp, Homo sapiens
agtagcatgagaga

SEQ ID NO: 4358526 - DNA, 23 bp, Homo sapiens
agtagcatgagagaattgtatca

SEQ ID NO: 4358527 - DNA, 18 bp, Homo sapiens
agtatatttatagtcaca

SEQ ID NO: 4358528 - DNA, 21 bp, Homo sapiens
agtatcactctaatataatat

SEQ ID NO: 4358529 - DNA, 13 bp, Homo sapiens
agtatgccttaag

SEQ ID NO: 4358530 - DNA, 20 bp, Homo sapiens
agtatgccttaagcagaaca

SEQ ID NO: 4358531 - DNA, 22 bp, Homo sapiens
agtatgccttaagcagaacaaa

SEQ ID NO: 4358532 - DNA, 23 bp, Homo sapiens
agtatgctttccctgaggaatga

SEQ ID NO: 4358533 - DNA, 19 bp, Homo sapiens
agtatggtaggggagggca

SEQ ID NO: 4358534 - DNA, 15 bp, Homo sapiens
agtcaggtaatatac

SEQ ID NO: 4358535 - DNA, 17 bp, Homo sapiens
agtcatctccatcagct

SEQ ID NO: 4358536 - DNA, 19 bp, Homo sapiens
agtcatctccatcagctgt

SEQ ID NO: 4358537 - DNA, 21 bp, Homo sapiens
agtcatctgtaagagcttgct

SEQ ID NO: 4358538 - DNA, 12 bp, Homo sapiens
agtcatggtact

SEQ ID NO: 4358539 - DNA, 19 bp, Homo sapiens
agtcatggtactaccccag

SEQ ID NO: 4358540 - DNA, 23 bp, Homo sapiens
agtccagacagcttgactgcttt

SEQ ID NO: 4358541 - DNA, 17 bp, Homo sapiens
agtccctggagctgtcc

SEQ ID NO: 4358542 - DNA, 22 bp, Homo sapiens
agtccctggagctgtccttcat

SEQ ID NO: 4358543 - DNA, 17 bp, Homo sapiens
agtctaaatatttcctt

SEQ ID NO: 4358544 - DNA, 23 bp, Homo sapiens
agtctaaatatttccttaaactg

SEQ ID NO: 4358545 - DNA, 13 bp, Homo sapiens
agtctgttatgca

SEQ ID NO: 4358546 - DNA, 14 bp, Homo sapiens
agtgaacaaagtga

SEQ ID NO: 4358547 - DNA, 21 bp, Homo sapiens
agtgaacaaagtgagaaatga

SEQ ID NO: 4358548 - DNA, 13 bp, Homo sapiens
agtgagcagaaca

SEQ ID NO: 4358549 - DNA, 19 bp, Homo sapiens
agtgagcagaacaggtagt

SEQ ID NO: 4358550 - DNA, 20 bp, Homo sapiens
agtgatcaataaaatgtgat

SEQ ID NO: 4358551 - DNA, 14 bp, Homo sapiens
agtgcctcttccag

SEQ ID NO: 4358552 - DNA, 17 bp, Homo sapiens
agtgcctcttccagtga

SEQ ID NO: 4358553 - DNA, 17 bp, Homo sapiens
agtgcctgggaatgtat

SEQ ID NO: 4358554 - DNA, 22 bp, Homo sapiens
agtgcctgggaatgtattattc

SEQ ID NO: 4358555 - DNA, 14 bp, Homo sapiens
agtgcttctctaca

SEQ ID NO: 4358556 - DNA, 19 bp, Homo sapiens
agtggataatcaggaaaaa

SEQ ID NO: 4358557 - DNA, 15 bp, Homo sapiens
agtggtctttctgga

SEQ ID NO: 4358558 - DNA, 20 bp, Homo sapiens
agtggtctttctggagaggt

SEQ ID NO: 4358559 - DNA, 18 bp, Homo sapiens
agtgtgagtaagagctgg

SEQ ID NO: 4358560 - DNA, 23 bp, Homo sapiens
agtgttctcatgaagcaggaggc

SEQ ID NO: 4358561 - DNA, 22 bp, Homo sapiens
agtgtttcaaaggtatgtagtt

SEQ ID NO: 4358562 - DNA, 15 bp, Homo sapiens
agttaagaattgagc

SEQ ID NO: 4358563 - DNA, 12 bp, Homo sapiens
agttaagtcaat

SEQ ID NO: 4358564 - DNA, 21 bp, Homo sapiens
agttattcccttacctgaagg

SEQ ID NO: 4358565 - DNA, 15 bp, Homo sapiens
agttcaccttggaag

SEQ ID NO: 4358566 - DNA, 20 bp, Homo sapiens
agttcatccaatcctcactg

SEQ ID NO: 4358567 - DNA, 10 bp, Homo sapiens
agttccttgc

SEQ ID NO: 4358568 - DNA, 18 bp, Homo sapiens
agttggaaggatctgctg

SEQ ID NO: 4358569 - DNA, 15 bp, Homo sapiens
agtttacaagtcaga

SEQ ID NO: 4358570 - DNA, 20 bp, Homo sapiens
agtttacattgtcctgtagc

SEQ ID NO: 4358571 - DNA, 16 bp, Homo sapiens
agtttgaaaaactaat

SEQ ID NO: 4358572 - DNA, 14 bp, Homo sapiens
agtttggccctgga

SEQ ID NO: 4358573 - DNA, 18 bp, Homo sapiens
agtttggccctggagcca

SEQ ID NO: 4358574 - DNA, 18 bp, Homo sapiens
agtttgtattttgcatac

SEQ ID NO: 4358575 - DNA, 16 bp, Homo sapiens
agtttttactttctgt

SEQ ID NO: 4358576 - DNA, 17 bp, Homo sapiens
ataaaagtgatcaataa

SEQ ID NO: 4358577 - DNA, 22 bp, Homo sapiens
ataaaagtgatcaataaaatgt

SEQ ID NO: 4358578 - DNA, 15 bp, Homo sapiens
ataaactttacatat

SEQ ID NO: 4358579 - DNA, 11 bp, Homo sapiens
ataaagcaatt

SEQ ID NO: 4358580 - DNA, 12 bp, Homo sapiens
ataaagcagtta

SEQ ID NO: 4358581 - DNA, 14 bp, Homo sapiens
ataaagttgctttt

SEQ ID NO: 4358582 - DNA, 12 bp, Homo sapiens
ataaatagatgt

SEQ ID NO: 4358583 - DNA, 15 bp, Homo sapiens
ataaatcgggaaatt

SEQ ID NO: 4358584 - DNA, 16 bp, Homo sapiens
ataaatttaagcaaac

SEQ ID NO: 4358585 - DNA, 14 bp, Homo sapiens
ataactgcagtgtt

SEQ ID NO: 4358586 - DNA, 12 bp, Homo sapiens
ataatacttgac

SEQ ID NO: 4358587 - DNA, 23 bp, Homo sapiens
ataatacttgacctctgtgacca

SEQ ID NO: 4358588 - DNA, 15 bp, Homo sapiens
ataatcaggaaaaat

SEQ ID NO: 4358589 - DNA, 13 bp, Homo sapiens
ataatgttgcctt

SEQ ID NO: 4358590 - DNA, 17 bp, Homo sapiens
ataattctgaaatgttt

SEQ ID NO: 4358591 - DNA, 11 bp, Homo sapiens
ataatttccca

SEQ ID NO: 4358592 - DNA, 16 bp, Homo sapiens
ataatttgtacaatgg

SEQ ID NO: 4358593 - DNA, 18 bp, Homo sapiens
ataatttgtacaatggtt

SEQ ID NO: 4358594 - DNA, 13 bp, Homo sapiens
atacccacccaga

SEQ ID NO: 4358595 - DNA, 14 bp, Homo sapiens
atacccacccagaa

SEQ ID NO: 4358596 - DNA, 14 bp, Homo sapiens
ataccctccctccc

SEQ ID NO: 4358597 - DNA, 13 bp, Homo sapiens
atacctggtttac

SEQ ID NO: 4358598 - DNA, 15 bp, Homo sapiens
atacttgacctctgt

SEQ ID NO: 4358599 - DNA, 19 bp, Homo sapiens
atactttgacaaggaaaat

SEQ ID NO: 4358600 - DNA, 23 bp, Homo sapiens
atactttgacaaggaaaatctat

SEQ ID NO: 4358601 - DNA, 12 bp, Homo sapiens
atagacttggga

SEQ ID NO: 4358602 - DNA, 14 bp, Homo sapiens
atagacttgggatg

SEQ ID NO: 4358603 - DNA, 15 bp, Homo sapiens
atagacttgggatgg

SEQ ID NO: 4358604 - DNA, 19 bp, Homo sapiens
atagccagcattcagcaca

SEQ ID NO: 4358605 - DNA, 19 bp, Homo sapiens
atagctttataaagcagtt

SEQ ID NO: 4358606 - DNA, 15 bp, Homo sapiens
ataggtcactcctgg

SEQ ID NO: 4358607 - DNA, 14 bp, Homo sapiens
atagtcacaagagc

SEQ ID NO: 4358608 - DNA, 16 bp, Homo sapiens
atagttccttgcctta

SEQ ID NO: 4358609 - DNA, 22 bp, Homo sapiens
atataatatggatcagagcatt

SEQ ID NO: 4358610 - DNA, 12 bp, Homo sapiens
atatagttcctt

SEQ ID NO: 4358611 - DNA, 18 bp, Homo sapiens
atatatagggagcacttt

SEQ ID NO: 4358612 - DNA, 16 bp, Homo sapiens
atatatgtgtgtgtat

SEQ ID NO: 4358613 - DNA, 14 bp, Homo sapiens
atatatttttcaca

SEQ ID NO: 4358614 - DNA, 17 bp, Homo sapiens
atatgacccacactgcc

SEQ ID NO: 4358615 - DNA, 16 bp, Homo sapiens
atatgtgtgtgtatgt

SEQ ID NO: 4358616 - DNA, 20 bp, Homo sapiens
atatgtgtgtgtatgtttgc

SEQ ID NO: 4358617 - DNA, 16 bp, Homo sapiens
atatgttgtaatattt

SEQ ID NO: 4358618 - DNA, 12 bp, Homo sapiens
atattaaagata

SEQ ID NO: 4358619 - DNA, 22 bp, Homo sapiens
atattaaattctgaatgcaatt

SEQ ID NO: 4358620 - DNA, 19 bp, Homo sapiens
atattccatgaatgtatca

SEQ ID NO: 4358621 - DNA, 22 bp, Homo sapiens
cagtccctggagaaggcatgtt

SEQ ID NO: 4358622 - DNA, 13 bp, Homo sapiens
cagtccctggagc

SEQ ID NO: 4358623 - DNA, 14 bp, Homo sapiens
cagtctgttatgca

SEQ ID NO: 4358624 - DNA, 20 bp, Homo sapiens
cagtgaacattcccagccca

SEQ ID NO: 4358625 - DNA, 19 bp, Homo sapiens
cagtgccactgccccccga

SEQ ID NO: 4358626 - DNA, 20 bp, Homo sapiens
cagtgcctcttccagtgaac

SEQ ID NO: 4358627 - DNA, 21 bp, Homo sapiens
cagtgcctcttccagtgaaca

SEQ ID NO: 4358628 - DNA, 17 bp, Homo sapiens
cagtgcttctctacaga

SEQ ID NO: 4358629 - DNA, 22 bp, Homo sapiens
cagtggatatgacccacactgc

SEQ ID NO: 4358630 - DNA, 23 bp, Homo sapiens
cagtggatatgacccacactgcc

SEQ ID NO: 4358631 - DNA, 13 bp, Homo sapiens
cagtgtggagttc

SEQ ID NO: 4358632 - DNA, 22 bp, Homo sapiens
cagtttggccctggagccaggg

SEQ ID NO: 4358633 - DNA, 17 bp, Homo sapiens
cagttttttggaagaaa

SEQ ID NO: 4358634 - DNA, 15 bp, Homo sapiens
cataaataaaagtac

SEQ ID NO: 4358635 - DNA, 23 bp, Homo sapiens
catactcaaggtgagaattaagt

SEQ ID NO: 4358636 - DNA, 15 bp, Homo sapiens
catactgattgggag

SEQ ID NO: 4358637 - DNA, 22 bp, Homo sapiens
catactttgacaaggaaaatct

SEQ ID NO: 4358638 - DNA, 18 bp, Homo sapiens
cataggcctgggtgctgg

SEQ ID NO: 4358639 - DNA, 16 bp, Homo sapiens
catagtttaagttgat

SEQ ID NO: 4358640 - DNA, 23 bp, Homo sapiens
catagtttaagttgattaaaaat

SEQ ID NO: 4358641 - DNA, 18 bp, Homo sapiens
catatgaataccaggata

SEQ ID NO: 4358642 - DNA, 13 bp, Homo sapiens
catatggaaatgt

SEQ ID NO: 4358643 - DNA, 14 bp, Homo sapiens
catcagaagtttgc

SEQ ID NO: 4358644 - DNA, 18 bp, Homo sapiens
catcagaagtttgcatct

SEQ ID NO: 4358645 - DNA, 18 bp, Homo sapiens
catccaatcctcactggg

SEQ ID NO: 4358646 - DNA, 19 bp, Homo sapiens
catccccttcccccatccc

SEQ ID NO: 4358647 - DNA, 22 bp, Homo sapiens
catccccttcccccatccctac

SEQ ID NO: 4358648 - DNA, 13 bp, Homo sapiens
catccctaccact

SEQ ID NO: 4358649 - DNA, 14 bp, Homo sapiens
catccctcacccat

SEQ ID NO: 4358650 - DNA, 16 bp, Homo sapiens
catccttgctgcagct

SEQ ID NO: 4358651 - DNA, 15 bp, Homo sapiens
catctccatcagctg

SEQ ID NO: 4358652 - DNA, 15 bp, Homo sapiens
catctcctgtgcatg

SEQ ID NO: 4358653 - DNA, 12 bp, Homo sapiens
catctggccctg

SEQ ID NO: 4358654 - DNA, 14 bp, Homo sapiens
catctggccctgac

SEQ ID NO: 4358655 - DNA, 15 bp, Homo sapiens
catcttgtggggcca

SEQ ID NO: 4358656 - DNA, 16 bp, Homo sapiens
catcttgtggggccag

SEQ ID NO: 4358657 - DNA, 18 bp, Homo sapiens
catcttgtggggccagga

SEQ ID NO: 4358658 - DNA, 17 bp, Homo sapiens
catgaatgtatcaggaa

SEQ ID NO: 4358659 - DNA, 16 bp, Homo sapiens
catgacctgtgaccag

SEQ ID NO: 4358660 - DNA, 19 bp, Homo sapiens
catgatgtaaaaaatatta

SEQ ID NO: 4358661 - DNA, 21 bp, Homo sapiens
catgatgtaaaaaatattaaa

SEQ ID NO: 4358662 - DNA, 23 bp, Homo sapiens
catgatgtaaaaaatattaaaga

SEQ ID NO: 4358663 - DNA, 14 bp, Homo sapiens
catgcactgatgtt

SEQ ID NO: 4358664 - DNA, 22 bp, Homo sapiens
catgcagacctcatgcccagct

SEQ ID NO: 4358665 - DNA, 12 bp, Homo sapiens
catgcaggaggt

SEQ ID NO: 4358666 - DNA, 14 bp, Homo sapiens
catgcaggaggtgg

SEQ ID NO: 4358667 - DNA, 13 bp, Homo sapiens
catgcccagctct

SEQ ID NO: 4358668 - DNA, 17 bp, Homo sapiens
catgccccagctctgga

SEQ ID NO: 4358669 - DNA, 23 bp, Homo sapiens
catggccgaagccccttggagag

SEQ ID NO: 4358670 - DNA, 12 bp, Homo sapiens
catggctgggaa

SEQ ID NO: 4358671 - DNA, 12 bp, Homo sapiens
catgggagggat

SEQ ID NO: 4358672 - DNA, 17 bp, Homo sapiens
catgggagggatcagcc

SEQ ID NO: 4358673 - DNA, 18 bp, Homo sapiens
catgggagggatcagccc

SEQ ID NO: 4358674 - DNA, 22 bp, Homo sapiens
catgggtgaagggagagccagc

SEQ ID NO: 4358675 - DNA, 17 bp, Homo sapiens
catggtactaccccagc

SEQ ID NO: 4358676 - DNA, 16 bp, Homo sapiens
catggtgtctcccaac

SEQ ID NO: 4358677 - DNA, 18 bp, Homo sapiens
catggtgtctcccaacat

SEQ ID NO: 4358678 - DNA, 20 bp, Homo sapiens
catggtgtctcccaacatgg

SEQ ID NO: 4358679 - DNA, 14 bp, Homo sapiens
catggttgagaaat

SEQ ID NO: 4358680 - DNA, 14 bp, Homo sapiens
catgtacttgaagg

SEQ ID NO: 4358681 - DNA, 15 bp, Homo sapiens
catgtacttgaagga

SEQ ID NO: 4358682 - DNA, 13 bp, Homo sapiens
catgttcctcaaa

SEQ ID NO: 4358683 - DNA, 17 bp, Homo sapiens
catgttgatttagtctt

SEQ ID NO: 4358684 - DNA, 23 bp, Homo sapiens
catgtttaaatagcctaaatgat

SEQ ID NO: 4358685 - DNA, 22 bp, Homo sapiens
catgtttggtgtttgtctgtgt

SEQ ID NO: 4358686 - DNA, 23 bp, Homo sapiens
catgtttggtgtttgtctgtgtt

SEQ ID NO: 4358687 - DNA, 13 bp, Homo sapiens
cattaagcacaca

SEQ ID NO: 4358688 - DNA, 20 bp, Homo sapiens
cattaagcacacacatctgg

SEQ ID NO: 4358689 - DNA, 13 bp, Homo sapiens
cattaatctcaaa

SEQ ID NO: 4358690 - DNA, 23 bp, Homo sapiens
cattaatgagatgttattactgt

SEQ ID NO: 4358691 - DNA, 12 bp, Homo sapiens
cattcagcacac

SEQ ID NO: 4358692 - DNA, 13 bp, Homo sapiens
cattcagcacaca

SEQ ID NO: 4358693 - DNA, 17 bp, Homo sapiens
cattccaattctaaatc

SEQ ID NO: 4358694 - DNA, 20 bp, Homo sapiens
cattccaattctaaatccga

SEQ ID NO: 4358695 - DNA, 22 bp, Homo sapiens
cattgctggtagagacccccag

SEQ ID NO: 4358696 - DNA, 16 bp, Homo sapiens
catttaactgaactgt

SEQ ID NO: 4358697 - DNA, 22 bp, Homo sapiens
catttgggctcagggttggcca

SEQ ID NO: 4358698 - DNA, 16 bp, Homo sapiens
catttggtctcaggca

SEQ ID NO: 4358699 - DNA, 11 bp, Homo sapiens
catttgtgagg

SEQ ID NO: 4358700 - DNA, 15 bp, Homo sapiens
catttttatgcagac

SEQ ID NO: 4358701 - DNA, 16 bp, Homo sapiens
catttttatgcagaca

SEQ ID NO: 4358702 - DNA, 14 bp, Homo sapiens
ccaaaagacaaaaa

SEQ ID NO: 4358703 - DNA, 13 bp, Homo sapiens
ccaaacaaggaag

SEQ ID NO: 4358704 - DNA, 18 bp, Homo sapiens
ccaaacaaggaagccaaa

SEQ ID NO: 4358705 - DNA, 16 bp, Homo sapiens
ccaaacagcttaaatt

SEQ ID NO: 4358706 - DNA, 21 bp, Homo sapiens
ccaaagagaatcccacattag

SEQ ID NO: 4358707 - DNA, 22 bp, Homo sapiens
ccaaagagaatcccacattagc

SEQ ID NO: 4358708 - DNA, 18 bp, Homo sapiens
ccaaagttttcaaactgc

SEQ ID NO: 4358709 - DNA, 21 bp, Homo sapiens
ccaaatgaaatactgccttgg

SEQ ID NO: 4358710 - DNA, 17 bp, Homo sapiens
ccaacatgcactgatgt

SEQ ID NO: 4358711 - DNA, 14 bp, Homo sapiens
ccaacatgggaggg

SEQ ID NO: 4358712 - DNA, 22 bp, Homo sapiens
ccaacatgggagggatcagccc

SEQ ID NO: 4358713 - DNA, 17 bp, Homo sapiens
ccaagactcctcaggca

SEQ ID NO: 4358714 - DNA, 17 bp, Homo sapiens
ccaagaggggcgggctc

SEQ ID NO: 4358715 - DNA, 19 bp, Homo sapiens
ccaagaggggcgggctcag

SEQ ID NO: 4358716 - DNA, 13 bp, Homo sapiens
ccaagcctgctgg

SEQ ID NO: 4358717 - DNA, 18 bp, Homo sapiens
ccaagcctgctggctgcg

SEQ ID NO: 4358718 - DNA, 17 bp, Homo sapiens
ccaagggggtgactgga

SEQ ID NO: 4358719 - DNA, 15 bp, Homo sapiens
ccaagtatgccttaa

SEQ ID NO: 4358720 - DNA, 22 bp, Homo sapiens
ccaatttggtaaaaatgctgct

SEQ ID NO: 4358721 - DNA, 18 bp, Homo sapiens
ccacaattaaaccgcatg

SEQ ID NO: 4358722 - DNA, 13 bp, Homo sapiens
ccacacagagtgg

SEQ ID NO: 4358723 - DNA, 14 bp, Homo sapiens
ccacaccgcagaag

SEQ ID NO: 4358724 - DNA, 18 bp, Homo sapiens
ccacactgccagaagaga

SEQ ID NO: 4358725 - DNA, 13 bp, Homo sapiens
ccacagctgggca

SEQ ID NO: 4358726 - DNA, 20 bp, Homo sapiens
ccacagctgggcagggtgag

SEQ ID NO: 4358727 - DNA, 16 bp, Homo sapiens
ccacatggtgtctccc

SEQ ID NO: 4358728 - DNA, 17 bp, Homo sapiens
ccacatggtgtctccca

SEQ ID NO: 4358729 - DNA, 18 bp, Homo sapiens
ccacatggtgtctcccaa

SEQ ID NO: 4358730 - DNA, 13 bp, Homo sapiens
ccaccatccccac

SEQ ID NO: 4358731 - DNA, 12 bp, Homo sapiens
ccacccaagcct

SEQ ID NO: 4358732 - DNA, 19 bp, Homo sapiens
ccaccctgccaagactcct

SEQ ID NO: 4358733 - DNA, 18 bp, Homo sapiens
ccacctgccaaaagctgg

SEQ ID NO: 4358734 - DNA, 21 bp, Homo sapiens
ccactgccccccgaggctgct

SEQ ID NO: 4358735 - DNA, 13 bp, Homo sapiens
ccactttgaaggg

SEQ ID NO: 4358736 - DNA, 16 bp, Homo sapiens
ccagaatgagacatcc

SEQ ID NO: 4358737 - DNA, 15 bp, Homo sapiens
ccagaattcccttga

SEQ ID NO: 4358738 - DNA, 20 bp, Homo sapiens
ccagacagcttgactgcttt

SEQ ID NO: 4358739 - DNA, 23 bp, Homo sapiens
ccagagctgccgacttggagact

SEQ ID NO: 4358740 - DNA, 16 bp, Homo sapiens
ccagaggtggatgtta

SEQ ID NO: 4358741 - DNA, 11 bp, Homo sapiens
cggccaggcat

SEQ ID NO: 4358742 - DNA, 22 bp, Homo sapiens
cggccccctccccccagactct

SEQ ID NO: 4358743 - DNA, 23 bp, Homo sapiens
cgggacatggttgggggaatgca

SEQ ID NO: 4358744 - DNA, 13 bp, Homo sapiens
cgggcagccaccc

SEQ ID NO: 4358745 - DNA, 22 bp, Homo sapiens
cgggcagccacccaagcctgct

SEQ ID NO: 4358746 - DNA, 23 bp, Homo sapiens
cgggcagccacccaagcctgctg

SEQ ID NO: 4358747 - DNA, 10 bp, Homo sapiens
cgggccaggg

SEQ ID NO: 4358748 - DNA, 14 bp, Homo sapiens
cgggcgcgggcagc

SEQ ID NO: 4358749 - DNA, 10 bp, Homo sapiens
cgggctcaga

SEQ ID NO: 4358750 - DNA, 11 bp, Homo sapiens
cgggctcagag

SEQ ID NO: 4358751 - DNA, 22 bp, Homo sapiens
cgggtctcgcagcctgaagcct

SEQ ID NO: 4358752 - DNA, 15 bp, Homo sapiens
cggtaagtgttctca

SEQ ID NO: 4358753 - DNA, 19 bp, Homo sapiens
cggtgggcatttgtgaggc

SEQ ID NO: 4358754 - DNA, 17 bp, Homo sapiens
cggtggtgcccgtgccc

SEQ ID NO: 4358755 - DNA, 21 bp, Homo sapiens
cggtggtgcccgtgcccgcag

SEQ ID NO: 4358756 - DNA, 12 bp, Homo sapiens
cgtctgctctgg

SEQ ID NO: 4358757 - DNA, 20 bp, Homo sapiens
cgttctaggtaggaagagcc

SEQ ID NO: 4358758 - DNA, 14 bp, Homo sapiens
cgttgtgagctgga

SEQ ID NO: 4358759 - DNA, 13 bp, Homo sapiens
ctaaatatttcct

SEQ ID NO: 4358760 - DNA, 18 bp, Homo sapiens
ctaaatccgacttgaata

SEQ ID NO: 4358761 - DNA, 12 bp, Homo sapiens
ctaaccaagttc

SEQ ID NO: 4358762 - DNA, 23 bp, Homo sapiens
ctaactggtaaaaagatccaggg

SEQ ID NO: 4358763 - DNA, 15 bp, Homo sapiens
ctaagtgacagtatc

SEQ ID NO: 4358764 - DNA, 15 bp, Homo sapiens
ctaatgtacgctgct

SEQ ID NO: 4358765 - DNA, 13 bp, Homo sapiens
ctacaatcatggt

SEQ ID NO: 4358766 - DNA, 15 bp, Homo sapiens
ctaccctaaccaagt

SEQ ID NO: 4358767 - DNA, 12 bp, Homo sapiens
ctactgtaagag

SEQ ID NO: 4358768 - DNA, 19 bp, Homo sapiens
ctactgtaagagacatgaa

SEQ ID NO: 4358769 - DNA, 15 bp, Homo sapiens
ctagaaaatctgagt

SEQ ID NO: 4358770 - DNA, 16 bp, Homo sapiens
ctagagtttgaaaaac

SEQ ID NO: 4358771 - DNA, 18 bp, Homo sapiens
ctagcccagtccctggag

SEQ ID NO: 4358772 - DNA, 24 bp, Homo sapiens
ctagctgtattttttgtatgctta

SEQ ID NO: 4358773 - DNA, 15 bp, Homo sapiens
ctaggtaggaagagc

SEQ ID NO: 4358774 - DNA, 16 bp, Homo sapiens
ctaggtaggaagagcc

SEQ ID NO: 4358775 - DNA, 16 bp, Homo sapiens
ctagtaatactgtctt

SEQ ID NO: 4358776 - DNA, 12 bp, Homo sapiens
ctagttcatcca

SEQ ID NO: 4358777 - DNA, 19 bp, Homo sapiens
ctagttcatccaatcctca

SEQ ID NO: 4358778 - DNA, 13 bp, Homo sapiens
ctagttctgctgc

SEQ ID NO: 4358779 - DNA, 16 bp, Homo sapiens
ctatacccacccagaa

SEQ ID NO: 4358780 - DNA, 20 bp, Homo sapiens
ctatatagttccttgcctta

SEQ ID NO: 4358781 - DNA, 18 bp, Homo sapiens
ctatattaaattctgaat

SEQ ID NO: 4358782 - DNA, 14 bp, Homo sapiens
ctatatttgtcttc

SEQ ID NO: 4358783 - DNA, 15 bp, Homo sapiens
ctatatttgtcttcc

SEQ ID NO: 4358784 - DNA, 12 bp, Homo sapiens
ctatcattccaa

SEQ ID NO: 4358785 - DNA, 20 bp, Homo sapiens
ctatcattccaattctaaat

SEQ ID NO: 4358786 - DNA, 13 bp, Homo sapiens
ctattgagccttg

SEQ ID NO: 4358787 - DNA, 18 bp, Homo sapiens
ctatttttatttatattt

SEQ ID NO: 4358788 - DNA, 16 bp, Homo sapiens
ctcaaagagattcgaa

SEQ ID NO: 4358789 - DNA, 16 bp, Homo sapiens
ctcaacatgttactga

SEQ ID NO: 4358790 - DNA, 13 bp, Homo sapiens
ctcaactgaaggg

SEQ ID NO: 4358791 - DNA, 17 bp, Homo sapiens
ctcacccatcctagagg

SEQ ID NO: 4358792 - DNA, 15 bp, Homo sapiens
ctcacctctgaggac

SEQ ID NO: 4358793 - DNA, 20 bp, Homo sapiens
ctcactcagtaaaacataat

SEQ ID NO: 4358794 - DNA, 12 bp, Homo sapiens
ctcactgggtgg

SEQ ID NO: 4358795 - DNA, 13 bp, Homo sapiens
ctcactgggtggg

SEQ ID NO: 4358796 - DNA, 10 bp, Homo sapiens
ctcagaacat

SEQ ID NO: 4358797 - DNA, 14 bp, Homo sapiens
ctcagaacatactg

SEQ ID NO: 4358798 - DNA, 16 bp, Homo sapiens
ctcagaacatactgat

SEQ ID NO: 4358799 - DNA, 13 bp, Homo sapiens
ctcagagctttgt

SEQ ID NO: 4358800 - DNA, 20 bp, Homo sapiens
ctcagagctttgtcacttgc

SEQ ID NO: 4358801 - DNA, 17 bp, Homo sapiens
ctcagccagtggcacag

SEQ ID NO: 4358802 - DNA, 13 bp, Homo sapiens
ctcaggcagcacc

SEQ ID NO: 4358803 - DNA, 20 bp, Homo sapiens
ctcaggcagcaccacactgg

SEQ ID NO: 4358804 - DNA, 16 bp, Homo sapiens
ctcaggcataggcctg

SEQ ID NO: 4358805 - DNA, 22 bp, Homo sapiens
ctcaggcataggcctgggtgct

SEQ ID NO: 4358806 - DNA, 14 bp, Homo sapiens
ctcagggttggcca

SEQ ID NO: 4358807 - DNA, 16 bp, Homo sapiens
ctcagggttggccatt

SEQ ID NO: 4358808 - DNA, 21 bp, Homo sapiens
ctcagtatgctttccctgagg

SEQ ID NO: 4358809 - DNA, 22 bp, Homo sapiens
ctcagtatgctttccctgagga

SEQ ID NO: 4358810 - DNA, 16 bp, Homo sapiens
ctcataccctccctcc

SEQ ID NO: 4358811 - DNA, 16 bp, Homo sapiens
ctcatgaagcaggagg

SEQ ID NO: 4358812 - DNA, 14 bp, Homo sapiens
ctcatgcccagctc

SEQ ID NO: 4358813 - DNA, 15 bp, Homo sapiens
ctccaccatccccac

SEQ ID NO: 4358814 - DNA, 21 bp, Homo sapiens
ctccaccctccggccagcgag

SEQ ID NO: 4358815 - DNA, 17 bp, Homo sapiens
ctccagacccaccacac

SEQ ID NO: 4358816 - DNA, 14 bp, Homo sapiens
ctccagattctgat

SEQ ID NO: 4358817 - DNA, 17 bp, Homo sapiens
ctccagattctgatgca

SEQ ID NO: 4358818 - DNA, 19 bp, Homo sapiens
ctccagattctgatgcata

SEQ ID NO: 4358819 - DNA, 14 bp, Homo sapiens
ctccagtcatggta

SEQ ID NO: 4358820 - DNA, 22 bp, Homo sapiens
ctccagtcatggtactacccca

SEQ ID NO: 4358821 - DNA, 19 bp, Homo sapiens
ctcccaacatgggagggat

SEQ ID NO: 4358822 - DNA, 18 bp, Homo sapiens
ctcccacggcacctcggg

SEQ ID NO: 4358823 - DNA, 15 bp, Homo sapiens
ctcccagcctcttgc

SEQ ID NO: 4358824 - DNA, 15 bp, Homo sapiens
ctccccccagactct

SEQ ID NO: 4358825 - DNA, 16 bp, Homo sapiens
ctccctcaactgaagg

SEQ ID NO: 4358826 - DNA, 18 bp, Homo sapiens
ctccctcccctctcagaa

SEQ ID NO: 4358827 - DNA, 20 bp, Homo sapiens
ctccggccagcgagtggtca

SEQ ID NO: 4358828 - DNA, 16 bp, Homo sapiens
ctcctggtctgtgaag

SEQ ID NO: 4358829 - DNA, 15 bp, Homo sapiens
ctcgactaaaacaag

SEQ ID NO: 4358830 - DNA, 16 bp, Homo sapiens
ctcgactaaaacaagt

SEQ ID NO: 4358831 - DNA, 14 bp, Homo sapiens
ctcgcagcctgaag

SEQ ID NO: 4358832 - DNA, 18 bp, Homo sapiens
ctcgcagcctgaagcctg

SEQ ID NO: 4358833 - DNA, 13 bp, Homo sapiens
ctctccctgcacg

SEQ ID NO: 4358834 - DNA, 14 bp, Homo sapiens
ctctcggccaggca

SEQ ID NO: 4358835 - DNA, 21 bp, Homo sapiens
ctctctgacgcttgtgacagt

SEQ ID NO: 4358836 - DNA, 23 bp, Homo sapiens
ctctgacgcttgtgacagtgcct

SEQ ID NO: 4358837 - DNA, 23 bp, Homo sapiens
ctctgatattccatgaatgtatc

SEQ ID NO: 4358838 - DNA, 10 bp, Homo sapiens
ctctgcacag

SEQ ID NO: 4358839 - DNA, 15 bp, Homo sapiens
ctctgcacagatgga

SEQ ID NO: 4358840 - DNA, 21 bp, Homo sapiens
ctctgcccccatttccccgat

SEQ ID NO: 4358841 - DNA, 10 bp, Homo sapiens
ctctggccag

SEQ ID NO: 4358842 - DNA, 18 bp, Homo sapiens
ctctggtggcttaagtga

SEQ ID NO: 4358843 - DNA, 12 bp, Homo sapiens
ctctggttgcct

SEQ ID NO: 4358844 - DNA, 13 bp, Homo sapiens
ctctgtcagatgg

SEQ ID NO: 4358845 - DNA, 23 bp, Homo sapiens
ctctgtcagatgggaagacatga

SEQ ID NO: 4358846 - DNA, 11 bp, Homo sapiens
ctctgtccaca

SEQ ID NO: 4358847 - DNA, 15 bp, Homo sapiens
ctctgtgaccaactg

SEQ ID NO: 4358848 - DNA, 22 bp, Homo sapiens
ctcttccagtgaacattcccag

SEQ ID NO: 4358849 - DNA, 17 bp, Homo sapiens
ctcttcttcttcagaag

SEQ ID NO: 4358850 - DNA, 15 bp, Homo sapiens
ctcttgagggagctt

SEQ ID NO: 4358851 - DNA, 15 bp, Homo sapiens
ctcttgctcagagct

SEQ ID NO: 4358852 - DNA, 15 bp, Homo sapiens
ctctttaccttctaa

SEQ ID NO: 4358853 - DNA, 16 bp, Homo sapiens
ctctttaccttctaaa

SEQ ID NO: 4358854 - DNA, 16 bp, Homo sapiens
ctgaagaaaatgagca

SEQ ID NO: 4358855 - DNA, 22 bp, Homo sapiens
ctgaagcctggattccagcagt

SEQ ID NO: 4358856 - DNA, 18 bp, Homo sapiens
ctgaaggggtgcacccac

SEQ ID NO: 4358857 - DNA, 22 bp, Homo sapiens
ctgaaggggtgcacccacctgt

SEQ ID NO: 4358858 - DNA, 18 bp, Homo sapiens
ctgacaaaggagccttga

SEQ ID NO: 4358859 - DNA, 15 bp, Homo sapiens
ctgacgcttgtgaca

SEQ ID NO: 4358860 - DNA, 18 bp, Homo sapiens
ctgactcaacatgttact

SEQ ID NO: 4358861 - DNA, 11 bp, Homo sapiens
ctgaggaggag

SEQ ID NO: 4358862 - DNA, 23 bp, Homo sapiens
ctgaggaggaggacacagcacaa

SEQ ID NO: 4358863 - DNA, 17 bp, Homo sapiens
gaagggaatttggctca

SEQ ID NO: 4358864 - DNA, 14 bp, Homo sapiens
gaagggcaagaaat

SEQ ID NO: 4358865 - DNA, 13 bp, Homo sapiens
gaagggtcctgcc

SEQ ID NO: 4358866 - DNA, 16 bp, Homo sapiens
gaaggtccttgcctga

SEQ ID NO: 4358867 - DNA, 22 bp, Homo sapiens
gaaggttgtatgtgtcatttat

SEQ ID NO: 4358868 - DNA, 17 bp, Homo sapiens
gaagtgtaacagctgag

SEQ ID NO: 4358869 - DNA, 23 bp, Homo sapiens
gaagtgtaacagctgaggtctct

SEQ ID NO: 4358870 - DNA, 23 bp, Homo sapiens
gaagttttcaggacttggtctga

SEQ ID NO: 4358871 - DNA, 21 bp, Homo sapiens
gaatgcaatttttttttgttc

SEQ ID NO: 4358872 - DNA, 22 bp, Homo sapiens
gaatgcacactagcctctccag

SEQ ID NO: 4358873 - DNA, 15 bp, Homo sapiens
gaatgcacctcccca

SEQ ID NO: 4358874 - DNA, 18 bp, Homo sapiens
gaatgcacctccccaaag

SEQ ID NO: 4358875 - DNA, 20 bp, Homo sapiens
gaatgccgcgaactgggttc

SEQ ID NO: 4358876 - DNA, 14 bp, Homo sapiens
gaatgctagacaga

SEQ ID NO: 4358877 - DNA, 21 bp, Homo sapiens
gaatggggggcgggccagggt

SEQ ID NO: 4358878 - DNA, 16 bp, Homo sapiens
gaatgtatcaggaaat

SEQ ID NO: 4358879 - DNA, 17 bp, Homo sapiens
gaatgtatcaggaaata

SEQ ID NO: 4358880 - DNA, 19 bp, Homo sapiens
gaatgtattattctgcagc

SEQ ID NO: 4358881 - DNA, 13 bp, Homo sapiens
gaattaagtttta

SEQ ID NO: 4358882 - DNA, 21 bp, Homo sapiens
gaattcccttgaattgtgtat

SEQ ID NO: 4358883 - DNA, 18 bp, Homo sapiens
gaattgtgtattgatgca

SEQ ID NO: 4358884 - DNA, 12 bp, Homo sapiens
gaatttgctaaa

SEQ ID NO: 4358885 - DNA, 17 bp, Homo sapiens
gaattttccaagaacat

SEQ ID NO: 4358886 - DNA, 15 bp, Homo sapiens
gacaaaggagccttg

SEQ ID NO: 4358887 - DNA, 18 bp, Homo sapiens
gacaaggaaaatctatat

SEQ ID NO: 4358888 - DNA, 20 bp, Homo sapiens
gacaaggaaaatctatattt

SEQ ID NO: 4358889 - DNA, 13 bp, Homo sapiens
gacaccagagctg

SEQ ID NO: 4358890 - DNA, 16 bp, Homo sapiens
gacagaaaccaagcca

SEQ ID NO: 4358891 - DNA, 13 bp, Homo sapiens
gacagcgggaaaa

SEQ ID NO: 4358892 - DNA, 22 bp, Homo sapiens
gacagtatcactctaatataat

SEQ ID NO: 4358893 - DNA, 13 bp, Homo sapiens
gacagtgcctctt

SEQ ID NO: 4358894 - DNA, 23 bp, Homo sapiens
gacagtggatatgacccacactg

SEQ ID NO: 4358895 - DNA, 16 bp, Homo sapiens
gacatgaaatgaaaat

SEQ ID NO: 4358896 - DNA, 21 bp, Homo sapiens
gacatggttgggggaatgcac

SEQ ID NO: 4358897 - DNA, 22 bp, Homo sapiens
gacattcctaagagtggaggag

SEQ ID NO: 4358898 - DNA, 12 bp, Homo sapiens
gaccagaattcc

SEQ ID NO: 4358899 - DNA, 10 bp, Homo sapiens
gaccaggagc

SEQ ID NO: 4358900 - DNA, 23 bp, Homo sapiens
gaccatggccgaagccccttgga

SEQ ID NO: 4358901 - DNA, 12 bp, Homo sapiens
gacccacactgc

SEQ ID NO: 4358902 - DNA, 13 bp, Homo sapiens
gacccagcctgaa

SEQ ID NO: 4358903 - DNA, 22 bp, Homo sapiens
gacccccaggcctgtccaccct

SEQ ID NO: 4358904 - DNA, 16 bp, Homo sapiens
gacccctctggccagg

SEQ ID NO: 4358905 - DNA, 20 bp, Homo sapiens
gacccctctggccaggatgg

SEQ ID NO: 4358906 - DNA, 14 bp, Homo sapiens
gaccctacaggaga

SEQ ID NO: 4358907 - DNA, 23 bp, Homo sapiens
gaccctgtccggcccagtgccac

SEQ ID NO: 4358908 - DNA, 19 bp, Homo sapiens
gacctcatgcccagctctc

SEQ ID NO: 4358909 - DNA, 14 bp, Homo sapiens
gactcctggtctgt

SEQ ID NO: 4358910 - DNA, 15 bp, Homo sapiens
gactgcagtgtggag

SEQ ID NO: 4358911 - DNA, 16 bp, Homo sapiens
gactgcagtgtggagt

SEQ ID NO: 4358912 - DNA, 21 bp, Homo sapiens
gactgcagtgtggagttcacc

SEQ ID NO: 4358913 - DNA, 19 bp, Homo sapiens
gagaagctagatgcccctg

SEQ ID NO: 4358914 - DNA, 16 bp, Homo sapiens
gagaattcagtatttt

SEQ ID NO: 4358915 - DNA, 12 bp, Homo sapiens
gagacatccagc

SEQ ID NO: 4358916 - DNA, 23 bp, Homo sapiens
gagactcctggtctgtgaagagc

SEQ ID NO: 4358917 - DNA, 14 bp, Homo sapiens
gagagagaggctgc

SEQ ID NO: 4358918 - DNA, 19 bp, Homo sapiens
gagagaggctgcctcagcc

SEQ ID NO: 4358919 - DNA, 24 bp, Homo sapiens
gagagtggcaggtgggctgcctgc

SEQ ID NO: 4358920 - DNA, 18 bp, Homo sapiens
gagcaaacccagaggtgg

SEQ ID NO: 4358921 - DNA, 17 bp, Homo sapiens
gagcaattctgggagaa

SEQ ID NO: 4358922 - DNA, 19 bp, Homo sapiens
gagccagggcagaggaatg

SEQ ID NO: 4358923 - DNA, 20 bp, Homo sapiens
gagccagggcagaggaatgt

SEQ ID NO: 4358924 - DNA, 19 bp, Homo sapiens
gagcccgcagggccatgca

SEQ ID NO: 4358925 - DNA, 23 bp, Homo sapiens
gagcccttctatacccacccaga

SEQ ID NO: 4358926 - DNA, 19 bp, Homo sapiens
gagccttgcatgtacttga

SEQ ID NO: 4358927 - DNA, 17 bp, Homo sapiens
gagccttgctgggccag

SEQ ID NO: 4358928 - DNA, 18 bp, Homo sapiens
gagctggatagacttggg

SEQ ID NO: 4358929 - DNA, 19 bp, Homo sapiens
gagctggatagacttggga

SEQ ID NO: 4358930 - DNA, 21 bp, Homo sapiens
gagctggatagacttgggatg

SEQ ID NO: 4358931 - DNA, 13 bp, Homo sapiens
gagctgggcccct

SEQ ID NO: 4358932 - DNA, 19 bp, Homo sapiens
gagctgggcccctgcacag

SEQ ID NO: 4358933 - DNA, 14 bp, Homo sapiens
gagctggtgtctga

SEQ ID NO: 4358934 - DNA, 21 bp, Homo sapiens
gagcttgctccagattctgat

SEQ ID NO: 4358935 - DNA, 22 bp, Homo sapiens
gagcttgctccagattctgatg

SEQ ID NO: 4358936 - DNA, 14 bp, Homo sapiens
gaggaatgtagggc

SEQ ID NO: 4358937 - DNA, 16 bp, Homo sapiens
gaggaatgtagggcct

SEQ ID NO: 4358938 - DNA, 17 bp, Homo sapiens
gaggacacagcacaagg

SEQ ID NO: 4358939 - DNA, 21 bp, Homo sapiens
gaggacacagcacaagggcac

SEQ ID NO: 4358940 - DNA, 22 bp, Homo sapiens
gaggacacagcacaagggcaca

SEQ ID NO: 4358941 - DNA, 22 bp, Homo sapiens
gaggagccttgctgggccaggg

SEQ ID NO: 4358942 - DNA, 15 bp, Homo sapiens
gaggaggacacagca

SEQ ID NO: 4358943 - DNA, 15 bp, Homo sapiens
gaggaggagccttgc

SEQ ID NO: 4358944 - DNA, 15 bp, Homo sapiens
gaggaggaggacaca

SEQ ID NO: 4358945 - DNA, 13 bp, Homo sapiens
gaggaggaggagc

SEQ ID NO: 4358946 - DNA, 21 bp, Homo sapiens
gaggcccttgtcgtgggatgg

SEQ ID NO: 4358947 - DNA, 17 bp, Homo sapiens
gaggccggggtccaggc

SEQ ID NO: 4358948 - DNA, 19 bp, Homo sapiens
gaggccggggtccaggccc

SEQ ID NO: 4358949 - DNA, 13 bp, Homo sapiens
gaggctgcctcag

SEQ ID NO: 4358950 - DNA, 14 bp, Homo sapiens
gaggctgcctcagc

SEQ ID NO: 4358951 - DNA, 14 bp, Homo sapiens
gagggaagaccaga

SEQ ID NO: 4358952 - DNA, 15 bp, Homo sapiens
gagggaaggagccca

SEQ ID NO: 4358953 - DNA, 18 bp, Homo sapiens
gagggacaaactcactca

SEQ ID NO: 4358954 - DNA, 15 bp, Homo sapiens
gagggagcttagcca

SEQ ID NO: 4358955 - DNA, 16 bp, Homo sapiens
gagggcaggcttgggg

SEQ ID NO: 4358956 - DNA, 20 bp, Homo sapiens
gagggcaggcttggggaaaa

SEQ ID NO: 4358957 - DNA, 16 bp, Homo sapiens
gaggggcgggctcaga

SEQ ID NO: 4358958 - DNA, 18 bp, Homo sapiens
gaggggcgggctcagagc

SEQ ID NO: 4358959 - DNA, 15 bp, Homo sapiens
gaggtctcttgaggg

SEQ ID NO: 4358960 - DNA, 17 bp, Homo sapiens
gaggtctcttgagggag

SEQ ID NO: 4358961 - DNA, 13 bp, Homo sapiens
gaggttataggtc

SEQ ID NO: 4358962 - DNA, 19 bp, Homo sapiens
gaggttataggtcactcct

SEQ ID NO: 4358963 - DNA, 13 bp, Homo sapiens
gagtcatctccat

SEQ ID NO: 4358964 - DNA, 13 bp, Homo sapiens
gagtcatcttgtg

SEQ ID NO: 4358965 - DNA, 13 bp, Homo sapiens
gagtggaggagga

SEQ ID NO: 4358966 - DNA, 17 bp, Homo sapiens
gagttaaaaagggcagg

SEQ ID NO: 4358967 - DNA, 15 bp, Homo sapiens
gagttttgtctgtct

SEQ ID NO: 4358968 - DNA, 15 bp, Homo sapiens
gataacaagatcttt

SEQ ID NO: 4358969 - DNA, 14 bp, Homo sapiens
gataatcaggaaaa

SEQ ID NO: 4358970 - DNA, 15 bp, Homo sapiens
gataatcaggaaaaa

SEQ ID NO: 4358971 - DNA, 13 bp, Homo sapiens
gatactctgtcag

SEQ ID NO: 4358972 - DNA, 13 bp, Homo sapiens
gatagacttggga

SEQ ID NO: 4358973 - DNA, 15 bp, Homo sapiens
gatagacttgggatg

SEQ ID NO: 4358974 - DNA, 21 bp, Homo sapiens
gatagacttgggatggggagg

SEQ ID NO: 4358975 - DNA, 17 bp, Homo sapiens
gataggctctgcacaga

SEQ ID NO: 4358976 - DNA, 15 bp, Homo sapiens
gatatatttttcaca

SEQ ID NO: 4358977 - DNA, 17 bp, Homo sapiens
gatatgacccacactgc

SEQ ID NO: 4358978 - DNA, 18 bp, Homo sapiens
gatatgacccacactgcc

SEQ ID NO: 4358979 - DNA, 13 bp, Homo sapiens
gatattaaagatt

SEQ ID NO: 4358980 - DNA, 17 bp, Homo sapiens
gatcaacatttatgacc

SEQ ID NO: 4358981 - DNA, 18 bp, Homo sapiens
gatcagccccgcctgtca

SEQ ID NO: 4358982 - DNA, 21 bp, Homo sapiens
gatcccgcctcttcttcttca

SEQ ID NO: 4358983 - DNA, 21 bp, Homo sapiens
gatccttccatcttgtggggc

SEQ ID NO: 4358984 - DNA, 14 bp, Homo sapiens
gatctgactgccaa

SEQ ID NO: 4358985 - DNA, 21 bp, Homo sapiens
gatctgctgaggcccagtgca

SEQ ID NO: 4358986 - DNA, 11 bp, Homo sapiens
gatctttcagg

SEQ ID NO: 4358987 - DNA, 16 bp, Homo sapiens
gatgagcgccacctct

SEQ ID NO: 4358988 - DNA, 19 bp, Homo sapiens
gatggatttgcctgtgcca

SEQ ID NO: 4358989 - DNA, 20 bp, Homo sapiens
gatggcatttggtctcaggc

SEQ ID NO: 4358990 - DNA, 23 bp, Homo sapiens
gatggcatttggtctcaggcagc

SEQ ID NO: 4358991 - DNA, 18 bp, Homo sapiens
gatggggtctgtgactgg

SEQ ID NO: 4358992 - DNA, 19 bp, Homo sapiens
gatggggtctgtgactgga

SEQ ID NO: 4358993 - DNA, 20 bp, Homo sapiens
gatggggtctgtgactggat

SEQ ID NO: 4358994 - DNA, 23 bp, Homo sapiens
gatggggtctgtgactggatctt

SEQ ID NO: 4358995 - DNA, 18 bp, Homo sapiens
gatgtaaaaaatattaaa

SEQ ID NO: 4358996 - DNA, 21 bp, Homo sapiens
gatgtccctttcttggccagt

SEQ ID NO: 4358997 - DNA, 12 bp, Homo sapiens
gatgtgcaataa

SEQ ID NO: 4358998 - DNA, 14 bp, Homo sapiens
gatgttatgaacag

SEQ ID NO: 4358999 - DNA, 19 bp, Homo sapiens
gatgttatgaacagctgtg

SEQ ID NO: 4359000 - DNA, 23 bp, Homo sapiens
gatgttatgaacagctgtgtctg

SEQ ID NO: 4359001 - DNA, 22 bp, Homo sapiens
gatgttattactgttttgggcc

SEQ ID NO: 4359002 - DNA, 16 bp, Homo sapiens
gattacatgtatgttc

SEQ ID NO: 4359003 - DNA, 19 bp, Homo sapiens
gattacatgtatgttcttg

SEQ ID NO: 4359004 - DNA, 14 bp, Homo sapiens
gattaccggcattt

SEQ ID NO: 4359005 - DNA, 13 bp, Homo sapiens
gattcaaattgct

SEQ ID NO: 4359006 - DNA, 17 bp, Homo sapiens
gattcaaattgctgctt

SEQ ID NO: 4359007 - DNA, 20 bp, Homo sapiens
gatttcaggatactctgtca

SEQ ID NO: 4359008 - DNA, 22 bp, Homo sapiens
gatttcaggatactctgtcaga

SEQ ID NO: 4359009 - DNA, 20 bp, Homo sapiens
gcaaacccagaggtggatgt

SEQ ID NO: 4359010 - DNA, 22 bp, Homo sapiens
gcaagaaatggcgtctgctctg

SEQ ID NO: 4359011 - DNA, 20 bp, Homo sapiens
gcaataatttgtacaatggt

SEQ ID NO: 4359012 - DNA, 13 bp, Homo sapiens
gcaatataagcat

SEQ ID NO: 4359013 - DNA, 17 bp, Homo sapiens
gcaatataagcataaaa

SEQ ID NO: 4359014 - DNA, 20 bp, Homo sapiens
gcaatttttttttgttccct

SEQ ID NO: 4359015 - DNA, 18 bp, Homo sapiens
gcacacacaaacctactg

SEQ ID NO: 4359016 - DNA, 13 bp, Homo sapiens
gcacacacatctg

SEQ ID NO: 4359017 - DNA, 17 bp, Homo sapiens
gcacacacatctggccc

SEQ ID NO: 4359018 - DNA, 13 bp, Homo sapiens
gcacacaggacag

SEQ ID NO: 4359019 - DNA, 21 bp, Homo sapiens
gcacaggagactccaaggagc

SEQ ID NO: 4359020 - DNA, 13 bp, Homo sapiens
gcacattgcccat

SEQ ID NO: 4359021 - DNA, 17 bp, Homo sapiens
gcacattgcccatggct

SEQ ID NO: 4359022 - DNA, 18 bp, Homo sapiens
gcacattgcccatggctg

SEQ ID NO: 4359023 - DNA, 23 bp, Homo sapiens
gcacccacctgttttctgaaaca

SEQ ID NO: 4359024 - DNA, 14 bp, Homo sapiens
gcacctccccaaag

SEQ ID NO: 4359025 - DNA, 23 bp, Homo sapiens
gcacctcggggacaccagagctg

SEQ ID NO: 4359026 - DNA, 16 bp, Homo sapiens
gcactacaatcatggt

SEQ ID NO: 4359027 - DNA, 18 bp, Homo sapiens
gcactgatgttgtgtttt

SEQ ID NO: 4359028 - DNA, 19 bp, Homo sapiens
gcactgtctcagtttcact

SEQ ID NO: 4359029 - DNA, 13 bp, Homo sapiens
gcactgtggtttc

SEQ ID NO: 4359030 - DNA, 20 bp, Homo sapiens
gcagaaagcatccctcaccc

SEQ ID NO: 4359031 - DNA, 14 bp, Homo sapiens
gcagaacaaatgtg

SEQ ID NO: 4359032 - DNA, 21 bp, Homo sapiens
gcagaacaaatgtgtttttct

SEQ ID NO: 4359033 - DNA, 22 bp, Homo sapiens
gcagaacaaatgtgtttttcta

SEQ ID NO: 4359034 - DNA, 15 bp, Homo sapiens
gcagaacctgcacac

SEQ ID NO: 4359035 - DNA, 23 bp, Homo sapiens
gcagaacctgcacacaggacagc

SEQ ID NO: 4359036 - DNA, 22 bp, Homo sapiens
gcagacagtctgttatgcactg

SEQ ID NO: 4359037 - DNA, 13 bp, Homo sapiens
gcagacctcatgc

SEQ ID NO: 4359038 - DNA, 13 bp, Homo sapiens
gcagcaggtgctg

SEQ ID NO: 4359039 - DNA, 17 bp, Homo sapiens
gcagcatgacctgtgac

SEQ ID NO: 4359040 - DNA, 22 bp, Homo sapiens
gcagccacccaagcctgctggc

SEQ ID NO: 4359041 - DNA, 23 bp, Homo sapiens
gcagccctcacctctgaggacag

SEQ ID NO: 4359042 - DNA, 13 bp, Homo sapiens
gcagcctgaagcc

SEQ ID NO: 4359043 - DNA, 20 bp, Homo sapiens
gcagcctgaagcctggattc

SEQ ID NO: 4359044 - DNA, 16 bp, Homo sapiens
gcagcgtgtgggtccc

SEQ ID NO: 4359045 - DNA, 18 bp, Homo sapiens
gcagcgtgtgggtcccgc

SEQ ID NO: 4359046 - DNA, 15 bp, Homo sapiens
gcaggaggtggagaa

SEQ ID NO: 4359047 - DNA, 23 bp, Homo sapiens
gcaggcctctggttgcctccccc

SEQ ID NO: 4359048 - DNA, 13 bp, Homo sapiens
gcaggcttgggga

SEQ ID NO: 4359049 - DNA, 14 bp, Homo sapiens
gcagggcatctcct

SEQ ID NO: 4359050 - DNA, 17 bp, Homo sapiens
gcaggtgctgtgcgcct

SEQ ID NO: 4359051 - DNA, 22 bp, Homo sapiens
gcaggtgggctgcctgctgtgt

SEQ ID NO: 4359052 - DNA, 20 bp, Homo sapiens
gcagtagagtcatctccatc

SEQ ID NO: 4359053 - DNA, 16 bp, Homo sapiens
gcagtgcttctctaca

SEQ ID NO: 4359054 - DNA, 14 bp, Homo sapiens
gcagtttggccctg

SEQ ID NO: 4359055 - DNA, 15 bp, Homo sapiens
gcagtttggccctgg

SEQ ID NO: 4359056 - DNA, 21 bp, Homo sapiens
gcagtttggccctggagccag

SEQ ID NO: 4359057 - DNA, 14 bp, Homo sapiens
gcataaaagatcac

SEQ ID NO: 4359058 - DNA, 12 bp, Homo sapiens
gcataggcctgg

SEQ ID NO: 4359059 - DNA, 23 bp, Homo sapiens
gcataggcctgggtgctggctgc

SEQ ID NO: 4359060 - DNA, 13 bp, Homo sapiens
gcatatagaatat

SEQ ID NO: 4359061 - DNA, 15 bp, Homo sapiens
gcatatagaatatat

SEQ ID NO: 4359062 - DNA, 23 bp, Homo sapiens
gcatatttatagcaatccatgtt

SEQ ID NO: 4359063 - DNA, 12 bp, Homo sapiens
gcatggagaagg

SEQ ID NO: 4359064 - DNA, 20 bp, Homo sapiens
gcatggagaagggttctgcc

SEQ ID NO: 4359065 - DNA, 23 bp, Homo sapiens
gcatggagaagggttctgccctg

SEQ ID NO: 4359066 - DNA, 23 bp, Homo sapiens
gcatgtacttgaaggatggatga

SEQ ID NO: 4359067 - DNA, 17 bp, Homo sapiens
gcatgtcccacccaccc

SEQ ID NO: 4359068 - DNA, 21 bp, Homo sapiens
gcattaagcacacacatctgg

SEQ ID NO: 4359069 - DNA, 16 bp, Homo sapiens
gcattagaaatagaca

SEQ ID NO: 4359070 - DNA, 12 bp, Homo sapiens
gcatttggtctc

SEQ ID NO: 4359071 - DNA, 16 bp, Homo sapiens
gcatttggtctcaggc

SEQ ID NO: 4359072 - DNA, 18 bp, Homo sapiens
gcattttattaaacttaa

SEQ ID NO: 4359073 - DNA, 18 bp, Homo sapiens
gcatttttatgcagacag

SEQ ID NO: 4359074 - DNA, 12 bp, Homo sapiens
gccaagactcct

SEQ ID NO: 4359075 - DNA, 19 bp, Homo sapiens
gccaagggggtgactggaa

SEQ ID NO: 4359076 - DNA, 22 bp, Homo sapiens
gccacccgtggggtgctgccct

SEQ ID NO: 4359077 - DNA, 17 bp, Homo sapiens
gccacctctttaaaaac

SEQ ID NO: 4359078 - DNA, 15 bp, Homo sapiens
gccagggcagaggaa

SEQ ID NO: 4359079 - DNA, 18 bp, Homo sapiens
gccagggcagaggaatgt

SEQ ID NO: 4359080 - DNA, 17 bp, Homo sapiens
gccagggtgggaagaga

SEQ ID NO: 4359081 - DNA, 18 bp, Homo sapiens
gccagggtgggaagagaa

SEQ ID NO: 4359082 - DNA, 20 bp, Homo sapiens
gccagggtgggaagagaaga

SEQ ID NO: 4359083 - DNA, 20 bp, Homo sapiens
gccatgcagacctcatgccc

SEQ ID NO: 4359084 - DNA, 22 bp, Homo sapiens
gccatgcagacctcatgcccag

SEQ ID NO: 4359085 - DNA, 14 bp, Homo sapiens
gccatgcaggaggt

SEQ ID NO: 4359086 - DNA, 22 bp, Homo sapiens
gccatttgctagttctgctgcc

SEQ ID NO: 4359087 - DNA, 23 bp, Homo sapiens
gcccacatttgggctcagggttg

SEQ ID NO: 4359088 - DNA, 19 bp, Homo sapiens
gcccagacccctctggcca

SEQ ID NO: 4359089 - DNA, 14 bp, Homo sapiens
gcccagtccctgga

SEQ ID NO: 4359090 - DNA, 16 bp, Homo sapiens
gccccactttgaaggg

SEQ ID NO: 4359091 - DNA, 18 bp, Homo sapiens
gccccactttgaagggca

SEQ ID NO: 4359092 - DNA, 12 bp, Homo sapiens
gccccagctctg

SEQ ID NO: 4359093 - DNA, 17 bp, Homo sapiens
gccccccgaggctgcta

SEQ ID NO: 4359094 - DNA, 17 bp, Homo sapiens
gccccccgcacagccac

SEQ ID NO: 4359095 - DNA, 19 bp, Homo sapiens
gccccccgcacagccaccc

SEQ ID NO: 4359096 - DNA, 14 bp, Homo sapiens
gcccccgcctgcca

SEQ ID NO: 4359097 - DNA, 16 bp, Homo sapiens
gcccccgcctgccacc

SEQ ID NO: 4359098 - DNA, 20 bp, Homo sapiens
gccccctctcggccaggcat

SEQ ID NO: 4359099 - DNA, 18 bp, Homo sapiens
gccccgttgtgagctgga

SEQ ID NO: 4359100 - DNA, 21 bp, Homo sapiens
gccccgttgtgagctggatag

SEQ ID NO: 4359101 - DNA, 21 bp, Homo sapiens
gcccctgcagtttggccctgg

SEQ ID NO: 4359102 - DNA, 20 bp, Homo sapiens
gtggagttcaccttggaagg

SEQ ID NO: 4359103 - DNA, 15 bp, Homo sapiens
gtggagtttgtattt

SEQ ID NO: 4359104 - DNA, 12 bp, Homo sapiens
gtggataatcag

SEQ ID NO: 4359105 - DNA, 21 bp, Homo sapiens
gtggataatcaggaaaaatga

SEQ ID NO: 4359106 - DNA, 19 bp, Homo sapiens
gtggcaggtgggctgcctg

SEQ ID NO: 4359107 - DNA, 22 bp, Homo sapiens
gtggcttaagtgagcagaacag

SEQ ID NO: 4359108 - DNA, 11 bp, Homo sapiens
gtggggccagg

SEQ ID NO: 4359109 - DNA, 16 bp, Homo sapiens
gtggggtacaggcagt

SEQ ID NO: 4359110 - DNA, 15 bp, Homo sapiens
gtggggtgctgccct

SEQ ID NO: 4359111 - DNA, 16 bp, Homo sapiens
gtggtctttctggaga

SEQ ID NO: 4359112 - DNA, 17 bp, Homo sapiens
gtggtctttctggagag

SEQ ID NO: 4359113 - DNA, 15 bp, Homo sapiens
gtggtttcagatgtg

SEQ ID NO: 4359114 - DNA, 18 bp, Homo sapiens
gtggtttcagatgtgcaa

SEQ ID NO: 4359115 - DNA, 12 bp, Homo sapiens
gtgtaacagctg

SEQ ID NO: 4359116 - DNA, 13 bp, Homo sapiens
gtgtctcccaaca

SEQ ID NO: 4359117 - DNA, 16 bp, Homo sapiens
gtgtctgccaaacaca

SEQ ID NO: 4359118 - DNA, 20 bp, Homo sapiens
gtgtctgccaaacacattta

SEQ ID NO: 4359119 - DNA, 18 bp, Homo sapiens
gtgtctgctgctgcctcc

SEQ ID NO: 4359120 - DNA, 19 bp, Homo sapiens
gtgtggagttcaccttgga

SEQ ID NO: 4359121 - DNA, 17 bp, Homo sapiens
gtgtgtgtatgtttgca

SEQ ID NO: 4359122 - DNA, 18 bp, Homo sapiens
gtgttctcatgaagcagg

SEQ ID NO: 4359123 - DNA, 16 bp, Homo sapiens
gtgttgataagctgca

SEQ ID NO: 4359124 - DNA, 13 bp, Homo sapiens
gttaatgaaataa

SEQ ID NO: 4359125 - DNA, 14 bp, Homo sapiens
gttaatgaaataaa

SEQ ID NO: 4359126 - DNA, 18 bp, Homo sapiens
gttaggaataacactgca

SEQ ID NO: 4359127 - DNA, 21 bp, Homo sapiens
gttatcccttccttttagcct

SEQ ID NO: 4359128 - DNA, 12 bp, Homo sapiens
gttatgaacagc

SEQ ID NO: 4359129 - DNA, 16 bp, Homo sapiens
gttatgaacagctgtg

SEQ ID NO: 4359130 - DNA, 17 bp, Homo sapiens
gttatgaacagctgtgt

SEQ ID NO: 4359131 - DNA, 21 bp, Homo sapiens
gttatgaacagctgtgtctgc

SEQ ID NO: 4359132 - DNA, 15 bp, Homo sapiens
gttatgcactgtggt

SEQ ID NO: 4359133 - DNA, 14 bp, Homo sapiens
gttcaccttggaag

SEQ ID NO: 4359134 - DNA, 12 bp, Homo sapiens
gttcagcagaac

SEQ ID NO: 4359135 - DNA, 15 bp, Homo sapiens
gttcagcagaacctg

SEQ ID NO: 4359136 - DNA, 18 bp, Homo sapiens
gttcatccaatcctcact

SEQ ID NO: 4359137 - DNA, 21 bp, Homo sapiens
gttcatccaatcctcactggg

SEQ ID NO: 4359138 - DNA, 22 bp, Homo sapiens
gttcatccaatcctcactgggt

SEQ ID NO: 4359139 - DNA, 12 bp, Homo sapiens
gttccttgcctt

SEQ ID NO: 4359140 - DNA, 20 bp, Homo sapiens
gttccttgccttaataaata

SEQ ID NO: 4359141 - DNA, 21 bp, Homo sapiens
gttctacttcctgtaatgtac

SEQ ID NO: 4359142 - DNA, 12 bp, Homo sapiens
gttctcatgaag

SEQ ID NO: 4359143 - DNA, 14 bp, Homo sapiens
gttctcatgaagca

SEQ ID NO: 4359144 - DNA, 20 bp, Homo sapiens
gttctgccctgcctgaggag

SEQ ID NO: 4359145 - DNA, 14 bp, Homo sapiens
gttctgctgccctc

SEQ ID NO: 4359146 - DNA, 16 bp, Homo sapiens
gttgacagtgaaacaa

SEQ ID NO: 4359147 - DNA, 12 bp, Homo sapiens
gttgcctccccc

SEQ ID NO: 4359148 - DNA, 21 bp, Homo sapiens
gttgcctcccccgcctccagt

SEQ ID NO: 4359149 - DNA, 14 bp, Homo sapiens
gttggaaggatctg

SEQ ID NO: 4359150 - DNA, 14 bp, Homo sapiens
gttgtggatatcag

SEQ ID NO: 4359151 - DNA, 19 bp, Homo sapiens
gtttaaggaacttctgaag

SEQ ID NO: 4359152 - DNA, 22 bp, Homo sapiens
gtttacttctttagcattttta

SEQ ID NO: 4359153 - DNA, 18 bp, Homo sapiens
gtttattcccaagtatgc

SEQ ID NO: 4359154 - DNA, 21 bp, Homo sapiens
gtttcactttcacatagatgt

SEQ ID NO: 4359155 - DNA, 18 bp, Homo sapiens
gtttcttcaagagctgag

SEQ ID NO: 4359156 - DNA, 21 bp, Homo sapiens
gtttgaaaaactaattgagcc

SEQ ID NO: 4359157 - DNA, 15 bp, Homo sapiens
gtttgcacacttgtg

SEQ ID NO: 4359158 - DNA, 18 bp, Homo sapiens
gtttgcatcatttaactg

SEQ ID NO: 4359159 - DNA, 21 bp, Homo sapiens
gttttcaaactgctgcatact

SEQ ID NO: 4359160 - DNA, 17 bp, Homo sapiens
gttttctgaaacacacg

SEQ ID NO: 4359161 - DNA, 17 bp, Homo sapiens
gttttgtctgtctccct

SEQ ID NO: 4359162 - DNA, 13 bp, Homo sapiens
gtttttaatgtat

SEQ ID NO: 4359163 - DNA, 12 bp, Homo sapiens
gtttttctatat

SEQ ID NO: 4359164 - DNA, 17 bp, Homo sapiens
gtttttggaaaatgtat

SEQ ID NO: 4359165 - DNA, 20 bp, Homo sapiens
taaaaagggcagggcatctc

SEQ ID NO: 4359166 - DNA, 18 bp, Homo sapiens
taaaaccacagctgggca

SEQ ID NO: 4359167 - DNA, 21 bp, Homo sapiens
taaaaccacagctgggcaggg

SEQ ID NO: 4359168 - DNA, 21 bp, Homo sapiens
taaaactttgtagaaagcaaa

SEQ ID NO: 4359169 - DNA, 17 bp, Homo sapiens
taaaagatcaccttgta

SEQ ID NO: 4359170 - DNA, 18 bp, Homo sapiens
taaaagatcaccttgtat

SEQ ID NO: 4359171 - DNA, 22 bp, Homo sapiens
taaaagttttttattatgcatt

SEQ ID NO: 4359172 - DNA, 17 bp, Homo sapiens
taaaataaaattatata

SEQ ID NO: 4359173 - DNA, 18 bp, Homo sapiens
taaaataaacattttgtc

SEQ ID NO: 4359174 - DNA, 19 bp, Homo sapiens
taaaatactatattaaatt

SEQ ID NO: 4359175 - DNA, 23 bp, Homo sapiens
taaaatactatattaaattctga

SEQ ID NO: 4359176 - DNA, 15 bp, Homo sapiens
taaaatgaacatttt

SEQ ID NO: 4359177 - DNA, 18 bp, Homo sapiens
taaaatgtgatttttctg

SEQ ID NO: 4359178 - DNA, 13 bp, Homo sapiens
taaaccagtttaa

SEQ ID NO: 4359179 - DNA, 19 bp, Homo sapiens
taaactacaaagtaaaatg

SEQ ID NO: 4359180 - DNA, 20 bp, Homo sapiens
taaactgtgtggactgtgat

SEQ ID NO: 4359181 - DNA, 22 bp, Homo sapiens
taaacttaaaataaaattatat

SEQ ID NO: 4359182 - DNA, 19 bp, Homo sapiens
taaagatatcaatactaag

SEQ ID NO: 4359183 - DNA, 18 bp, Homo sapiens
taaagattggaatgtgtt

SEQ ID NO: 4359184 - DNA, 21 bp, Homo sapiens
taaaggtaccaaacaaggaag

SEQ ID NO: 4359185 - DNA, 22 bp, Homo sapiens
taaaggtaccaaacaaggaagc

SEQ ID NO: 4359186 - DNA, 12 bp, Homo sapiens
taaagtttatta

SEQ ID NO: 4359187 - DNA, 20 bp, Homo sapiens
taaatagatgtaaataaaat

SEQ ID NO: 4359188 - DNA, 14 bp, Homo sapiens
taaatatttcctta

SEQ ID NO: 4359189 - DNA, 16 bp, Homo sapiens
taaatcatcctcatgt

SEQ ID NO: 4359190 - DNA, 14 bp, Homo sapiens
taaatgaccaaaga

SEQ ID NO: 4359191 - DNA, 23 bp, Homo sapiens
taaattcagatatatttttcaca

SEQ ID NO: 4359192 - DNA, 21 bp, Homo sapiens
taacaatcaggtaagatcata

SEQ ID NO: 4359193 - DNA, 22 bp, Homo sapiens
taacaatgtctcatgatgtaaa

SEQ ID NO: 4359194 - DNA, 14 bp, Homo sapiens
taagaagagactgg

SEQ ID NO: 4359195 - DNA, 19 bp, Homo sapiens
taagaagagactgggaaga

SEQ ID NO: 4359196 - DNA, 15 bp, Homo sapiens
taagagcaattctgg

SEQ ID NO: 4359197 - DNA, 17 bp, Homo sapiens
taagagctggtgtctga

SEQ ID NO: 4359198 - DNA, 16 bp, Homo sapiens
taagagcttgctccag

SEQ ID NO: 4359199 - DNA, 16 bp, Homo sapiens
taagagtggaggagga

SEQ ID NO: 4359200 - DNA, 17 bp, Homo sapiens
taagagtggaggaggag

SEQ ID NO: 4359201 - DNA, 15 bp, Homo sapiens
taagatcataacaat

SEQ ID NO: 4359202 - DNA, 21 bp, Homo sapiens
taagcacacacatctggccct

SEQ ID NO: 4359203 - DNA, 15 bp, Homo sapiens
taagcagaacaaatg

SEQ ID NO: 4359204 - DNA, 20 bp, Homo sapiens
taagcagaacaaatgtgttt

SEQ ID NO: 4359205 - DNA, 16 bp, Homo sapiens
taagcataaaagatca

SEQ ID NO: 4359206 - DNA, 16 bp, Homo sapiens
taagtatctaggagta

SEQ ID NO: 4359207 - DNA, 19 bp, Homo sapiens
taagtgtgagtaagagctg

SEQ ID NO: 4359208 - DNA, 23 bp, Homo sapiens
taagttaatgaaataaaatttga

SEQ ID NO: 4359209 - DNA, 15 bp, Homo sapiens
taagttacttgaaat

SEQ ID NO: 4359210 - DNA, 21 bp, Homo sapiens
taagttacttgaaataagttg

SEQ ID NO: 4359211 - DNA, 15 bp, Homo sapiens
taataaattcagata

SEQ ID NO: 4359212 - DNA, 17 bp, Homo sapiens
taatacttgacctctgt

SEQ ID NO: 4359213 - DNA, 13 bp, Homo sapiens
taatataaattta

SEQ ID NO: 4359214 - DNA, 14 bp, Homo sapiens
taatataaatttaa

SEQ ID NO: 4359215 - DNA, 17 bp, Homo sapiens
taatataaatttaagca

SEQ ID NO: 4359216 - DNA, 13 bp, Homo sapiens
taatataatatgg

SEQ ID NO: 4359217 - DNA, 17 bp, Homo sapiens
taatatggatcagagca

SEQ ID NO: 4359218 - DNA, 18 bp, Homo sapiens
taatgaaataaaatttga

SEQ ID NO: 4359219 - DNA, 22 bp, Homo sapiens
taatgtacgctgctgcaggaca

SEQ ID NO: 4359220 - DNA, 18 bp, Homo sapiens
taatgtatcatgaagaaa

SEQ ID NO: 4359221 - DNA, 16 bp, Homo sapiens
taattattttaataat

SEQ ID NO: 4359222 - DNA, 22 bp, Homo sapiens
tctactcacagctgaagaaaat

SEQ ID NO: 4359223 - DNA, 13 bp, Homo sapiens
tctagcatataga

SEQ ID NO: 4359224 - DNA, 14 bp, Homo sapiens
tctaggactgcagt

SEQ ID NO: 4359225 - DNA, 15 bp, Homo sapiens
tctatacccacccag

SEQ ID NO: 4359226 - DNA, 20 bp, Homo sapiens
tctatatagttccttgcctt

SEQ ID NO: 4359227 - DNA, 15 bp, Homo sapiens
tctatatttgtcttc

SEQ ID NO: 4359228 - DNA, 16 bp, Homo sapiens
tctatcattccaattc

SEQ ID NO: 4359229 - DNA, 15 bp, Homo sapiens
tctattatcacatta

SEQ ID NO: 4359230 - DNA, 15 bp, Homo sapiens
tctattttgtatatt

SEQ ID NO: 4359231 - DNA, 16 bp, Homo sapiens
tctcagaacatactga

SEQ ID NO: 4359232 - DNA, 18 bp, Homo sapiens
tctcccagcttcaaatgc

SEQ ID NO: 4359233 - DNA, 19 bp, Homo sapiens
tctccctcaactgaagggg

SEQ ID NO: 4359234 - DNA, 23 bp, Homo sapiens
tctccctcaactgaaggggtgca

SEQ ID NO: 4359235 - DNA, 19 bp, Homo sapiens
tctccctcccctctcagaa

SEQ ID NO: 4359236 - DNA, 19 bp, Homo sapiens
tctccttcccctttcccca

SEQ ID NO: 4359237 - DNA, 21 bp, Homo sapiens
tctcgcagcctgaagcctgga

SEQ ID NO: 4359238 - DNA, 13 bp, Homo sapiens
tctcggccaggca

SEQ ID NO: 4359239 - DNA, 19 bp, Homo sapiens
tctctgacgcttgtgacag

SEQ ID NO: 4359240 - DNA, 20 bp, Homo sapiens
tctcttctgaataaagcaat

SEQ ID NO: 4359241 - DNA, 22 bp, Homo sapiens
tctcttgagggagcttagccaa

SEQ ID NO: 4359242 - DNA, 14 bp, Homo sapiens
tctgaataaagcaa

SEQ ID NO: 4359243 - DNA, 17 bp, Homo sapiens
tctgaataaagcaatta

SEQ ID NO: 4359244 - DNA, 20 bp, Homo sapiens
tctgactgccaaataaatca

SEQ ID NO: 4359245 - DNA, 17 bp, Homo sapiens
tctgatattccatgaat

SEQ ID NO: 4359246 - DNA, 15 bp, Homo sapiens
tctgccctgcctgag

SEQ ID NO: 4359247 - DNA, 21 bp, Homo sapiens
tctgcctctggaaaactattg

SEQ ID NO: 4359248 - DNA, 13 bp, Homo sapiens
tctgctctggtgg

SEQ ID NO: 4359249 - DNA, 19 bp, Homo sapiens
tctgctgaggcccagtgca

SEQ ID NO: 4359250 - DNA, 13 bp, Homo sapiens
tctgctgccctct

SEQ ID NO: 4359251 - DNA, 19 bp, Homo sapiens
tctggactgaagcctgcag

SEQ ID NO: 4359252 - DNA, 19 bp, Homo sapiens
tctgggatgtcacagtcca

SEQ ID NO: 4359253 - DNA, 12 bp, Homo sapiens
tctggtggctta

SEQ ID NO: 4359254 - DNA, 15 bp, Homo sapiens
tctggttgcctcccc

SEQ ID NO: 4359255 - DNA, 22 bp, Homo sapiens
tctgtaagagcttgctccagat

SEQ ID NO: 4359256 - DNA, 16 bp, Homo sapiens
tctgtagttacattta

SEQ ID NO: 4359257 - DNA, 19 bp, Homo sapiens
tctgtcagatgggaagaca

SEQ ID NO: 4359258 - DNA, 16 bp, Homo sapiens
tctgtgaccaactgtt

SEQ ID NO: 4359259 - DNA, 15 bp, Homo sapiens
tctgtgactggatct

SEQ ID NO: 4359260 - DNA, 21 bp, Homo sapiens
tctgttatgcactgtggtttc

SEQ ID NO: 4359261 - DNA, 16 bp, Homo sapiens
tcttatctgctataaa

SEQ ID NO: 4359262 - DNA, 16 bp, Homo sapiens
tcttcccgatgaggga

SEQ ID NO: 4359263 - DNA, 14 bp, Homo sapiens
tcttctatcattcc

SEQ ID NO: 4359264 - DNA, 18 bp, Homo sapiens
tcttctgaataaagcaat

SEQ ID NO: 4359265 - DNA, 14 bp, Homo sapiens
tcttcttcagaaga

SEQ ID NO: 4359266 - DNA, 19 bp, Homo sapiens
tcttctttcccaatcttct

SEQ ID NO: 4359267 - DNA, 14 bp, Homo sapiens
tcttgagggagctt

SEQ ID NO: 4359268 - DNA, 16 bp, Homo sapiens
tcttgctcagagctag

SEQ ID NO: 4359269 - DNA, 13 bp, Homo sapiens
tcttggttctaaa

SEQ ID NO: 4359270 - DNA, 20 bp, Homo sapiens
tctttaccttctaaaagcca

SEQ ID NO: 4359271 - DNA, 23 bp, Homo sapiens
tctttaccttctaaaagccatta

SEQ ID NO: 4359272 - DNA, 22 bp, Homo sapiens
tctttagcatttttatgcagac

SEQ ID NO: 4359273 - DNA, 20 bp, Homo sapiens
tctttctgtgcttggatttg

SEQ ID NO: 4359274 - DNA, 18 bp, Homo sapiens
tgaaaaactagtaatact

SEQ ID NO: 4359275 - DNA, 23 bp, Homo sapiens
tgaaaaactagtaatactgtctt

SEQ ID NO: 4359276 - DNA, 13 bp, Homo sapiens
tgaaaagttggaa

SEQ ID NO: 4359277 - DNA, 16 bp, Homo sapiens
tgaaaagttggaagga

SEQ ID NO: 4359278 - DNA, 22 bp, Homo sapiens
tgaaaagttggaaggatctgct

SEQ ID NO: 4359279 - DNA, 13 bp, Homo sapiens
tgaaacacacgag

SEQ ID NO: 4359280 - DNA, 21 bp, Homo sapiens
tgaaacacacgagcaaaccca

SEQ ID NO: 4359281 - DNA, 18 bp, Homo sapiens
tgaaataaaatttgaaac

SEQ ID NO: 4359282 - DNA, 19 bp, Homo sapiens
tgaaataaaatttgaaact

SEQ ID NO: 4359283 - DNA, 21 bp, Homo sapiens
tgaaatactgccttggctaga

SEQ ID NO: 4359284 - DNA, 16 bp, Homo sapiens
tgaacattttgtggag

SEQ ID NO: 4359285 - DNA, 12 bp, Homo sapiens
tgaactccagag

SEQ ID NO: 4359286 - DNA, 20 bp, Homo sapiens
tgaagcctggattccagcag

SEQ ID NO: 4359287 - DNA, 16 bp, Homo sapiens
tgaagctgttgtgtga

SEQ ID NO: 4359288 - DNA, 23 bp, Homo sapiens
tgaaggcaaaaactgtactgtgt

SEQ ID NO: 4359289 - DNA, 22 bp, Homo sapiens
tgaaggggtgcacccacctgtt

SEQ ID NO: 4359290 - DNA, 14 bp, Homo sapiens
tgaataatttccca

SEQ ID NO: 4359291 - DNA, 17 bp, Homo sapiens
tgaatatcagtcactgt

SEQ ID NO: 4359292 - DNA, 16 bp, Homo sapiens
tgaatattcctggact

SEQ ID NO: 4359293 - DNA, 19 bp, Homo sapiens
tgaatgcacactagcctct

SEQ ID NO: 4359294 - DNA, 18 bp, Homo sapiens
tgaattttccaagaacat

SEQ ID NO: 4359295 - DNA, 17 bp, Homo sapiens
tgacaaaggagccttga

SEQ ID NO: 4359296 - DNA, 11 bp, Homo sapiens
tgacaaggaaa

SEQ ID NO: 4359297 - DNA, 21 bp, Homo sapiens
tgacagcatatagaatatatt

SEQ ID NO: 4359298 - DNA, 16 bp, Homo sapiens
tgacagctttctggga

SEQ ID NO: 4359299 - DNA, 20 bp, Homo sapiens
tgacagctttctgggatgtc

SEQ ID NO: 4359300 - DNA, 23 bp, Homo sapiens
tgacagctttctgggatgtcaca

SEQ ID NO: 4359301 - DNA, 17 bp, Homo sapiens
tgacagtgcctcttcca

SEQ ID NO: 4359302 - DNA, 21 bp, Homo sapiens
tgacagtgcctcttccagtga

SEQ ID NO: 4359303 - DNA, 14 bp, Homo sapiens
tgacagtgcctggg

SEQ ID NO: 4359304 - DNA, 17 bp, Homo sapiens
tgacagtgcctgggaat

SEQ ID NO: 4359305 - DNA, 14 bp, Homo sapiens
tgacatgaaatgaa

SEQ ID NO: 4359306 - DNA, 22 bp, Homo sapiens
tgaccaaagatgacctgtggta

SEQ ID NO: 4359307 - DNA, 19 bp, Homo sapiens
tgaccagcaacttgtcttt

SEQ ID NO: 4359308 - DNA, 13 bp, Homo sapiens
tgacccacactgc

SEQ ID NO: 4359309 - DNA, 16 bp, Homo sapiens
tgacccacactgccag

SEQ ID NO: 4359310 - DNA, 21 bp, Homo sapiens
tgacccacactgccagaagag

SEQ ID NO: 4359311 - DNA, 12 bp, Homo sapiens
tgacccagcctg

SEQ ID NO: 4359312 - DNA, 17 bp, Homo sapiens
tgacccagcctgaaaga

SEQ ID NO: 4359313 - DNA, 17 bp, Homo sapiens
tgacctaagtcaggtaa

SEQ ID NO: 4359314 - DNA, 15 bp, Homo sapiens
tgacgcttgtgacag

SEQ ID NO: 4359315 - DNA, 14 bp, Homo sapiens
tgactcctgggtgg

SEQ ID NO: 4359316 - DNA, 21 bp, Homo sapiens
tgactgcttttaaatgaccaa

SEQ ID NO: 4359317 - DNA, 22 bp, Homo sapiens
tgagaaatgaataatttcccaa

SEQ ID NO: 4359318 - DNA, 14 bp, Homo sapiens
tgagaactgacaaa

SEQ ID NO: 4359319 - DNA, 12 bp, Homo sapiens
tgagacatccag

SEQ ID NO: 4359320 - DNA, 13 bp, Homo sapiens
tgagacatccagc

SEQ ID NO: 4359321 - DNA, 13 bp, Homo sapiens
tgagcagaacagg

SEQ ID NO: 4359322 - DNA, 14 bp, Homo sapiens
tgagcagaacaggt

SEQ ID NO: 4359323 - DNA, 14 bp, Homo sapiens
tgagccttgcatgt

SEQ ID NO: 4359324 - DNA, 20 bp, Homo sapiens
tgagccttgcatgtacttga

SEQ ID NO: 4359325 - DNA, 18 bp, Homo sapiens
tgaggaatccaaaagaca

SEQ ID NO: 4359326 - DNA, 17 bp, Homo sapiens
tgaggaggaggacacag

SEQ ID NO: 4359327 - DNA, 16 bp, Homo sapiens
tgagggaaggagccca

SEQ ID NO: 4359328 - DNA, 24 bp, Homo sapiens
tgagggaaggagcccagccagaaa

SEQ ID NO: 4359329 - DNA, 14 bp, Homo sapiens
tgagggagcttagc

SEQ ID NO: 4359330 - DNA, 23 bp, Homo sapiens
tgagtaagagctggtgtctgatt

SEQ ID NO: 4359331 - DNA, 18 bp, Homo sapiens
tgagtcttggttctaaag

SEQ ID NO: 4359332 - DNA, 14 bp, Homo sapiens
tgagtgacagcttt

SEQ ID NO: 4359333 - DNA, 17 bp, Homo sapiens
tgagtgacagctttctg

SEQ ID NO: 4359334 - DNA, 23 bp, Homo sapiens
tgagtgacagctttctgggatgt

SEQ ID NO: 4359335 - DNA, 15 bp, Homo sapiens
tgagtggataatcag

SEQ ID NO: 4359336 - DNA, 14 bp, Homo sapiens
tgagtgtaagtgtg

SEQ ID NO: 4359337 - DNA, 13 bp, Homo sapiens
tgataatacttga

SEQ ID NO: 4359338 - DNA, 16 bp, Homo sapiens
tgatattccatgaatg

SEQ ID NO: 4359339 - DNA, 20 bp, Homo sapiens
tgatattccatgaatgtatc

SEQ ID NO: 4359340 - DNA, 13 bp, Homo sapiens
tgatcaataaaat

SEQ ID NO: 4359341 - DNA, 15 bp, Homo sapiens
tgatgttagaagaag

SEQ ID NO: 4359342 - DNA, 18 bp, Homo sapiens
tgttaggcatgtcccacc

SEQ ID NO: 4359343 - DNA, 23 bp, Homo sapiens
tgttatcacctatcctgaagatg

SEQ ID NO: 4359344 - DNA, 13 bp, Homo sapiens
tgttatgaacagc

SEQ ID NO: 4359345 - DNA, 24 bp, Homo sapiens
tgttatgaacagctgtgtctgcca

SEQ ID NO: 4359346 - DNA, 15 bp, Homo sapiens
tgttatgcactgtgg

SEQ ID NO: 4359347 - DNA, 23 bp, Homo sapiens
tgttatgcactgtggtttcagat

SEQ ID NO: 4359348 - DNA, 20 bp, Homo sapiens
tgttattactgttttgggcc

SEQ ID NO: 4359349 - DNA, 14 bp, Homo sapiens
tgttcagcagaacc

SEQ ID NO: 4359350 - DNA, 20 bp, Homo sapiens
tgtttaaatagcctaaatga

SEQ ID NO: 4359351 - DNA, 23 bp, Homo sapiens
tgtttaaatagcctaaatgatgg

SEQ ID NO: 4359352 - DNA, 20 bp, Homo sapiens
tgtttcgcattaagcacaca

SEQ ID NO: 4359353 - DNA, 12 bp, Homo sapiens
tgttttctgaaa

SEQ ID NO: 4359354 - DNA, 22 bp, Homo sapiens
tgttttctgaaacacacgagca

SEQ ID NO: 4359355 - DNA, 19 bp, Homo sapiens
tgtttttaacatgtcaatc

SEQ ID NO: 4359356 - DNA, 16 bp, Homo sapiens
ttaaaaccacagctgg

SEQ ID NO: 4359357 - DNA, 18 bp, Homo sapiens
ttaaaatactatattaaa

SEQ ID NO: 4359358 - DNA, 20 bp, Homo sapiens
ttaaactcgactaaaacaag

SEQ ID NO: 4359359 - DNA, 14 bp, Homo sapiens
ttaaagatatcaat

SEQ ID NO: 4359360 - DNA, 13 bp, Homo sapiens
ttaaataaaagtg

SEQ ID NO: 4359361 - DNA, 14 bp, Homo sapiens
ttaaataaaagtga

SEQ ID NO: 4359362 - DNA, 20 bp, Homo sapiens
ttaaataaaagtgatcaata

SEQ ID NO: 4359363 - DNA, 17 bp, Homo sapiens
ttaaatagcctaaatga

SEQ ID NO: 4359364 - DNA, 17 bp, Homo sapiens
ttaaattcttcaagaaa

SEQ ID NO: 4359365 - DNA, 22 bp, Homo sapiens
ttaaattcttcaagaaagaatt

SEQ ID NO: 4359366 - DNA, 15 bp, Homo sapiens
ttaagatctgactgc

SEQ ID NO: 4359367 - DNA, 23 bp, Homo sapiens
ttaagcacacacatctggccctg

SEQ ID NO: 4359368 - DNA, 18 bp, Homo sapiens
ttaagcagaacaaatgtg

SEQ ID NO: 4359369 - DNA, 17 bp, Homo sapiens
ttaaggtcaaacacaag

SEQ ID NO: 4359370 - DNA, 19 bp, Homo sapiens
ttaagtctaaatatttcct

SEQ ID NO: 4359371 - DNA, 14 bp, Homo sapiens
ttaagtgagcagaa

SEQ ID NO: 4359372 - DNA, 14 bp, Homo sapiens
ttaagttaatgaaa

SEQ ID NO: 4359373 - DNA, 16 bp, Homo sapiens
ttaagttaatgaaata

SEQ ID NO: 4359374 - DNA, 15 bp, Homo sapiens
ttacaaaatgccaag

SEQ ID NO: 4359375 - DNA, 15 bp, Homo sapiens
ttacattgtcctgta

SEQ ID NO: 4359376 - DNA, 21 bp, Homo sapiens
ttacattgtcctgtagcttta

SEQ ID NO: 4359377 - DNA, 13 bp, Homo sapiens
ttaccttctaaaa

SEQ ID NO: 4359378 - DNA, 20 bp, Homo sapiens
ttactcctcctgctcctcac

SEQ ID NO: 4359379 - DNA, 12 bp, Homo sapiens
ttactgaccagc

SEQ ID NO: 4359380 - DNA, 17 bp, Homo sapiens
ttactgtctatatatat

SEQ ID NO: 4359381 - DNA, 14 bp, Homo sapiens
ttacttgaaataag

SEQ ID NO: 4359382 - DNA, 18 bp, Homo sapiens
ttactttctgttgccaca

SEQ ID NO: 4359383 - DNA, 13 bp, Homo sapiens
ttaggaagtgtaa

SEQ ID NO: 4359384 - DNA, 18 bp, Homo sapiens
ttatcatcggagttgaca

SEQ ID NO: 4359385 - DNA, 14 bp, Homo sapiens
ttatgaacagctgt

SEQ ID NO: 4359386 - DNA, 17 bp, Homo sapiens
ttatgaacagctgtgtc

SEQ ID NO: 4359387 - DNA, 18 bp, Homo sapiens
ttatgacctaagtcaggt

SEQ ID NO: 4359388 - DNA, 20 bp, Homo sapiens
ttatgcactgtggtttcaga

SEQ ID NO: 4359389 - DNA, 22 bp, Homo sapiens
ttatgcactgtggtttcagatg

SEQ ID NO: 4359390 - DNA, 15 bp, Homo sapiens
ttatgcagacagtct

SEQ ID NO: 4359391 - DNA, 21 bp, Homo sapiens
ttatgtagtttttatatgttg

SEQ ID NO: 4359392 - DNA, 14 bp, Homo sapiens
ttattatgcattat

SEQ ID NO: 4359393 - DNA, 19 bp, Homo sapiens
ttattcccaagtatgcctt

SEQ ID NO: 4359394 - DNA, 20 bp, Homo sapiens
ttattcccaagtatgcctta

SEQ ID NO: 4359395 - DNA, 21 bp, Homo sapiens
ttatttactcctcctgctcct

SEQ ID NO: 4359396 - DNA, 18 bp, Homo sapiens
ttcaaattgctgcttgga

SEQ ID NO: 4359397 - DNA, 21 bp, Homo sapiens
ttcaattagatttaaaataaa

SEQ ID NO: 4359398 - DNA, 17 bp, Homo sapiens
ttcacatagatgtccct

SEQ ID NO: 4359399 - DNA, 12 bp, Homo sapiens
ttcaccttggaa

SEQ ID NO: 4359400 - DNA, 20 bp, Homo sapiens
ttcactatttttatttatat

SEQ ID NO: 4359401 - DNA, 12 bp, Homo sapiens
ttcactttgaaa

SEQ ID NO: 4359402 - DNA, 23 bp, Homo sapiens
ttcactttgaaaagttggaagga

SEQ ID NO: 4359403 - DNA, 14 bp, Homo sapiens
ttcagatgtgcaat

SEQ ID NO: 4359404 - DNA, 16 bp, Homo sapiens
ttcagatgtgcaataa

SEQ ID NO: 4359405 - DNA, 10 bp, Homo sapiens
ttcagcacac

SEQ ID NO: 4359406 - DNA, 23 bp, Homo sapiens
ttcagcagaacctgcacacagga

SEQ ID NO: 4359407 - DNA, 17 bp, Homo sapiens
ttcaggatactctgtca

SEQ ID NO: 4359408 - DNA, 18 bp, Homo sapiens
ttcagggcagggctctga

SEQ ID NO: 4359409 - DNA, 11 bp, Homo sapiens
ttcaggtacag

SEQ ID NO: 4359410 - DNA, 14 bp, Homo sapiens
ttccaattctaaat

SEQ ID NO: 4359411 - DNA, 17 bp, Homo sapiens
ttccagtgaacattccc

SEQ ID NO: 4359412 - DNA, 23 bp, Homo sapiens
ttccagtgaacattcccagccca

SEQ ID NO: 4359413 - DNA, 16 bp, Homo sapiens
ttcccaagtatgcctt

SEQ ID NO: 4359414 - DNA, 14 bp, Homo sapiens
ttcccaattaggaa

SEQ ID NO: 4359415 - DNA, 13 bp, Homo sapiens
ttcccagcccagc

SEQ ID NO: 4359416 - DNA, 18 bp, Homo sapiens
ttcccccatccctaccac

SEQ ID NO: 4359417 - DNA, 17 bp, Homo sapiens
ttcccctttccccactc

SEQ ID NO: 4359418 - DNA, 11 bp, Homo sapiens
ttccctgagga

SEQ ID NO: 4359419 - DNA, 22 bp, Homo sapiens
ttccctggaaaccttccaccca

SEQ ID NO: 4359420 - DNA, 17 bp, Homo sapiens
ttcccttacctgaaggc

SEQ ID NO: 4359421 - DNA, 17 bp, Homo sapiens
ttccgatcaacatttat

SEQ ID NO: 4359422 - DNA, 21 bp, Homo sapiens
ttccgatcaacatttatgacc

SEQ ID NO: 4359423 - DNA, 22 bp, Homo sapiens
ttccgatcaacatttatgacct

SEQ ID NO: 4359424 - DNA, 20 bp, Homo sapiens
ttccgggtctcgcagcctga

SEQ ID NO: 4359425 - DNA, 19 bp, Homo sapiens
ttcctaagagtggaggagg

SEQ ID NO: 4359426 - DNA, 21 bp, Homo sapiens
ttcctaagagtggaggaggag

SEQ ID NO: 4359427 - DNA, 14 bp, Homo sapiens
ttctaaaagccatt

SEQ ID NO: 4359428 - DNA, 22 bp, Homo sapiens
ttctaaaggtaccaaacaagga

SEQ ID NO: 4359429 - DNA, 14 bp, Homo sapiens
ttctacttcctgta

SEQ ID NO: 4359430 - DNA, 14 bp, Homo sapiens
ttctagcatataga

SEQ ID NO: 4359431 - DNA, 12 bp, Homo sapiens
ttctatcattcc

SEQ ID NO: 4359432 - DNA, 13 bp, Homo sapiens
ttctcatgaagca

SEQ ID NO: 4359433 - DNA, 20 bp, Homo sapiens
ttctctacagacttctccag

SEQ ID NO: 4359434 - DNA, 18 bp, Homo sapiens
ttctctttaccttctaaa

SEQ ID NO: 4359435 - DNA, 19 bp, Homo sapiens
ttctctttaccttctaaaa

SEQ ID NO: 4359436 - DNA, 14 bp, Homo sapiens
ttctgaataaagca

SEQ ID NO: 4359437 - DNA, 19 bp, Homo sapiens
ttctgccctgcctgaggag

SEQ ID NO: 4359438 - DNA, 17 bp, Homo sapiens
ttcttcagaagacactg

SEQ ID NO: 4359439 - DNA, 23 bp, Homo sapiens
ttcttgctggttgtcatttttgc

SEQ ID NO: 4359440 - DNA, 21 bp, Homo sapiens
ttcttggtggcagaatgaaaa

SEQ ID NO: 4359441 - DNA, 21 bp, Homo sapiens
ttctttagcatttttatgcag

SEQ ID NO: 4359442 - DNA, 13 bp, Homo sapiens
ttctttataaact

SEQ ID NO: 4359443 - DNA, 17 bp, Homo sapiens
ttcttttttaaaccagt

SEQ ID NO: 4359444 - DNA, 19 bp, Homo sapiens
ttgaagggcaagaaatggc

SEQ ID NO: 4359445 - DNA, 18 bp, Homo sapiens
ttgaatattcctggactt

SEQ ID NO: 4359446 - DNA, 19 bp, Homo sapiens
ttgaattgtgtattgatgc

SEQ ID NO: 4359447 - DNA, 18 bp, Homo sapiens
ttgacaaggaaaatctat

SEQ ID NO: 4359448 - DNA, 19 bp, Homo sapiens
ttgacagcatatagaatat

SEQ ID NO: 4359449 - DNA, 20 bp, Homo sapiens
ttgactgcttttaaatgacc

SEQ ID NO: 4359450 - DNA, 13 bp, Homo sapiens
ttgagaactgaca

SEQ ID NO: 4359451 - DNA, 21 bp, Homo sapiens
ttgagccttgcatgtacttga

SEQ ID NO: 4359452 - DNA, 17 bp, Homo sapiens
ttgattaaaaatgcttt

SEQ ID NO: 4359453 - DNA, 22 bp, Homo sapiens
ttgcatcatttaactgaactgt

SEQ ID NO: 4359454 - DNA, 21 bp, Homo sapiens
ttgccacatggtgtctcccaa

SEQ ID NO: 4359455 - DNA, 16 bp, Homo sapiens
ttgcctgaactccaga

SEQ ID NO: 4359456 - DNA, 17 bp, Homo sapiens
ttgcctgaactccagag

SEQ ID NO: 4359457 - DNA, 20 bp, Homo sapiens
ttgctaaatacaacactgat

SEQ ID NO: 4359458 - DNA, 12 bp, Homo sapiens
ttgctcagagct

SEQ ID NO: 4359459 - DNA, 20 bp, Homo sapiens
ttgctccagattctgatgca

SEQ ID NO: 4359460 - DNA, 12 bp, Homo sapiens
ttgctgcttgga

SEQ ID NO: 4359461 - DNA, 15 bp, Homo sapiens
ttgctgcttggattt

SEQ ID NO: 4359462 - DNA, 14 bp, Homo sapiens
aaaaagatccaggg

SEQ ID NO: 4359463 - DNA, 22 bp, Homo sapiens
aaaaagggcagggcatctcctg

SEQ ID NO: 4359464 - DNA, 15 bp, Homo sapiens
aaaaatagcagtatt

SEQ ID NO: 4359465 - DNA, 23 bp, Homo sapiens
aaaacaagcgtttatttgaatgt

SEQ ID NO: 4359466 - DNA, 11 bp, Homo sapiens
aaaaccacagc

SEQ ID NO: 4359467 - DNA, 15 bp, Homo sapiens
aaaagatcaccttgt

SEQ ID NO: 4359468 - DNA, 17 bp, Homo sapiens
aaaagatgtatgttgct

SEQ ID NO: 4359469 - DNA, 12 bp, Homo sapiens
aaaagccattat

SEQ ID NO: 4359470 - DNA, 20 bp, Homo sapiens
aaaagttggaaggatctgct

SEQ ID NO: 4359471 - DNA, 14 bp, Homo sapiens
aaaatcaactttta

SEQ ID NO: 4359472 - DNA, 17 bp, Homo sapiens
aaaatcagcaacttcta

SEQ ID NO: 4359473 - DNA, 21 bp, Homo sapiens
aaaatctatatttgtcttccg

SEQ ID NO: 4359474 - DNA, 15 bp, Homo sapiens
aaaattcataaccaa

SEQ ID NO: 4359475 - DNA, 23 bp, Homo sapiens
aaacaaagtttacattgtcctgt

SEQ ID NO: 4359476 - DNA, 14 bp, Homo sapiens
aaacacccctctgt

SEQ ID NO: 4359477 - DNA, 20 bp, Homo sapiens
aaacacccctctgtctagga

SEQ ID NO: 4359478 - DNA, 22 bp, Homo sapiens
aaacatgtttaaatagcctaaa

SEQ ID NO: 4359479 - DNA, 13 bp, Homo sapiens
aaacattttgtcc

SEQ ID NO: 4359480 - DNA, 22 bp, Homo sapiens
aaaccagtttaaggaacttctg

SEQ ID NO: 4359481 - DNA, 18 bp, Homo sapiens
aaacctactgcccacatt

SEQ ID NO: 4359482 - DNA, 16 bp, Homo sapiens
aaaccttccacccagt

SEQ ID NO: 4359483 - DNA, 22 bp, Homo sapiens
aaactaacaagattaaatatcc

SEQ ID NO: 4359484 - DNA, 18 bp, Homo sapiens
aaactattgagccttgca

SEQ ID NO: 4359485 - DNA, 20 bp, Homo sapiens
aaactattgagccttgcatg

SEQ ID NO: 4359486 - DNA, 13 bp, Homo sapiens
aaactgtactgtg

SEQ ID NO: 4359487 - DNA, 19 bp, Homo sapiens
aaactgtgtggactgtgat

SEQ ID NO: 4359488 - DNA, 12 bp, Homo sapiens
aaacttaaaact

SEQ ID NO: 4359489 - DNA, 13 bp, Homo sapiens
aaacttaaaataa

SEQ ID NO: 4359490 - DNA, 19 bp, Homo sapiens
aaactttgtagaaagcaaa

SEQ ID NO: 4359491 - DNA, 21 bp, Homo sapiens
aaagaattcctgcagcagtta

SEQ ID NO: 4359492 - DNA, 20 bp, Homo sapiens
aaagataacaagatctttca

SEQ ID NO: 4359493 - DNA, 12 bp, Homo sapiens
aaagcatccctc

SEQ ID NO: 4359494 - DNA, 22 bp, Homo sapiens
aaaggagccttgataatacttg

SEQ ID NO: 4359495 - DNA, 16 bp, Homo sapiens
aaaggcagccctcacc

SEQ ID NO: 4359496 - DNA, 22 bp, Homo sapiens
aaaggtatgtagttacagaatt

SEQ ID NO: 4359497 - DNA, 17 bp, Homo sapiens
aaagtggccatgccacc

SEQ ID NO: 4359498 - DNA, 20 bp, Homo sapiens
aaagtgtaaatcctttttct

SEQ ID NO: 4359499 - DNA, 19 bp, Homo sapiens
aaagttggaaggatctgct

SEQ ID NO: 4359500 - DNA, 22 bp, Homo sapiens
aaagttttttattatgcattat

SEQ ID NO: 4359501 - DNA, 17 bp, Homo sapiens
aaataaaagtacagttt

SEQ ID NO: 4359502 - DNA, 14 bp, Homo sapiens
aaataaaattatat

SEQ ID NO: 4359503 - DNA, 18 bp, Homo sapiens
aaataaacattttgtcca

SEQ ID NO: 4359504 - DNA, 19 bp, Homo sapiens
aaataaacctataatattt

SEQ ID NO: 4359505 - DNA, 19 bp, Homo sapiens
aaataagttgtttcagata

SEQ ID NO: 4359506 - DNA, 14 bp, Homo sapiens
aaatactatattaa

SEQ ID NO: 4359507 - DNA, 13 bp, Homo sapiens
aaatatgtaatat

SEQ ID NO: 4359508 - DNA, 15 bp, Homo sapiens
aaatatgtaatataa

SEQ ID NO: 4359509 - DNA, 15 bp, Homo sapiens
aaatcaaagaacaga

SEQ ID NO: 4359510 - DNA, 16 bp, Homo sapiens
aaatcaaagaacagat

SEQ ID NO: 4359511 - DNA, 17 bp, Homo sapiens
aaatcaaagaacagatg

SEQ ID NO: 4359512 - DNA, 16 bp, Homo sapiens
aaatcagcaacttcta

SEQ ID NO: 4359513 - DNA, 14 bp, Homo sapiens
aaatccgacttgaa

SEQ ID NO: 4359514 - DNA, 18 bp, Homo sapiens
aaatcctttttctttata

SEQ ID NO: 4359515 - DNA, 14 bp, Homo sapiens
aaatcgggaaattt

SEQ ID NO: 4359516 - DNA, 19 bp, Homo sapiens
aaatgaaatactgccttgg

SEQ ID NO: 4359517 - DNA, 18 bp, Homo sapiens
aaatgaataatttcccaa

SEQ ID NO: 4359518 - DNA, 13 bp, Homo sapiens
aaatgaccaaaga

SEQ ID NO: 4359519 - DNA, 14 bp, Homo sapiens
aaatgaccaaagat

SEQ ID NO: 4359520 - DNA, 21 bp, Homo sapiens
aaatgaggaatccaaaagaca

SEQ ID NO: 4359521 - DNA, 20 bp, Homo sapiens
aaatgattcaaattgctgct

SEQ ID NO: 4359522 - DNA, 13 bp, Homo sapiens
aaatgtgtttttc

SEQ ID NO: 4359523 - DNA, 17 bp, Homo sapiens
aaatgtgtttttctata

SEQ ID NO: 4359524 - DNA, 13 bp, Homo sapiens
aaattaagacttt

SEQ ID NO: 4359525 - DNA, 9 bp, Homo sapiens
aaattcagg

SEQ ID NO: 4359526 - DNA, 16 bp, Homo sapiens
aaattcaggtacagaa

SEQ ID NO: 4359527 - DNA, 19 bp, Homo sapiens
aaattcataaccaaagaga

SEQ ID NO: 4359528 - DNA, 19 bp, Homo sapiens
aaattcttcaagaaagaat

SEQ ID NO: 4359529 - DNA, 12 bp, Homo sapiens
aaattgccttca

SEQ ID NO: 4359530 - DNA, 14 bp, Homo sapiens
aaattgccttcagc

SEQ ID NO: 4359531 - DNA, 19 bp, Homo sapiens
aaattgccttcagccctaa

SEQ ID NO: 4359532 - DNA, 13 bp, Homo sapiens
aaatttaagcaaa

SEQ ID NO: 4359533 - DNA, 14 bp, Homo sapiens
aaatttaagcaaac

SEQ ID NO: 4359534 - DNA, 13 bp, Homo sapiens
aacaaatttacat

SEQ ID NO: 4359535 - DNA, 22 bp, Homo sapiens
aacaactgctactctcgggaag

SEQ ID NO: 4359536 - DNA, 15 bp, Homo sapiens
aacacccctctgtct

SEQ ID NO: 4359537 - DNA, 12 bp, Homo sapiens
aacactgcagcc

SEQ ID NO: 4359538 - DNA, 21 bp, Homo sapiens
aacagatggggtctgtgactg

SEQ ID NO: 4359539 - DNA, 23 bp, Homo sapiens
aacagatggggtctgtgactgga

SEQ ID NO: 4359540 - DNA, 19 bp, Homo sapiens
aacagctgaggtctcttga

SEQ ID NO: 4359541 - DNA, 20 bp, Homo sapiens
aacagctgaggtctcttgag

SEQ ID NO: 4359542 - DNA, 21 bp, Homo sapiens
aacagctgaggtctcttgagg

SEQ ID NO: 4359543 - DNA, 23 bp, Homo sapiens
aacaggtagtattacaccaccgg

SEQ ID NO: 4359544 - DNA, 16 bp, Homo sapiens
aacatgacccagcctg

SEQ ID NO: 4359545 - DNA, 16 bp, Homo sapiens
aacatgcactgatgtt

SEQ ID NO: 4359546 - DNA, 21 bp, Homo sapiens
aacatgtttaaatagcctaaa

SEQ ID NO: 4359547 - DNA, 14 bp, Homo sapiens
aacattttgtggag

SEQ ID NO: 4359548 - DNA, 19 bp, Homo sapiens
aacatttttgagatattaa

SEQ ID NO: 4359549 - DNA, 21 bp, Homo sapiens
aaccacagctgggcagggtga

SEQ ID NO: 4359550 - DNA, 22 bp, Homo sapiens
aaccagaaacacccctctgtct

SEQ ID NO: 4359551 - DNA, 22 bp, Homo sapiens
aacccagaggtggatgttatga

SEQ ID NO: 4359552 - DNA, 15 bp, Homo sapiens
aaccctgttttatac

SEQ ID NO: 4359553 - DNA, 16 bp, Homo sapiens
aaccgcatgtgatctc

SEQ ID NO: 4359554 - DNA, 20 bp, Homo sapiens
aacctactgcccacatttgg

SEQ ID NO: 4359555 - DNA, 15 bp, Homo sapiens
aaccttccacccagt

SEQ ID NO: 4359556 - DNA, 16 bp, Homo sapiens
aacgtctattttgtat

SEQ ID NO: 4359557 - DNA, 20 bp, Homo sapiens
aactaacaagattaaatatc

SEQ ID NO: 4359558 - DNA, 16 bp, Homo sapiens
aactacaaagtaaaat

SEQ ID NO: 4359559 - DNA, 23 bp, Homo sapiens
aactgaaggggtgcacccacctg

SEQ ID NO: 4359560 - DNA, 23 bp, Homo sapiens
aactgattctctatgacatgaaa

SEQ ID NO: 4359561 - DNA, 14 bp, Homo sapiens
aactgctgcatact

SEQ ID NO: 4359562 - DNA, 20 bp, Homo sapiens
aactggtaaaaagatccagg

SEQ ID NO: 4359563 - DNA, 24 bp, Homo sapiens
aactggtaaaaagatccagggatg

SEQ ID NO: 4359564 - DNA, 13 bp, Homo sapiens
aactgtactgtgt

SEQ ID NO: 4359565 - DNA, 18 bp, Homo sapiens
aactgtgtggactgtgat

SEQ ID NO: 4359566 - DNA, 18 bp, Homo sapiens
aacttaaaataaaattat

SEQ ID NO: 4359567 - DNA, 16 bp, Homo sapiens
aacttctagcatatag

SEQ ID NO: 4359568 - DNA, 12 bp, Homo sapiens
aactttacatat

SEQ ID NO: 4359569 - DNA, 18 bp, Homo sapiens
aactttgtagaaagcaaa

SEQ ID NO: 4359570 - DNA, 23 bp, Homo sapiens
aagaaatgattcaaattgctgct

SEQ ID NO: 4359571 - DNA, 22 bp, Homo sapiens
aagaaatggcgtctgctctggt

SEQ ID NO: 4359572 - DNA, 12 bp, Homo sapiens
aagaaattcagg

SEQ ID NO: 4359573 - DNA, 15 bp, Homo sapiens
aagaatttttttgtc

SEQ ID NO: 4359574 - DNA, 13 bp, Homo sapiens
aagagaattcagt

SEQ ID NO: 4359575 - DNA, 23 bp, Homo sapiens
aagagcccgcagggccatgcaga

SEQ ID NO: 4359576 - DNA, 17 bp, Homo sapiens
aagagccggtggtgccc

SEQ ID NO: 4359577 - DNA, 14 bp, Homo sapiens
aagagcttgctcca

SEQ ID NO: 4359578 - DNA, 15 bp, Homo sapiens
aagagcttgctccag

SEQ ID NO: 4359579 - DNA, 22 bp, Homo sapiens
aagagcttgctccagattctga

SEQ ID NO: 4359580 - DNA, 20 bp, Homo sapiens
aagaggggcgggctcagagc

SEQ ID NO: 4359581 - DNA, 23 bp, Homo sapiens
aagagtccttttgaattaaactc

SEQ ID NO: 4359582 - DNA, 20 bp, Homo sapiens
aagataacaagatctttcag

SEQ ID NO: 4359583 - DNA, 13 bp, Homo sapiens
aagataggctctg

SEQ ID NO: 4359584 - DNA, 14 bp, Homo sapiens
aagatcaccttgta

SEQ ID NO: 4359585 - DNA, 15 bp, Homo sapiens
aagatcaccttgtat

SEQ ID NO: 4359586 - DNA, 15 bp, Homo sapiens
aagatctgactgcca

SEQ ID NO: 4359587 - DNA, 11 bp, Homo sapiens
aagcacacaca

SEQ ID NO: 4359588 - DNA, 15 bp, Homo sapiens
aagcacacacatctg

SEQ ID NO: 4359589 - DNA, 21 bp, Homo sapiens
aagcacacacatctggccctg

SEQ ID NO: 4359590 - DNA, 16 bp, Homo sapiens
aagcactacaatcatg

SEQ ID NO: 4359591 - DNA, 13 bp, Homo sapiens
aagcagaacaaat

SEQ ID NO: 4359592 - DNA, 14 bp, Homo sapiens
aagcagaacaaatg

SEQ ID NO: 4359593 - DNA, 19 bp, Homo sapiens
aagcagaacaaatgtgttt

SEQ ID NO: 4359594 - DNA, 15 bp, Homo sapiens
aagcaggaggccctt

SEQ ID NO: 4359595 - DNA, 23 bp, Homo sapiens
aagcatccctcacccatcctaga

SEQ ID NO: 4359596 - DNA, 16 bp, Homo sapiens
aagcccaacctcctga

SEQ ID NO: 4359597 - DNA, 21 bp, Homo sapiens
aagcctgctggctgcggcccc

SEQ ID NO: 4359598 - DNA, 15 bp, Homo sapiens
aagctttttgtttgc

SEQ ID NO: 4359599 - DNA, 19 bp, Homo sapiens
aagctttttgtttgcatca

SEQ ID NO: 4359600 - DNA, 20 bp, Homo sapiens
aagctttttgtttgcatcat

SEQ ID NO: 4359601 - DNA, 14 bp, Homo sapiens
aaggaagaagaaat

SEQ ID NO: 4359602 - DNA, 13 bp, Homo sapiens
aaggaagccaaag

SEQ ID NO: 4359603 - DNA, 16 bp, Homo sapiens
aaggagcccagccaga

SEQ ID NO: 4359604 - DNA, 12 bp, Homo sapiens
aaggagccttga

SEQ ID NO: 4359605 - DNA, 23 bp, Homo sapiens
aaggagccttgataatacttgac

SEQ ID NO: 4359606 - DNA, 14 bp, Homo sapiens
aaggatctgctgag

SEQ ID NO: 4359607 - DNA, 22 bp, Homo sapiens
aagggattgaggagttgcctga

SEQ ID NO: 4359608 - DNA, 15 bp, Homo sapiens
aagggcaagaaatgg

SEQ ID NO: 4359609 - DNA, 23 bp, Homo sapiens
aagggcaagaaatggcgtctgct

SEQ ID NO: 4359610 - DNA, 14 bp, Homo sapiens
aagggcacattgcc

SEQ ID NO: 4359611 - DNA, 22 bp, Homo sapiens
aagggcagggcatctcctgtgc

SEQ ID NO: 4359612 - DNA, 14 bp, Homo sapiens
aagggggtgactgg

SEQ ID NO: 4359613 - DNA, 15 bp, Homo sapiens
aagggggtgactgga

SEQ ID NO: 4359614 - DNA, 16 bp, Homo sapiens
aagggggtgactggaa

SEQ ID NO: 4359615 - DNA, 19 bp, Homo sapiens
aaggggtgcacccacctgt

SEQ ID NO: 4359616 - DNA, 20 bp, Homo sapiens
aagggttctgccctgcctga

SEQ ID NO: 4359617 - DNA, 22 bp, Homo sapiens
aaggtattccttttgtgtacag

SEQ ID NO: 4359618 - DNA, 16 bp, Homo sapiens
aaggtgagaattaagt

SEQ ID NO: 4359619 - DNA, 22 bp, Homo sapiens
aagtacagaacagtaaagttaa

SEQ ID NO: 4359620 - DNA, 12 bp, Homo sapiens
aagtatgcctta

SEQ ID NO: 4359621 - DNA, 19 bp, Homo sapiens
aagtatgccttaagcagaa

SEQ ID NO: 4359622 - DNA, 17 bp, Homo sapiens
aagtctaaatatttcct

SEQ ID NO: 4359623 - DNA, 14 bp, Homo sapiens
aagtgagcagaaca

SEQ ID NO: 4359624 - DNA, 16 bp, Homo sapiens
aagtgagcagaacagg

SEQ ID NO: 4359625 - DNA, 14 bp, Homo sapiens
aagtgtaacagctg

SEQ ID NO: 4359626 - DNA, 19 bp, Homo sapiens
aagtgtgagtaagagctgg

SEQ ID NO: 4359627 - DNA, 17 bp, Homo sapiens
aagtgttctcatgaagc

SEQ ID NO: 4359628 - DNA, 21 bp, Homo sapiens
aagtgttctcatgaagcagga

SEQ ID NO: 4359629 - DNA, 23 bp, Homo sapiens
aagtgttctcatgaagcaggagg

SEQ ID NO: 4359630 - DNA, 13 bp, Homo sapiens
aagttaatgaaat

SEQ ID NO: 4359631 - DNA, 12 bp, Homo sapiens
aagttacttgaa

SEQ ID NO: 4359632 - DNA, 13 bp, Homo sapiens
aagttggaaggat

SEQ ID NO: 4359633 - DNA, 20 bp, Homo sapiens
aagttgtttcagataaattt

SEQ ID NO: 4359634 - DNA, 14 bp, Homo sapiens
aataaaatgtgatt

SEQ ID NO: 4359635 - DNA, 21 bp, Homo sapiens
aataaaatgtgatttttctga

SEQ ID NO: 4359636 - DNA, 15 bp, Homo sapiens
aataaagttgctttt

SEQ ID NO: 4359637 - DNA, 12 bp, Homo sapiens
aataaatatgta

SEQ ID NO: 4359638 - DNA, 15 bp, Homo sapiens
aataaatcatcctca

SEQ ID NO: 4359639 - DNA, 11 bp, Homo sapiens
aataacactgc

SEQ ID NO: 4359640 - DNA, 12 bp, Homo sapiens
aataacactgca

SEQ ID NO: 4359641 - DNA, 13 bp, Homo sapiens
aataatttgtaca

SEQ ID NO: 4359642 - DNA, 20 bp, Homo sapiens
aataatttgtacaatggttt

SEQ ID NO: 4359643 - DNA, 14 bp, Homo sapiens
aatactatattaaa

SEQ ID NO: 4359644 - DNA, 17 bp, Homo sapiens
aatactatattaaattc

SEQ ID NO: 4359645 - DNA, 20 bp, Homo sapiens
aatagacagtatatttatag

SEQ ID NO: 4359646 - DNA, 17 bp, Homo sapiens
aatataaatttaagcaa

SEQ ID NO: 4359647 - DNA, 16 bp, Homo sapiens
aatatacctggtttac

SEQ ID NO: 4359648 - DNA, 23 bp, Homo sapiens
aatattcctggacttacaaaatg

SEQ ID NO: 4359649 - DNA, 21 bp, Homo sapiens
aatgttgccttggaaacattt

SEQ ID NO: 4359650 - DNA, 22 bp, Homo sapiens
aattaggaagtgtaacagctga

SEQ ID NO: 4359651 - DNA, 15 bp, Homo sapiens
aattattttaataat

SEQ ID NO: 4359652 - DNA, 17 bp, Homo sapiens
aattctgaatgcaattt

SEQ ID NO: 4359653 - DNA, 19 bp, Homo sapiens
aattcttcaagaaagaatt

SEQ ID NO: 4359654 - DNA, 20 bp, Homo sapiens
aattcttcaagaaagaattc

SEQ ID NO: 4359655 - DNA, 24 bp, Homo sapiens
aattcttcaagaaagaattcctgc

SEQ ID NO: 4359656 - DNA, 19 bp, Homo sapiens
aattgagcctgtgcctggc

SEQ ID NO: 4359657 - DNA, 24 bp, Homo sapiens
aattgagcctgtgcctggctagaa

SEQ ID NO: 4359658 - DNA, 18 bp, Homo sapiens
aattgtatcatttgaaca

SEQ ID NO: 4359659 - DNA, 24 bp, Homo sapiens
aattgtatcatttgaacaactagg

SEQ ID NO: 4359660 - DNA, 16 bp, Homo sapiens
aatttaagcaaacgtc

SEQ ID NO: 4359661 - DNA, 21 bp, Homo sapiens
aatttggtaaaaatgctgctc

SEQ ID NO: 4359662 - DNA, 22 bp, Homo sapiens
aatttgtctggactagaaaatc

SEQ ID NO: 4359663 - DNA, 18 bp, Homo sapiens
aattttaaataaaagtga

SEQ ID NO: 4359664 - DNA, 22 bp, Homo sapiens
aattttaaataaaagtgatcaa

SEQ ID NO: 4359665 - DNA, 17 bp, Homo sapiens
acaaaaatcaaagaaca

SEQ ID NO: 4359666 - DNA, 17 bp, Homo sapiens
acaaacctactgcccac

SEQ ID NO: 4359667 - DNA, 14 bp, Homo sapiens
acaaaggagccttg

SEQ ID NO: 4359668 - DNA, 20 bp, Homo sapiens
acaaagtttacattgtcctg

SEQ ID NO: 4359669 - DNA, 23 bp, Homo sapiens
acaaggaaaatctatatttgtct

SEQ ID NO: 4359670 - DNA, 14 bp, Homo sapiens
acaataaagtttat

SEQ ID NO: 4359671 - DNA, 21 bp, Homo sapiens
acaataagttacttgaaataa

SEQ ID NO: 4359672 - DNA, 20 bp, Homo sapiens
acaatagctttaccctcagg

SEQ ID NO: 4359673 - DNA, 21 bp, Homo sapiens
acaatcatggtcaagttccca

SEQ ID NO: 4359674 - DNA, 14 bp, Homo sapiens
acaatggaaaccat

SEQ ID NO: 4359675 - DNA, 17 bp, Homo sapiens
acaatggtttattccca

SEQ ID NO: 4359676 - DNA, 19 bp, Homo sapiens
acaatggtttattcccaag

SEQ ID NO: 4359677 - DNA, 23 bp, Homo sapiens
acacagagtggtctttctggaga

SEQ ID NO: 4359678 - DNA, 11 bp, Homo sapiens
acacagcacaa

SEQ ID NO: 4359679 - DNA, 16 bp, Homo sapiens
acacaggacagcggga

SEQ ID NO: 4359680 - DNA, 13 bp, Homo sapiens
acacatctggccc

SEQ ID NO: 4359681 - DNA, 13 bp, Homo sapiens
acaccagagctgc

SEQ ID NO: 4359682 - DNA, 14 bp, Homo sapiens
acacccctctgtct

SEQ ID NO: 4359683 - DNA, 15 bp, Homo sapiens
acactagcctctcca

SEQ ID NO: 4359684 - DNA, 18 bp, Homo sapiens
acactgaatatttatatt

SEQ ID NO: 4359685 - DNA, 15 bp, Homo sapiens
acactgggtgcgtct

SEQ ID NO: 4359686 - DNA, 23 bp, Homo sapiens
acacttgtgtgtgggctgtgagt

SEQ ID NO: 4359687 - DNA, 13 bp, Homo sapiens
acagaaaacatgt

SEQ ID NO: 4359688 - DNA, 21 bp, Homo sapiens
acagaagctttttgtttgcat

SEQ ID NO: 4359689 - DNA, 16 bp, Homo sapiens
acagacttctccagac

SEQ ID NO: 4359690 - DNA, 17 bp, Homo sapiens
acagacttctccagacc

SEQ ID NO: 4359691 - DNA, 18 bp, Homo sapiens
acagagtggtctttctgg

SEQ ID NO: 4359692 - DNA, 18 bp, Homo sapiens
acagatggggtctgtgac

SEQ ID NO: 4359693 - DNA, 21 bp, Homo sapiens
acagccacccgtggggtgctg

SEQ ID NO: 4359694 - DNA, 16 bp, Homo sapiens
acagctgaagaaaatg

SEQ ID NO: 4359695 - DNA, 17 bp, Homo sapiens
acagctgggcagggtga

SEQ ID NO: 4359696 - DNA, 22 bp, Homo sapiens
acagctgtgtctgccaaacaca

SEQ ID NO: 4359697 - DNA, 14 bp, Homo sapiens
acagctttctggga

SEQ ID NO: 4359698 - DNA, 17 bp, Homo sapiens
acaggcacacagggccc

SEQ ID NO: 4359699 - DNA, 23 bp, Homo sapiens
acaggcagttaggtgctgaatga

SEQ ID NO: 4359700 - DNA, 20 bp, Homo sapiens
acagtatcactctaatataa

SEQ ID NO: 4359701 - DNA, 21 bp, Homo sapiens
acagtatcactctaatataat

SEQ ID NO: 4359702 - DNA, 19 bp, Homo sapiens
acagtgaaacaaatttaca

SEQ ID NO: 4359703 - DNA, 23 bp, Homo sapiens
acagtgcctcttccagtgaacat

SEQ ID NO: 4359704 - DNA, 20 bp, Homo sapiens
acagtgcctgggaatgtatt

SEQ ID NO: 4359705 - DNA, 22 bp, Homo sapiens
acatatggaaatgttactgtct

SEQ ID NO: 4359706 - DNA, 14 bp, Homo sapiens
acatctggccctga

SEQ ID NO: 4359707 - DNA, 21 bp, Homo sapiens
acatctggccctgacttctgg

SEQ ID NO: 4359708 - DNA, 13 bp, Homo sapiens
acatgaagctgtt

SEQ ID NO: 4359709 - DNA, 19 bp, Homo sapiens
acatgaagctgttgtgtga

SEQ ID NO: 4359710 - DNA, 15 bp, Homo sapiens
acatgacccagcctg

SEQ ID NO: 4359711 - DNA, 13 bp, Homo sapiens
acatgactacata

SEQ ID NO: 4359712 - DNA, 18 bp, Homo sapiens
acatgcatcatgctcatg

SEQ ID NO: 4359713 - DNA, 14 bp, Homo sapiens
acatggtgtctccc

SEQ ID NO: 4359714 - DNA, 15 bp, Homo sapiens
acatggtgtctccca

SEQ ID NO: 4359715 - DNA, 20 bp, Homo sapiens
acatggtgtctcccaacatg

SEQ ID NO: 4359716 - DNA, 14 bp, Homo sapiens
acatggttggggga

SEQ ID NO: 4359717 - DNA, 18 bp, Homo sapiens
acatgtggggacagggct

SEQ ID NO: 4359718 - DNA, 13 bp, Homo sapiens
acatttgggctca

SEQ ID NO: 4359719 - DNA, 14 bp, Homo sapiens
acatttgggctcag

SEQ ID NO: 4359720 - DNA, 17 bp, Homo sapiens
acatttgggctcagggt

SEQ ID NO: 4359721 - DNA, 20 bp, Homo sapiens
accaaaatttaagttaactg

SEQ ID NO: 4359722 - DNA, 23 bp, Homo sapiens
accaatttggtaaaaatgctgct

SEQ ID NO: 4359723 - DNA, 22 bp, Homo sapiens
accacactgggtgcgtctccag

SEQ ID NO: 4359724 - DNA, 23 bp, Homo sapiens
accacactgggtgcgtctccagt

SEQ ID NO: 4359725 - DNA, 13 bp, Homo sapiens
accacagctgggc

SEQ ID NO: 4359726 - DNA, 20 bp, Homo sapiens
accacagctgggcagggtga

SEQ ID NO: 4359727 - DNA, 23 bp, Homo sapiens
accatggccgaagccccttggag

SEQ ID NO: 4359728 - DNA, 19 bp, Homo sapiens
acccaagcctgctggctgc

SEQ ID NO: 4359729 - DNA, 20 bp, Homo sapiens
acccacactgccagaagaga

SEQ ID NO: 4359730 - DNA, 12 bp, Homo sapiens
acccacccagaa

SEQ ID NO: 4359731 - DNA, 15 bp, Homo sapiens
acccacccagaatga

SEQ ID NO: 4359732 - DNA, 19 bp, Homo sapiens
acccagaatgagacatcca

SEQ ID NO: 4359733 - DNA, 11 bp, Homo sapiens
acccagcctga

SEQ ID NO: 4359734 - DNA, 12 bp, Homo sapiens
acccagcctgaa

SEQ ID NO: 4359735 - DNA, 14 bp, Homo sapiens
acccagtgctgaat

SEQ ID NO: 4359736 - DNA, 16 bp, Homo sapiens
actagtaatactgtct

SEQ ID NO: 4359737 - DNA, 23 bp, Homo sapiens
actattgagccttgcatgtactt

SEQ ID NO: 4359738 - DNA, 23 bp, Homo sapiens
actcaacatgttactgaccagca

SEQ ID NO: 4359739 - DNA, 21 bp, Homo sapiens
actccaccatccccaccccac

SEQ ID NO: 4359740 - DNA, 18 bp, Homo sapiens
actccctggctctcagaa

SEQ ID NO: 4359741 - DNA, 21 bp, Homo sapiens
actcctcaaaagcaaatgaga

SEQ ID NO: 4359742 - DNA, 16 bp, Homo sapiens
actcctggggcctctt

SEQ ID NO: 4359743 - DNA, 17 bp, Homo sapiens
actcctgtacactgaat

SEQ ID NO: 4359744 - DNA, 13 bp, Homo sapiens
actctaatataat

SEQ ID NO: 4359745 - DNA, 22 bp, Homo sapiens
actgaaggggtgcacccacctg

SEQ ID NO: 4359746 - DNA, 21 bp, Homo sapiens
actgaatatttatatttcact

SEQ ID NO: 4359747 - DNA, 20 bp, Homo sapiens
actgaatggaaataaataga

SEQ ID NO: 4359748 - DNA, 23 bp, Homo sapiens
actgccagaagagaattcagtat

SEQ ID NO: 4359749 - DNA, 18 bp, Homo sapiens
actgcccacatttgggct

SEQ ID NO: 4359750 - DNA, 22 bp, Homo sapiens
actgcccacatttgggctcagg

SEQ ID NO: 4359751 - DNA, 19 bp, Homo sapiens
actgccccccgaggctgct

SEQ ID NO: 4359752 - DNA, 21 bp, Homo sapiens
actgccccccgaggctgctag

SEQ ID NO: 4359753 - DNA, 13 bp, Homo sapiens
actgctgcatact

SEQ ID NO: 4359754 - DNA, 17 bp, Homo sapiens
actgcttttaaatgacc

SEQ ID NO: 4359755 - DNA, 10 bp, Homo sapiens
actggatctt

SEQ ID NO: 4359756 - DNA, 14 bp, Homo sapiens
actggatcttctat

SEQ ID NO: 4359757 - DNA, 19 bp, Homo sapiens
actgggaagataggctctg

SEQ ID NO: 4359758 - DNA, 13 bp, Homo sapiens
actgggctgggcc

SEQ ID NO: 4359759 - DNA, 22 bp, Homo sapiens
actgggtggggtgaggaccact

SEQ ID NO: 4359760 - DNA, 19 bp, Homo sapiens
actgtaagagacatgaatg

SEQ ID NO: 4359761 - DNA, 12 bp, Homo sapiens
actgtactgtgt

SEQ ID NO: 4359762 - DNA, 17 bp, Homo sapiens
actgtacttaataaatt

SEQ ID NO: 4359763 - DNA, 14 bp, Homo sapiens
actgtcaggaatgg

SEQ ID NO: 4359764 - DNA, 11 bp, Homo sapiens
actgtcttccc

SEQ ID NO: 4359765 - DNA, 23 bp, Homo sapiens
actgtcttcccgatgagggaagg

SEQ ID NO: 4359766 - DNA, 18 bp, Homo sapiens
actgttggattcagaaat

SEQ ID NO: 4359767 - DNA, 17 bp, Homo sapiens
acttaaaataaaattat

SEQ ID NO: 4359768 - DNA, 13 bp, Homo sapiens
acttacaggctaa

SEQ ID NO: 4359769 - DNA, 19 bp, Homo sapiens
acttcagggcagggctctg

SEQ ID NO: 4359770 - DNA, 16 bp, Homo sapiens
acttcctgtaatgtac

SEQ ID NO: 4359771 - DNA, 13 bp, Homo sapiens
acttctaatttgt

SEQ ID NO: 4359772 - DNA, 16 bp, Homo sapiens
acttctagcatataga

SEQ ID NO: 4359773 - DNA, 23 bp, Homo sapiens
acttctggagatggatccttcca

SEQ ID NO: 4359774 - DNA, 21 bp, Homo sapiens
acttgtgtgtgggctgtgagt

SEQ ID NO: 4359775 - DNA, 22 bp, Homo sapiens
acttgtgtgtgggctgtgagtg

SEQ ID NO: 4359776 - DNA, 15 bp, Homo sapiens
actttcacatagatg

SEQ ID NO: 4359777 - DNA, 19 bp, Homo sapiens
actttgaagggcaagaaat

SEQ ID NO: 4359778 - DNA, 15 bp, Homo sapiens
acttttcacactgtc

SEQ ID NO: 4359779 - DNA, 16 bp, Homo sapiens
acttttcacactgtct

SEQ ID NO: 4359780 - DNA, 19 bp, Homo sapiens
acttttcacactgtcttcc

SEQ ID NO: 4359781 - DNA, 18 bp, Homo sapiens
agaaaatatttttaaatg

SEQ ID NO: 4359782 - DNA, 15 bp, Homo sapiens
agaaacacccctctg

SEQ ID NO: 4359783 - DNA, 19 bp, Homo sapiens
agaaacacccctctgtcta

SEQ ID NO: 4359784 - DNA, 21 bp, Homo sapiens
agaaagtggccatgccaccct

SEQ ID NO: 4359785 - DNA, 11 bp, Homo sapiens
agaaatagcag

SEQ ID NO: 4359786 - DNA, 19 bp, Homo sapiens
agaaatgaataatttccca

SEQ ID NO: 4359787 - DNA, 16 bp, Homo sapiens
agaaatggcgtctgct

SEQ ID NO: 4359788 - DNA, 18 bp, Homo sapiens
agaaatggcgtctgctct

SEQ ID NO: 4359789 - DNA, 22 bp, Homo sapiens
agaaatggcgtctgctctggtg

SEQ ID NO: 4359790 - DNA, 14 bp, Homo sapiens
agaacaaatgtgtt

SEQ ID NO: 4359791 - DNA, 18 bp, Homo sapiens
agaacaaatgtgtttttc

SEQ ID NO: 4359792 - DNA, 14 bp, Homo sapiens
agaacatactgatt

SEQ ID NO: 4359793 - DNA, 17 bp, Homo sapiens
agaacctgcacacagga

SEQ ID NO: 4359794 - DNA, 12 bp, Homo sapiens
agaactgacaaa

SEQ ID NO: 4359795 - DNA, 18 bp, Homo sapiens
agaactgacaaaggagcc

SEQ ID NO: 4359796 - DNA, 23 bp, Homo sapiens
agaactgacaaaggagccttgat

SEQ ID NO: 4359797 - DNA, 19 bp, Homo sapiens
agaagaaatagcagagcct

SEQ ID NO: 4359798 - DNA, 20 bp, Homo sapiens
agaagaaatagcagagccta

SEQ ID NO: 4359799 - DNA, 12 bp, Homo sapiens
agaagacactgc

SEQ ID NO: 4359800 - DNA, 21 bp, Homo sapiens
agaagagaattcagtattttt

SEQ ID NO: 4359801 - DNA, 22 bp, Homo sapiens
agaagagaattcagtatttttt

SEQ ID NO: 4359802 - DNA, 14 bp, Homo sapiens
agaagaggaagaaa

SEQ ID NO: 4359803 - DNA, 18 bp, Homo sapiens
agaagctagatgcccctg

SEQ ID NO: 4359804 - DNA, 17 bp, Homo sapiens
agaagggttctgccctg

SEQ ID NO: 4359805 - DNA, 18 bp, Homo sapiens
agaagggttctgccctgc

SEQ ID NO: 4359806 - DNA, 19 bp, Homo sapiens
agaagggttctgccctgcc

SEQ ID NO: 4359807 - DNA, 22 bp, Homo sapiens
agaagggttctgccctgcctga

SEQ ID NO: 4359808 - DNA, 23 bp, Homo sapiens
agaagggttctgccctgcctgag

SEQ ID NO: 4359809 - DNA, 13 bp, Homo sapiens
agaagtttgcatc

SEQ ID NO: 4359810 - DNA, 14 bp, Homo sapiens
agaatgaaaatcag

SEQ ID NO: 4359811 - DNA, 15 bp, Homo sapiens
agaattcccttgaat

SEQ ID NO: 4359812 - DNA, 21 bp, Homo sapiens
agaattcccttgaattgtgta

SEQ ID NO: 4359813 - DNA, 20 bp, Homo sapiens
agaatttttttgtctttcaa

SEQ ID NO: 4359814 - DNA, 14 bp, Homo sapiens
agacaaaaatcaaa

SEQ ID NO: 4359815 - DNA, 15 bp, Homo sapiens
agacagtatatttat

SEQ ID NO: 4359816 - DNA, 17 bp, Homo sapiens
agacagtatatttatag

SEQ ID NO: 4359817 - DNA, 20 bp, Homo sapiens
agacagtctgttatgcactg

SEQ ID NO: 4359818 - DNA, 20 bp, Homo sapiens
agaccaaaatttaagttaac

SEQ ID NO: 4359819 - DNA, 18 bp, Homo sapiens
agaccagaattcccttga

SEQ ID NO: 4359820 - DNA, 19 bp, Homo sapiens
agaccagaattcccttgaa

SEQ ID NO: 4359821 - DNA, 22 bp, Homo sapiens
agaccagaattcccttgaattg

SEQ ID NO: 4359822 - DNA, 12 bp, Homo sapiens
agacccccaggc

SEQ ID NO: 4359823 - DNA, 23 bp, Homo sapiens
agacctcatgcccagctctctga

SEQ ID NO: 4359824 - DNA, 19 bp, Homo sapiens
agactccaaggagctactg

SEQ ID NO: 4359825 - DNA, 17 bp, Homo sapiens
agactttatgtagtttt

SEQ ID NO: 4359826 - DNA, 19 bp, Homo sapiens
agagaagaaatagcagagc

SEQ ID NO: 4359827 - DNA, 12 bp, Homo sapiens
agagacccccag

SEQ ID NO: 4359828 - DNA, 13 bp, Homo sapiens
agagacccccagg

SEQ ID NO: 4359829 - DNA, 14 bp, Homo sapiens
agagacccccaggc

SEQ ID NO: 4359830 - DNA, 12 bp, Homo sapiens
agagagcaattt

SEQ ID NO: 4359831 - DNA, 21 bp, Homo sapiens
agagcaattctgggagaatga

SEQ ID NO: 4359832 - DNA, 21 bp, Homo sapiens
agagcccagcagggcctcaaa

SEQ ID NO: 4359833 - DNA, 14 bp, Homo sapiens
agagcccgcagggc

SEQ ID NO: 4359834 - DNA, 19 bp, Homo sapiens
agagcctattttggtgagg

SEQ ID NO: 4359835 - DNA, 15 bp, Homo sapiens
agagctggtgtctga

SEQ ID NO: 4359836 - DNA, 14 bp, Homo sapiens
agagctttgtcact

SEQ ID NO: 4359837 - DNA, 17 bp, Homo sapiens
agagctttgtcacttgc

SEQ ID NO: 4359838 - DNA, 15 bp, Homo sapiens
agaggaagaaattca

SEQ ID NO: 4359839 - DNA, 20 bp, Homo sapiens
agaggaagaaattcaggtac

SEQ ID NO: 4359840 - DNA, 19 bp, Homo sapiens
agaggagagtggcaggtgg

SEQ ID NO: 4359841 - DNA, 16 bp, Homo sapiens
agaggccggggtccag

SEQ ID NO: 4359842 - DNA, 12 bp, Homo sapiens
agaggctgcctc

SEQ ID NO: 4359843 - DNA, 14 bp, Homo sapiens
agaggctgcctcag

SEQ ID NO: 4359844 - DNA, 19 bp, Homo sapiens
agaggctgcctcagccagt

SEQ ID NO: 4359845 - DNA, 20 bp, Homo sapiens
agaggtggatgttatgaaca

SEQ ID NO: 4359846 - DNA, 21 bp, Homo sapiens
agaggtggatgttatgaacag

SEQ ID NO: 4359847 - DNA, 22 bp, Homo sapiens
agaggtggatgttatgaacagc

SEQ ID NO: 4359848 - DNA, 13 bp, Homo sapiens
agagtcatctcca

SEQ ID NO: 4359849 - DNA, 18 bp, Homo sapiens
agagtcatctccatcagc

SEQ ID NO: 4359850 - DNA, 13 bp, Homo sapiens
agataggctctgc

SEQ ID NO: 4359851 - DNA, 20 bp, Homo sapiens
agatatcaatactaagtgac

SEQ ID NO: 4359852 - DNA, 14 bp, Homo sapiens
agatcaccttgtat

SEQ ID NO: 4359853 - DNA, 22 bp, Homo sapiens
agatcccgcctcttcttcttca

SEQ ID NO: 4359854 - DNA, 13 bp, Homo sapiens
agatctttcagga

SEQ ID NO: 4359855 - DNA, 23 bp, Homo sapiens
agatgctacaatggaaaccattt

SEQ ID NO: 4359856 - DNA, 20 bp, Homo sapiens
agatggatttgcctgtgcca

SEQ ID NO: 4359857 - DNA, 23 bp, Homo sapiens
agatgggaaggttagaaaggcag

SEQ ID NO: 4359858 - DNA, 18 bp, Homo sapiens
agatggggtctgtgactg

SEQ ID NO: 4359859 - DNA, 20 bp, Homo sapiens
agatggggtctgtgactgga

SEQ ID NO: 4359860 - DNA, 20 bp, Homo sapiens
agatgtccctttcttggcca

SEQ ID NO: 4359861 - DNA, 17 bp, Homo sapiens
agatgtgatacactgaa

SEQ ID NO: 4359862 - DNA, 13 bp, Homo sapiens
agatgtgcaataa

SEQ ID NO: 4359863 - DNA, 18 bp, Homo sapiens
agatgtgcaataatttgt

SEQ ID NO: 4359864 - DNA, 14 bp, Homo sapiens
agatttaaaataaa

SEQ ID NO: 4359865 - DNA, 17 bp, Homo sapiens
agatttaaaataaacat

SEQ ID NO: 4359866 - DNA, 18 bp, Homo sapiens
agcaaacccagaggtgga

SEQ ID NO: 4359867 - DNA, 20 bp, Homo sapiens
agcaaacgtctattttgtat

SEQ ID NO: 4359868 - DNA, 20 bp, Homo sapiens
agcaacttgtctttttctgg

SEQ ID NO: 4359869 - DNA, 17 bp, Homo sapiens
agcacaagggcacattg

SEQ ID NO: 4359870 - DNA, 19 bp, Homo sapiens
agcacacacaaacctactg

SEQ ID NO: 4359871 - DNA, 17 bp, Homo sapiens
agcactacaatcatggt

SEQ ID NO: 4359872 - DNA, 14 bp, Homo sapiens
agcactgtctcagt

SEQ ID NO: 4359873 - DNA, 14 bp, Homo sapiens
agcagaacaaatgt

SEQ ID NO: 4359874 - DNA, 16 bp, Homo sapiens
agcagaacaaatgtgt

SEQ ID NO: 4359875 - DNA, 15 bp, Homo sapiens
agcagaacctgcaca

SEQ ID NO: 4359876 - DNA, 19 bp, Homo sapiens
agcagaacctgcacacagg

SEQ ID NO: 4359877 - DNA, 23 bp, Homo sapiens
agcagaacctgcacacaggacag

SEQ ID NO: 4359878 - DNA, 22 bp, Homo sapiens
agcagcggtttggggagcagag

SEQ ID NO: 4359879 - DNA, 23 bp, Homo sapiens
agcagcggtttggggagcagaga

SEQ ID NO: 4359880 - DNA, 21 bp, Homo sapiens
agcaggaggcccttgtcgtgg

SEQ ID NO: 4359881 - DNA, 23 bp, Homo sapiens
agcaggaggcccttgtcgtggga

SEQ ID NO: 4359882 - DNA, 23 bp, Homo sapiens
agcagttagttagttagttactc

SEQ ID NO: 4359883 - DNA, 20 bp, Homo sapiens
agcataaaagatcaccttgt

SEQ ID NO: 4359884 - DNA, 13 bp, Homo sapiens
agcatagccagca

SEQ ID NO: 4359885 - DNA, 15 bp, Homo sapiens
agcatccctcaccca

SEQ ID NO: 4359886 - DNA, 10 bp, Homo sapiens
agccaaagtt

SEQ ID NO: 4359887 - DNA, 19 bp, Homo sapiens
agccacccgtggggtgctg

SEQ ID NO: 4359888 - DNA, 14 bp, Homo sapiens
agccagaaagcact

SEQ ID NO: 4359889 - DNA, 16 bp, Homo sapiens
agccagtggcacagga

SEQ ID NO: 4359890 - DNA, 22 bp, Homo sapiens
agccatggggtccatccccttc

SEQ ID NO: 4359891 - DNA, 15 bp, Homo sapiens
agcccagccagaaag

SEQ ID NO: 4359892 - DNA, 17 bp, Homo sapiens
agcccagtccctggagc

SEQ ID NO: 4359893 - DNA, 20 bp, Homo sapiens
agcccagtccctggagctgt

SEQ ID NO: 4359894 - DNA, 13 bp, Homo sapiens
agccccgcctgtc

SEQ ID NO: 4359895 - DNA, 19 bp, Homo sapiens
agcccgcagggccatgcag

SEQ ID NO: 4359896 - DNA, 11 bp, Homo sapiens
agccctcacct

SEQ ID NO: 4359897 - DNA, 19 bp, Homo sapiens
agccctcacctctgaggac

SEQ ID NO: 4359898 - DNA, 20 bp, Homo sapiens
agcccttctatacccaccca

SEQ ID NO: 4359899 - DNA, 23 bp, Homo sapiens
agcccttctatacccacccagaa

SEQ ID NO: 4359900 - DNA, 14 bp, Homo sapiens
agcctagttcatcc

SEQ ID NO: 4359901 - DNA, 15 bp, Homo sapiens
agcctagttcatcca

SEQ ID NO: 4359902 - DNA, 23 bp, Homo sapiens
agcctagttcatccaatcctcac

SEQ ID NO: 4359903 - DNA, 21 bp, Homo sapiens
agcctcgttggagagcagcag

SEQ ID NO: 4359904 - DNA, 22 bp, Homo sapiens
agcctcgttggagagcagcagg

SEQ ID NO: 4359905 - DNA, 23 bp, Homo sapiens
agcctgaaagatacaggggatca

SEQ ID NO: 4359906 - DNA, 15 bp, Homo sapiens
agcctgaagcctgga

SEQ ID NO: 4359907 - DNA, 18 bp, Homo sapiens
agcctgaagcctggattc

SEQ ID NO: 4359908 - DNA, 13 bp, Homo sapiens
agcctgctggctg

SEQ ID NO: 4359909 - DNA, 17 bp, Homo sapiens
agccttgataatacttg

SEQ ID NO: 4359910 - DNA, 19 bp, Homo sapiens
agccttgataatacttgac

SEQ ID NO: 4359911 - DNA, 18 bp, Homo sapiens
agccttgcatgtacttga

SEQ ID NO: 4359912 - DNA, 20 bp, Homo sapiens
agcggccccccgcacagcca

SEQ ID NO: 4359913 - DNA, 22 bp, Homo sapiens
agcggtttggggagcagagaca

SEQ ID NO: 4359914 - DNA, 16 bp, Homo sapiens
agctaaagcccaacct

SEQ ID NO: 4359915 - DNA, 16 bp, Homo sapiens
agctctaagagcaatt

SEQ ID NO: 4359916 - DNA, 18 bp, Homo sapiens
agctctggatgaaggcaa

SEQ ID NO: 4359917 - DNA, 16 bp, Homo sapiens
agctgaagaaaatgag

SEQ ID NO: 4359918 - DNA, 18 bp, Homo sapiens
agctgaggtctcttgagg

SEQ ID NO: 4359919 - DNA, 23 bp, Homo sapiens
agctgaggtctcttgagggagct

SEQ ID NO: 4359920 - DNA, 16 bp, Homo sapiens
agctggatagacttgg

SEQ ID NO: 4359921 - DNA, 20 bp, Homo sapiens
agctggatagacttgggatg

SEQ ID NO: 4359922 - DNA, 21 bp, Homo sapiens
agctggatagacttgggatgg

SEQ ID NO: 4359923 - DNA, 14 bp, Homo sapiens
agctgggcagggtg

SEQ ID NO: 4359924 - DNA, 15 bp, Homo sapiens
agctgggcagggtga

SEQ ID NO: 4359925 - DNA, 17 bp, Homo sapiens
agctgggcccctgcaca

SEQ ID NO: 4359926 - DNA, 22 bp, Homo sapiens
agctgtaagaagagactgggaa

SEQ ID NO: 4359927 - DNA, 14 bp, Homo sapiens
agctgtgtctgcca

SEQ ID NO: 4359928 - DNA, 21 bp, Homo sapiens
agctgtgtctgccaaacacat

SEQ ID NO: 4359929 - DNA, 22 bp, Homo sapiens
agcttgactgcttttaaatgac

SEQ ID NO: 4359930 - DNA, 23 bp, Homo sapiens
agcttgactgcttttaaatgacc

SEQ ID NO: 4359931 - DNA, 14 bp, Homo sapiens
agcttgatgttata

SEQ ID NO: 4359932 - DNA, 19 bp, Homo sapiens
agcttgctccagattctga

SEQ ID NO: 4359933 - DNA, 22 bp, Homo sapiens
agcttgctccagattctgatgc

SEQ ID NO: 4359934 - DNA, 23 bp, Homo sapiens
agctttaaaaccacagctgggca

SEQ ID NO: 4359935 - DNA, 20 bp, Homo sapiens
agctttaccctcaggcatag

SEQ ID NO: 4359936 - DNA, 20 bp, Homo sapiens
agctttctgggatgtcacag

SEQ ID NO: 4359937 - DNA, 12 bp, Homo sapiens
agctttgtcact

SEQ ID NO: 4359938 - DNA, 16 bp, Homo sapiens
agctttgtcacttgcc

SEQ ID NO: 4359939 - DNA, 13 bp, Homo sapiens
cgtgttcagcaga

SEQ ID NO: 4359940 - DNA, 18 bp, Homo sapiens
cgttctaggtaggaagag

SEQ ID NO: 4359941 - DNA, 22 bp, Homo sapiens
cgttggagagcagcaggtgctg

SEQ ID NO: 4359942 - DNA, 19 bp, Homo sapiens
ctaaactaacaagattaaa

SEQ ID NO: 4359943 - DNA, 17 bp, Homo sapiens
ctaaagcccaacctcct

SEQ ID NO: 4359944 - DNA, 22 bp, Homo sapiens
ctaaaggtaccaaacaaggaag

SEQ ID NO: 4359945 - DNA, 17 bp, Homo sapiens
ctaaatacaacactgat

SEQ ID NO: 4359946 - DNA, 16 bp, Homo sapiens
ctaaatgatggtgctt

SEQ ID NO: 4359947 - DNA, 10 bp, Homo sapiens
ctaaccaagt

SEQ ID NO: 4359948 - DNA, 16 bp, Homo sapiens
ctaagagtggaggagg

SEQ ID NO: 4359949 - DNA, 17 bp, Homo sapiens
ctaagtcaggtaatata

SEQ ID NO: 4359950 - DNA, 18 bp, Homo sapiens
ctaagtcaggtaatatac

SEQ ID NO: 4359951 - DNA, 16 bp, Homo sapiens
ctaagtgtaaatgtta

SEQ ID NO: 4359952 - DNA, 16 bp, Homo sapiens
ctacaaagtaaaatga

SEQ ID NO: 4359953 - DNA, 17 bp, Homo sapiens
ctacaaagtaaaatgaa

SEQ ID NO: 4359954 - DNA, 11 bp, Homo sapiens
ctacaatcatg

SEQ ID NO: 4359955 - DNA, 12 bp, Homo sapiens
ctacaatcatgg

SEQ ID NO: 4359956 - DNA, 23 bp, Homo sapiens
ctacaatcatggtcaagttccca

SEQ ID NO: 4359957 - DNA, 21 bp, Homo sapiens
ctacagacttctccagaccca

SEQ ID NO: 4359958 - DNA, 16 bp, Homo sapiens
ctacatagtaagtaca

SEQ ID NO: 4359959 - DNA, 22 bp, Homo sapiens
ctaccactgtggccccaagagg

SEQ ID NO: 4359960 - DNA, 23 bp, Homo sapiens
ctaccactgtggccccaagaggg

SEQ ID NO: 4359961 - DNA, 15 bp, Homo sapiens
ctactgcccacattt

SEQ ID NO: 4359962 - DNA, 20 bp, Homo sapiens
ctacttcctgtaatgtacaa

SEQ ID NO: 4359963 - DNA, 18 bp, Homo sapiens
ctacttctagctgtattt

SEQ ID NO: 4359964 - DNA, 13 bp, Homo sapiens
ctagaaaacaagc

SEQ ID NO: 4359965 - DNA, 22 bp, Homo sapiens
ctagcccagtccctggagctgt

SEQ ID NO: 4359966 - DNA, 23 bp, Homo sapiens
ctagcccagtccctggagctgtc

SEQ ID NO: 4359967 - DNA, 15 bp, Homo sapiens
ctaggcccccaaatt

SEQ ID NO: 4359968 - DNA, 18 bp, Homo sapiens
ctagttcatccaatcctc

SEQ ID NO: 4359969 - DNA, 20 bp, Homo sapiens
ctagttcatccaatcctcac

SEQ ID NO: 4359970 - DNA, 21 bp, Homo sapiens
ctagttcatccaatcctcact

SEQ ID NO: 4359971 - DNA, 22 bp, Homo sapiens
ctagttcatccaatcctcactg

SEQ ID NO: 4359972 - DNA, 11 bp, Homo sapiens
ctagttctgct

SEQ ID NO: 4359973 - DNA, 16 bp, Homo sapiens
ctagttctgctgccct

SEQ ID NO: 4359974 - DNA, 21 bp, Homo sapiens
ctagttctgctgccctcttaa

SEQ ID NO: 4359975 - DNA, 15 bp, Homo sapiens
ctataatattttatc

SEQ ID NO: 4359976 - DNA, 15 bp, Homo sapiens
ctatacccacccaga

SEQ ID NO: 4359977 - DNA, 14 bp, Homo sapiens
ctatatagttcctt

SEQ ID NO: 4359978 - DNA, 16 bp, Homo sapiens
ctatatagttccttgc

SEQ ID NO: 4359979 - DNA, 19 bp, Homo sapiens
ctatatagttccttgcctt

SEQ ID NO: 4359980 - DNA, 22 bp, Homo sapiens
ctatatagttccttgccttaat

SEQ ID NO: 4359981 - DNA, 16 bp, Homo sapiens
ctatcctgcaggaaat

SEQ ID NO: 4359982 - DNA, 16 bp, Homo sapiens
ctattgagccttgcat

SEQ ID NO: 4359983 - DNA, 15 bp, Homo sapiens
ctatttttatttata

SEQ ID NO: 4359984 - DNA, 20 bp, Homo sapiens
ctcaacatgttactgaccag

SEQ ID NO: 4359985 - DNA, 23 bp, Homo sapiens
ctcaactgaaggggtgcacccac

SEQ ID NO: 4359986 - DNA, 18 bp, Homo sapiens
ctcactcagtaaaacata

SEQ ID NO: 4359987 - DNA, 21 bp, Homo sapiens
ctcagaacatactgattggga

SEQ ID NO: 4359988 - DNA, 16 bp, Homo sapiens
ctcagaaggtattcct

SEQ ID NO: 4359989 - DNA, 12 bp, Homo sapiens
ctcagagctttg

SEQ ID NO: 4359990 - DNA, 21 bp, Homo sapiens
ctcagagctttgtcacttgcc

SEQ ID NO: 4359991 - DNA, 19 bp, Homo sapiens
ctcagccagtggcacagga

SEQ ID NO: 4359992 - DNA, 22 bp, Homo sapiens
ctcagccagtggcacaggagac

SEQ ID NO: 4359993 - DNA, 14 bp, Homo sapiens
ctcagcctcccaca

SEQ ID NO: 4359994 - DNA, 14 bp, Homo sapiens
ctcaggcagcacca

SEQ ID NO: 4359995 - DNA, 23 bp, Homo sapiens
ctcaggcataggcctgggtgctg

SEQ ID NO: 4359996 - DNA, 19 bp, Homo sapiens
ctcatagcatagccagcat

SEQ ID NO: 4359997 - DNA, 21 bp, Homo sapiens
ctcatagcatagccagcattc

SEQ ID NO: 4359998 - DNA, 19 bp, Homo sapiens
ctcatgatgtaaaaaatat

SEQ ID NO: 4359999 - DNA, 19 bp, Homo sapiens
ctcatgcccagctctctga

SEQ ID NO: 4360000 - DNA, 22 bp, Homo sapiens
ctccaccctccggccagcgagt

SEQ ID NO: 4360001 - DNA, 20 bp, Homo sapiens
ctccaggaatgcctcctccc

SEQ ID NO: 4360002 - DNA, 16 bp, Homo sapiens
ctccagtcatggtact

SEQ ID NO: 4360003 - DNA, 23 bp, Homo sapiens
ctccagtcatggtactaccccag

SEQ ID NO: 4360004 - DNA, 16 bp, Homo sapiens
ctccatgccccagctc

SEQ ID NO: 4360005 - DNA, 19 bp, Homo sapiens
ctccatgccccagctctgg

SEQ ID NO: 4360006 - DNA, 20 bp, Homo sapiens
ctccatgccccagctctgga

SEQ ID NO: 4360007 - DNA, 21 bp, Homo sapiens
ctcccaacatgggagggatca

SEQ ID NO: 4360008 - DNA, 17 bp, Homo sapiens
ctcccagcttcaaatgc

SEQ ID NO: 4360009 - DNA, 23 bp, Homo sapiens
ctcccctctcagaacatactgat

SEQ ID NO: 4360010 - DNA, 15 bp, Homo sapiens
ctccctcaactgaag

SEQ ID NO: 4360011 - DNA, 12 bp, Homo sapiens
catttgtgaggc

SEQ ID NO: 4360012 - DNA, 15 bp, Homo sapiens
catttgtgaggccca

SEQ ID NO: 4360013 - DNA, 21 bp, Homo sapiens
cattttgtccaccttttaagt

SEQ ID NO: 4360014 - DNA, 23 bp, Homo sapiens
catttttacaccaatttggtaaa

SEQ ID NO: 4360015 - DNA, 16 bp, Homo sapiens
ccaaattgccttcagc

SEQ ID NO: 4360016 - DNA, 13 bp, Homo sapiens
ccaacatgcactg

SEQ ID NO: 4360017 - DNA, 21 bp, Homo sapiens
ccaacatgcactgatgttgtg

SEQ ID NO: 4360018 - DNA, 14 bp, Homo sapiens
ccaacctcctgacc

SEQ ID NO: 4360019 - DNA, 15 bp, Homo sapiens
ccaagactcctcagg

SEQ ID NO: 4360020 - DNA, 16 bp, Homo sapiens
ccaagactcctcaggc

SEQ ID NO: 4360021 - DNA, 15 bp, Homo sapiens
ccaagcctgctggct

SEQ ID NO: 4360022 - DNA, 16 bp, Homo sapiens
ccaagcctgctggctg

SEQ ID NO: 4360023 - DNA, 19 bp, Homo sapiens
ccaagggggtgactggaag

SEQ ID NO: 4360024 - DNA, 16 bp, Homo sapiens
ccaagtatgccttaag

SEQ ID NO: 4360025 - DNA, 20 bp, Homo sapiens
ccaagtatgccttaagcaga

SEQ ID NO: 4360026 - DNA, 18 bp, Homo sapiens
ccaatcctcactgggtgg

SEQ ID NO: 4360027 - DNA, 12 bp, Homo sapiens
ccaattctaaat

SEQ ID NO: 4360028 - DNA, 23 bp, Homo sapiens
ccaattctaaatccgacttgaat

SEQ ID NO: 4360029 - DNA, 20 bp, Homo sapiens
ccaatttggtaaaaatgctg

SEQ ID NO: 4360030 - DNA, 23 bp, Homo sapiens
ccaatttggtaaaaatgctgctc

SEQ ID NO: 4360031 - DNA, 15 bp, Homo sapiens
ccacacccagcggcc

SEQ ID NO: 4360032 - DNA, 15 bp, Homo sapiens
ccacaccgcagaagc

SEQ ID NO: 4360033 - DNA, 22 bp, Homo sapiens
ccacatggtgtctcccaacatg

SEQ ID NO: 4360034 - DNA, 20 bp, Homo sapiens
ccacatgtggggacagggct

SEQ ID NO: 4360035 - DNA, 18 bp, Homo sapiens
ccacatttgggctcaggg

SEQ ID NO: 4360036 - DNA, 17 bp, Homo sapiens
ccaccacaccgcagaag

SEQ ID NO: 4360037 - DNA, 15 bp, Homo sapiens
ccacccaccagggcg

SEQ ID NO: 4360038 - DNA, 22 bp, Homo sapiens
ccacccagaatgagacatccag

SEQ ID NO: 4360039 - DNA, 21 bp, Homo sapiens
ccacccgccgcctcccacggc

SEQ ID NO: 4360040 - DNA, 20 bp, Homo sapiens
ccaccggaggtcactccacc

SEQ ID NO: 4360041 - DNA, 18 bp, Homo sapiens
ccagaaacacccctctgt

SEQ ID NO: 4360042 - DNA, 17 bp, Homo sapiens
ccagaagagaattcagt

SEQ ID NO: 4360043 - DNA, 22 bp, Homo sapiens
ccagaattcccttgaattgtgt

SEQ ID NO: 4360044 - DNA, 22 bp, Homo sapiens
ccagacagtggatatgacccac

SEQ ID NO: 4360045 - DNA, 18 bp, Homo sapiens
ccagacccctctggccag

SEQ ID NO: 4360046 - DNA, 19 bp, Homo sapiens
ccagacccctctggccagg

SEQ ID NO: 4360047 - DNA, 21 bp, Homo sapiens
ccagacccctctggccaggat

SEQ ID NO: 4360048 - DNA, 24 bp, Homo sapiens
ccagacccctctggccaggatgga

SEQ ID NO: 4360049 - DNA, 17 bp, Homo sapiens
ccagactctttttttga

SEQ ID NO: 4360050 - DNA, 22 bp, Homo sapiens
ccagaggtgtcgggacatggtt

SEQ ID NO: 4360051 - DNA, 18 bp, Homo sapiens
ccagcaacttgtcttttt

SEQ ID NO: 4360052 - DNA, 16 bp, Homo sapiens
ccagcattcagcacac

SEQ ID NO: 4360053 - DNA, 17 bp, Homo sapiens
ccagcattcagcacaca

SEQ ID NO: 4360054 - DNA, 12 bp, Homo sapiens
ccagctctctga

SEQ ID NO: 4360055 - DNA, 13 bp, Homo sapiens
ccagctctctgac

SEQ ID NO: 4360056 - DNA, 16 bp, Homo sapiens
ccagctctctgacgct

SEQ ID NO: 4360057 - DNA, 20 bp, Homo sapiens
ccagctctggatgaaggcaa

SEQ ID NO: 4360058 - DNA, 18 bp, Homo sapiens
ccagcttcaaatgcaaat

SEQ ID NO: 4360059 - DNA, 12 bp, Homo sapiens
ccaggagctagc

SEQ ID NO: 4360060 - DNA, 16 bp, Homo sapiens
ccaggagctagcccag

SEQ ID NO: 4360061 - DNA, 21 bp, Homo sapiens
ccaggagctagcccagtccct

SEQ ID NO: 4360062 - DNA, 18 bp, Homo sapiens
ccaggcaggagcccttct

SEQ ID NO: 4360063 - DNA, 15 bp, Homo sapiens
ccaggcattggctca

SEQ ID NO: 4360064 - DNA, 14 bp, Homo sapiens
ccagggcagaggaa

SEQ ID NO: 4360065 - DNA, 21 bp, Homo sapiens
ccagtcatctgtaagagcttg

SEQ ID NO: 4360066 - DNA, 20 bp, Homo sapiens
ccagtcatggtactacccca

SEQ ID NO: 4360067 - DNA, 14 bp, Homo sapiens
ccagtccccgagga

SEQ ID NO: 4360068 - DNA, 22 bp, Homo sapiens
ccagtccccgaggagctgggcc

SEQ ID NO: 4360069 - DNA, 13 bp, Homo sapiens
ccagtccctggag

SEQ ID NO: 4360070 - DNA, 16 bp, Homo sapiens
cccgcagggccatgca

SEQ ID NO: 4360071 - DNA, 20 bp, Homo sapiens
cccgccccgttgtgagctgg

SEQ ID NO: 4360072 - DNA, 21 bp, Homo sapiens
cccgtgcccccgcctgccacc

SEQ ID NO: 4360073 - DNA, 23 bp, Homo sapiens
cccgtgggcgcaaaggtgcctca

SEQ ID NO: 4360074 - DNA, 15 bp, Homo sapiens
ccctaaccaagttcc

SEQ ID NO: 4360075 - DNA, 13 bp, Homo sapiens
ccctcacccatcc

SEQ ID NO: 4360076 - DNA, 13 bp, Homo sapiens
ccctcacctctga

SEQ ID NO: 4360077 - DNA, 19 bp, Homo sapiens
ccctcacctctgaggacag

SEQ ID NO: 4360078 - DNA, 23 bp, Homo sapiens
ccctcaggcataggcctgggtgc

SEQ ID NO: 4360079 - DNA, 13 bp, Homo sapiens
ccctccccccaga

SEQ ID NO: 4360080 - DNA, 16 bp, Homo sapiens
ccctccccccagactc

SEQ ID NO: 4360081 - DNA, 17 bp, Homo sapiens
ccctccccccagactct

SEQ ID NO: 4360082 - DNA, 16 bp, Homo sapiens
ccctccctaccctaac

SEQ ID NO: 4360083 - DNA, 14 bp, Homo sapiens
ccctctcagaacat

SEQ ID NO: 4360084 - DNA, 21 bp, Homo sapiens
ccctctcggccaggcattggc

SEQ ID NO: 4360085 - DNA, 22 bp, Homo sapiens
ccctctctcataccctccctcc

SEQ ID NO: 4360086 - DNA, 13 bp, Homo sapiens
ccctctggccagg

SEQ ID NO: 4360087 - DNA, 20 bp, Homo sapiens
ccctgcagtttggccctgga

SEQ ID NO: 4360088 - DNA, 21 bp, Homo sapiens
ccctgcagtttggccctggag

SEQ ID NO: 4360089 - DNA, 18 bp, Homo sapiens
ccctgccaagactcctca

SEQ ID NO: 4360090 - DNA, 13 bp, Homo sapiens
ccctgcctgagga

SEQ ID NO: 4360091 - DNA, 14 bp, Homo sapiens
ccctgcctgaggag

SEQ ID NO: 4360092 - DNA, 18 bp, Homo sapiens
ccctgcctgaggaggagg

SEQ ID NO: 4360093 - DNA, 18 bp, Homo sapiens
ccctgcgggcgcgggcag

SEQ ID NO: 4360094 - DNA, 21 bp, Homo sapiens
ccctgcgggcgcgggcagcca

SEQ ID NO: 4360095 - DNA, 23 bp, Homo sapiens
ccctgcgggcgcgggcagccacc

SEQ ID NO: 4360096 - DNA, 23 bp, Homo sapiens
ccctggagccagggcagaggaat

SEQ ID NO: 4360097 - DNA, 13 bp, Homo sapiens
ccctggagctgtc

SEQ ID NO: 4360098 - DNA, 18 bp, Homo sapiens
ccctggagctgtccttca

SEQ ID NO: 4360099 - DNA, 19 bp, Homo sapiens
ccctggagctgtccttcat

SEQ ID NO: 4360100 - DNA, 19 bp, Homo sapiens
ccctggctctcagaaggta

SEQ ID NO: 4360101 - DNA, 15 bp, Homo sapiens
ccctggggaccagga

SEQ ID NO: 4360102 - DNA, 15 bp, Homo sapiens
ccctgtccggcccag

SEQ ID NO: 4360103 - DNA, 18 bp, Homo sapiens
cccttctatacccaccca

SEQ ID NO: 4360104 - DNA, 21 bp, Homo sapiens
cccttctatacccacccagaa

SEQ ID NO: 4360105 - DNA, 18 bp, Homo sapiens
cccttgagaccaaaattt

SEQ ID NO: 4360106 - DNA, 16 bp, Homo sapiens
ccctttcttggccagt

SEQ ID NO: 4360107 - DNA, 16 bp, Homo sapiens
ccgaagccccttggag

SEQ ID NO: 4360108 - DNA, 18 bp, Homo sapiens
ccgaagccccttggagag

SEQ ID NO: 4360109 - DNA, 19 bp, Homo sapiens
ccgaagccccttggagaga

SEQ ID NO: 4360110 - DNA, 15 bp, Homo sapiens
ccgaggagctgggcc

SEQ ID NO: 4360111 - DNA, 18 bp, Homo sapiens
ccgaggagctgggcccct

SEQ ID NO: 4360112 - DNA, 11 bp, Homo sapiens
ccgcagggcca

SEQ ID NO: 4360113 - DNA, 17 bp, Homo sapiens
ccgccgcctcccacggc

SEQ ID NO: 4360114 - DNA, 16 bp, Homo sapiens
ccggaggtcactccac

SEQ ID NO: 4360115 - DNA, 21 bp, Homo sapiens
ccgtgggcgcaaaggtgcctc

SEQ ID NO: 4360116 - DNA, 18 bp, Homo sapiens
ccgtggggtctgcgcttg

SEQ ID NO: 4360117 - DNA, 15 bp, Homo sapiens
ccgtggggtgctgcc

SEQ ID NO: 4360118 - DNA, 15 bp, Homo sapiens
cctaacatagtgtct

SEQ ID NO: 4360119 - DNA, 16 bp, Homo sapiens
cctaagagtggaggag

SEQ ID NO: 4360120 - DNA, 21 bp, Homo sapiens
cctagttcatccaatcctcac

SEQ ID NO: 4360121 - DNA, 16 bp, Homo sapiens
cctcaaaagcaccctt

SEQ ID NO: 4360122 - DNA, 11 bp, Homo sapiens
cctcacctctg

SEQ ID NO: 4360123 - DNA, 12 bp, Homo sapiens
cctcacctctga

SEQ ID NO: 4360124 - DNA, 14 bp, Homo sapiens
cctcacctctgagg

SEQ ID NO: 4360125 - DNA, 11 bp, Homo sapiens
cctcagccagt

SEQ ID NO: 4360126 - DNA, 19 bp, Homo sapiens
cctcagccagtggcacagg

SEQ ID NO: 4360127 - DNA, 23 bp, Homo sapiens
cctcaggcagcgtgtgggtcccg

SEQ ID NO: 4360128 - DNA, 13 bp, Homo sapiens
cctcatgcccagc

SEQ ID NO: 4360129 - DNA, 15 bp, Homo sapiens
cctcccctctcagaa

SEQ ID NO: 4360130 - DNA, 18 bp, Homo sapiens
cctcccctctcagaacat

SEQ ID NO: 4360131 - DNA, 22 bp, Homo sapiens
cctccctaccctaaccaagttc

SEQ ID NO: 4360132 - DNA, 15 bp, Homo sapiens
cctcctgacctgtca

SEQ ID NO: 4360133 - DNA, 14 bp, Homo sapiens
cctcctgctcctca

SEQ ID NO: 4360134 - DNA, 16 bp, Homo sapiens
cctcgttggagagcag

SEQ ID NO: 4360135 - DNA, 14 bp, Homo sapiens
cctctcagaacata

SEQ ID NO: 4360136 - DNA, 11 bp, Homo sapiens
cctctgaggac

SEQ ID NO: 4360137 - DNA, 17 bp, Homo sapiens
cctctggttgcctcccc

SEQ ID NO: 4360138 - DNA, 10 bp, Homo sapiens
cctctgtcta

SEQ ID NO: 4360139 - DNA, 15 bp, Homo sapiens
cctctgtctaggact

SEQ ID NO: 4360140 - DNA, 22 bp, Homo sapiens
cctcttaagatctgactgccaa

SEQ ID NO: 4360141 - DNA, 16 bp, Homo sapiens
cctgaactccagaggt

SEQ ID NO: 4360142 - DNA, 23 bp, Homo sapiens
cctgacttctggagatggatcct

SEQ ID NO: 4360143 - DNA, 13 bp, Homo sapiens
cctgagtgggctg

SEQ ID NO: 4360144 - DNA, 17 bp, Homo sapiens
cctgagtgggctgggcc

SEQ ID NO: 4360145 - DNA, 18 bp, Homo sapiens
cctgcacacaggacagcg

SEQ ID NO: 4360146 - DNA, 22 bp, Homo sapiens
cctgcacaggcacacagggccc

SEQ ID NO: 4360147 - DNA, 17 bp, Homo sapiens
cctgcagtttggccctg

SEQ ID NO: 4360148 - DNA, 22 bp, Homo sapiens
cctgcagtttggccctggagcc

SEQ ID NO: 4360149 - DNA, 19 bp, Homo sapiens
cctgccaagactcctcagg

SEQ ID NO: 4360150 - DNA, 18 bp, Homo sapiens
cctgccggtgggaccctg

SEQ ID NO: 4360151 - DNA, 22 bp, Homo sapiens
cctgccggtgggaccctgtccg

SEQ ID NO: 4360152 - DNA, 12 bp, Homo sapiens
cctgcctgagga

SEQ ID NO: 4360153 - DNA, 20 bp, Homo sapiens
cctgcgggcgcgggcagcca

SEQ ID NO: 4360154 - DNA, 23 bp, Homo sapiens
cctgcgggcgcgggcagccaccc

SEQ ID NO: 4360155 - DNA, 21 bp, Homo sapiens
cctgctggctgcggccccctc

SEQ ID NO: 4360156 - DNA, 13 bp, Homo sapiens
cctggagccaggg

SEQ ID NO: 4360157 - DNA, 15 bp, Homo sapiens
cctggattccagcag

SEQ ID NO: 4360158 - DNA, 13 bp, Homo sapiens
cctggggcctctt

SEQ ID NO: 4360159 - DNA, 16 bp, Homo sapiens
cctgggtgctggctgc

SEQ ID NO: 4360160 - DNA, 20 bp, Homo sapiens
cctgggtgggtggggtacag

SEQ ID NO: 4360161 - DNA, 22 bp, Homo sapiens
cctgtagggaaaccttggagag

SEQ ID NO: 4360162 - DNA, 23 bp, Homo sapiens
cctgtagggaaaccttggagagg

SEQ ID NO: 4360163 - DNA, 13 bp, Homo sapiens
cctgtcacaataa

SEQ ID NO: 4360164 - DNA, 15 bp, Homo sapiens
cctgtcacaataaag

SEQ ID NO: 4360165 - DNA, 14 bp, Homo sapiens
cctgtccaccctgc

SEQ ID NO: 4360166 - DNA, 16 bp, Homo sapiens
cctgtgaccagcactg

SEQ ID NO: 4360167 - DNA, 14 bp, Homo sapiens
cctgttttctgaaa

SEQ ID NO: 4360168 - DNA, 15 bp, Homo sapiens
cctgttttctgaaac

SEQ ID NO: 4360169 - DNA, 15 bp, Homo sapiens
ccttaagcagaacaa

SEQ ID NO: 4360170 - DNA, 21 bp, Homo sapiens
ccttaagcagaacaaatgtgt

SEQ ID NO: 4360171 - DNA, 15 bp, Homo sapiens
ccttaataaatatgt

SEQ ID NO: 4360172 - DNA, 13 bp, Homo sapiens
ccttccatcttgt

SEQ ID NO: 4360173 - DNA, 23 bp, Homo sapiens
ccttccatcttgtggggccagga

SEQ ID NO: 4360174 - DNA, 18 bp, Homo sapiens
ccttcccccatccctacc

SEQ ID NO: 4360175 - DNA, 15 bp, Homo sapiens
ccttctaaaagccat

SEQ ID NO: 4360176 - DNA, 23 bp, Homo sapiens
ccttctaaaagccattattatga

SEQ ID NO: 4360177 - DNA, 18 bp, Homo sapiens
ccttctatacccacccag

SEQ ID NO: 4360178 - DNA, 19 bp, Homo sapiens
ccttctatacccacccaga

SEQ ID NO: 4360179 - DNA, 20 bp, Homo sapiens
ccttgacgtcaagtctcctt

SEQ ID NO: 4360180 - DNA, 23 bp, Homo sapiens
ccttgcatgtacttgaaggatgg

SEQ ID NO: 4360181 - DNA, 18 bp, Homo sapiens
ccttgcctgaactccaga

SEQ ID NO: 4360182 - DNA, 20 bp, Homo sapiens
ccttgcctgaactccagagg

SEQ ID NO: 4360183 - DNA, 12 bp, Homo sapiens
ccttgccttaat

SEQ ID NO: 4360184 - DNA, 16 bp, Homo sapiens
ccttgctgggccaggg

SEQ ID NO: 4360185 - DNA, 12 bp, Homo sapiens
ccttggagagga

SEQ ID NO: 4360186 - DNA, 15 bp, Homo sapiens
ccttggagaggagag

SEQ ID NO: 4360187 - DNA, 20 bp, Homo sapiens
ccttggctgacatgaagctg

SEQ ID NO: 4360188 - DNA, 15 bp, Homo sapiens
cctttcttggccagt

SEQ ID NO: 4360189 - DNA, 15 bp, Homo sapiens
cgaagccccttggag

SEQ ID NO: 4360190 - DNA, 16 bp, Homo sapiens
cgaagccccttggaga

SEQ ID NO: 4360191 - DNA, 17 bp, Homo sapiens
cgaatgacggtaagtgt

SEQ ID NO: 4360192 - DNA, 22 bp, Homo sapiens
cgacggtgggcatttgtgaggc

SEQ ID NO: 4360193 - DNA, 19 bp, Homo sapiens
caggaactgggctgggcct

SEQ ID NO: 4360194 - DNA, 19 bp, Homo sapiens
caggaatggggggcgggcc

SEQ ID NO: 4360195 - DNA, 23 bp, Homo sapiens
caggacattaataaagttgcttt

SEQ ID NO: 4360196 - DNA, 16 bp, Homo sapiens
caggaccacaaaaatg

SEQ ID NO: 4360197 - DNA, 13 bp, Homo sapiens
caggaccatggcc

SEQ ID NO: 4360198 - DNA, 20 bp, Homo sapiens
caggacttggtctgatttca

SEQ ID NO: 4360199 - DNA, 16 bp, Homo sapiens
caggagactccaagga

SEQ ID NO: 4360200 - DNA, 12 bp, Homo sapiens
caggagagggaa

SEQ ID NO: 4360201 - DNA, 19 bp, Homo sapiens
caggagttaaaaagggcag

SEQ ID NO: 4360202 - DNA, 20 bp, Homo sapiens
caggatactctgtcagatgg

SEQ ID NO: 4360203 - DNA, 23 bp, Homo sapiens
caggatggaggggtggtcctgac

SEQ ID NO: 4360204 - DNA, 15 bp, Homo sapiens
caggcacacagggcc

SEQ ID NO: 4360205 - DNA, 14 bp, Homo sapiens
caggcataggcctg

SEQ ID NO: 4360206 - DNA, 17 bp, Homo sapiens
caggcataggcctgggt

SEQ ID NO: 4360207 - DNA, 19 bp, Homo sapiens
caggcataggcctgggtgc

SEQ ID NO: 4360208 - DNA, 15 bp, Homo sapiens
caggcatctgcctct

SEQ ID NO: 4360209 - DNA, 19 bp, Homo sapiens
caggcattggctcagcccg

SEQ ID NO: 4360210 - DNA, 18 bp, Homo sapiens
caggcctctggttgcctc

SEQ ID NO: 4360211 - DNA, 16 bp, Homo sapiens
caggcctgtccaccct

SEQ ID NO: 4360212 - DNA, 18 bp, Homo sapiens
cagggaaacaaagtttac

SEQ ID NO: 4360213 - DNA, 16 bp, Homo sapiens
cagggcagaggaatgt

SEQ ID NO: 4360214 - DNA, 15 bp, Homo sapiens
cagggcagggctctg

SEQ ID NO: 4360215 - DNA, 18 bp, Homo sapiens
cagggccatgcagacctc

SEQ ID NO: 4360216 - DNA, 13 bp, Homo sapiens
cagggtataaatt

SEQ ID NO: 4360217 - DNA, 17 bp, Homo sapiens
cagggtgggaagagaag

SEQ ID NO: 4360218 - DNA, 21 bp, Homo sapiens
caggtaatatacctggtttac

SEQ ID NO: 4360219 - DNA, 22 bp, Homo sapiens
caggtagtattacaccaccggc

SEQ ID NO: 4360220 - DNA, 15 bp, Homo sapiens
caggtggtgaatttt

SEQ ID NO: 4360221 - DNA, 16 bp, Homo sapiens
cagtactttgtgcatt

SEQ ID NO: 4360222 - DNA, 18 bp, Homo sapiens
cagtactttgtgcattct

SEQ ID NO: 4360223 - DNA, 14 bp, Homo sapiens
cagtatatttatag

SEQ ID NO: 4360224 - DNA, 21 bp, Homo sapiens
cagtatcactctaatataata

SEQ ID NO: 4360225 - DNA, 16 bp, Homo sapiens
cagtcatctgtaagag

SEQ ID NO: 4360226 - DNA, 14 bp, Homo sapiens
cagtccaaccagaa

SEQ ID NO: 4360227 - DNA, 12 bp, Homo sapiens
cagtccccgagg

SEQ ID NO: 4360228 - DNA, 13 bp, Homo sapiens
cagtccccgagga

SEQ ID NO: 4360229 - DNA, 22 bp, Homo sapiens
cagtccccgaggagctgggccc

SEQ ID NO: 4360230 - DNA, 12 bp, Homo sapiens
cagtccctggag

SEQ ID NO: 4360231 - DNA, 15 bp, Homo sapiens
cagtctaagtgtaaa

SEQ ID NO: 4360232 - DNA, 17 bp, Homo sapiens
cagtgaacattcccagc

SEQ ID NO: 4360233 - DNA, 21 bp, Homo sapiens
cagtgaacattcccagcccag

SEQ ID NO: 4360234 - DNA, 14 bp, Homo sapiens
cagtgccactgccc

SEQ ID NO: 4360235 - DNA, 17 bp, Homo sapiens
cagtgccactgcccccc

SEQ ID NO: 4360236 - DNA, 14 bp, Homo sapiens
cagtgcctgggaat

SEQ ID NO: 4360237 - DNA, 18 bp, Homo sapiens
cagtgcctgggaatgtat

SEQ ID NO: 4360238 - DNA, 16 bp, Homo sapiens
cagtggatatgaccca

SEQ ID NO: 4360239 - DNA, 17 bp, Homo sapiens
cagtggatatgacccac

SEQ ID NO: 4360240 - DNA, 21 bp, Homo sapiens
cagtggatatgacccacactg

SEQ ID NO: 4360241 - DNA, 22 bp, Homo sapiens
cagtggggtcccccctgagtgg

SEQ ID NO: 4360242 - DNA, 17 bp, Homo sapiens
cagtgtacacgtctgga

SEQ ID NO: 4360243 - DNA, 23 bp, Homo sapiens
cagtgtccacgtttttggaaaat

SEQ ID NO: 4360244 - DNA, 22 bp, Homo sapiens
cagtgtggagttcaccttggaa

SEQ ID NO: 4360245 - DNA, 20 bp, Homo sapiens
cagttaggtgctgaatgaag

SEQ ID NO: 4360246 - DNA, 22 bp, Homo sapiens
cagttaggtgctgaatgaagct

SEQ ID NO: 4360247 - DNA, 23 bp, Homo sapiens
cagtttcactttcacatagatgt

SEQ ID NO: 4360248 - DNA, 21 bp, Homo sapiens
cagtttggccctggagccagg

SEQ ID NO: 4360249 - DNA, 17 bp, Homo sapiens
catactttgacaaggaa

SEQ ID NO: 4360250 - DNA, 19 bp, Homo sapiens
catactttgacaaggaaaa

SEQ ID NO: 4360251 - DNA, 23 bp, Homo sapiens
catactttgacaaggaaaatcta

SEQ ID NO: 4360252 - DNA, 23 bp, Homo sapiens
catagatgtccctttcttggcca

SEQ ID NO: 4360253 - DNA, 19 bp, Homo sapiens
catagcatagccagcattc

SEQ ID NO: 4360254 - DNA, 17 bp, Homo sapiens
cataggcctgggtgctg

SEQ ID NO: 4360255 - DNA, 19 bp, Homo sapiens
cataggcctgggtgctggc

SEQ ID NO: 4360256 - DNA, 19 bp, Homo sapiens
cacacaaacctactgccca

SEQ ID NO: 4360257 - DNA, 20 bp, Homo sapiens
cacacaaacctactgcccac

SEQ ID NO: 4360258 - DNA, 13 bp, Homo sapiens
cacacacatctgg

SEQ ID NO: 4360259 - DNA, 20 bp, Homo sapiens
cacacagagtggtctttctg

SEQ ID NO: 4360260 - DNA, 23 bp, Homo sapiens
cacacgagcaaacccagaggtgg

SEQ ID NO: 4360261 - DNA, 23 bp, Homo sapiens
cacacttgtgtgtgggctgtgag

SEQ ID NO: 4360262 - DNA, 15 bp, Homo sapiens
cacagcacaagggca

SEQ ID NO: 4360263 - DNA, 13 bp, Homo sapiens
cacagctgggcag

SEQ ID NO: 4360264 - DNA, 16 bp, Homo sapiens
cacagctgggcagggt

SEQ ID NO: 4360265 - DNA, 15 bp, Homo sapiens
cacaggacagcggga

SEQ ID NO: 4360266 - DNA, 21 bp, Homo sapiens
cacaggagactccaaggagct

SEQ ID NO: 4360267 - DNA, 18 bp, Homo sapiens
cacaggcacacagggccc

SEQ ID NO: 4360268 - DNA, 15 bp, Homo sapiens
cacagggcccggcca

SEQ ID NO: 4360269 - DNA, 14 bp, Homo sapiens
cacatctggccctg

SEQ ID NO: 4360270 - DNA, 16 bp, Homo sapiens
cacatctggccctgac

SEQ ID NO: 4360271 - DNA, 16 bp, Homo sapiens
cacatggtgtctccca

SEQ ID NO: 4360272 - DNA, 21 bp, Homo sapiens
cacatggtgtctcccaacatg

SEQ ID NO: 4360273 - DNA, 17 bp, Homo sapiens
cacattaatctcaaaga

SEQ ID NO: 4360274 - DNA, 23 bp, Homo sapiens
caccaatttggtaaaaatgctgc

SEQ ID NO: 4360275 - DNA, 23 bp, Homo sapiens
caccacccgctttcttgctggtt

SEQ ID NO: 4360276 - DNA, 15 bp, Homo sapiens
cacccaagcctgctg

SEQ ID NO: 4360277 - DNA, 16 bp, Homo sapiens
cacccaagcctgctgg

SEQ ID NO: 4360278 - DNA, 18 bp, Homo sapiens
cacccaagcctgctggct

SEQ ID NO: 4360279 - DNA, 15 bp, Homo sapiens
cacccaccagggcga

SEQ ID NO: 4360280 - DNA, 20 bp, Homo sapiens
cacccacctgttttctgaaa

SEQ ID NO: 4360281 - DNA, 22 bp, Homo sapiens
cacccctctgtctaggactgca

SEQ ID NO: 4360282 - DNA, 12 bp, Homo sapiens
cacccctgtagg

SEQ ID NO: 4360283 - DNA, 16 bp, Homo sapiens
cacccgactcctcaaa

SEQ ID NO: 4360284 - DNA, 21 bp, Homo sapiens
cacccgccgcctcccacggca

SEQ ID NO: 4360285 - DNA, 14 bp, Homo sapiens
cacctccccaaagc

SEQ ID NO: 4360286 - DNA, 15 bp, Homo sapiens
cacctgttttctgaa

SEQ ID NO: 4360287 - DNA, 16 bp, Homo sapiens
cacctgttttctgaaa

SEQ ID NO: 4360288 - DNA, 20 bp, Homo sapiens
cacctgttttctgaaacaca

SEQ ID NO: 4360289 - DNA, 21 bp, Homo sapiens
cacctgttttctgaaacacac

SEQ ID NO: 4360290 - DNA, 20 bp, Homo sapiens
cacgagcaaacccagaggtg

SEQ ID NO: 4360291 - DNA, 21 bp, Homo sapiens
cacgagcaaacccagaggtgg

SEQ ID NO: 4360292 - DNA, 15 bp, Homo sapiens
cacgtctggaccccg

SEQ ID NO: 4360293 - DNA, 14 bp, Homo sapiens
cactagcctctcca

SEQ ID NO: 4360294 - DNA, 16 bp, Homo sapiens
cactagcctctccagg

SEQ ID NO: 4360295 - DNA, 17 bp, Homo sapiens
cactagcctctccagga

SEQ ID NO: 4360296 - DNA, 21 bp, Homo sapiens
cactagcctctccaggaatgc

SEQ ID NO: 4360297 - DNA, 17 bp, Homo sapiens
cactcaaatgaatttgc

SEQ ID NO: 4360298 - DNA, 13 bp, Homo sapiens
cactccaccatcc

SEQ ID NO: 4360299 - DNA, 10 bp, Homo sapiens
cactcctggg

SEQ ID NO: 4360300 - DNA, 12 bp, Homo sapiens
cactcctggggc

SEQ ID NO: 4360301 - DNA, 19 bp, Homo sapiens
cactctagtgataaatcgg

SEQ ID NO: 4360302 - DNA, 13 bp, Homo sapiens
cactgaatattta

SEQ ID NO: 4360303 - DNA, 14 bp, Homo sapiens
cactgaatatttat

SEQ ID NO: 4360304 - DNA, 15 bp, Homo sapiens
cactgcagccctctc

SEQ ID NO: 4360305 - DNA, 14 bp, Homo sapiens
cactgccagaagag

SEQ ID NO: 4360306 - DNA, 14 bp, Homo sapiens
cactgccccccgag

SEQ ID NO: 4360307 - DNA, 14 bp, Homo sapiens
cactgtggccccaa

SEQ ID NO: 4360308 - DNA, 13 bp, Homo sapiens
cacttgccacatg

SEQ ID NO: 4360309 - DNA, 14 bp, Homo sapiens
cacttgtgtgtggg

SEQ ID NO: 4360310 - DNA, 15 bp, Homo sapiens
cacttgtgtgtgggc

SEQ ID NO: 4360311 - DNA, 22 bp, Homo sapiens
cacttgtgtgtgggctgtgagt

SEQ ID NO: 4360312 - DNA, 21 bp, Homo sapiens
cactttgaaaagttggaagga

SEQ ID NO: 4360313 - DNA, 16 bp, Homo sapiens
cagaaacacccctctg

SEQ ID NO: 4360314 - DNA, 18 bp, Homo sapiens
cagaaacacccctctgtc

SEQ ID NO: 4360315 - DNA, 21 bp, Homo sapiens
cagaaagcactacaatcatgg

SEQ ID NO: 4360316 - DNA, 22 bp, Homo sapiens
cagaaagcatccctcacccatc

SEQ ID NO: 4360317 - DNA, 13 bp, Homo sapiens
cagaacaggtagt

SEQ ID NO: 4360318 - DNA, 15 bp, Homo sapiens
cagaacatactgatt

SEQ ID NO: 4360319 - DNA, 17 bp, Homo sapiens
cagaacctgcacacagg

SEQ ID NO: 4360320 - DNA, 18 bp, Homo sapiens
cagaagagaattcagtat

SEQ ID NO: 4360321 - DNA, 20 bp, Homo sapiens
cagaagctttttgtttgcat

SEQ ID NO: 4360322 - DNA, 23 bp, Homo sapiens
cagaagctttttgtttgcatcat

SEQ ID NO: 4360323 - DNA, 22 bp, Homo sapiens
cagaattcccttgaattgtgta

SEQ ID NO: 4360324 - DNA, 13 bp, Homo sapiens
atgtatgttcttg

SEQ ID NO: 4360325 - DNA, 12 bp, Homo sapiens
atgtcccaccca

SEQ ID NO: 4360326 - DNA, 20 bp, Homo sapiens
atgtctcatgatgtaaaaaa

SEQ ID NO: 4360327 - DNA, 14 bp, Homo sapiens
atgtgatttttctg

SEQ ID NO: 4360328 - DNA, 18 bp, Homo sapiens
atgtgtcatttataactt

SEQ ID NO: 4360329 - DNA, 15 bp, Homo sapiens
atgtgtgtgtatgtt

SEQ ID NO: 4360330 - DNA, 21 bp, Homo sapiens
atgtgtgtgtatgtttgcaca

SEQ ID NO: 4360331 - DNA, 20 bp, Homo sapiens
atgtgtttttctatatagtt

SEQ ID NO: 4360332 - DNA, 13 bp, Homo sapiens
atgttactgacca

SEQ ID NO: 4360333 - DNA, 16 bp, Homo sapiens
atgttagaagaagagg

SEQ ID NO: 4360334 - DNA, 13 bp, Homo sapiens
atgttatgaacag

SEQ ID NO: 4360335 - DNA, 14 bp, Homo sapiens
atgttatgaacagc

SEQ ID NO: 4360336 - DNA, 15 bp, Homo sapiens
atgttgatttagtct

SEQ ID NO: 4360337 - DNA, 15 bp, Homo sapiens
atgtttaaatagcct

SEQ ID NO: 4360338 - DNA, 13 bp, Homo sapiens
attaagcacacac

SEQ ID NO: 4360339 - DNA, 17 bp, Homo sapiens
attaagcacacacatct

SEQ ID NO: 4360340 - DNA, 18 bp, Homo sapiens
attaagttttaaataaac

SEQ ID NO: 4360341 - DNA, 13 bp, Homo sapiens
attaatctcaaag

SEQ ID NO: 4360342 - DNA, 13 bp, Homo sapiens
attactaatgtac

SEQ ID NO: 4360343 - DNA, 16 bp, Homo sapiens
attactgttttgggcc

SEQ ID NO: 4360344 - DNA, 22 bp, Homo sapiens
attagaaatagacagtatattt

SEQ ID NO: 4360345 - DNA, 16 bp, Homo sapiens
attagatttaaaataa

SEQ ID NO: 4360346 - DNA, 19 bp, Homo sapiens
attagatttaaaataaaca

SEQ ID NO: 4360347 - DNA, 20 bp, Homo sapiens
attatcacattaatctcaaa

SEQ ID NO: 4360348 - DNA, 16 bp, Homo sapiens
attatgcattatatca

SEQ ID NO: 4360349 - DNA, 14 bp, Homo sapiens
attattttaataat

SEQ ID NO: 4360350 - DNA, 18 bp, Homo sapiens
attcagatatatttttca

SEQ ID NO: 4360351 - DNA, 21 bp, Homo sapiens
attcagatatatttttcacag

SEQ ID NO: 4360352 - DNA, 14 bp, Homo sapiens
attccaattctaaa

SEQ ID NO: 4360353 - DNA, 17 bp, Homo sapiens
attccagcagtgaatgc

SEQ ID NO: 4360354 - DNA, 16 bp, Homo sapiens
attccatgaatgtatc

SEQ ID NO: 4360355 - DNA, 23 bp, Homo sapiens
attccatgaatgtatcaggaaat

SEQ ID NO: 4360356 - DNA, 17 bp, Homo sapiens
attcccttgaattgtgt

SEQ ID NO: 4360357 - DNA, 14 bp, Homo sapiens
attccgttaggaat

SEQ ID NO: 4360358 - DNA, 22 bp, Homo sapiens
attccgttaggaataacactgc

SEQ ID NO: 4360359 - DNA, 20 bp, Homo sapiens
attctctttaccttctaaaa

SEQ ID NO: 4360360 - DNA, 15 bp, Homo sapiens
attctgcagcatgac

SEQ ID NO: 4360361 - DNA, 18 bp, Homo sapiens
attctgggagaatgaaag

SEQ ID NO: 4360362 - DNA, 20 bp, Homo sapiens
attcttcaagaaagaattcc

SEQ ID NO: 4360363 - DNA, 20 bp, Homo sapiens
attgacagcatatagaatat

SEQ ID NO: 4360364 - DNA, 16 bp, Homo sapiens
attgagaactgacaaa

SEQ ID NO: 4360365 - DNA, 12 bp, Homo sapiens
attgagccttgc

SEQ ID NO: 4360366 - DNA, 16 bp, Homo sapiens
attgagccttgcatgt

SEQ ID NO: 4360367 - DNA, 22 bp, Homo sapiens
attgagccttgcatgtacttga

SEQ ID NO: 4360368 - DNA, 14 bp, Homo sapiens
attgctcataatga

SEQ ID NO: 4360369 - DNA, 15 bp, Homo sapiens
attgctcataatgac

SEQ ID NO: 4360370 - DNA, 23 bp, Homo sapiens
attggaactctactcaacccatt

SEQ ID NO: 4360371 - DNA, 20 bp, Homo sapiens
attggaatgtgttgtaagtt

SEQ ID NO: 4360372 - DNA, 13 bp, Homo sapiens
attgtcctgtagc

SEQ ID NO: 4360373 - DNA, 17 bp, Homo sapiens
atttaaaataaacattt

SEQ ID NO: 4360374 - DNA, 14 bp, Homo sapiens
atttaagcaaacgt

SEQ ID NO: 4360375 - DNA, 15 bp, Homo sapiens
atttaagcaaacgtc

SEQ ID NO: 4360376 - DNA, 18 bp, Homo sapiens
atttacatcagaagtttg

SEQ ID NO: 4360377 - DNA, 16 bp, Homo sapiens
atttactcctcctgct

SEQ ID NO: 4360378 - DNA, 21 bp, Homo sapiens
atttagtgatcaaattgtgca

SEQ ID NO: 4360379 - DNA, 13 bp, Homo sapiens
atttatatttttg

SEQ ID NO: 4360380 - DNA, 19 bp, Homo sapiens
atttccccgatgtcccctg

SEQ ID NO: 4360381 - DNA, 15 bp, Homo sapiens
atttgcctgtgccac

SEQ ID NO: 4360382 - DNA, 19 bp, Homo sapiens
atttgctagttctgctgcc

SEQ ID NO: 4360383 - DNA, 17 bp, Homo sapiens
atttgggctcagggttg

SEQ ID NO: 4360384 - DNA, 20 bp, Homo sapiens
atttggtaaaaatgctgctc

SEQ ID NO: 4360385 - DNA, 14 bp, Homo sapiens
atttggtctcaggc

SEQ ID NO: 4360386 - DNA, 14 bp, Homo sapiens
atttgtacaatggt

SEQ ID NO: 4360387 - DNA, 19 bp, Homo sapiens
atttgtctggactagaaaa

SEQ ID NO: 4360388 - DNA, 21 bp, Homo sapiens
atttgtgcacatgtacatatg

SEQ ID NO: 4360389 - DNA, 16 bp, Homo sapiens
attttccaagaacata

SEQ ID NO: 4360390 - DNA, 12 bp, Homo sapiens
attttgcatact

SEQ ID NO: 4360391 - DNA, 20 bp, Homo sapiens
attttgtccaccttttaagt

SEQ ID NO: 4360392 - DNA, 23 bp, Homo sapiens
attttgtccaccttttaagttaa

SEQ ID NO: 4360393 - DNA, 14 bp, Homo sapiens
atttttatgcagac

SEQ ID NO: 4360394 - DNA, 16 bp, Homo sapiens
atttttttgtctttca

SEQ ID NO: 4360395 - DNA, 21 bp, Homo sapiens
caaaaatcaaagaacagatgg

SEQ ID NO: 4360396 - DNA, 16 bp, Homo sapiens
agggaaggagcccagc

SEQ ID NO: 4360397 - DNA, 12 bp, Homo sapiens
agggagggagtt

SEQ ID NO: 4360398 - DNA, 20 bp, Homo sapiens
agggagttttgtctgtctcc

SEQ ID NO: 4360399 - DNA, 21 bp, Homo sapiens
agggagttttgtctgtctccc

SEQ ID NO: 4360400 - DNA, 22 bp, Homo sapiens
agggatcagccccgcctgtcac

SEQ ID NO: 4360401 - DNA, 23 bp, Homo sapiens
agggatcagccccgcctgtcaca

SEQ ID NO: 4360402 - DNA, 19 bp, Homo sapiens
agggatggagatgggaagg

SEQ ID NO: 4360403 - DNA, 18 bp, Homo sapiens
agggattgaggagttgcc

SEQ ID NO: 4360404 - DNA, 22 bp, Homo sapiens
agggattgaggagttgcctgac

SEQ ID NO: 4360405 - DNA, 13 bp, Homo sapiens
agggcagaggaat

SEQ ID NO: 4360406 - DNA, 15 bp, Homo sapiens
agggcagaggaatgt

SEQ ID NO: 4360407 - DNA, 17 bp, Homo sapiens
agggcaggcttggggaa

SEQ ID NO: 4360408 - DNA, 15 bp, Homo sapiens
agggcagggctctga

SEQ ID NO: 4360409 - DNA, 13 bp, Homo sapiens
agggcatctcctg

SEQ ID NO: 4360410 - DNA, 16 bp, Homo sapiens
agggccatgcagacct

SEQ ID NO: 4360411 - DNA, 20 bp, Homo sapiens
agggcccggccacacccagc

SEQ ID NO: 4360412 - DNA, 16 bp, Homo sapiens
agggcctgcatggaga

SEQ ID NO: 4360413 - DNA, 23 bp, Homo sapiens
agggcgttctaggtaggaagagc

SEQ ID NO: 4360414 - DNA, 13 bp, Homo sapiens
agggggtgactgg

SEQ ID NO: 4360415 - DNA, 13 bp, Homo sapiens
aggggtggtcctg

SEQ ID NO: 4360416 - DNA, 15 bp, Homo sapiens
aggggtggtcctgac

SEQ ID NO: 4360417 - DNA, 14 bp, Homo sapiens
agggtcctgccggt

SEQ ID NO: 4360418 - DNA, 23 bp, Homo sapiens
agggtcctgccggtgggaccctg

SEQ ID NO: 4360419 - DNA, 20 bp, Homo sapiens
agggttctgccctgcctgag
